United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 31

SEQ ID NO: 1288993 - DNA, 20 bp, Homo sapiens
caggaaagagaacttccaga

SEQ ID NO: 1288994 - DNA, 21 bp, Homo sapiens
caggatggttcccttgatgaa

SEQ ID NO: 1288995 - DNA, 23 bp, Homo sapiens
caggatggttcccttgatgaaga

SEQ ID NO: 1288996 - DNA, 15 bp, Homo sapiens
cagtcacctcatgga

SEQ ID NO: 1288997 - DNA, 19 bp, Homo sapiens
cagtcacctcatggaattg

SEQ ID NO: 1288998 - DNA, 14 bp, Homo sapiens
cagttctgaagaag

SEQ ID NO: 1288999 - DNA, 15 bp, Homo sapiens
cagttctgaagaaga

SEQ ID NO: 1289000 - DNA, 22 bp, Homo sapiens
catctagtgagcagtcaggaaa

SEQ ID NO: 1289001 - DNA, 20 bp, Homo sapiens
catggaattggagctcgtgg

SEQ ID NO: 1289002 - DNA, 22 bp, Homo sapiens
cattccaactatctcatttcca

SEQ ID NO: 1289003 - DNA, 12 bp, Homo sapiens
catttccaagca

SEQ ID NO: 1289004 - DNA, 13 bp, Homo sapiens
catttgctcatgg

SEQ ID NO: 1289005 - DNA, 18 bp, Homo sapiens
catttgctcatggaattg

SEQ ID NO: 1289006 - DNA, 16 bp, Homo sapiens
ccatgatgtttagaaa

SEQ ID NO: 1289007 - DNA, 15 bp, Homo sapiens
cccttgatgaagaag

SEQ ID NO: 1289008 - DNA, 14 bp, Homo sapiens
ctaagagagaatga

SEQ ID NO: 1289009 - DNA, 15 bp, Homo sapiens
ctaagagagaatgag

SEQ ID NO: 1289010 - DNA, 15 bp, Homo sapiens
ctaggaaatatttat

SEQ ID NO: 1289011 - DNA, 22 bp, Homo sapiens
ctaggaaatatttattttaata

SEQ ID NO: 1289012 - DNA, 20 bp, Homo sapiens
ctagtgaaactcgttaattt

SEQ ID NO: 1289013 - DNA, 13 bp, Homo sapiens
ctatgaaatatta

SEQ ID NO: 1289014 - DNA, 17 bp, Homo sapiens
ctcatttccaagcaagt

SEQ ID NO: 1289015 - DNA, 15 bp, Homo sapiens
ctctaggaaatattt

SEQ ID NO: 1289016 - DNA, 20 bp, Homo sapiens
ctcttagatgcagttctgaa

SEQ ID NO: 1289017 - DNA, 23 bp, Homo sapiens
ctggaaaagtatgttagtgcaaa

SEQ ID NO: 1289018 - DNA, 21 bp, Homo sapiens
ctggaaatcagggttagtatt

SEQ ID NO: 1289019 - DNA, 13 bp, Homo sapiens
ctgtattttaaaa

SEQ ID NO: 1289020 - DNA, 19 bp, Homo sapiens
ctgtattttaaaagaatga

SEQ ID NO: 1289021 - DNA, 13 bp, Homo sapiens
ctgttataatctt

SEQ ID NO: 1289022 - DNA, 15 bp, Homo sapiens
ctgttttataatttt

SEQ ID NO: 1289023 - DNA, 19 bp, Homo sapiens
ctgttttataattttgtga

SEQ ID NO: 1289024 - DNA, 19 bp, Homo sapiens
cttagatgcagttctgaag

SEQ ID NO: 1289025 - DNA, 16 bp, Homo sapiens
cttcagcggtttatat

SEQ ID NO: 1289026 - DNA, 18 bp, Homo sapiens
cttcagcggtttatataa

SEQ ID NO: 1289027 - DNA, 23 bp, Homo sapiens
cttcatgctgtctacactaagag

SEQ ID NO: 1289028 - DNA, 20 bp, Homo sapiens
cttctgttttataattttgt

SEQ ID NO: 1289029 - DNA, 12 bp, Homo sapiens
cttgatgaagaa

SEQ ID NO: 1289030 - DNA, 13 bp, Homo sapiens
ctttccacagaag

SEQ ID NO: 1289031 - DNA, 14 bp, Homo sapiens
gaaaagtatgttag

SEQ ID NO: 1289032 - DNA, 20 bp, Homo sapiens
gaaaagtatgttagtgcaaa

SEQ ID NO: 1289033 - DNA, 23 bp, Homo sapiens
gaaacttcagcggtttatataag

SEQ ID NO: 1289034 - DNA, 17 bp, Homo sapiens
gaaagagaacttccaga

SEQ ID NO: 1289035 - DNA, 17 bp, Homo sapiens
gaaatatttattttaat

SEQ ID NO: 1289036 - DNA, 22 bp, Homo sapiens
gaaatatttattttaataatgt

SEQ ID NO: 1289037 - DNA, 14 bp, Homo sapiens
gaaccacaagactg

SEQ ID NO: 1289038 - DNA, 15 bp, Homo sapiens
gaaccacaagactgc

SEQ ID NO: 1289039 - DNA, 13 bp, Homo sapiens
gaactgaaatcat

SEQ ID NO: 1289040 - DNA, 17 bp, Homo sapiens
gaagactgcattatatt

SEQ ID NO: 1289041 - DNA, 12 bp, Homo sapiens
gaagtccaagca

SEQ ID NO: 1289042 - DNA, 20 bp, Homo sapiens
gaatgagagacacactgaag

SEQ ID NO: 1289043 - DNA, 14 bp, Homo sapiens
gaatgattatgaat

SEQ ID NO: 1289044 - DNA, 13 bp, Homo sapiens
gaattacatttgt

SEQ ID NO: 1289045 - DNA, 20 bp, Homo sapiens
gaattacatttgtataaaat

SEQ ID NO: 1289046 - DNA, 11 bp, Homo sapiens
gaattagtttt

SEQ ID NO: 1289047 - DNA, 15 bp, Homo sapiens
gacaagctcacagac

SEQ ID NO: 1289048 - DNA, 12 bp, Homo sapiens
gacacacatgaa

SEQ ID NO: 1289049 - DNA, 15 bp, Homo sapiens
gacacactgaagaag

SEQ ID NO: 1289050 - DNA, 23 bp, Homo sapiens
gacaggatggttcccttgatgaa

SEQ ID NO: 1289051 - DNA, 17 bp, Homo sapiens
gacatgggacatttgct

SEQ ID NO: 1289052 - DNA, 16 bp, Homo sapiens
gactcttaagaagact

SEQ ID NO: 1289053 - DNA, 17 bp, Homo sapiens
gactcttaagaagactg

SEQ ID NO: 1289054 - DNA, 13 bp, Homo sapiens
gagaagaactgaa

SEQ ID NO: 1289055 - DNA, 21 bp, Homo sapiens
gagaatgagagacacactgaa

SEQ ID NO: 1289056 - DNA, 16 bp, Homo sapiens
gagtttagctggaaaa

SEQ ID NO: 1289057 - DNA, 22 bp, Homo sapiens
gcaatagtcaaattgtgtgaaa

SEQ ID NO: 1289058 - DNA, 18 bp, Homo sapiens
gcacagcctcttagatgc

SEQ ID NO: 1289059 - DNA, 20 bp, Homo sapiens
gcacagcctcttagatgcag

SEQ ID NO: 1289060 - DNA, 13 bp, Homo sapiens
gcattatatttat

SEQ ID NO: 1289061 - DNA, 16 bp, Homo sapiens
gcccacagctgtatga

SEQ ID NO: 1289062 - DNA, 19 bp, Homo sapiens
gcccttctttccacagaag

SEQ ID NO: 1289063 - DNA, 15 bp, Homo sapiens
gcctcttagatgcag

SEQ ID NO: 1289064 - DNA, 18 bp, Homo sapiens
gccttggggctgatgcag

SEQ ID NO: 1289065 - DNA, 14 bp, Homo sapiens
gctagatgtatgta

SEQ ID NO: 1289066 - DNA, 18 bp, Homo sapiens
gctagatgtatgtacttc

SEQ ID NO: 1289067 - DNA, 21 bp, Homo sapiens
gctagtaattggaaaggcagc

SEQ ID NO: 1289068 - DNA, 12 bp, Homo sapiens
gctgtattttaa

SEQ ID NO: 1289069 - DNA, 13 bp, Homo sapiens
gctgtattttaaa

SEQ ID NO: 1289070 - DNA, 20 bp, Homo sapiens
gctgtattttaaaagaatga

SEQ ID NO: 1289071 - DNA, 21 bp, Homo sapiens
gctgtattttaaaagaatgat

SEQ ID NO: 1289072 - DNA, 22 bp, Homo sapiens
gctgtattttaaaagaatgatt

SEQ ID NO: 1289073 - DNA, 20 bp, Homo sapiens
gctgtctacactaagagaga

SEQ ID NO: 1289074 - DNA, 19 bp, Homo sapiens
gcttctgttttataatttt

SEQ ID NO: 1289075 - DNA, 12 bp, Homo sapiens
ggaaatatttat

SEQ ID NO: 1289076 - DNA, 18 bp, Homo sapiens
ggacagtcacctcatgga

SEQ ID NO: 1289077 - DNA, 17 bp, Homo sapiens
ggacatttgctcatgga

SEQ ID NO: 1289078 - DNA, 20 bp, Homo sapiens
ggacatttgctcatggaatt

SEQ ID NO: 1289079 - DNA, 18 bp, Homo sapiens
ttctcaactccaaactga

SEQ ID NO: 1289080 - DNA, 13 bp, Homo sapiens
ttctgaagaagat

SEQ ID NO: 1289081 - DNA, 19 bp, Homo sapiens
ttgaaatattgacttttta

SEQ ID NO: 1289082 - DNA, 12 bp, Homo sapiens
ttgactttttat

SEQ ID NO: 1289083 - DNA, 14 bp, Homo sapiens
ttgaggacactgat

SEQ ID NO: 1289084 - DNA, 19 bp, Homo sapiens
ttgatggtggtatgttttc

SEQ ID NO: 1289085 - DNA, 18 bp, Homo sapiens
ttgctaagcattccaact

SEQ ID NO: 1289086 - DNA, 22 bp, Homo sapiens
ttggagaagaactgaaatcata

SEQ ID NO: 1289087 - DNA, 23 bp, Homo sapiens
ttgtagtgttggagaagaactga

SEQ ID NO: 1289088 - DNA, 15 bp, Homo sapiens
ttgtataaaataatt

SEQ ID NO: 1289089 - DNA, 19 bp, Homo sapiens
ttgtataaaataattttta

SEQ ID NO: 1289090 - DNA, 15 bp, Homo sapiens
ttgtctagtgaaact

SEQ ID NO: 1289091 - DNA, 20 bp, Homo sapiens
tttaaaaaagaaacatttgg

SEQ ID NO: 1289092 - DNA, 14 bp, Homo sapiens
tttaaaagaatgat

SEQ ID NO: 1289093 - DNA, 11 bp, Homo sapiens
aaaataatttt

SEQ ID NO: 1289094 - DNA, 17 bp, Homo sapiens
aaaataatttttatatt

SEQ ID NO: 1289095 - DNA, 21 bp, Homo sapiens
aaaataatttttatatttgaa

SEQ ID NO: 1289096 - DNA, 23 bp, Homo sapiens
aaaataatttttatatttgaaat

SEQ ID NO: 1289097 - DNA, 19 bp, Homo sapiens
aaaattttttctctaggaa

SEQ ID NO: 1289098 - DNA, 19 bp, Homo sapiens
aaacccttgccatgtgcta

SEQ ID NO: 1289099 - DNA, 17 bp, Homo sapiens
aaactgactcttaagaa

SEQ ID NO: 1289100 - DNA, 20 bp, Homo sapiens
aaagggctgttataatcttt

SEQ ID NO: 1289101 - DNA, 17 bp, Homo sapiens
aaagtatgttagtgcaa

SEQ ID NO: 1289102 - DNA, 18 bp, Homo sapiens
aaagtatgttagtgcaaa

SEQ ID NO: 1289103 - DNA, 22 bp, Homo sapiens
aaataatttttatatttgaaat

SEQ ID NO: 1289104 - DNA, 13 bp, Homo sapiens
aaatatttatttt

SEQ ID NO: 1289105 - DNA, 15 bp, Homo sapiens
aaatatttattttaa

SEQ ID NO: 1289106 - DNA, 19 bp, Homo sapiens
aaatggcttcctggcaata

SEQ ID NO: 1289107 - DNA, 15 bp, Homo sapiens
aacaaggatgaatta

SEQ ID NO: 1289108 - DNA, 17 bp, Homo sapiens
aacaatgctgtatttta

SEQ ID NO: 1289109 - DNA, 22 bp, Homo sapiens
aacaatgctgtattttaaaaga

SEQ ID NO: 1289110 - DNA, 16 bp, Homo sapiens
aacatatataacaatg

SEQ ID NO: 1289111 - DNA, 18 bp, Homo sapiens
aacatttggtaaggggaa

SEQ ID NO: 1289112 - DNA, 12 bp, Homo sapiens
aactgaaatcat

SEQ ID NO: 1289113 - DNA, 13 bp, Homo sapiens
aagccagattttc

SEQ ID NO: 1289114 - DNA, 19 bp, Homo sapiens
aagccagattttcctgaaa

SEQ ID NO: 1289115 - DNA, 23 bp, Homo sapiens
aagcttgtattcctttttctctc

SEQ ID NO: 1289116 - DNA, 17 bp, Homo sapiens
aagggctgttataatct

SEQ ID NO: 1289117 - DNA, 13 bp, Homo sapiens
aaggtacttcaaa

SEQ ID NO: 1289118 - DNA, 14 bp, Homo sapiens
aataatgtttcaaa

SEQ ID NO: 1289119 - DNA, 23 bp, Homo sapiens
aatacatcccttacctgggaaag

SEQ ID NO: 1289120 - DNA, 23 bp, Homo sapiens
aataccacaggaaccacaagact

SEQ ID NO: 1289121 - DNA, 19 bp, Homo sapiens
aatagtcaaattgtgtgaa

SEQ ID NO: 1289122 - DNA, 24 bp, Homo sapiens
aatatgccccattcaacatctagt

SEQ ID NO: 1289123 - DNA, 15 bp, Homo sapiens
aatatttattttaat

SEQ ID NO: 1289124 - DNA, 13 bp, Homo sapiens
aatcacaatacat

SEQ ID NO: 1289125 - DNA, 16 bp, Homo sapiens
aatcagcctagttgat

SEQ ID NO: 1289126 - DNA, 21 bp, Homo sapiens
aatcagggttagtattgtcca

SEQ ID NO: 1289127 - DNA, 22 bp, Homo sapiens
aatcagggttagtattgtccag

SEQ ID NO: 1289128 - DNA, 17 bp, Homo sapiens
aatcatgaattagtttt

SEQ ID NO: 1289129 - DNA, 23 bp, Homo sapiens
aatcatgaattagttttatatgc

SEQ ID NO: 1289130 - DNA, 14 bp, Homo sapiens
aatccatacatttg

SEQ ID NO: 1289131 - DNA, 17 bp, Homo sapiens
aatccatacatttgtgt

SEQ ID NO: 1289132 - DNA, 23 bp, Homo sapiens
aatgattatgaattacatttgta

SEQ ID NO: 1289133 - DNA, 16 bp, Homo sapiens
aatgctgtattttaaa

SEQ ID NO: 1289134 - DNA, 23 bp, Homo sapiens
aatgtttcaaacatatataacaa

SEQ ID NO: 1289135 - DNA, 14 bp, Homo sapiens
aattacatttgtat

SEQ ID NO: 1289136 - DNA, 17 bp, Homo sapiens
aattagttttatatgct

SEQ ID NO: 1289137 - DNA, 23 bp, Homo sapiens
aattgtgtgaaaggtacttcaaa

SEQ ID NO: 1289138 - DNA, 13 bp, Homo sapiens
aattttgtgaagc

SEQ ID NO: 1289139 - DNA, 18 bp, Homo sapiens
aattttgtgaagcaaaat

SEQ ID NO: 1289140 - DNA, 22 bp, Homo sapiens
aattttttctctaggaaatatt

SEQ ID NO: 1289141 - DNA, 14 bp, Homo sapiens
acaagactgcacat

SEQ ID NO: 1289142 - DNA, 22 bp, Homo sapiens
acaagctcacagacctttgaac

SEQ ID NO: 1289143 - DNA, 17 bp, Homo sapiens
acacaactatattgttt

SEQ ID NO: 1289144 - DNA, 13 bp, Homo sapiens
acacactgaagaa

SEQ ID NO: 1289145 - DNA, 14 bp, Homo sapiens
acacactgaagaag

SEQ ID NO: 1289146 - DNA, 19 bp, Homo sapiens
acactaagagagaatgaga

SEQ ID NO: 1289147 - DNA, 12 bp, Homo sapiens
acactgaagaag

SEQ ID NO: 1289148 - DNA, 19 bp, Homo sapiens
acagcccttctttccacag

SEQ ID NO: 1289149 - DNA, 16 bp, Homo sapiens
acagcctcttagatgc

SEQ ID NO: 1289150 - DNA, 14 bp, Homo sapiens
acagctgtatgatt

SEQ ID NO: 1289151 - DNA, 22 bp, Homo sapiens
acaggaaccacaagactgcaca

SEQ ID NO: 1289152 - DNA, 16 bp, Homo sapiens
acagtcacctcatgga

SEQ ID NO: 1289153 - DNA, 16 bp, Homo sapiens
accacaagactgcaca

SEQ ID NO: 1289154 - DNA, 14 bp, Homo sapiens
accagtctgactgt

SEQ ID NO: 1289155 - DNA, 20 bp, Homo sapiens
accttttggtctggagggaa

SEQ ID NO: 1289156 - DNA, 22 bp, Homo sapiens
actatattgtttgctaagcatt

SEQ ID NO: 1289157 - DNA, 16 bp, Homo sapiens
actatctcatttccaa

SEQ ID NO: 1289158 - DNA, 14 bp, Homo sapiens
actccagaaagtga

SEQ ID NO: 1289159 - DNA, 19 bp, Homo sapiens
actcgttaatttgtagtgt

SEQ ID NO: 1289160 - DNA, 22 bp, Homo sapiens
actgaagaagcaccaatcatga

SEQ ID NO: 1289161 - DNA, 17 bp, Homo sapiens
actgactcttaagaaga

SEQ ID NO: 1289162 - DNA, 15 bp, Homo sapiens
actgcattatattta

SEQ ID NO: 1289163 - DNA, 18 bp, Homo sapiens
actgggacaggggagaac

SEQ ID NO: 1289164 - DNA, 15 bp, Homo sapiens
acttgtcaataaaat

SEQ ID NO: 1289165 - DNA, 16 bp, Homo sapiens
agaaaacaaggatgaa

SEQ ID NO: 1289166 - DNA, 21 bp, Homo sapiens
agaagaactgaaatcatactt

SEQ ID NO: 1289167 - DNA, 19 bp, Homo sapiens
agaagcaccaatcatgaat

SEQ ID NO: 1289168 - DNA, 17 bp, Homo sapiens
agaatgagagacacact

SEQ ID NO: 1289169 - DNA, 12 bp, Homo sapiens
agacacacatga

SEQ ID NO: 1289170 - DNA, 15 bp, Homo sapiens
agacacacatgaagt

SEQ ID NO: 1289171 - DNA, 20 bp, Homo sapiens
agagacacactgaagaagca

SEQ ID NO: 1289172 - DNA, 13 bp, Homo sapiens
agatcctggaaat

SEQ ID NO: 1289173 - DNA, 14 bp, Homo sapiens
agatcctggaaatc

SEQ ID NO: 1289174 - DNA, 16 bp, Homo sapiens
agatgcagttctgaag

SEQ ID NO: 1289175 - DNA, 17 bp, Homo sapiens
agatgcagttctgaaga

SEQ ID NO: 1289176 - DNA, 19 bp, Homo sapiens
agatgcagttctgaagaag

SEQ ID NO: 1289177 - DNA, 23 bp, Homo sapiens
agcaaaattttttctctaggaaa

SEQ ID NO: 1289178 - DNA, 18 bp, Homo sapiens
agcagtcaggaaagagaa

SEQ ID NO: 1289179 - DNA, 22 bp, Homo sapiens
agcatttagatgtataggttga

SEQ ID NO: 1289180 - DNA, 19 bp, Homo sapiens
agccagattttcctgaaaa

SEQ ID NO: 1289181 - DNA, 18 bp, Homo sapiens
agcccttctttccacaga

SEQ ID NO: 1289182 - DNA, 19 bp, Homo sapiens
agcccttctttccacagaa

SEQ ID NO: 1289183 - DNA, 13 bp, Homo sapiens
agctggaaaagta

SEQ ID NO: 1289184 - DNA, 13 bp, Homo sapiens
aggaaagagaact

SEQ ID NO: 1289185 - DNA, 14 bp, Homo sapiens
aggacactgatatg

SEQ ID NO: 1289186 - DNA, 13 bp, Homo sapiens
agtaatgataact

SEQ ID NO: 1289187 - DNA, 20 bp, Homo sapiens
agtaatgataactggaaact

SEQ ID NO: 1289188 - DNA, 13 bp, Homo sapiens
agtaattggaaag

SEQ ID NO: 1289189 - DNA, 13 bp, Homo sapiens
agtatttctatga

SEQ ID NO: 1289190 - DNA, 14 bp, Homo sapiens
agtcacctcatgga

SEQ ID NO: 1289191 - DNA, 15 bp, Homo sapiens
agtcaggaaagagaa

SEQ ID NO: 1289192 - DNA, 16 bp, Homo sapiens
agtccaagcatttaga

SEQ ID NO: 1289193 - DNA, 21 bp, Homo sapiens
agtccaagcatttagatgtat

SEQ ID NO: 1289194 - DNA, 14 bp, Homo sapiens
agtgttggagaaga

SEQ ID NO: 1289195 - DNA, 16 bp, Homo sapiens
agtgttggagaagaac

SEQ ID NO: 1289196 - DNA, 17 bp, Homo sapiens
agtgttggagaagaact

SEQ ID NO: 1289197 - DNA, 13 bp, Homo sapiens
agttctgaagaag

SEQ ID NO: 1289198 - DNA, 14 bp, Homo sapiens
agttctgaagaaga

SEQ ID NO: 1289199 - DNA, 16 bp, Homo sapiens
ataaaataatttttat

SEQ ID NO: 1289200 - DNA, 19 bp, Homo sapiens
ataaaatccatacatttgt

SEQ ID NO: 1289201 - DNA, 21 bp, Homo sapiens
ataatctttcacaggggacag

SEQ ID NO: 1289202 - DNA, 18 bp, Homo sapiens
ataatgtttcaaacatat

SEQ ID NO: 1289203 - DNA, 13 bp, Homo sapiens
ataattttgtgaa

SEQ ID NO: 1289204 - DNA, 14 bp, Homo sapiens
ataattttgtgaag

SEQ ID NO: 1289205 - DNA, 20 bp, Homo sapiens
ataattttgtgaagcaaaat

SEQ ID NO: 1289206 - DNA, 14 bp, Homo sapiens
ataatttttatatt

SEQ ID NO: 1289207 - DNA, 22 bp, Homo sapiens
ccaaactgactcttaagaagac

SEQ ID NO: 1289208 - DNA, 17 bp, Homo sapiens
ccaagcatttagatgta

SEQ ID NO: 1289209 - DNA, 16 bp, Homo sapiens
ccacagaagctccagg

SEQ ID NO: 1289210 - DNA, 13 bp, Homo sapiens
ccatacatttgtg

SEQ ID NO: 1289211 - DNA, 14 bp, Homo sapiens
ccatacatttgtgt

SEQ ID NO: 1289212 - DNA, 23 bp, Homo sapiens
cctcatggaattggagctcgtgg

SEQ ID NO: 1289213 - DNA, 14 bp, Homo sapiens
ccttgatgaagaag

SEQ ID NO: 1289214 - DNA, 19 bp, Homo sapiens
ccttggggctgatgcagtt

SEQ ID NO: 1289215 - DNA, 19 bp, Homo sapiens
ctagagtttagctggaaaa

SEQ ID NO: 1289216 - DNA, 14 bp, Homo sapiens
ctaggaaatattta

SEQ ID NO: 1289217 - DNA, 23 bp, Homo sapiens
ctcagaaaacaaggatgaattaa

SEQ ID NO: 1289218 - DNA, 15 bp, Homo sapiens
ctcttagatgcagtt

SEQ ID NO: 1289219 - DNA, 21 bp, Homo sapiens
ctcttagatgcagttctgaag

SEQ ID NO: 1289220 - DNA, 22 bp, Homo sapiens
ctcttagatgcagttctgaaga

SEQ ID NO: 1289221 - DNA, 23 bp, Homo sapiens
ctgaagaagcaccaatcatgaat

SEQ ID NO: 1289222 - DNA, 20 bp, Homo sapiens
ctgtattttaaaagaatgat

SEQ ID NO: 1289223 - DNA, 20 bp, Homo sapiens
ctgtctacactaagagagaa

SEQ ID NO: 1289224 - DNA, 16 bp, Homo sapiens
cttggggctgatgcag

SEQ ID NO: 1289225 - DNA, 23 bp, Homo sapiens
gaaactcgttaatttgtagtgtt

SEQ ID NO: 1289226 - DNA, 16 bp, Homo sapiens
gaaatattatgttaaa

SEQ ID NO: 1289227 - DNA, 13 bp, Homo sapiens
gaaatatttattt

SEQ ID NO: 1289228 - DNA, 18 bp, Homo sapiens
gaaatatttattttaata

SEQ ID NO: 1289229 - DNA, 21 bp, Homo sapiens
gaactagagtttagctggaaa

SEQ ID NO: 1289230 - DNA, 22 bp, Homo sapiens
gaactagagtttagctggaaaa

SEQ ID NO: 1289231 - DNA, 12 bp, Homo sapiens
gaagaactgaaa

SEQ ID NO: 1289232 - DNA, 21 bp, Homo sapiens
gaagaagcaccaatcatgaat

SEQ ID NO: 1289233 - DNA, 14 bp, Homo sapiens
gaagcaaaattttt

SEQ ID NO: 1289234 - DNA, 22 bp, Homo sapiens
gaatgagagacacactgaagaa

SEQ ID NO: 1289235 - DNA, 15 bp, Homo sapiens
gaattacatttgtat

SEQ ID NO: 1289236 - DNA, 16 bp, Homo sapiens
gaattggagctcgtgg

SEQ ID NO: 1289237 - DNA, 13 bp, Homo sapiens
gacacactgaaga

SEQ ID NO: 1289238 - DNA, 21 bp, Homo sapiens
gacagcccttctttccacaga

SEQ ID NO: 1289239 - DNA, 16 bp, Homo sapiens
gacatttgctcatgga

SEQ ID NO: 1289240 - DNA, 15 bp, Homo sapiens
gactcttaagaagac

SEQ ID NO: 1289241 - DNA, 18 bp, Homo sapiens
gactcttaagaagactgc

SEQ ID NO: 1289242 - DNA, 21 bp, Homo sapiens
gagaacctagggtgatattaa

SEQ ID NO: 1289243 - DNA, 22 bp, Homo sapiens
gagaacctagggtgatattaac

SEQ ID NO: 1289244 - DNA, 23 bp, Homo sapiens
gagaacttccagatcctggaaat

SEQ ID NO: 1289245 - DNA, 14 bp, Homo sapiens
gagaagaactgaaa

SEQ ID NO: 1289246 - DNA, 16 bp, Homo sapiens
gagaagaactgaaatc

SEQ ID NO: 1289247 - DNA, 14 bp, Homo sapiens
gatcctggaaatca

SEQ ID NO: 1289248 - DNA, 22 bp, Homo sapiens
gattaagtaatgataactggaa

SEQ ID NO: 1289249 - DNA, 16 bp, Homo sapiens
aaaataatttttatat

SEQ ID NO: 1289250 - DNA, 14 bp, Homo sapiens
aaacacaactatat

SEQ ID NO: 1289251 - DNA, 16 bp, Homo sapiens
aaacatatataacaat

SEQ ID NO: 1289252 - DNA, 16 bp, Homo sapiens
aaactgactcttaaga

SEQ ID NO: 1289253 - DNA, 16 bp, Homo sapiens
aaagaatgattatgaa

SEQ ID NO: 1289254 - DNA, 22 bp, Homo sapiens
aaagggctgttataatctttca

SEQ ID NO: 1289255 - DNA, 20 bp, Homo sapiens
aaataatttttatatttgaa

SEQ ID NO: 1289256 - DNA, 15 bp, Homo sapiens
gatttaccacttgtg

SEQ ID NO: 1289257 - DNA, 10 bp, Homo sapiens
gcaagccaga

SEQ ID NO: 1289258 - DNA, 18 bp, Homo sapiens
gcaatagtcaaattgtgt

SEQ ID NO: 1289259 - DNA, 15 bp, Homo sapiens
gcagttctgaagaag

SEQ ID NO: 1289260 - DNA, 17 bp, Homo sapiens
gcagttctgaagaagat

SEQ ID NO: 1289261 - DNA, 12 bp, Homo sapiens
gcatttagatgt

SEQ ID NO: 1289262 - DNA, 13 bp, Homo sapiens
gcatttagatgta

SEQ ID NO: 1289263 - DNA, 19 bp, Homo sapiens
gccatgggcactgtgggta

SEQ ID NO: 1289264 - DNA, 21 bp, Homo sapiens
ggacagtcacctcatggaatt

SEQ ID NO: 1289265 - DNA, 11 bp, Homo sapiens
ggagaagaact

SEQ ID NO: 1289266 - DNA, 14 bp, Homo sapiens
ggagaagaactgaa

SEQ ID NO: 1289267 - DNA, 20 bp, Homo sapiens
gggacatttgctcatggaat

SEQ ID NO: 1289268 - DNA, 22 bp, Homo sapiens
ggtacttcaaatccttgaagat

SEQ ID NO: 1289269 - DNA, 15 bp, Homo sapiens
ggtagacacacatga

SEQ ID NO: 1289270 - DNA, 22 bp, Homo sapiens
ggtagacacacatgaagtccaa

SEQ ID NO: 1289271 - DNA, 15 bp, Homo sapiens
gtacttcatgctgtc

SEQ ID NO: 1289272 - DNA, 18 bp, Homo sapiens
gtatgtacttcatgctgt

SEQ ID NO: 1289273 - DNA, 20 bp, Homo sapiens
gtattttaaaagaatgatta

SEQ ID NO: 1289274 - DNA, 23 bp, Homo sapiens
gtcaataaaatccatacatttgt

SEQ ID NO: 1289275 - DNA, 20 bp, Homo sapiens
gtgaaactcgttaatttgta

SEQ ID NO: 1289276 - DNA, 16 bp, Homo sapiens
gtgacaagctcacaga

SEQ ID NO: 1289277 - DNA, 21 bp, Homo sapiens
gtgggacagtcacctcatgga

SEQ ID NO: 1289278 - DNA, 21 bp, Homo sapiens
gtgtaagtagataggccatgg

SEQ ID NO: 1289279 - DNA, 14 bp, Homo sapiens
gttgacatgggaca

SEQ ID NO: 1289280 - DNA, 18 bp, Homo sapiens
gttgacatgggacatttg

SEQ ID NO: 1289281 - DNA, 20 bp, Homo sapiens
gttgatggtggtatgttttc

SEQ ID NO: 1289282 - DNA, 20 bp, Homo sapiens
gtttatataagcttgtattc

SEQ ID NO: 1289283 - DNA, 22 bp, Homo sapiens
gttttataattttgtgaagcaa

SEQ ID NO: 1289284 - DNA, 18 bp, Homo sapiens
gttttcaggctagatgta

SEQ ID NO: 1289285 - DNA, 23 bp, Homo sapiens
gtttttttttaaaaaagaaacat

SEQ ID NO: 1289286 - DNA, 20 bp, Homo sapiens
taaatggcttcctggcaata

SEQ ID NO: 1289287 - DNA, 19 bp, Homo sapiens
taacaatgctgtattttaa

SEQ ID NO: 1289288 - DNA, 17 bp, Homo sapiens
taaccaggggccatgaa

SEQ ID NO: 1289289 - DNA, 21 bp, Homo sapiens
taagaaaatatcacttgtcaa

SEQ ID NO: 1289290 - DNA, 14 bp, Homo sapiens
taatgtttcaaaca

SEQ ID NO: 1289291 - DNA, 22 bp, Homo sapiens
taatgtttcaaacatatataac

SEQ ID NO: 1289292 - DNA, 22 bp, Homo sapiens
taattggaaaggcagctctaaa

SEQ ID NO: 1289293 - DNA, 20 bp, Homo sapiens
taatttgtagtgttggagaa

SEQ ID NO: 1289294 - DNA, 12 bp, Homo sapiens
taatttttatat

SEQ ID NO: 1289295 - DNA, 13 bp, Homo sapiens
tactgtaagaaaa

SEQ ID NO: 1289296 - DNA, 14 bp, Homo sapiens
tacttcaaatcctt

SEQ ID NO: 1289297 - DNA, 21 bp, Homo sapiens
tacttcaaatccttgaagatt

SEQ ID NO: 1289298 - DNA, 15 bp, Homo sapiens
tagaaacacaactat

SEQ ID NO: 1289299 - DNA, 17 bp, Homo sapiens
tagagtttagctggaaa

SEQ ID NO: 1289300 - DNA, 17 bp, Homo sapiens
tagataggccatgggca

SEQ ID NO: 1289301 - DNA, 16 bp, Homo sapiens
tagatgcagttctgaa

SEQ ID NO: 1289302 - DNA, 19 bp, Homo sapiens
tagatgcagttctgaagaa

SEQ ID NO: 1289303 - DNA, 16 bp, Homo sapiens
tagatgtatgtacttc

SEQ ID NO: 1289304 - DNA, 18 bp, Homo sapiens
taggaaatatttatttta

SEQ ID NO: 1289305 - DNA, 19 bp, Homo sapiens
taggaaatatttattttaa

SEQ ID NO: 1289306 - DNA, 19 bp, Homo sapiens
tagtatttctatgaaatat

SEQ ID NO: 1289307 - DNA, 14 bp, Homo sapiens
tagtcaaattgtgt

SEQ ID NO: 1289308 - DNA, 22 bp, Homo sapiens
tagtgaaactcgttaatttgta

SEQ ID NO: 1289309 - DNA, 23 bp, Homo sapiens
tataaaataatttttatatttga

SEQ ID NO: 1289310 - DNA, 14 bp, Homo sapiens
tataattttgtgaa

SEQ ID NO: 1289311 - DNA, 19 bp, Homo sapiens
tataattttgtgaagcaaa

SEQ ID NO: 1289312 - DNA, 16 bp, Homo sapiens
tatatgcttctgtttt

SEQ ID NO: 1289313 - DNA, 15 bp, Homo sapiens
tatatttattactgt

SEQ ID NO: 1289314 - DNA, 19 bp, Homo sapiens
tatatttattactgtaaga

SEQ ID NO: 1289315 - DNA, 16 bp, Homo sapiens
tatgattcccagccag

SEQ ID NO: 1289316 - DNA, 15 bp, Homo sapiens
tatgccccattcaac

SEQ ID NO: 1289317 - DNA, 17 bp, Homo sapiens
tatgtacttcatgctgt

SEQ ID NO: 1289318 - DNA, 15 bp, Homo sapiens
tattagaataccaca

SEQ ID NO: 1289319 - DNA, 14 bp, Homo sapiens
tatttattactgta

SEQ ID NO: 1289320 - DNA, 13 bp, Homo sapiens
tatttctatgaaa

SEQ ID NO: 1289321 - DNA, 14 bp, Homo sapiens
tatttctatgaaat

SEQ ID NO: 1289322 - DNA, 21 bp, Homo sapiens
tatttctatgaaatattatgt

SEQ ID NO: 1289323 - DNA, 17 bp, Homo sapiens
tcaaacatatataacaa

SEQ ID NO: 1289324 - DNA, 15 bp, Homo sapiens
tcaaattgtgtgaaa

SEQ ID NO: 1289325 - DNA, 14 bp, Homo sapiens
tcaataaaatccat

SEQ ID NO: 1289326 - DNA, 15 bp, Homo sapiens
tcaatatttcagata

SEQ ID NO: 1289327 - DNA, 14 bp, Homo sapiens
tcacctcatggaat

SEQ ID NO: 1289328 - DNA, 19 bp, Homo sapiens
tcaggaaagagaacttcca

SEQ ID NO: 1289329 - DNA, 17 bp, Homo sapiens
tcaggctagatgtatgt

SEQ ID NO: 1289330 - DNA, 13 bp, Homo sapiens
tcatttccaagca

SEQ ID NO: 1289331 - DNA, 17 bp, Homo sapiens
tccagatcctggaaatc

SEQ ID NO: 1289332 - DNA, 17 bp, Homo sapiens
tcctggcaatagtcaaa

SEQ ID NO: 1289333 - DNA, 18 bp, Homo sapiens
tctatgaaatattatgtt

SEQ ID NO: 1289334 - DNA, 13 bp, Homo sapiens
tctctaggaaata

SEQ ID NO: 1289335 - DNA, 18 bp, Homo sapiens
tctgttttataattttgt

SEQ ID NO: 1289336 - DNA, 20 bp, Homo sapiens
tctgttttataattttgtga

SEQ ID NO: 1289337 - DNA, 22 bp, Homo sapiens
tcttagggttatgattaagtaa

SEQ ID NO: 1289338 - DNA, 23 bp, Homo sapiens
tgaactagagtttagctggaaaa

SEQ ID NO: 1289339 - DNA, 20 bp, Homo sapiens
tgaagaagcaccaatcatga

SEQ ID NO: 1289340 - DNA, 20 bp, Homo sapiens
tgacaagctcacagaccttt

SEQ ID NO: 1289341 - DNA, 16 bp, Homo sapiens
tgactcttaagaagac

SEQ ID NO: 1289342 - DNA, 19 bp, Homo sapiens
tgagagacacactgaagaa

SEQ ID NO: 1289343 - DNA, 21 bp, Homo sapiens
tgagagacacactgaagaagc

SEQ ID NO: 1289344 - DNA, 22 bp, Homo sapiens
tgagagacacactgaagaagca

SEQ ID NO: 1289345 - DNA, 24 bp, Homo sapiens
tgatcagcttattgtctagtgaaa

SEQ ID NO: 1289346 - DNA, 22 bp, Homo sapiens
tgatgtttagaaacacaactat

SEQ ID NO: 1289347 - DNA, 18 bp, Homo sapiens
tgattaagtaatgataac

SEQ ID NO: 1289348 - DNA, 19 bp, Homo sapiens
tgattatgaattacatttg

SEQ ID NO: 1289349 - DNA, 22 bp, Homo sapiens
tgattatgaattacatttgtat

SEQ ID NO: 1289350 - DNA, 15 bp, Homo sapiens
tgcacatcaaaatat

SEQ ID NO: 1289351 - DNA, 18 bp, Homo sapiens
tgcagttctgaagaagat

SEQ ID NO: 1289352 - DNA, 22 bp, Homo sapiens
tgcagttctgaagaagatggta

SEQ ID NO: 1289353 - DNA, 20 bp, Homo sapiens
tgcattatatttattactgt

SEQ ID NO: 1289354 - DNA, 21 bp, Homo sapiens
tgcattatatttattactgta

SEQ ID NO: 1289355 - DNA, 16 bp, Homo sapiens
tgccccattcaacatc

SEQ ID NO: 1289356 - DNA, 22 bp, Homo sapiens
tgccttctcaactccaaactga

SEQ ID NO: 1289357 - DNA, 17 bp, Homo sapiens
tgccttttcccaactcc

SEQ ID NO: 1289358 - DNA, 19 bp, Homo sapiens
tgccttttcccaactccag

SEQ ID NO: 1289359 - DNA, 21 bp, Homo sapiens
tgctgtattttaaaagaatga

SEQ ID NO: 1289360 - DNA, 22 bp, Homo sapiens
tgctgtattttaaaagaatgat

SEQ ID NO: 1289361 - DNA, 14 bp, Homo sapiens
tgcttctgttttat

SEQ ID NO: 1289362 - DNA, 23 bp, Homo sapiens
tggaaacttcagcggtttatata

SEQ ID NO: 1289363 - DNA, 16 bp, Homo sapiens
tggagaagaactgaaa

SEQ ID NO: 1289364 - DNA, 14 bp, Homo sapiens
tggagctcgtggaa

SEQ ID NO: 1289365 - DNA, 16 bp, Homo sapiens
tggcttcctggcaata

SEQ ID NO: 1289366 - DNA, 16 bp, Homo sapiens
tgggtagacacacatg

SEQ ID NO: 1289367 - DNA, 20 bp, Homo sapiens
tggtaaggggaattgaggac

SEQ ID NO: 1289368 - DNA, 16 bp, Homo sapiens
tggttcccttgatgaa

SEQ ID NO: 1289369 - DNA, 13 bp, Homo sapiens
tgtataaaataat

SEQ ID NO: 1289370 - DNA, 21 bp, Homo sapiens
tgtcaataaaatccatacatt

SEQ ID NO: 1289371 - DNA, 21 bp, Homo sapiens
tgtttcaaacatatataacaa

SEQ ID NO: 1289372 - DNA, 22 bp, Homo sapiens
tgtttcaaacatatataacaat

SEQ ID NO: 1289373 - DNA, 22 bp, Homo sapiens
ttaagaagactgcattatattt

SEQ ID NO: 1289374 - DNA, 14 bp, Homo sapiens
ttacatttgtataa

SEQ ID NO: 1289375 - DNA, 19 bp, Homo sapiens
tgtgttttgcaagccagat

SEQ ID NO: 1289376 - DNA, 14 bp, Homo sapiens
tgttagtgcaaatt

SEQ ID NO: 1289377 - DNA, 22 bp, Homo sapiens
tgttgcccacagctgtatgatt

SEQ ID NO: 1289378 - DNA, 14 bp, Homo sapiens
tgttggagaagaac

SEQ ID NO: 1289379 - DNA, 20 bp, Homo sapiens
tgttggagaagaactgaaat

SEQ ID NO: 1289380 - DNA, 20 bp, Homo sapiens
tgttttataattttgtgaag

SEQ ID NO: 1289381 - DNA, 15 bp, Homo sapiens
ttaaaaaagaaacat

SEQ ID NO: 1289382 - DNA, 18 bp, Homo sapiens
ttaaaaaagaaacatttg

SEQ ID NO: 1289383 - DNA, 19 bp, Homo sapiens
ttaaaaaagaaacatttgg

SEQ ID NO: 1289384 - DNA, 19 bp, Homo sapiens
ttaaaagaatgattatgaa

SEQ ID NO: 1289385 - DNA, 20 bp, Homo sapiens
ttaagaagactgcattatat

SEQ ID NO: 1289386 - DNA, 18 bp, Homo sapiens
ttaagtaatgataactgg

SEQ ID NO: 1289387 - DNA, 16 bp, Homo sapiens
ttaataatgtttcaaa

SEQ ID NO: 1289388 - DNA, 12 bp, Homo sapiens
ttacctgggaaa

SEQ ID NO: 1289389 - DNA, 15 bp, Homo sapiens
ttactgtaagaaaat

SEQ ID NO: 1289390 - DNA, 23 bp, Homo sapiens
ttagatgcagttctgaagaagat

SEQ ID NO: 1289391 - DNA, 12 bp, Homo sapiens
ttagctggaaaa

SEQ ID NO: 1289392 - DNA, 13 bp, Homo sapiens
ttagctggaaaag

SEQ ID NO: 1289393 - DNA, 11 bp, Homo sapiens
ttataatcttt

SEQ ID NO: 1289394 - DNA, 16 bp, Homo sapiens
ttataattttgtgaag

SEQ ID NO: 1289395 - DNA, 13 bp, Homo sapiens
ttatatttgaaat

SEQ ID NO: 1289396 - DNA, 15 bp, Homo sapiens
ttatatttgaaatat

SEQ ID NO: 1289397 - DNA, 16 bp, Homo sapiens
ttatgaattacatttg

SEQ ID NO: 1289398 - DNA, 22 bp, Homo sapiens
ttatgattaagtaatgataact

SEQ ID NO: 1289399 - DNA, 19 bp, Homo sapiens
ttatgttaaaactgggaca

SEQ ID NO: 1289400 - DNA, 18 bp, Homo sapiens
ttcccttgatgaagaagt

SEQ ID NO: 1289401 - DNA, 12 bp, Homo sapiens
ttctctaggaaa

SEQ ID NO: 1289402 - DNA, 18 bp, Homo sapiens
ttctttccacagaagctc

SEQ ID NO: 1289403 - DNA, 15 bp, Homo sapiens
ttgaggacactgata

SEQ ID NO: 1289404 - DNA, 20 bp, Homo sapiens
ttgatatgccttttcccaac

SEQ ID NO: 1289405 - DNA, 23 bp, Homo sapiens
ttgatgaagaagttgatatgcct

SEQ ID NO: 1289406 - DNA, 15 bp, Homo sapiens
ttggagaagaactga

SEQ ID NO: 1289407 - DNA, 20 bp, Homo sapiens
ttggtaaggggaattgagga

SEQ ID NO: 1289408 - DNA, 13 bp, Homo sapiens
ttgtataaaataa

SEQ ID NO: 1289409 - DNA, 17 bp, Homo sapiens
ttgtataaaataatttt

SEQ ID NO: 1289410 - DNA, 18 bp, Homo sapiens
ttgtgaagcaaaattttt

SEQ ID NO: 1289411 - DNA, 18 bp, Homo sapiens
ttgtgttttgcaagccag

SEQ ID NO: 1289412 - DNA, 17 bp, Homo sapiens
tttaaaagaatgattat

SEQ ID NO: 1289413 - DNA, 19 bp, Homo sapiens
tttaataatgtttcaaaca

SEQ ID NO: 1289414 - DNA, 13 bp, Homo sapiens
tttaccacttgtg

SEQ ID NO: 1289415 - DNA, 20 bp, Homo sapiens
tttagctggaaaagtatgtt

SEQ ID NO: 1289416 - DNA, 22 bp, Homo sapiens
tttagctggaaaagtatgttag

SEQ ID NO: 1289417 - DNA, 22 bp, Homo sapiens
tttataattttgtgaagcaaaa

SEQ ID NO: 1289418 - DNA, 13 bp, Homo sapiens
tttatataagctt

SEQ ID NO: 1289419 - DNA, 19 bp, Homo sapiens
tttatatgcttctgtttta

SEQ ID NO: 1289420 - DNA, 15 bp, Homo sapiens
tttcagataatcaca

SEQ ID NO: 1289421 - DNA, 13 bp, Homo sapiens
tttctatgaaata

SEQ ID NO: 1289422 - DNA, 14 bp, Homo sapiens
tttctatgaaatat

SEQ ID NO: 1289423 - DNA, 14 bp, Homo sapiens
tttgaaatattgac

SEQ ID NO: 1289424 - DNA, 14 bp, Homo sapiens
tttgcaagccagat

SEQ ID NO: 1289425 - DNA, 18 bp, Homo sapiens
tttggtaaggggaattga

SEQ ID NO: 1289426 - DNA, 20 bp, Homo sapiens
ttttaataatgtttcaaaca

SEQ ID NO: 1289427 - DNA, 21 bp, Homo sapiens
ttttataattttgtgaagcaa

SEQ ID NO: 1289428 - DNA, 14 bp, Homo sapiens
ttttctctaggaaa

SEQ ID NO: 1289429 - DNA, 19 bp, Homo sapiens
tttttctctaggaaatatt

SEQ ID NO: 1289430 - DNA, 16 bp, Homo sapiens
tcctggaaatcagggt

SEQ ID NO: 1289431 - DNA, 19 bp, Homo sapiens
tctagtgagcagtcaggaa

SEQ ID NO: 1289432 - DNA, 22 bp, Homo sapiens
tctagtgagcagtcaggaaaga

SEQ ID NO: 1289433 - DNA, 13 bp, Homo sapiens
tctatgaaatatt

SEQ ID NO: 1289434 - DNA, 15 bp, Homo sapiens
tctcaactccaaact

SEQ ID NO: 1289435 - DNA, 21 bp, Homo sapiens
tctgactgtttccatcaaggg

SEQ ID NO: 1289436 - DNA, 22 bp, Homo sapiens
tctgttttataattttgtgaag

SEQ ID NO: 1289437 - DNA, 12 bp, Homo sapiens
tcttaagaagac

SEQ ID NO: 1289438 - DNA, 23 bp, Homo sapiens
tcttagatgcagttctgaagaag

SEQ ID NO: 1289439 - DNA, 17 bp, Homo sapiens
tctttccacagaagctc

SEQ ID NO: 1289440 - DNA, 18 bp, Homo sapiens
tgaaatattatgttaaaa

SEQ ID NO: 1289441 - DNA, 14 bp, Homo sapiens
tgaagaagatggta

SEQ ID NO: 1289442 - DNA, 20 bp, Homo sapiens
tgaagatttaccacttgtgt

SEQ ID NO: 1289443 - DNA, 21 bp, Homo sapiens
tgaagtccaagcatttagatg

SEQ ID NO: 1289444 - DNA, 15 bp, Homo sapiens
tgaattacatttgta

SEQ ID NO: 1289445 - DNA, 18 bp, Homo sapiens
tgaattacatttgtataa

SEQ ID NO: 1289446 - DNA, 14 bp, Homo sapiens
tgactcttaagaag

SEQ ID NO: 1289447 - DNA, 15 bp, Homo sapiens
tgactcttaagaaga

SEQ ID NO: 1289448 - DNA, 16 bp, Homo sapiens
tgagagacacactgaa

SEQ ID NO: 1289449 - DNA, 17 bp, Homo sapiens
tgagagacacactgaag

SEQ ID NO: 1289450 - DNA, 15 bp, Homo sapiens
tgaggacactgatat

SEQ ID NO: 1289451 - DNA, 11 bp, Homo sapiens
tgatgaagaag

SEQ ID NO: 1289452 - DNA, 12 bp, Homo sapiens
tgatgaagaagt

SEQ ID NO: 1289453 - DNA, 15 bp, Homo sapiens
tgatggtggtatgtt

SEQ ID NO: 1289454 - DNA, 15 bp, Homo sapiens
tgattaagtaatgat

SEQ ID NO: 1289455 - DNA, 23 bp, Homo sapiens
tgattaagtaatgataactggaa

SEQ ID NO: 1289456 - DNA, 17 bp, Homo sapiens
tgattatgaattacatt

SEQ ID NO: 1289457 - DNA, 16 bp, Homo sapiens
tgcagttctgaagaag

SEQ ID NO: 1289458 - DNA, 17 bp, Homo sapiens
tgcagttctgaagaaga

SEQ ID NO: 1289459 - DNA, 14 bp, Homo sapiens
tgctagtaattgga

SEQ ID NO: 1289460 - DNA, 11 bp, Homo sapiens
tgctcatggaa

SEQ ID NO: 1289461 - DNA, 14 bp, Homo sapiens
tgctcatggaattg

SEQ ID NO: 1289462 - DNA, 13 bp, Homo sapiens
tgctgtattttaa

SEQ ID NO: 1289463 - DNA, 22 bp, Homo sapiens
tgcttctgttttataattttgt

SEQ ID NO: 1289464 - DNA, 14 bp, Homo sapiens
tggagaagaactga

SEQ ID NO: 1289465 - DNA, 20 bp, Homo sapiens
tggcaatagtcaaattgtgt

SEQ ID NO: 1289466 - DNA, 15 bp, Homo sapiens
tggcactagtatttc

SEQ ID NO: 1289467 - DNA, 20 bp, Homo sapiens
tgggacatttgctcatggaa

SEQ ID NO: 1289468 - DNA, 17 bp, Homo sapiens
tgggtagacacacatga

SEQ ID NO: 1289469 - DNA, 13 bp, Homo sapiens
tggtatgttttca

SEQ ID NO: 1289470 - DNA, 14 bp, Homo sapiens
tgtagtgttggaga

SEQ ID NO: 1289471 - DNA, 16 bp, Homo sapiens
tgtagtgttggagaag

SEQ ID NO: 1289472 - DNA, 17 bp, Homo sapiens
tgtagtgttggagaaga

SEQ ID NO: 1289473 - DNA, 18 bp, Homo sapiens
tgtagtgttggagaagaa

SEQ ID NO: 1289474 - DNA, 14 bp, Homo sapiens
tgtataaaataatt

SEQ ID NO: 1289475 - DNA, 16 bp, Homo sapiens
tgtatgattcccagcc

SEQ ID NO: 1289476 - DNA, 18 bp, Homo sapiens
tgtattttaaaagaatga

SEQ ID NO: 1289477 - DNA, 13 bp, Homo sapiens
tgtgtaagtagat

SEQ ID NO: 1289478 - DNA, 20 bp, Homo sapiens
tgtgtgaaaggtacttcaaa

SEQ ID NO: 1289479 - DNA, 20 bp, Homo sapiens
atgaagtccaagcatttaga

SEQ ID NO: 1289480 - DNA, 15 bp, Homo sapiens
atgaattaagttttt

SEQ ID NO: 1289481 - DNA, 17 bp, Homo sapiens
atgaattacatttgtat

SEQ ID NO: 1289482 - DNA, 19 bp, Homo sapiens
atgaattacatttgtataa

SEQ ID NO: 1289483 - DNA, 18 bp, Homo sapiens
atgattaagtaatgataa

SEQ ID NO: 1289484 - DNA, 19 bp, Homo sapiens
atgcagttctgaagaagat

SEQ ID NO: 1289485 - DNA, 14 bp, Homo sapiens
atgctgtattttaa

SEQ ID NO: 1289486 - DNA, 19 bp, Homo sapiens
atgctgtattttaaaagaa

SEQ ID NO: 1289487 - DNA, 23 bp, Homo sapiens
atgctgtctacactaagagagaa

SEQ ID NO: 1289488 - DNA, 21 bp, Homo sapiens
atgcttctgttttataatttt

SEQ ID NO: 1289489 - DNA, 14 bp, Homo sapiens
atggcactagtatt

SEQ ID NO: 1289490 - DNA, 21 bp, Homo sapiens
atgggacatttgctcatggaa

SEQ ID NO: 1289491 - DNA, 16 bp, Homo sapiens
atgtacttcatgctgt

SEQ ID NO: 1289492 - DNA, 21 bp, Homo sapiens
atgtcaatcagcctagttgat

SEQ ID NO: 1289493 - DNA, 17 bp, Homo sapiens
atgttttcaggctagat

SEQ ID NO: 1289494 - DNA, 23 bp, Homo sapiens
attaagtaatgataactggaaac

SEQ ID NO: 1289495 - DNA, 16 bp, Homo sapiens
attacatttgtataaa

SEQ ID NO: 1289496 - DNA, 15 bp, Homo sapiens
attatatttattact

SEQ ID NO: 1289497 - DNA, 18 bp, Homo sapiens
attatatttattactgta

SEQ ID NO: 1289498 - DNA, 17 bp, Homo sapiens
attatgaattacatttg

SEQ ID NO: 1289499 - DNA, 22 bp, Homo sapiens
attatgaattacatttgtataa

SEQ ID NO: 1289500 - DNA, 18 bp, Homo sapiens
attgactttttatggcac

SEQ ID NO: 1289501 - DNA, 17 bp, Homo sapiens
attggagctcgtgggac

SEQ ID NO: 1289502 - DNA, 15 bp, Homo sapiens
atttaccacttgtgt

SEQ ID NO: 1289503 - DNA, 19 bp, Homo sapiens
atttattactgtaagaaaa

SEQ ID NO: 1289504 - DNA, 14 bp, Homo sapiens
atttattttaataa

SEQ ID NO: 1289505 - DNA, 15 bp, Homo sapiens
atttctatgaaatat

SEQ ID NO: 1289506 - DNA, 17 bp, Homo sapiens
atttgctcatggaattg

SEQ ID NO: 1289507 - DNA, 18 bp, Homo sapiens
atttgtagtgttggagaa

SEQ ID NO: 1289508 - DNA, 18 bp, Homo sapiens
atttgtataaaataattt

SEQ ID NO: 1289509 - DNA, 21 bp, Homo sapiens
atttgtataaaataattttta

SEQ ID NO: 1289510 - DNA, 16 bp, Homo sapiens
attttaaaagaatgat

SEQ ID NO: 1289511 - DNA, 23 bp, Homo sapiens
attttaaaagaatgattatgaat

SEQ ID NO: 1289512 - DNA, 14 bp, Homo sapiens
attttcctgaaaac

SEQ ID NO: 1289513 - DNA, 14 bp, Homo sapiens
caagcaagtattag

SEQ ID NO: 1289514 - DNA, 19 bp, Homo sapiens
caagcatttagatgtatag

SEQ ID NO: 1289515 - DNA, 20 bp, Homo sapiens
caataaaatccatacatttg

SEQ ID NO: 1289516 - DNA, 17 bp, Homo sapiens
caatagtcaaattgtgt

SEQ ID NO: 1289517 - DNA, 19 bp, Homo sapiens
caatagtcaaattgtgtga

SEQ ID NO: 1289518 - DNA, 20 bp, Homo sapiens
caatatttcagataatcaca

SEQ ID NO: 1289519 - DNA, 21 bp, Homo sapiens
caatatttcagataatcacaa

SEQ ID NO: 1289520 - DNA, 15 bp, Homo sapiens
caatgctgtatttta

SEQ ID NO: 1289521 - DNA, 16 bp, Homo sapiens
cacatgaagtccaagc

SEQ ID NO: 1289522 - DNA, 20 bp, Homo sapiens
cacatgaagtccaagcattt

SEQ ID NO: 1289523 - DNA, 14 bp, Homo sapiens
cacctcatggaatt

SEQ ID NO: 1289524 - DNA, 19 bp, Homo sapiens
cactagtatttctatgaaa

SEQ ID NO: 1289525 - DNA, 13 bp, Homo sapiens
cagatcctggaaa

SEQ ID NO: 1289526 - DNA, 14 bp, Homo sapiens
cagattttcctgaa

SEQ ID NO: 1289527 - DNA, 15 bp, Homo sapiens
cagattttcctgaaa

SEQ ID NO: 1289528 - DNA, 16 bp, Homo sapiens
caggaaagagaacttc

SEQ ID NO: 1289529 - DNA, 23 bp, Homo sapiens
caggacagcccttctttccacag

SEQ ID NO: 1289530 - DNA, 13 bp, Homo sapiens
caggctagatgta

SEQ ID NO: 1289531 - DNA, 16 bp, Homo sapiens
caggggacaggatggt

SEQ ID NO: 1289532 - DNA, 16 bp, Homo sapiens
cagtcacctcatggaa

SEQ ID NO: 1289533 - DNA, 15 bp, Homo sapiens
cagtcaggaaagaga

SEQ ID NO: 1289534 - DNA, 21 bp, Homo sapiens
cagttacctctgcctcagaaa

SEQ ID NO: 1289535 - DNA, 13 bp, Homo sapiens
catatataacaat

SEQ ID NO: 1289536 - DNA, 20 bp, Homo sapiens
catatataacaatgctgtat

SEQ ID NO: 1289537 - DNA, 18 bp, Homo sapiens
catcccttacctgggaaa

SEQ ID NO: 1289538 - DNA, 16 bp, Homo sapiens
catgaattagttttat

SEQ ID NO: 1289539 - DNA, 20 bp, Homo sapiens
catgtgctagtaattggaaa

SEQ ID NO: 1289540 - DNA, 14 bp, Homo sapiens
catttgctcatgga

SEQ ID NO: 1289541 - DNA, 15 bp, Homo sapiens
catttgctcatggaa

SEQ ID NO: 1289542 - DNA, 18 bp, Homo sapiens
ccacagaagctccaggta

SEQ ID NO: 1289543 - DNA, 20 bp, Homo sapiens
ccacaggaaccacaagactg

SEQ ID NO: 1289544 - DNA, 15 bp, Homo sapiens
ccagatcctggaaat

SEQ ID NO: 1289545 - DNA, 18 bp, Homo sapiens
ccatcaagggtacactgc

SEQ ID NO: 1289546 - DNA, 17 bp, Homo sapiens
cccttctttccacagaa

SEQ ID NO: 1289547 - DNA, 23 bp, Homo sapiens
cctcttagatgcagttctgaaga

SEQ ID NO: 1289548 - DNA, 12 bp, Homo sapiens
ccttttcccaac

SEQ ID NO: 1289549 - DNA, 18 bp, Homo sapiens
ctagagtttagctggaaa

SEQ ID NO: 1289550 - DNA, 16 bp, Homo sapiens
ctagtaattggaaagg

SEQ ID NO: 1289551 - DNA, 19 bp, Homo sapiens
ctagtatttctatgaaata

SEQ ID NO: 1289552 - DNA, 21 bp, Homo sapiens
ctagtgagcagtcaggaaaga

SEQ ID NO: 1289553 - DNA, 19 bp, Homo sapiens
ctatattgtttgctaagca

SEQ ID NO: 1289554 - DNA, 18 bp, Homo sapiens
ctatctcatttccaagca

SEQ ID NO: 1289555 - DNA, 19 bp, Homo sapiens
ctcagaaaacaaggatgaa

SEQ ID NO: 1289556 - DNA, 14 bp, Homo sapiens
ctcatttccaagca

SEQ ID NO: 1289557 - DNA, 21 bp, Homo sapiens
ctccaaactgactcttaagaa

SEQ ID NO: 1289558 - DNA, 19 bp, Homo sapiens
ctccccatgatgtttagaa

SEQ ID NO: 1289559 - DNA, 17 bp, Homo sapiens
ctctaggaaatatttat

SEQ ID NO: 1289560 - DNA, 15 bp, Homo sapiens
ctctccccatgatgt

SEQ ID NO: 1289561 - DNA, 16 bp, Homo sapiens
ctctccccatgatgtt

SEQ ID NO: 1289562 - DNA, 13 bp, Homo sapiens
ctcttaagaagac

SEQ ID NO: 1289563 - DNA, 16 bp, Homo sapiens
ctgtattttaaaagaa

SEQ ID NO: 1289564 - DNA, 21 bp, Homo sapiens
cttaagaagactgcattatat

SEQ ID NO: 1289565 - DNA, 20 bp, Homo sapiens
cttagatgcagttctgaaga

SEQ ID NO: 1289566 - DNA, 21 bp, Homo sapiens
cttagggttatgattaagtaa

SEQ ID NO: 1289567 - DNA, 17 bp, Homo sapiens
cttcaaatccttgaaga

SEQ ID NO: 1289568 - DNA, 15 bp, Homo sapiens
cttctgttttataat

SEQ ID NO: 1289569 - DNA, 19 bp, Homo sapiens
cttctttccacagaagctc

SEQ ID NO: 1289570 - DNA, 13 bp, Homo sapiens
cttgatgaagaag

SEQ ID NO: 1289571 - DNA, 18 bp, Homo sapiens
cttggggctgatgcagtt

SEQ ID NO: 1289572 - DNA, 14 bp, Homo sapiens
gaaaacaaggatga

SEQ ID NO: 1289573 - DNA, 12 bp, Homo sapiens
gaaaatatcact

SEQ ID NO: 1289574 - DNA, 11 bp, Homo sapiens
gaaacatttgg

SEQ ID NO: 1289575 - DNA, 13 bp, Homo sapiens
gaaatattatgtt

SEQ ID NO: 1289576 - DNA, 15 bp, Homo sapiens
gaaatatttatttta

SEQ ID NO: 1289577 - DNA, 21 bp, Homo sapiens
gaagccttggggctgatgcag

SEQ ID NO: 1289578 - DNA, 22 bp, Homo sapiens
gaagtccaagcatttagatgta

SEQ ID NO: 1289579 - DNA, 23 bp, Homo sapiens
gaagtccaagcatttagatgtat

SEQ ID NO: 1289580 - DNA, 23 bp, Homo sapiens
gaatgagagacacactgaagaag

SEQ ID NO: 1289581 - DNA, 22 bp, Homo sapiens
gaatgattatgaattacatttg

SEQ ID NO: 1289582 - DNA, 18 bp, Homo sapiens
gaattacatttgtataaa

SEQ ID NO: 1289583 - DNA, 16 bp, Homo sapiens
gacacactgaagaagc

SEQ ID NO: 1289584 - DNA, 18 bp, Homo sapiens
gacagtcacctcatggaa

SEQ ID NO: 1289585 - DNA, 17 bp, Homo sapiens
gacatttgctcatggaa

SEQ ID NO: 1289586 - DNA, 21 bp, Homo sapiens
gactcttaagaagactgcatt

SEQ ID NO: 1289587 - DNA, 24 bp, Homo sapiens
gactgcattatatttattactgta

SEQ ID NO: 1289588 - DNA, 22 bp, Homo sapiens
gagaacttccagatcctggaaa

SEQ ID NO: 1289589 - DNA, 20 bp, Homo sapiens
gagaatgagagacacactga

SEQ ID NO: 1289590 - DNA, 18 bp, Homo sapiens
gagacacactgaagaagc

SEQ ID NO: 1289591 - DNA, 19 bp, Homo sapiens
gagagacacactgaagaag

SEQ ID NO: 1289592 - DNA, 16 bp, Homo sapiens
gagctcgtgggacagt

SEQ ID NO: 1289593 - DNA, 22 bp, Homo sapiens
gataaatggcttcctggcaata

SEQ ID NO: 1289594 - DNA, 23 bp, Homo sapiens
gatcagcttattgtctagtgaaa

SEQ ID NO: 1289595 - DNA, 13 bp, Homo sapiens
gatcctggaaatc

SEQ ID NO: 1289596 - DNA, 18 bp, Homo sapiens
gatgcagttctgaagaag

SEQ ID NO: 1289597 - DNA, 22 bp, Homo sapiens
gatggttcccttgatgaagaag

SEQ ID NO: 1289598 - DNA, 16 bp, Homo sapiens
gatttaccacttgtgt

SEQ ID NO: 1289599 - DNA, 15 bp, Homo sapiens
gattttcctgaaaac

SEQ ID NO: 1289600 - DNA, 22 bp, Homo sapiens
gcagttgttgcccacagctgta

SEQ ID NO: 1289601 - DNA, 13 bp, Homo sapiens
gctagatgtatgt

SEQ ID NO: 1289602 - DNA, 18 bp, Homo sapiens
gctgtattttaaaagaat

SEQ ID NO: 1289603 - DNA, 19 bp, Homo sapiens
gcttcctggcaatagtcaa

SEQ ID NO: 1289604 - DNA, 13 bp, Homo sapiens
ggaaatatttatt

SEQ ID NO: 1289605 - DNA, 17 bp, Homo sapiens
ggaaatatttattttaa

SEQ ID NO: 1289606 - DNA, 18 bp, Homo sapiens
ggaaatatttattttaat

SEQ ID NO: 1289607 - DNA, 16 bp, Homo sapiens
ggaattggagctcgtg

SEQ ID NO: 1289608 - DNA, 22 bp, Homo sapiens
ggatggttcccttgatgaagaa

SEQ ID NO: 1289609 - DNA, 21 bp, Homo sapiens
gggacatttgctcatggaatt

SEQ ID NO: 1289610 - DNA, 19 bp, Homo sapiens
gtaatgataactggaaact

SEQ ID NO: 1289611 - DNA, 14 bp, Homo sapiens
gtagtgttggagaa

SEQ ID NO: 1289612 - DNA, 14 bp, Homo sapiens
gtatgattcccagc

SEQ ID NO: 1289613 - DNA, 16 bp, Homo sapiens
gtattttaaaagaatg

SEQ ID NO: 1289614 - DNA, 15 bp, Homo sapiens
gtcaataaaatccat

SEQ ID NO: 1289615 - DNA, 21 bp, Homo sapiens
gtccaagcatttagatgtata

SEQ ID NO: 1289616 - DNA, 17 bp, Homo sapiens
gtctacactaagagaga

SEQ ID NO: 1289617 - DNA, 13 bp, Homo sapiens
gtctgactgtttc

SEQ ID NO: 1289618 - DNA, 18 bp, Homo sapiens
gtgctagtaattggaaag

SEQ ID NO: 1289619 - DNA, 14 bp, Homo sapiens
gtgggtagacacac

SEQ ID NO: 1289620 - DNA, 12 bp, Homo sapiens
gttctgaagaag

SEQ ID NO: 1289621 - DNA, 13 bp, Homo sapiens
gttctgaagaaga

SEQ ID NO: 1289622 - DNA, 14 bp, Homo sapiens
gttctgaagaagat

SEQ ID NO: 1289623 - DNA, 15 bp, Homo sapiens
gttctgaagaagatg

SEQ ID NO: 1289624 - DNA, 18 bp, Homo sapiens
taaaatccatacatttgt

SEQ ID NO: 1289625 - DNA, 19 bp, Homo sapiens
taaaatccatacatttgtg

SEQ ID NO: 1289626 - DNA, 15 bp, Homo sapiens
taaatgttgacatgg

SEQ ID NO: 1289627 - DNA, 17 bp, Homo sapiens
taacaatgctgtatttt

SEQ ID NO: 1289628 - DNA, 15 bp, Homo sapiens
taactggaaacttca

SEQ ID NO: 1289629 - DNA, 20 bp, Homo sapiens
taagcattccaactatctca

SEQ ID NO: 1289630 - DNA, 20 bp, Homo sapiens
taagtaatgataactggaaa

SEQ ID NO: 1289631 - DNA, 14 bp, Homo sapiens
taataatgtttcaa

SEQ ID NO: 1289632 - DNA, 13 bp, Homo sapiens
taatctttcacag

SEQ ID NO: 1289633 - DNA, 17 bp, Homo sapiens
taatgataactggaaac

SEQ ID NO: 1289634 - DNA, 15 bp, Homo sapiens
taatgtttcaaacat

SEQ ID NO: 1289635 - DNA, 21 bp, Homo sapiens
taatttttatatttgaaatat

SEQ ID NO: 1289636 - DNA, 14 bp, Homo sapiens
tacactaagagaga

SEQ ID NO: 1289637 - DNA, 16 bp, Homo sapiens
tacatttgtataaaat

SEQ ID NO: 1289638 - DNA, 17 bp, Homo sapiens
tacatttgtataaaata

SEQ ID NO: 1289639 - DNA, 22 bp, Homo sapiens
taccaaaaatctcaatatttca

SEQ ID NO: 1289640 - DNA, 19 bp, Homo sapiens
tacttcaaatccttgaaga

SEQ ID NO: 1289641 - DNA, 19 bp, Homo sapiens
tacttcttagggttatgat

SEQ ID NO: 1289642 - DNA, 14 bp, Homo sapiens
tagagggtgtgtaa

SEQ ID NO: 1289643 - DNA, 21 bp, Homo sapiens
tagatgcagttctgaagaaga

SEQ ID NO: 1289644 - DNA, 17 bp, Homo sapiens
tagtattgtccaggtct

SEQ ID NO: 1289645 - DNA, 14 bp, Homo sapiens
tagtgcaaattgtc

SEQ ID NO: 1289646 - DNA, 12 bp, Homo sapiens
tagtgttggaga

SEQ ID NO: 1289647 - DNA, 21 bp, Homo sapiens
tataaaataatttttatattt

SEQ ID NO: 1289648 - DNA, 18 bp, Homo sapiens
tataacaatgctgtattt

SEQ ID NO: 1289649 - DNA, 17 bp, Homo sapiens
tatataacaatgctgta

SEQ ID NO: 1289650 - DNA, 14 bp, Homo sapiens
tatatgcttctgtt

SEQ ID NO: 1289651 - DNA, 23 bp, Homo sapiens
tatatttattactgtaagaaaat

SEQ ID NO: 1289652 - DNA, 21 bp, Homo sapiens
tatgaaatattatgttaaaac

SEQ ID NO: 1289653 - DNA, 17 bp, Homo sapiens
tatgaattacatttgta

SEQ ID NO: 1289654 - DNA, 23 bp, Homo sapiens
tatgaattacatttgtataaaat

SEQ ID NO: 1289655 - DNA, 16 bp, Homo sapiens
tatgattaagtaatga

SEQ ID NO: 1289656 - DNA, 20 bp, Homo sapiens
tatgattaagtaatgataac

SEQ ID NO: 1289657 - DNA, 21 bp, Homo sapiens
tatgattaagtaatgataact

SEQ ID NO: 1289658 - DNA, 16 bp, Homo sapiens
tattatgttaaaactg

SEQ ID NO: 1289659 - DNA, 13 bp, Homo sapiens
tatttattactgt

SEQ ID NO: 1289660 - DNA, 16 bp, Homo sapiens
tatttattttaataat

SEQ ID NO: 1289661 - DNA, 22 bp, Homo sapiens
tatttctatgaaatattatgtt

SEQ ID NO: 1289662 - DNA, 14 bp, Homo sapiens
tattttaaaagaat

SEQ ID NO: 1289663 - DNA, 21 bp, Homo sapiens
tcaaaatatgccccattcaac

SEQ ID NO: 1289664 - DNA, 15 bp, Homo sapiens
tcaaatccttgaaga

SEQ ID NO: 1289665 - DNA, 22 bp, Homo sapiens
tcaactccaaactgactcttaa

SEQ ID NO: 1289666 - DNA, 23 bp, Homo sapiens
tcaatatttcagataatcacaat

SEQ ID NO: 1289667 - DNA, 16 bp, Homo sapiens
tcacagacctttgaac

SEQ ID NO: 1289668 - DNA, 12 bp, Homo sapiens
tcacctcatgga

SEQ ID NO: 1289669 - DNA, 16 bp, Homo sapiens
tcatttccaagcaagt

SEQ ID NO: 1289670 - DNA, 16 bp, Homo sapiens
tcccttgatgaagaag

SEQ ID NO: 1289671 - DNA, 17 bp, Homo sapiens
tcctctccccatgatgt

SEQ ID NO: 1289672 - DNA, 22 bp, Homo sapiens
tcctgaaaacccttgccatgtg

SEQ ID NO: 1289673 - DNA, 16 bp, Homo sapiens
ataatttttatatttg

SEQ ID NO: 1289674 - DNA, 22 bp, Homo sapiens
ataatttttatatttgaaatat

SEQ ID NO: 1289675 - DNA, 20 bp, Homo sapiens
atacatcccttacctgggaa

SEQ ID NO: 1289676 - DNA, 22 bp, Homo sapiens
ataccacaggaaccacaagact

SEQ ID NO: 1289677 - DNA, 14 bp, Homo sapiens
atatataacaatgc

SEQ ID NO: 1289678 - DNA, 23 bp, Homo sapiens
atatgcttctgttttataatttt

SEQ ID NO: 1289679 - DNA, 13 bp, Homo sapiens
atattatgttaaa

SEQ ID NO: 1289680 - DNA, 16 bp, Homo sapiens
atattatgttaaaact

SEQ ID NO: 1289681 - DNA, 14 bp, Homo sapiens
atattgtttgctaa

SEQ ID NO: 1289682 - DNA, 19 bp, Homo sapiens
atatttattactgtaagaa

SEQ ID NO: 1289683 - DNA, 22 bp, Homo sapiens
atatttattactgtaagaaaat

SEQ ID NO: 1289684 - DNA, 14 bp, Homo sapiens
atatttattttaat

SEQ ID NO: 1289685 - DNA, 19 bp, Homo sapiens
atatttgaaatattgactt

SEQ ID NO: 1289686 - DNA, 14 bp, Homo sapiens
atccatacatttgt

SEQ ID NO: 1289687 - DNA, 12 bp, Homo sapiens
atccttgaagat

SEQ ID NO: 1289688 - DNA, 23 bp, Homo sapiens
atctcatttccaagcaagtatta

SEQ ID NO: 1289689 - DNA, 21 bp, Homo sapiens
atgaattagttttatatgctt

SEQ ID NO: 1289690 - DNA, 21 bp, Homo sapiens
atgagagacacactgaagaag

SEQ ID NO: 1289691 - DNA, 23 bp, Homo sapiens
atgagagacacactgaagaagca

SEQ ID NO: 1289692 - DNA, 15 bp, Homo sapiens
atgataactggaaac

SEQ ID NO: 1289693 - DNA, 22 bp, Homo sapiens
atgattatgaattacatttgta

SEQ ID NO: 1289694 - DNA, 15 bp, Homo sapiens
atgcagttctgaaga

SEQ ID NO: 1289695 - DNA, 22 bp, Homo sapiens
atgctgtattttaaaagaatga

SEQ ID NO: 1289696 - DNA, 23 bp, Homo sapiens
atgctgtattttaaaagaatgat

SEQ ID NO: 1289697 - DNA, 22 bp, Homo sapiens
atgctgtctacactaagagaga

SEQ ID NO: 1289698 - DNA, 20 bp, Homo sapiens
atgggacatttgctcatgga

SEQ ID NO: 1289699 - DNA, 22 bp, Homo sapiens
atgggacatttgctcatggaat

SEQ ID NO: 1289700 - DNA, 21 bp, Homo sapiens
atggttcccttgatgaagaag

SEQ ID NO: 1289701 - DNA, 20 bp, Homo sapiens
atgtgctagtaattggaaag

SEQ ID NO: 1289702 - DNA, 13 bp, Homo sapiens
attaagtaatgat

SEQ ID NO: 1289703 - DNA, 21 bp, Homo sapiens
attaagtaatgataactggaa

SEQ ID NO: 1289704 - DNA, 15 bp, Homo sapiens
attactgtaagaaaa

SEQ ID NO: 1289705 - DNA, 18 bp, Homo sapiens
attatgaattacatttgt

SEQ ID NO: 1289706 - DNA, 19 bp, Homo sapiens
attatgaattacatttgta

SEQ ID NO: 1289707 - DNA, 13 bp, Homo sapiens
attgactttttat

SEQ ID NO: 1289708 - DNA, 19 bp, Homo sapiens
attggagctcgtgggacag

SEQ ID NO: 1289709 - DNA, 22 bp, Homo sapiens
atttaccacttgtgttttgcaa

SEQ ID NO: 1289710 - DNA, 13 bp, Homo sapiens
atttagatgtata

SEQ ID NO: 1289711 - DNA, 22 bp, Homo sapiens
atttattactgtaagaaaatat

SEQ ID NO: 1289712 - DNA, 20 bp, Homo sapiens
atttctatgaaatattatgt

SEQ ID NO: 1289713 - DNA, 23 bp, Homo sapiens
atttggtaaggggaattgaggac

SEQ ID NO: 1289714 - DNA, 14 bp, Homo sapiens
atttgtataaaata

SEQ ID NO: 1289715 - DNA, 22 bp, Homo sapiens
attttaaaagaatgattatgaa

SEQ ID NO: 1289716 - DNA, 15 bp, Homo sapiens
attttaataatgttt

SEQ ID NO: 1289717 - DNA, 16 bp, Homo sapiens
atttttatatttgaaa

SEQ ID NO: 1289718 - DNA, 19 bp, Homo sapiens
atttttatatttgaaatat

SEQ ID NO: 1289719 - DNA, 23 bp, Homo sapiens
attttttctctaggaaatattta

SEQ ID NO: 1289720 - DNA, 16 bp, Homo sapiens
caaactgactcttaag

SEQ ID NO: 1289721 - DNA, 17 bp, Homo sapiens
caaactgactcttaaga

SEQ ID NO: 1289722 - DNA, 21 bp, Homo sapiens
caaactgactcttaagaagac

SEQ ID NO: 1289723 - DNA, 15 bp, Homo sapiens
caaatccttgaagat

SEQ ID NO: 1289724 - DNA, 15 bp, Homo sapiens
caaattgtgtgaaag

SEQ ID NO: 1289725 - DNA, 19 bp, Homo sapiens
caactatctcatttccaag

SEQ ID NO: 1289726 - DNA, 12 bp, Homo sapiens
caactccagaaa

SEQ ID NO: 1289727 - DNA, 14 bp, Homo sapiens
caagtattagaata

SEQ ID NO: 1289728 - DNA, 12 bp, Homo sapiens
caatatttcaga

SEQ ID NO: 1289729 - DNA, 13 bp, Homo sapiens
cacactgaagaag

SEQ ID NO: 1289730 - DNA, 14 bp, Homo sapiens
cacactgaagaagc

SEQ ID NO: 1289731 - DNA, 17 bp, Homo sapiens
cacatgaagtccaagca

SEQ ID NO: 1289732 - DNA, 12 bp, Homo sapiens
cacctcatggaa

SEQ ID NO: 1289733 - DNA, 17 bp, Homo sapiens
cactaagagagaatgag

SEQ ID NO: 1289734 - DNA, 20 bp, Homo sapiens
cactgccttctcaactccaa

SEQ ID NO: 1289735 - DNA, 22 bp, Homo sapiens
cactgtgggtagacacacatga

SEQ ID NO: 1289736 - DNA, 24 bp, Homo sapiens
cactgtgggtagacacacatgaag

SEQ ID NO: 1289737 - DNA, 12 bp, Homo sapiens
cagatcctggaa

SEQ ID NO: 1289738 - DNA, 16 bp, Homo sapiens
cagcctagttgatcag

SEQ ID NO: 1289739 - DNA, 18 bp, Homo sapiens
cagctgtatgattcccag

SEQ ID NO: 1289740 - DNA, 20 bp, Homo sapiens
cagctgtatgattcccagcc

SEQ ID NO: 1289741 - DNA, 18 bp, Homo sapiens
caggaaccacaagactgc

SEQ ID NO: 1289742 - DNA, 19 bp, Homo sapiens
caggctagatgtatgtact

SEQ ID NO: 1289743 - DNA, 11 bp, Homo sapiens
caggggacagg

SEQ ID NO: 1289744 - DNA, 22 bp, Homo sapiens
cagtcaggaaagagaacttcca

SEQ ID NO: 1289745 - DNA, 16 bp, Homo sapiens
cagttctgaagaagat

SEQ ID NO: 1289746 - DNA, 22 bp, Homo sapiens
cagttctgaagaagatggtacc

SEQ ID NO: 1289747 - DNA, 14 bp, Homo sapiens
catctagtgagcag

SEQ ID NO: 1289748 - DNA, 19 bp, Homo sapiens
cattatatttattactgta

SEQ ID NO: 1289749 - DNA, 16 bp, Homo sapiens
catttgtataaaataa

SEQ ID NO: 1289750 - DNA, 17 bp, Homo sapiens
catttgtataaaataat

SEQ ID NO: 1289751 - DNA, 20 bp, Homo sapiens
catttgtataaaataatttt

SEQ ID NO: 1289752 - DNA, 15 bp, Homo sapiens
aatgataactggaaa

SEQ ID NO: 1289753 - DNA, 15 bp, Homo sapiens
aatgattatgaatta

SEQ ID NO: 1289754 - DNA, 20 bp, Homo sapiens
aatgctgtattttaaaagaa

SEQ ID NO: 1289755 - DNA, 14 bp, Homo sapiens
aattagttttatat

SEQ ID NO: 1289756 - DNA, 20 bp, Homo sapiens
aattagttttatatgcttct

SEQ ID NO: 1289757 - DNA, 19 bp, Homo sapiens
aatttttatatttgaaata

SEQ ID NO: 1289758 - DNA, 18 bp, Homo sapiens
acaatgctgtattttaaa

SEQ ID NO: 1289759 - DNA, 13 bp, Homo sapiens
acactaagagaga

SEQ ID NO: 1289760 - DNA, 17 bp, Homo sapiens
acactaagagagaatga

SEQ ID NO: 1289761 - DNA, 16 bp, Homo sapiens
acagaagctccaggta

SEQ ID NO: 1289762 - DNA, 23 bp, Homo sapiens
acagctgtatgattcccagccag

SEQ ID NO: 1289763 - DNA, 22 bp, Homo sapiens
acaggatggttcccttgatgaa

SEQ ID NO: 1289764 - DNA, 24 bp, Homo sapiens
acaggatggttcccttgatgaaga

SEQ ID NO: 1289765 - DNA, 20 bp, Homo sapiens
acatcccttacctgggaaag

SEQ ID NO: 1289766 - DNA, 11 bp, Homo sapiens
acatgggacat

SEQ ID NO: 1289767 - DNA, 14 bp, Homo sapiens
acatgggacatttg

SEQ ID NO: 1289768 - DNA, 15 bp, Homo sapiens
acatgggacatttgc

SEQ ID NO: 1289769 - DNA, 15 bp, Homo sapiens
acatttgctcatgga

SEQ ID NO: 1289770 - DNA, 16 bp, Homo sapiens
acatttgctcatggaa

SEQ ID NO: 1289771 - DNA, 23 bp, Homo sapiens
accaaaaatctcaatatttcaga

SEQ ID NO: 1289772 - DNA, 23 bp, Homo sapiens
accacttgtgttttgcaagccag

SEQ ID NO: 1289773 - DNA, 21 bp, Homo sapiens
acctagggtgatattaaccag

SEQ ID NO: 1289774 - DNA, 18 bp, Homo sapiens
acctctgcctcagaaaac

SEQ ID NO: 1289775 - DNA, 15 bp, Homo sapiens
actaagagagaatga

SEQ ID NO: 1289776 - DNA, 16 bp, Homo sapiens
actaagagagaatgag

SEQ ID NO: 1289777 - DNA, 20 bp, Homo sapiens
actagtatttctatgaaata

SEQ ID NO: 1289778 - DNA, 15 bp, Homo sapiens
actcttaagaagact

SEQ ID NO: 1289779 - DNA, 21 bp, Homo sapiens
actcttaagaagactgcatta

SEQ ID NO: 1289780 - DNA, 13 bp, Homo sapiens
actgactcttaag

SEQ ID NO: 1289781 - DNA, 13 bp, Homo sapiens
actgccttctcaa

SEQ ID NO: 1289782 - DNA, 20 bp, Homo sapiens
actgccttctcaactccaaa

SEQ ID NO: 1289783 - DNA, 15 bp, Homo sapiens
ccaggggccatgaat

SEQ ID NO: 1289784 - DNA, 20 bp, Homo sapiens
ccaggtagagggtgtgtaag

SEQ ID NO: 1289785 - DNA, 18 bp, Homo sapiens
ccatgggcactgtgggta

SEQ ID NO: 1289786 - DNA, 13 bp, Homo sapiens
cccaactccagaa

SEQ ID NO: 1289787 - DNA, 16 bp, Homo sapiens
cccttgatgaagaagt

SEQ ID NO: 1289788 - DNA, 20 bp, Homo sapiens
cctcagaaaacaaggatgaa

SEQ ID NO: 1289789 - DNA, 23 bp, Homo sapiens
cctggaaatcagggttagtattg

SEQ ID NO: 1289790 - DNA, 15 bp, Homo sapiens
cggtttatataagct

SEQ ID NO: 1289791 - DNA, 14 bp, Homo sapiens
ctacactaagagag

SEQ ID NO: 1289792 - DNA, 19 bp, Homo sapiens
ctaggaaatatttatttta

SEQ ID NO: 1289793 - DNA, 20 bp, Homo sapiens
ctaggaaatatttattttaa

SEQ ID NO: 1289794 - DNA, 20 bp, Homo sapiens
ctagtatttctatgaaatat

SEQ ID NO: 1289795 - DNA, 22 bp, Homo sapiens
ctagtatttctatgaaatatta

SEQ ID NO: 1289796 - DNA, 23 bp, Homo sapiens
ctagttgatcagcttattgtcta

SEQ ID NO: 1289797 - DNA, 18 bp, Homo sapiens
ctatattgtttgctaagc

SEQ ID NO: 1289798 - DNA, 18 bp, Homo sapiens
ctatgaaatattatgtta

SEQ ID NO: 1289799 - DNA, 19 bp, Homo sapiens
ctatgaaatattatgttaa

SEQ ID NO: 1289800 - DNA, 12 bp, Homo sapiens
ctcatttccaag

SEQ ID NO: 1289801 - DNA, 13 bp, Homo sapiens
ctcatttccaagc

SEQ ID NO: 1289802 - DNA, 21 bp, Homo sapiens
ctcatttccaagcaagtatta

SEQ ID NO: 1289803 - DNA, 14 bp, Homo sapiens
ctcgttaatttgta

SEQ ID NO: 1289804 - DNA, 14 bp, Homo sapiens
ctgaagaagatggt

SEQ ID NO: 1289805 - DNA, 17 bp, Homo sapiens
ctgactcttaagaagac

SEQ ID NO: 1289806 - DNA, 10 bp, Homo sapiens
ctgggacagg

SEQ ID NO: 1289807 - DNA, 20 bp, Homo sapiens
ctgtaagaaaatatcacttg

SEQ ID NO: 1289808 - DNA, 15 bp, Homo sapiens
ctgtatgattcccag

SEQ ID NO: 1289809 - DNA, 22 bp, Homo sapiens
ctgtattttaaaagaatgatta

SEQ ID NO: 1289810 - DNA, 19 bp, Homo sapiens
ctgttataatctttcacag

SEQ ID NO: 1289811 - DNA, 14 bp, Homo sapiens
ctgttttataattt

SEQ ID NO: 1289812 - DNA, 23 bp, Homo sapiens
cttaagaagactgcattatattt

SEQ ID NO: 1289813 - DNA, 22 bp, Homo sapiens
cttagatgcagttctgaagaag

SEQ ID NO: 1289814 - DNA, 19 bp, Homo sapiens
cttccagatcctggaaatc

SEQ ID NO: 1289815 - DNA, 13 bp, Homo sapiens
cttctttccacag

SEQ ID NO: 1289816 - DNA, 23 bp, Homo sapiens
cttgtcaataaaatccatacatt

SEQ ID NO: 1289817 - DNA, 16 bp, Homo sapiens
gaaacacaactatatt

SEQ ID NO: 1289818 - DNA, 16 bp, Homo sapiens
gaaatatttattttaa

SEQ ID NO: 1289819 - DNA, 24 bp, Homo sapiens
gaacagttacctctgcctcagaaa

SEQ ID NO: 1289820 - DNA, 14 bp, Homo sapiens
gaactgaaatcata

SEQ ID NO: 1289821 - DNA, 22 bp, Homo sapiens
gaacttccagatcctggaaatc

SEQ ID NO: 1289822 - DNA, 19 bp, Homo sapiens
gaagactgcattatattta

SEQ ID NO: 1289823 - DNA, 14 bp, Homo sapiens
gacacactgaagaa

SEQ ID NO: 1289824 - DNA, 17 bp, Homo sapiens
gacagtcacctcatgga

SEQ ID NO: 1289825 - DNA, 16 bp, Homo sapiens
gacatgggacatttgc

SEQ ID NO: 1289826 - DNA, 22 bp, Homo sapiens
gacatgggacatttgctcatgg

SEQ ID NO: 1289827 - DNA, 14 bp, Homo sapiens
gactcttaagaaga

SEQ ID NO: 1289828 - DNA, 14 bp, Homo sapiens
gactgcattatatt

SEQ ID NO: 1289829 - DNA, 16 bp, Homo sapiens
gactgcattatattta

SEQ ID NO: 1289830 - DNA, 22 bp, Homo sapiens
gactttttatggcactagtatt

SEQ ID NO: 1289831 - DNA, 17 bp, Homo sapiens
gagaatgagagacacac

SEQ ID NO: 1289832 - DNA, 14 bp, Homo sapiens
gagcagtcaggaaa

SEQ ID NO: 1289833 - DNA, 14 bp, Homo sapiens
gattaagtaatgat

SEQ ID NO: 1289834 - DNA, 16 bp, Homo sapiens
gcaaattgtcacagga

SEQ ID NO: 1289835 - DNA, 20 bp, Homo sapiens
gcaagtattagaataccaca

SEQ ID NO: 1289836 - DNA, 15 bp, Homo sapiens
gcacagcctcttaga

SEQ ID NO: 1289837 - DNA, 19 bp, Homo sapiens
gcactgtgggtagacacac

SEQ ID NO: 1289838 - DNA, 13 bp, Homo sapiens
gcagttctgaaga

SEQ ID NO: 1289839 - DNA, 14 bp, Homo sapiens
gcagttctgaagaa

SEQ ID NO: 1289840 - DNA, 19 bp, Homo sapiens
gccagattttcctgaaaac

SEQ ID NO: 1289841 - DNA, 22 bp, Homo sapiens
gccatgtgctagtaattggaaa

SEQ ID NO: 1289842 - DNA, 14 bp, Homo sapiens
gctaagcattccaa

SEQ ID NO: 1289843 - DNA, 16 bp, Homo sapiens
gctagatgtatgtact

SEQ ID NO: 1289844 - DNA, 21 bp, Homo sapiens
gctggaaaagtatgttagtgc

SEQ ID NO: 1289845 - DNA, 23 bp, Homo sapiens
gctggaaaagtatgttagtgcaa

SEQ ID NO: 1289846 - DNA, 15 bp, Homo sapiens
ggaaatatttatttt

SEQ ID NO: 1289847 - DNA, 19 bp, Homo sapiens
ggaaatcagggttagtatt

SEQ ID NO: 1289848 - DNA, 22 bp, Homo sapiens
ggaattggagctcgtgggacag

SEQ ID NO: 1289849 - DNA, 17 bp, Homo sapiens
ggacagtcacctcatgg

SEQ ID NO: 1289850 - DNA, 16 bp, Homo sapiens
ggacatttgctcatgg

SEQ ID NO: 1289851 - DNA, 23 bp, Homo sapiens
ggatggttcccttgatgaagaag

SEQ ID NO: 1289852 - DNA, 21 bp, Homo sapiens
gggacagtcacctcatggaat

SEQ ID NO: 1289853 - DNA, 19 bp, Homo sapiens
gggacatttgctcatggaa

SEQ ID NO: 1289854 - DNA, 19 bp, Homo sapiens
ggggaattgaggacactga

SEQ ID NO: 1289855 - DNA, 15 bp, Homo sapiens
gtaattggaaaggca

SEQ ID NO: 1289856 - DNA, 21 bp, Homo sapiens
gtacttcaaatccttgaagat

SEQ ID NO: 1289857 - DNA, 15 bp, Homo sapiens
gtagtgttggagaag

SEQ ID NO: 1289858 - DNA, 17 bp, Homo sapiens
gtagtgttggagaagaa

SEQ ID NO: 1289859 - DNA, 20 bp, Homo sapiens
gtagtgttggagaagaactg

SEQ ID NO: 1289860 - DNA, 22 bp, Homo sapiens
gtatttctatgaaatattatgt

SEQ ID NO: 1289861 - DNA, 17 bp, Homo sapiens
gtattttaaaagaatga

SEQ ID NO: 1289862 - DNA, 18 bp, Homo sapiens
gtattttaaaagaatgat

SEQ ID NO: 1289863 - DNA, 22 bp, Homo sapiens
gtcaataaaatccatacatttg

SEQ ID NO: 1289864 - DNA, 14 bp, Homo sapiens
gtcacctcatggaa

SEQ ID NO: 1289865 - DNA, 13 bp, Homo sapiens
gtcaggaaagaga

SEQ ID NO: 1289866 - DNA, 14 bp, Homo sapiens
gtcaggaaagagaa

SEQ ID NO: 1289867 - DNA, 16 bp, Homo sapiens
gtgagcagtcaggaaa

SEQ ID NO: 1289868 - DNA, 18 bp, Homo sapiens
gtgcaaattgtcacagga

SEQ ID NO: 1289869 - DNA, 18 bp, Homo sapiens
gttcccttgatgaagaag

SEQ ID NO: 1289870 - DNA, 13 bp, Homo sapiens
gttgacatgggac

SEQ ID NO: 1289871 - DNA, 21 bp, Homo sapiens
gttgatggtggtatgttttca

SEQ ID NO: 1289872 - DNA, 21 bp, Homo sapiens
gtttagctggaaaagtatgtt

SEQ ID NO: 1289873 - DNA, 15 bp, Homo sapiens
gttttataattttgt

SEQ ID NO: 1289874 - DNA, 16 bp, Homo sapiens
taaaaaagaaacattt

SEQ ID NO: 1289875 - DNA, 22 bp, Homo sapiens
taaaataatttttatatttgaa

SEQ ID NO: 1289876 - DNA, 15 bp, Homo sapiens
taaaatccatacatt

SEQ ID NO: 1289877 - DNA, 15 bp, Homo sapiens
taacaatgctgtatt

SEQ ID NO: 1289878 - DNA, 13 bp, Homo sapiens
taagagagaatga

SEQ ID NO: 1289879 - DNA, 14 bp, Homo sapiens
taagagagaatgag

SEQ ID NO: 1289880 - DNA, 23 bp, Homo sapiens
taagagagaatgagagacacact

SEQ ID NO: 1289881 - DNA, 18 bp, Homo sapiens
taagcattccaactatct

SEQ ID NO: 1289882 - DNA, 16 bp, Homo sapiens
taagcttgtattcctt

SEQ ID NO: 1289883 - DNA, 19 bp, Homo sapiens
taagtaatgataactggaa

SEQ ID NO: 1289884 - DNA, 18 bp, Homo sapiens
taagtttttttttaaaaa

SEQ ID NO: 1289885 - DNA, 15 bp, Homo sapiens
taataatgtttcaaa

SEQ ID NO: 1289886 - DNA, 23 bp, Homo sapiens
taatgataactggaaacttcagc

SEQ ID NO: 1289887 - DNA, 13 bp, Homo sapiens
taattttgtgaag

SEQ ID NO: 1289888 - DNA, 19 bp, Homo sapiens
taatttttatatttgaaat

SEQ ID NO: 1289889 - DNA, 20 bp, Homo sapiens
tacatcccttacctgggaaa

SEQ ID NO: 1289890 - DNA, 18 bp, Homo sapiens
taccaccagtctgactgt

SEQ ID NO: 1289891 - DNA, 13 bp, Homo sapiens
tagacacacatga

SEQ ID NO: 1289892 - DNA, 15 bp, Homo sapiens
tagatgcagttctga

SEQ ID NO: 1289893 - DNA, 20 bp, Homo sapiens
tagatgcagttctgaagaag

SEQ ID NO: 1289894 - DNA, 16 bp, Homo sapiens
tagtatttctatgaaa

SEQ ID NO: 1289895 - DNA, 18 bp, Homo sapiens
tagtatttctatgaaata

SEQ ID NO: 1289896 - DNA, 15 bp, Homo sapiens
tagtgcaaattgtca

SEQ ID NO: 1289897 - DNA, 16 bp, Homo sapiens
tagtgttggagaagaa

SEQ ID NO: 1289898 - DNA, 15 bp, Homo sapiens
tagttttatatgctt

SEQ ID NO: 1289899 - DNA, 22 bp, Homo sapiens
tataaaataatttttatatttg

SEQ ID NO: 1289900 - DNA, 13 bp, Homo sapiens
tttaataatgttt

SEQ ID NO: 1289901 - DNA, 12 bp, Homo sapiens
tttagaaacaca

SEQ ID NO: 1289902 - DNA, 17 bp, Homo sapiens
tttatatgcttctgttt

SEQ ID NO: 1289903 - DNA, 16 bp, Homo sapiens
tttcaaacatatataa

SEQ ID NO: 1289904 - DNA, 19 bp, Homo sapiens
tttcaaacatatataacaa

SEQ ID NO: 1289905 - DNA, 15 bp, Homo sapiens
tttccacagaagctc

SEQ ID NO: 1289906 - DNA, 12 bp, Homo sapiens
tttctctaggaa

SEQ ID NO: 1289907 - DNA, 13 bp, Homo sapiens
tttgctcatggaa

SEQ ID NO: 1289908 - DNA, 19 bp, Homo sapiens
tttgtagtgttggagaaga

SEQ ID NO: 1289909 - DNA, 14 bp, Homo sapiens
tttgtataaaataa

SEQ ID NO: 1289910 - DNA, 21 bp, Homo sapiens
tttgtataaaataatttttat

SEQ ID NO: 1289911 - DNA, 17 bp, Homo sapiens
tttgtgaagcaaaattt

SEQ ID NO: 1289912 - DNA, 13 bp, Homo sapiens
ttttaaaaaagaa

SEQ ID NO: 1289913 - DNA, 15 bp, Homo sapiens
ttttaaaagaatgat

SEQ ID NO: 1289914 - DNA, 12 bp, Homo sapiens
ttttaataatgt

SEQ ID NO: 1289915 - DNA, 13 bp, Homo sapiens
ttttaataatgtt

SEQ ID NO: 1289916 - DNA, 14 bp, Homo sapiens
ttttaataatgttt

SEQ ID NO: 1289917 - DNA, 16 bp, Homo sapiens
ttttaataatgtttca

SEQ ID NO: 1289918 - DNA, 20 bp, Homo sapiens
ttttatatgcttctgtttta

SEQ ID NO: 1289919 - DNA, 22 bp, Homo sapiens
ttttatggcactagtatttcta

SEQ ID NO: 1289920 - DNA, 14 bp, Homo sapiens
ttttgtgaagcaaa

SEQ ID NO: 1289921 - DNA, 18 bp, Homo sapiens
tttttaaaaaagaaacat

SEQ ID NO: 1289922 - DNA, 23 bp, Homo sapiens
ttttttaaaaaagaaacatttgg

SEQ ID NO: 1289923 - DNA, 14 bp, Homo sapiens
gggaattgaggaca

SEQ ID NO: 1289924 - DNA, 20 bp, Homo sapiens
gggacagtcacctcatggaa

SEQ ID NO: 1289925 - DNA, 22 bp, Homo sapiens
gggacagtcacctcatggaatt

SEQ ID NO: 1289926 - DNA, 23 bp, Homo sapiens
gtacactgccttctcaactccaa

SEQ ID NO: 1289927 - DNA, 22 bp, Homo sapiens
gtacttcaaatccttgaagatt

SEQ ID NO: 1289928 - DNA, 15 bp, Homo sapiens
gtataaaataatttt

SEQ ID NO: 1289929 - DNA, 21 bp, Homo sapiens
gtataaaataatttttatatt

SEQ ID NO: 1289930 - DNA, 17 bp, Homo sapiens
gtatgttagtgcaaatt

SEQ ID NO: 1289931 - DNA, 17 bp, Homo sapiens
gtatttctatgaaatat

SEQ ID NO: 1289932 - DNA, 16 bp, Homo sapiens
gtcaaattgtgtgaaa

SEQ ID NO: 1289933 - DNA, 21 bp, Homo sapiens
gtcaataaaatccatacattt

SEQ ID NO: 1289934 - DNA, 23 bp, Homo sapiens
gtctacactaagagagaatgaga

SEQ ID NO: 1289935 - DNA, 23 bp, Homo sapiens
gttacctctgcctcagaaaacaa

SEQ ID NO: 1289936 - DNA, 20 bp, Homo sapiens
gtttagctggaaaagtatgt

SEQ ID NO: 1289937 - DNA, 21 bp, Homo sapiens
gtttcaaacatatataacaat

SEQ ID NO: 1289938 - DNA, 12 bp, Homo sapiens
taaaagaatgat

SEQ ID NO: 1289939 - DNA, 20 bp, Homo sapiens
taaaataatttttatatttg

SEQ ID NO: 1289940 - DNA, 17 bp, Homo sapiens
taaaatccatacatttg

SEQ ID NO: 1289941 - DNA, 13 bp, Homo sapiens
taacaatgctgta

SEQ ID NO: 1289942 - DNA, 16 bp, Homo sapiens
taagcattccaactat

SEQ ID NO: 1289943 - DNA, 16 bp, Homo sapiens
taatgataactggaaa

SEQ ID NO: 1289944 - DNA, 22 bp, Homo sapiens
taatgataactggaaacttcag

SEQ ID NO: 1289945 - DNA, 23 bp, Homo sapiens
taatttgtagtgttggagaagaa

SEQ ID NO: 1289946 - DNA, 18 bp, Homo sapiens
taattttgtgaagcaaaa

SEQ ID NO: 1289947 - DNA, 16 bp, Homo sapiens
taatttttatatttga

SEQ ID NO: 1289948 - DNA, 17 bp, Homo sapiens
taatttttatatttgaa

SEQ ID NO: 1289949 - DNA, 18 bp, Homo sapiens
taatttttatatttgaaa

SEQ ID NO: 1289950 - DNA, 18 bp, Homo sapiens
tacactaagagagaatga

SEQ ID NO: 1289951 - DNA, 19 bp, Homo sapiens
tacactaagagagaatgag

SEQ ID NO: 1289952 - DNA, 11 bp, Homo sapiens
tacatttgtgt

SEQ ID NO: 1289953 - DNA, 23 bp, Homo sapiens
taccacaggaaccacaagactgc

SEQ ID NO: 1289954 - DNA, 14 bp, Homo sapiens
tactgtaagaaaat

SEQ ID NO: 1289955 - DNA, 16 bp, Homo sapiens
tacttcatgctgtcta

SEQ ID NO: 1289956 - DNA, 23 bp, Homo sapiens
tagaataccacaggaaccacaag

SEQ ID NO: 1289957 - DNA, 18 bp, Homo sapiens
tagagtttagctggaaaa

SEQ ID NO: 1289958 - DNA, 14 bp, Homo sapiens
tagataggccatgg

SEQ ID NO: 1289959 - DNA, 17 bp, Homo sapiens
tagatgcagttctgaag

SEQ ID NO: 1289960 - DNA, 20 bp, Homo sapiens
tagatgtatgtacttcatgc

SEQ ID NO: 1289961 - DNA, 13 bp, Homo sapiens
tagtcaaattgtg

SEQ ID NO: 1289962 - DNA, 18 bp, Homo sapiens
tagtcaaattgtgtgaaa

SEQ ID NO: 1289963 - DNA, 22 bp, Homo sapiens
tagtgagcagtcaggaaagaga

SEQ ID NO: 1289964 - DNA, 17 bp, Homo sapiens
tagtgttggagaagaac

SEQ ID NO: 1289965 - DNA, 23 bp, Homo sapiens
tagtgttggagaagaactgaaat

SEQ ID NO: 1289966 - DNA, 16 bp, Homo sapiens
tagttttatatgcttc

SEQ ID NO: 1289967 - DNA, 13 bp, Homo sapiens
tatataacaatgc

SEQ ID NO: 1289968 - DNA, 19 bp, Homo sapiens
tatataacaatgctgtatt

SEQ ID NO: 1289969 - DNA, 20 bp, Homo sapiens
tatatttattactgtaagaa

SEQ ID NO: 1289970 - DNA, 13 bp, Homo sapiens
tatatttgaaata

SEQ ID NO: 1289971 - DNA, 14 bp, Homo sapiens
tatatttgaaatat

SEQ ID NO: 1289972 - DNA, 12 bp, Homo sapiens
tatgttaaaact

SEQ ID NO: 1289973 - DNA, 21 bp, Homo sapiens
tatgttttcaggctagatgta

SEQ ID NO: 1289974 - DNA, 14 bp, Homo sapiens
tattactgtaagaa

SEQ ID NO: 1289975 - DNA, 18 bp, Homo sapiens
tatttattttaataatgt

SEQ ID NO: 1289976 - DNA, 15 bp, Homo sapiens
tatttctatgaaata

SEQ ID NO: 1289977 - DNA, 19 bp, Homo sapiens
tattttaataatgtttcaa

SEQ ID NO: 1289978 - DNA, 16 bp, Homo sapiens
tcaaatccttgaagat

SEQ ID NO: 1289979 - DNA, 18 bp, Homo sapiens
tcaaattgtgtgaaaggt

SEQ ID NO: 1289980 - DNA, 21 bp, Homo sapiens
tcaataaaatccatacatttg

SEQ ID NO: 1289981 - DNA, 13 bp, Homo sapiens
tcacctcatggaa

SEQ ID NO: 1289982 - DNA, 13 bp, Homo sapiens
tcaggaaagagaa

SEQ ID NO: 1289983 - DNA, 13 bp, Homo sapiens
tcaggctagatgt

SEQ ID NO: 1289984 - DNA, 16 bp, Homo sapiens
tcatgaattagtttta

SEQ ID NO: 1289985 - DNA, 23 bp, Homo sapiens
tccaaactgactcttaagaagac

SEQ ID NO: 1289986 - DNA, 21 bp, Homo sapiens
tccaactatctcatttccaag

SEQ ID NO: 1289987 - DNA, 20 bp, Homo sapiens
tccaagcatttagatgtata

SEQ ID NO: 1289988 - DNA, 19 bp, Homo sapiens
tccacagaagctccaggta

SEQ ID NO: 1289989 - DNA, 19 bp, Homo sapiens
tccaggtagagggtgtgta

SEQ ID NO: 1289990 - DNA, 12 bp, Homo sapiens
tccatacatttg

SEQ ID NO: 1289991 - DNA, 15 bp, Homo sapiens
tccatacatttgtgt

SEQ ID NO: 1289992 - DNA, 21 bp, Homo sapiens
tcgtggaacagttacctctgc

SEQ ID NO: 1289993 - DNA, 17 bp, Homo sapiens
tctacactaagagagaa

SEQ ID NO: 1289994 - DNA, 21 bp, Homo sapiens
tctacactaagagagaatgag

SEQ ID NO: 1289995 - DNA, 17 bp, Homo sapiens
tctaccaaaaatctcaa

SEQ ID NO: 1289996 - DNA, 17 bp, Homo sapiens
tctaggaaatatttatt

SEQ ID NO: 1289997 - DNA, 14 bp, Homo sapiens
tctatgaaatatta

SEQ ID NO: 1289998 - DNA, 15 bp, Homo sapiens
tctcatttccaagca

SEQ ID NO: 1289999 - DNA, 22 bp, Homo sapiens
tgaagtccaagcatttagatgt

SEQ ID NO: 1290000 - DNA, 13 bp, Homo sapiens
tgaattacatttg

SEQ ID NO: 1290001 - DNA, 16 bp, Homo sapiens
tgaattacatttgtat

SEQ ID NO: 1290002 - DNA, 15 bp, Homo sapiens
tgacaagctcacaga

SEQ ID NO: 1290003 - DNA, 16 bp, Homo sapiens
tgacatgggacatttg

SEQ ID NO: 1290004 - DNA, 20 bp, Homo sapiens
tgagagacacactgaagaag

SEQ ID NO: 1290005 - DNA, 15 bp, Homo sapiens
tgagcagtcaggaaa

SEQ ID NO: 1290006 - DNA, 17 bp, Homo sapiens
tgagcagtcaggaaaga

SEQ ID NO: 1290007 - DNA, 12 bp, Homo sapiens
tgatatgggtct

SEQ ID NO: 1290008 - DNA, 16 bp, Homo sapiens
tgattaagtaatgata

SEQ ID NO: 1290009 - DNA, 21 bp, Homo sapiens
tgattatgaattacatttgta

SEQ ID NO: 1290010 - DNA, 15 bp, Homo sapiens
tgcaagccagatttt

SEQ ID NO: 1290011 - DNA, 15 bp, Homo sapiens
tgcagttctgaagaa

SEQ ID NO: 1290012 - DNA, 15 bp, Homo sapiens
tgccttctcaactcc

SEQ ID NO: 1290013 - DNA, 17 bp, Homo sapiens
tgccttctcaactccaa

SEQ ID NO: 1290014 - DNA, 19 bp, Homo sapiens
tgctaagcattccaactat

SEQ ID NO: 1290015 - DNA, 16 bp, Homo sapiens
tgctagtaattggaaa

SEQ ID NO: 1290016 - DNA, 17 bp, Homo sapiens
tgcttctgttttataat

SEQ ID NO: 1290017 - DNA, 22 bp, Homo sapiens
tggaaaagtatgttagtgcaaa

SEQ ID NO: 1290018 - DNA, 13 bp, Homo sapiens
tggaaaggcagct

SEQ ID NO: 1290019 - DNA, 17 bp, Homo sapiens
tggagctcgtggaacag

SEQ ID NO: 1290020 - DNA, 21 bp, Homo sapiens
tggagctcgtgggacagtcac

SEQ ID NO: 1290021 - DNA, 14 bp, Homo sapiens
tgggtagacacaca

SEQ ID NO: 1290022 - DNA, 20 bp, Homo sapiens
tggttcccttgatgaagaag

SEQ ID NO: 1290023 - DNA, 18 bp, Homo sapiens
tgtaagaaaatatcactt

SEQ ID NO: 1290024 - DNA, 20 bp, Homo sapiens
tgtagtgttggagaagaact

SEQ ID NO: 1290025 - DNA, 19 bp, Homo sapiens
tgtattttaaaagaatgat

SEQ ID NO: 1290026 - DNA, 20 bp, Homo sapiens
tgtcaatcagcctagttgat

SEQ ID NO: 1290027 - DNA, 14 bp, Homo sapiens
tgtgaagcaaaatt

SEQ ID NO: 1290028 - DNA, 21 bp, Homo sapiens
tgtgtgaaaggtacttcaaat

SEQ ID NO: 1290029 - DNA, 22 bp, Homo sapiens
tgtgtgaaaggtacttcaaatc

SEQ ID NO: 1290030 - DNA, 13 bp, Homo sapiens
tgtgttttgcaag

SEQ ID NO: 1290031 - DNA, 12 bp, Homo sapiens
tgttataatctt

SEQ ID NO: 1290032 - DNA, 20 bp, Homo sapiens
tgttgacatgggacatttgc

SEQ ID NO: 1290033 - DNA, 16 bp, Homo sapiens
tgttggagaagaactg

SEQ ID NO: 1290034 - DNA, 21 bp, Homo sapiens
tgttggagaagaactgaaatc

SEQ ID NO: 1290035 - DNA, 13 bp, Homo sapiens
tgtttcaaacata

SEQ ID NO: 1290036 - DNA, 15 bp, Homo sapiens
tgtttgctaagcatt

SEQ ID NO: 1290037 - DNA, 19 bp, Homo sapiens
tgtttgctaagcattccaa

SEQ ID NO: 1290038 - DNA, 14 bp, Homo sapiens
tgttttgcaagcca

SEQ ID NO: 1290039 - DNA, 21 bp, Homo sapiens
ttaccacttgtgttttgcaag

SEQ ID NO: 1290040 - DNA, 20 bp, Homo sapiens
ttagatgcagttctgaagaa

SEQ ID NO: 1290041 - DNA, 15 bp, Homo sapiens
ttataattttgtgaa

SEQ ID NO: 1290042 - DNA, 17 bp, Homo sapiens
ttataattttgtgaagc

SEQ ID NO: 1290043 - DNA, 18 bp, Homo sapiens
ttataattttgtgaagca

SEQ ID NO: 1290044 - DNA, 12 bp, Homo sapiens
ttatatttgaaa

SEQ ID NO: 1290045 - DNA, 19 bp, Homo sapiens
ttatgattaagtaatgata

SEQ ID NO: 1290046 - DNA, 15 bp, Homo sapiens
ttattgtctagtgaa

SEQ ID NO: 1290047 - DNA, 16 bp, Homo sapiens
ttattttaataatgtt

SEQ ID NO: 1290048 - DNA, 14 bp, Homo sapiens
ttcaaacatatata

SEQ ID NO: 1290049 - DNA, 15 bp, Homo sapiens
ttcaaacatatataa

SEQ ID NO: 1290050 - DNA, 18 bp, Homo sapiens
ttccagatcctggaaatc

SEQ ID NO: 1290051 - DNA, 17 bp, Homo sapiens
ttcccttgatgaagaag

SEQ ID NO: 1290052 - DNA, 14 bp, Homo sapiens
ttctcaactccaaa

SEQ ID NO: 1290053 - DNA, 16 bp, Homo sapiens
ttctgttttataattt

SEQ ID NO: 1290054 - DNA, 17 bp, Homo sapiens
ttctgttttataatttt

SEQ ID NO: 1290055 - DNA, 19 bp, Homo sapiens
ttcttagggttatgattaa

SEQ ID NO: 1290056 - DNA, 14 bp, Homo sapiens
ttgatgaagaagtt

SEQ ID NO: 1290057 - DNA, 18 bp, Homo sapiens
ttgatggtggtatgtttt

SEQ ID NO: 1290058 - DNA, 16 bp, Homo sapiens
ttgctaagcattccaa

SEQ ID NO: 1290059 - DNA, 11 bp, Homo sapiens
ttgctcatgga

SEQ ID NO: 1290060 - DNA, 12 bp, Homo sapiens
ttgctcatggaa

SEQ ID NO: 1290061 - DNA, 16 bp, Homo sapiens
ttgtataaaataattt

SEQ ID NO: 1290062 - DNA, 20 bp, Homo sapiens
ttgtcaataaaatccataca

SEQ ID NO: 1290063 - DNA, 15 bp, Homo sapiens
tttaataatgtttca

SEQ ID NO: 1290064 - DNA, 20 bp, Homo sapiens
tttagaaacacaactatatt

SEQ ID NO: 1290065 - DNA, 17 bp, Homo sapiens
tttatggcactagtatt

SEQ ID NO: 1290066 - DNA, 16 bp, Homo sapiens
tttattttaataatgt

SEQ ID NO: 1290067 - DNA, 17 bp, Homo sapiens
tttcaaacatatataac

SEQ ID NO: 1290068 - DNA, 21 bp, Homo sapiens
tttcagataatcacaatacat

SEQ ID NO: 1290069 - DNA, 11 bp, Homo sapiens
tttgctcatgg

SEQ ID NO: 1290070 - DNA, 12 bp, Homo sapiens
tttgctcatgga

SEQ ID NO: 1290071 - DNA, 13 bp, Homo sapiens
tttgtataaaata

SEQ ID NO: 1290072 - DNA, 16 bp, Homo sapiens
tttgtataaaataatt

SEQ ID NO: 1290073 - DNA, 19 bp, Homo sapiens
tttgtataaaataattttt

SEQ ID NO: 1290074 - DNA, 14 bp, Homo sapiens
ttttataattttgt

SEQ ID NO: 1290075 - DNA, 10 bp, Homo sapiens
ttttatattt

SEQ ID NO: 1290076 - DNA, 13 bp, Homo sapiens
ttttatatttgaa

SEQ ID NO: 1290077 - DNA, 18 bp, Homo sapiens
ttttatatttgaaatatt

SEQ ID NO: 1290078 - DNA, 19 bp, Homo sapiens
ttttatggcactagtattt

SEQ ID NO: 1290079 - DNA, 20 bp, Homo sapiens
ttttcaggctagatgtatgt

SEQ ID NO: 1290080 - DNA, 13 bp, Homo sapiens
ttttcctgaaaac

SEQ ID NO: 1290081 - DNA, 14 bp, Homo sapiens
ttttcctgaaaacc

SEQ ID NO: 1290082 - DNA, 19 bp, Homo sapiens
tttttatatttgaaatatt

SEQ ID NO: 1290083 - DNA, 22 bp, Homo sapiens
actgccttctcaactccaaact

SEQ ID NO: 1290084 - DNA, 13 bp, Homo sapiens
actgtaagaaaat

SEQ ID NO: 1290085 - DNA, 13 bp, Homo sapiens
actgtgggtagac

SEQ ID NO: 1290086 - DNA, 18 bp, Homo sapiens
actgtgggtagacacaca

SEQ ID NO: 1290087 - DNA, 18 bp, Homo sapiens
acttcaaatccttgaaga

SEQ ID NO: 1290088 - DNA, 19 bp, Homo sapiens
acttcaaatccttgaagat

SEQ ID NO: 1290089 - DNA, 20 bp, Homo sapiens
acttcaaatccttgaagatt

SEQ ID NO: 1290090 - DNA, 17 bp, Homo sapiens
acttcagcggtttatat

SEQ ID NO: 1290091 - DNA, 16 bp, Homo sapiens
acttgtcaataaaatc

SEQ ID NO: 1290092 - DNA, 15 bp, Homo sapiens
agaaacatttggtaa

SEQ ID NO: 1290093 - DNA, 21 bp, Homo sapiens
agaagactgcattatatttat

SEQ ID NO: 1290094 - DNA, 14 bp, Homo sapiens
agaagctccaggta

SEQ ID NO: 1290095 - DNA, 22 bp, Homo sapiens
agaatgagagacacactgaaga

SEQ ID NO: 1290096 - DNA, 17 bp, Homo sapiens
agagacacactgaagaa

SEQ ID NO: 1290097 - DNA, 18 bp, Homo sapiens
agatgcagttctgaagaa

SEQ ID NO: 1290098 - DNA, 20 bp, Homo sapiens
agatgcagttctgaagaaga

SEQ ID NO: 1290099 - DNA, 21 bp, Homo sapiens
agatgcagttctgaagaagat

SEQ ID NO: 1290100 - DNA, 22 bp, Homo sapiens
agatgtatgtacttcatgctgt

SEQ ID NO: 1290101 - DNA, 16 bp, Homo sapiens
agatttaccacttgtg

SEQ ID NO: 1290102 - DNA, 24 bp, Homo sapiens
agcaaaattttttctctaggaaat

SEQ ID NO: 1290103 - DNA, 17 bp, Homo sapiens
agcagtcaggaaagaga

SEQ ID NO: 1290104 - DNA, 14 bp, Homo sapiens
agctgtatgattcc

SEQ ID NO: 1290105 - DNA, 17 bp, Homo sapiens
agctgtatgattcccag

SEQ ID NO: 1290106 - DNA, 18 bp, Homo sapiens
agctgtatgattcccagc

SEQ ID NO: 1290107 - DNA, 21 bp, Homo sapiens
agcttattgtctagtgaaact

SEQ ID NO: 1290108 - DNA, 17 bp, Homo sapiens
aggacactgatatgggt

SEQ ID NO: 1290109 - DNA, 23 bp, Homo sapiens
aggacagcccttctttccacaga

SEQ ID NO: 1290110 - DNA, 21 bp, Homo sapiens
aggccatgggcactgtgggta

SEQ ID NO: 1290111 - DNA, 16 bp, Homo sapiens
aggctagatgtatgta

SEQ ID NO: 1290112 - DNA, 22 bp, Homo sapiens
agggctgttataatctttcaca

SEQ ID NO: 1290113 - DNA, 12 bp, Homo sapiens
agtaattggaaa

SEQ ID NO: 1290114 - DNA, 19 bp, Homo sapiens
agtagataggccatgggca

SEQ ID NO: 1290115 - DNA, 21 bp, Homo sapiens
agtatgttagtgcaaattgtc

SEQ ID NO: 1290116 - DNA, 16 bp, Homo sapiens
agtatttctatgaaat

SEQ ID NO: 1290117 - DNA, 13 bp, Homo sapiens
agtcaaattgtgt

SEQ ID NO: 1290118 - DNA, 17 bp, Homo sapiens
agtcacctcatggaatt

SEQ ID NO: 1290119 - DNA, 20 bp, Homo sapiens
agtgaaactcgttaatttgt

SEQ ID NO: 1290120 - DNA, 14 bp, Homo sapiens
agtgcaaattgtca

SEQ ID NO: 1290121 - DNA, 18 bp, Homo sapiens
agtgcaaattgtcacagg

SEQ ID NO: 1290122 - DNA, 23 bp, Homo sapiens
agtgttggagaagaactgaaatc

SEQ ID NO: 1290123 - DNA, 12 bp, Homo sapiens
ataaaataattt

SEQ ID NO: 1290124 - DNA, 15 bp, Homo sapiens
ataaaataattttta

SEQ ID NO: 1290125 - DNA, 21 bp, Homo sapiens
ataaaataatttttatatttg

SEQ ID NO: 1290126 - DNA, 15 bp, Homo sapiens
ataacaatgctgtat

SEQ ID NO: 1290127 - DNA, 19 bp, Homo sapiens
ataacaatgctgtatttta

SEQ ID NO: 1290128 - DNA, 21 bp, Homo sapiens
ataacaatgctgtattttaaa

SEQ ID NO: 1290129 - DNA, 12 bp, Homo sapiens
ataactggaaac

SEQ ID NO: 1290130 - DNA, 23 bp, Homo sapiens
ataatgtttcaaacatatataac

SEQ ID NO: 1290131 - DNA, 19 bp, Homo sapiens
ataatttttatatttgaaa

SEQ ID NO: 1290132 - DNA, 18 bp, Homo sapiens
atagtcaaattgtgtgaa

SEQ ID NO: 1290133 - DNA, 17 bp, Homo sapiens
atataacaatgctgtat

SEQ ID NO: 1290134 - DNA, 17 bp, Homo sapiens
atatataacaatgctgt

SEQ ID NO: 1290135 - DNA, 13 bp, Homo sapiens
atatttgaaatat

SEQ ID NO: 1290136 - DNA, 23 bp, Homo sapiens
atatttgaaatattgacttttta

SEQ ID NO: 1290137 - DNA, 16 bp, Homo sapiens
atcaagggtacactgc

SEQ ID NO: 1290138 - DNA, 21 bp, Homo sapiens
atcaagggtacactgccttct

SEQ ID NO: 1290139 - DNA, 13 bp, Homo sapiens
atcagcttattgt

SEQ ID NO: 1290140 - DNA, 21 bp, Homo sapiens
atcatgaattagttttatatg

SEQ ID NO: 1290141 - DNA, 13 bp, Homo sapiens
atgaaatattatg

SEQ ID NO: 1290142 - DNA, 20 bp, Homo sapiens
atgaaatattatgttaaaac

SEQ ID NO: 1290143 - DNA, 15 bp, Homo sapiens
atgaattacatttgt

SEQ ID NO: 1290144 - DNA, 13 bp, Homo sapiens
atgagagacacac

SEQ ID NO: 1290145 - DNA, 20 bp, Homo sapiens
atgagagacacactgaagaa

SEQ ID NO: 1290146 - DNA, 17 bp, Homo sapiens
atgcagttctgaagaag

SEQ ID NO: 1290147 - DNA, 20 bp, Homo sapiens
atgccttttcccaactccag

SEQ ID NO: 1290148 - DNA, 23 bp, Homo sapiens
atggaattggagctcgtgggaca

SEQ ID NO: 1290149 - DNA, 19 bp, Homo sapiens
atgtgctagtaattggaaa

SEQ ID NO: 1290150 - DNA, 21 bp, Homo sapiens
atgtgctagtaattggaaagg

SEQ ID NO: 1290151 - DNA, 15 bp, Homo sapiens
atgttgacatgggac

SEQ ID NO: 1290152 - DNA, 21 bp, Homo sapiens
atgtttcaaacatatataaca

SEQ ID NO: 1290153 - DNA, 15 bp, Homo sapiens
attaagtaatgataa

SEQ ID NO: 1290154 - DNA, 15 bp, Homo sapiens
attacatttgtataa

SEQ ID NO: 1290155 - DNA, 18 bp, Homo sapiens
attacatttgtataaaat

SEQ ID NO: 1290156 - DNA, 14 bp, Homo sapiens
atttctatgaaata

SEQ ID NO: 1290157 - DNA, 14 bp, Homo sapiens
atttgctcatggaa

SEQ ID NO: 1290158 - DNA, 15 bp, Homo sapiens
atttgtataaaataa

SEQ ID NO: 1290159 - DNA, 19 bp, Homo sapiens
atttgtataaaataatttt

SEQ ID NO: 1290160 - DNA, 17 bp, Homo sapiens
attttaaaagaatgatt

SEQ ID NO: 1290161 - DNA, 16 bp, Homo sapiens
attttaataatgtttc

SEQ ID NO: 1290162 - DNA, 18 bp, Homo sapiens
attttaataatgtttcaa

SEQ ID NO: 1290163 - DNA, 19 bp, Homo sapiens
attttaataatgtttcaaa

SEQ ID NO: 1290164 - DNA, 13 bp, Homo sapiens
attttcctgaaaa

SEQ ID NO: 1290165 - DNA, 20 bp, Homo sapiens
attttttctctaggaaatat

SEQ ID NO: 1290166 - DNA, 19 bp, Homo sapiens
caaaaatctcaatatttca

SEQ ID NO: 1290167 - DNA, 16 bp, Homo sapiens
caaaattttttctcta

SEQ ID NO: 1290168 - DNA, 22 bp, Homo sapiens
caaaattttttctctaggaaat

SEQ ID NO: 1290169 - DNA, 19 bp, Homo sapiens
caactatattgtttgctaa

SEQ ID NO: 1290170 - DNA, 21 bp, Homo sapiens
caactatctcatttccaagca

SEQ ID NO: 1290171 - DNA, 19 bp, Homo sapiens
caagactgcacatcaaaat

SEQ ID NO: 1290172 - DNA, 16 bp, Homo sapiens
caagcatttagatgta

SEQ ID NO: 1290173 - DNA, 14 bp, Homo sapiens
caatgctgtatttt

SEQ ID NO: 1290174 - DNA, 23 bp, Homo sapiens
caatgctgtattttaaaagaatg

SEQ ID NO: 1290175 - DNA, 13 bp, Homo sapiens
cacaactatattg

SEQ ID NO: 1290176 - DNA, 18 bp, Homo sapiens
cacaagactgcacatcaa

SEQ ID NO: 1290177 - DNA, 17 bp, Homo sapiens
cacacatgaagtccaag

SEQ ID NO: 1290178 - DNA, 21 bp, Homo sapiens
cacagcctcttagatgcagtt

SEQ ID NO: 1290179 - DNA, 11 bp, Homo sapiens
cacctcatgga

SEQ ID NO: 1290180 - DNA, 17 bp, Homo sapiens
cacttgtgttttgcaag

SEQ ID NO: 1290181 - DNA, 19 bp, Homo sapiens
cacttgtgttttgcaagcc

SEQ ID NO: 1290182 - DNA, 22 bp, Homo sapiens
cacttgtgttttgcaagccaga

SEQ ID NO: 1290183 - DNA, 14 bp, Homo sapiens
cagatcctggaaat

SEQ ID NO: 1290184 - DNA, 15 bp, Homo sapiens
cagcccttctttcca

SEQ ID NO: 1290185 - DNA, 19 bp, Homo sapiens
cagctgtatgattcccagc

SEQ ID NO: 1290186 - DNA, 24 bp, Homo sapiens
caggacagcccttctttccacaga

SEQ ID NO: 1290187 - DNA, 18 bp, Homo sapiens
cagtcaggaaagagaact

SEQ ID NO: 1290188 - DNA, 20 bp, Homo sapiens
cagtctgactgtttccatca

SEQ ID NO: 1290189 - DNA, 12 bp, Homo sapiens
cagttctgaaga

SEQ ID NO: 1290190 - DNA, 13 bp, Homo sapiens
cagttctgaagaa

SEQ ID NO: 1290191 - DNA, 15 bp, Homo sapiens
catatataacaatgc

SEQ ID NO: 1290192 - DNA, 14 bp, Homo sapiens
catgatgtttagaa

SEQ ID NO: 1290193 - DNA, 23 bp, Homo sapiens
catgctgtctacactaagagaga

SEQ ID NO: 1290194 - DNA, 16 bp, Homo sapiens
catttgctcatggaat

SEQ ID NO: 1290195 - DNA, 14 bp, Homo sapiens
catttgtataaaat

SEQ ID NO: 1290196 - DNA, 19 bp, Homo sapiens
catttgtataaaataattt

SEQ ID NO: 1290197 - DNA, 21 bp, Homo sapiens
ccaactccagaaagtgacaag

SEQ ID NO: 1290198 - DNA, 14 bp, Homo sapiens
ccaagcaagtatta

SEQ ID NO: 1290199 - DNA, 13 bp, Homo sapiens
tatatgcttctgt

SEQ ID NO: 1290200 - DNA, 15 bp, Homo sapiens
tatattgtttgctaa

SEQ ID NO: 1290201 - DNA, 20 bp, Homo sapiens
tatatttgaaatattgactt

SEQ ID NO: 1290202 - DNA, 15 bp, Homo sapiens
tatgcttctgtttta

SEQ ID NO: 1290203 - DNA, 16 bp, Homo sapiens
tatgcttctgttttat

SEQ ID NO: 1290204 - DNA, 13 bp, Homo sapiens
tatgtacttcatg

SEQ ID NO: 1290205 - DNA, 19 bp, Homo sapiens
tatgttagtgcaaattgtc

SEQ ID NO: 1290206 - DNA, 17 bp, Homo sapiens
tattgtctagtgaaact

SEQ ID NO: 1290207 - DNA, 14 bp, Homo sapiens
tatttattttaata

SEQ ID NO: 1290208 - DNA, 18 bp, Homo sapiens
tattttaaaagaatgatt

SEQ ID NO: 1290209 - DNA, 22 bp, Homo sapiens
tattttaataatgtttcaaaca

SEQ ID NO: 1290210 - DNA, 14 bp, Homo sapiens
tcaaattgtgtgaa

SEQ ID NO: 1290211 - DNA, 19 bp, Homo sapiens
tcaactccaaactgactct

SEQ ID NO: 1290212 - DNA, 19 bp, Homo sapiens
tcaatatttcagataatca

SEQ ID NO: 1290213 - DNA, 23 bp, Homo sapiens
tcacaggacagcccttctttcca

SEQ ID NO: 1290214 - DNA, 17 bp, Homo sapiens
tcacttgtcaataaaat

SEQ ID NO: 1290215 - DNA, 21 bp, Homo sapiens
tcatgaattagttttatatgc

SEQ ID NO: 1290216 - DNA, 22 bp, Homo sapiens
tcatgaattagttttatatgct

SEQ ID NO: 1290217 - DNA, 19 bp, Homo sapiens
tcatggaattggagctcgt

SEQ ID NO: 1290218 - DNA, 21 bp, Homo sapiens
tcatggaattggagctcgtgg

SEQ ID NO: 1290219 - DNA, 17 bp, Homo sapiens
tccaagcatttagatgt

SEQ ID NO: 1290220 - DNA, 14 bp, Homo sapiens
tccagatcctggaa

SEQ ID NO: 1290221 - DNA, 16 bp, Homo sapiens
tccagatcctggaaat

SEQ ID NO: 1290222 - DNA, 15 bp, Homo sapiens
tcccttgatgaagaa

SEQ ID NO: 1290223 - DNA, 21 bp, Homo sapiens
tcctgaaaacccttgccatgt

SEQ ID NO: 1290224 - DNA, 22 bp, Homo sapiens
tcgtgggacagtcacctcatgg

SEQ ID NO: 1290225 - DNA, 13 bp, Homo sapiens
tcgttaatttgta

SEQ ID NO: 1290226 - DNA, 16 bp, Homo sapiens
tctaggaaatatttat

SEQ ID NO: 1290227 - DNA, 17 bp, Homo sapiens
tctatgaaatattatgt

SEQ ID NO: 1290228 - DNA, 19 bp, Homo sapiens
tctctaggaaatatttatt

SEQ ID NO: 1290229 - DNA, 12 bp, Homo sapiens
tctgaagaagat

SEQ ID NO: 1290230 - DNA, 18 bp, Homo sapiens
tcttaagaagactgcatt

SEQ ID NO: 1290231 - DNA, 22 bp, Homo sapiens
tcttagatgcagttctgaagaa

SEQ ID NO: 1290232 - DNA, 19 bp, Homo sapiens
tctttccacagaagctcca

SEQ ID NO: 1290233 - DNA, 19 bp, Homo sapiens
tgaaactcgttaatttgta

SEQ ID NO: 1290234 - DNA, 15 bp, Homo sapiens
tgaaaggtacttcaa

SEQ ID NO: 1290235 - DNA, 16 bp, Homo sapiens
tgaaaggtacttcaaa

SEQ ID NO: 1290236 - DNA, 16 bp, Homo sapiens
tgaaatattgactttt

SEQ ID NO: 1290237 - DNA, 22 bp, Homo sapiens
tgaagaagcaccaatcatgaat

SEQ ID NO: 1290238 - DNA, 17 bp, Homo sapiens
tgaagatttaccacttg

SEQ ID NO: 1290239 - DNA, 11 bp, Homo sapiens
tgaagtccaag

SEQ ID NO: 1290240 - DNA, 13 bp, Homo sapiens
tgaagtccaagca

SEQ ID NO: 1290241 - DNA, 14 bp, Homo sapiens
tgaattaagttttt

SEQ ID NO: 1290242 - DNA, 14 bp, Homo sapiens
tgaattacatttgt

SEQ ID NO: 1290243 - DNA, 12 bp, Homo sapiens
tgacaagctcac

SEQ ID NO: 1290244 - DNA, 17 bp, Homo sapiens
tgacatgggacatttgc

SEQ ID NO: 1290245 - DNA, 18 bp, Homo sapiens
tgacatgggacatttgct

SEQ ID NO: 1290246 - DNA, 12 bp, Homo sapiens
tgactcttaaga

SEQ ID NO: 1290247 - DNA, 13 bp, Homo sapiens
tgactcttaagaa

SEQ ID NO: 1290248 - DNA, 15 bp, Homo sapiens
tgactgtttccatca

SEQ ID NO: 1290249 - DNA, 20 bp, Homo sapiens
tgagcagtcaggaaagagaa

SEQ ID NO: 1290250 - DNA, 16 bp, Homo sapiens
tgataactggaaactt

SEQ ID NO: 1290251 - DNA, 17 bp, Homo sapiens
tgatcagcttattgtct

SEQ ID NO: 1290252 - DNA, 17 bp, Homo sapiens
tgatgaagaagttgata

SEQ ID NO: 1290253 - DNA, 21 bp, Homo sapiens
tgcaagccagattttcctgaa

SEQ ID NO: 1290254 - DNA, 12 bp, Homo sapiens
tgcagttctgaa

SEQ ID NO: 1290255 - DNA, 14 bp, Homo sapiens
tgcagttctgaaga

SEQ ID NO: 1290256 - DNA, 19 bp, Homo sapiens
tgcagttctgaagaagatg

SEQ ID NO: 1290257 - DNA, 14 bp, Homo sapiens
tgcattatatttat

SEQ ID NO: 1290258 - DNA, 15 bp, Homo sapiens
tgcattatatttatt

SEQ ID NO: 1290259 - DNA, 18 bp, Homo sapiens
tgcctcagaaaacaagga

SEQ ID NO: 1290260 - DNA, 15 bp, Homo sapiens
tgctaagcattccaa

SEQ ID NO: 1290261 - DNA, 23 bp, Homo sapiens
tgctgtattttaaaagaatgatt

SEQ ID NO: 1290262 - DNA, 18 bp, Homo sapiens
tggaattggagctcgtgg

SEQ ID NO: 1290263 - DNA, 13 bp, Homo sapiens
tggagaagaactg

SEQ ID NO: 1290264 - DNA, 21 bp, Homo sapiens
tggagctcgtggaacagttac

SEQ ID NO: 1290265 - DNA, 11 bp, Homo sapiens
tggagggaagc

SEQ ID NO: 1290266 - DNA, 18 bp, Homo sapiens
tgggacagtcacctcatg

SEQ ID NO: 1290267 - DNA, 20 bp, Homo sapiens
tgggacagtcacctcatgga

SEQ ID NO: 1290268 - DNA, 21 bp, Homo sapiens
tgggacagtcacctcatggaa

SEQ ID NO: 1290269 - DNA, 19 bp, Homo sapiens
tgggacatttgctcatgga

SEQ ID NO: 1290270 - DNA, 21 bp, Homo sapiens
tggtatgttttcaggctagat

SEQ ID NO: 1290271 - DNA, 17 bp, Homo sapiens
tggttcccttgatgaag

SEQ ID NO: 1290272 - DNA, 17 bp, Homo sapiens
tgtaagaaaatatcact

SEQ ID NO: 1290273 - DNA, 15 bp, Homo sapiens
tgtagtgttggagaa

SEQ ID NO: 1290274 - DNA, 19 bp, Homo sapiens
tgtagtgttggagaagaac

SEQ ID NO: 1290275 - DNA, 21 bp, Homo sapiens
tgtagtgttggagaagaactg

SEQ ID NO: 1290276 - DNA, 22 bp, Homo sapiens
tgtagtgttggagaagaactga

SEQ ID NO: 1290277 - DNA, 15 bp, Homo sapiens
tgtatgattcccagc

SEQ ID NO: 1290278 - DNA, 17 bp, Homo sapiens
tgtctacactaagagag

SEQ ID NO: 1290279 - DNA, 22 bp, Homo sapiens
tgtctacactaagagagaatga

SEQ ID NO: 1290280 - DNA, 19 bp, Homo sapiens
tgtgctagtaattggaaag

SEQ ID NO: 1290281 - DNA, 15 bp, Homo sapiens
tgttataatctttca

SEQ ID NO: 1290282 - DNA, 17 bp, Homo sapiens
tgttggagaagaactga

SEQ ID NO: 1290283 - DNA, 19 bp, Homo sapiens
tgttggagaagaactgaaa

SEQ ID NO: 1290284 - DNA, 19 bp, Homo sapiens
tgtttcaaacatatataac

SEQ ID NO: 1290285 - DNA, 13 bp, Homo sapiens
tgttttataattt

SEQ ID NO: 1290286 - DNA, 13 bp, Homo sapiens
ttaaaagaatgat

SEQ ID NO: 1290287 - DNA, 18 bp, Homo sapiens
ttaataatgtttcaaaca

SEQ ID NO: 1290288 - DNA, 15 bp, Homo sapiens
ttacatttgtataaa

SEQ ID NO: 1290289 - DNA, 20 bp, Homo sapiens
ttacatttgtataaaataat

SEQ ID NO: 1290290 - DNA, 22 bp, Homo sapiens
ttagatgcagttctgaagaaga

SEQ ID NO: 1290291 - DNA, 14 bp, Homo sapiens
ttagggttatgatt

SEQ ID NO: 1290292 - DNA, 19 bp, Homo sapiens
ttatatttgaaatattgac

SEQ ID NO: 1290293 - DNA, 14 bp, Homo sapiens
ttatgaattacatt

SEQ ID NO: 1290294 - DNA, 16 bp, Homo sapiens
ttattactgtaagaaa

SEQ ID NO: 1290295 - DNA, 17 bp, Homo sapiens
ttattactgtaagaaaa

SEQ ID NO: 1290296 - DNA, 19 bp, Homo sapiens
ttattttaataatgtttca

SEQ ID NO: 1290297 - DNA, 20 bp, Homo sapiens
ttattttaataatgtttcaa

SEQ ID NO: 1290298 - DNA, 20 bp, Homo sapiens
ttcagataatcacaatacat

SEQ ID NO: 1290299 - DNA, 17 bp, Homo sapiens
ttcagcggtttatataa

SEQ ID NO: 1290300 - DNA, 19 bp, Homo sapiens
ttccagatcctggaaatca

SEQ ID NO: 1290301 - DNA, 18 bp, Homo sapiens
ttcccaactccagaaagt

SEQ ID NO: 1290302 - DNA, 14 bp, Homo sapiens
aaaacaaggatgaa

SEQ ID NO: 1290303 - DNA, 17 bp, Homo sapiens
aaaacaaggatgaatta

SEQ ID NO: 1290304 - DNA, 19 bp, Homo sapiens
aaaagtatgttagtgcaaa

SEQ ID NO: 1290305 - DNA, 19 bp, Homo sapiens
aaaatccatacatttgtgt

SEQ ID NO: 1290306 - DNA, 22 bp, Homo sapiens
aaaattttttctctaggaaata

SEQ ID NO: 1290307 - DNA, 17 bp, Homo sapiens
aaacaaggatgaattaa

SEQ ID NO: 1290308 - DNA, 13 bp, Homo sapiens
aaacatatataac

SEQ ID NO: 1290309 - DNA, 15 bp, Homo sapiens
aaactcgttaatttg

SEQ ID NO: 1290310 - DNA, 13 bp, Homo sapiens
aaagaaacatttg

SEQ ID NO: 1290311 - DNA, 18 bp, Homo sapiens
aaagagaacttccagatc

SEQ ID NO: 1290312 - DNA, 14 bp, Homo sapiens
aaaggtacttcaaa

SEQ ID NO: 1290313 - DNA, 15 bp, Homo sapiens
aaataatttttatat

SEQ ID NO: 1290314 - DNA, 21 bp, Homo sapiens
aaatatttattttaataatgt

SEQ ID NO: 1290315 - DNA, 14 bp, Homo sapiens
aaatccttgaagat

SEQ ID NO: 1290316 - DNA, 18 bp, Homo sapiens
aaatctcaatatttcaga

SEQ ID NO: 1290317 - DNA, 15 bp, Homo sapiens
aacacaactatattg

SEQ ID NO: 1290318 - DNA, 16 bp, Homo sapiens
aacacaactatattgt

SEQ ID NO: 1290319 - DNA, 12 bp, Homo sapiens
aacatatataac

SEQ ID NO: 1290320 - DNA, 13 bp, Homo sapiens
aactatattgttt

SEQ ID NO: 1290321 - DNA, 20 bp, Homo sapiens
aactatctcatttccaagca

SEQ ID NO: 1290322 - DNA, 23 bp, Homo sapiens
aactatctcatttccaagcaagt

SEQ ID NO: 1290323 - DNA, 15 bp, Homo sapiens
aactgactcttaaga

SEQ ID NO: 1290324 - DNA, 19 bp, Homo sapiens
aactgactcttaagaagac

SEQ ID NO: 1290325 - DNA, 18 bp, Homo sapiens
aacttccagatcctggaa

SEQ ID NO: 1290326 - DNA, 11 bp, Homo sapiens
aagaaacattt

SEQ ID NO: 1290327 - DNA, 15 bp, Homo sapiens
aagaactgaaatcat

SEQ ID NO: 1290328 - DNA, 17 bp, Homo sapiens
aagactgcattatattt

SEQ ID NO: 1290329 - DNA, 15 bp, Homo sapiens
aagagaacttccaga

SEQ ID NO: 1290330 - DNA, 16 bp, Homo sapiens
aagcaagtattagaat

SEQ ID NO: 1290331 - DNA, 16 bp, Homo sapiens
aagcatttagatgtat

SEQ ID NO: 1290332 - DNA, 20 bp, Homo sapiens
aagctcacagacctttgaac

SEQ ID NO: 1290333 - DNA, 13 bp, Homo sapiens
aagctccaggtag

SEQ ID NO: 1290334 - DNA, 20 bp, Homo sapiens
aaggcagctctaaatgtcaa

SEQ ID NO: 1290335 - DNA, 14 bp, Homo sapiens
aagtaatgataact

SEQ ID NO: 1290336 - DNA, 13 bp, Homo sapiens
aagtattagaata

SEQ ID NO: 1290337 - DNA, 22 bp, Homo sapiens
aagttgatatgccttttcccaa

SEQ ID NO: 1290338 - DNA, 16 bp, Homo sapiens
aataatttttatattt

SEQ ID NO: 1290339 - DNA, 19 bp, Homo sapiens
aataatttttatatttgaa

SEQ ID NO: 1290340 - DNA, 19 bp, Homo sapiens
aatatttattttaataatg

SEQ ID NO: 1290341 - DNA, 15 bp, Homo sapiens
aatatttcagataat

SEQ ID NO: 1290342 - DNA, 16 bp, Homo sapiens
aatctcaatatttcag

SEQ ID NO: 1290343 - DNA, 22 bp, Homo sapiens
aatgagagacacactgaagaag

SEQ ID NO: 1290344 - DNA, 17 bp, Homo sapiens
aaatattatgttaaaac

SEQ ID NO: 1290345 - DNA, 18 bp, Homo sapiens
aaatccatacatttgtgt

SEQ ID NO: 1290346 - DNA, 22 bp, Homo sapiens
aaatgttgacatgggacatttg

SEQ ID NO: 1290347 - DNA, 23 bp, Homo sapiens
aaatgttgacatgggacatttgc

SEQ ID NO: 1290348 - DNA, 20 bp, Homo sapiens
aaattttttctctaggaaat

SEQ ID NO: 1290349 - DNA, 14 bp, Homo sapiens
aacaatgctgtatt

SEQ ID NO: 1290350 - DNA, 15 bp, Homo sapiens
aacaatgctgtattt

SEQ ID NO: 1290351 - DNA, 20 bp, Homo sapiens
aacctagggtgatattaacc

SEQ ID NO: 1290352 - DNA, 14 bp, Homo sapiens
aactccagaaagtg

SEQ ID NO: 1290353 - DNA, 21 bp, Homo sapiens
aactccagaaagtgacaagct

SEQ ID NO: 1290354 - DNA, 18 bp, Homo sapiens
aactcgttaatttgtagt

SEQ ID NO: 1290355 - DNA, 13 bp, Homo sapiens
aactgaaatcata

SEQ ID NO: 1290356 - DNA, 18 bp, Homo sapiens
aactgactcttaagaaga

SEQ ID NO: 1290357 - DNA, 17 bp, Homo sapiens
aactgggacaggggaga

SEQ ID NO: 1290358 - DNA, 13 bp, Homo sapiens
aagaaaatatcac

SEQ ID NO: 1290359 - DNA, 11 bp, Homo sapiens
aagaactgaaa

SEQ ID NO: 1290360 - DNA, 12 bp, Homo sapiens
aagaactgaaat

SEQ ID NO: 1290361 - DNA, 15 bp, Homo sapiens
aagaagactgcatta

SEQ ID NO: 1290362 - DNA, 18 bp, Homo sapiens
aagaatgattatgaatta

SEQ ID NO: 1290363 - DNA, 16 bp, Homo sapiens
aagactgcacatcaaa

SEQ ID NO: 1290364 - DNA, 16 bp, Homo sapiens
aagatttaccacttgt

SEQ ID NO: 1290365 - DNA, 19 bp, Homo sapiens
aagcaaaattttttctcta

SEQ ID NO: 1290366 - DNA, 21 bp, Homo sapiens
aagccttggggctgatgcagt

SEQ ID NO: 1290367 - DNA, 15 bp, Homo sapiens
aagggctgttataat

SEQ ID NO: 1290368 - DNA, 19 bp, Homo sapiens
aagtaatgataactggaaa

SEQ ID NO: 1290369 - DNA, 19 bp, Homo sapiens
aagtatgttagtgcaaatt

SEQ ID NO: 1290370 - DNA, 21 bp, Homo sapiens
aagtatgttagtgcaaattgt

SEQ ID NO: 1290371 - DNA, 18 bp, Homo sapiens
aagtccaagcatttagat

SEQ ID NO: 1290372 - DNA, 19 bp, Homo sapiens
aataatgtttcaaacatat

SEQ ID NO: 1290373 - DNA, 12 bp, Homo sapiens
aatatcacttgt

SEQ ID NO: 1290374 - DNA, 15 bp, Homo sapiens
aatatcacttgtcaa

SEQ ID NO: 1290375 - DNA, 21 bp, Homo sapiens
aatatgccccattcaacatct

SEQ ID NO: 1290376 - DNA, 16 bp, Homo sapiens
aatattatgttaaaac

SEQ ID NO: 1290377 - DNA, 18 bp, Homo sapiens
aatatttattttaataat

SEQ ID NO: 1290378 - DNA, 14 bp, Homo sapiens
aatatttcagataa

SEQ ID NO: 1290379 - DNA, 16 bp, Homo sapiens
aatcagggttagtatt

SEQ ID NO: 1290380 - DNA, 15 bp, Homo sapiens
aatcatgaattagtt

SEQ ID NO: 1290381 - DNA, 13 bp, Homo sapiens
aatccatacattt

SEQ ID NO: 1290382 - DNA, 21 bp, Homo sapiens
aatgagagacacactgaagaa

SEQ ID NO: 1290383 - DNA, 14 bp, Homo sapiens
aatgataactggaa

SEQ ID NO: 1290384 - DNA, 20 bp, Homo sapiens
aatgataactggaaacttca

SEQ ID NO: 1290385 - DNA, 21 bp, Homo sapiens
aatgattatgaattacatttg

SEQ ID NO: 1290386 - DNA, 21 bp, Homo sapiens
aatgctgtattttaaaagaat

SEQ ID NO: 1290387 - DNA, 22 bp, Homo sapiens
aatgctgtattttaaaagaatg

SEQ ID NO: 1290388 - DNA, 18 bp, Homo sapiens
aattgaggacactgatat

SEQ ID NO: 1290389 - DNA, 15 bp, Homo sapiens
aattggagctcgtgg

SEQ ID NO: 1290390 - DNA, 17 bp, Homo sapiens
aattttgtgaagcaaaa

SEQ ID NO: 1290391 - DNA, 13 bp, Homo sapiens
acaactatattgt

SEQ ID NO: 1290392 - DNA, 17 bp, Homo sapiens
acaatgctgtattttaa

SEQ ID NO: 1290393 - DNA, 22 bp, Homo sapiens
acaatgctgtattttaaaagaa

SEQ ID NO: 1290394 - DNA, 15 bp, Homo sapiens
acacatgaagtccaa

SEQ ID NO: 1290395 - DNA, 18 bp, Homo sapiens
acactaagagagaatgag

SEQ ID NO: 1290396 - DNA, 14 bp, Homo sapiens
acactgaagaagca

SEQ ID NO: 1290397 - DNA, 14 bp, Homo sapiens
acagacctttgaac

SEQ ID NO: 1290398 - DNA, 19 bp, Homo sapiens
acagctgtatgattcccag

SEQ ID NO: 1290399 - DNA, 20 bp, Homo sapiens
acagctgtatgattcccagc

SEQ ID NO: 1290400 - DNA, 18 bp, Homo sapiens
acagtcacctcatggaat

SEQ ID NO: 1290401 - DNA, 16 bp, Homo sapiens
acatgaagtccaagca

SEQ ID NO: 1290402 - DNA, 21 bp, Homo sapiens
acatgggacatttgctcatgg

SEQ ID NO: 1290403 - DNA, 21 bp, Homo sapiens
acatttgtataaaataatttt

SEQ ID NO: 1290404 - DNA, 13 bp, Homo sapiens
accaatcatgaat

SEQ ID NO: 1290405 - DNA, 15 bp, Homo sapiens
accaatcatgaatta

SEQ ID NO: 1290406 - DNA, 13 bp, Homo sapiens
actaagagagaat

SEQ ID NO: 1290407 - DNA, 18 bp, Homo sapiens
actccagaaagtgacaag

SEQ ID NO: 1290408 - DNA, 14 bp, Homo sapiens
actcgttaatttgt

SEQ ID NO: 1290409 - DNA, 14 bp, Homo sapiens
actcttaagaagac

SEQ ID NO: 1290410 - DNA, 14 bp, Homo sapiens
actgactcttaaga

SEQ ID NO: 1290411 - DNA, 20 bp, Homo sapiens
actgactcttaagaagactg

SEQ ID NO: 1290412 - DNA, 14 bp, Homo sapiens
actgcattatattt

SEQ ID NO: 1290413 - DNA, 19 bp, Homo sapiens
actgccttctcaactccaa

SEQ ID NO: 1290414 - DNA, 19 bp, Homo sapiens
actgtaagaaaatatcact

SEQ ID NO: 1290415 - DNA, 22 bp, Homo sapiens
actgtaagaaaatatcacttgt

SEQ ID NO: 1290416 - DNA, 20 bp, Homo sapiens
acttccagatcctggaaatc

SEQ ID NO: 1290417 - DNA, 19 bp, Homo sapiens
agaaaacaaggatgaatta

SEQ ID NO: 1290418 - DNA, 13 bp, Homo sapiens
agaagaactgaaa

SEQ ID NO: 1290419 - DNA, 14 bp, Homo sapiens
agaagaactgaaat

SEQ ID NO: 1290420 - DNA, 18 bp, Homo sapiens
agaagactgcattatatt

SEQ ID NO: 1290421 - DNA, 18 bp, Homo sapiens
agaagatggtaccaccag

SEQ ID NO: 1290422 - DNA, 17 bp, Homo sapiens
agaatgattatgaatta

SEQ ID NO: 1290423 - DNA, 16 bp, Homo sapiens
agacacactgaagaag

SEQ ID NO: 1290424 - DNA, 17 bp, Homo sapiens
agacacactgaagaagc

SEQ ID NO: 1290425 - DNA, 21 bp, Homo sapiens
agactgcattatatttattac

SEQ ID NO: 1290426 - DNA, 17 bp, Homo sapiens
agagaacttccagatcc

SEQ ID NO: 1290427 - DNA, 15 bp, Homo sapiens
agagaatgagagaca

SEQ ID NO: 1290428 - DNA, 18 bp, Homo sapiens
agagacacactgaagaag

SEQ ID NO: 1290429 - DNA, 22 bp, Homo sapiens
agcacagcctcttagatgcagt

SEQ ID NO: 1290430 - DNA, 19 bp, Homo sapiens
agcagtcaggaaagagaac

SEQ ID NO: 1290431 - DNA, 23 bp, Homo sapiens
agcataaatgttgacatgggaca

SEQ ID NO: 1290432 - DNA, 19 bp, Homo sapiens
aggaaagagaacttccaga

SEQ ID NO: 1290433 - DNA, 12 bp, Homo sapiens
aggaaatattta

SEQ ID NO: 1290434 - DNA, 14 bp, Homo sapiens
aggaaatatttatt

SEQ ID NO: 1290435 - DNA, 18 bp, Homo sapiens
aggaaatatttattttaa

SEQ ID NO: 1290436 - DNA, 20 bp, Homo sapiens
aggcagctctaaatgtcaat

SEQ ID NO: 1290437 - DNA, 17 bp, Homo sapiens
aggctagatgtatgtac

SEQ ID NO: 1290438 - DNA, 16 bp, Homo sapiens
aggggaattgaggaca

SEQ ID NO: 1290439 - DNA, 17 bp, Homo sapiens
agtaatgataactggaa

SEQ ID NO: 1290440 - DNA, 18 bp, Homo sapiens
agtaatgataactggaaa

SEQ ID NO: 1290441 - DNA, 18 bp, Homo sapiens
agtatgttagtgcaaatt

SEQ ID NO: 1290442 - DNA, 18 bp, Homo sapiens
agtattagaataccacag

SEQ ID NO: 1290443 - DNA, 15 bp, Homo sapiens
agtattgtccaggtc

SEQ ID NO: 1290444 - DNA, 15 bp, Homo sapiens
agtcaaattgtgtga

SEQ ID NO: 1290445 - DNA, 15 bp, Homo sapiens
agtcacctcatggaa

SEQ ID NO: 1290446 - DNA, 16 bp, Homo sapiens
agtcaggaaagagaac

SEQ ID NO: 1290447 - DNA, 16 bp, Homo sapiens
agttctgaagaagatg

SEQ ID NO: 1290448 - DNA, 15 bp, Homo sapiens
agtttagctggaaaa

SEQ ID NO: 1290449 - DNA, 16 bp, Homo sapiens
agtttagctggaaaag

SEQ ID NO: 1290450 - DNA, 22 bp, Homo sapiens
ataaaataatttttatatttga

SEQ ID NO: 1290451 - DNA, 17 bp, Homo sapiens
ataacaatgctgtattt

SEQ ID NO: 1290452 - DNA, 20 bp, Homo sapiens
ataacaatgctgtattttaa

SEQ ID NO: 1290453 - DNA, 15 bp, Homo sapiens
ataattttgtgaagc

SEQ ID NO: 1290454 - DNA, 19 bp, Homo sapiens
atataagcttgtattcctt

SEQ ID NO: 1290455 - DNA, 18 bp, Homo sapiens
atatataacaatgctgta

SEQ ID NO: 1290456 - DNA, 20 bp, Homo sapiens
atatgcttctgttttataat

SEQ ID NO: 1290457 - DNA, 22 bp, Homo sapiens
atatgcttctgttttataattt

SEQ ID NO: 1290458 - DNA, 17 bp, Homo sapiens
atatttattttaataat

SEQ ID NO: 1290459 - DNA, 18 bp, Homo sapiens
atatttattttaataatg

SEQ ID NO: 1290460 - DNA, 23 bp, Homo sapiens
atatttcagataatcacaataca

SEQ ID NO: 1290461 - DNA, 14 bp, Homo sapiens
atctcatttccaag

SEQ ID NO: 1290462 - DNA, 18 bp, Homo sapiens
atgaaatattatgttaaa

SEQ ID NO: 1290463 - DNA, 21 bp, Homo sapiens
atgaaatattatgttaaaact

SEQ ID NO: 1290464 - DNA, 19 bp, Homo sapiens
ttagaaacacaactatatt

SEQ ID NO: 1290465 - DNA, 21 bp, Homo sapiens
ttagatgcagttctgaagaag

SEQ ID NO: 1290466 - DNA, 16 bp, Homo sapiens
ttagggttatgattaa

SEQ ID NO: 1290467 - DNA, 14 bp, Homo sapiens
ttataattttgtga

SEQ ID NO: 1290468 - DNA, 18 bp, Homo sapiens
ttatataagcttgtattc

SEQ ID NO: 1290469 - DNA, 20 bp, Homo sapiens
ttatatttattactgtaaga

SEQ ID NO: 1290470 - DNA, 17 bp, Homo sapiens
ttatgaattacatttgt

SEQ ID NO: 1290471 - DNA, 21 bp, Homo sapiens
ttatgaattacatttgtataa

SEQ ID NO: 1290472 - DNA, 21 bp, Homo sapiens
ttatggcactagtatttctat

SEQ ID NO: 1290473 - DNA, 18 bp, Homo sapiens
ttattactgtaagaaaat

SEQ ID NO: 1290474 - DNA, 15 bp, Homo sapiens
ttattttaataatgt

SEQ ID NO: 1290475 - DNA, 17 bp, Homo sapiens
ttattttaataatgttt

SEQ ID NO: 1290476 - DNA, 17 bp, Homo sapiens
ttcaaatccttgaagat

SEQ ID NO: 1290477 - DNA, 14 bp, Homo sapiens
ttctatgaaatatt

SEQ ID NO: 1290478 - DNA, 21 bp, Homo sapiens
ttctatgaaatattatgttaa

SEQ ID NO: 1290479 - DNA, 23 bp, Homo sapiens
ttctctcctctccccatgatgtt

SEQ ID NO: 1290480 - DNA, 12 bp, Homo sapiens
ttctgaagaaga

SEQ ID NO: 1290481 - DNA, 14 bp, Homo sapiens
ttctgaagaagatg

SEQ ID NO: 1290482 - DNA, 13 bp, Homo sapiens
ttgacatgggaca

SEQ ID NO: 1290483 - DNA, 12 bp, Homo sapiens
ttgatgaagaag

SEQ ID NO: 1290484 - DNA, 13 bp, Homo sapiens
ttgatgaagaagt

SEQ ID NO: 1290485 - DNA, 22 bp, Homo sapiens
ttgcaagccagattttcctgaa

SEQ ID NO: 1290486 - DNA, 17 bp, Homo sapiens
ttggagaagaactgaaa

SEQ ID NO: 1290487 - DNA, 23 bp, Homo sapiens
ttgtgtgaaaggtacttcaaatc

SEQ ID NO: 1290488 - DNA, 14 bp, Homo sapiens
tttaataatgtttc

SEQ ID NO: 1290489 - DNA, 21 bp, Homo sapiens
tttatatgcttctgttttata

SEQ ID NO: 1290490 - DNA, 16 bp, Homo sapiens
tttattactgtaagaa

SEQ ID NO: 1290491 - DNA, 19 bp, Homo sapiens
tttattactgtaagaaaat

SEQ ID NO: 1290492 - DNA, 20 bp, Homo sapiens
tttctatgaaatattatgtt

SEQ ID NO: 1290493 - DNA, 15 bp, Homo sapiens
tttgaaatattgact

SEQ ID NO: 1290494 - DNA, 19 bp, Homo sapiens
tttgctaagcattccaact

SEQ ID NO: 1290495 - DNA, 17 bp, Homo sapiens
tttgtagtgttggagaa

SEQ ID NO: 1290496 - DNA, 21 bp, Homo sapiens
tttgtagtgttggagaagaac

SEQ ID NO: 1290497 - DNA, 17 bp, Homo sapiens
tttgtataaaataattt

SEQ ID NO: 1290498 - DNA, 18 bp, Homo sapiens
tttgtataaaataatttt

SEQ ID NO: 1290499 - DNA, 14 bp, Homo sapiens
ttttaaaagaatga

SEQ ID NO: 1290500 - DNA, 21 bp, Homo sapiens
ttttaaaagaatgattatgaa

SEQ ID NO: 1290501 - DNA, 23 bp, Homo sapiens
ttttataattttgtgaagcaaaa

SEQ ID NO: 1290502 - DNA, 15 bp, Homo sapiens
ttttatatgcttctg

SEQ ID NO: 1290503 - DNA, 16 bp, Homo sapiens
ttttctctaggaaata

SEQ ID NO: 1290504 - DNA, 18 bp, Homo sapiens
ttttggtctggagggaag

SEQ ID NO: 1290505 - DNA, 17 bp, Homo sapiens
tttttatatttgaaata

SEQ ID NO: 1290506 - DNA, 17 bp, Homo sapiens
tggagaggtatgtgccc

SEQ ID NO: 1290507 - DNA, 15 bp, Homo sapiens
tggagcagccggaag

SEQ ID NO: 1290508 - DNA, 12 bp, Homo sapiens
tggcaggccctg

SEQ ID NO: 1290509 - DNA, 19 bp, Homo sapiens
tggcaggccctgcccagcc

SEQ ID NO: 1290510 - DNA, 21 bp, Homo sapiens
tggcaggccctgcccagccag

SEQ ID NO: 1290511 - DNA, 15 bp, Homo sapiens
tggcagtgctgaagg

SEQ ID NO: 1290512 - DNA, 13 bp, Homo sapiens
tggccaggacaca

SEQ ID NO: 1290513 - DNA, 22 bp, Homo sapiens
tggccaggacacactgaaaagc

SEQ ID NO: 1290514 - DNA, 17 bp, Homo sapiens
tggccctgcgccctgtg

SEQ ID NO: 1290515 - DNA, 18 bp, Homo sapiens
tggcctgggtcccagggc

SEQ ID NO: 1290516 - DNA, 18 bp, Homo sapiens
tggcctgtgcttggaggc

SEQ ID NO: 1290517 - DNA, 22 bp, Homo sapiens
tggcctgtgcttggaggcctca

SEQ ID NO: 1290518 - DNA, 14 bp, Homo sapiens
tggcgaagcctgag

SEQ ID NO: 1290519 - DNA, 20 bp, Homo sapiens
tggcggcccctcagcctgcc

SEQ ID NO: 1290520 - DNA, 13 bp, Homo sapiens
tggctcagcccgg

SEQ ID NO: 1290521 - DNA, 18 bp, Homo sapiens
tggctgccccattccagc

SEQ ID NO: 1290522 - DNA, 22 bp, Homo sapiens
tgggacacggtttaactgtccc

SEQ ID NO: 1290523 - DNA, 21 bp, Homo sapiens
tgggacccaggctcccagcct

SEQ ID NO: 1290524 - DNA, 14 bp, Homo sapiens
tgggagtggggagc

SEQ ID NO: 1290525 - DNA, 16 bp, Homo sapiens
tggggagcggagcttg

SEQ ID NO: 1290526 - DNA, 16 bp, Homo sapiens
tggggcaagatccagg

SEQ ID NO: 1290527 - DNA, 14 bp, Homo sapiens
tgggggtgggaggt

SEQ ID NO: 1290528 - DNA, 18 bp, Homo sapiens
tggggtccccctcccact

SEQ ID NO: 1290529 - DNA, 23 bp, Homo sapiens
tggggttcttgtccacggggctc

SEQ ID NO: 1290530 - DNA, 12 bp, Homo sapiens
tgggtcccaggg

SEQ ID NO: 1290531 - DNA, 14 bp, Homo sapiens
tgggtcccagggct

SEQ ID NO: 1290532 - DNA, 21 bp, Homo sapiens
tgggtcccagggctggcccta

SEQ ID NO: 1290533 - DNA, 11 bp, Homo sapiens
tggtcaggccc

SEQ ID NO: 1290534 - DNA, 14 bp, Homo sapiens
tggtcaggcccagc

SEQ ID NO: 1290535 - DNA, 16 bp, Homo sapiens
tggtcaggcccagcct

SEQ ID NO: 1290536 - DNA, 17 bp, Homo sapiens
tggtcaggcccagcctc

SEQ ID NO: 1290537 - DNA, 16 bp, Homo sapiens
tggtcaggcccagttc

SEQ ID NO: 1290538 - DNA, 14 bp, Homo sapiens
tggtctggtcaggc

SEQ ID NO: 1290539 - DNA, 18 bp, Homo sapiens
tggtggcaaccccagacc

SEQ ID NO: 1290540 - DNA, 20 bp, Homo sapiens
tgtccacggggctcactctg

SEQ ID NO: 1290541 - DNA, 14 bp, Homo sapiens
tgtgacctggtctg

SEQ ID NO: 1290542 - DNA, 15 bp, Homo sapiens
tgtgcttggaggcct

SEQ ID NO: 1290543 - DNA, 17 bp, Homo sapiens
tgtggcgccgcgtggac

SEQ ID NO: 1290544 - DNA, 19 bp, Homo sapiens
tgtggcgccgcgtggacag

SEQ ID NO: 1290545 - DNA, 18 bp, Homo sapiens
tgtggttgggggtgggag

SEQ ID NO: 1290546 - DNA, 22 bp, Homo sapiens
tgtggtttttgtgtgtgtggac

SEQ ID NO: 1290547 - DNA, 12 bp, Homo sapiens
tgtgtggacagc

SEQ ID NO: 1290548 - DNA, 13 bp, Homo sapiens
ttacttgagcaaa

SEQ ID NO: 1290549 - DNA, 12 bp, Homo sapiens
ttcaccagccct

SEQ ID NO: 1290550 - DNA, 13 bp, Homo sapiens
ttcatcccagctg

SEQ ID NO: 1290551 - DNA, 16 bp, Homo sapiens
ttcatcccagctgctg

SEQ ID NO: 1290552 - DNA, 22 bp, Homo sapiens
ttccagaggagagtggcctggg

SEQ ID NO: 1290553 - DNA, 16 bp, Homo sapiens
ttccagctctcccatg

SEQ ID NO: 1290554 - DNA, 18 bp, Homo sapiens
ttccagctctcccatgga

SEQ ID NO: 1290555 - DNA, 15 bp, Homo sapiens
ttcccttggtggcaa

SEQ ID NO: 1290556 - DNA, 18 bp, Homo sapiens
ttccctttgagtccagtg

SEQ ID NO: 1290557 - DNA, 13 bp, Homo sapiens
ttcctggctttgg

SEQ ID NO: 1290558 - DNA, 14 bp, Homo sapiens
ttctcgtgccctta

SEQ ID NO: 1290559 - DNA, 14 bp, Homo sapiens
ttctcttctcctgt

SEQ ID NO: 1290560 - DNA, 16 bp, Homo sapiens
ttcttcccctcctgta

SEQ ID NO: 1290561 - DNA, 23 bp, Homo sapiens
ttgccttttcttcccctcctgta

SEQ ID NO: 1290562 - DNA, 19 bp, Homo sapiens
ttgctcctggaacctggca

SEQ ID NO: 1290563 - DNA, 22 bp, Homo sapiens
ttgctcctggaacctggcaggc

SEQ ID NO: 1290564 - DNA, 11 bp, Homo sapiens
ttggccctgcg

SEQ ID NO: 1290565 - DNA, 15 bp, Homo sapiens
ttgtcaccccagttc

SEQ ID NO: 1290566 - DNA, 12 bp, Homo sapiens
tttagcctggct

SEQ ID NO: 1290567 - DNA, 19 bp, Homo sapiens
tttgctctcaaggcttgga

SEQ ID NO: 1290568 - DNA, 23 bp, Homo sapiens
ttttaacatagagaactgtcacc

SEQ ID NO: 1290569 - DNA, 20 bp, Homo sapiens
gtcaactggcgaagcctgag

SEQ ID NO: 1290570 - DNA, 17 bp, Homo sapiens
gtcacaaaccagcctgg

SEQ ID NO: 1290571 - DNA, 20 bp, Homo sapiens
gtcaccccagttcccttggt

SEQ ID NO: 1290572 - DNA, 13 bp, Homo sapiens
gtcaccctgaggt

SEQ ID NO: 1290573 - DNA, 20 bp, Homo sapiens
gtcacctttttaatttccag

SEQ ID NO: 1290574 - DNA, 16 bp, Homo sapiens
gtcaggcaatgccctg

SEQ ID NO: 1290575 - DNA, 19 bp, Homo sapiens
gtcaggcaatgccctgcgg

SEQ ID NO: 1290576 - DNA, 14 bp, Homo sapiens
gtcaggcccagcct

SEQ ID NO: 1290577 - DNA, 16 bp, Homo sapiens
gtcaggcccagcctct

SEQ ID NO: 1290578 - DNA, 20 bp, Homo sapiens
gtccaatcacccccaggacc

SEQ ID NO: 1290579 - DNA, 22 bp, Homo sapiens
gtccacggggctcactctggcc

SEQ ID NO: 1290580 - DNA, 19 bp, Homo sapiens
gtcccagcgacatttctcc

SEQ ID NO: 1290581 - DNA, 15 bp, Homo sapiens
gtcccagggctggcc

SEQ ID NO: 1290582 - DNA, 22 bp, Homo sapiens
gtcccagggctggccctaggca

SEQ ID NO: 1290583 - DNA, 22 bp, Homo sapiens
gtcctacaaaaataaaaggctt

SEQ ID NO: 1290584 - DNA, 17 bp, Homo sapiens
gtccttgctcctggaac

SEQ ID NO: 1290585 - DNA, 22 bp, Homo sapiens
gtccttgctcctggaacctggc

SEQ ID NO: 1290586 - DNA, 13 bp, Homo sapiens
gtcggagggctgg

SEQ ID NO: 1290587 - DNA, 22 bp, Homo sapiens
gtctcacctgccggctctgggc

SEQ ID NO: 1290588 - DNA, 22 bp, Homo sapiens
gtctggtcaggcaatgccctgc

SEQ ID NO: 1290589 - DNA, 13 bp, Homo sapiens
gtgacctggtctg

SEQ ID NO: 1290590 - DNA, 20 bp, Homo sapiens
gtgacctggtctggtcaggc

SEQ ID NO: 1290591 - DNA, 15 bp, Homo sapiens
gtgcccctcctgggt

SEQ ID NO: 1290592 - DNA, 14 bp, Homo sapiens
gtgcctggggctgg

SEQ ID NO: 1290593 - DNA, 18 bp, Homo sapiens
gtgcctggggctggctgc

SEQ ID NO: 1290594 - DNA, 15 bp, Homo sapiens
gtgcttggaggcctc

SEQ ID NO: 1290595 - DNA, 22 bp, Homo sapiens
gtggaatccagtgtggctccca

SEQ ID NO: 1290596 - DNA, 19 bp, Homo sapiens
gtggacagcccgggagctt

SEQ ID NO: 1290597 - DNA, 12 bp, Homo sapiens
gtggcagtgctg

SEQ ID NO: 1290598 - DNA, 21 bp, Homo sapiens
gtggcctgggtcccagggctg

SEQ ID NO: 1290599 - DNA, 14 bp, Homo sapiens
gtgggacccaggct

SEQ ID NO: 1290600 - DNA, 14 bp, Homo sapiens
gtggtcaggcccag

SEQ ID NO: 1290601 - DNA, 16 bp, Homo sapiens
gtggtcaggcccagcc

SEQ ID NO: 1290602 - DNA, 21 bp, Homo sapiens
gtggtcccataggtcttgtga

SEQ ID NO: 1290603 - DNA, 13 bp, Homo sapiens
gtggtctccagct

SEQ ID NO: 1290604 - DNA, 15 bp, Homo sapiens
gtggtctccagctcc

SEQ ID NO: 1290605 - DNA, 21 bp, Homo sapiens
gtggtctccagctcctctcca

SEQ ID NO: 1290606 - DNA, 23 bp, Homo sapiens
gtgtggtctccagctcctctcca

SEQ ID NO: 1290607 - DNA, 13 bp, Homo sapiens
gttcaccagccct

SEQ ID NO: 1290608 - DNA, 16 bp, Homo sapiens
gttcaccagccctgag

SEQ ID NO: 1290609 - DNA, 18 bp, Homo sapiens
gttcaccagccctgagcc

SEQ ID NO: 1290610 - DNA, 15 bp, Homo sapiens
gttctcgtgccctta

SEQ ID NO: 1290611 - DNA, 18 bp, Homo sapiens
gttggcctgtgcttggag

SEQ ID NO: 1290612 - DNA, 23 bp, Homo sapiens
gttggcctgtgcttggaggcctc

SEQ ID NO: 1290613 - DNA, 14 bp, Homo sapiens
gttgggaggcaggt

SEQ ID NO: 1290614 - DNA, 15 bp, Homo sapiens
gttgggggtgggagg

SEQ ID NO: 1290615 - DNA, 18 bp, Homo sapiens
taagaagttcaccagccc

SEQ ID NO: 1290616 - DNA, 12 bp, Homo sapiens
tacacaggcagg

SEQ ID NO: 1290617 - DNA, 16 bp, Homo sapiens
tagacctgtgacctgg

SEQ ID NO: 1290618 - DNA, 13 bp, Homo sapiens
tagagaactgtca

SEQ ID NO: 1290619 - DNA, 16 bp, Homo sapiens
tagcttttagcctggc

SEQ ID NO: 1290620 - DNA, 17 bp, Homo sapiens
tagcttttagcctggct

SEQ ID NO: 1290621 - DNA, 20 bp, Homo sapiens
tagttgccttttcttcccct

SEQ ID NO: 1290622 - DNA, 22 bp, Homo sapiens
tatggagcagccggaagtctgt

SEQ ID NO: 1290623 - DNA, 16 bp, Homo sapiens
tatgtgcccctcctgg

SEQ ID NO: 1290624 - DNA, 17 bp, Homo sapiens
tattgtcagtcctacaa

SEQ ID NO: 1290625 - DNA, 18 bp, Homo sapiens
tatttttttacttgagca

SEQ ID NO: 1290626 - DNA, 14 bp, Homo sapiens
tcacaaaccagcct

SEQ ID NO: 1290627 - DNA, 16 bp, Homo sapiens
tcacaaaccagcctgg

SEQ ID NO: 1290628 - DNA, 15 bp, Homo sapiens
tcaccagccctgagc

SEQ ID NO: 1290629 - DNA, 16 bp, Homo sapiens
tcaccagccctgagcc

SEQ ID NO: 1290630 - DNA, 20 bp, Homo sapiens
tcaccccagttcccttggtg

SEQ ID NO: 1290631 - DNA, 16 bp, Homo sapiens
tcacccccaggacctc

SEQ ID NO: 1290632 - DNA, 21 bp, Homo sapiens
tcaccgcctgctacacaggca

SEQ ID NO: 1290633 - DNA, 20 bp, Homo sapiens
tcacctgccggctctgggct

SEQ ID NO: 1290634 - DNA, 23 bp, Homo sapiens
tcacctgccggctctgggctggc

SEQ ID NO: 1290635 - DNA, 13 bp, Homo sapiens
tcacggcctggca

SEQ ID NO: 1290636 - DNA, 16 bp, Homo sapiens
tcacggcctggcatgc

SEQ ID NO: 1290637 - DNA, 14 bp, Homo sapiens
tcagcctgcctgaa

SEQ ID NO: 1290638 - DNA, 16 bp, Homo sapiens
tcagcctgcctgaaga

SEQ ID NO: 1290639 - DNA, 21 bp, Homo sapiens
tcagcctgcctgaagagagga

SEQ ID NO: 1290640 - DNA, 21 bp, Homo sapiens
tcagtcacaaaccagcctggg

SEQ ID NO: 1290641 - DNA, 21 bp, Homo sapiens
tcagtctcacctgccggctct

SEQ ID NO: 1290642 - DNA, 15 bp, Homo sapiens
tcatattgtcagtcc

SEQ ID NO: 1290643 - DNA, 17 bp, Homo sapiens
tcatcccagctgctgag

SEQ ID NO: 1290644 - DNA, 20 bp, Homo sapiens
tccaaggtcccattttcccc

SEQ ID NO: 1290645 - DNA, 17 bp, Homo sapiens
tccaccgggcgcatgcc

SEQ ID NO: 1290646 - DNA, 23 bp, Homo sapiens
tccaccgggcgcatgcctcccag

SEQ ID NO: 1290647 - DNA, 19 bp, Homo sapiens
tccacggggctcactctgg

SEQ ID NO: 1290648 - DNA, 14 bp, Homo sapiens
tccagaactgcaca

SEQ ID NO: 1290649 - DNA, 13 bp, Homo sapiens
tccagaggagagt

SEQ ID NO: 1290650 - DNA, 23 bp, Homo sapiens
tccagaggagagtggcctgggtc

SEQ ID NO: 1290651 - DNA, 14 bp, Homo sapiens
tccagctcctctcc

SEQ ID NO: 1290652 - DNA, 17 bp, Homo sapiens
tccagctctcccatgga

SEQ ID NO: 1290653 - DNA, 13 bp, Homo sapiens
tccaggtggtccc

SEQ ID NO: 1290654 - DNA, 18 bp, Homo sapiens
tccaggtggtcccatagg

SEQ ID NO: 1290655 - DNA, 19 bp, Homo sapiens
tccagtgtggctcccacag

SEQ ID NO: 1290656 - DNA, 16 bp, Homo sapiens
tcccagcctaagggag

SEQ ID NO: 1290657 - DNA, 19 bp, Homo sapiens
tcccaggccacctcagtct

SEQ ID NO: 1290658 - DNA, 14 bp, Homo sapiens
tcccagggctctct

SEQ ID NO: 1290659 - DNA, 16 bp, Homo sapiens
tcccattttccccctg

SEQ ID NO: 1290660 - DNA, 22 bp, Homo sapiens
tcccttggtggcaaccccagac

SEQ ID NO: 1290661 - DNA, 24 bp, Homo sapiens
tcctatttttgtagatctccatgc

SEQ ID NO: 1290662 - DNA, 20 bp, Homo sapiens
tcctcacacacggaggccag

SEQ ID NO: 1290663 - DNA, 13 bp, Homo sapiens
tcctctccagaca

SEQ ID NO: 1290664 - DNA, 18 bp, Homo sapiens
tcctggaacctggcaggc

SEQ ID NO: 1290665 - DNA, 20 bp, Homo sapiens
tcctggaacctggcaggccc

SEQ ID NO: 1290666 - DNA, 22 bp, Homo sapiens
tcctggaacctggcaggccctg

SEQ ID NO: 1290667 - DNA, 22 bp, Homo sapiens
tcctgggtgctcaccgcctgct

SEQ ID NO: 1290668 - DNA, 21 bp, Homo sapiens
tcctgtaagagtattaacaaa

SEQ ID NO: 1290669 - DNA, 14 bp, Homo sapiens
tccttgctcctgga

SEQ ID NO: 1290670 - DNA, 12 bp, Homo sapiens
tcggaagagagg

SEQ ID NO: 1290671 - DNA, 21 bp, Homo sapiens
tcggaagagagggctgagcca

SEQ ID NO: 1290672 - DNA, 17 bp, Homo sapiens
tcggcctggctggccag

SEQ ID NO: 1290673 - DNA, 12 bp, Homo sapiens
tcgggctgccag

SEQ ID NO: 1290674 - DNA, 19 bp, Homo sapiens
tcgggctgccagcccagct

SEQ ID NO: 1290675 - DNA, 18 bp, Homo sapiens
tctagttctcttctcctg

SEQ ID NO: 1290676 - DNA, 19 bp, Homo sapiens
tctagttctcttctcctgt

SEQ ID NO: 1290677 - DNA, 15 bp, Homo sapiens
tctcaaggcttggag

SEQ ID NO: 1290678 - DNA, 18 bp, Homo sapiens
tctcaaggcttggagagg

SEQ ID NO: 1290679 - DNA, 18 bp, Homo sapiens
tctccagctcctctccag

SEQ ID NO: 1290680 - DNA, 12 bp, Homo sapiens
tctcccagggct

SEQ ID NO: 1290681 - DNA, 15 bp, Homo sapiens
tctcccatggagccc

SEQ ID NO: 1290682 - DNA, 21 bp, Homo sapiens
gaactgcacaatgaccagcag

SEQ ID NO: 1290683 - DNA, 22 bp, Homo sapiens
gaactgcacaatgaccagcagg

SEQ ID NO: 1290684 - DNA, 21 bp, Homo sapiens
gaagttcaccagccctgagcc

SEQ ID NO: 1290685 - DNA, 19 bp, Homo sapiens
gaatgcggttgggaggcag

SEQ ID NO: 1290686 - DNA, 20 bp, Homo sapiens
gacacaagggtgcaagcccc

SEQ ID NO: 1290687 - DNA, 21 bp, Homo sapiens
gacacaggccgtgggacccag

SEQ ID NO: 1290688 - DNA, 20 bp, Homo sapiens
gacacggtttaactgtccca

SEQ ID NO: 1290689 - DNA, 13 bp, Homo sapiens
gacagcccgggag

SEQ ID NO: 1290690 - DNA, 15 bp, Homo sapiens
gacaggtgcctgggg

SEQ ID NO: 1290691 - DNA, 16 bp, Homo sapiens
gaccagcaggagggaa

SEQ ID NO: 1290692 - DNA, 23 bp, Homo sapiens
gaccagcaggagggaaggacaga

SEQ ID NO: 1290693 - DNA, 20 bp, Homo sapiens
gacccaacccatgcccctga

SEQ ID NO: 1290694 - DNA, 22 bp, Homo sapiens
gacccaacccatgcccctgaca

SEQ ID NO: 1290695 - DNA, 23 bp, Homo sapiens
gacccaacccatgcccctgacag

SEQ ID NO: 1290696 - DNA, 12 bp, Homo sapiens
gacccaggctcc

SEQ ID NO: 1290697 - DNA, 15 bp, Homo sapiens
gacccaggctcccag

SEQ ID NO: 1290698 - DNA, 16 bp, Homo sapiens
gacccaggctcccagc

SEQ ID NO: 1290699 - DNA, 23 bp, Homo sapiens
gacctctttggggcaagatccag

SEQ ID NO: 1290700 - DNA, 18 bp, Homo sapiens
gacctgagatgctgggag

SEQ ID NO: 1290701 - DNA, 13 bp, Homo sapiens
gacctggtctggt

SEQ ID NO: 1290702 - DNA, 16 bp, Homo sapiens
gacctggtctggtcag

SEQ ID NO: 1290703 - DNA, 21 bp, Homo sapiens
gacctggtctggtcaggcaat

SEQ ID NO: 1290704 - DNA, 14 bp, Homo sapiens
gacctgtgacctgg

SEQ ID NO: 1290705 - DNA, 13 bp, Homo sapiens
gagacaggccttt

SEQ ID NO: 1290706 - DNA, 22 bp, Homo sapiens
gagagggggcactgtggtcagg

SEQ ID NO: 1290707 - DNA, 17 bp, Homo sapiens
gagagtggcctgggtcc

SEQ ID NO: 1290708 - DNA, 13 bp, Homo sapiens
gagatgctgggag

SEQ ID NO: 1290709 - DNA, 13 bp, Homo sapiens
gagccatggcggc

SEQ ID NO: 1290710 - DNA, 21 bp, Homo sapiens
gagctttgagacaggtgcctg

SEQ ID NO: 1290711 - DNA, 22 bp, Homo sapiens
gaggaaactggcgatctcccag

SEQ ID NO: 1290712 - DNA, 16 bp, Homo sapiens
gaggagagtggcctgg

SEQ ID NO: 1290713 - DNA, 16 bp, Homo sapiens
gaggagttttctgtgt

SEQ ID NO: 1290714 - DNA, 19 bp, Homo sapiens
gaggcaggtcgggctgcca

SEQ ID NO: 1290715 - DNA, 22 bp, Homo sapiens
gaggcaggtcgggctgccagcc

SEQ ID NO: 1290716 - DNA, 18 bp, Homo sapiens
gagggctgaacccccact

SEQ ID NO: 1290717 - DNA, 15 bp, Homo sapiens
gagggctgagccatg

SEQ ID NO: 1290718 - DNA, 16 bp, Homo sapiens
gagggctgagccatgg

SEQ ID NO: 1290719 - DNA, 15 bp, Homo sapiens
gaggtaacagggtca

SEQ ID NO: 1290720 - DNA, 20 bp, Homo sapiens
gagtaagaaatgggcctcag

SEQ ID NO: 1290721 - DNA, 21 bp, Homo sapiens
gagtaagaaatgggcctcagc

SEQ ID NO: 1290722 - DNA, 22 bp, Homo sapiens
gagtggcctgggtcccagggct

SEQ ID NO: 1290723 - DNA, 16 bp, Homo sapiens
gagtgtctatggagca

SEQ ID NO: 1290724 - DNA, 20 bp, Homo sapiens
gagtgtctatggagcagccg

SEQ ID NO: 1290725 - DNA, 16 bp, Homo sapiens
gatcaaccaggcagag

SEQ ID NO: 1290726 - DNA, 23 bp, Homo sapiens
gatcctgatggcacccacacaga

SEQ ID NO: 1290727 - DNA, 21 bp, Homo sapiens
gatctagttctcttctcctgt

SEQ ID NO: 1290728 - DNA, 21 bp, Homo sapiens
gatctccatgctttgctctca

SEQ ID NO: 1290729 - DNA, 14 bp, Homo sapiens
gatctcccagggct

SEQ ID NO: 1290730 - DNA, 22 bp, Homo sapiens
gatctcccagggctctctggac

SEQ ID NO: 1290731 - DNA, 16 bp, Homo sapiens
gcaacttcatcccagc

SEQ ID NO: 1290732 - DNA, 19 bp, Homo sapiens
gcaacttcatcccagctgc

SEQ ID NO: 1290733 - DNA, 20 bp, Homo sapiens
gcaacttcatcccagctgct

SEQ ID NO: 1290734 - DNA, 14 bp, Homo sapiens
gcaagatccaggtg

SEQ ID NO: 1290735 - DNA, 23 bp, Homo sapiens
gcaagccccattcacggcctggc

SEQ ID NO: 1290736 - DNA, 19 bp, Homo sapiens
gcacccacacagaggacct

SEQ ID NO: 1290737 - DNA, 16 bp, Homo sapiens
gcacctttgagagagg

SEQ ID NO: 1290738 - DNA, 19 bp, Homo sapiens
gcacctttgagagaggggg

SEQ ID NO: 1290739 - DNA, 14 bp, Homo sapiens
gcactgtggtcagg

SEQ ID NO: 1290740 - DNA, 19 bp, Homo sapiens
gcactgtggtcaggcccag

SEQ ID NO: 1290741 - DNA, 22 bp, Homo sapiens
gcactgtggtcaggcccagcct

SEQ ID NO: 1290742 - DNA, 21 bp, Homo sapiens
gcagacggtgtggttgggggt

SEQ ID NO: 1290743 - DNA, 14 bp, Homo sapiens
gcagccggaagtct

SEQ ID NO: 1290744 - DNA, 22 bp, Homo sapiens
gcagcctttttcaccatggcaa

SEQ ID NO: 1290745 - DNA, 21 bp, Homo sapiens
gcagcttgtccttgctcctgg

SEQ ID NO: 1290746 - DNA, 23 bp, Homo sapiens
gcaggaatgcggttgggaggcag

SEQ ID NO: 1290747 - DNA, 14 bp, Homo sapiens
gcaggccctgccca

SEQ ID NO: 1290748 - DNA, 18 bp, Homo sapiens
gcaggccctgcccagcca

SEQ ID NO: 1290749 - DNA, 21 bp, Homo sapiens
gcagggaaagggatggtcagg

SEQ ID NO: 1290750 - DNA, 22 bp, Homo sapiens
gcagggaaagggatggtcaggc

SEQ ID NO: 1290751 - DNA, 23 bp, Homo sapiens
gcagggaaagggatggtcaggcc

SEQ ID NO: 1290752 - DNA, 12 bp, Homo sapiens
gcaggggcttgg

SEQ ID NO: 1290753 - DNA, 22 bp, Homo sapiens
gcaggtcatattgtcagtccta

SEQ ID NO: 1290754 - DNA, 18 bp, Homo sapiens
gcaggtcgggctgccagc

SEQ ID NO: 1290755 - DNA, 19 bp, Homo sapiens
gcaggtcgggctgccagcc

SEQ ID NO: 1290756 - DNA, 12 bp, Homo sapiens
gcagttggcctg

SEQ ID NO: 1290757 - DNA, 13 bp, Homo sapiens
gcagttggcctgt

SEQ ID NO: 1290758 - DNA, 15 bp, Homo sapiens
gcagttggcctgtgc

SEQ ID NO: 1290759 - DNA, 17 bp, Homo sapiens
gcatgcctcccaggcca

SEQ ID NO: 1290760 - DNA, 21 bp, Homo sapiens
gccacctcagtctcacctgcc

SEQ ID NO: 1290761 - DNA, 14 bp, Homo sapiens
gccagacacaggcc

SEQ ID NO: 1290762 - DNA, 21 bp, Homo sapiens
gccagacacaggccgtgggac

SEQ ID NO: 1290763 - DNA, 15 bp, Homo sapiens
gccaggacacactga

SEQ ID NO: 1290764 - DNA, 14 bp, Homo sapiens
gccatcggaagaga

SEQ ID NO: 1290765 - DNA, 21 bp, Homo sapiens
gccatcggaagagagggctga

SEQ ID NO: 1290766 - DNA, 17 bp, Homo sapiens
gcccagctggccggaag

SEQ ID NO: 1290767 - DNA, 18 bp, Homo sapiens
gcccagttctcgtgccct

SEQ ID NO: 1290768 - DNA, 22 bp, Homo sapiens
gcccagttctcgtgcccttaga

SEQ ID NO: 1290769 - DNA, 21 bp, Homo sapiens
gccccattcacggcctggcat

SEQ ID NO: 1290770 - DNA, 17 bp, Homo sapiens
gccccattccagctctc

SEQ ID NO: 1290771 - DNA, 23 bp, Homo sapiens
gccccgcggatcaaccaggcaga

SEQ ID NO: 1290772 - DNA, 21 bp, Homo sapiens
gcccctcagcctgcctgaaga

SEQ ID NO: 1290773 - DNA, 12 bp, Homo sapiens
gcccctcctggg

SEQ ID NO: 1290774 - DNA, 19 bp, Homo sapiens
gcccctcctgggtgctcac

SEQ ID NO: 1290775 - DNA, 13 bp, Homo sapiens
gccctgagccatg

SEQ ID NO: 1290776 - DNA, 18 bp, Homo sapiens
gccctgcccagccagcca

SEQ ID NO: 1290777 - DNA, 15 bp, Homo sapiens
gccctgcgccctgtg

SEQ ID NO: 1290778 - DNA, 16 bp, Homo sapiens
gccctgcgccctgtgc

SEQ ID NO: 1290779 - DNA, 18 bp, Homo sapiens
gccctgcgccctgtgcag

SEQ ID NO: 1290780 - DNA, 13 bp, Homo sapiens
gccctgcggctct

SEQ ID NO: 1290781 - DNA, 14 bp, Homo sapiens
gccctgtgcaggga

SEQ ID NO: 1290782 - DNA, 21 bp, Homo sapiens
gccgagctgtcggagggctgg

SEQ ID NO: 1290783 - DNA, 13 bp, Homo sapiens
gccgcgtggacag

SEQ ID NO: 1290784 - DNA, 14 bp, Homo sapiens
gccgcgtggacagc

SEQ ID NO: 1290785 - DNA, 19 bp, Homo sapiens
gccgcgtggacagccggag

SEQ ID NO: 1290786 - DNA, 17 bp, Homo sapiens
gccggctctgggctggc

SEQ ID NO: 1290787 - DNA, 17 bp, Homo sapiens
gccgtgggacccaggct

SEQ ID NO: 1290788 - DNA, 18 bp, Homo sapiens
gccgtgggacccaggctc

SEQ ID NO: 1290789 - DNA, 22 bp, Homo sapiens
gccgtgggacccaggctcccag

SEQ ID NO: 1290790 - DNA, 16 bp, Homo sapiens
gcctaagggagacagg

SEQ ID NO: 1290791 - DNA, 11 bp, Homo sapiens
gcctcccaggc

SEQ ID NO: 1290792 - DNA, 13 bp, Homo sapiens
gcctcccaggcca

SEQ ID NO: 1290793 - DNA, 14 bp, Homo sapiens
gcctcccaggccac

SEQ ID NO: 1290794 - DNA, 17 bp, Homo sapiens
gcctcggcctggctggc

SEQ ID NO: 1290795 - DNA, 13 bp, Homo sapiens
gcctgaagagagg

SEQ ID NO: 1290796 - DNA, 15 bp, Homo sapiens
gcctgagcaggcagg

SEQ ID NO: 1290797 - DNA, 19 bp, Homo sapiens
gcctgcctgaagagaggaa

SEQ ID NO: 1290798 - DNA, 20 bp, Homo sapiens
gcctgctacacaggcaggaa

SEQ ID NO: 1290799 - DNA, 19 bp, Homo sapiens
gcctggggccttcctggct

SEQ ID NO: 1290800 - DNA, 20 bp, Homo sapiens
gcctggggccttcctggctt

SEQ ID NO: 1290801 - DNA, 22 bp, Homo sapiens
gcctgtgcttggaggcctcaga

SEQ ID NO: 1290802 - DNA, 13 bp, Homo sapiens
gccttcctggctt

SEQ ID NO: 1290803 - DNA, 18 bp, Homo sapiens
gcctttttcaccatggca

SEQ ID NO: 1290804 - DNA, 13 bp, Homo sapiens
gcgaagcctgagc

SEQ ID NO: 1290805 - DNA, 18 bp, Homo sapiens
gcgaagcctgagcaggca

SEQ ID NO: 1290806 - DNA, 19 bp, Homo sapiens
gcgaagcctgagcaggcag

SEQ ID NO: 1290807 - DNA, 14 bp, Homo sapiens
gcgatctcccaggg

SEQ ID NO: 1290808 - DNA, 20 bp, Homo sapiens
gcgatctcccagggctctct

SEQ ID NO: 1290809 - DNA, 16 bp, Homo sapiens
gcgccgcgtggacagc

SEQ ID NO: 1290810 - DNA, 16 bp, Homo sapiens
gcggagcttggccctg

SEQ ID NO: 1290811 - DNA, 17 bp, Homo sapiens
gcggagcttggccctgc

SEQ ID NO: 1290812 - DNA, 14 bp, Homo sapiens
gcggcccctcagcc

SEQ ID NO: 1290813 - DNA, 15 bp, Homo sapiens
gcggcccctcagcct

SEQ ID NO: 1290814 - DNA, 14 bp, Homo sapiens
gcggctctggaaag

SEQ ID NO: 1290815 - DNA, 15 bp, Homo sapiens
gcgtggacagccgga

SEQ ID NO: 1290816 - DNA, 18 bp, Homo sapiens
gctaagaagttcaccagc

SEQ ID NO: 1290817 - DNA, 14 bp, Homo sapiens
gctacacaggcagg

SEQ ID NO: 1290818 - DNA, 15 bp, Homo sapiens
gctacacaggcagga

SEQ ID NO: 1290819 - DNA, 16 bp, Homo sapiens
gctacacaggcaggaa

SEQ ID NO: 1290820 - DNA, 23 bp, Homo sapiens
gctcagcccgggatcctgatggc

SEQ ID NO: 1290821 - DNA, 14 bp, Homo sapiens
gctcctctccagac

SEQ ID NO: 1290822 - DNA, 17 bp, Homo sapiens
gctcctctccagacaca

SEQ ID NO: 1290823 - DNA, 19 bp, Homo sapiens
gctcctctccagacacaga

SEQ ID NO: 1290824 - DNA, 13 bp, Homo sapiens
gctctcaaggctt

SEQ ID NO: 1290825 - DNA, 19 bp, Homo sapiens
gctctcaaggcttggagag

SEQ ID NO: 1290826 - DNA, 13 bp, Homo sapiens
gctctcccatgga

SEQ ID NO: 1290827 - DNA, 18 bp, Homo sapiens
gctctgggctggctgctc

SEQ ID NO: 1290828 - DNA, 13 bp, Homo sapiens
gctgaagggggca

SEQ ID NO: 1290829 - DNA, 22 bp, Homo sapiens
gctgccagcccagctggccgga

SEQ ID NO: 1290830 - DNA, 19 bp, Homo sapiens
gctggccaggacacactga

SEQ ID NO: 1290831 - DNA, 14 bp, Homo sapiens
gctggccctaggca

SEQ ID NO: 1290832 - DNA, 17 bp, Homo sapiens
gctggccggaaggagac

SEQ ID NO: 1290833 - DNA, 17 bp, Homo sapiens
gctgtcggagggctgga

SEQ ID NO: 1290834 - DNA, 13 bp, Homo sapiens
gcttggccctgcg

SEQ ID NO: 1290835 - DNA, 14 bp, Homo sapiens
gcttggccctgcgc

SEQ ID NO: 1290836 - DNA, 15 bp, Homo sapiens
gcttggccctgcgcc

SEQ ID NO: 1290837 - DNA, 23 bp, Homo sapiens
gcttggccctgcgccctgtgcag

SEQ ID NO: 1290838 - DNA, 13 bp, Homo sapiens
gcttggctgcccc

SEQ ID NO: 1290839 - DNA, 18 bp, Homo sapiens
gcttgtccttgctcctgg

SEQ ID NO: 1290840 - DNA, 23 bp, Homo sapiens
gcttgtccttgctcctggaacct

SEQ ID NO: 1290841 - DNA, 21 bp, Homo sapiens
gctttgctctcaaggcttgga

SEQ ID NO: 1290842 - DNA, 17 bp, Homo sapiens
gcttttagcctggctgt

SEQ ID NO: 1290843 - DNA, 21 bp, Homo sapiens
ggaaactggcgatctcccagg

SEQ ID NO: 1290844 - DNA, 22 bp, Homo sapiens
ggaaagggatggtcaggcccag

SEQ ID NO: 1290845 - DNA, 12 bp, Homo sapiens
ggaacctggcag

SEQ ID NO: 1290846 - DNA, 13 bp, Homo sapiens
ggaacctggcagg

SEQ ID NO: 1290847 - DNA, 20 bp, Homo sapiens
ggaacctggcaggccctgcc

SEQ ID NO: 1290848 - DNA, 15 bp, Homo sapiens
ggacatgggcagcaa

SEQ ID NO: 1290849 - DNA, 24 bp, Homo sapiens
ggacatgggcagcaattcacgctg

SEQ ID NO: 1290850 - DNA, 17 bp, Homo sapiens
ggacatttgtggcagtg

SEQ ID NO: 1290851 - DNA, 19 bp, Homo sapiens
ggacatttgtggcagtgct

SEQ ID NO: 1290852 - DNA, 18 bp, Homo sapiens
ggaccatacgcggaggag

SEQ ID NO: 1290853 - DNA, 19 bp, Homo sapiens
ggacccaggctcccagcct

SEQ ID NO: 1290854 - DNA, 15 bp, Homo sapiens
ggacctcttcagctg

SEQ ID NO: 1290855 - DNA, 14 bp, Homo sapiens
ggagagtggcctgg

SEQ ID NO: 1290856 - DNA, 14 bp, Homo sapiens
ggagcagccggaag

SEQ ID NO: 1290857 - DNA, 21 bp, Homo sapiens
ggagcggagcttggccctgcg

SEQ ID NO: 1290858 - DNA, 14 bp, Homo sapiens
ggagcttggccctg

SEQ ID NO: 1290859 - DNA, 15 bp, Homo sapiens
ggagcttggccctgc

SEQ ID NO: 1290860 - DNA, 19 bp, Homo sapiens
ggagcttggccctgcgccc

SEQ ID NO: 1290861 - DNA, 16 bp, Homo sapiens
ggagctttgagacagg

SEQ ID NO: 1290862 - DNA, 21 bp, Homo sapiens
ggaggccagacacaggccgtg

SEQ ID NO: 1290863 - DNA, 22 bp, Homo sapiens
ggaggccagacacaggccgtgg

SEQ ID NO: 1290864 - DNA, 12 bp, Homo sapiens
ggaggcctcaga

SEQ ID NO: 1290865 - DNA, 16 bp, Homo sapiens
ggagggaaggacagac

SEQ ID NO: 1290866 - DNA, 14 bp, Homo sapiens
ggagggctgaaccc

SEQ ID NO: 1290867 - DNA, 22 bp, Homo sapiens
ggagtaagaaatgggcctcagc

SEQ ID NO: 1290868 - DNA, 16 bp, Homo sapiens
ggatcaaccaggcaga

SEQ ID NO: 1290869 - DNA, 22 bp, Homo sapiens
ggatggggttcttgtccacggg

SEQ ID NO: 1290870 - DNA, 13 bp, Homo sapiens
ggcaatgccctgc

SEQ ID NO: 1290871 - DNA, 15 bp, Homo sapiens
ggcaatgccctgcgg

SEQ ID NO: 1290872 - DNA, 14 bp, Homo sapiens
ggcacccacacaga

SEQ ID NO: 1290873 - DNA, 15 bp, Homo sapiens
ggcactgtggtcagg

SEQ ID NO: 1290874 - DNA, 17 bp, Homo sapiens
ggcactgtggtcaggcc

SEQ ID NO: 1290875 - DNA, 17 bp, Homo sapiens
ggcagcaattcacgctg

SEQ ID NO: 1290876 - DNA, 19 bp, Homo sapiens
ggcaggccctgcccagcca

SEQ ID NO: 1290877 - DNA, 18 bp, Homo sapiens
ggcaggggcttggctgcc

SEQ ID NO: 1290878 - DNA, 21 bp, Homo sapiens
ggcaggggcttggctgcccca

SEQ ID NO: 1290879 - DNA, 19 bp, Homo sapiens
ggccagacacaggccgtgg

SEQ ID NO: 1290880 - DNA, 16 bp, Homo sapiens
ggccaggacacactga

SEQ ID NO: 1290881 - DNA, 18 bp, Homo sapiens
ggcccagcctctctggct

SEQ ID NO: 1290882 - DNA, 20 bp, Homo sapiens
ggcccagcctctctggctca

SEQ ID NO: 1290883 - DNA, 21 bp, Homo sapiens
ggcccagcctctctggctcag

SEQ ID NO: 1290884 - DNA, 19 bp, Homo sapiens
ggcccagttctcgtgccct

SEQ ID NO: 1290885 - DNA, 23 bp, Homo sapiens
ggccccctattgtctccaaggtc

SEQ ID NO: 1290886 - DNA, 14 bp, Homo sapiens
ggcccctcagcctg

SEQ ID NO: 1290887 - DNA, 15 bp, Homo sapiens
ggcccctcagcctgc

SEQ ID NO: 1290888 - DNA, 16 bp, Homo sapiens
ggcccctcagcctgcc

SEQ ID NO: 1290889 - DNA, 21 bp, Homo sapiens
ggcccctcagcctgcctgaag

SEQ ID NO: 1290890 - DNA, 18 bp, Homo sapiens
ggccctgcgccctgtgca

SEQ ID NO: 1290891 - DNA, 16 bp, Homo sapiens
ggccggaaggagactg

SEQ ID NO: 1290892 - DNA, 20 bp, Homo sapiens
ggcctggctggccaggacac

SEQ ID NO: 1290893 - DNA, 15 bp, Homo sapiens
ggcctgggtcccagg

SEQ ID NO: 1290894 - DNA, 17 bp, Homo sapiens
ggcctgggtcccagggc

SEQ ID NO: 1290895 - DNA, 15 bp, Homo sapiens
ggcctgtgcttggag

SEQ ID NO: 1290896 - DNA, 14 bp, Homo sapiens
ggccttcctggctt

SEQ ID NO: 1290897 - DNA, 14 bp, Homo sapiens
ggcctttccctgcc

SEQ ID NO: 1290898 - DNA, 20 bp, Homo sapiens
ggcgaagcctgagcaggcag

SEQ ID NO: 1290899 - DNA, 15 bp, Homo sapiens
ggcgcatgcctccca

SEQ ID NO: 1290900 - DNA, 20 bp, Homo sapiens
ggcgcatgcctcccaggcca

SEQ ID NO: 1290901 - DNA, 22 bp, Homo sapiens
ggcggcccctcagcctgcctga

SEQ ID NO: 1290902 - DNA, 22 bp, Homo sapiens
ggctaagaagttcaccagccct

SEQ ID NO: 1290903 - DNA, 19 bp, Homo sapiens
ggctcagcccgggatcctg

SEQ ID NO: 1290904 - DNA, 12 bp, Homo sapiens
ggctcccagcct

SEQ ID NO: 1290905 - DNA, 12 bp, Homo sapiens
ggctctctggac

SEQ ID NO: 1290906 - DNA, 14 bp, Homo sapiens
ggctctctggacca

SEQ ID NO: 1290907 - DNA, 17 bp, Homo sapiens
ggctctggaaagcaact

SEQ ID NO: 1290908 - DNA, 22 bp, Homo sapiens
ggctctgggctggctgctccta

SEQ ID NO: 1290909 - DNA, 14 bp, Homo sapiens
ggctgagccatggg

SEQ ID NO: 1290910 - DNA, 15 bp, Homo sapiens
ggctgccagcccagc

SEQ ID NO: 1290911 - DNA, 10 bp, Homo sapiens
ggctggctgc

SEQ ID NO: 1290912 - DNA, 12 bp, Homo sapiens
ggcttggagagg

SEQ ID NO: 1290913 - DNA, 14 bp, Homo sapiens
ggcttggagaggta

SEQ ID NO: 1290914 - DNA, 14 bp, Homo sapiens
ggcttggctgcccc

SEQ ID NO: 1290915 - DNA, 18 bp, Homo sapiens
gggaatgaaccatggcac

SEQ ID NO: 1290916 - DNA, 24 bp, Homo sapiens
gggacacggtttaactgtcccagc

SEQ ID NO: 1290917 - DNA, 16 bp, Homo sapiens
gggacccaggctccca

SEQ ID NO: 1290918 - DNA, 18 bp, Homo sapiens
gggacccaggctcccagc

SEQ ID NO: 1290919 - DNA, 22 bp, Homo sapiens
gggagtaagaaatgggcctcag

SEQ ID NO: 1290920 - DNA, 24 bp, Homo sapiens
gggagtaagaaatgggcctcagcc

SEQ ID NO: 1290921 - DNA, 12 bp, Homo sapiens
gggatggtcagg

SEQ ID NO: 1290922 - DNA, 17 bp, Homo sapiens
gggcaagatccaggtgg

SEQ ID NO: 1290923 - DNA, 21 bp, Homo sapiens
gggcactgtggtcaggcccag

SEQ ID NO: 1290924 - DNA, 18 bp, Homo sapiens
gggcagcaattcacgctg

SEQ ID NO: 1290925 - DNA, 12 bp, Homo sapiens
gggctcactctg

SEQ ID NO: 1290926 - DNA, 16 bp, Homo sapiens
gggctcactctggccc

SEQ ID NO: 1290927 - DNA, 13 bp, Homo sapiens
gggctgagccatg

SEQ ID NO: 1290928 - DNA, 15 bp, Homo sapiens
gggctgccagcccag

SEQ ID NO: 1290929 - DNA, 21 bp, Homo sapiens
gggctgccagcccagctggcc

SEQ ID NO: 1290930 - DNA, 14 bp, Homo sapiens
gggctggctgcaga

SEQ ID NO: 1290931 - DNA, 15 bp, Homo sapiens
gggctggctgcagac

SEQ ID NO: 1290932 - DNA, 14 bp, Homo sapiens
ggggcactgtggtc

SEQ ID NO: 1290933 - DNA, 19 bp, Homo sapiens
ggggcactgtggtcaggcc

SEQ ID NO: 1290934 - DNA, 21 bp, Homo sapiens
ggggcactgtggtcaggccca

SEQ ID NO: 1290935 - DNA, 19 bp, Homo sapiens
ggggccttcctggctttgg

SEQ ID NO: 1290936 - DNA, 16 bp, Homo sapiens
ggggcttggctgcccc

SEQ ID NO: 1290937 - DNA, 13 bp, Homo sapiens
gggggcactgtgg

SEQ ID NO: 1290938 - DNA, 19 bp, Homo sapiens
gggggcactgtggtcaggc

SEQ ID NO: 1290939 - DNA, 22 bp, Homo sapiens
ggggttcttgtccacggggctc

SEQ ID NO: 1290940 - DNA, 20 bp, Homo sapiens
gggtcaactggcgaagcctg

SEQ ID NO: 1290941 - DNA, 17 bp, Homo sapiens
gggtcccagggctggcc

SEQ ID NO: 1290942 - DNA, 18 bp, Homo sapiens
gggtgctcaccgcctgct

SEQ ID NO: 1290943 - DNA, 23 bp, Homo sapiens
ggtcaactggcgaagcctgagca

SEQ ID NO: 1290944 - DNA, 18 bp, Homo sapiens
ggtcaggcaatgccctgc

SEQ ID NO: 1290945 - DNA, 13 bp, Homo sapiens
ggtcaggcccagc

SEQ ID NO: 1290946 - DNA, 21 bp, Homo sapiens
ggtcccagggctggccctagg

SEQ ID NO: 1290947 - DNA, 23 bp, Homo sapiens
ggtccccctcccacttgacctga

SEQ ID NO: 1290948 - DNA, 16 bp, Homo sapiens
ggtcgggctgccagcc

SEQ ID NO: 1290949 - DNA, 13 bp, Homo sapiens
ggtctggtcaggc

SEQ ID NO: 1290950 - DNA, 12 bp, Homo sapiens
ggtgcctggggc

SEQ ID NO: 1290951 - DNA, 19 bp, Homo sapiens
ggtggcaaccccagaccca

SEQ ID NO: 1290952 - DNA, 16 bp, Homo sapiens
gtaagaaatgggcctc

SEQ ID NO: 1290953 - DNA, 20 bp, Homo sapiens
gtaagaaatgggcctcagcc

SEQ ID NO: 1290954 - DNA, 13 bp, Homo sapiens
agagggggcactg

SEQ ID NO: 1290955 - DNA, 19 bp, Homo sapiens
agaggtatgtgcccctcct

SEQ ID NO: 1290956 - DNA, 20 bp, Homo sapiens
agaggtatgtgcccctcctg

SEQ ID NO: 1290957 - DNA, 22 bp, Homo sapiens
agaggtatgtgcccctcctggg

SEQ ID NO: 1290958 - DNA, 13 bp, Homo sapiens
agagtggcctggg

SEQ ID NO: 1290959 - DNA, 18 bp, Homo sapiens
agagtggcctgggtccca

SEQ ID NO: 1290960 - DNA, 15 bp, Homo sapiens
agatagacctgtgac

SEQ ID NO: 1290961 - DNA, 14 bp, Homo sapiens
agatgctgggaggg

SEQ ID NO: 1290962 - DNA, 16 bp, Homo sapiens
agcaacttcatcccag

SEQ ID NO: 1290963 - DNA, 21 bp, Homo sapiens
agcaacttcatcccagctgct

SEQ ID NO: 1290964 - DNA, 23 bp, Homo sapiens
agcaacttcatcccagctgctga

SEQ ID NO: 1290965 - DNA, 22 bp, Homo sapiens
agcagccggaagtctgttctca

SEQ ID NO: 1290966 - DNA, 20 bp, Homo sapiens
agcagcctttttcaccatgg

SEQ ID NO: 1290967 - DNA, 15 bp, Homo sapiens
agcaggagggaagga

SEQ ID NO: 1290968 - DNA, 19 bp, Homo sapiens
agcaggcaggggcttggct

SEQ ID NO: 1290969 - DNA, 14 bp, Homo sapiens
agcagttggcctgt

SEQ ID NO: 1290970 - DNA, 22 bp, Homo sapiens
agccagccatcggaagagaggg

SEQ ID NO: 1290971 - DNA, 23 bp, Homo sapiens
agccagccatcggaagagagggc

SEQ ID NO: 1290972 - DNA, 20 bp, Homo sapiens
agccatggcggcccctcagc

SEQ ID NO: 1290973 - DNA, 16 bp, Homo sapiens
agccatgggggtttgg

SEQ ID NO: 1290974 - DNA, 19 bp, Homo sapiens
agccccattcacggcctgg

SEQ ID NO: 1290975 - DNA, 21 bp, Homo sapiens
agccccattcacggcctggca

SEQ ID NO: 1290976 - DNA, 14 bp, Homo sapiens
agccctgagccatg

SEQ ID NO: 1290977 - DNA, 20 bp, Homo sapiens
agccggagcagttggcctgt

SEQ ID NO: 1290978 - DNA, 17 bp, Homo sapiens
agcctctctggctcagc

SEQ ID NO: 1290979 - DNA, 14 bp, Homo sapiens
agcctgagcaggca

SEQ ID NO: 1290980 - DNA, 15 bp, Homo sapiens
agcctgagcaggcag

SEQ ID NO: 1290981 - DNA, 14 bp, Homo sapiens
agcctgcctgaaga

SEQ ID NO: 1290982 - DNA, 15 bp, Homo sapiens
agcctgcctgaagag

SEQ ID NO: 1290983 - DNA, 13 bp, Homo sapiens
agcctggctgtca

SEQ ID NO: 1290984 - DNA, 20 bp, Homo sapiens
agcctttttcaccatggcaa

SEQ ID NO: 1290985 - DNA, 19 bp, Homo sapiens
agcggagcttggccctgcg

SEQ ID NO: 1290986 - DNA, 13 bp, Homo sapiens
agctcctctccag

SEQ ID NO: 1290987 - DNA, 17 bp, Homo sapiens
agctcctctccagacac

SEQ ID NO: 1290988 - DNA, 19 bp, Homo sapiens
agctggccggaaggagact

SEQ ID NO: 1290989 - DNA, 14 bp, Homo sapiens
agctgtcggagggc

SEQ ID NO: 1290990 - DNA, 18 bp, Homo sapiens
agctgtcggagggctgga

SEQ ID NO: 1290991 - DNA, 13 bp, Homo sapiens
agcttggccctgc

SEQ ID NO: 1290992 - DNA, 17 bp, Homo sapiens
agcttggccctgcgccc

SEQ ID NO: 1290993 - DNA, 19 bp, Homo sapiens
agcttgtccttgctcctgg

SEQ ID NO: 1290994 - DNA, 21 bp, Homo sapiens
agctttgagacaggtgcctgg

SEQ ID NO: 1290995 - DNA, 23 bp, Homo sapiens
aggaaactggcgatctcccaggg

SEQ ID NO: 1290996 - DNA, 12 bp, Homo sapiens
aggacacactga

SEQ ID NO: 1290997 - DNA, 17 bp, Homo sapiens
aggagttttctgtgtgg

SEQ ID NO: 1290998 - DNA, 23 bp, Homo sapiens
aggagttttctgtgtggtctcca

SEQ ID NO: 1290999 - DNA, 15 bp, Homo sapiens
aggcaatgccctgcg

SEQ ID NO: 1291000 - DNA, 16 bp, Homo sapiens
aggcaggggcttggct

SEQ ID NO: 1291001 - DNA, 19 bp, Homo sapiens
aggcaggggcttggctgcc

SEQ ID NO: 1291002 - DNA, 20 bp, Homo sapiens
aggcaggggcttggctgccc

SEQ ID NO: 1291003 - DNA, 21 bp, Homo sapiens
aggcaggggcttggctgcccc

SEQ ID NO: 1291004 - DNA, 17 bp, Homo sapiens
aggcaggtcgggctgcc

SEQ ID NO: 1291005 - DNA, 20 bp, Homo sapiens
aggcaggtcgggctgccagc

SEQ ID NO: 1291006 - DNA, 14 bp, Homo sapiens
aggccagacacagg

SEQ ID NO: 1291007 - DNA, 17 bp, Homo sapiens
aggccagacacaggccg

SEQ ID NO: 1291008 - DNA, 13 bp, Homo sapiens
aggcccagcctct

SEQ ID NO: 1291009 - DNA, 18 bp, Homo sapiens
aggcccagcctctctggc

SEQ ID NO: 1291010 - DNA, 14 bp, Homo sapiens
aggccctgcccagc

SEQ ID NO: 1291011 - DNA, 20 bp, Homo sapiens
aggccctgcccagccagcca

SEQ ID NO: 1291012 - DNA, 21 bp, Homo sapiens
aggccctgcccagccagccat

SEQ ID NO: 1291013 - DNA, 16 bp, Homo sapiens
aggccgtgggacccag

SEQ ID NO: 1291014 - DNA, 19 bp, Homo sapiens
aggccgtgggacccaggct

SEQ ID NO: 1291015 - DNA, 20 bp, Homo sapiens
aggccgtgggacccaggctc

SEQ ID NO: 1291016 - DNA, 12 bp, Homo sapiens
aggctcccagcc

SEQ ID NO: 1291017 - DNA, 23 bp, Homo sapiens
aggctcccagcctaagggagaca

SEQ ID NO: 1291018 - DNA, 16 bp, Homo sapiens
aggcttccagaggaga

SEQ ID NO: 1291019 - DNA, 24 bp, Homo sapiens
aggcttccagaggagagtggcctg

SEQ ID NO: 1291020 - DNA, 19 bp, Homo sapiens
agggaaagggatggtcagg

SEQ ID NO: 1291021 - DNA, 15 bp, Homo sapiens
agggagacaggcctt

SEQ ID NO: 1291022 - DNA, 13 bp, Homo sapiens
agggatggtcagg

SEQ ID NO: 1291023 - DNA, 17 bp, Homo sapiens
agggatggtcaggccca

SEQ ID NO: 1291024 - DNA, 19 bp, Homo sapiens
agggatggtcaggcccagt

SEQ ID NO: 1291025 - DNA, 14 bp, Homo sapiens
agggctgagccatg

SEQ ID NO: 1291026 - DNA, 20 bp, Homo sapiens
agggctggccctaggcactg

SEQ ID NO: 1291027 - DNA, 23 bp, Homo sapiens
aggggaatgaaccatggcacctt

SEQ ID NO: 1291028 - DNA, 17 bp, Homo sapiens
aggggcttggctgcccc

SEQ ID NO: 1291029 - DNA, 18 bp, Homo sapiens
aggggcttggctgcccca

SEQ ID NO: 1291030 - DNA, 23 bp, Homo sapiens
agggggcactgtggtcaggccca

SEQ ID NO: 1291031 - DNA, 15 bp, Homo sapiens
agggtcaactggcga

SEQ ID NO: 1291032 - DNA, 21 bp, Homo sapiens
agggtcaactggcgaagcctg

SEQ ID NO: 1291033 - DNA, 20 bp, Homo sapiens
aggtatgtgcccctcctggg

SEQ ID NO: 1291034 - DNA, 15 bp, Homo sapiens
aggtcgggctgccag

SEQ ID NO: 1291035 - DNA, 16 bp, Homo sapiens
aggtcgggctgccagc

SEQ ID NO: 1291036 - DNA, 23 bp, Homo sapiens
aggtcgggctgccagcccagctg

SEQ ID NO: 1291037 - DNA, 18 bp, Homo sapiens
aggtcttcactgcccagg

SEQ ID NO: 1291038 - DNA, 13 bp, Homo sapiens
aggtgcctggggc

SEQ ID NO: 1291039 - DNA, 16 bp, Homo sapiens
aggtgcctggggctgg

SEQ ID NO: 1291040 - DNA, 18 bp, Homo sapiens
agtaagaaatgggcctca

SEQ ID NO: 1291041 - DNA, 19 bp, Homo sapiens
agtcacaaaccagcctggg

SEQ ID NO: 1291042 - DNA, 20 bp, Homo sapiens
agtcagtcacaaaccagcct

SEQ ID NO: 1291043 - DNA, 21 bp, Homo sapiens
agtcagtcacaaaccagcctg

SEQ ID NO: 1291044 - DNA, 22 bp, Homo sapiens
agtcagtcacaaaccagcctgg

SEQ ID NO: 1291045 - DNA, 19 bp, Homo sapiens
agtctcacctgccggctct

SEQ ID NO: 1291046 - DNA, 16 bp, Homo sapiens
agtggaatccagtgtg

SEQ ID NO: 1291047 - DNA, 17 bp, Homo sapiens
agtggaatccagtgtgg

SEQ ID NO: 1291048 - DNA, 18 bp, Homo sapiens
agtggaatccagtgtggc

SEQ ID NO: 1291049 - DNA, 13 bp, Homo sapiens
agtggcctgggtc

SEQ ID NO: 1291050 - DNA, 16 bp, Homo sapiens
agtggggagcggagct

SEQ ID NO: 1291051 - DNA, 13 bp, Homo sapiens
agtgtggctccca

SEQ ID NO: 1291052 - DNA, 14 bp, Homo sapiens
agttcaccagccct

SEQ ID NO: 1291053 - DNA, 16 bp, Homo sapiens
agttcaccagccctga

SEQ ID NO: 1291054 - DNA, 17 bp, Homo sapiens
agttcaccagccctgag

SEQ ID NO: 1291055 - DNA, 18 bp, Homo sapiens
agttcaccagccctgagc

SEQ ID NO: 1291056 - DNA, 14 bp, Homo sapiens
agttctcttctcct

SEQ ID NO: 1291057 - DNA, 16 bp, Homo sapiens
atcacccccaggacct

SEQ ID NO: 1291058 - DNA, 20 bp, Homo sapiens
aaactggcgatctcccaggg

SEQ ID NO: 1291059 - DNA, 18 bp, Homo sapiens
aaaggcttccagaggaga

SEQ ID NO: 1291060 - DNA, 19 bp, Homo sapiens
aaataaaaggcttccagag

SEQ ID NO: 1291061 - DNA, 20 bp, Homo sapiens
aaatcctatttttgtagatc

SEQ ID NO: 1291062 - DNA, 22 bp, Homo sapiens
aaccagcctggggccttcctgg

SEQ ID NO: 1291063 - DNA, 19 bp, Homo sapiens
aacccatgcccctgacaga

SEQ ID NO: 1291064 - DNA, 16 bp, Homo sapiens
aactggcgaagcctga

SEQ ID NO: 1291065 - DNA, 18 bp, Homo sapiens
aactggcgaagcctgagc

SEQ ID NO: 1291066 - DNA, 17 bp, Homo sapiens
aactggcgatctcccag

SEQ ID NO: 1291067 - DNA, 19 bp, Homo sapiens
aactggcgatctcccaggg

SEQ ID NO: 1291068 - DNA, 21 bp, Homo sapiens
aactggcgatctcccagggct

SEQ ID NO: 1291069 - DNA, 17 bp, Homo sapiens
aactgtcaccctgaggt

SEQ ID NO: 1291070 - DNA, 17 bp, Homo sapiens
aagaaatgggcctcagc

SEQ ID NO: 1291071 - DNA, 15 bp, Homo sapiens
aagcctgagcaggca

SEQ ID NO: 1291072 - DNA, 17 bp, Homo sapiens
aagcctgagcaggcagg

SEQ ID NO: 1291073 - DNA, 16 bp, Homo sapiens
aagggatggtcaggcc

SEQ ID NO: 1291074 - DNA, 17 bp, Homo sapiens
aagtattatgtttcttc

SEQ ID NO: 1291075 - DNA, 15 bp, Homo sapiens
aagttcaccagccct

SEQ ID NO: 1291076 - DNA, 16 bp, Homo sapiens
aagttcaccagccctg

SEQ ID NO: 1291077 - DNA, 19 bp, Homo sapiens
aagttcaccagccctgagc

SEQ ID NO: 1291078 - DNA, 11 bp, Homo sapiens
aatgccctgcg

SEQ ID NO: 1291079 - DNA, 20 bp, Homo sapiens
aatgccctgcggctctggaa

SEQ ID NO: 1291080 - DNA, 16 bp, Homo sapiens
aatgcggttgggaggc

SEQ ID NO: 1291081 - DNA, 12 bp, Homo sapiens
acaaaccagcct

SEQ ID NO: 1291082 - DNA, 14 bp, Homo sapiens
acaaaccagcctgg

SEQ ID NO: 1291083 - DNA, 15 bp, Homo sapiens
acaaaccagcctggg

SEQ ID NO: 1291084 - DNA, 11 bp, Homo sapiens
acacaggcagg

SEQ ID NO: 1291085 - DNA, 23 bp, Homo sapiens
acacaggccgtgggacccaggct

SEQ ID NO: 1291086 - DNA, 16 bp, Homo sapiens
acacggaggccagaca

SEQ ID NO: 1291087 - DNA, 22 bp, Homo sapiens
acaggccgtgggacccaggctc

SEQ ID NO: 1291088 - DNA, 20 bp, Homo sapiens
acaggtcttcactgcccagg

SEQ ID NO: 1291089 - DNA, 16 bp, Homo sapiens
acaggtgcctggggct

SEQ ID NO: 1291090 - DNA, 21 bp, Homo sapiens
acaggtgcctggggctggctg

SEQ ID NO: 1291091 - DNA, 15 bp, Homo sapiens
acatcaagtgccaga

SEQ ID NO: 1291092 - DNA, 23 bp, Homo sapiens
acatcaagtgccagatgttgtct

SEQ ID NO: 1291093 - DNA, 12 bp, Homo sapiens
acatgggagtgg

SEQ ID NO: 1291094 - DNA, 14 bp, Homo sapiens
accagccctgagcc

SEQ ID NO: 1291095 - DNA, 16 bp, Homo sapiens
accagcctggggcctt

SEQ ID NO: 1291096 - DNA, 16 bp, Homo sapiens
accatacgcggaggag

SEQ ID NO: 1291097 - DNA, 20 bp, Homo sapiens
accatggcacctttgagaga

SEQ ID NO: 1291098 - DNA, 19 bp, Homo sapiens
acccaacccatgcccctga

SEQ ID NO: 1291099 - DNA, 23 bp, Homo sapiens
acccaacccatgcccctgacaga

SEQ ID NO: 1291100 - DNA, 12 bp, Homo sapiens
acccccaggacc

SEQ ID NO: 1291101 - DNA, 19 bp, Homo sapiens
acccccaggacctcttcag

SEQ ID NO: 1291102 - DNA, 23 bp, Homo sapiens
acccttagcttttagcctggctg

SEQ ID NO: 1291103 - DNA, 22 bp, Homo sapiens
accgcctgctacacaggcagga

SEQ ID NO: 1291104 - DNA, 21 bp, Homo sapiens
accgggcgcatgcctcccagg

SEQ ID NO: 1291105 - DNA, 19 bp, Homo sapiens
acctcttcagctgctgaca

SEQ ID NO: 1291106 - DNA, 21 bp, Homo sapiens
acctgagatgctgggagggct

SEQ ID NO: 1291107 - DNA, 18 bp, Homo sapiens
acctgccggctctgggct

SEQ ID NO: 1291108 - DNA, 19 bp, Homo sapiens
acctgccggctctgggctg

SEQ ID NO: 1291109 - DNA, 15 bp, Homo sapiens
acctggcaggccctg

SEQ ID NO: 1291110 - DNA, 22 bp, Homo sapiens
acctggcaggccctgcccagcc

SEQ ID NO: 1291111 - DNA, 18 bp, Homo sapiens
acctggtctggtcaggca

SEQ ID NO: 1291112 - DNA, 13 bp, Homo sapiens
acctgtgacctgg

SEQ ID NO: 1291113 - DNA, 20 bp, Homo sapiens
acggcctggcatgcagcttg

SEQ ID NO: 1291114 - DNA, 17 bp, Homo sapiens
acggggctcactctggc

SEQ ID NO: 1291115 - DNA, 13 bp, Homo sapiens
actaatcgagcac

SEQ ID NO: 1291116 - DNA, 21 bp, Homo sapiens
actagtccaatcacccccagg

SEQ ID NO: 1291117 - DNA, 11 bp, Homo sapiens
actctggcccc

SEQ ID NO: 1291118 - DNA, 23 bp, Homo sapiens
actgatagttgccttttcttccc

SEQ ID NO: 1291119 - DNA, 14 bp, Homo sapiens
actggcgaagcctg

SEQ ID NO: 1291120 - DNA, 18 bp, Homo sapiens
actggcgaagcctgagca

SEQ ID NO: 1291121 - DNA, 21 bp, Homo sapiens
actggcgaagcctgagcaggc

SEQ ID NO: 1291122 - DNA, 22 bp, Homo sapiens
actggcgaagcctgagcaggca

SEQ ID NO: 1291123 - DNA, 16 bp, Homo sapiens
actggcgatctcccag

SEQ ID NO: 1291124 - DNA, 17 bp, Homo sapiens
actggcgatctcccagg

SEQ ID NO: 1291125 - DNA, 19 bp, Homo sapiens
actggcgatctcccagggc

SEQ ID NO: 1291126 - DNA, 20 bp, Homo sapiens
actggcgatctcccagggct

SEQ ID NO: 1291127 - DNA, 13 bp, Homo sapiens
actgtcaccctga

SEQ ID NO: 1291128 - DNA, 16 bp, Homo sapiens
acttcatcccagctgc

SEQ ID NO: 1291129 - DNA, 19 bp, Homo sapiens
acttcatcccagctgctga

SEQ ID NO: 1291130 - DNA, 21 bp, Homo sapiens
acttcatcccagctgctgagg

SEQ ID NO: 1291131 - DNA, 18 bp, Homo sapiens
agaagttcaccagccctg

SEQ ID NO: 1291132 - DNA, 19 bp, Homo sapiens
agaagttcaccagccctga

SEQ ID NO: 1291133 - DNA, 22 bp, Homo sapiens
agaagttcaccagccctgagcc

SEQ ID NO: 1291134 - DNA, 16 bp, Homo sapiens
agacacagagacatgg

SEQ ID NO: 1291135 - DNA, 16 bp, Homo sapiens
agacaggtgcctgggg

SEQ ID NO: 1291136 - DNA, 21 bp, Homo sapiens
agacccaacccatgcccctga

SEQ ID NO: 1291137 - DNA, 13 bp, Homo sapiens
agacccaaccctt

SEQ ID NO: 1291138 - DNA, 19 bp, Homo sapiens
agacctgtgacctggtctg

SEQ ID NO: 1291139 - DNA, 17 bp, Homo sapiens
agagaactgtcaccctg

SEQ ID NO: 1291140 - DNA, 22 bp, Homo sapiens
agagagggggcactgtggtcag

SEQ ID NO: 1291141 - DNA, 22 bp, Homo sapiens
agaggaaactggcgatctccca

SEQ ID NO: 1291142 - DNA, 19 bp, Homo sapiens
agaggacctctttggggca

SEQ ID NO: 1291143 - DNA, 19 bp, Homo sapiens
agaggagagtggcctgggt

SEQ ID NO: 1291144 - DNA, 23 bp, Homo sapiens
agagggggcactgtggtcaggcc

SEQ ID NO: 1291145 - DNA, 21 bp, Homo sapiens
agaggtatgtgcccctcctgg

SEQ ID NO: 1291146 - DNA, 14 bp, Homo sapiens
agagtggcctgggt

SEQ ID NO: 1291147 - DNA, 24 bp, Homo sapiens
agagtggcctgggtcccagggctg

SEQ ID NO: 1291148 - DNA, 21 bp, Homo sapiens
agatctagttctcttctcctg

SEQ ID NO: 1291149 - DNA, 16 bp, Homo sapiens
agatgctgggagggct

SEQ ID NO: 1291150 - DNA, 17 bp, Homo sapiens
agatgctgggagggctg

SEQ ID NO: 1291151 - DNA, 18 bp, Homo sapiens
agatgctgggagggctga

SEQ ID NO: 1291152 - DNA, 19 bp, Homo sapiens
agcaacttcatcccagctg

SEQ ID NO: 1291153 - DNA, 15 bp, Homo sapiens
agcacacacacacag

SEQ ID NO: 1291154 - DNA, 19 bp, Homo sapiens
agcacacacacacagtcct

SEQ ID NO: 1291155 - DNA, 20 bp, Homo sapiens
agcagaagtggaatccagtg

SEQ ID NO: 1291156 - DNA, 23 bp, Homo sapiens
agcagcctttttcaccatggcaa

SEQ ID NO: 1291157 - DNA, 15 bp, Homo sapiens
agcagttggcctgtg

SEQ ID NO: 1291158 - DNA, 17 bp, Homo sapiens
agccagccatcggaaga

SEQ ID NO: 1291159 - DNA, 21 bp, Homo sapiens
agccagccatcggaagagagg

SEQ ID NO: 1291160 - DNA, 14 bp, Homo sapiens
agccatcggaagag

SEQ ID NO: 1291161 - DNA, 20 bp, Homo sapiens
agccatcggaagagagggct

SEQ ID NO: 1291162 - DNA, 22 bp, Homo sapiens
agccatcggaagagagggctga

SEQ ID NO: 1291163 - DNA, 19 bp, Homo sapiens
agcccagctggccggaagg

SEQ ID NO: 1291164 - DNA, 24 bp, Homo sapiens
agccccattcacggcctggcatgc

SEQ ID NO: 1291165 - DNA, 22 bp, Homo sapiens
agccccgcggatcaaccaggca

SEQ ID NO: 1291166 - DNA, 23 bp, Homo sapiens
agccccgcggatcaaccaggcag

SEQ ID NO: 1291167 - DNA, 18 bp, Homo sapiens
agcccgggagctttgaga

SEQ ID NO: 1291168 - DNA, 22 bp, Homo sapiens
agcccgggagctttgagacagg

SEQ ID NO: 1291169 - DNA, 11 bp, Homo sapiens
agccctgagcc

SEQ ID NO: 1291170 - DNA, 15 bp, Homo sapiens
agccctgagccatgg

SEQ ID NO: 1291171 - DNA, 19 bp, Homo sapiens
agccctgagccatggcggc

SEQ ID NO: 1291172 - DNA, 13 bp, Homo sapiens
agcctctctggct

SEQ ID NO: 1291173 - DNA, 16 bp, Homo sapiens
agcctctctggctcag

SEQ ID NO: 1291174 - DNA, 18 bp, Homo sapiens
agcctgcctgaagagagg

SEQ ID NO: 1291175 - DNA, 20 bp, Homo sapiens
agcctggggccttcctggct

SEQ ID NO: 1291176 - DNA, 15 bp, Homo sapiens
agcgacatttctcca

SEQ ID NO: 1291177 - DNA, 18 bp, Homo sapiens
agcggagcttggccctgc

SEQ ID NO: 1291178 - DNA, 14 bp, Homo sapiens
agctctcccatgga

SEQ ID NO: 1291179 - DNA, 16 bp, Homo sapiens
agctgtcggagggctg

SEQ ID NO: 1291180 - DNA, 17 bp, Homo sapiens
agctgtcggagggctgg

SEQ ID NO: 1291181 - DNA, 20 bp, Homo sapiens
agctgtcggagggctggaca

SEQ ID NO: 1291182 - DNA, 21 bp, Homo sapiens
agcttggccctgcgccctgtg

SEQ ID NO: 1291183 - DNA, 19 bp, Homo sapiens
agctttgagacaggtgcct

SEQ ID NO: 1291184 - DNA, 15 bp, Homo sapiens
agcttttagcctggc

SEQ ID NO: 1291185 - DNA, 13 bp, Homo sapiens
aggaaactggcga

SEQ ID NO: 1291186 - DNA, 22 bp, Homo sapiens
aggaatgcggttgggaggcagg

SEQ ID NO: 1291187 - DNA, 22 bp, Homo sapiens
aggacacactgaaaagcagcct

SEQ ID NO: 1291188 - DNA, 15 bp, Homo sapiens
aggacctcttcagct

SEQ ID NO: 1291189 - DNA, 18 bp, Homo sapiens
aggacctcttcagctgct

SEQ ID NO: 1291190 - DNA, 13 bp, Homo sapiens
aggagactgtggt

SEQ ID NO: 1291191 - DNA, 22 bp, Homo sapiens
aggagagtggcctgggtcccag

SEQ ID NO: 1291192 - DNA, 18 bp, Homo sapiens
aggatggggttcttgtcc

SEQ ID NO: 1291193 - DNA, 18 bp, Homo sapiens
aggatttttccatggaca

SEQ ID NO: 1291194 - DNA, 14 bp, Homo sapiens
aggcaatgccctgc

SEQ ID NO: 1291195 - DNA, 16 bp, Homo sapiens
aggcaatgccctgcgg

SEQ ID NO: 1291196 - DNA, 14 bp, Homo sapiens
aggcaggggcttgg

SEQ ID NO: 1291197 - DNA, 23 bp, Homo sapiens
aggcaggtcgggctgccagccca

SEQ ID NO: 1291198 - DNA, 16 bp, Homo sapiens
aggccagacacaggcc

SEQ ID NO: 1291199 - DNA, 18 bp, Homo sapiens
aggccagacacaggccgt

SEQ ID NO: 1291200 - DNA, 20 bp, Homo sapiens
aggccagacacaggccgtgg

SEQ ID NO: 1291201 - DNA, 22 bp, Homo sapiens
aggcccagcctctctggctcag

SEQ ID NO: 1291202 - DNA, 22 bp, Homo sapiens
aggcccagttctcgtgccctta

SEQ ID NO: 1291203 - DNA, 12 bp, Homo sapiens
aggccctgccca

SEQ ID NO: 1291204 - DNA, 13 bp, Homo sapiens
aggccctgcccag

SEQ ID NO: 1291205 - DNA, 17 bp, Homo sapiens
aggccctgcccagccag

SEQ ID NO: 1291206 - DNA, 21 bp, Homo sapiens
agggagacaggcctttccctg

SEQ ID NO: 1291207 - DNA, 16 bp, Homo sapiens
agggctctctggacca

SEQ ID NO: 1291208 - DNA, 15 bp, Homo sapiens
agggctgagccatgg

SEQ ID NO: 1291209 - DNA, 12 bp, Homo sapiens
agggctggccct

SEQ ID NO: 1291210 - DNA, 15 bp, Homo sapiens
agggctggccctagg

SEQ ID NO: 1291211 - DNA, 17 bp, Homo sapiens
agggctggccctaggca

SEQ ID NO: 1291212 - DNA, 21 bp, Homo sapiens
agggctggccctaggcactga

SEQ ID NO: 1291213 - DNA, 19 bp, Homo sapiens
aggtatgtgcccctcctgg

SEQ ID NO: 1291214 - DNA, 21 bp, Homo sapiens
aggtcccattttccccctgtg

SEQ ID NO: 1291215 - DNA, 19 bp, Homo sapiens
aggtcgggctgccagccca

SEQ ID NO: 1291216 - DNA, 20 bp, Homo sapiens
aggtgcctggggctggctgc

SEQ ID NO: 1291217 - DNA, 17 bp, Homo sapiens
agtaagaaatgggcctc

SEQ ID NO: 1291218 - DNA, 19 bp, Homo sapiens
agtaagaaatgggcctcag

SEQ ID NO: 1291219 - DNA, 20 bp, Homo sapiens
agtcacaaaccagcctgggg

SEQ ID NO: 1291220 - DNA, 23 bp, Homo sapiens
agtcagtcacaaaccagcctggg

SEQ ID NO: 1291221 - DNA, 21 bp, Homo sapiens
agtccaatcacccccaggacc

SEQ ID NO: 1291222 - DNA, 17 bp, Homo sapiens
agtctcacctgccggct

SEQ ID NO: 1291223 - DNA, 21 bp, Homo sapiens
agtctcacctgccggctctgg

SEQ ID NO: 1291224 - DNA, 22 bp, Homo sapiens
agtctcacctgccggctctggg

SEQ ID NO: 1291225 - DNA, 22 bp, Homo sapiens
agtggaatccagtgtggctccc

SEQ ID NO: 1291226 - DNA, 11 bp, Homo sapiens
agtggcctggg

SEQ ID NO: 1291227 - DNA, 21 bp, Homo sapiens
agtgtctatggagcagccgga

SEQ ID NO: 1291228 - DNA, 16 bp, Homo sapiens
agtgtggctcccacag

SEQ ID NO: 1291229 - DNA, 14 bp, Homo sapiens
agttctcgtgccct

SEQ ID NO: 1291230 - DNA, 16 bp, Homo sapiens
agttctcttctcctgt

SEQ ID NO: 1291231 - DNA, 17 bp, Homo sapiens
agttctcttctcctgtg

SEQ ID NO: 1291232 - DNA, 14 bp, Homo sapiens
agttgccttttctt

SEQ ID NO: 1291233 - DNA, 13 bp, Homo sapiens
atcaaccaggcag

SEQ ID NO: 1291234 - DNA, 14 bp, Homo sapiens
atcaaccaggcaga

SEQ ID NO: 1291235 - DNA, 16 bp, Homo sapiens
atcaaccaggcagagt

SEQ ID NO: 1291236 - DNA, 17 bp, Homo sapiens
atcacccccaggacctc

SEQ ID NO: 1291237 - DNA, 10 bp, Homo sapiens
atccaggtgg

SEQ ID NO: 1291238 - DNA, 15 bp, Homo sapiens
atccaggtggtccca

SEQ ID NO: 1291239 - DNA, 22 bp, Homo sapiens
atcctatttttgtagatctcca

SEQ ID NO: 1291240 - DNA, 13 bp, Homo sapiens
atctcccagggct

SEQ ID NO: 1291241 - DNA, 14 bp, Homo sapiens
atctcccagggctc

SEQ ID NO: 1291242 - DNA, 16 bp, Homo sapiens
atctcccagggctctc

SEQ ID NO: 1291243 - DNA, 16 bp, Homo sapiens
atgcagcttgtccttg

SEQ ID NO: 1291244 - DNA, 18 bp, Homo sapiens
atgccctgcggctctgga

SEQ ID NO: 1291245 - DNA, 14 bp, Homo sapiens
atgcctcccaggcc

SEQ ID NO: 1291246 - DNA, 20 bp, Homo sapiens
atgctgggagggctgaaccc

SEQ ID NO: 1291247 - DNA, 15 bp, Homo sapiens
atggtcaggcccagt

SEQ ID NO: 1291248 - DNA, 15 bp, Homo sapiens
atgtgcccctcctgg

SEQ ID NO: 1291249 - DNA, 16 bp, Homo sapiens
attcacggcctggcat

SEQ ID NO: 1291250 - DNA, 19 bp, Homo sapiens
attgtctccaaggtcccat

SEQ ID NO: 1291251 - DNA, 14 bp, Homo sapiens
atttgtggcagtgc

SEQ ID NO: 1291252 - DNA, 17 bp, Homo sapiens
atttttaaaacaaacca

SEQ ID NO: 1291253 - DNA, 13 bp, Homo sapiens
caaaccagcctgg

SEQ ID NO: 1291254 - DNA, 15 bp, Homo sapiens
caaaccagcctgggg

SEQ ID NO: 1291255 - DNA, 21 bp, Homo sapiens
caaagaactaaggatttttcc

SEQ ID NO: 1291256 - DNA, 14 bp, Homo sapiens
caaccaggcagagt

SEQ ID NO: 1291257 - DNA, 15 bp, Homo sapiens
caacccatgcccctg

SEQ ID NO: 1291258 - DNA, 21 bp, Homo sapiens
caacccatgcccctgacagat

SEQ ID NO: 1291259 - DNA, 22 bp, Homo sapiens
caacccttagcttttagcctgg

SEQ ID NO: 1291260 - DNA, 23 bp, Homo sapiens
caacccttagcttttagcctggc

SEQ ID NO: 1291261 - DNA, 20 bp, Homo sapiens
caactggcgaagcctgagca

SEQ ID NO: 1291262 - DNA, 17 bp, Homo sapiens
caacttcatcccagctg

SEQ ID NO: 1291263 - DNA, 19 bp, Homo sapiens
caacttcatcccagctgct

SEQ ID NO: 1291264 - DNA, 21 bp, Homo sapiens
caacttcatcccagctgctga

SEQ ID NO: 1291265 - DNA, 22 bp, Homo sapiens
caagccccattcacggcctggc

SEQ ID NO: 1291266 - DNA, 23 bp, Homo sapiens
caaggcttggagaggtatgtgcc

SEQ ID NO: 1291267 - DNA, 13 bp, Homo sapiens
caatcacccccag

SEQ ID NO: 1291268 - DNA, 15 bp, Homo sapiens
caatcacccccagga

SEQ ID NO: 1291269 - DNA, 13 bp, Homo sapiens
caatgaccagcag

SEQ ID NO: 1291270 - DNA, 21 bp, Homo sapiens
caatgccctgcggctctggaa

SEQ ID NO: 1291271 - DNA, 13 bp, Homo sapiens
caattcacgctgt

SEQ ID NO: 1291272 - DNA, 17 bp, Homo sapiens
cacaagggtgcaagccc

SEQ ID NO: 1291273 - DNA, 18 bp, Homo sapiens
cacacacagtcctcacac

SEQ ID NO: 1291274 - DNA, 14 bp, Homo sapiens
cacacagaggacct

SEQ ID NO: 1291275 - DNA, 16 bp, Homo sapiens
cacacagtcctcacac

SEQ ID NO: 1291276 - DNA, 22 bp, Homo sapiens
cacacagtcctcacacacggag

SEQ ID NO: 1291277 - DNA, 23 bp, Homo sapiens
cacacggaggccagacacaggcc

SEQ ID NO: 1291278 - DNA, 20 bp, Homo sapiens
cacaggccgtgggacccagg

SEQ ID NO: 1291279 - DNA, 20 bp, Homo sapiens
cacaggtcttcactgcccag

SEQ ID NO: 1291280 - DNA, 12 bp, Homo sapiens
caccagccctga

SEQ ID NO: 1291281 - DNA, 22 bp, Homo sapiens
caccgcctgctacacaggcagg

SEQ ID NO: 1291282 - DNA, 16 bp, Homo sapiens
cacctgccggctctgg

SEQ ID NO: 1291283 - DNA, 18 bp, Homo sapiens
cacctgccggctctgggc

SEQ ID NO: 1291284 - DNA, 21 bp, Homo sapiens
cacctgccggctctgggctgg

SEQ ID NO: 1291285 - DNA, 22 bp, Homo sapiens
cacctgccggctctgggctggc

SEQ ID NO: 1291286 - DNA, 15 bp, Homo sapiens
cacctttgagagagg

SEQ ID NO: 1291287 - DNA, 23 bp, Homo sapiens
cacctttgagagagggggcactg

SEQ ID NO: 1291288 - DNA, 23 bp, Homo sapiens
cacgctgtctcttcttaaccctg

SEQ ID NO: 1291289 - DNA, 17 bp, Homo sapiens
cacggaggccagacaca

SEQ ID NO: 1291290 - DNA, 21 bp, Homo sapiens
cacggaggccagacacaggcc

SEQ ID NO: 1291291 - DNA, 12 bp, Homo sapiens
cacggcctggca

SEQ ID NO: 1291292 - DNA, 20 bp, Homo sapiens
cacggggctcactctggccc

SEQ ID NO: 1291293 - DNA, 12 bp, Homo sapiens
cactgtggtcag

SEQ ID NO: 1291294 - DNA, 19 bp, Homo sapiens
cactgtggtcaggcccagc

SEQ ID NO: 1291295 - DNA, 20 bp, Homo sapiens
cagaagtggaatccagtgtg

SEQ ID NO: 1291296 - DNA, 15 bp, Homo sapiens
cagacacagagacat

SEQ ID NO: 1291297 - DNA, 16 bp, Homo sapiens
cagacacaggccgtgg

SEQ ID NO: 1291298 - DNA, 22 bp, Homo sapiens
cagacccaacccatgcccctga

SEQ ID NO: 1291299 - DNA, 12 bp, Homo sapiens
cagaggacctct

SEQ ID NO: 1291300 - DNA, 19 bp, Homo sapiens
cagaggagagtggcctggg

SEQ ID NO: 1291301 - DNA, 21 bp, Homo sapiens
cagaggagagtggcctgggtc

SEQ ID NO: 1291302 - DNA, 14 bp, Homo sapiens
cagagttctgtggc

SEQ ID NO: 1291303 - DNA, 13 bp, Homo sapiens
cagatagacctgt

SEQ ID NO: 1291304 - DNA, 24 bp, Homo sapiens
cagatagacctgtgacctggtctg

SEQ ID NO: 1291305 - DNA, 19 bp, Homo sapiens
cagatctagttctcttctc

SEQ ID NO: 1291306 - DNA, 22 bp, Homo sapiens
cagatctagttctcttctcctg

SEQ ID NO: 1291307 - DNA, 19 bp, Homo sapiens
cagatgttgtctgaactaa

SEQ ID NO: 1291308 - DNA, 19 bp, Homo sapiens
cagcaattcacgctgtctc

SEQ ID NO: 1291309 - DNA, 14 bp, Homo sapiens
cagcaggagggaag

SEQ ID NO: 1291310 - DNA, 23 bp, Homo sapiens
cagccatcggaagagagggctga

SEQ ID NO: 1291311 - DNA, 22 bp, Homo sapiens
cagcccgggagctttgagacag

SEQ ID NO: 1291312 - DNA, 20 bp, Homo sapiens
cagccggagcagttggcctg

SEQ ID NO: 1291313 - DNA, 22 bp, Homo sapiens
cagccggagcagttggcctgtg

SEQ ID NO: 1291314 - DNA, 24 bp, Homo sapiens
cagccggagcagttggcctgtgct

SEQ ID NO: 1291315 - DNA, 20 bp, Homo sapiens
cagcctaagggagacaggcc

SEQ ID NO: 1291316 - DNA, 21 bp, Homo sapiens
cagcctaagggagacaggcct

SEQ ID NO: 1291317 - DNA, 18 bp, Homo sapiens
cagcctctctggctcagc

SEQ ID NO: 1291318 - DNA, 21 bp, Homo sapiens
cagcctctctggctcagcccg

SEQ ID NO: 1291319 - DNA, 12 bp, Homo sapiens
cagcctgcctga

SEQ ID NO: 1291320 - DNA, 14 bp, Homo sapiens
cagcctgcctgaag

SEQ ID NO: 1291321 - DNA, 13 bp, Homo sapiens
cagcctggggcct

SEQ ID NO: 1291322 - DNA, 21 bp, Homo sapiens
cagctggccggaaggagactg

SEQ ID NO: 1291323 - DNA, 20 bp, Homo sapiens
caggaatgcggttgggaggc

SEQ ID NO: 1291324 - DNA, 15 bp, Homo sapiens
caggcaatgccctgc

SEQ ID NO: 1291325 - DNA, 21 bp, Homo sapiens
caggcaatgccctgcggctct

SEQ ID NO: 1291326 - DNA, 23 bp, Homo sapiens
caggcaatgccctgcggctctgg

SEQ ID NO: 1291327 - DNA, 24 bp, Homo sapiens
caggcaatgccctgcggctctgga

SEQ ID NO: 1291328 - DNA, 14 bp, Homo sapiens
caggcaggggcttg

SEQ ID NO: 1291329 - DNA, 12 bp, Homo sapiens
caggccacctca

SEQ ID NO: 1291330 - DNA, 16 bp, Homo sapiens
caggccacctcagtct

SEQ ID NO: 1291331 - DNA, 18 bp, Homo sapiens
caggccacctcagtctca

SEQ ID NO: 1291332 - DNA, 19 bp, Homo sapiens
caggccctgcccagccagc

SEQ ID NO: 1291333 - DNA, 22 bp, Homo sapiens
caggccgtgggacccaggctcc

SEQ ID NO: 1291334 - DNA, 17 bp, Homo sapiens
caggcctttccctgccg

SEQ ID NO: 1291335 - DNA, 20 bp, Homo sapiens
caggctcccagcctaaggga

SEQ ID NO: 1291336 - DNA, 21 bp, Homo sapiens
cagggaaagggatggtcaggc

SEQ ID NO: 1291337 - DNA, 11 bp, Homo sapiens
cagggctctct

SEQ ID NO: 1291338 - DNA, 15 bp, Homo sapiens
cagggctctctggac

SEQ ID NO: 1291339 - DNA, 13 bp, Homo sapiens
cagggctggccct

SEQ ID NO: 1291340 - DNA, 14 bp, Homo sapiens
cagggctggcccta

SEQ ID NO: 1291341 - DNA, 18 bp, Homo sapiens
caggggcttggctgcccc

SEQ ID NO: 1291342 - DNA, 19 bp, Homo sapiens
caggggcttggctgcccca

SEQ ID NO: 1291343 - DNA, 16 bp, Homo sapiens
caggtcttcactgccc

SEQ ID NO: 1291344 - DNA, 18 bp, Homo sapiens
caggtgcctggggctggc

SEQ ID NO: 1291345 - DNA, 22 bp, Homo sapiens
cagtcacaaaccagcctggggc

SEQ ID NO: 1291346 - DNA, 16 bp, Homo sapiens
cagtctcacctgccgg

SEQ ID NO: 1291347 - DNA, 21 bp, Homo sapiens
cagtctcacctgccggctctg

SEQ ID NO: 1291348 - DNA, 24 bp, Homo sapiens
cagtgtggctcccacaggtcttca

SEQ ID NO: 1291349 - DNA, 15 bp, Homo sapiens
cagttggcctgtgct

SEQ ID NO: 1291350 - DNA, 17 bp, Homo sapiens
cataaatttattatatt

SEQ ID NO: 1291351 - DNA, 15 bp, Homo sapiens
catcccagctgctga

SEQ ID NO: 1291352 - DNA, 17 bp, Homo sapiens
catcggaagagagggct

SEQ ID NO: 1291353 - DNA, 13 bp, Homo sapiens
catgcccctgaca

SEQ ID NO: 1291354 - DNA, 15 bp, Homo sapiens
catggacatgggcag

SEQ ID NO: 1291355 - DNA, 16 bp, Homo sapiens
catggacatgggcagc

SEQ ID NO: 1291356 - DNA, 22 bp, Homo sapiens
catggcggcccctcagcctgcc

SEQ ID NO: 1291357 - DNA, 16 bp, Homo sapiens
catgggagtggggagc

SEQ ID NO: 1291358 - DNA, 15 bp, Homo sapiens
cattcacggcctggc

SEQ ID NO: 1291359 - DNA, 23 bp, Homo sapiens
ccaaggtcccattttccccctgt

SEQ ID NO: 1291360 - DNA, 18 bp, Homo sapiens
ccaagtggaaatcctatt

SEQ ID NO: 1291361 - DNA, 20 bp, Homo sapiens
ccaatcacccccaggacctc

SEQ ID NO: 1291362 - DNA, 13 bp, Homo sapiens
ccacacagaggac

SEQ ID NO: 1291363 - DNA, 15 bp, Homo sapiens
ccacacagaggacct

SEQ ID NO: 1291364 - DNA, 20 bp, Homo sapiens
ccacaggtcttcactgccca

SEQ ID NO: 1291365 - DNA, 22 bp, Homo sapiens
ccaccgggcgcatgcctcccag

SEQ ID NO: 1291366 - DNA, 14 bp, Homo sapiens
ccagaactgcacaa

SEQ ID NO: 1291367 - DNA, 13 bp, Homo sapiens
ccagacacaggcc

SEQ ID NO: 1291368 - DNA, 18 bp, Homo sapiens
ccagaggagagtggcctg

SEQ ID NO: 1291369 - DNA, 19 bp, Homo sapiens
ccagaggagagtggcctgg

SEQ ID NO: 1291370 - DNA, 22 bp, Homo sapiens
ccagaggagagtggcctgggtc

SEQ ID NO: 1291371 - DNA, 20 bp, Homo sapiens
ccagcctaagggagacaggc

SEQ ID NO: 1291372 - DNA, 14 bp, Homo sapiens
ccagcctctctggc

SEQ ID NO: 1291373 - DNA, 15 bp, Homo sapiens
ccagcctctctggct

SEQ ID NO: 1291374 - DNA, 14 bp, Homo sapiens
ccagcctggggcct

SEQ ID NO: 1291375 - DNA, 23 bp, Homo sapiens
ccagcctggggccttcctggctt

SEQ ID NO: 1291376 - DNA, 15 bp, Homo sapiens
ccagcgacatttctc

SEQ ID NO: 1291377 - DNA, 16 bp, Homo sapiens
ccagctctcccatgga

SEQ ID NO: 1291378 - DNA, 19 bp, Homo sapiens
ccagctctcccatggagcc

SEQ ID NO: 1291379 - DNA, 19 bp, Homo sapiens
ccaggcagagttctgtggc

SEQ ID NO: 1291380 - DNA, 15 bp, Homo sapiens
ccagggctctctgga

SEQ ID NO: 1291381 - DNA, 15 bp, Homo sapiens
ccagggctggcccta

SEQ ID NO: 1291382 - DNA, 17 bp, Homo sapiens
ccagggctggccctagg

SEQ ID NO: 1291383 - DNA, 13 bp, Homo sapiens
ccagtgtggctcc

SEQ ID NO: 1291384 - DNA, 14 bp, Homo sapiens
ccagtgtggctccc

SEQ ID NO: 1291385 - DNA, 17 bp, Homo sapiens
ccagtgtgggacacggt

SEQ ID NO: 1291386 - DNA, 17 bp, Homo sapiens
ccagttctcgtgccctt

SEQ ID NO: 1291387 - DNA, 18 bp, Homo sapiens
ccagttctcgtgccctta

SEQ ID NO: 1291388 - DNA, 16 bp, Homo sapiens
ccatcggaagagaggg

SEQ ID NO: 1291389 - DNA, 22 bp, Homo sapiens
ccatggcacctttgagagaggg

SEQ ID NO: 1291390 - DNA, 18 bp, Homo sapiens
ccatggcggcccctcagc

SEQ ID NO: 1291391 - DNA, 17 bp, Homo sapiens
ccattcacggcctggca

SEQ ID NO: 1291392 - DNA, 18 bp, Homo sapiens
ccattcacggcctggcat

SEQ ID NO: 1291393 - DNA, 23 bp, Homo sapiens
ccattcacggcctggcatgcagc

SEQ ID NO: 1291394 - DNA, 16 bp, Homo sapiens
ccattttccccctgtg

SEQ ID NO: 1291395 - DNA, 18 bp, Homo sapiens
cccaacccatgcccctga

SEQ ID NO: 1291396 - DNA, 21 bp, Homo sapiens
cccacaggtcttcactgccca

SEQ ID NO: 1291397 - DNA, 23 bp, Homo sapiens
cccacaggtcttcactgcccagg

SEQ ID NO: 1291398 - DNA, 12 bp, Homo sapiens
cccacttgacct

SEQ ID NO: 1291399 - DNA, 20 bp, Homo sapiens
cccagccagccatcggaaga

SEQ ID NO: 1291400 - DNA, 15 bp, Homo sapiens
cccagcctctctggc

SEQ ID NO: 1291401 - DNA, 20 bp, Homo sapiens
cccagcctctctggctcagc

SEQ ID NO: 1291402 - DNA, 20 bp, Homo sapiens
cccaggacctcttcagctgc

SEQ ID NO: 1291403 - DNA, 21 bp, Homo sapiens
cccaggacctcttcagctgct

SEQ ID NO: 1291404 - DNA, 22 bp, Homo sapiens
cccaggacctcttcagctgctg

SEQ ID NO: 1291405 - DNA, 23 bp, Homo sapiens
cccaggccacctcagtctcacct

SEQ ID NO: 1291406 - DNA, 24 bp, Homo sapiens
cccaggccacctcagtctcacctg

SEQ ID NO: 1291407 - DNA, 10 bp, Homo sapiens
cccaggctcc

SEQ ID NO: 1291408 - DNA, 17 bp, Homo sapiens
cccagggctctctggac

SEQ ID NO: 1291409 - DNA, 23 bp, Homo sapiens
cccagggctggccctaggcactg

SEQ ID NO: 1291410 - DNA, 14 bp, Homo sapiens
cccatggagcccct

SEQ ID NO: 1291411 - DNA, 18 bp, Homo sapiens
cccattcacggcctggca

SEQ ID NO: 1291412 - DNA, 15 bp, Homo sapiens
cccattttccccctg

SEQ ID NO: 1291413 - DNA, 21 bp, Homo sapiens
ccccagttcccttggtggcaa

SEQ ID NO: 1291414 - DNA, 21 bp, Homo sapiens
ccccgcggatcaaccaggcag

SEQ ID NO: 1291415 - DNA, 10 bp, Homo sapiens
cccctcctgt

SEQ ID NO: 1291416 - DNA, 20 bp, Homo sapiens
cccgcggatcaaccaggcag

SEQ ID NO: 1291417 - DNA, 21 bp, Homo sapiens
cccgcggatcaaccaggcaga

SEQ ID NO: 1291418 - DNA, 16 bp, Homo sapiens
ccctattgtctccaag

SEQ ID NO: 1291419 - DNA, 12 bp, Homo sapiens
ccctgcccagcc

SEQ ID NO: 1291420 - DNA, 13 bp, Homo sapiens
ccctgcccagcca

SEQ ID NO: 1291421 - DNA, 18 bp, Homo sapiens
ccctgcccagccagccat

SEQ ID NO: 1291422 - DNA, 14 bp, Homo sapiens
ccctgcgccctgtg

SEQ ID NO: 1291423 - DNA, 15 bp, Homo sapiens
ccctgcgccctgtgc

SEQ ID NO: 1291424 - DNA, 13 bp, Homo sapiens
ccctgcggctctg

SEQ ID NO: 1291425 - DNA, 14 bp, Homo sapiens
ccctgcggctctgg

SEQ ID NO: 1291426 - DNA, 22 bp, Homo sapiens
cccttagaggggaatgaaccat

SEQ ID NO: 1291427 - DNA, 14 bp, Homo sapiens
cccttggtggcaac

SEQ ID NO: 1291428 - DNA, 16 bp, Homo sapiens
ccgagctgtcggaggg

SEQ ID NO: 1291429 - DNA, 18 bp, Homo sapiens
ccgagctgtcggagggct

SEQ ID NO: 1291430 - DNA, 21 bp, Homo sapiens
ccgagctgtcggagggctgga

SEQ ID NO: 1291431 - DNA, 19 bp, Homo sapiens
ccgcctgctacacaggcag

SEQ ID NO: 1291432 - DNA, 20 bp, Homo sapiens
ccgcctgctacacaggcagg

SEQ ID NO: 1291433 - DNA, 20 bp, Homo sapiens
ccgcggatcaaccaggcaga

SEQ ID NO: 1291434 - DNA, 22 bp, Homo sapiens
ccgcggatcaaccaggcagagt

SEQ ID NO: 1291435 - DNA, 18 bp, Homo sapiens
ccggagcagttggcctgt

SEQ ID NO: 1291436 - DNA, 21 bp, Homo sapiens
ccgggcgcatgcctcccaggc

SEQ ID NO: 1291437 - DNA, 14 bp, Homo sapiens
ccgtgggacccagg

SEQ ID NO: 1291438 - DNA, 18 bp, Homo sapiens
ccgtgggacccaggctcc

SEQ ID NO: 1291439 - DNA, 21 bp, Homo sapiens
cctaagggagacaggcctttc

SEQ ID NO: 1291440 - DNA, 22 bp, Homo sapiens
cctcacacacggaggccagaca

SEQ ID NO: 1291441 - DNA, 22 bp, Homo sapiens
cctcagatagacctgtgacctg

SEQ ID NO: 1291442 - DNA, 19 bp, Homo sapiens
cctcagcctgcctgaagag

SEQ ID NO: 1291443 - DNA, 22 bp, Homo sapiens
cctcagcctgcctgaagagagg

SEQ ID NO: 1291444 - DNA, 22 bp, Homo sapiens
cctcagtctcacctgccggctc

SEQ ID NO: 1291445 - DNA, 19 bp, Homo sapiens
cctcccacttgacctgaga

SEQ ID NO: 1291446 - DNA, 20 bp, Homo sapiens
cctcgccgagctgtcggagg

SEQ ID NO: 1291447 - DNA, 21 bp, Homo sapiens
cctgacagatctagttctctt

SEQ ID NO: 1291448 - DNA, 22 bp, Homo sapiens
cctgagatgctgggagggctga

SEQ ID NO: 1291449 - DNA, 13 bp, Homo sapiens
cctgcccagccag

SEQ ID NO: 1291450 - DNA, 14 bp, Homo sapiens
cctgccggctctgg

SEQ ID NO: 1291451 - DNA, 20 bp, Homo sapiens
cctgccggctctgggctggc

SEQ ID NO: 1291452 - DNA, 12 bp, Homo sapiens
cctgcggctctg

SEQ ID NO: 1291453 - DNA, 13 bp, Homo sapiens
cctgcggctctgg

SEQ ID NO: 1291454 - DNA, 14 bp, Homo sapiens
cctgcggctctgga

SEQ ID NO: 1291455 - DNA, 17 bp, Homo sapiens
cctgcggctctggaaag

SEQ ID NO: 1291456 - DNA, 18 bp, Homo sapiens
cctgcggctctggaaagc

SEQ ID NO: 1291457 - DNA, 20 bp, Homo sapiens
cctgctacacaggcaggaat

SEQ ID NO: 1291458 - DNA, 15 bp, Homo sapiens
cctggaacctggcag

SEQ ID NO: 1291459 - DNA, 18 bp, Homo sapiens
cctggaacctggcaggcc

SEQ ID NO: 1291460 - DNA, 18 bp, Homo sapiens
cctggcaggccctgccca

SEQ ID NO: 1291461 - DNA, 13 bp, Homo sapiens
cctggctggccag

SEQ ID NO: 1291462 - DNA, 14 bp, Homo sapiens
cctggctggccagg

SEQ ID NO: 1291463 - DNA, 23 bp, Homo sapiens
cctggctggccaggacacactga

SEQ ID NO: 1291464 - DNA, 15 bp, Homo sapiens
cctggctgtcacctt

SEQ ID NO: 1291465 - DNA, 21 bp, Homo sapiens
cctggggccttcctggctttg

SEQ ID NO: 1291466 - DNA, 13 bp, Homo sapiens
cctggggctggct

SEQ ID NO: 1291467 - DNA, 15 bp, Homo sapiens
cctggggctggctgc

SEQ ID NO: 1291468 - DNA, 19 bp, Homo sapiens
cctggggctggctgcagac

SEQ ID NO: 1291469 - DNA, 22 bp, Homo sapiens
cctgggtcccagggctggccct

SEQ ID NO: 1291470 - DNA, 23 bp, Homo sapiens
cctgggtcccagggctggcccta

SEQ ID NO: 1291471 - DNA, 17 bp, Homo sapiens
cctggtctggtcaggca

SEQ ID NO: 1291472 - DNA, 20 bp, Homo sapiens
cctgtaagagtattaacaaa

SEQ ID NO: 1291473 - DNA, 14 bp, Homo sapiens
cctgtgcttggagg

SEQ ID NO: 1291474 - DNA, 18 bp, Homo sapiens
cctgtgcttggaggcctc

SEQ ID NO: 1291475 - DNA, 20 bp, Homo sapiens
cctgtgcttggaggcctcag

SEQ ID NO: 1291476 - DNA, 21 bp, Homo sapiens
cctgtgcttggaggcctcaga

SEQ ID NO: 1291477 - DNA, 19 bp, Homo sapiens
cctgtgttttcacgcaggt

SEQ ID NO: 1291478 - DNA, 12 bp, Homo sapiens
ccttgctcctgg

SEQ ID NO: 1291479 - DNA, 13 bp, Homo sapiens
ccttgctcctgga

SEQ ID NO: 1291480 - DNA, 15 bp, Homo sapiens
cctttgagagagggg

SEQ ID NO: 1291481 - DNA, 20 bp, Homo sapiens
ccttttcttcccctcctgta

SEQ ID NO: 1291482 - DNA, 22 bp, Homo sapiens
cgaatggggtccccctcccact

SEQ ID NO: 1291483 - DNA, 14 bp, Homo sapiens
cgagctgtcggagg

SEQ ID NO: 1291484 - DNA, 18 bp, Homo sapiens
cgagctgtcggagggctg

SEQ ID NO: 1291485 - DNA, 17 bp, Homo sapiens
cgatctcccagggctct

SEQ ID NO: 1291486 - DNA, 19 bp, Homo sapiens
cgccgcgtggacagccgga

SEQ ID NO: 1291487 - DNA, 14 bp, Homo sapiens
cgcctgctacacag

SEQ ID NO: 1291488 - DNA, 17 bp, Homo sapiens
cgcgtggacagccggag

SEQ ID NO: 1291489 - DNA, 11 bp, Homo sapiens
cggaagagagg

SEQ ID NO: 1291490 - DNA, 16 bp, Homo sapiens
cggaaggagactgtgg

SEQ ID NO: 1291491 - DNA, 14 bp, Homo sapiens
cggaagtctgttct

SEQ ID NO: 1291492 - DNA, 16 bp, Homo sapiens
cggagcagttggcctg

SEQ ID NO: 1291493 - DNA, 18 bp, Homo sapiens
cggagcagttggcctgtg

SEQ ID NO: 1291494 - DNA, 19 bp, Homo sapiens
cggagcagttggcctgtgc

SEQ ID NO: 1291495 - DNA, 15 bp, Homo sapiens
cggagcttggccctg

SEQ ID NO: 1291496 - DNA, 21 bp, Homo sapiens
cggagcttggccctgcgccct

SEQ ID NO: 1291497 - DNA, 19 bp, Homo sapiens
cggaggagttttctgtgtg

SEQ ID NO: 1291498 - DNA, 14 bp, Homo sapiens
cggaggccagacac

SEQ ID NO: 1291499 - DNA, 17 bp, Homo sapiens
cggatcaaccaggcaga

SEQ ID NO: 1291500 - DNA, 17 bp, Homo sapiens
cggcccctcagcctgcc

SEQ ID NO: 1291501 - DNA, 15 bp, Homo sapiens
cggcctggcatgcag

SEQ ID NO: 1291502 - DNA, 22 bp, Homo sapiens
cggcctggcatgcagcttgtcc

SEQ ID NO: 1291503 - DNA, 19 bp, Homo sapiens
cggctctgggctggctgct

SEQ ID NO: 1291504 - DNA, 18 bp, Homo sapiens
cgggagctttgagacagg

SEQ ID NO: 1291505 - DNA, 19 bp, Homo sapiens
cgggcgcatgcctcccagg

SEQ ID NO: 1291506 - DNA, 21 bp, Homo sapiens
cgggcgcatgcctcccaggcc

SEQ ID NO: 1291507 - DNA, 16 bp, Homo sapiens
cggttgggaggcaggt

SEQ ID NO: 1291508 - DNA, 14 bp, Homo sapiens
cggtttaactgtcc

SEQ ID NO: 1291509 - DNA, 14 bp, Homo sapiens
cgtgggacccaggc

SEQ ID NO: 1291510 - DNA, 17 bp, Homo sapiens
cgtgggacccaggctcc

SEQ ID NO: 1291511 - DNA, 23 bp, Homo sapiens
cgtgggacccaggctcccagcct

SEQ ID NO: 1291512 - DNA, 20 bp, Homo sapiens
ctaagaagttcaccagccct

SEQ ID NO: 1291513 - DNA, 18 bp, Homo sapiens
ctaagggagacaggcctt

SEQ ID NO: 1291514 - DNA, 23 bp, Homo sapiens
ctacaaaaataaaaggcttccag

SEQ ID NO: 1291515 - DNA, 22 bp, Homo sapiens
ctagtccaatcacccccaggac

SEQ ID NO: 1291516 - DNA, 18 bp, Homo sapiens
ctagttctcttctcctgt

SEQ ID NO: 1291517 - DNA, 16 bp, Homo sapiens
ctatggagcagccgga

SEQ ID NO: 1291518 - DNA, 15 bp, Homo sapiens
ctatttttgtagatc

SEQ ID NO: 1291519 - DNA, 14 bp, Homo sapiens
ctcacctgccggct

SEQ ID NO: 1291520 - DNA, 22 bp, Homo sapiens
ctcacctgccggctctgggctg

SEQ ID NO: 1291521 - DNA, 23 bp, Homo sapiens
ctcacctgccggctctgggctgg

SEQ ID NO: 1291522 - DNA, 12 bp, Homo sapiens
ctcactctggcc

SEQ ID NO: 1291523 - DNA, 12 bp, Homo sapiens
ctcagcccggga

SEQ ID NO: 1291524 - DNA, 23 bp, Homo sapiens
ctcagcccgggatcctgatggca

SEQ ID NO: 1291525 - DNA, 17 bp, Homo sapiens
ctcagcctgcctgaaga

SEQ ID NO: 1291526 - DNA, 21 bp, Homo sapiens
ctcagcctgcctgaagagagg

SEQ ID NO: 1291527 - DNA, 14 bp, Homo sapiens
ctccagctcctctc

SEQ ID NO: 1291528 - DNA, 22 bp, Homo sapiens
ctccagctcctctccagacaca

SEQ ID NO: 1291529 - DNA, 17 bp, Homo sapiens
ctcccacttgacctgag

SEQ ID NO: 1291530 - DNA, 14 bp, Homo sapiens
ctcccagggctctc

SEQ ID NO: 1291531 - DNA, 12 bp, Homo sapiens
ctcctggaacct

SEQ ID NO: 1291532 - DNA, 18 bp, Homo sapiens
ctcctggaacctggcagg

SEQ ID NO: 1291533 - DNA, 21 bp, Homo sapiens
ctcctggaacctggcaggccc

SEQ ID NO: 1291534 - DNA, 24 bp, Homo sapiens
ctcgccgagctgtcggagggctgg

SEQ ID NO: 1291535 - DNA, 23 bp, Homo sapiens
ctcggcctggctggccaggacac

SEQ ID NO: 1291536 - DNA, 14 bp, Homo sapiens
ctctcaaggcttgg

SEQ ID NO: 1291537 - DNA, 15 bp, Homo sapiens
ctctcaaggcttgga

SEQ ID NO: 1291538 - DNA, 18 bp, Homo sapiens
ctctggctcagcccggga

SEQ ID NO: 1291539 - DNA, 15 bp, Homo sapiens
ctctgggctggctgc

SEQ ID NO: 1291540 - DNA, 15 bp, Homo sapiens
ctcttcagctgctga

SEQ ID NO: 1291541 - DNA, 18 bp, Homo sapiens
ctcttcagctgctgacaa

SEQ ID NO: 1291542 - DNA, 20 bp, Homo sapiens
ctcttctcctgtgttccctt

SEQ ID NO: 1291543 - DNA, 19 bp, Homo sapiens
ctgagatgctgggagggct

SEQ ID NO: 1291544 - DNA, 15 bp, Homo sapiens
ctgagcaggcagggg

SEQ ID NO: 1291545 - DNA, 13 bp, Homo sapiens
ctgagccatggcg

SEQ ID NO: 1291546 - DNA, 12 bp, Homo sapiens
ctgagccatggg

SEQ ID NO: 1291547 - DNA, 22 bp, Homo sapiens
ctgatggcacccacacagagga

SEQ ID NO: 1291548 - DNA, 11 bp, Homo sapiens
ctgccagccca

SEQ ID NO: 1291549 - DNA, 13 bp, Homo sapiens
ctgcccagccagc

SEQ ID NO: 1291550 - DNA, 16 bp, Homo sapiens
ctgccggccccccaag

SEQ ID NO: 1291551 - DNA, 13 bp, Homo sapiens
ctgccggctctgg

SEQ ID NO: 1291552 - DNA, 15 bp, Homo sapiens
ctgcctgaagagagg

SEQ ID NO: 1291553 - DNA, 16 bp, Homo sapiens
ctgcctgaagagagga

SEQ ID NO: 1291554 - DNA, 15 bp, Homo sapiens
ctgctacacaggcag

SEQ ID NO: 1291555 - DNA, 18 bp, Homo sapiens
ctgctacacaggcaggaa

SEQ ID NO: 1291556 - DNA, 22 bp, Homo sapiens
ctggaacctggcaggccctgcc

SEQ ID NO: 1291557 - DNA, 17 bp, Homo sapiens
ctggacatttgtggcag

SEQ ID NO: 1291558 - DNA, 20 bp, Homo sapiens
ctggacatttgtggcagtgc

SEQ ID NO: 1291559 - DNA, 22 bp, Homo sapiens
ctggacatttgtggcagtgctg

SEQ ID NO: 1291560 - DNA, 23 bp, Homo sapiens
ctggacatttgtggcagtgctga

SEQ ID NO: 1291561 - DNA, 15 bp, Homo sapiens
ctggcaggccctgcc

SEQ ID NO: 1291562 - DNA, 18 bp, Homo sapiens
ctggcaggccctgcccag

SEQ ID NO: 1291563 - DNA, 16 bp, Homo sapiens
ctggccctaggcactg

SEQ ID NO: 1291564 - DNA, 15 bp, Homo sapiens
ctggccggaaggaga

SEQ ID NO: 1291565 - DNA, 17 bp, Homo sapiens
ctggccggaaggagact

SEQ ID NO: 1291566 - DNA, 15 bp, Homo sapiens
ctggcgaagcctgag

SEQ ID NO: 1291567 - DNA, 17 bp, Homo sapiens
ctggcgaagcctgagca

SEQ ID NO: 1291568 - DNA, 19 bp, Homo sapiens
ctggcgaagcctgagcagg

SEQ ID NO: 1291569 - DNA, 17 bp, Homo sapiens
ctggcgatctcccaggg

SEQ ID NO: 1291570 - DNA, 24 bp, Homo sapiens
ctggcgatctcccagggctctctg

SEQ ID NO: 1291571 - DNA, 13 bp, Homo sapiens
ctggctggccagg

SEQ ID NO: 1291572 - DNA, 14 bp, Homo sapiens
ctggctggccagga

SEQ ID NO: 1291573 - DNA, 13 bp, Homo sapiens
ctgggctggctgc

SEQ ID NO: 1291574 - DNA, 17 bp, Homo sapiens
ctggggccttcctggct

SEQ ID NO: 1291575 - DNA, 13 bp, Homo sapiens
ctggggctggctg

SEQ ID NO: 1291576 - DNA, 18 bp, Homo sapiens
ctgggtcccagggctggc

SEQ ID NO: 1291577 - DNA, 22 bp, Homo sapiens
ctgggtcccagggctggcccta

SEQ ID NO: 1291578 - DNA, 12 bp, Homo sapiens
ctggtcaggcaa

SEQ ID NO: 1291579 - DNA, 21 bp, Homo sapiens
ctggtcaggcaatgccctgcg

SEQ ID NO: 1291580 - DNA, 15 bp, Homo sapiens
ctggtctggtcaggc

SEQ ID NO: 1291581 - DNA, 17 bp, Homo sapiens
ctgtcggagggctggac

SEQ ID NO: 1291582 - DNA, 19 bp, Homo sapiens
ctgtctcttcttaaccctg

SEQ ID NO: 1291583 - DNA, 23 bp, Homo sapiens
ctgtctcttcttaaccctgaaca

SEQ ID NO: 1291584 - DNA, 14 bp, Homo sapiens
ctgtgacctggtct

SEQ ID NO: 1291585 - DNA, 16 bp, Homo sapiens
ctgtgacctggtctgg

SEQ ID NO: 1291586 - DNA, 16 bp, Homo sapiens
ctgtgcagggaaaggg

SEQ ID NO: 1291587 - DNA, 18 bp, Homo sapiens
ctgtggcgccgcgtggac

SEQ ID NO: 1291588 - DNA, 13 bp, Homo sapiens
ctgtggtcaggcc

SEQ ID NO: 1291589 - DNA, 14 bp, Homo sapiens
ctgtggtcaggccc

SEQ ID NO: 1291590 - DNA, 18 bp, Homo sapiens
ctgtggtcaggcccagcc

SEQ ID NO: 1291591 - DNA, 22 bp, Homo sapiens
ctgtggtcaggcccagcctctc

SEQ ID NO: 1291592 - DNA, 24 bp, Homo sapiens
ctgtggtcaggcccagcctctctg

SEQ ID NO: 1291593 - DNA, 18 bp, Homo sapiens
ctgtgtggtctccagctc

SEQ ID NO: 1291594 - DNA, 17 bp, Homo sapiens
ctgtgttttcacgcagg

SEQ ID NO: 1291595 - DNA, 23 bp, Homo sapiens
cttagaggggaatgaaccatggc

SEQ ID NO: 1291596 - DNA, 19 bp, Homo sapiens
cttagcttttagcctggct

SEQ ID NO: 1291597 - DNA, 20 bp, Homo sapiens
cttagcttttagcctggctg

SEQ ID NO: 1291598 - DNA, 21 bp, Homo sapiens
cttagcttttagcctggctgt

SEQ ID NO: 1291599 - DNA, 13 bp, Homo sapiens
cttcactgcccag

SEQ ID NO: 1291600 - DNA, 16 bp, Homo sapiens
cttcagctgctgacaa

SEQ ID NO: 1291601 - DNA, 20 bp, Homo sapiens
cttcagctgctgacaatcct

SEQ ID NO: 1291602 - DNA, 12 bp, Homo sapiens
cttcatcccagc

SEQ ID NO: 1291603 - DNA, 12 bp, Homo sapiens
cttccagaggag

SEQ ID NO: 1291604 - DNA, 19 bp, Homo sapiens
cttcttaaccctgaacaag

SEQ ID NO: 1291605 - DNA, 22 bp, Homo sapiens
cttgacctgagatgctgggagg

SEQ ID NO: 1291606 - DNA, 14 bp, Homo sapiens
cttgctcctggaac

SEQ ID NO: 1291607 - DNA, 15 bp, Homo sapiens
cttggaggcctcaga

SEQ ID NO: 1291608 - DNA, 13 bp, Homo sapiens
cttgtcaccccag

SEQ ID NO: 1291609 - DNA, 19 bp, Homo sapiens
cttgtccttgctcctggaa

SEQ ID NO: 1291610 - DNA, 23 bp, Homo sapiens
cttgtccttgctcctggaacctg

SEQ ID NO: 1291611 - DNA, 18 bp, Homo sapiens
ctttgagacaggtgcctg

SEQ ID NO: 1291612 - DNA, 19 bp, Homo sapiens
ctttgagacaggtgcctgg

SEQ ID NO: 1291613 - DNA, 13 bp, Homo sapiens
ctttgagagaggg

SEQ ID NO: 1291614 - DNA, 14 bp, Homo sapiens
cttttagcctggct

SEQ ID NO: 1291615 - DNA, 20 bp, Homo sapiens
gaaagcaacttcatcccagc

SEQ ID NO: 1291616 - DNA, 18 bp, Homo sapiens
gaaagggatggtcaggcc

SEQ ID NO: 1291617 - DNA, 21 bp, Homo sapiens
gaaagggatggtcaggcccag

SEQ ID NO: 1291618 - DNA, 16 bp, Homo sapiens
gaacctggcaggccct

SEQ ID NO: 1291619 - DNA, 18 bp, Homo sapiens
gaacctggcaggccctgc

SEQ ID NO: 1291620 - DNA, 23 bp, Homo sapiens
gaactgcacaatgaccagcagga

SEQ ID NO: 1291621 - DNA, 14 bp, Homo sapiens
gaagagagggctga

SEQ ID NO: 1291622 - DNA, 11 bp, Homo sapiens
gaagcctgagc

SEQ ID NO: 1291623 - DNA, 17 bp, Homo sapiens
gaagcctgagcaggcag

SEQ ID NO: 1291624 - DNA, 18 bp, Homo sapiens
gaagcctgagcaggcagg

SEQ ID NO: 1291625 - DNA, 19 bp, Homo sapiens
gaagcctgagcaggcaggg

SEQ ID NO: 1291626 - DNA, 14 bp, Homo sapiens
gaagtctgttctca

SEQ ID NO: 1291627 - DNA, 17 bp, Homo sapiens
gaagttcaccagccctg

SEQ ID NO: 1291628 - DNA, 15 bp, Homo sapiens
gaatgaaccatggca

SEQ ID NO: 1291629 - DNA, 20 bp, Homo sapiens
gaatgcggttgggaggcagg

SEQ ID NO: 1291630 - DNA, 12 bp, Homo sapiens
gacaatcctatt

SEQ ID NO: 1291631 - DNA, 13 bp, Homo sapiens
gacacaagggtgc

SEQ ID NO: 1291632 - DNA, 17 bp, Homo sapiens
gacacaagggtgcaagc

SEQ ID NO: 1291633 - DNA, 24 bp, Homo sapiens
gacacggtttaactgtcccagcga

SEQ ID NO: 1291634 - DNA, 13 bp, Homo sapiens
gacaggtgcctgg

SEQ ID NO: 1291635 - DNA, 11 bp, Homo sapiens
gacatgggcag

SEQ ID NO: 1291636 - DNA, 12 bp, Homo sapiens
gacatgggcagc

SEQ ID NO: 1291637 - DNA, 14 bp, Homo sapiens
gaccagcaggaggg

SEQ ID NO: 1291638 - DNA, 17 bp, Homo sapiens
gaccagcaggagggaag

SEQ ID NO: 1291639 - DNA, 22 bp, Homo sapiens
gaccagcaggagggaaggacag

SEQ ID NO: 1291640 - DNA, 14 bp, Homo sapiens
gacccaacccatgc

SEQ ID NO: 1291641 - DNA, 14 bp, Homo sapiens
gacccaggctccca

SEQ ID NO: 1291642 - DNA, 17 bp, Homo sapiens
gacccaggctcccagcc

SEQ ID NO: 1291643 - DNA, 16 bp, Homo sapiens
gacctcttcagctgct

SEQ ID NO: 1291644 - DNA, 18 bp, Homo sapiens
gacctcttcagctgctga

SEQ ID NO: 1291645 - DNA, 21 bp, Homo sapiens
gacctcttcagctgctgacaa

SEQ ID NO: 1291646 - DNA, 16 bp, Homo sapiens
gacctgagatgctggg

SEQ ID NO: 1291647 - DNA, 19 bp, Homo sapiens
gacctgtgacctggtctgg

SEQ ID NO: 1291648 - DNA, 18 bp, Homo sapiens
gagaactgtcaccctgag

SEQ ID NO: 1291649 - DNA, 14 bp, Homo sapiens
gagacaggtgcctg

SEQ ID NO: 1291650 - DNA, 19 bp, Homo sapiens
gagacaggtgcctggggct

SEQ ID NO: 1291651 - DNA, 14 bp, Homo sapiens
gagagggctgagcc

SEQ ID NO: 1291652 - DNA, 19 bp, Homo sapiens
gagagggggcactgtggtc

SEQ ID NO: 1291653 - DNA, 23 bp, Homo sapiens
gagagggggcactgtggtcaggc

SEQ ID NO: 1291654 - DNA, 22 bp, Homo sapiens
gagagtggcctgggtcccaggg

SEQ ID NO: 1291655 - DNA, 18 bp, Homo sapiens
gagatgctgggagggctg

SEQ ID NO: 1291656 - DNA, 19 bp, Homo sapiens
gagcaggcaggggcttggc

SEQ ID NO: 1291657 - DNA, 20 bp, Homo sapiens
gagcaggcaggggcttggct

SEQ ID NO: 1291658 - DNA, 15 bp, Homo sapiens
gagcagttggcctgt

SEQ ID NO: 1291659 - DNA, 17 bp, Homo sapiens
gagcagttggcctgtgc

SEQ ID NO: 1291660 - DNA, 18 bp, Homo sapiens
gagccatggcggcccctc

SEQ ID NO: 1291661 - DNA, 17 bp, Homo sapiens
gagctgtcggagggctg

SEQ ID NO: 1291662 - DNA, 18 bp, Homo sapiens
gagctgtcggagggctgg

SEQ ID NO: 1291663 - DNA, 13 bp, Homo sapiens
gagcttggccctg

SEQ ID NO: 1291664 - DNA, 15 bp, Homo sapiens
gagctttgagacagg

SEQ ID NO: 1291665 - DNA, 19 bp, Homo sapiens
gaggaaactggcgatctcc

SEQ ID NO: 1291666 - DNA, 21 bp, Homo sapiens
gaggagttttctgtgtggtct

SEQ ID NO: 1291667 - DNA, 17 bp, Homo sapiens
gaggcaggtcgggctgc

SEQ ID NO: 1291668 - DNA, 18 bp, Homo sapiens
gaggccagacacaggccg

SEQ ID NO: 1291669 - DNA, 21 bp, Homo sapiens
gaggccagacacaggccgtgg

SEQ ID NO: 1291670 - DNA, 19 bp, Homo sapiens
gagggctgagccatggggg

SEQ ID NO: 1291671 - DNA, 22 bp, Homo sapiens
gagggggcactgtggtcaggcc

SEQ ID NO: 1291672 - DNA, 20 bp, Homo sapiens
gaggtatgtgcccctcctgg

SEQ ID NO: 1291673 - DNA, 22 bp, Homo sapiens
gaggtatgtgcccctcctgggt

SEQ ID NO: 1291674 - DNA, 18 bp, Homo sapiens
gagtaagaaatgggcctc

SEQ ID NO: 1291675 - DNA, 14 bp, Homo sapiens
gagtggcctgggtc

SEQ ID NO: 1291676 - DNA, 20 bp, Homo sapiens
gagtggggagcggagcttgg

SEQ ID NO: 1291677 - DNA, 20 bp, Homo sapiens
gatagttgccttttcttccc

SEQ ID NO: 1291678 - DNA, 15 bp, Homo sapiens
gatcaaccaggcaga

SEQ ID NO: 1291679 - DNA, 23 bp, Homo sapiens
gatctagttctcttctcctgtgt

SEQ ID NO: 1291680 - DNA, 19 bp, Homo sapiens
gatctcccagggctctctg

SEQ ID NO: 1291681 - DNA, 17 bp, Homo sapiens
gatggcacccacacaga

SEQ ID NO: 1291682 - DNA, 23 bp, Homo sapiens
gatggcacccacacagaggacct

SEQ ID NO: 1291683 - DNA, 12 bp, Homo sapiens
gatggtcaggcc

SEQ ID NO: 1291684 - DNA, 15 bp, Homo sapiens
gcaaccccagaccca

SEQ ID NO: 1291685 - DNA, 15 bp, Homo sapiens
gcaacttcatcccag

SEQ ID NO: 1291686 - DNA, 23 bp, Homo sapiens
gcaacttcatcccagctgctgag

SEQ ID NO: 1291687 - DNA, 22 bp, Homo sapiens
gcaagccccattcacggcctgg

SEQ ID NO: 1291688 - DNA, 18 bp, Homo sapiens
gcaattcacgctgtctct

SEQ ID NO: 1291689 - DNA, 12 bp, Homo sapiens
gcacccacacag

SEQ ID NO: 1291690 - DNA, 17 bp, Homo sapiens
gcacctttgagagaggg

SEQ ID NO: 1291691 - DNA, 18 bp, Homo sapiens
gcactgtggtcaggccca

SEQ ID NO: 1291692 - DNA, 20 bp, Homo sapiens
gcactgtggtcaggcccagc

SEQ ID NO: 1291693 - DNA, 21 bp, Homo sapiens
gcactgtggtcaggcccagcc

SEQ ID NO: 1291694 - DNA, 12 bp, Homo sapiens
gcagagttctgt

SEQ ID NO: 1291695 - DNA, 17 bp, Homo sapiens
gcaggcaggggcttggc

SEQ ID NO: 1291696 - DNA, 19 bp, Homo sapiens
gcaggcaggggcttggctg

SEQ ID NO: 1291697 - DNA, 15 bp, Homo sapiens
gcaggccctgcccag

SEQ ID NO: 1291698 - DNA, 19 bp, Homo sapiens
gcaggccctgcccagccag

SEQ ID NO: 1291699 - DNA, 20 bp, Homo sapiens
gcaggccctgcccagccagc

SEQ ID NO: 1291700 - DNA, 21 bp, Homo sapiens
gcaggccctgcccagccagcc

SEQ ID NO: 1291701 - DNA, 22 bp, Homo sapiens
gcaggccctgcccagccagcca

SEQ ID NO: 1291702 - DNA, 13 bp, Homo sapiens
gcaggggcttggc

SEQ ID NO: 1291703 - DNA, 15 bp, Homo sapiens
gcaggtcgggctgcc

SEQ ID NO: 1291704 - DNA, 16 bp, Homo sapiens
gcaggtcgggctgcca

SEQ ID NO: 1291705 - DNA, 22 bp, Homo sapiens
gcaggtcgggctgccagcccag

SEQ ID NO: 1291706 - DNA, 17 bp, Homo sapiens
gcagtgctgaagggggc

SEQ ID NO: 1291707 - DNA, 19 bp, Homo sapiens
gcagtgctgaagggggcat

SEQ ID NO: 1291708 - DNA, 15 bp, Homo sapiens
gcatgcctcccaggc

SEQ ID NO: 1291709 - DNA, 16 bp, Homo sapiens
gcatgcctcccaggcc

SEQ ID NO: 1291710 - DNA, 18 bp, Homo sapiens
gcatgcctcccaggccac

SEQ ID NO: 1291711 - DNA, 20 bp, Homo sapiens
gccacctcagtctcacctgc

SEQ ID NO: 1291712 - DNA, 15 bp, Homo sapiens
gccagacacaggccg

SEQ ID NO: 1291713 - DNA, 16 bp, Homo sapiens
gccagacacaggccgt

SEQ ID NO: 1291714 - DNA, 19 bp, Homo sapiens
gccagccatcggaagagag

SEQ ID NO: 1291715 - DNA, 13 bp, Homo sapiens
gccagcccagctg

SEQ ID NO: 1291716 - DNA, 21 bp, Homo sapiens
gccagcccagctggccggaag

SEQ ID NO: 1291717 - DNA, 22 bp, Homo sapiens
gccagcccagctggccggaagg

SEQ ID NO: 1291718 - DNA, 22 bp, Homo sapiens
gccatggcggcccctcagcctg

SEQ ID NO: 1291719 - DNA, 13 bp, Homo sapiens
gcccagccagcca

SEQ ID NO: 1291720 - DNA, 18 bp, Homo sapiens
gcccagcctctctggctc

SEQ ID NO: 1291721 - DNA, 13 bp, Homo sapiens
gcccagctggccg

SEQ ID NO: 1291722 - DNA, 23 bp, Homo sapiens
gcccagctggccggaaggagact

SEQ ID NO: 1291723 - DNA, 17 bp, Homo sapiens
gccccattcacggcctg

SEQ ID NO: 1291724 - DNA, 18 bp, Homo sapiens
gccccattcacggcctgg

SEQ ID NO: 1291725 - DNA, 15 bp, Homo sapiens
gccccattccagctc

SEQ ID NO: 1291726 - DNA, 15 bp, Homo sapiens
gccccccaaggatgg

SEQ ID NO: 1291727 - DNA, 19 bp, Homo sapiens
gccccctattgtctccaag

SEQ ID NO: 1291728 - DNA, 13 bp, Homo sapiens
gcccctcagcctg

SEQ ID NO: 1291729 - DNA, 22 bp, Homo sapiens
gcccctgacagatctagttctc

SEQ ID NO: 1291730 - DNA, 23 bp, Homo sapiens
gcccctgacagatctagttctct

SEQ ID NO: 1291731 - DNA, 13 bp, Homo sapiens
gcccgggatcctg

SEQ ID NO: 1291732 - DNA, 12 bp, Homo sapiens
gccctgcccagc

SEQ ID NO: 1291733 - DNA, 16 bp, Homo sapiens
gccctgcccagccagc

SEQ ID NO: 1291734 - DNA, 19 bp, Homo sapiens
gccctgcggctctggaaag

SEQ ID NO: 1291735 - DNA, 19 bp, Homo sapiens
gccgagctgtcggagggct

SEQ ID NO: 1291736 - DNA, 12 bp, Homo sapiens
gccggctctggg

SEQ ID NO: 1291737 - DNA, 21 bp, Homo sapiens
gccggctctgggctggctgct

SEQ ID NO: 1291738 - DNA, 15 bp, Homo sapiens
gccgtgggacccagg

SEQ ID NO: 1291739 - DNA, 21 bp, Homo sapiens
gccgtgggacccaggctccca

SEQ ID NO: 1291740 - DNA, 22 bp, Homo sapiens
gcctcagatagacctgtgacct

SEQ ID NO: 1291741 - DNA, 12 bp, Homo sapiens
gcctcccaggcc

SEQ ID NO: 1291742 - DNA, 14 bp, Homo sapiens
gcctctctggctca

SEQ ID NO: 1291743 - DNA, 22 bp, Homo sapiens
gcctctctggctcagcccggga

SEQ ID NO: 1291744 - DNA, 14 bp, Homo sapiens
gcctgagcaggcag

SEQ ID NO: 1291745 - DNA, 19 bp, Homo sapiens
gcctgagcaggcaggggct

SEQ ID NO: 1291746 - DNA, 22 bp, Homo sapiens
gcctgagcaggcaggggcttgg

SEQ ID NO: 1291747 - DNA, 14 bp, Homo sapiens
gcctgcctgaagag

SEQ ID NO: 1291748 - DNA, 16 bp, Homo sapiens
gcctgctacacaggca

SEQ ID NO: 1291749 - DNA, 17 bp, Homo sapiens
gcctgctacacaggcag

SEQ ID NO: 1291750 - DNA, 19 bp, Homo sapiens
gcctgctacacaggcagga

SEQ ID NO: 1291751 - DNA, 15 bp, Homo sapiens
gcctggctggccagg

SEQ ID NO: 1291752 - DNA, 16 bp, Homo sapiens
gcctggctggccagga

SEQ ID NO: 1291753 - DNA, 13 bp, Homo sapiens
gcctggggctggc

SEQ ID NO: 1291754 - DNA, 19 bp, Homo sapiens
gcctggggctggctgcaga

SEQ ID NO: 1291755 - DNA, 18 bp, Homo sapiens
gcctgggtcccagggctg

SEQ ID NO: 1291756 - DNA, 13 bp, Homo sapiens
gcctgtgcttgga

SEQ ID NO: 1291757 - DNA, 19 bp, Homo sapiens
gcctgtgcttggaggcctc

SEQ ID NO: 1291758 - DNA, 16 bp, Homo sapiens
gcgaagcctgagcagg

SEQ ID NO: 1291759 - DNA, 21 bp, Homo sapiens
gcgaagcctgagcaggcaggg

SEQ ID NO: 1291760 - DNA, 16 bp, Homo sapiens
gcgacatttctccaag

SEQ ID NO: 1291761 - DNA, 23 bp, Homo sapiens
gcgatctcccagggctctctgga

SEQ ID NO: 1291762 - DNA, 16 bp, Homo sapiens
gcgcatgcctcccagg

SEQ ID NO: 1291763 - DNA, 18 bp, Homo sapiens
gcgcatgcctcccaggcc

SEQ ID NO: 1291764 - DNA, 15 bp, Homo sapiens
gcgccgcgtggacag

SEQ ID NO: 1291765 - DNA, 18 bp, Homo sapiens
gcggagcttggccctgcg

SEQ ID NO: 1291766 - DNA, 21 bp, Homo sapiens
gcggaggagttttctgtgtgg

SEQ ID NO: 1291767 - DNA, 16 bp, Homo sapiens
gcggatcaaccaggca

SEQ ID NO: 1291768 - DNA, 18 bp, Homo sapiens
gcggatcaaccaggcaga

SEQ ID NO: 1291769 - DNA, 19 bp, Homo sapiens
gcggatcaaccaggcagag

SEQ ID NO: 1291770 - DNA, 18 bp, Homo sapiens
gcggcccctcagcctgcc

SEQ ID NO: 1291771 - DNA, 19 bp, Homo sapiens
gcggcccctcagcctgcct

SEQ ID NO: 1291772 - DNA, 18 bp, Homo sapiens
gcgtggacagccggagca

SEQ ID NO: 1291773 - DNA, 15 bp, Homo sapiens
gctagacccaaccct

SEQ ID NO: 1291774 - DNA, 13 bp, Homo sapiens
gctcactctggcc

SEQ ID NO: 1291775 - DNA, 14 bp, Homo sapiens
gctcactctggccc

SEQ ID NO: 1291776 - DNA, 16 bp, Homo sapiens
gctcctctccagacac

SEQ ID NO: 1291777 - DNA, 14 bp, Homo sapiens
gctcctggaacctg

SEQ ID NO: 1291778 - DNA, 19 bp, Homo sapiens
gctcctggaacctggcagg

SEQ ID NO: 1291779 - DNA, 21 bp, Homo sapiens
gctcctggaacctggcaggcc

SEQ ID NO: 1291780 - DNA, 12 bp, Homo sapiens
gctctgggctgg

SEQ ID NO: 1291781 - DNA, 13 bp, Homo sapiens
gctctgggctggc

SEQ ID NO: 1291782 - DNA, 12 bp, Homo sapiens
gctgccagccca

SEQ ID NO: 1291783 - DNA, 15 bp, Homo sapiens
gctgccagcccagct

SEQ ID NO: 1291784 - DNA, 16 bp, Homo sapiens
gctgccagcccagctg

SEQ ID NO: 1291785 - DNA, 18 bp, Homo sapiens
gctgccagcccagctggc

SEQ ID NO: 1291786 - DNA, 23 bp, Homo sapiens
gctgccccattccagctctccca

SEQ ID NO: 1291787 - DNA, 18 bp, Homo sapiens
gctggacatttgtggcag

SEQ ID NO: 1291788 - DNA, 14 bp, Homo sapiens
gctggccggaagga

SEQ ID NO: 1291789 - DNA, 14 bp, Homo sapiens
gctgggagggctga

SEQ ID NO: 1291790 - DNA, 16 bp, Homo sapiens
gctgggagggctgaac

SEQ ID NO: 1291791 - DNA, 20 bp, Homo sapiens
gctgtcggagggctggacat

SEQ ID NO: 1291792 - DNA, 14 bp, Homo sapiens
gcttccagaggaga

SEQ ID NO: 1291793 - DNA, 22 bp, Homo sapiens
gcttccagaggagagtggcctg

SEQ ID NO: 1291794 - DNA, 21 bp, Homo sapiens
gcttggagaggtatgtgcccc

SEQ ID NO: 1291795 - DNA, 13 bp, Homo sapiens
gcttggaggcctc

SEQ ID NO: 1291796 - DNA, 15 bp, Homo sapiens
gcttggaggcctcag

SEQ ID NO: 1291797 - DNA, 19 bp, Homo sapiens
gcttggccctgcgccctgt

SEQ ID NO: 1291798 - DNA, 13 bp, Homo sapiens
gctttgagacagg

SEQ ID NO: 1291799 - DNA, 23 bp, Homo sapiens
gctttgagacaggtgcctggggc

SEQ ID NO: 1291800 - DNA, 15 bp, Homo sapiens
gctttgctctcaagg

SEQ ID NO: 1291801 - DNA, 22 bp, Homo sapiens
gctttgctctcaaggcttggag

SEQ ID NO: 1291802 - DNA, 22 bp, Homo sapiens
ggaaagcaacttcatcccagct

SEQ ID NO: 1291803 - DNA, 14 bp, Homo sapiens
ggaacctggcaggc

SEQ ID NO: 1291804 - DNA, 21 bp, Homo sapiens
ggaacctggcaggccctgccc

SEQ ID NO: 1291805 - DNA, 24 bp, Homo sapiens
ggaacctggcaggccctgcccagc

SEQ ID NO: 1291806 - DNA, 23 bp, Homo sapiens
ggaatgcggttgggaggcaggtc

SEQ ID NO: 1291807 - DNA, 17 bp, Homo sapiens
ggacacaagggtgcaag

SEQ ID NO: 1291808 - DNA, 23 bp, Homo sapiens
ggacacggtttaactgtcccagc

SEQ ID NO: 1291809 - DNA, 20 bp, Homo sapiens
ggacagacatcaagtgccag

SEQ ID NO: 1291810 - DNA, 12 bp, Homo sapiens
ggacagcccggg

SEQ ID NO: 1291811 - DNA, 15 bp, Homo sapiens
ggacagcccgggagc

SEQ ID NO: 1291812 - DNA, 16 bp, Homo sapiens
ggacagcccgggagct

SEQ ID NO: 1291813 - DNA, 13 bp, Homo sapiens
ggacagccggagc

SEQ ID NO: 1291814 - DNA, 15 bp, Homo sapiens
ggacagccggagcag

SEQ ID NO: 1291815 - DNA, 18 bp, Homo sapiens
ggacatttgtggcagtgc

SEQ ID NO: 1291816 - DNA, 19 bp, Homo sapiens
ggaccatacgcggaggagt

SEQ ID NO: 1291817 - DNA, 17 bp, Homo sapiens
ggacctcttcagctgct

SEQ ID NO: 1291818 - DNA, 19 bp, Homo sapiens
ggacctcttcagctgctga

SEQ ID NO: 1291819 - DNA, 19 bp, Homo sapiens
ggagacaggcctttccctg

SEQ ID NO: 1291820 - DNA, 15 bp, Homo sapiens
ggagagtggcctggg

SEQ ID NO: 1291821 - DNA, 19 bp, Homo sapiens
ggagcagccggaagtctgt

SEQ ID NO: 1291822 - DNA, 19 bp, Homo sapiens
ggagcagttggcctgtgct

SEQ ID NO: 1291823 - DNA, 20 bp, Homo sapiens
ggagcagttggcctgtgctt

SEQ ID NO: 1291824 - DNA, 17 bp, Homo sapiens
ggagcccctccaccggg

SEQ ID NO: 1291825 - DNA, 16 bp, Homo sapiens
ggagcggagcttggcc

SEQ ID NO: 1291826 - DNA, 16 bp, Homo sapiens
ggagcttggccctgcg

SEQ ID NO: 1291827 - DNA, 18 bp, Homo sapiens
ggagcttggccctgcgcc

SEQ ID NO: 1291828 - DNA, 21 bp, Homo sapiens
ggagtaagaaatgggcctcag

SEQ ID NO: 1291829 - DNA, 12 bp, Homo sapiens
ggagtggggagc

SEQ ID NO: 1291830 - DNA, 15 bp, Homo sapiens
ggatcaaccaggcag

SEQ ID NO: 1291831 - DNA, 15 bp, Homo sapiens
ggatcctgatggcac

SEQ ID NO: 1291832 - DNA, 21 bp, Homo sapiens
ggcaaacctaaatgcagtcag

SEQ ID NO: 1291833 - DNA, 15 bp, Homo sapiens
ggcaaccccagaccc

SEQ ID NO: 1291834 - DNA, 16 bp, Homo sapiens
ggcaagatccaggtgg

SEQ ID NO: 1291835 - DNA, 18 bp, Homo sapiens
ggcaatgccctgcggctc

SEQ ID NO: 1291836 - DNA, 21 bp, Homo sapiens
ggcaatgccctgcggctctgg

SEQ ID NO: 1291837 - DNA, 22 bp, Homo sapiens
ggcaatgccctgcggctctgga

SEQ ID NO: 1291838 - DNA, 20 bp, Homo sapiens
ggcacccacacagaggacct

SEQ ID NO: 1291839 - DNA, 18 bp, Homo sapiens
ggcacctttgagagaggg

SEQ ID NO: 1291840 - DNA, 20 bp, Homo sapiens
ggcactgtggtcaggcccag

SEQ ID NO: 1291841 - DNA, 22 bp, Homo sapiens
ggcactgtggtcaggcccagcc

SEQ ID NO: 1291842 - DNA, 18 bp, Homo sapiens
ggcaggccctgcccagcc

SEQ ID NO: 1291843 - DNA, 16 bp, Homo sapiens
ggcaggggcttggctg

SEQ ID NO: 1291844 - DNA, 19 bp, Homo sapiens
ggcaggtcgggctgccagc

SEQ ID NO: 1291845 - DNA, 20 bp, Homo sapiens
ggccacctcagtctcacctg

SEQ ID NO: 1291846 - DNA, 19 bp, Homo sapiens
ggcccagcctctctggctc

SEQ ID NO: 1291847 - DNA, 21 bp, Homo sapiens
ggcccagttctcgtgccctta

SEQ ID NO: 1291848 - DNA, 18 bp, Homo sapiens
ggcccctcagcctgcctg

SEQ ID NO: 1291849 - DNA, 19 bp, Homo sapiens
ggcccctcagcctgcctga

SEQ ID NO: 1291850 - DNA, 14 bp, Homo sapiens
ggccctaggcactg

SEQ ID NO: 1291851 - DNA, 14 bp, Homo sapiens
ggccctgcccagcc

SEQ ID NO: 1291852 - DNA, 19 bp, Homo sapiens
ggccctgcccagccagcca

SEQ ID NO: 1291853 - DNA, 13 bp, Homo sapiens
ggccctgcgccct

SEQ ID NO: 1291854 - DNA, 20 bp, Homo sapiens
ggccctgcgccctgtgcagg

SEQ ID NO: 1291855 - DNA, 17 bp, Homo sapiens
ggccgtgggacccaggc

SEQ ID NO: 1291856 - DNA, 21 bp, Homo sapiens
ggcctcagatagacctgtgac

SEQ ID NO: 1291857 - DNA, 15 bp, Homo sapiens
ggcctggcatgcagc

SEQ ID NO: 1291858 - DNA, 14 bp, Homo sapiens
ggcctggctggcca

SEQ ID NO: 1291859 - DNA, 19 bp, Homo sapiens
ggcctggctggccaggaca

SEQ ID NO: 1291860 - DNA, 16 bp, Homo sapiens
ggcctgggtcccaggg

SEQ ID NO: 1291861 - DNA, 19 bp, Homo sapiens
ggcctgggtcccagggctg

SEQ ID NO: 1291862 - DNA, 24 bp, Homo sapiens
ggcctgggtcccagggctggccct

SEQ ID NO: 1291863 - DNA, 13 bp, Homo sapiens
ggccttcctggct

SEQ ID NO: 1291864 - DNA, 16 bp, Homo sapiens
ggccttcctggctttg

SEQ ID NO: 1291865 - DNA, 15 bp, Homo sapiens
ggcgaagcctgagca

SEQ ID NO: 1291866 - DNA, 18 bp, Homo sapiens
ggcgaagcctgagcaggc

SEQ ID NO: 1291867 - DNA, 21 bp, Homo sapiens
ggcgaagcctgagcaggcagg

SEQ ID NO: 1291868 - DNA, 18 bp, Homo sapiens
ggctaagaagttcaccag

SEQ ID NO: 1291869 - DNA, 13 bp, Homo sapiens
ggctcactctggc

SEQ ID NO: 1291870 - DNA, 16 bp, Homo sapiens
ggctcactctggcccc

SEQ ID NO: 1291871 - DNA, 13 bp, Homo sapiens
ggctcccacaggt

SEQ ID NO: 1291872 - DNA, 16 bp, Homo sapiens
ggctctgggctggctg

SEQ ID NO: 1291873 - DNA, 17 bp, Homo sapiens
ggctctgggctggctgc

SEQ ID NO: 1291874 - DNA, 13 bp, Homo sapiens
ggctgccagccca

SEQ ID NO: 1291875 - DNA, 22 bp, Homo sapiens
ggctgccagcccagctggccgg

SEQ ID NO: 1291876 - DNA, 18 bp, Homo sapiens
ggctgccccattccagct

SEQ ID NO: 1291877 - DNA, 21 bp, Homo sapiens
ggctgccccattccagctctc

SEQ ID NO: 1291878 - DNA, 21 bp, Homo sapiens
ggctggacatttgtggcagtg

SEQ ID NO: 1291879 - DNA, 14 bp, Homo sapiens
ggctggctgctcct

SEQ ID NO: 1291880 - DNA, 14 bp, Homo sapiens
ggcttccagaggag

SEQ ID NO: 1291881 - DNA, 18 bp, Homo sapiens
gggaaagggatggtcagg

SEQ ID NO: 1291882 - DNA, 21 bp, Homo sapiens
gggaatgaaccatggcacctt

SEQ ID NO: 1291883 - DNA, 14 bp, Homo sapiens
gggacccaggctcc

SEQ ID NO: 1291884 - DNA, 15 bp, Homo sapiens
gggagacaggccttt

SEQ ID NO: 1291885 - DNA, 21 bp, Homo sapiens
gggagcggagcttggccctgc

SEQ ID NO: 1291886 - DNA, 23 bp, Homo sapiens
gggagctttgagacaggtgcctg

SEQ ID NO: 1291887 - DNA, 22 bp, Homo sapiens
gggaggcaggtcgggctgccag

SEQ ID NO: 1291888 - DNA, 13 bp, Homo sapiens
gggcctcagcccc

SEQ ID NO: 1291889 - DNA, 17 bp, Homo sapiens
gggcgcatgcctcccag

SEQ ID NO: 1291890 - DNA, 14 bp, Homo sapiens
gggctcactctggc

SEQ ID NO: 1291891 - DNA, 16 bp, Homo sapiens
gggctgccagcccagc

SEQ ID NO: 1291892 - DNA, 20 bp, Homo sapiens
gggctggccctaggcactga

SEQ ID NO: 1291893 - DNA, 16 bp, Homo sapiens
gggctggctgctccta

SEQ ID NO: 1291894 - DNA, 22 bp, Homo sapiens
gggcttggctgccccattccag

SEQ ID NO: 1291895 - DNA, 12 bp, Homo sapiens
ggggccttcctg

SEQ ID NO: 1291896 - DNA, 15 bp, Homo sapiens
ggggctcactctggc

SEQ ID NO: 1291897 - DNA, 16 bp, Homo sapiens
ggggctcactctggcc

SEQ ID NO: 1291898 - DNA, 17 bp, Homo sapiens
ggggctcactctggccc

SEQ ID NO: 1291899 - DNA, 18 bp, Homo sapiens
ggggctcactctggcccc

SEQ ID NO: 1291900 - DNA, 13 bp, Homo sapiens
ggggctggctgca

SEQ ID NO: 1291901 - DNA, 18 bp, Homo sapiens
gggggcactgtggtcagg

SEQ ID NO: 1291902 - DNA, 24 bp, Homo sapiens
gggtcaactggcgaagcctgagca

SEQ ID NO: 1291903 - DNA, 23 bp, Homo sapiens
gggtcccagggctggccctaggc

SEQ ID NO: 1291904 - DNA, 21 bp, Homo sapiens
ggtatgtgcccctcctgggtg

SEQ ID NO: 1291905 - DNA, 21 bp, Homo sapiens
ggtcaactggcgaagcctgag

SEQ ID NO: 1291906 - DNA, 22 bp, Homo sapiens
ggtcaactggcgaagcctgagc

SEQ ID NO: 1291907 - DNA, 15 bp, Homo sapiens
ggtcaggcccagcct

SEQ ID NO: 1291908 - DNA, 18 bp, Homo sapiens
ggtcccagggctggccct

SEQ ID NO: 1291909 - DNA, 21 bp, Homo sapiens
ggtcccattttccccctgtgt

SEQ ID NO: 1291910 - DNA, 21 bp, Homo sapiens
ggtcgggctgccagcccagct

SEQ ID NO: 1291911 - DNA, 21 bp, Homo sapiens
ggtctccagctcctctccaga

SEQ ID NO: 1291912 - DNA, 22 bp, Homo sapiens
ggtctggtcaggcaatgccctg

SEQ ID NO: 1291913 - DNA, 17 bp, Homo sapiens
ggtcttcactgcccagg

SEQ ID NO: 1291914 - DNA, 18 bp, Homo sapiens
ggtcttcactgcccaggg

SEQ ID NO: 1291915 - DNA, 19 bp, Homo sapiens
ggtcttgtgaaaaggcttt

SEQ ID NO: 1291916 - DNA, 14 bp, Homo sapiens
ggtgcctggggctg

SEQ ID NO: 1291917 - DNA, 16 bp, Homo sapiens
ggtgcctggggctggc

SEQ ID NO: 1291918 - DNA, 19 bp, Homo sapiens
gtaagaaatgggcctcagc

SEQ ID NO: 1291919 - DNA, 20 bp, Homo sapiens
gtatgtgcccctcctgggtg

SEQ ID NO: 1291920 - DNA, 22 bp, Homo sapiens
gtcaactggcgaagcctgagca

SEQ ID NO: 1291921 - DNA, 15 bp, Homo sapiens
gtcacaaaccagcct

SEQ ID NO: 1291922 - DNA, 18 bp, Homo sapiens
gtcacaaaccagcctggg

SEQ ID NO: 1291923 - DNA, 15 bp, Homo sapiens
gtcaccccagttccc

SEQ ID NO: 1291924 - DNA, 15 bp, Homo sapiens
gtcaggcaatgccct

SEQ ID NO: 1291925 - DNA, 18 bp, Homo sapiens
gtcaggcaatgccctgcg

SEQ ID NO: 1291926 - DNA, 13 bp, Homo sapiens
gtcaggcccagcc

SEQ ID NO: 1291927 - DNA, 19 bp, Homo sapiens
gtcaggcccagcctctctg

SEQ ID NO: 1291928 - DNA, 21 bp, Homo sapiens
gtcaggcccagcctctctggc

SEQ ID NO: 1291929 - DNA, 12 bp, Homo sapiens
gtcccagggctg

SEQ ID NO: 1291930 - DNA, 17 bp, Homo sapiens
gtcccagggctggccct

SEQ ID NO: 1291931 - DNA, 20 bp, Homo sapiens
gtcccataggtcttgtgaaa

SEQ ID NO: 1291932 - DNA, 19 bp, Homo sapiens
gtcccattttccccctgtg

SEQ ID NO: 1291933 - DNA, 14 bp, Homo sapiens
gtccccctcccact

SEQ ID NO: 1291934 - DNA, 23 bp, Homo sapiens
gtcctacaaaaataaaaggcttc

SEQ ID NO: 1291935 - DNA, 20 bp, Homo sapiens
gtcctcacacacggaggcca

SEQ ID NO: 1291936 - DNA, 14 bp, Homo sapiens
gtccttgctcctgg

SEQ ID NO: 1291937 - DNA, 13 bp, Homo sapiens
gtcgggctgccag

SEQ ID NO: 1291938 - DNA, 19 bp, Homo sapiens
gtcgggctgccagcccagc

SEQ ID NO: 1291939 - DNA, 13 bp, Homo sapiens
gtctatggagcag

SEQ ID NO: 1291940 - DNA, 16 bp, Homo sapiens
gtctatggagcagccg

SEQ ID NO: 1291941 - DNA, 20 bp, Homo sapiens
gtctcacctgccggctctgg

SEQ ID NO: 1291942 - DNA, 21 bp, Homo sapiens
gtctcacctgccggctctggg

SEQ ID NO: 1291943 - DNA, 22 bp, Homo sapiens
gtctcttcttaaccctgaacaa

SEQ ID NO: 1291944 - DNA, 11 bp, Homo sapiens
gtctggtcagg

SEQ ID NO: 1291945 - DNA, 15 bp, Homo sapiens
gtcttcactgcccag

SEQ ID NO: 1291946 - DNA, 19 bp, Homo sapiens
gtgacctggtctggtcagg

SEQ ID NO: 1291947 - DNA, 14 bp, Homo sapiens
gtgcccctcctggg

SEQ ID NO: 1291948 - DNA, 17 bp, Homo sapiens
gtgcccctcctgggtgc

SEQ ID NO: 1291949 - DNA, 20 bp, Homo sapiens
gtgcccctcctgggtgctca

SEQ ID NO: 1291950 - DNA, 17 bp, Homo sapiens
gtgcctggggctggctg

SEQ ID NO: 1291951 - DNA, 20 bp, Homo sapiens
gtgctgaagggggcattgcc

SEQ ID NO: 1291952 - DNA, 17 bp, Homo sapiens
gtgcttggaggcctcag

SEQ ID NO: 1291953 - DNA, 17 bp, Homo sapiens
gtggacagccggagcag

SEQ ID NO: 1291954 - DNA, 15 bp, Homo sapiens
gtggcaaccccagac

SEQ ID NO: 1291955 - DNA, 17 bp, Homo sapiens
gtggcagtgctgaaggg

SEQ ID NO: 1291956 - DNA, 13 bp, Homo sapiens
gtggcctgggtcc

SEQ ID NO: 1291957 - DNA, 18 bp, Homo sapiens
gtggcctgggtcccaggg

SEQ ID NO: 1291958 - DNA, 23 bp, Homo sapiens
gtggcctgggtcccagggctggc

SEQ ID NO: 1291959 - DNA, 14 bp, Homo sapiens
gtggctcccacagg

SEQ ID NO: 1291960 - DNA, 17 bp, Homo sapiens
gtggctcccacaggtct

SEQ ID NO: 1291961 - DNA, 15 bp, Homo sapiens
gtgggacccaggctc

SEQ ID NO: 1291962 - DNA, 21 bp, Homo sapiens
gtgggacccaggctcccagcc

SEQ ID NO: 1291963 - DNA, 21 bp, Homo sapiens
gtggggagcggagcttggccc

SEQ ID NO: 1291964 - DNA, 23 bp, Homo sapiens
gtggggagcggagcttggccctg

SEQ ID NO: 1291965 - DNA, 15 bp, Homo sapiens
gtggtcaggcccagc

SEQ ID NO: 1291966 - DNA, 17 bp, Homo sapiens
gtggtcaggcccagcct

SEQ ID NO: 1291967 - DNA, 20 bp, Homo sapiens
gtggttgggggtgggaggtg

SEQ ID NO: 1291968 - DNA, 15 bp, Homo sapiens
gtgtctatggagcag

SEQ ID NO: 1291969 - DNA, 19 bp, Homo sapiens
gtgtggtctccagctcctc

SEQ ID NO: 1291970 - DNA, 12 bp, Homo sapiens
gttctcttctcc

SEQ ID NO: 1291971 - DNA, 16 bp, Homo sapiens
gttctcttctcctgtg

SEQ ID NO: 1291972 - DNA, 23 bp, Homo sapiens
gttctgtggcgccgcgtggacag

SEQ ID NO: 1291973 - DNA, 19 bp, Homo sapiens
gttgccttttcttcccctc

SEQ ID NO: 1291974 - DNA, 13 bp, Homo sapiens
taactgtcccagc

SEQ ID NO: 1291975 - DNA, 18 bp, Homo sapiens
taagaaatgggcctcagc

SEQ ID NO: 1291976 - DNA, 19 bp, Homo sapiens
taagaaatgggcctcagcc

SEQ ID NO: 1291977 - DNA, 16 bp, Homo sapiens
taagggagacaggcct

SEQ ID NO: 1291978 - DNA, 18 bp, Homo sapiens
tagacctgtgacctggtc

SEQ ID NO: 1291979 - DNA, 18 bp, Homo sapiens
tagagaactgtcaccctg

SEQ ID NO: 1291980 - DNA, 21 bp, Homo sapiens
tagagaactgtcaccctgagg

SEQ ID NO: 1291981 - DNA, 14 bp, Homo sapiens
tagcctggctgtca

SEQ ID NO: 1291982 - DNA, 21 bp, Homo sapiens
tagtccaatcacccccaggac

SEQ ID NO: 1291983 - DNA, 19 bp, Homo sapiens
tagttctcttctcctgtgt

SEQ ID NO: 1291984 - DNA, 19 bp, Homo sapiens
tatgtgcccctcctgggtg

SEQ ID NO: 1291985 - DNA, 12 bp, Homo sapiens
tatgtttcttct

SEQ ID NO: 1291986 - DNA, 14 bp, Homo sapiens
tattgtcagtccta

SEQ ID NO: 1291987 - DNA, 20 bp, Homo sapiens
tatttttttacttgagcaaa

SEQ ID NO: 1291988 - DNA, 15 bp, Homo sapiens
tcaaccaggcagagt

SEQ ID NO: 1291989 - DNA, 17 bp, Homo sapiens
tcaaggcttggagaggt

SEQ ID NO: 1291990 - DNA, 17 bp, Homo sapiens
tcacaaaccagcctggg

SEQ ID NO: 1291991 - DNA, 22 bp, Homo sapiens
tcacacacggaggccagacaca

SEQ ID NO: 1291992 - DNA, 14 bp, Homo sapiens
tcaccagccctgag

SEQ ID NO: 1291993 - DNA, 16 bp, Homo sapiens
tcacctgccggctctg

SEQ ID NO: 1291994 - DNA, 14 bp, Homo sapiens
tcagatagacctgt

SEQ ID NO: 1291995 - DNA, 15 bp, Homo sapiens
tcagcctgcctgaag

SEQ ID NO: 1291996 - DNA, 17 bp, Homo sapiens
tcagcctgcctgaagag

SEQ ID NO: 1291997 - DNA, 20 bp, Homo sapiens
tcagcctgcctgaagagagg

SEQ ID NO: 1291998 - DNA, 22 bp, Homo sapiens
tcaggcaatgccctgcggctct

SEQ ID NO: 1291999 - DNA, 22 bp, Homo sapiens
tcaggcccagcctctctggctc

SEQ ID NO: 1292000 - DNA, 24 bp, Homo sapiens
tcaggcccagcctctctggctcag

SEQ ID NO: 1292001 - DNA, 19 bp, Homo sapiens
tcaggcccagttctcgtgc

SEQ ID NO: 1292002 - DNA, 19 bp, Homo sapiens
tcagtcacaaaccagcctg

SEQ ID NO: 1292003 - DNA, 13 bp, Homo sapiens
tcatcccagctgc

SEQ ID NO: 1292004 - DNA, 19 bp, Homo sapiens
tcatcccagctgctgaggc

SEQ ID NO: 1292005 - DNA, 17 bp, Homo sapiens
tccaatcacccccagga

SEQ ID NO: 1292006 - DNA, 20 bp, Homo sapiens
tccacggggctcactctggc

SEQ ID NO: 1292007 - DNA, 15 bp, Homo sapiens
tccagaggagagtgg

SEQ ID NO: 1292008 - DNA, 19 bp, Homo sapiens
tccagaggagagtggcctg

SEQ ID NO: 1292009 - DNA, 21 bp, Homo sapiens
tccagaggagagtggcctggg

SEQ ID NO: 1292010 - DNA, 21 bp, Homo sapiens
tccagctcctctccagacaca

SEQ ID NO: 1292011 - DNA, 20 bp, Homo sapiens
tccagctctcccatggagcc

SEQ ID NO: 1292012 - DNA, 23 bp, Homo sapiens
tccagctctcccatggagcccct

SEQ ID NO: 1292013 - DNA, 17 bp, Homo sapiens
tccagtgtggctcccac

SEQ ID NO: 1292014 - DNA, 18 bp, Homo sapiens
tccatgctttgctctcaa

SEQ ID NO: 1292015 - DNA, 22 bp, Homo sapiens
tccatgctttgctctcaaggct

SEQ ID NO: 1292016 - DNA, 17 bp, Homo sapiens
tccatggacatgggcag

SEQ ID NO: 1292017 - DNA, 20 bp, Homo sapiens
tcccacaggtcttcactgcc

SEQ ID NO: 1292018 - DNA, 23 bp, Homo sapiens
tcccacaggtcttcactgcccag

SEQ ID NO: 1292019 - DNA, 13 bp, Homo sapiens
tcccagctgctga

SEQ ID NO: 1292020 - DNA, 12 bp, Homo sapiens
tcccaggccacc

SEQ ID NO: 1292021 - DNA, 13 bp, Homo sapiens
tcccagggctctc

SEQ ID NO: 1292022 - DNA, 16 bp, Homo sapiens
tcccagggctctctgg

SEQ ID NO: 1292023 - DNA, 18 bp, Homo sapiens
tcccagggctctctggac

SEQ ID NO: 1292024 - DNA, 17 bp, Homo sapiens
tcccagggctggcccta

SEQ ID NO: 1292025 - DNA, 13 bp, Homo sapiens
tcccatggagccc

SEQ ID NO: 1292026 - DNA, 12 bp, Homo sapiens
tcccctcctgta

SEQ ID NO: 1292027 - DNA, 15 bp, Homo sapiens
tcctggaacctggca

SEQ ID NO: 1292028 - DNA, 17 bp, Homo sapiens
tcctggaacctggcagg

SEQ ID NO: 1292029 - DNA, 23 bp, Homo sapiens
tcctggaacctggcaggccctgc

SEQ ID NO: 1292030 - DNA, 13 bp, Homo sapiens
tccttgctcctgg

SEQ ID NO: 1292031 - DNA, 16 bp, Homo sapiens
tccttgctcctggaac

SEQ ID NO: 1292032 - DNA, 13 bp, Homo sapiens
tcggagggctgga

SEQ ID NO: 1292033 - DNA, 16 bp, Homo sapiens
tctagttctcttctcc

SEQ ID NO: 1292034 - DNA, 13 bp, Homo sapiens
tctatggagcagc

SEQ ID NO: 1292035 - DNA, 19 bp, Homo sapiens
tctatggagcagccggaag

SEQ ID NO: 1292036 - DNA, 14 bp, Homo sapiens
tctcaaagcagaag

SEQ ID NO: 1292037 - DNA, 18 bp, Homo sapiens
tctcacctgccggctctg

SEQ ID NO: 1292038 - DNA, 22 bp, Homo sapiens
tctccaagtggaaatcctattt

SEQ ID NO: 1292039 - DNA, 13 bp, Homo sapiens
tctctggctcagc

SEQ ID NO: 1292040 - DNA, 22 bp, Homo sapiens
tctggaccatacgcggaggagt

SEQ ID NO: 1292041 - DNA, 16 bp, Homo sapiens
tctggccccctattgt

SEQ ID NO: 1292042 - DNA, 17 bp, Homo sapiens
tctggctcagcccggga

SEQ ID NO: 1292043 - DNA, 14 bp, Homo sapiens
tctgggctggctgc

SEQ ID NO: 1292044 - DNA, 23 bp, Homo sapiens
tctggtcaggcaatgccctgcgg

SEQ ID NO: 1292045 - DNA, 18 bp, Homo sapiens
tctgtgtggtctccagct

SEQ ID NO: 1292046 - DNA, 16 bp, Homo sapiens
tcttaaccctgaacaa

SEQ ID NO: 1292047 - DNA, 15 bp, Homo sapiens
tcttcactgcccagg

SEQ ID NO: 1292048 - DNA, 17 bp, Homo sapiens
tcttcagctgctgacaa

SEQ ID NO: 1292049 - DNA, 17 bp, Homo sapiens
tcttcccctcctgtaag

SEQ ID NO: 1292050 - DNA, 19 bp, Homo sapiens
tcttcttaaccctgaacaa

SEQ ID NO: 1292051 - DNA, 18 bp, Homo sapiens
tgaccagcaggagggaag

SEQ ID NO: 1292052 - DNA, 18 bp, Homo sapiens
tgacctggtctggtcagg

SEQ ID NO: 1292053 - DNA, 19 bp, Homo sapiens
tgacctggtctggtcaggc

SEQ ID NO: 1292054 - DNA, 18 bp, Homo sapiens
tgagagagggggcactgt

SEQ ID NO: 1292055 - DNA, 16 bp, Homo sapiens
tgagatgctgggaggg

SEQ ID NO: 1292056 - DNA, 23 bp, Homo sapiens
tgagctagacccaacccttagct

SEQ ID NO: 1292057 - DNA, 12 bp, Homo sapiens
tgagtccagtgt

SEQ ID NO: 1292058 - DNA, 20 bp, Homo sapiens
tgcagcttgtccttgctcct

SEQ ID NO: 1292059 - DNA, 21 bp, Homo sapiens
tgcagcttgtccttgctcctg

SEQ ID NO: 1292060 - DNA, 23 bp, Homo sapiens
tgcagggaaagggatggtcaggc

SEQ ID NO: 1292061 - DNA, 15 bp, Homo sapiens
tgccagatgttgtct

SEQ ID NO: 1292062 - DNA, 22 bp, Homo sapiens
tgccagatgttgtctgaactaa

SEQ ID NO: 1292063 - DNA, 13 bp, Homo sapiens
tgccagcccagct

SEQ ID NO: 1292064 - DNA, 13 bp, Homo sapiens
tgcccctcctggg

SEQ ID NO: 1292065 - DNA, 21 bp, Homo sapiens
tgccggctctgggctggctgc

SEQ ID NO: 1292066 - DNA, 12 bp, Homo sapiens
tgcctcccaggc

SEQ ID NO: 1292067 - DNA, 16 bp, Homo sapiens
tgcctcccaggccacc

SEQ ID NO: 1292068 - DNA, 15 bp, Homo sapiens
tgccttttcttcccc

SEQ ID NO: 1292069 - DNA, 13 bp, Homo sapiens
tgcggctctggaa

SEQ ID NO: 1292070 - DNA, 13 bp, Homo sapiens
tgctacacaggca

SEQ ID NO: 1292071 - DNA, 19 bp, Homo sapiens
tgctcctggaacctggcag

SEQ ID NO: 1292072 - DNA, 16 bp, Homo sapiens
tgctctcaaggcttgg

SEQ ID NO: 1292073 - DNA, 14 bp, Homo sapiens
tgcttggaggcctc

SEQ ID NO: 1292074 - DNA, 15 bp, Homo sapiens
tgcttggaggcctca

SEQ ID NO: 1292075 - DNA, 22 bp, Homo sapiens
tgctttgctctcaaggcttgga

SEQ ID NO: 1292076 - DNA, 15 bp, Homo sapiens
tggaacctggcaggc

SEQ ID NO: 1292077 - DNA, 16 bp, Homo sapiens
tggaacctggcaggcc

SEQ ID NO: 1292078 - DNA, 22 bp, Homo sapiens
tggaacctggcaggccctgccc

SEQ ID NO: 1292079 - DNA, 14 bp, Homo sapiens
tggaatccagtgtg

SEQ ID NO: 1292080 - DNA, 12 bp, Homo sapiens
tggacagccgga

SEQ ID NO: 1292081 - DNA, 12 bp, Homo sapiens
tggagcagccgg

SEQ ID NO: 1292082 - DNA, 13 bp, Homo sapiens
tggagcccctcca

SEQ ID NO: 1292083 - DNA, 19 bp, Homo sapiens
tggcacctttgagagaggg

SEQ ID NO: 1292084 - DNA, 21 bp, Homo sapiens
tggcacctttgagagaggggg

SEQ ID NO: 1292085 - DNA, 16 bp, Homo sapiens
tggcaggccctgccca

SEQ ID NO: 1292086 - DNA, 17 bp, Homo sapiens
tggcaggccctgcccag

SEQ ID NO: 1292087 - DNA, 20 bp, Homo sapiens
tggcaggccctgcccagcca

SEQ ID NO: 1292088 - DNA, 16 bp, Homo sapiens
tggcagtgctgaaggg

SEQ ID NO: 1292089 - DNA, 23 bp, Homo sapiens
tggcctgggtcccagggctggcc

SEQ ID NO: 1292090 - DNA, 12 bp, Homo sapiens
tggcctgtgctt

SEQ ID NO: 1292091 - DNA, 17 bp, Homo sapiens
tggcctgtgcttggagg

SEQ ID NO: 1292092 - DNA, 23 bp, Homo sapiens
tggcctgtgcttggaggcctcag

SEQ ID NO: 1292093 - DNA, 22 bp, Homo sapiens
tggcgaagcctgagcaggcagg

SEQ ID NO: 1292094 - DNA, 18 bp, Homo sapiens
tggcgatctcccagggct

SEQ ID NO: 1292095 - DNA, 19 bp, Homo sapiens
tggcgccgcgtggacagcc

SEQ ID NO: 1292096 - DNA, 21 bp, Homo sapiens
tggcggcccctcagcctgcct

SEQ ID NO: 1292097 - DNA, 15 bp, Homo sapiens
tggctcagcccggga

SEQ ID NO: 1292098 - DNA, 12 bp, Homo sapiens
tggctggccagg

SEQ ID NO: 1292099 - DNA, 19 bp, Homo sapiens
tgggaggtgagctagaccc

SEQ ID NO: 1292100 - DNA, 23 bp, Homo sapiens
tgggagtaagaaatgggcctcag

SEQ ID NO: 1292101 - DNA, 23 bp, Homo sapiens
tggggagcggagcttggccctgc

SEQ ID NO: 1292102 - DNA, 14 bp, Homo sapiens
tggggctggctgca

SEQ ID NO: 1292103 - DNA, 19 bp, Homo sapiens
tgggtcccagggctggccc

SEQ ID NO: 1292104 - DNA, 22 bp, Homo sapiens
tgggtcccagggctggccctag

SEQ ID NO: 1292105 - DNA, 19 bp, Homo sapiens
tgggtgctcaccgcctgct

SEQ ID NO: 1292106 - DNA, 20 bp, Homo sapiens
tggtcaggcaatgccctgcg

SEQ ID NO: 1292107 - DNA, 10 bp, Homo sapiens
tggtcaggcc

SEQ ID NO: 1292108 - DNA, 12 bp, Homo sapiens
tggtcaggccca

SEQ ID NO: 1292109 - DNA, 13 bp, Homo sapiens
tggtctccagctc

SEQ ID NO: 1292110 - DNA, 16 bp, Homo sapiens
tggtctggtcaggcaa

SEQ ID NO: 1292111 - DNA, 18 bp, Homo sapiens
tgtaagagtattaacaaa

SEQ ID NO: 1292112 - DNA, 23 bp, Homo sapiens
tgtccacggggctcactctggcc

SEQ ID NO: 1292113 - DNA, 16 bp, Homo sapiens
tgtccttgctcctgga

SEQ ID NO: 1292114 - DNA, 14 bp, Homo sapiens
tgtcggagggctgg

SEQ ID NO: 1292115 - DNA, 19 bp, Homo sapiens
tgtctcttcttaaccctga

SEQ ID NO: 1292116 - DNA, 17 bp, Homo sapiens
tgtgacctggtctggtc

SEQ ID NO: 1292117 - DNA, 21 bp, Homo sapiens
tgtgacctggtctggtcaggc

SEQ ID NO: 1292118 - DNA, 18 bp, Homo sapiens
tgtgcttggaggcctcag

SEQ ID NO: 1292119 - DNA, 17 bp, Homo sapiens
tgtggacagcccgggag

SEQ ID NO: 1292120 - DNA, 18 bp, Homo sapiens
tgtggcagtgctgaaggg

SEQ ID NO: 1292121 - DNA, 18 bp, Homo sapiens
tgtggctcccacaggtct

SEQ ID NO: 1292122 - DNA, 17 bp, Homo sapiens
tgtggtcaggcccagcc

SEQ ID NO: 1292123 - DNA, 18 bp, Homo sapiens
tgtggtctccagctcctc

SEQ ID NO: 1292124 - DNA, 19 bp, Homo sapiens
tgtggttgggggtgggagg

SEQ ID NO: 1292125 - DNA, 15 bp, Homo sapiens
tgttgtctgaactaa

SEQ ID NO: 1292126 - DNA, 13 bp, Homo sapiens
ttaaaacaaacca

SEQ ID NO: 1292127 - DNA, 14 bp, Homo sapiens
ttaaccctgaacaa

SEQ ID NO: 1292128 - DNA, 19 bp, Homo sapiens
ttaaccctgaacaagagtg

SEQ ID NO: 1292129 - DNA, 12 bp, Homo sapiens
ttagcctggctg

SEQ ID NO: 1292130 - DNA, 17 bp, Homo sapiens
ttagcttttagcctggc

SEQ ID NO: 1292131 - DNA, 13 bp, Homo sapiens
ttcaccagccctg

SEQ ID NO: 1292132 - DNA, 18 bp, Homo sapiens
ttcaccagccctgagcca

SEQ ID NO: 1292133 - DNA, 14 bp, Homo sapiens
ttcatcccagctgc

SEQ ID NO: 1292134 - DNA, 22 bp, Homo sapiens
ttccctgccggccccccaagga

SEQ ID NO: 1292135 - DNA, 22 bp, Homo sapiens
ttggaggcctcagatagacctg

SEQ ID NO: 1292136 - DNA, 24 bp, Homo sapiens
ttggctgccccattccagctctcc

SEQ ID NO: 1292137 - DNA, 13 bp, Homo sapiens
ttgggaggcaggt

SEQ ID NO: 1292138 - DNA, 22 bp, Homo sapiens
ttgggaggcaggtcgggctgcc

SEQ ID NO: 1292139 - DNA, 20 bp, Homo sapiens
ttggggcaagatccaggtgg

SEQ ID NO: 1292140 - DNA, 17 bp, Homo sapiens
ttgggggtgggaggtga

SEQ ID NO: 1292141 - DNA, 16 bp, Homo sapiens
ttgtccttgctcctgg

SEQ ID NO: 1292142 - DNA, 20 bp, Homo sapiens
ttgtggcagtgctgaagggg

SEQ ID NO: 1292143 - DNA, 16 bp, Homo sapiens
tttcttcccctcctgt

SEQ ID NO: 1292144 - DNA, 19 bp, Homo sapiens
tttgagacaggtgcctggg

SEQ ID NO: 1292145 - DNA, 15 bp, Homo sapiens
tttgtggcagtgctg

SEQ ID NO: 1292146 - DNA, 15 bp, Homo sapiens
ttttacttgagcaaa

SEQ ID NO: 1292147 - DNA, 22 bp, Homo sapiens
aaagcaacttcatcccagctgc

SEQ ID NO: 1292148 - DNA, 22 bp, Homo sapiens
aaagtattatgtttcttcttgt

SEQ ID NO: 1292149 - DNA, 13 bp, Homo sapiens
aaccagcctgggg

SEQ ID NO: 1292150 - DNA, 21 bp, Homo sapiens
aacccttagcttttagcctgg

SEQ ID NO: 1292151 - DNA, 22 bp, Homo sapiens
aacccttagcttttagcctggc

SEQ ID NO: 1292152 - DNA, 13 bp, Homo sapiens
aacctggcaggcc

SEQ ID NO: 1292153 - DNA, 16 bp, Homo sapiens
aacctggcaggccctg

SEQ ID NO: 1292154 - DNA, 23 bp, Homo sapiens
aacctggcaggccctgcccagcc

SEQ ID NO: 1292155 - DNA, 17 bp, Homo sapiens
aactggcgaagcctgag

SEQ ID NO: 1292156 - DNA, 12 bp, Homo sapiens
aactgtcccagc

SEQ ID NO: 1292157 - DNA, 14 bp, Homo sapiens
aacttcatcccagc

SEQ ID NO: 1292158 - DNA, 18 bp, Homo sapiens
aagaagttcaccagccct

SEQ ID NO: 1292159 - DNA, 19 bp, Homo sapiens
aagcaacttcatcccagct

SEQ ID NO: 1292160 - DNA, 22 bp, Homo sapiens
aagcaacttcatcccagctgct

SEQ ID NO: 1292161 - DNA, 19 bp, Homo sapiens
aagcacacacacacagtcc

SEQ ID NO: 1292162 - DNA, 13 bp, Homo sapiens
aagggagacaggc

SEQ ID NO: 1292163 - DNA, 14 bp, Homo sapiens
aagggagacaggcc

SEQ ID NO: 1292164 - DNA, 15 bp, Homo sapiens
aagggatggtcaggc

SEQ ID NO: 1292165 - DNA, 15 bp, Homo sapiens
aagggtgcaagcccc

SEQ ID NO: 1292166 - DNA, 13 bp, Homo sapiens
aagtctgttctca

SEQ ID NO: 1292167 - DNA, 18 bp, Homo sapiens
aagtgccagatgttgtct

SEQ ID NO: 1292168 - DNA, 14 bp, Homo sapiens
aatgggcctcagcc

SEQ ID NO: 1292169 - DNA, 16 bp, Homo sapiens
aatgggcctcagcccc

SEQ ID NO: 1292170 - DNA, 23 bp, Homo sapiens
acaagagtgtctatggagcagcc

SEQ ID NO: 1292171 - DNA, 19 bp, Homo sapiens
acacacggaggccagacac

SEQ ID NO: 1292172 - DNA, 12 bp, Homo sapiens
acacaggcagga

SEQ ID NO: 1292173 - DNA, 13 bp, Homo sapiens
acacaggcaggaa

SEQ ID NO: 1292174 - DNA, 22 bp, Homo sapiens
acacaggccgtgggacccaggc

SEQ ID NO: 1292175 - DNA, 15 bp, Homo sapiens
acacggaggccagac

SEQ ID NO: 1292176 - DNA, 18 bp, Homo sapiens
acacggtttaactgtccc

SEQ ID NO: 1292177 - DNA, 20 bp, Homo sapiens
acacggtttaactgtcccag

SEQ ID NO: 1292178 - DNA, 22 bp, Homo sapiens
acacggtttaactgtcccagcg

SEQ ID NO: 1292179 - DNA, 21 bp, Homo sapiens
acaggccgtgggacccaggct

SEQ ID NO: 1292180 - DNA, 18 bp, Homo sapiens
acaggtcttcactgccca

SEQ ID NO: 1292181 - DNA, 19 bp, Homo sapiens
acatagagaactgtcaccc

SEQ ID NO: 1292182 - DNA, 14 bp, Homo sapiens
accagcaggaggga

SEQ ID NO: 1292183 - DNA, 19 bp, Homo sapiens
accagccctgagccatggc

SEQ ID NO: 1292184 - DNA, 12 bp, Homo sapiens
accagcctgggg

SEQ ID NO: 1292185 - DNA, 13 bp, Homo sapiens
accagcctggggc

SEQ ID NO: 1292186 - DNA, 16 bp, Homo sapiens
acccaggctcccagcc

SEQ ID NO: 1292187 - DNA, 21 bp, Homo sapiens
acccaggctcccagcctaagg

SEQ ID NO: 1292188 - DNA, 23 bp, Homo sapiens
accgggcgcatgcctcccaggcc

SEQ ID NO: 1292189 - DNA, 20 bp, Homo sapiens
acctgagatgctgggagggc

SEQ ID NO: 1292190 - DNA, 14 bp, Homo sapiens
acctgccggctctg

SEQ ID NO: 1292191 - DNA, 14 bp, Homo sapiens
acctggcaggccct

SEQ ID NO: 1292192 - DNA, 17 bp, Homo sapiens
acctggcaggccctgcc

SEQ ID NO: 1292193 - DNA, 19 bp, Homo sapiens
acctggcaggccctgccca

SEQ ID NO: 1292194 - DNA, 16 bp, Homo sapiens
acctgtgacctggtct

SEQ ID NO: 1292195 - DNA, 17 bp, Homo sapiens
acctgtgacctggtctg

SEQ ID NO: 1292196 - DNA, 22 bp, Homo sapiens
acctttgagagagggggcactg

SEQ ID NO: 1292197 - DNA, 19 bp, Homo sapiens
acctttttaatttccagaa

SEQ ID NO: 1292198 - DNA, 21 bp, Homo sapiens
acctttttaatttccagaact

SEQ ID NO: 1292199 - DNA, 12 bp, Homo sapiens
acggaggccaga

SEQ ID NO: 1292200 - DNA, 12 bp, Homo sapiens
acggcctggcat

SEQ ID NO: 1292201 - DNA, 15 bp, Homo sapiens
acggcctggcatgca

SEQ ID NO: 1292202 - DNA, 16 bp, Homo sapiens
actgaaaagcagcctt

SEQ ID NO: 1292203 - DNA, 19 bp, Homo sapiens
actgcacaatgaccagcag

SEQ ID NO: 1292204 - DNA, 16 bp, Homo sapiens
actggcgaagcctgag

SEQ ID NO: 1292205 - DNA, 20 bp, Homo sapiens
actggcgaagcctgagcagg

SEQ ID NO: 1292206 - DNA, 15 bp, Homo sapiens
actgtcaccctgagg

SEQ ID NO: 1292207 - DNA, 15 bp, Homo sapiens
actgtcccagcgaca

SEQ ID NO: 1292208 - DNA, 12 bp, Homo sapiens
actgtggtcagg

SEQ ID NO: 1292209 - DNA, 15 bp, Homo sapiens
actgtggtcaggccc

SEQ ID NO: 1292210 - DNA, 16 bp, Homo sapiens
actgtggtcaggccca

SEQ ID NO: 1292211 - DNA, 18 bp, Homo sapiens
actgtggtcaggcccagc

SEQ ID NO: 1292212 - DNA, 19 bp, Homo sapiens
actgtggtcaggcccagcc

SEQ ID NO: 1292213 - DNA, 20 bp, Homo sapiens
actgtggtcaggcccagcct

SEQ ID NO: 1292214 - DNA, 18 bp, Homo sapiens
acttcatcccagctgctg

SEQ ID NO: 1292215 - DNA, 23 bp, Homo sapiens
acttgacctgagatgctgggagg

SEQ ID NO: 1292216 - DNA, 19 bp, Homo sapiens
agaaatgggcctcagcccc

SEQ ID NO: 1292217 - DNA, 21 bp, Homo sapiens
agaactaaggatttttccatg

SEQ ID NO: 1292218 - DNA, 15 bp, Homo sapiens
agaactgcacaatga

SEQ ID NO: 1292219 - DNA, 22 bp, Homo sapiens
agaactgcacaatgaccagcag

SEQ ID NO: 1292220 - DNA, 21 bp, Homo sapiens
agaagtggaatccagtgtggc

SEQ ID NO: 1292221 - DNA, 21 bp, Homo sapiens
agaagttcaccagccctgagc

SEQ ID NO: 1292222 - DNA, 20 bp, Homo sapiens
agacaggcctttccctgccg

SEQ ID NO: 1292223 - DNA, 17 bp, Homo sapiens
agagggctgagccatgg

SEQ ID NO: 1292224 - DNA, 18 bp, Homo sapiens
agagggggcactgtggtc

SEQ ID NO: 1292225 - DNA, 19 bp, Homo sapiens
agagggggcactgtggtca

SEQ ID NO: 1292226 - DNA, 14 bp, Homo sapiens
agaggtatgtgccc

SEQ ID NO: 1292227 - DNA, 15 bp, Homo sapiens
agaggtatgtgcccc

SEQ ID NO: 1292228 - DNA, 19 bp, Homo sapiens
agagtggcctgggtcccag

SEQ ID NO: 1292229 - DNA, 20 bp, Homo sapiens
agagtggcctgggtcccagg

SEQ ID NO: 1292230 - DNA, 21 bp, Homo sapiens
agagtggcctgggtcccaggg

SEQ ID NO: 1292231 - DNA, 15 bp, Homo sapiens
agagtgtctatggag

SEQ ID NO: 1292232 - DNA, 20 bp, Homo sapiens
agatccaggtggtcccatag

SEQ ID NO: 1292233 - DNA, 21 bp, Homo sapiens
agatgctgggagggctgaacc

SEQ ID NO: 1292234 - DNA, 17 bp, Homo sapiens
agcaacttcatcccagc

SEQ ID NO: 1292235 - DNA, 22 bp, Homo sapiens
agcaacttcatcccagctgctg

SEQ ID NO: 1292236 - DNA, 17 bp, Homo sapiens
agcagaagtggaatcca

SEQ ID NO: 1292237 - DNA, 18 bp, Homo sapiens
agcaggagggaaggacag

SEQ ID NO: 1292238 - DNA, 23 bp, Homo sapiens
agcaggagggaaggacagacatc

SEQ ID NO: 1292239 - DNA, 20 bp, Homo sapiens
agcaggcaggggcttggctg

SEQ ID NO: 1292240 - DNA, 17 bp, Homo sapiens
agcagttggcctgtgct

SEQ ID NO: 1292241 - DNA, 15 bp, Homo sapiens
agccatcggaagaga

SEQ ID NO: 1292242 - DNA, 15 bp, Homo sapiens
agcccagctggccgg

SEQ ID NO: 1292243 - DNA, 16 bp, Homo sapiens
agcccagctggccgga

SEQ ID NO: 1292244 - DNA, 21 bp, Homo sapiens
agcccagctggccggaaggag

SEQ ID NO: 1292245 - DNA, 17 bp, Homo sapiens
agccccattcacggcct

SEQ ID NO: 1292246 - DNA, 18 bp, Homo sapiens
agccccattcacggcctg

SEQ ID NO: 1292247 - DNA, 22 bp, Homo sapiens
agccccattcacggcctggcat

SEQ ID NO: 1292248 - DNA, 21 bp, Homo sapiens
agcctaagggagacaggcctt

SEQ ID NO: 1292249 - DNA, 15 bp, Homo sapiens
agcctctctggctca

SEQ ID NO: 1292250 - DNA, 16 bp, Homo sapiens
agcctgagcaggcagg

SEQ ID NO: 1292251 - DNA, 17 bp, Homo sapiens
agcctgagcaggcaggg

SEQ ID NO: 1292252 - DNA, 10 bp, Homo sapiens
agcctggctg

SEQ ID NO: 1292253 - DNA, 11 bp, Homo sapiens
agcctggctgt

SEQ ID NO: 1292254 - DNA, 21 bp, Homo sapiens
agcctggggccttcctggctt

SEQ ID NO: 1292255 - DNA, 19 bp, Homo sapiens
agcctttttcaccatggca

SEQ ID NO: 1292256 - DNA, 19 bp, Homo sapiens
agcgacatttctccaagtg

SEQ ID NO: 1292257 - DNA, 16 bp, Homo sapiens
agcggagcttggccct

SEQ ID NO: 1292258 - DNA, 21 bp, Homo sapiens
agctcctctccagacacagag

SEQ ID NO: 1292259 - DNA, 18 bp, Homo sapiens
agctctcccatggagccc

SEQ ID NO: 1292260 - DNA, 13 bp, Homo sapiens
agctgctgaggcg

SEQ ID NO: 1292261 - DNA, 16 bp, Homo sapiens
agctggccggaaggag

SEQ ID NO: 1292262 - DNA, 20 bp, Homo sapiens
agctggccggaaggagactg

SEQ ID NO: 1292263 - DNA, 14 bp, Homo sapiens
agcttggccctgcg

SEQ ID NO: 1292264 - DNA, 18 bp, Homo sapiens
agcttggccctgcgccct

SEQ ID NO: 1292265 - DNA, 15 bp, Homo sapiens
agcttgtccttgctc

SEQ ID NO: 1292266 - DNA, 17 bp, Homo sapiens
agcttgtccttgctcct

SEQ ID NO: 1292267 - DNA, 22 bp, Homo sapiens
agcttgtccttgctcctggaac

SEQ ID NO: 1292268 - DNA, 20 bp, Homo sapiens
agctttgagacaggtgcctg

SEQ ID NO: 1292269 - DNA, 21 bp, Homo sapiens
aggacacaagggtgcaagccc

SEQ ID NO: 1292270 - DNA, 19 bp, Homo sapiens
aggacctcttcagctgctg

SEQ ID NO: 1292271 - DNA, 14 bp, Homo sapiens
aggagagtggcctg

SEQ ID NO: 1292272 - DNA, 16 bp, Homo sapiens
aggagagtggcctggg

SEQ ID NO: 1292273 - DNA, 17 bp, Homo sapiens
aggagagtggcctgggt

SEQ ID NO: 1292274 - DNA, 18 bp, Homo sapiens
aggagagtggcctgggtc

SEQ ID NO: 1292275 - DNA, 19 bp, Homo sapiens
aggagttttctgtgtggtc

SEQ ID NO: 1292276 - DNA, 14 bp, Homo sapiens
aggatttttccatg

SEQ ID NO: 1292277 - DNA, 13 bp, Homo sapiens
aggcaatgccctg

SEQ ID NO: 1292278 - DNA, 18 bp, Homo sapiens
aggcaatgccctgcggct

SEQ ID NO: 1292279 - DNA, 21 bp, Homo sapiens
aggcaatgccctgcggctctg

SEQ ID NO: 1292280 - DNA, 22 bp, Homo sapiens
aggcaatgccctgcggctctgg

SEQ ID NO: 1292281 - DNA, 22 bp, Homo sapiens
aggcaggggcttggctgcccca

SEQ ID NO: 1292282 - DNA, 16 bp, Homo sapiens
aggcaggtcgggctgc

SEQ ID NO: 1292283 - DNA, 19 bp, Homo sapiens
aggcaggtcgggctgccag

SEQ ID NO: 1292284 - DNA, 14 bp, Homo sapiens
aggccacctcagtc

SEQ ID NO: 1292285 - DNA, 21 bp, Homo sapiens
aggccacctcagtctcacctg

SEQ ID NO: 1292286 - DNA, 19 bp, Homo sapiens
aggcccagcctctctggct

SEQ ID NO: 1292287 - DNA, 21 bp, Homo sapiens
aggcccagcctctctggctca

SEQ ID NO: 1292288 - DNA, 15 bp, Homo sapiens
aggccctgcccagcc

SEQ ID NO: 1292289 - DNA, 18 bp, Homo sapiens
aggccgtgggacccaggc

SEQ ID NO: 1292290 - DNA, 21 bp, Homo sapiens
aggccgtgggacccaggctcc

SEQ ID NO: 1292291 - DNA, 22 bp, Homo sapiens
aggccgtgggacccaggctccc

SEQ ID NO: 1292292 - DNA, 23 bp, Homo sapiens
aggccgtgggacccaggctccca

SEQ ID NO: 1292293 - DNA, 16 bp, Homo sapiens
aggcctttccctgccg

SEQ ID NO: 1292294 - DNA, 22 bp, Homo sapiens
aggcttggagaggtatgtgccc

SEQ ID NO: 1292295 - DNA, 15 bp, Homo sapiens
agggatggtcaggcc

SEQ ID NO: 1292296 - DNA, 18 bp, Homo sapiens
agggatggtcaggcccag

SEQ ID NO: 1292297 - DNA, 14 bp, Homo sapiens
agggctctctggac

SEQ ID NO: 1292298 - DNA, 24 bp, Homo sapiens
agggctggacatttgtggcagtgc

SEQ ID NO: 1292299 - DNA, 13 bp, Homo sapiens
agggctggcccta

SEQ ID NO: 1292300 - DNA, 16 bp, Homo sapiens
agggctggccctaggc

SEQ ID NO: 1292301 - DNA, 14 bp, Homo sapiens
agggggcactgtgg

SEQ ID NO: 1292302 - DNA, 15 bp, Homo sapiens
agggggcattgccgg

SEQ ID NO: 1292303 - DNA, 21 bp, Homo sapiens
aggtatgtgcccctcctgggt

SEQ ID NO: 1292304 - DNA, 22 bp, Homo sapiens
aggtcgggctgccagcccagct

SEQ ID NO: 1292305 - DNA, 12 bp, Homo sapiens
aggtggtcccat

SEQ ID NO: 1292306 - DNA, 19 bp, Homo sapiens
agtccaatcacccccagga

SEQ ID NO: 1292307 - DNA, 23 bp, Homo sapiens
agtccaatcacccccaggacctc

SEQ ID NO: 1292308 - DNA, 22 bp, Homo sapiens
agtcctcacacacggaggccag

SEQ ID NO: 1292309 - DNA, 23 bp, Homo sapiens
agtctcacctgccggctctgggc

SEQ ID NO: 1292310 - DNA, 20 bp, Homo sapiens
agtgccagatgttgtctgaa

SEQ ID NO: 1292311 - DNA, 23 bp, Homo sapiens
agtgccagatgttgtctgaacta

SEQ ID NO: 1292312 - DNA, 17 bp, Homo sapiens
agtggcctgggtcccag

SEQ ID NO: 1292313 - DNA, 19 bp, Homo sapiens
agtggcctgggtcccaggg

SEQ ID NO: 1292314 - DNA, 12 bp, Homo sapiens
agtgtggctccc

SEQ ID NO: 1292315 - DNA, 19 bp, Homo sapiens
agttcaccagccctgagcc

SEQ ID NO: 1292316 - DNA, 16 bp, Homo sapiens
agttcccttggtggca

SEQ ID NO: 1292317 - DNA, 19 bp, Homo sapiens
agttggcctgtgcttggag

SEQ ID NO: 1292318 - DNA, 22 bp, Homo sapiens
agttggcctgtgcttggaggcc

SEQ ID NO: 1292319 - DNA, 23 bp, Homo sapiens
atacgcggaggagttttctgtgt

SEQ ID NO: 1292320 - DNA, 22 bp, Homo sapiens
atagacctgtgacctggtctgg

SEQ ID NO: 1292321 - DNA, 18 bp, Homo sapiens
atagttgccttttcttcc

SEQ ID NO: 1292322 - DNA, 23 bp, Homo sapiens
atcaaccaggcagagttctgtgg

SEQ ID NO: 1292323 - DNA, 18 bp, Homo sapiens
atcgagcacttctcacca

SEQ ID NO: 1292324 - DNA, 20 bp, Homo sapiens
atcggaagagagggctgagc

SEQ ID NO: 1292325 - DNA, 18 bp, Homo sapiens
atctagttctcttctcct

SEQ ID NO: 1292326 - DNA, 21 bp, Homo sapiens
atctccatgctttgctctcaa

SEQ ID NO: 1292327 - DNA, 11 bp, Homo sapiens
atctcccaggg

SEQ ID NO: 1292328 - DNA, 17 bp, Homo sapiens
atctcccagggctctct

SEQ ID NO: 1292329 - DNA, 20 bp, Homo sapiens
cctgagcaggcaggggcttg

SEQ ID NO: 1292330 - DNA, 17 bp, Homo sapiens
cctgagccatggcggcc

SEQ ID NO: 1292331 - DNA, 12 bp, Homo sapiens
cctgcccagcca

SEQ ID NO: 1292332 - DNA, 16 bp, Homo sapiens
cctgccggccccccaa

SEQ ID NO: 1292333 - DNA, 13 bp, Homo sapiens
cctgccggctctg

SEQ ID NO: 1292334 - DNA, 23 bp, Homo sapiens
cctgccggctctgggctggctgc

SEQ ID NO: 1292335 - DNA, 16 bp, Homo sapiens
cctgcctgaagagagg

SEQ ID NO: 1292336 - DNA, 14 bp, Homo sapiens
cctgcgccctgtgc

SEQ ID NO: 1292337 - DNA, 15 bp, Homo sapiens
cctgcgccctgtgca

SEQ ID NO: 1292338 - DNA, 17 bp, Homo sapiens
cctgctacacaggcagg

SEQ ID NO: 1292339 - DNA, 22 bp, Homo sapiens
cctggaacctggcaggccctgc

SEQ ID NO: 1292340 - DNA, 21 bp, Homo sapiens
cctggcaggccctgcccagcc

SEQ ID NO: 1292341 - DNA, 22 bp, Homo sapiens
cctggcaggccctgcccagcca

SEQ ID NO: 1292342 - DNA, 16 bp, Homo sapiens
cctggctggccaggac

SEQ ID NO: 1292343 - DNA, 18 bp, Homo sapiens
cctggggccttcctggct

SEQ ID NO: 1292344 - DNA, 13 bp, Homo sapiens
cctgggtcccagg

SEQ ID NO: 1292345 - DNA, 18 bp, Homo sapiens
cctgggtcccagggctgg

SEQ ID NO: 1292346 - DNA, 18 bp, Homo sapiens
cctgggtgctcaccgcct

SEQ ID NO: 1292347 - DNA, 21 bp, Homo sapiens
cctgggtgctcaccgcctgct

SEQ ID NO: 1292348 - DNA, 14 bp, Homo sapiens
cctggtctggtcag

SEQ ID NO: 1292349 - DNA, 15 bp, Homo sapiens
cctggtctggtcagg

SEQ ID NO: 1292350 - DNA, 16 bp, Homo sapiens
cctggtctggtcaggc

SEQ ID NO: 1292351 - DNA, 21 bp, Homo sapiens
cctggtctggtcaggcaatgc

SEQ ID NO: 1292352 - DNA, 17 bp, Homo sapiens
cctgtgacctggtctgg

SEQ ID NO: 1292353 - DNA, 19 bp, Homo sapiens
cctgtgacctggtctggtc

SEQ ID NO: 1292354 - DNA, 17 bp, Homo sapiens
cctgtgcttggaggcct

SEQ ID NO: 1292355 - DNA, 22 bp, Homo sapiens
ccttagcttttagcctggctgt

SEQ ID NO: 1292356 - DNA, 15 bp, Homo sapiens
ccttgctcctggaac

SEQ ID NO: 1292357 - DNA, 16 bp, Homo sapiens
ccttgctcctggaacc

SEQ ID NO: 1292358 - DNA, 17 bp, Homo sapiens
ccttgctcctggaacct

SEQ ID NO: 1292359 - DNA, 21 bp, Homo sapiens
ccttgctcctggaacctggca

SEQ ID NO: 1292360 - DNA, 14 bp, Homo sapiens
cctttgagagaggg

SEQ ID NO: 1292361 - DNA, 23 bp, Homo sapiens
cctttgagtccagtgtgggacac

SEQ ID NO: 1292362 - DNA, 14 bp, Homo sapiens
cgaagcctgagcag

SEQ ID NO: 1292363 - DNA, 15 bp, Homo sapiens
cgaagcctgagcagg

SEQ ID NO: 1292364 - DNA, 20 bp, Homo sapiens
cgagctgtcggagggctgga

SEQ ID NO: 1292365 - DNA, 13 bp, Homo sapiens
cgatctcccaggg

SEQ ID NO: 1292366 - DNA, 23 bp, Homo sapiens
cgcaggtcatattgtcagtccta

SEQ ID NO: 1292367 - DNA, 17 bp, Homo sapiens
cgcatgcctcccaggcc

SEQ ID NO: 1292368 - DNA, 19 bp, Homo sapiens
cgccctgtgcagggaaagg

SEQ ID NO: 1292369 - DNA, 22 bp, Homo sapiens
cgccgcgtggacagccggagca

SEQ ID NO: 1292370 - DNA, 16 bp, Homo sapiens
cgcctgctacacaggc

SEQ ID NO: 1292371 - DNA, 17 bp, Homo sapiens
cgcggaggagttttctg

SEQ ID NO: 1292372 - DNA, 17 bp, Homo sapiens
cgcggatcaaccaggca

SEQ ID NO: 1292373 - DNA, 20 bp, Homo sapiens
cgcggatcaaccaggcagag

SEQ ID NO: 1292374 - DNA, 15 bp, Homo sapiens
cggaagagagggctg

SEQ ID NO: 1292375 - DNA, 19 bp, Homo sapiens
cggaagagagggctgagcc

SEQ ID NO: 1292376 - DNA, 20 bp, Homo sapiens
cggaagagagggctgagcca

SEQ ID NO: 1292377 - DNA, 22 bp, Homo sapiens
cggaagagagggctgagccatg

SEQ ID NO: 1292378 - DNA, 16 bp, Homo sapiens
cggaagtctgttctca

SEQ ID NO: 1292379 - DNA, 20 bp, Homo sapiens
cggagcagttggcctgtgct

SEQ ID NO: 1292380 - DNA, 13 bp, Homo sapiens
cggagcttggccc

SEQ ID NO: 1292381 - DNA, 20 bp, Homo sapiens
cggagcttggccctgcgccc

SEQ ID NO: 1292382 - DNA, 19 bp, Homo sapiens
cggcctggcatgcagcttg

SEQ ID NO: 1292383 - DNA, 14 bp, Homo sapiens
cggctctgggctgg

SEQ ID NO: 1292384 - DNA, 17 bp, Homo sapiens
cgggctgccagcccagc

SEQ ID NO: 1292385 - DNA, 20 bp, Homo sapiens
cgggctgccagcccagctgg

SEQ ID NO: 1292386 - DNA, 14 bp, Homo sapiens
cggggctcactctg

SEQ ID NO: 1292387 - DNA, 15 bp, Homo sapiens
cggggctcactctgg

SEQ ID NO: 1292388 - DNA, 18 bp, Homo sapiens
cggggctcactctggccc

SEQ ID NO: 1292389 - DNA, 14 bp, Homo sapiens
cggttgggaggcag

SEQ ID NO: 1292390 - DNA, 18 bp, Homo sapiens
cgtggacagccggagcag

SEQ ID NO: 1292391 - DNA, 15 bp, Homo sapiens
cgtgggacccaggct

SEQ ID NO: 1292392 - DNA, 20 bp, Homo sapiens
cgtgggacccaggctcccag

SEQ ID NO: 1292393 - DNA, 22 bp, Homo sapiens
cgtgggacccaggctcccagcc

SEQ ID NO: 1292394 - DNA, 21 bp, Homo sapiens
ctaagaagttcaccagccctg

SEQ ID NO: 1292395 - DNA, 22 bp, Homo sapiens
ctaagaagttcaccagccctga

SEQ ID NO: 1292396 - DNA, 14 bp, Homo sapiens
ctaagggagacagg

SEQ ID NO: 1292397 - DNA, 14 bp, Homo sapiens
ctacacaggcagga

SEQ ID NO: 1292398 - DNA, 19 bp, Homo sapiens
ctagtccaatcacccccag

SEQ ID NO: 1292399 - DNA, 21 bp, Homo sapiens
ctagtccaatcacccccagga

SEQ ID NO: 1292400 - DNA, 21 bp, Homo sapiens
ctagttctcttctcctgtgtt

SEQ ID NO: 1292401 - DNA, 11 bp, Homo sapiens
ctatggagcag

SEQ ID NO: 1292402 - DNA, 22 bp, Homo sapiens
ctcaaagcagaagtggaatcca

SEQ ID NO: 1292403 - DNA, 14 bp, Homo sapiens
ctcaaggcttggag

SEQ ID NO: 1292404 - DNA, 19 bp, Homo sapiens
ctcacacacggaggccaga

SEQ ID NO: 1292405 - DNA, 17 bp, Homo sapiens
ctcacctgccggctctg

SEQ ID NO: 1292406 - DNA, 16 bp, Homo sapiens
ctcagatagacctgtg

SEQ ID NO: 1292407 - DNA, 21 bp, Homo sapiens
ctcagtctcacctgccggctc

SEQ ID NO: 1292408 - DNA, 23 bp, Homo sapiens
ctcagtctcacctgccggctctg

SEQ ID NO: 1292409 - DNA, 20 bp, Homo sapiens
ctccaccgggcgcatgcctc

SEQ ID NO: 1292410 - DNA, 15 bp, Homo sapiens
ctccagacacagaga

SEQ ID NO: 1292411 - DNA, 13 bp, Homo sapiens
ctcccacaggtct

SEQ ID NO: 1292412 - DNA, 19 bp, Homo sapiens
ctcccacttgacctgagat

SEQ ID NO: 1292413 - DNA, 21 bp, Homo sapiens
ctcccagcctaagggagacag

SEQ ID NO: 1292414 - DNA, 15 bp, Homo sapiens
ctcctctccagacac

SEQ ID NO: 1292415 - DNA, 16 bp, Homo sapiens
ctcctctccagacaca

SEQ ID NO: 1292416 - DNA, 21 bp, Homo sapiens
ctcctctccagacacagagac

SEQ ID NO: 1292417 - DNA, 22 bp, Homo sapiens
ctcgccgagctgtcggagggct

SEQ ID NO: 1292418 - DNA, 19 bp, Homo sapiens
ctcggcctggctggccagg

SEQ ID NO: 1292419 - DNA, 21 bp, Homo sapiens
ctcggcctggctggccaggac

SEQ ID NO: 1292420 - DNA, 14 bp, Homo sapiens
ctctccagacacag

SEQ ID NO: 1292421 - DNA, 23 bp, Homo sapiens
ctctggaccatacgcggaggagt

SEQ ID NO: 1292422 - DNA, 20 bp, Homo sapiens
ctctggccccctattgtctc

SEQ ID NO: 1292423 - DNA, 12 bp, Homo sapiens
ctcttcagctgc

SEQ ID NO: 1292424 - DNA, 13 bp, Homo sapiens
ctcttcagctgct

SEQ ID NO: 1292425 - DNA, 14 bp, Homo sapiens
ctcttcagctgctg

SEQ ID NO: 1292426 - DNA, 12 bp, Homo sapiens
ctcttctcctgt

SEQ ID NO: 1292427 - DNA, 13 bp, Homo sapiens
ctcttctcctgtg

SEQ ID NO: 1292428 - DNA, 17 bp, Homo sapiens
ctcttcttaaccctgaa

SEQ ID NO: 1292429 - DNA, 20 bp, Homo sapiens
ctcttcttaaccctgaacaa

SEQ ID NO: 1292430 - DNA, 21 bp, Homo sapiens
ctgaaaagcagcctttttcac

SEQ ID NO: 1292431 - DNA, 15 bp, Homo sapiens
ctgacagatctagtt

SEQ ID NO: 1292432 - DNA, 14 bp, Homo sapiens
ctgagatgctggga

SEQ ID NO: 1292433 - DNA, 16 bp, Homo sapiens
ctgagatgctgggagg

SEQ ID NO: 1292434 - DNA, 14 bp, Homo sapiens
ctgagcaggcaggg

SEQ ID NO: 1292435 - DNA, 16 bp, Homo sapiens
ctgagcaggcaggggc

SEQ ID NO: 1292436 - DNA, 21 bp, Homo sapiens
ctgccagcccagctggccgga

SEQ ID NO: 1292437 - DNA, 19 bp, Homo sapiens
ctgccccattccagctctc

SEQ ID NO: 1292438 - DNA, 23 bp, Homo sapiens
ctgccggccccccaaggatgggg

SEQ ID NO: 1292439 - DNA, 13 bp, Homo sapiens
ctgcctgaagaga

SEQ ID NO: 1292440 - DNA, 17 bp, Homo sapiens
ggcgatctcccagggct

SEQ ID NO: 1292441 - DNA, 19 bp, Homo sapiens
ggcgatctcccagggctct

SEQ ID NO: 1292442 - DNA, 24 bp, Homo sapiens
ggcgatctcccagggctctctgga

SEQ ID NO: 1292443 - DNA, 19 bp, Homo sapiens
ggcgcatgcctcccaggcc

SEQ ID NO: 1292444 - DNA, 16 bp, Homo sapiens
ggcgccgcgtggacag

SEQ ID NO: 1292445 - DNA, 17 bp, Homo sapiens
ggcgccgcgtggacagc

SEQ ID NO: 1292446 - DNA, 14 bp, Homo sapiens
ggcggcccctcagc

SEQ ID NO: 1292447 - DNA, 17 bp, Homo sapiens
ggcggcccctcagcctg

SEQ ID NO: 1292448 - DNA, 18 bp, Homo sapiens
ggcggcccctcagcctgc

SEQ ID NO: 1292449 - DNA, 20 bp, Homo sapiens
ggcggcccctcagcctgcct

SEQ ID NO: 1292450 - DNA, 21 bp, Homo sapiens
ggctaagaagttcaccagccc

SEQ ID NO: 1292451 - DNA, 14 bp, Homo sapiens
ggctcactctggcc

SEQ ID NO: 1292452 - DNA, 15 bp, Homo sapiens
ggctcccagcctaag

SEQ ID NO: 1292453 - DNA, 16 bp, Homo sapiens
ggctcccagcctaagg

SEQ ID NO: 1292454 - DNA, 14 bp, Homo sapiens
ggctctgggctggc

SEQ ID NO: 1292455 - DNA, 12 bp, Homo sapiens
ggctgccagccc

SEQ ID NO: 1292456 - DNA, 19 bp, Homo sapiens
ggctgccccattccagctc

SEQ ID NO: 1292457 - DNA, 22 bp, Homo sapiens
ggctgccccattccagctctcc

SEQ ID NO: 1292458 - DNA, 20 bp, Homo sapiens
ggctgctcctaacctacctc

SEQ ID NO: 1292459 - DNA, 15 bp, Homo sapiens
ggctggccaggacac

SEQ ID NO: 1292460 - DNA, 20 bp, Homo sapiens
ggctggccaggacacactga

SEQ ID NO: 1292461 - DNA, 11 bp, Homo sapiens
ggctggcccta

SEQ ID NO: 1292462 - DNA, 15 bp, Homo sapiens
ggcttccagaggaga

SEQ ID NO: 1292463 - DNA, 21 bp, Homo sapiens
ggcttggagaggtatgtgccc

SEQ ID NO: 1292464 - DNA, 13 bp, Homo sapiens
ggcttggctgccc

SEQ ID NO: 1292465 - DNA, 23 bp, Homo sapiens
gggacacggtttaactgtcccag

SEQ ID NO: 1292466 - DNA, 12 bp, Homo sapiens
gggacccaggct

SEQ ID NO: 1292467 - DNA, 19 bp, Homo sapiens
gggacccaggctcccagcc

SEQ ID NO: 1292468 - DNA, 13 bp, Homo sapiens
gggagacaggcct

SEQ ID NO: 1292469 - DNA, 14 bp, Homo sapiens
gggagcggagcttg

SEQ ID NO: 1292470 - DNA, 17 bp, Homo sapiens
gggagctttgagacagg

SEQ ID NO: 1292471 - DNA, 13 bp, Homo sapiens
gggatggtcaggc

SEQ ID NO: 1292472 - DNA, 17 bp, Homo sapiens
gggatggtcaggcccag

SEQ ID NO: 1292473 - DNA, 21 bp, Homo sapiens
gggcaagatccaggtggtccc

SEQ ID NO: 1292474 - DNA, 23 bp, Homo sapiens
gggcagcaattcacgctgtctct

SEQ ID NO: 1292475 - DNA, 18 bp, Homo sapiens
gggcgcatgcctcccagg

SEQ ID NO: 1292476 - DNA, 20 bp, Homo sapiens
gggcgcatgcctcccaggcc

SEQ ID NO: 1292477 - DNA, 14 bp, Homo sapiens
gggctgccagccca

SEQ ID NO: 1292478 - DNA, 11 bp, Homo sapiens
gggctggccct

SEQ ID NO: 1292479 - DNA, 12 bp, Homo sapiens
gggctggcccta

SEQ ID NO: 1292480 - DNA, 22 bp, Homo sapiens
gggtcaactggcgaagcctgag

SEQ ID NO: 1292481 - DNA, 19 bp, Homo sapiens
gggtccccctcccacttga

SEQ ID NO: 1292482 - DNA, 12 bp, Homo sapiens
gggtgggaggtg

SEQ ID NO: 1292483 - DNA, 22 bp, Homo sapiens
ggtatgtgcccctcctgggtgc

SEQ ID NO: 1292484 - DNA, 19 bp, Homo sapiens
ggtcaggcaatgccctgcg

SEQ ID NO: 1292485 - DNA, 18 bp, Homo sapiens
ggtcaggcccagcctctc

SEQ ID NO: 1292486 - DNA, 20 bp, Homo sapiens
ggtcccagggctggccctag

SEQ ID NO: 1292487 - DNA, 15 bp, Homo sapiens
ggtcgggctgccagc

SEQ ID NO: 1292488 - DNA, 22 bp, Homo sapiens
ggtcgggctgccagcccagctg

SEQ ID NO: 1292489 - DNA, 12 bp, Homo sapiens
ggtctggtcagg

SEQ ID NO: 1292490 - DNA, 16 bp, Homo sapiens
ggtctggtcaggcaat

SEQ ID NO: 1292491 - DNA, 18 bp, Homo sapiens
ggtgcctggggctggctg

SEQ ID NO: 1292492 - DNA, 19 bp, Homo sapiens
ggtgcctggggctggctgc

SEQ ID NO: 1292493 - DNA, 21 bp, Homo sapiens
ggtgcctggggctggctgcag

SEQ ID NO: 1292494 - DNA, 23 bp, Homo sapiens
ggttgggaggcaggtcgggctgc

SEQ ID NO: 1292495 - DNA, 18 bp, Homo sapiens
ggtttaactgtcccagcg

SEQ ID NO: 1292496 - DNA, 17 bp, Homo sapiens
gtatgtgcccctcctgg

SEQ ID NO: 1292497 - DNA, 21 bp, Homo sapiens
gtatgtgcccctcctgggtgc

SEQ ID NO: 1292498 - DNA, 18 bp, Homo sapiens
gtcaactggcgaagcctg

SEQ ID NO: 1292499 - DNA, 20 bp, Homo sapiens
gtcacaaaccagcctggggc

SEQ ID NO: 1292500 - DNA, 21 bp, Homo sapiens
gtcacaaaccagcctggggcc

SEQ ID NO: 1292501 - DNA, 20 bp, Homo sapiens
gtcagtcacaaaccagcctg

SEQ ID NO: 1292502 - DNA, 19 bp, Homo sapiens
gtccaatcacccccaggac

SEQ ID NO: 1292503 - DNA, 13 bp, Homo sapiens
gtcccagggctgg

SEQ ID NO: 1292504 - DNA, 16 bp, Homo sapiens
gtcccagggctggccc

SEQ ID NO: 1292505 - DNA, 20 bp, Homo sapiens
gtcccagggctggccctagg

SEQ ID NO: 1292506 - DNA, 22 bp, Homo sapiens
gtcccataggtcttgtgaaaag

SEQ ID NO: 1292507 - DNA, 15 bp, Homo sapiens
gtcctcacacacgga

SEQ ID NO: 1292508 - DNA, 15 bp, Homo sapiens
gtccttgctcctgga

SEQ ID NO: 1292509 - DNA, 23 bp, Homo sapiens
gtccttgctcctggaacctggca

SEQ ID NO: 1292510 - DNA, 17 bp, Homo sapiens
gtcggagggctggacat

SEQ ID NO: 1292511 - DNA, 17 bp, Homo sapiens
gtcgggctgccagccca

SEQ ID NO: 1292512 - DNA, 20 bp, Homo sapiens
gtcgggctgccagcccagct

SEQ ID NO: 1292513 - DNA, 12 bp, Homo sapiens
gtctccagctcc

SEQ ID NO: 1292514 - DNA, 15 bp, Homo sapiens
gtctccagctcctct

SEQ ID NO: 1292515 - DNA, 14 bp, Homo sapiens
gtcttcactgccca

SEQ ID NO: 1292516 - DNA, 16 bp, Homo sapiens
gtcttcactgcccagg

SEQ ID NO: 1292517 - DNA, 15 bp, Homo sapiens
gtgacctggtctggt

SEQ ID NO: 1292518 - DNA, 22 bp, Homo sapiens
gtgcagggaaagggatggtcag

SEQ ID NO: 1292519 - DNA, 23 bp, Homo sapiens
gtgcagggaaagggatggtcagg

SEQ ID NO: 1292520 - DNA, 13 bp, Homo sapiens
gtgcccctcctgg

SEQ ID NO: 1292521 - DNA, 19 bp, Homo sapiens
gtgcctggggctggctgca

SEQ ID NO: 1292522 - DNA, 20 bp, Homo sapiens
gtgcctggggctggctgcag

SEQ ID NO: 1292523 - DNA, 17 bp, Homo sapiens
gtgctcaccgcctgcta

SEQ ID NO: 1292524 - DNA, 23 bp, Homo sapiens
gtgctcaccgcctgctacacagg

SEQ ID NO: 1292525 - DNA, 12 bp, Homo sapiens
gtgcttggaggc

SEQ ID NO: 1292526 - DNA, 15 bp, Homo sapiens
gtggaatccagtgtg

SEQ ID NO: 1292527 - DNA, 18 bp, Homo sapiens
gtggacagcccgggagct

SEQ ID NO: 1292528 - DNA, 17 bp, Homo sapiens
gtggcctgggtcccagg

SEQ ID NO: 1292529 - DNA, 19 bp, Homo sapiens
gtggcgccgcgtggacagc

SEQ ID NO: 1292530 - DNA, 18 bp, Homo sapiens
gtgggacccaggctccca

SEQ ID NO: 1292531 - DNA, 12 bp, Homo sapiens
gtggtctccagc

SEQ ID NO: 1292532 - DNA, 18 bp, Homo sapiens
gtgtctatggagcagccg

SEQ ID NO: 1292533 - DNA, 15 bp, Homo sapiens
gtgtggctcccacag

SEQ ID NO: 1292534 - DNA, 14 bp, Homo sapiens
gtgtgtggacagcc

SEQ ID NO: 1292535 - DNA, 14 bp, Homo sapiens
gtgtgtgtggacag

SEQ ID NO: 1292536 - DNA, 12 bp, Homo sapiens
gttcaccagccc

SEQ ID NO: 1292537 - DNA, 17 bp, Homo sapiens
gttcaccagccctgagc

SEQ ID NO: 1292538 - DNA, 13 bp, Homo sapiens
gttggcctgtgct

SEQ ID NO: 1292539 - DNA, 17 bp, Homo sapiens
gttggcctgtgcttgga

SEQ ID NO: 1292540 - DNA, 16 bp, Homo sapiens
gttgggggtgggaggt

SEQ ID NO: 1292541 - DNA, 17 bp, Homo sapiens
gtttaactgtcccagcg

SEQ ID NO: 1292542 - DNA, 22 bp, Homo sapiens
gttttctgtgtggtctccagct

SEQ ID NO: 1292543 - DNA, 15 bp, Homo sapiens
taaaactgagactgt

SEQ ID NO: 1292544 - DNA, 13 bp, Homo sapiens
taaccctgaacaa

SEQ ID NO: 1292545 - DNA, 14 bp, Homo sapiens
taactgtcccagcg

SEQ ID NO: 1292546 - DNA, 14 bp, Homo sapiens
tacctcgccgagct

SEQ ID NO: 1292547 - DNA, 22 bp, Homo sapiens
tagaggggaatgaaccatggca

SEQ ID NO: 1292548 - DNA, 15 bp, Homo sapiens
tagcttttagcctgg

SEQ ID NO: 1292549 - DNA, 20 bp, Homo sapiens
tagtccaatcacccccagga

SEQ ID NO: 1292550 - DNA, 16 bp, Homo sapiens
tagttctcttctcctg

SEQ ID NO: 1292551 - DNA, 12 bp, Homo sapiens
tcaaccaggcag

SEQ ID NO: 1292552 - DNA, 20 bp, Homo sapiens
aaagcaacttcatcccagct

SEQ ID NO: 1292553 - DNA, 19 bp, Homo sapiens
aaagggatggtcaggccca

SEQ ID NO: 1292554 - DNA, 23 bp, Homo sapiens
aacatagagaactgtcaccctga

SEQ ID NO: 1292555 - DNA, 15 bp, Homo sapiens
aacccatgcccctga

SEQ ID NO: 1292556 - DNA, 17 bp, Homo sapiens
aacctggcaggccctgc

SEQ ID NO: 1292557 - DNA, 21 bp, Homo sapiens
aacctggcaggccctgcccag

SEQ ID NO: 1292558 - DNA, 15 bp, Homo sapiens
aactgtcaccctgag

SEQ ID NO: 1292559 - DNA, 15 bp, Homo sapiens
aacttcatcccagct

SEQ ID NO: 1292560 - DNA, 18 bp, Homo sapiens
aacttcatcccagctgct

SEQ ID NO: 1292561 - DNA, 22 bp, Homo sapiens
aagaactaaggatttttccatg

SEQ ID NO: 1292562 - DNA, 19 bp, Homo sapiens
aagaagttcaccagccctg

SEQ ID NO: 1292563 - DNA, 13 bp, Homo sapiens
aagagtgtctatg

SEQ ID NO: 1292564 - DNA, 18 bp, Homo sapiens
aagagtgtctatggagca

SEQ ID NO: 1292565 - DNA, 18 bp, Homo sapiens
aagcaacttcatcccagc

SEQ ID NO: 1292566 - DNA, 21 bp, Homo sapiens
aagcagcctttttcaccatgg

SEQ ID NO: 1292567 - DNA, 24 bp, Homo sapiens
aagccccattcacggcctggcatg

SEQ ID NO: 1292568 - DNA, 14 bp, Homo sapiens
aagcctgagcaggc

SEQ ID NO: 1292569 - DNA, 13 bp, Homo sapiens
aaggagactgtgg

SEQ ID NO: 1292570 - DNA, 12 bp, Homo sapiens
aaggatggggtt

SEQ ID NO: 1292571 - DNA, 16 bp, Homo sapiens
aaggatttttccatgg

SEQ ID NO: 1292572 - DNA, 14 bp, Homo sapiens
aagggtgcaagccc

SEQ ID NO: 1292573 - DNA, 22 bp, Homo sapiens
aatgaaccatggcacctttgag

SEQ ID NO: 1292574 - DNA, 17 bp, Homo sapiens
aatgccctgcggctctg

SEQ ID NO: 1292575 - DNA, 18 bp, Homo sapiens
aatgcggttgggaggcag

SEQ ID NO: 1292576 - DNA, 22 bp, Homo sapiens
aatttccagaactgcacaatga

SEQ ID NO: 1292577 - DNA, 16 bp, Homo sapiens
acaaaccagcctgggg

SEQ ID NO: 1292578 - DNA, 18 bp, Homo sapiens
acaatgaccagcaggagg

SEQ ID NO: 1292579 - DNA, 18 bp, Homo sapiens
acagacatcaagtgccag

SEQ ID NO: 1292580 - DNA, 21 bp, Homo sapiens
acagccggagcagttggcctg

SEQ ID NO: 1292581 - DNA, 20 bp, Homo sapiens
acaggccgtgggacccaggc

SEQ ID NO: 1292582 - DNA, 23 bp, Homo sapiens
acaggcctttccctgccggcccc

SEQ ID NO: 1292583 - DNA, 16 bp, Homo sapiens
acaggtcttcactgcc

SEQ ID NO: 1292584 - DNA, 13 bp, Homo sapiens
acaggtgcctggg

SEQ ID NO: 1292585 - DNA, 22 bp, Homo sapiens
acagtcctcacacacggaggcc

SEQ ID NO: 1292586 - DNA, 23 bp, Homo sapiens
acagtcctcacacacggaggcca

SEQ ID NO: 1292587 - DNA, 11 bp, Homo sapiens
accagccctga

SEQ ID NO: 1292588 - DNA, 17 bp, Homo sapiens
accagccctgagccatg

SEQ ID NO: 1292589 - DNA, 17 bp, Homo sapiens
accagcctggggccttc

SEQ ID NO: 1292590 - DNA, 17 bp, Homo sapiens
acccacacagaggacct

SEQ ID NO: 1292591 - DNA, 14 bp, Homo sapiens
acccaggctcccag

SEQ ID NO: 1292592 - DNA, 15 bp, Homo sapiens
acccaggctcccagc

SEQ ID NO: 1292593 - DNA, 17 bp, Homo sapiens
acccaggctcccagcct

SEQ ID NO: 1292594 - DNA, 14 bp, Homo sapiens
acccatgcccctga

SEQ ID NO: 1292595 - DNA, 17 bp, Homo sapiens
acccatgcccctgacag

SEQ ID NO: 1292596 - DNA, 17 bp, Homo sapiens
accccagacccaaccca

SEQ ID NO: 1292597 - DNA, 16 bp, Homo sapiens
accccagttcccttgg

SEQ ID NO: 1292598 - DNA, 13 bp, Homo sapiens
acccccaggacct

SEQ ID NO: 1292599 - DNA, 21 bp, Homo sapiens
acccttagcttttagcctggc

SEQ ID NO: 1292600 - DNA, 20 bp, Homo sapiens
accgcctgctacacaggcag

SEQ ID NO: 1292601 - DNA, 16 bp, Homo sapiens
acctcttcagctgctg

SEQ ID NO: 1292602 - DNA, 16 bp, Homo sapiens
acctgagatgctggga

SEQ ID NO: 1292603 - DNA, 23 bp, Homo sapiens
acctgagatgctgggagggctga

SEQ ID NO: 1292604 - DNA, 17 bp, Homo sapiens
acctgccggctctgggc

SEQ ID NO: 1292605 - DNA, 23 bp, Homo sapiens
acctgccggctctgggctggctg

SEQ ID NO: 1292606 - DNA, 12 bp, Homo sapiens
acctggcaggcc

SEQ ID NO: 1292607 - DNA, 20 bp, Homo sapiens
acctggcaggccctgcccag

SEQ ID NO: 1292608 - DNA, 16 bp, Homo sapiens
acctggtctggtcagg

SEQ ID NO: 1292609 - DNA, 17 bp, Homo sapiens
acctggtctggtcaggc

SEQ ID NO: 1292610 - DNA, 15 bp, Homo sapiens
acctgtgacctggtc

SEQ ID NO: 1292611 - DNA, 18 bp, Homo sapiens
acctgtgacctggtctgg

SEQ ID NO: 1292612 - DNA, 19 bp, Homo sapiens
acggaggccagacacaggc

SEQ ID NO: 1292613 - DNA, 16 bp, Homo sapiens
acggcctggcatgcag

SEQ ID NO: 1292614 - DNA, 18 bp, Homo sapiens
acggcctggcatgcagct

SEQ ID NO: 1292615 - DNA, 18 bp, Homo sapiens
acggtttaactgtcccag

SEQ ID NO: 1292616 - DNA, 20 bp, Homo sapiens
acggtttaactgtcccagcg

SEQ ID NO: 1292617 - DNA, 22 bp, Homo sapiens
actagtccaatcacccccagga

SEQ ID NO: 1292618 - DNA, 22 bp, Homo sapiens
actctggccccctattgtctcc

SEQ ID NO: 1292619 - DNA, 14 bp, Homo sapiens
actgaaaagcagcc

SEQ ID NO: 1292620 - DNA, 12 bp, Homo sapiens
actgcccagggg

SEQ ID NO: 1292621 - DNA, 17 bp, Homo sapiens
actggcgaagcctgagc

SEQ ID NO: 1292622 - DNA, 23 bp, Homo sapiens
actggcgaagcctgagcaggcag

SEQ ID NO: 1292623 - DNA, 14 bp, Homo sapiens
actgtcaccctgag

SEQ ID NO: 1292624 - DNA, 14 bp, Homo sapiens
acttcatcccagct

SEQ ID NO: 1292625 - DNA, 17 bp, Homo sapiens
acttcatcccagctgct

SEQ ID NO: 1292626 - DNA, 17 bp, Homo sapiens
agaaatgggcctcagcc

SEQ ID NO: 1292627 - DNA, 21 bp, Homo sapiens
agaactgcacaatgaccagca

SEQ ID NO: 1292628 - DNA, 16 bp, Homo sapiens
agaactgtcaccctga

SEQ ID NO: 1292629 - DNA, 14 bp, Homo sapiens
agacacaggccgtg

SEQ ID NO: 1292630 - DNA, 17 bp, Homo sapiens
agacaggcctttccctg

SEQ ID NO: 1292631 - DNA, 20 bp, Homo sapiens
atcccagctgctgaggcgaa

SEQ ID NO: 1292632 - DNA, 22 bp, Homo sapiens
atcctgatggcacccacacaga

SEQ ID NO: 1292633 - DNA, 19 bp, Homo sapiens
atctagttctcttctcctg

SEQ ID NO: 1292634 - DNA, 15 bp, Homo sapiens
atctcccagggctct

SEQ ID NO: 1292635 - DNA, 16 bp, Homo sapiens
atgaaccatggcacct

SEQ ID NO: 1292636 - DNA, 21 bp, Homo sapiens
atgaccagcaggagggaagga

SEQ ID NO: 1292637 - DNA, 23 bp, Homo sapiens
atgcagcttgtccttgctcctgg

SEQ ID NO: 1292638 - DNA, 17 bp, Homo sapiens
atgccctgcggctctgg

SEQ ID NO: 1292639 - DNA, 19 bp, Homo sapiens
atgccctgcggctctggaa

SEQ ID NO: 1292640 - DNA, 17 bp, Homo sapiens
atgcggttgggaggcag

SEQ ID NO: 1292641 - DNA, 19 bp, Homo sapiens
atgcggttgggaggcaggt

SEQ ID NO: 1292642 - DNA, 15 bp, Homo sapiens
atgctgggagggctg

SEQ ID NO: 1292643 - DNA, 14 bp, Homo sapiens
atgctttgctctca

SEQ ID NO: 1292644 - DNA, 21 bp, Homo sapiens
atggcacccacacagaggacc

SEQ ID NO: 1292645 - DNA, 22 bp, Homo sapiens
atggcggcccctcagcctgcct

SEQ ID NO: 1292646 - DNA, 11 bp, Homo sapiens
atggtcaggcc

SEQ ID NO: 1292647 - DNA, 17 bp, Homo sapiens
attatgtttcttcttgt

SEQ ID NO: 1292648 - DNA, 21 bp, Homo sapiens
attcacggcctggcatgcagc

SEQ ID NO: 1292649 - DNA, 14 bp, Homo sapiens
attccagctctccc

SEQ ID NO: 1292650 - DNA, 20 bp, Homo sapiens
attccagctctcccatggag

SEQ ID NO: 1292651 - DNA, 18 bp, Homo sapiens
atttccagaactgcacaa

SEQ ID NO: 1292652 - DNA, 14 bp, Homo sapiens
caaaccagcctggg

SEQ ID NO: 1292653 - DNA, 16 bp, Homo sapiens
caaaccagcctggggc

SEQ ID NO: 1292654 - DNA, 12 bp, Homo sapiens
caaaggacacaa

SEQ ID NO: 1292655 - DNA, 21 bp, Homo sapiens
caactggcgaagcctgagcag

SEQ ID NO: 1292656 - DNA, 15 bp, Homo sapiens
caacttcatcccagc

SEQ ID NO: 1292657 - DNA, 16 bp, Homo sapiens
caacttcatcccagct

SEQ ID NO: 1292658 - DNA, 17 bp, Homo sapiens
caagagtgtctatggag

SEQ ID NO: 1292659 - DNA, 20 bp, Homo sapiens
caagagtgtctatggagcag

SEQ ID NO: 1292660 - DNA, 15 bp, Homo sapiens
caagccccattcacg

SEQ ID NO: 1292661 - DNA, 23 bp, Homo sapiens
caagccccattcacggcctggca

SEQ ID NO: 1292662 - DNA, 14 bp, Homo sapiens
caagggtgcaagcc

SEQ ID NO: 1292663 - DNA, 18 bp, Homo sapiens
caatgaccagcaggaggg

SEQ ID NO: 1292664 - DNA, 16 bp, Homo sapiens
cacaatgaccagcagg

SEQ ID NO: 1292665 - DNA, 22 bp, Homo sapiens
cacacggaggccagacacaggc

SEQ ID NO: 1292666 - DNA, 18 bp, Homo sapiens
cacactgaaaagcagcct

SEQ ID NO: 1292667 - DNA, 24 bp, Homo sapiens
cacagagacatgggagtggggagc

SEQ ID NO: 1292668 - DNA, 22 bp, Homo sapiens
cacagtcctcacacacggaggc

SEQ ID NO: 1292669 - DNA, 14 bp, Homo sapiens
caccagccctgagc

SEQ ID NO: 1292670 - DNA, 13 bp, Homo sapiens
caccatggcaaac

SEQ ID NO: 1292671 - DNA, 22 bp, Homo sapiens
caccgggcgcatgcctcccagg

SEQ ID NO: 1292672 - DNA, 15 bp, Homo sapiens
cacctgccggctctg

SEQ ID NO: 1292673 - DNA, 16 bp, Homo sapiens
cacctttgagagaggg

SEQ ID NO: 1292674 - DNA, 16 bp, Homo sapiens
cacggaggccagacac

SEQ ID NO: 1292675 - DNA, 11 bp, Homo sapiens
cacggcctggc

SEQ ID NO: 1292676 - DNA, 18 bp, Homo sapiens
cacggtttaactgtccca

SEQ ID NO: 1292677 - DNA, 21 bp, Homo sapiens
cacggtttaactgtcccagcg

SEQ ID NO: 1292678 - DNA, 22 bp, Homo sapiens
cacggtttaactgtcccagcga

SEQ ID NO: 1292679 - DNA, 15 bp, Homo sapiens
cactgtggtcaggcc

SEQ ID NO: 1292680 - DNA, 13 bp, Homo sapiens
cacttgacctgag

SEQ ID NO: 1292681 - DNA, 13 bp, Homo sapiens
cagacacaggccg

SEQ ID NO: 1292682 - DNA, 17 bp, Homo sapiens
cagacatcaagtgccag

SEQ ID NO: 1292683 - DNA, 15 bp, Homo sapiens
cagacccaacccatg

SEQ ID NO: 1292684 - DNA, 17 bp, Homo sapiens
cagaggagagtggcctg

SEQ ID NO: 1292685 - DNA, 13 bp, Homo sapiens
cagagttctgtgg

SEQ ID NO: 1292686 - DNA, 16 bp, Homo sapiens
cagagttctgtggcgc

SEQ ID NO: 1292687 - DNA, 21 bp, Homo sapiens
cagatctagttctcttctcct

SEQ ID NO: 1292688 - DNA, 16 bp, Homo sapiens
cagcaggagggaagga

SEQ ID NO: 1292689 - DNA, 18 bp, Homo sapiens
cagccagccatcggaaga

SEQ ID NO: 1292690 - DNA, 22 bp, Homo sapiens
cagccagccatcggaagagagg

SEQ ID NO: 1292691 - DNA, 17 bp, Homo sapiens
cagccatcggaagagag

SEQ ID NO: 1292692 - DNA, 21 bp, Homo sapiens
cagccatcggaagagagggct

SEQ ID NO: 1292693 - DNA, 13 bp, Homo sapiens
cagcccagctggc

SEQ ID NO: 1292694 - DNA, 17 bp, Homo sapiens
cagcccagctggccgga

SEQ ID NO: 1292695 - DNA, 21 bp, Homo sapiens
cagcccagctggccggaagga

SEQ ID NO: 1292696 - DNA, 17 bp, Homo sapiens
cagcccgggagctttga

SEQ ID NO: 1292697 - DNA, 16 bp, Homo sapiens
cagcccgggatcctga

SEQ ID NO: 1292698 - DNA, 22 bp, Homo sapiens
cagccctgagccatggcggccc

SEQ ID NO: 1292699 - DNA, 19 bp, Homo sapiens
cagccggaagtctgttctc

SEQ ID NO: 1292700 - DNA, 14 bp, Homo sapiens
cagcctaagggaga

SEQ ID NO: 1292701 - DNA, 13 bp, Homo sapiens
cagcctctctggc

SEQ ID NO: 1292702 - DNA, 14 bp, Homo sapiens
cagcctctctggct

SEQ ID NO: 1292703 - DNA, 19 bp, Homo sapiens
cagcctgcctgaagagagg

SEQ ID NO: 1292704 - DNA, 16 bp, Homo sapiens
cagcctggggccttcc

SEQ ID NO: 1292705 - DNA, 21 bp, Homo sapiens
cagcctggggccttcctggct

SEQ ID NO: 1292706 - DNA, 17 bp, Homo sapiens
cagctctcccatggagc

SEQ ID NO: 1292707 - DNA, 19 bp, Homo sapiens
cagctctcccatggagccc

SEQ ID NO: 1292708 - DNA, 14 bp, Homo sapiens
cagctgctgaggcg

SEQ ID NO: 1292709 - DNA, 17 bp, Homo sapiens
cagctggccggaaggag

SEQ ID NO: 1292710 - DNA, 21 bp, Homo sapiens
cagcttgtccttgctcctgga

SEQ ID NO: 1292711 - DNA, 19 bp, Homo sapiens
caggaatgcggttgggagg

SEQ ID NO: 1292712 - DNA, 23 bp, Homo sapiens
caggaatgcggttgggaggcagg

SEQ ID NO: 1292713 - DNA, 20 bp, Homo sapiens
caggacctcttcagctgctg

SEQ ID NO: 1292714 - DNA, 13 bp, Homo sapiens
caggagggaagga

SEQ ID NO: 1292715 - DNA, 18 bp, Homo sapiens
caggagggaaggacagac

SEQ ID NO: 1292716 - DNA, 16 bp, Homo sapiens
caggcaatgccctgcg

SEQ ID NO: 1292717 - DNA, 23 bp, Homo sapiens
caggcaggaatgcggttgggagg

SEQ ID NO: 1292718 - DNA, 16 bp, Homo sapiens
caggcaggggcttggc

SEQ ID NO: 1292719 - DNA, 23 bp, Homo sapiens
caggccacctcagtctcacctgc

SEQ ID NO: 1292720 - DNA, 15 bp, Homo sapiens
caggccctgcccagc

SEQ ID NO: 1292721 - DNA, 17 bp, Homo sapiens
caggccctgcccagcca

SEQ ID NO: 1292722 - DNA, 21 bp, Homo sapiens
caggccctgcccagccagcca

SEQ ID NO: 1292723 - DNA, 21 bp, Homo sapiens
caggccgtgggacccaggctc

SEQ ID NO: 1292724 - DNA, 13 bp, Homo sapiens
caggctcccagcc

SEQ ID NO: 1292725 - DNA, 21 bp, Homo sapiens
caggctcccagcctaagggag

SEQ ID NO: 1292726 - DNA, 22 bp, Homo sapiens
cagggaaagggatggtcaggcc

SEQ ID NO: 1292727 - DNA, 13 bp, Homo sapiens
cagggctctctgg

SEQ ID NO: 1292728 - DNA, 21 bp, Homo sapiens
cagggctggccctaggcactg

SEQ ID NO: 1292729 - DNA, 16 bp, Homo sapiens
caggtcgggctgccag

SEQ ID NO: 1292730 - DNA, 23 bp, Homo sapiens
caggtcgggctgccagcccagct

SEQ ID NO: 1292731 - DNA, 18 bp, Homo sapiens
caggtcttcactgcccag

SEQ ID NO: 1292732 - DNA, 13 bp, Homo sapiens
caggtgcctgggg

SEQ ID NO: 1292733 - DNA, 16 bp, Homo sapiens
caggtgcctggggctg

SEQ ID NO: 1292734 - DNA, 22 bp, Homo sapiens
caggtgcctggggctggctgca

SEQ ID NO: 1292735 - DNA, 21 bp, Homo sapiens
cagtcacaaaccagcctgggg

SEQ ID NO: 1292736 - DNA, 17 bp, Homo sapiens
cagtcagtcacaaacca

SEQ ID NO: 1292737 - DNA, 13 bp, Homo sapiens
cagtgctgaaggg

SEQ ID NO: 1292738 - DNA, 16 bp, Homo sapiens
cagttctcgtgccctt

SEQ ID NO: 1292739 - DNA, 20 bp, Homo sapiens
cagttggcctgtgcttggag

SEQ ID NO: 1292740 - DNA, 13 bp, Homo sapiens
catacgcggagga

SEQ ID NO: 1292741 - DNA, 15 bp, Homo sapiens
catacgcggaggagt

SEQ ID NO: 1292742 - DNA, 16 bp, Homo sapiens
catcccagctgctgag

SEQ ID NO: 1292743 - DNA, 13 bp, Homo sapiens
cctcttcagctgc

SEQ ID NO: 1292744 - DNA, 17 bp, Homo sapiens
cctgagatgctgggagg

SEQ ID NO: 1292745 - DNA, 12 bp, Homo sapiens
cctgagcaggca

SEQ ID NO: 1292746 - DNA, 13 bp, Homo sapiens
cctgagcaggcag

SEQ ID NO: 1292747 - DNA, 14 bp, Homo sapiens
cctgagcaggcagg

SEQ ID NO: 1292748 - DNA, 22 bp, Homo sapiens
cctgagcaggcaggggcttggc

SEQ ID NO: 1292749 - DNA, 19 bp, Homo sapiens
cctgatggcacccacacag

SEQ ID NO: 1292750 - DNA, 16 bp, Homo sapiens
cctgcccagccagcca

SEQ ID NO: 1292751 - DNA, 16 bp, Homo sapiens
cctgccggctctgggc

SEQ ID NO: 1292752 - DNA, 19 bp, Homo sapiens
cctgccggctctgggctgg

SEQ ID NO: 1292753 - DNA, 13 bp, Homo sapiens
cctgcctgaagag

SEQ ID NO: 1292754 - DNA, 13 bp, Homo sapiens
cctgcgccctgtg

SEQ ID NO: 1292755 - DNA, 17 bp, Homo sapiens
cctgcgccctgtgcagg

SEQ ID NO: 1292756 - DNA, 15 bp, Homo sapiens
cctgcggctctggaa

SEQ ID NO: 1292757 - DNA, 17 bp, Homo sapiens
cctggaacctggcaggc

SEQ ID NO: 1292758 - DNA, 20 bp, Homo sapiens
cctggaacctggcaggccct

SEQ ID NO: 1292759 - DNA, 23 bp, Homo sapiens
cctggaacctggcaggccctgcc

SEQ ID NO: 1292760 - DNA, 15 bp, Homo sapiens
cctggcaggccctgc

SEQ ID NO: 1292761 - DNA, 19 bp, Homo sapiens
cctggcaggccctgcccag

SEQ ID NO: 1292762 - DNA, 20 bp, Homo sapiens
cctggcaggccctgcccagc

SEQ ID NO: 1292763 - DNA, 13 bp, Homo sapiens
cctggcatgcagc

SEQ ID NO: 1292764 - DNA, 17 bp, Homo sapiens
cctggctggccaggaca

SEQ ID NO: 1292765 - DNA, 19 bp, Homo sapiens
cctggggccttcctggctt

SEQ ID NO: 1292766 - DNA, 14 bp, Homo sapiens
cctgggtcccaggg

SEQ ID NO: 1292767 - DNA, 19 bp, Homo sapiens
cctgggtcccagggctggc

SEQ ID NO: 1292768 - DNA, 21 bp, Homo sapiens
cctgtgacctggtctggtcag

SEQ ID NO: 1292769 - DNA, 13 bp, Homo sapiens
cctgtgcttggag

SEQ ID NO: 1292770 - DNA, 15 bp, Homo sapiens
cctgtgcttggaggc

SEQ ID NO: 1292771 - DNA, 16 bp, Homo sapiens
cctgtgcttggaggcc

SEQ ID NO: 1292772 - DNA, 20 bp, Homo sapiens
ccttagcttttagcctggct

SEQ ID NO: 1292773 - DNA, 21 bp, Homo sapiens
ccttagcttttagcctggctg

SEQ ID NO: 1292774 - DNA, 14 bp, Homo sapiens
ccttgctcctggaa

SEQ ID NO: 1292775 - DNA, 22 bp, Homo sapiens
ccttgctcctggaacctggcag

SEQ ID NO: 1292776 - DNA, 16 bp, Homo sapiens
cgaagcctgagcaggc

SEQ ID NO: 1292777 - DNA, 18 bp, Homo sapiens
cgaagcctgagcaggcag

SEQ ID NO: 1292778 - DNA, 14 bp, Homo sapiens
cgaatggggtcccc

SEQ ID NO: 1292779 - DNA, 18 bp, Homo sapiens
cgatctcccagggctctc

SEQ ID NO: 1292780 - DNA, 19 bp, Homo sapiens
cgatctcccagggctctct

SEQ ID NO: 1292781 - DNA, 18 bp, Homo sapiens
cgcaggtcatattgtcag

SEQ ID NO: 1292782 - DNA, 19 bp, Homo sapiens
cgcatgcctcccaggccac

SEQ ID NO: 1292783 - DNA, 15 bp, Homo sapiens
cgccctgtgcaggga

SEQ ID NO: 1292784 - DNA, 15 bp, Homo sapiens
cgcctgctacacagg

SEQ ID NO: 1292785 - DNA, 19 bp, Homo sapiens
cgcctgctacacaggcagg

SEQ ID NO: 1292786 - DNA, 12 bp, Homo sapiens
cggaagagaggg

SEQ ID NO: 1292787 - DNA, 18 bp, Homo sapiens
cggaagagagggctgagc

SEQ ID NO: 1292788 - DNA, 12 bp, Homo sapiens
cggagcttggcc

SEQ ID NO: 1292789 - DNA, 14 bp, Homo sapiens
cggagcttggccct

SEQ ID NO: 1292790 - DNA, 16 bp, Homo sapiens
cggagcttggccctgc

SEQ ID NO: 1292791 - DNA, 17 bp, Homo sapiens
cggagcttggccctgcg

SEQ ID NO: 1292792 - DNA, 21 bp, Homo sapiens
cggaggccagacacaggccgt

SEQ ID NO: 1292793 - DNA, 15 bp, Homo sapiens
cggatcaaccaggca

SEQ ID NO: 1292794 - DNA, 18 bp, Homo sapiens
cggatcaaccaggcagag

SEQ ID NO: 1292795 - DNA, 16 bp, Homo sapiens
cggcccctcagcctgc

SEQ ID NO: 1292796 - DNA, 11 bp, Homo sapiens
cggcctggcat

SEQ ID NO: 1292797 - DNA, 16 bp, Homo sapiens
cggcctggctggccag

SEQ ID NO: 1292798 - DNA, 17 bp, Homo sapiens
cggcctggctggccagg

SEQ ID NO: 1292799 - DNA, 20 bp, Homo sapiens
cggcctggctggccaggaca

SEQ ID NO: 1292800 - DNA, 15 bp, Homo sapiens
cggctctgggctggc

SEQ ID NO: 1292801 - DNA, 17 bp, Homo sapiens
cggctctgggctggctg

SEQ ID NO: 1292802 - DNA, 23 bp, Homo sapiens
cggctctgggctggctgctccta

SEQ ID NO: 1292803 - DNA, 20 bp, Homo sapiens
cgggatcctgatggcaccca

SEQ ID NO: 1292804 - DNA, 15 bp, Homo sapiens
cgggctgccagccca

SEQ ID NO: 1292805 - DNA, 18 bp, Homo sapiens
cgggctgccagcccagct

SEQ ID NO: 1292806 - DNA, 17 bp, Homo sapiens
cggggctcactctggcc

SEQ ID NO: 1292807 - DNA, 19 bp, Homo sapiens
cggggctcactctggcccc

SEQ ID NO: 1292808 - DNA, 21 bp, Homo sapiens
cggtgtggttgggggtgggag

SEQ ID NO: 1292809 - DNA, 15 bp, Homo sapiens
cggttgggaggcagg

SEQ ID NO: 1292810 - DNA, 17 bp, Homo sapiens
cggtttaactgtcccag

SEQ ID NO: 1292811 - DNA, 19 bp, Homo sapiens
cggtttaactgtcccagcg

SEQ ID NO: 1292812 - DNA, 20 bp, Homo sapiens
cggtttaactgtcccagcga

SEQ ID NO: 1292813 - DNA, 14 bp, Homo sapiens
cgtggacagccgga

SEQ ID NO: 1292814 - DNA, 18 bp, Homo sapiens
cgtgggacccaggctccc

SEQ ID NO: 1292815 - DNA, 19 bp, Homo sapiens
cgtgggacccaggctccca

SEQ ID NO: 1292816 - DNA, 23 bp, Homo sapiens
ctaagaagttcaccagccctgag

SEQ ID NO: 1292817 - DNA, 16 bp, Homo sapiens
ctaagggagacaggcc

SEQ ID NO: 1292818 - DNA, 13 bp, Homo sapiens
ctacacaggcagg

SEQ ID NO: 1292819 - DNA, 19 bp, Homo sapiens
ctagttctcttctcctgtg

SEQ ID NO: 1292820 - DNA, 13 bp, Homo sapiens
ctcacacacggag

SEQ ID NO: 1292821 - DNA, 18 bp, Homo sapiens
ctcacacacggaggccag

SEQ ID NO: 1292822 - DNA, 19 bp, Homo sapiens
aagaaatgggcctcagccc

SEQ ID NO: 1292823 - DNA, 17 bp, Homo sapiens
aagaagttcaccagccc

SEQ ID NO: 1292824 - DNA, 20 bp, Homo sapiens
aagaagttcaccagccctga

SEQ ID NO: 1292825 - DNA, 16 bp, Homo sapiens
aagagtgtctatggag

SEQ ID NO: 1292826 - DNA, 12 bp, Homo sapiens
aagcacacacac

SEQ ID NO: 1292827 - DNA, 22 bp, Homo sapiens
aagcagaagtggaatccagtgt

SEQ ID NO: 1292828 - DNA, 20 bp, Homo sapiens
aagcagcctttttcaccatg

SEQ ID NO: 1292829 - DNA, 21 bp, Homo sapiens
aagccccattcacggcctggc

SEQ ID NO: 1292830 - DNA, 22 bp, Homo sapiens
aagccccattcacggcctggca

SEQ ID NO: 1292831 - DNA, 23 bp, Homo sapiens
aagccccattcacggcctggcat

SEQ ID NO: 1292832 - DNA, 14 bp, Homo sapiens
aagggatggtcagg

SEQ ID NO: 1292833 - DNA, 19 bp, Homo sapiens
aagggatggtcaggcccag

SEQ ID NO: 1292834 - DNA, 20 bp, Homo sapiens
aagggatggtcaggcccagt

SEQ ID NO: 1292835 - DNA, 18 bp, Homo sapiens
aagtattatgtttcttct

SEQ ID NO: 1292836 - DNA, 17 bp, Homo sapiens
aagttcaccagccctga

SEQ ID NO: 1292837 - DNA, 23 bp, Homo sapiens
aatattttactagtccaatcacc

SEQ ID NO: 1292838 - DNA, 14 bp, Homo sapiens
aatcacccccagga

SEQ ID NO: 1292839 - DNA, 15 bp, Homo sapiens
aatcacccccaggac

SEQ ID NO: 1292840 - DNA, 14 bp, Homo sapiens
acacacagtcctca

SEQ ID NO: 1292841 - DNA, 15 bp, Homo sapiens
acacacggaggccag

SEQ ID NO: 1292842 - DNA, 13 bp, Homo sapiens
acacactgaaaag

SEQ ID NO: 1292843 - DNA, 20 bp, Homo sapiens
acacagtcctcacacacgga

SEQ ID NO: 1292844 - DNA, 14 bp, Homo sapiens
acacggaggccaga

SEQ ID NO: 1292845 - DNA, 21 bp, Homo sapiens
acacggtttaactgtcccagc

SEQ ID NO: 1292846 - DNA, 22 bp, Homo sapiens
acagatctagttctcttctcct

SEQ ID NO: 1292847 - DNA, 13 bp, Homo sapiens
acagcccgggagc

SEQ ID NO: 1292848 - DNA, 20 bp, Homo sapiens
acaggcctttccctgccggc

SEQ ID NO: 1292849 - DNA, 14 bp, Homo sapiens
acagggtcaactgg

SEQ ID NO: 1292850 - DNA, 23 bp, Homo sapiens
acagggtcaactggcgaagcctg

SEQ ID NO: 1292851 - DNA, 19 bp, Homo sapiens
acaggtcttcactgcccag

SEQ ID NO: 1292852 - DNA, 12 bp, Homo sapiens
acaggtgcctgg

SEQ ID NO: 1292853 - DNA, 14 bp, Homo sapiens
acaggtgcctgggg

SEQ ID NO: 1292854 - DNA, 20 bp, Homo sapiens
acaggtgcctggggctggct

SEQ ID NO: 1292855 - DNA, 23 bp, Homo sapiens
acatagagaactgtcaccctgag

SEQ ID NO: 1292856 - DNA, 14 bp, Homo sapiens
accagcctggggcc

SEQ ID NO: 1292857 - DNA, 15 bp, Homo sapiens
accagcctggggcct

SEQ ID NO: 1292858 - DNA, 21 bp, Homo sapiens
accagcctggggccttcctgg

SEQ ID NO: 1292859 - DNA, 23 bp, Homo sapiens
accagcctggggccttcctggct

SEQ ID NO: 1292860 - DNA, 17 bp, Homo sapiens
accatggcacctttgag

SEQ ID NO: 1292861 - DNA, 22 bp, Homo sapiens
accatggcacctttgagagagg

SEQ ID NO: 1292862 - DNA, 15 bp, Homo sapiens
acccaacccatgccc

SEQ ID NO: 1292863 - DNA, 18 bp, Homo sapiens
acccacacagaggacctc

SEQ ID NO: 1292864 - DNA, 13 bp, Homo sapiens
acccaggctccca

SEQ ID NO: 1292865 - DNA, 21 bp, Homo sapiens
accccagttcccttggtggca

SEQ ID NO: 1292866 - DNA, 16 bp, Homo sapiens
accctgaggtaacagg

SEQ ID NO: 1292867 - DNA, 18 bp, Homo sapiens
accgcctgctacacaggc

SEQ ID NO: 1292868 - DNA, 22 bp, Homo sapiens
accgggcgcatgcctcccaggc

SEQ ID NO: 1292869 - DNA, 20 bp, Homo sapiens
acctacctcgccgagctgtc

SEQ ID NO: 1292870 - DNA, 20 bp, Homo sapiens
acctcagtctcacctgccgg

SEQ ID NO: 1292871 - DNA, 15 bp, Homo sapiens
acctcttcagctgct

SEQ ID NO: 1292872 - DNA, 14 bp, Homo sapiens
acctctttggggca

SEQ ID NO: 1292873 - DNA, 18 bp, Homo sapiens
acctgagatgctgggagg

SEQ ID NO: 1292874 - DNA, 15 bp, Homo sapiens
acctgccggctctgg

SEQ ID NO: 1292875 - DNA, 16 bp, Homo sapiens
acctggcaggccctgc

SEQ ID NO: 1292876 - DNA, 23 bp, Homo sapiens
acctggcaggccctgcccagcca

SEQ ID NO: 1292877 - DNA, 19 bp, Homo sapiens
acctggtctggtcaggcaa

SEQ ID NO: 1292878 - DNA, 16 bp, Homo sapiens
acctttgagagagggg

SEQ ID NO: 1292879 - DNA, 23 bp, Homo sapiens
acctttgagagagggggcactgt

SEQ ID NO: 1292880 - DNA, 16 bp, Homo sapiens
acggaggccagacaca

SEQ ID NO: 1292881 - DNA, 11 bp, Homo sapiens
acggcctggca

SEQ ID NO: 1292882 - DNA, 19 bp, Homo sapiens
acggggctcactctggccc

SEQ ID NO: 1292883 - DNA, 16 bp, Homo sapiens
acggtttaactgtccc

SEQ ID NO: 1292884 - DNA, 15 bp, Homo sapiens
actggcgaagcctga

SEQ ID NO: 1292885 - DNA, 19 bp, Homo sapiens
actggcgaagcctgagcag

SEQ ID NO: 1292886 - DNA, 18 bp, Homo sapiens
actggcgatctcccaggg

SEQ ID NO: 1292887 - DNA, 22 bp, Homo sapiens
actgtcaccctgaggtaacagg

SEQ ID NO: 1292888 - DNA, 15 bp, Homo sapiens
agaaatgggcctcag

SEQ ID NO: 1292889 - DNA, 15 bp, Homo sapiens
agaagttcaccagcc

SEQ ID NO: 1292890 - DNA, 17 bp, Homo sapiens
agaagttcaccagccct

SEQ ID NO: 1292891 - DNA, 17 bp, Homo sapiens
agacacaggccgtggga

SEQ ID NO: 1292892 - DNA, 18 bp, Homo sapiens
agacaggcctttccctgc

SEQ ID NO: 1292893 - DNA, 22 bp, Homo sapiens
agacaggtgcctggggctggct

SEQ ID NO: 1292894 - DNA, 23 bp, Homo sapiens
agacccaacccatgcccctgaca

SEQ ID NO: 1292895 - DNA, 23 bp, Homo sapiens
agacctgtgacctggtctggtca

SEQ ID NO: 1292896 - DNA, 13 bp, Homo sapiens
agacggtgtggtt

SEQ ID NO: 1292897 - DNA, 15 bp, Homo sapiens
agagaactgtcaccc

SEQ ID NO: 1292898 - DNA, 18 bp, Homo sapiens
agagagggctgagccatg

SEQ ID NO: 1292899 - DNA, 20 bp, Homo sapiens
agagagggctgagccatggg

SEQ ID NO: 1292900 - DNA, 18 bp, Homo sapiens
agagagggggcactgtgg

SEQ ID NO: 1292901 - DNA, 16 bp, Homo sapiens
agaggagagtggcctg

SEQ ID NO: 1292902 - DNA, 18 bp, Homo sapiens
agaggagagtggcctggg

SEQ ID NO: 1292903 - DNA, 22 bp, Homo sapiens
agagggctgagccatgggggtt

SEQ ID NO: 1292904 - DNA, 21 bp, Homo sapiens
agagggggcactgtggtcagg

SEQ ID NO: 1292905 - DNA, 22 bp, Homo sapiens
agagggggcactgtggtcaggc

SEQ ID NO: 1292906 - DNA, 15 bp, Homo sapiens
agagtggcctgggtc

SEQ ID NO: 1292907 - DNA, 16 bp, Homo sapiens
agatagacctgtgacc

SEQ ID NO: 1292908 - DNA, 22 bp, Homo sapiens
agatctccatgctttgctctca

SEQ ID NO: 1292909 - DNA, 15 bp, Homo sapiens
agatgttgtctgaac

SEQ ID NO: 1292910 - DNA, 15 bp, Homo sapiens
agcaacttcatccca

SEQ ID NO: 1292911 - DNA, 18 bp, Homo sapiens
agcaacttcatcccagct

SEQ ID NO: 1292912 - DNA, 20 bp, Homo sapiens
agcaattcacgctgtctctt

SEQ ID NO: 1292913 - DNA, 16 bp, Homo sapiens
agcagttggcctgtgc

SEQ ID NO: 1292914 - DNA, 21 bp, Homo sapiens
agcagttggcctgtgcttgga

SEQ ID NO: 1292915 - DNA, 22 bp, Homo sapiens
agcagttggcctgtgcttggag

SEQ ID NO: 1292916 - DNA, 20 bp, Homo sapiens
agccagccatcggaagagag

SEQ ID NO: 1292917 - DNA, 17 bp, Homo sapiens
agccatcggaagagagg

SEQ ID NO: 1292918 - DNA, 21 bp, Homo sapiens
agccatcggaagagagggctg

SEQ ID NO: 1292919 - DNA, 19 bp, Homo sapiens
agccatggcggcccctcag

SEQ ID NO: 1292920 - DNA, 24 bp, Homo sapiens
agccatggcggcccctcagcctgc

SEQ ID NO: 1292921 - DNA, 20 bp, Homo sapiens
agccccattcacggcctggc

SEQ ID NO: 1292922 - DNA, 23 bp, Homo sapiens
agccccattcacggcctggcatg

SEQ ID NO: 1292923 - DNA, 17 bp, Homo sapiens
agccctgagccatggcg

SEQ ID NO: 1292924 - DNA, 19 bp, Homo sapiens
agccggagcagttggcctg

SEQ ID NO: 1292925 - DNA, 23 bp, Homo sapiens
agccggagcagttggcctgtgct

SEQ ID NO: 1292926 - DNA, 13 bp, Homo sapiens
agcctaagggaga

SEQ ID NO: 1292927 - DNA, 12 bp, Homo sapiens
agcctctctggc

SEQ ID NO: 1292928 - DNA, 14 bp, Homo sapiens
agcctctctggctc

SEQ ID NO: 1292929 - DNA, 21 bp, Homo sapiens
agcctctctggctcagcccgg

SEQ ID NO: 1292930 - DNA, 15 bp, Homo sapiens
ctgacaatcctattt

SEQ ID NO: 1292931 - DNA, 13 bp, Homo sapiens
ctgagactgtata

SEQ ID NO: 1292932 - DNA, 20 bp, Homo sapiens
ctgagatgctgggagggctg

SEQ ID NO: 1292933 - DNA, 13 bp, Homo sapiens
ctgagcaggcagg

SEQ ID NO: 1292934 - DNA, 20 bp, Homo sapiens
ctgagcaggcaggggcttgg

SEQ ID NO: 1292935 - DNA, 21 bp, Homo sapiens
ctgagcaggcaggggcttggc

SEQ ID NO: 1292936 - DNA, 15 bp, Homo sapiens
ctgagccatggcggc

SEQ ID NO: 1292937 - DNA, 23 bp, Homo sapiens
ctgatggcacccacacagaggac

SEQ ID NO: 1292938 - DNA, 16 bp, Homo sapiens
ctgccagcccagctgg

SEQ ID NO: 1292939 - DNA, 19 bp, Homo sapiens
ctgccagcccagctggccg

SEQ ID NO: 1292940 - DNA, 23 bp, Homo sapiens
ctgccagcccagctggccggaag

SEQ ID NO: 1292941 - DNA, 17 bp, Homo sapiens
ctgccccattccagctc

SEQ ID NO: 1292942 - DNA, 18 bp, Homo sapiens
ctgccccattccagctct

SEQ ID NO: 1292943 - DNA, 18 bp, Homo sapiens
ctgccggccccccaagga

SEQ ID NO: 1292944 - DNA, 17 bp, Homo sapiens
ctgccggctctgggctg

SEQ ID NO: 1292945 - DNA, 18 bp, Homo sapiens
ctgccggctctgggctgg

SEQ ID NO: 1292946 - DNA, 19 bp, Homo sapiens
ctgccggctctgggctggc

SEQ ID NO: 1292947 - DNA, 23 bp, Homo sapiens
ctgccggctctgggctggctgct

SEQ ID NO: 1292948 - DNA, 16 bp, Homo sapiens
ctgcgccctgtgcagg

SEQ ID NO: 1292949 - DNA, 14 bp, Homo sapiens
ctgcggctctggaa

SEQ ID NO: 1292950 - DNA, 17 bp, Homo sapiens
ctgctacacaggcagga

SEQ ID NO: 1292951 - DNA, 14 bp, Homo sapiens
ctggaacctggcag

SEQ ID NO: 1292952 - DNA, 16 bp, Homo sapiens
ctggaacctggcaggc

SEQ ID NO: 1292953 - DNA, 20 bp, Homo sapiens
ctggaacctggcaggccctg

SEQ ID NO: 1292954 - DNA, 21 bp, Homo sapiens
ctggaacctggcaggccctgc

SEQ ID NO: 1292955 - DNA, 19 bp, Homo sapiens
ctggcaggccctgcccagc

SEQ ID NO: 1292956 - DNA, 21 bp, Homo sapiens
ctggcaggccctgcccagcca

SEQ ID NO: 1292957 - DNA, 22 bp, Homo sapiens
ctggcaggccctgcccagccag

SEQ ID NO: 1292958 - DNA, 12 bp, Homo sapiens
ctggccctaggc

SEQ ID NO: 1292959 - DNA, 13 bp, Homo sapiens
ctggccctaggca

SEQ ID NO: 1292960 - DNA, 18 bp, Homo sapiens
ctggccggaaggagactg

SEQ ID NO: 1292961 - DNA, 21 bp, Homo sapiens
ctggcgaagcctgagcaggca

SEQ ID NO: 1292962 - DNA, 22 bp, Homo sapiens
ctggcgaagcctgagcaggcag

SEQ ID NO: 1292963 - DNA, 23 bp, Homo sapiens
ctggcgaagcctgagcaggcagg

SEQ ID NO: 1292964 - DNA, 13 bp, Homo sapiens
ctggcgatctccc

SEQ ID NO: 1292965 - DNA, 21 bp, Homo sapiens
ctggcgatctcccagggctct

SEQ ID NO: 1292966 - DNA, 14 bp, Homo sapiens
ctggctcagcccgg

SEQ ID NO: 1292967 - DNA, 16 bp, Homo sapiens
ctggctcagcccggga

SEQ ID NO: 1292968 - DNA, 22 bp, Homo sapiens
ctggctgctcctaacctacctc

SEQ ID NO: 1292969 - DNA, 17 bp, Homo sapiens
ctgggctggctgctcct

SEQ ID NO: 1292970 - DNA, 14 bp, Homo sapiens
ctggggccttcctg

SEQ ID NO: 1292971 - DNA, 13 bp, Homo sapiens
ctggtcaggcaat

SEQ ID NO: 1292972 - DNA, 15 bp, Homo sapiens
ctgtatatgttgtga

SEQ ID NO: 1292973 - DNA, 13 bp, Homo sapiens
ctgtcaccctgag

SEQ ID NO: 1292974 - DNA, 23 bp, Homo sapiens
ctgtgacctggtctggtcaggca

SEQ ID NO: 1292975 - DNA, 19 bp, Homo sapiens
ctgtgcagggaaagggatg

SEQ ID NO: 1292976 - DNA, 16 bp, Homo sapiens
ctgtgcttggaggcct

SEQ ID NO: 1292977 - DNA, 19 bp, Homo sapiens
ctgtgcttggaggcctcag

SEQ ID NO: 1292978 - DNA, 11 bp, Homo sapiens
ctgtggtcagg

SEQ ID NO: 1292979 - DNA, 15 bp, Homo sapiens
ctgtggtcaggccca

SEQ ID NO: 1292980 - DNA, 19 bp, Homo sapiens
ctgtggtcaggcccagcct

SEQ ID NO: 1292981 - DNA, 16 bp, Homo sapiens
ctgtgttccctttgag

SEQ ID NO: 1292982 - DNA, 23 bp, Homo sapiens
cttaaccctgaacaagagtgtct

SEQ ID NO: 1292983 - DNA, 17 bp, Homo sapiens
cttagcttttagcctgg

SEQ ID NO: 1292984 - DNA, 13 bp, Homo sapiens
cttcagctgctga

SEQ ID NO: 1292985 - DNA, 15 bp, Homo sapiens
cttcatcccagctgc

SEQ ID NO: 1292986 - DNA, 19 bp, Homo sapiens
cttcatcccagctgctgag

SEQ ID NO: 1292987 - DNA, 20 bp, Homo sapiens
cttcatcccagctgctgagg

SEQ ID NO: 1292988 - DNA, 21 bp, Homo sapiens
cttccagaggagagtggcctg

SEQ ID NO: 1292989 - DNA, 23 bp, Homo sapiens
cttccagaggagagtggcctggg

SEQ ID NO: 1292990 - DNA, 14 bp, Homo sapiens
cttcccctcctgta

SEQ ID NO: 1292991 - DNA, 14 bp, Homo sapiens
cttcctggctttgg

SEQ ID NO: 1292992 - DNA, 23 bp, Homo sapiens
cttcttgtcaccccagttccctt

SEQ ID NO: 1292993 - DNA, 12 bp, Homo sapiens
cttgacctgaga

SEQ ID NO: 1292994 - DNA, 14 bp, Homo sapiens
cttgacctgagatg

SEQ ID NO: 1292995 - DNA, 21 bp, Homo sapiens
cttgctcctggaacctggcag

SEQ ID NO: 1292996 - DNA, 12 bp, Homo sapiens
cttggaggcctc

SEQ ID NO: 1292997 - DNA, 17 bp, Homo sapiens
cttggccctgcgccctg

SEQ ID NO: 1292998 - DNA, 12 bp, Homo sapiens
cttggctgcccc

SEQ ID NO: 1292999 - DNA, 21 bp, Homo sapiens
cttggctgccccattccagct

SEQ ID NO: 1293000 - DNA, 15 bp, Homo sapiens
cttgtccttgctcct

SEQ ID NO: 1293001 - DNA, 17 bp, Homo sapiens
cttgtccttgctcctgg

SEQ ID NO: 1293002 - DNA, 16 bp, Homo sapiens
ctttgagacaggtgcc

SEQ ID NO: 1293003 - DNA, 22 bp, Homo sapiens
ctttgagacaggtgcctggggc

SEQ ID NO: 1293004 - DNA, 20 bp, Homo sapiens
ctttgagagagggggcactg

SEQ ID NO: 1293005 - DNA, 21 bp, Homo sapiens
ctttgagagagggggcactgt

SEQ ID NO: 1293006 - DNA, 21 bp, Homo sapiens
ctttgctctcaaggcttggag

SEQ ID NO: 1293007 - DNA, 23 bp, Homo sapiens
cttttaacatagagaactgtcac

SEQ ID NO: 1293008 - DNA, 15 bp, Homo sapiens
cttttagcctggctg

SEQ ID NO: 1293009 - DNA, 16 bp, Homo sapiens
cttttagcctggctgt

SEQ ID NO: 1293010 - DNA, 19 bp, Homo sapiens
cttttagcctggctgtcac

SEQ ID NO: 1293011 - DNA, 13 bp, Homo sapiens
gaaaagcagcctt

SEQ ID NO: 1293012 - DNA, 21 bp, Homo sapiens
gaaagcaacttcatcccagct

SEQ ID NO: 1293013 - DNA, 22 bp, Homo sapiens
gaaagcaacttcatcccagctg

SEQ ID NO: 1293014 - DNA, 22 bp, Homo sapiens
gaaagggatggtcaggcccagt

SEQ ID NO: 1293015 - DNA, 15 bp, Homo sapiens
gaaatgggcctcagc

SEQ ID NO: 1293016 - DNA, 20 bp, Homo sapiens
gaacaagagtgtctatggag

SEQ ID NO: 1293017 - DNA, 13 bp, Homo sapiens
gaaccatggcacc

SEQ ID NO: 1293018 - DNA, 11 bp, Homo sapiens
gaacctggcag

SEQ ID NO: 1293019 - DNA, 14 bp, Homo sapiens
gaacctggcaggcc

SEQ ID NO: 1293020 - DNA, 15 bp, Homo sapiens
gaacctggcaggccc

SEQ ID NO: 1293021 - DNA, 22 bp, Homo sapiens
gaacctggcaggccctgcccag

SEQ ID NO: 1293022 - DNA, 17 bp, Homo sapiens
gaactgtcaccctgagg

SEQ ID NO: 1293023 - DNA, 20 bp, Homo sapiens
gaagagagggctgagccatg

SEQ ID NO: 1293024 - DNA, 13 bp, Homo sapiens
gaagcctgagcag

SEQ ID NO: 1293025 - DNA, 14 bp, Homo sapiens
gaagcctgagcagg

SEQ ID NO: 1293026 - DNA, 16 bp, Homo sapiens
gaagcctgagcaggca

SEQ ID NO: 1293027 - DNA, 20 bp, Homo sapiens
gaagttcaccagccctgagc

SEQ ID NO: 1293028 - DNA, 22 bp, Homo sapiens
gaagttcaccagccctgagcca

SEQ ID NO: 1293029 - DNA, 21 bp, Homo sapiens
gaatccagtgtggctcccaca

SEQ ID NO: 1293030 - DNA, 17 bp, Homo sapiens
gaatggggtccccctcc

SEQ ID NO: 1293031 - DNA, 20 bp, Homo sapiens
gacacactgaaaagcagcct

SEQ ID NO: 1293032 - DNA, 13 bp, Homo sapiens
gacacaggccgtg

SEQ ID NO: 1293033 - DNA, 23 bp, Homo sapiens
gacacaggccgtgggacccaggc

SEQ ID NO: 1293034 - DNA, 17 bp, Homo sapiens
gacagatctagttctct

SEQ ID NO: 1293035 - DNA, 22 bp, Homo sapiens
gacagccggagcagttggcctg

SEQ ID NO: 1293036 - DNA, 22 bp, Homo sapiens
gacaggcctttccctgccggcc

SEQ ID NO: 1293037 - DNA, 16 bp, Homo sapiens
gacaggtgcctggggc

SEQ ID NO: 1293038 - DNA, 23 bp, Homo sapiens
gacaggtgcctggggctggctgc

SEQ ID NO: 1293039 - DNA, 17 bp, Homo sapiens
gacatcaagtgccagat

SEQ ID NO: 1293040 - DNA, 18 bp, Homo sapiens
gacatgggagtggggagc

SEQ ID NO: 1293041 - DNA, 19 bp, Homo sapiens
gaccagcaggagggaagga

SEQ ID NO: 1293042 - DNA, 15 bp, Homo sapiens
cagctctcccatgga

SEQ ID NO: 1293043 - DNA, 13 bp, Homo sapiens
cagctgctgaggc

SEQ ID NO: 1293044 - DNA, 14 bp, Homo sapiens
cagctggccggaag

SEQ ID NO: 1293045 - DNA, 19 bp, Homo sapiens
cagctggccggaaggagac

SEQ ID NO: 1293046 - DNA, 15 bp, Homo sapiens
cagcttgtccttgct

SEQ ID NO: 1293047 - DNA, 23 bp, Homo sapiens
cagcttgtccttgctcctggaac

SEQ ID NO: 1293048 - DNA, 13 bp, Homo sapiens
caggacacactga

SEQ ID NO: 1293049 - DNA, 14 bp, Homo sapiens
caggcaatgccctg

SEQ ID NO: 1293050 - DNA, 17 bp, Homo sapiens
caggcaatgccctgcgg

SEQ ID NO: 1293051 - DNA, 20 bp, Homo sapiens
caggcaatgccctgcggctc

SEQ ID NO: 1293052 - DNA, 22 bp, Homo sapiens
caggcaatgccctgcggctctg

SEQ ID NO: 1293053 - DNA, 15 bp, Homo sapiens
caggcagagttctgt

SEQ ID NO: 1293054 - DNA, 18 bp, Homo sapiens
caggcagagttctgtggc

SEQ ID NO: 1293055 - DNA, 17 bp, Homo sapiens
caggcaggggcttggct

SEQ ID NO: 1293056 - DNA, 18 bp, Homo sapiens
caggcaggggcttggctg

SEQ ID NO: 1293057 - DNA, 22 bp, Homo sapiens
caggcaggggcttggctgcccc

SEQ ID NO: 1293058 - DNA, 14 bp, Homo sapiens
caggcccagcctct

SEQ ID NO: 1293059 - DNA, 20 bp, Homo sapiens
caggcccagcctctctggct

SEQ ID NO: 1293060 - DNA, 22 bp, Homo sapiens
caggcccagcctctctggctca

SEQ ID NO: 1293061 - DNA, 23 bp, Homo sapiens
caggcccagcctctctggctcag

SEQ ID NO: 1293062 - DNA, 19 bp, Homo sapiens
caggcccagttctcgtgcc

SEQ ID NO: 1293063 - DNA, 14 bp, Homo sapiens
caggccctgcccag

SEQ ID NO: 1293064 - DNA, 19 bp, Homo sapiens
caggccgtgggacccaggc

SEQ ID NO: 1293065 - DNA, 20 bp, Homo sapiens
caggccgtgggacccaggct

SEQ ID NO: 1293066 - DNA, 15 bp, Homo sapiens
caggcctttccctgc

SEQ ID NO: 1293067 - DNA, 14 bp, Homo sapiens
caggctcccagcct

SEQ ID NO: 1293068 - DNA, 20 bp, Homo sapiens
cagggaaagggatggtcagg

SEQ ID NO: 1293069 - DNA, 16 bp, Homo sapiens
cagggctctctggacc

SEQ ID NO: 1293070 - DNA, 15 bp, Homo sapiens
cagggctggccctag

SEQ ID NO: 1293071 - DNA, 17 bp, Homo sapiens
cagggctggccctaggc

SEQ ID NO: 1293072 - DNA, 20 bp, Homo sapiens
cagggctggccctaggcact

SEQ ID NO: 1293073 - DNA, 14 bp, Homo sapiens
cagggtcaactggc

SEQ ID NO: 1293074 - DNA, 14 bp, Homo sapiens
caggtgcctggggc

SEQ ID NO: 1293075 - DNA, 16 bp, Homo sapiens
caggtggtcccatagg

SEQ ID NO: 1293076 - DNA, 18 bp, Homo sapiens
cagtcacaaaccagcctg

SEQ ID NO: 1293077 - DNA, 19 bp, Homo sapiens
cagtcacaaaccagcctgg

SEQ ID NO: 1293078 - DNA, 23 bp, Homo sapiens
cagtcacaaaccagcctggggcc

SEQ ID NO: 1293079 - DNA, 21 bp, Homo sapiens
cagtcctcacacacggaggcc

SEQ ID NO: 1293080 - DNA, 19 bp, Homo sapiens
cagtctcacctgccggctc

SEQ ID NO: 1293081 - DNA, 22 bp, Homo sapiens
cagtctcacctgccggctctgg

SEQ ID NO: 1293082 - DNA, 18 bp, Homo sapiens
cagtgctgaagggggcat

SEQ ID NO: 1293083 - DNA, 14 bp, Homo sapiens
cagtgtggctccca

SEQ ID NO: 1293084 - DNA, 19 bp, Homo sapiens
cagttctcgtgcccttaga

SEQ ID NO: 1293085 - DNA, 23 bp, Homo sapiens
cagttggcctgtgcttggaggcc

SEQ ID NO: 1293086 - DNA, 17 bp, Homo sapiens
catagagaactgtcacc

SEQ ID NO: 1293087 - DNA, 23 bp, Homo sapiens
catagagaactgtcaccctgagg

SEQ ID NO: 1293088 - DNA, 13 bp, Homo sapiens
catcccagctgct

SEQ ID NO: 1293089 - DNA, 18 bp, Homo sapiens
catcccagctgctgaggc

SEQ ID NO: 1293090 - DNA, 13 bp, Homo sapiens
catcggaagagag

SEQ ID NO: 1293091 - DNA, 15 bp, Homo sapiens
catcggaagagaggg

SEQ ID NO: 1293092 - DNA, 24 bp, Homo sapiens
catgcagcttgtccttgctcctgg

SEQ ID NO: 1293093 - DNA, 24 bp, Homo sapiens
catggacatgggcagcaattcacg

SEQ ID NO: 1293094 - DNA, 14 bp, Homo sapiens
catggagcccctcc

SEQ ID NO: 1293095 - DNA, 19 bp, Homo sapiens
catggcggcccctcagcct

SEQ ID NO: 1293096 - DNA, 15 bp, Homo sapiens
cattttccccctgtg

SEQ ID NO: 1293097 - DNA, 16 bp, Homo sapiens
ccaacccatgcccctg

SEQ ID NO: 1293098 - DNA, 22 bp, Homo sapiens
ccaaggtcccattttccccctg

SEQ ID NO: 1293099 - DNA, 16 bp, Homo sapiens
ccaatcacccccagga

SEQ ID NO: 1293100 - DNA, 15 bp, Homo sapiens
ccacttgacctgaga

SEQ ID NO: 1293101 - DNA, 22 bp, Homo sapiens
ccagaactgcacaatgaccagc

SEQ ID NO: 1293102 - DNA, 12 bp, Homo sapiens
ccagacacagag

SEQ ID NO: 1293103 - DNA, 16 bp, Homo sapiens
ccagacacagagacat

SEQ ID NO: 1293104 - DNA, 20 bp, Homo sapiens
ccagacacagagacatggga

SEQ ID NO: 1293105 - DNA, 16 bp, Homo sapiens
ccagacacaggccgtg

SEQ ID NO: 1293106 - DNA, 17 bp, Homo sapiens
ccagacacaggccgtgg

SEQ ID NO: 1293107 - DNA, 14 bp, Homo sapiens
ccagatgttgtctg

SEQ ID NO: 1293108 - DNA, 17 bp, Homo sapiens
ccagatgttgtctgaac

SEQ ID NO: 1293109 - DNA, 22 bp, Homo sapiens
ccagcaggagggaaggacagac

SEQ ID NO: 1293110 - DNA, 15 bp, Homo sapiens
ccagcccagctggcc

SEQ ID NO: 1293111 - DNA, 17 bp, Homo sapiens
ccagcccagctggccgg

SEQ ID NO: 1293112 - DNA, 12 bp, Homo sapiens
ccagccctgagc

SEQ ID NO: 1293113 - DNA, 17 bp, Homo sapiens
ccagcctctctggctca

SEQ ID NO: 1293114 - DNA, 18 bp, Homo sapiens
ccagcctctctggctcag

SEQ ID NO: 1293115 - DNA, 13 bp, Homo sapiens
ccagcctggggcc

SEQ ID NO: 1293116 - DNA, 14 bp, Homo sapiens
ccagctcctctcca

SEQ ID NO: 1293117 - DNA, 15 bp, Homo sapiens
ccagctcctctccag

SEQ ID NO: 1293118 - DNA, 15 bp, Homo sapiens
ccaggacacactgaa

SEQ ID NO: 1293119 - DNA, 18 bp, Homo sapiens
ccagggctctctggacca

SEQ ID NO: 1293120 - DNA, 12 bp, Homo sapiens
ccagggctggcc

SEQ ID NO: 1293121 - DNA, 19 bp, Homo sapiens
ccagggctggccctaggca

SEQ ID NO: 1293122 - DNA, 22 bp, Homo sapiens
ccagggctggccctaggcactg

SEQ ID NO: 1293123 - DNA, 14 bp, Homo sapiens
ccatcggaagagag

SEQ ID NO: 1293124 - DNA, 15 bp, Homo sapiens
ccatgcccctgacag

SEQ ID NO: 1293125 - DNA, 19 bp, Homo sapiens
ccatgctttgctctcaagg

SEQ ID NO: 1293126 - DNA, 18 bp, Homo sapiens
ccatggacatgggcagca

SEQ ID NO: 1293127 - DNA, 20 bp, Homo sapiens
ccatggagcccctccaccgg

SEQ ID NO: 1293128 - DNA, 22 bp, Homo sapiens
ccatggcggcccctcagcctgc

SEQ ID NO: 1293129 - DNA, 16 bp, Homo sapiens
ccattcacggcctggc

SEQ ID NO: 1293130 - DNA, 13 bp, Homo sapiens
ccattccagctct

SEQ ID NO: 1293131 - DNA, 16 bp, Homo sapiens
cccacacagaggacct

SEQ ID NO: 1293132 - DNA, 21 bp, Homo sapiens
cccagccagccatcggaagag

SEQ ID NO: 1293133 - DNA, 16 bp, Homo sapiens
cccagctgctgaggcg

SEQ ID NO: 1293134 - DNA, 14 bp, Homo sapiens
cccagctggccgga

SEQ ID NO: 1293135 - DNA, 17 bp, Homo sapiens
cccaggacctcttcagc

SEQ ID NO: 1293136 - DNA, 12 bp, Homo sapiens
cccaggctccca

SEQ ID NO: 1293137 - DNA, 15 bp, Homo sapiens
cccagggctctctgg

SEQ ID NO: 1293138 - DNA, 20 bp, Homo sapiens
cccagggctctctggaccat

SEQ ID NO: 1293139 - DNA, 16 bp, Homo sapiens
cccagggctggcccta

SEQ ID NO: 1293140 - DNA, 19 bp, Homo sapiens
cccagttctcgtgccctta

SEQ ID NO: 1293141 - DNA, 22 bp, Homo sapiens
cccattcacggcctggcatgca

SEQ ID NO: 1293142 - DNA, 13 bp, Homo sapiens
cccattccagctc

SEQ ID NO: 1293143 - DNA, 20 bp, Homo sapiens
cccattccagctctcccatg

SEQ ID NO: 1293144 - DNA, 19 bp, Homo sapiens
ccccgcggatcaaccaggc

SEQ ID NO: 1293145 - DNA, 20 bp, Homo sapiens
ccccgcggatcaaccaggca

SEQ ID NO: 1293146 - DNA, 11 bp, Homo sapiens
cccctcctgta

SEQ ID NO: 1293147 - DNA, 13 bp, Homo sapiens
cccctcctgtaag

SEQ ID NO: 1293148 - DNA, 13 bp, Homo sapiens
cccgggagctttg

SEQ ID NO: 1293149 - DNA, 12 bp, Homo sapiens
ccctcagcctgc

SEQ ID NO: 1293150 - DNA, 18 bp, Homo sapiens
ccctcagcctgcctgaag

SEQ ID NO: 1293151 - DNA, 20 bp, Homo sapiens
ccctcccacttgacctgaga

SEQ ID NO: 1293152 - DNA, 12 bp, Homo sapiens
ccctcctgggtg

SEQ ID NO: 1293153 - DNA, 15 bp, Homo sapiens
ccctgcccagccagc

SEQ ID NO: 1293154 - DNA, 17 bp, Homo sapiens
ccctgcccagccagcca

SEQ ID NO: 1293155 - DNA, 20 bp, Homo sapiens
agtctcacctgccggctctg

SEQ ID NO: 1293156 - DNA, 16 bp, Homo sapiens
agtgctgaagggggca

SEQ ID NO: 1293157 - DNA, 12 bp, Homo sapiens
agtggcctgggt

SEQ ID NO: 1293158 - DNA, 18 bp, Homo sapiens
agtggcctgggtcccagg

SEQ ID NO: 1293159 - DNA, 23 bp, Homo sapiens
agtggcctgggtcccagggctgg

SEQ ID NO: 1293160 - DNA, 21 bp, Homo sapiens
agtggggagcggagcttggcc

SEQ ID NO: 1293161 - DNA, 15 bp, Homo sapiens
agtgtctatggagca

SEQ ID NO: 1293162 - DNA, 18 bp, Homo sapiens
agtgtctatggagcagcc

SEQ ID NO: 1293163 - DNA, 20 bp, Homo sapiens
agtgtggctcccacaggtct

SEQ ID NO: 1293164 - DNA, 13 bp, Homo sapiens
agttcaccagccc

SEQ ID NO: 1293165 - DNA, 16 bp, Homo sapiens
agttgccttttcttcc

SEQ ID NO: 1293166 - DNA, 23 bp, Homo sapiens
agttggcctgtgcttggaggcct

SEQ ID NO: 1293167 - DNA, 23 bp, Homo sapiens
ataaaactgagactgtatatgtt

SEQ ID NO: 1293168 - DNA, 14 bp, Homo sapiens
ataaaatacatatt

SEQ ID NO: 1293169 - DNA, 14 bp, Homo sapiens
atacgcggaggagt

SEQ ID NO: 1293170 - DNA, 23 bp, Homo sapiens
atagagaactgtcaccctgaggt

SEQ ID NO: 1293171 - DNA, 15 bp, Homo sapiens
atatttttttacttg

SEQ ID NO: 1293172 - DNA, 13 bp, Homo sapiens
atcaagtgccaga

SEQ ID NO: 1293173 - DNA, 17 bp, Homo sapiens
atccagtgtggctccca

SEQ ID NO: 1293174 - DNA, 13 bp, Homo sapiens
atcggaagagagg

SEQ ID NO: 1293175 - DNA, 21 bp, Homo sapiens
atctagttctcttctcctgtg

SEQ ID NO: 1293176 - DNA, 19 bp, Homo sapiens
atctccatgctttgctctc

SEQ ID NO: 1293177 - DNA, 19 bp, Homo sapiens
atctcccagggctctctgg

SEQ ID NO: 1293178 - DNA, 17 bp, Homo sapiens
atgcagcttgtccttgc

SEQ ID NO: 1293179 - DNA, 21 bp, Homo sapiens
atgccctgcggctctggaaag

SEQ ID NO: 1293180 - DNA, 13 bp, Homo sapiens
atgcctcccaggc

SEQ ID NO: 1293181 - DNA, 16 bp, Homo sapiens
atgcggttgggaggca

SEQ ID NO: 1293182 - DNA, 16 bp, Homo sapiens
atggcacccacacaga

SEQ ID NO: 1293183 - DNA, 22 bp, Homo sapiens
atggcacccacacagaggacct

SEQ ID NO: 1293184 - DNA, 15 bp, Homo sapiens
atggcacctttgaga

SEQ ID NO: 1293185 - DNA, 17 bp, Homo sapiens
atggcggcccctcagcc

SEQ ID NO: 1293186 - DNA, 15 bp, Homo sapiens
atgggcctcagcccc

SEQ ID NO: 1293187 - DNA, 12 bp, Homo sapiens
atggtcaggccc

SEQ ID NO: 1293188 - DNA, 18 bp, Homo sapiens
atgtgcccctcctgggtg

SEQ ID NO: 1293189 - DNA, 13 bp, Homo sapiens
attcacggcctgg

SEQ ID NO: 1293190 - DNA, 14 bp, Homo sapiens
attcacggcctggc

SEQ ID NO: 1293191 - DNA, 11 bp, Homo sapiens
attccagctct

SEQ ID NO: 1293192 - DNA, 16 bp, Homo sapiens
attgtcagtcctacaa

SEQ ID NO: 1293193 - DNA, 19 bp, Homo sapiens
caaagcagaagtggaatcc

SEQ ID NO: 1293194 - DNA, 17 bp, Homo sapiens
caaaggacacaagggtg

SEQ ID NO: 1293195 - DNA, 11 bp, Homo sapiens
caaccaggcag

SEQ ID NO: 1293196 - DNA, 12 bp, Homo sapiens
caaccaggcaga

SEQ ID NO: 1293197 - DNA, 16 bp, Homo sapiens
caacccatgcccctga

SEQ ID NO: 1293198 - DNA, 18 bp, Homo sapiens
caacccatgcccctgaca

SEQ ID NO: 1293199 - DNA, 19 bp, Homo sapiens
caacccatgcccctgacag

SEQ ID NO: 1293200 - DNA, 16 bp, Homo sapiens
caactggcgaagcctg

SEQ ID NO: 1293201 - DNA, 21 bp, Homo sapiens
caagccccattcacggcctgg

SEQ ID NO: 1293202 - DNA, 15 bp, Homo sapiens
caaggcttggagagg

SEQ ID NO: 1293203 - DNA, 23 bp, Homo sapiens
caaggtcccattttccccctgtg

SEQ ID NO: 1293204 - DNA, 15 bp, Homo sapiens
caatgaccagcagga

SEQ ID NO: 1293205 - DNA, 18 bp, Homo sapiens
caatgccctgcggctctg

SEQ ID NO: 1293206 - DNA, 19 bp, Homo sapiens
caatgccctgcggctctgg

SEQ ID NO: 1293207 - DNA, 20 bp, Homo sapiens
caatgccctgcggctctgga

SEQ ID NO: 1293208 - DNA, 22 bp, Homo sapiens
caatgccctgcggctctggaaa

SEQ ID NO: 1293209 - DNA, 16 bp, Homo sapiens
cacaaaccagcctggg

SEQ ID NO: 1293210 - DNA, 15 bp, Homo sapiens
cacacacacagtcct

SEQ ID NO: 1293211 - DNA, 17 bp, Homo sapiens
cacacacggaggccaga

SEQ ID NO: 1293212 - DNA, 15 bp, Homo sapiens
cacacagaggacctc

SEQ ID NO: 1293213 - DNA, 12 bp, Homo sapiens
cacacagtcctc

SEQ ID NO: 1293214 - DNA, 13 bp, Homo sapiens
cacacggaggcca

SEQ ID NO: 1293215 - DNA, 15 bp, Homo sapiens
cacacggaggccaga

SEQ ID NO: 1293216 - DNA, 18 bp, Homo sapiens
cacaggtcttcactgccc

SEQ ID NO: 1293217 - DNA, 22 bp, Homo sapiens
cacaggtcttcactgcccaggg

SEQ ID NO: 1293218 - DNA, 18 bp, Homo sapiens
cacagtcctcacacacgg

SEQ ID NO: 1293219 - DNA, 15 bp, Homo sapiens
caccagccctgagcc

SEQ ID NO: 1293220 - DNA, 16 bp, Homo sapiens
caccagccctgagcca

SEQ ID NO: 1293221 - DNA, 18 bp, Homo sapiens
cacccacacagaggacct

SEQ ID NO: 1293222 - DNA, 12 bp, Homo sapiens
cacccccaggac

SEQ ID NO: 1293223 - DNA, 14 bp, Homo sapiens
cacccccaggacct

SEQ ID NO: 1293224 - DNA, 20 bp, Homo sapiens
cacccccaggacctcttcag

SEQ ID NO: 1293225 - DNA, 18 bp, Homo sapiens
caccgggcgcatgcctcc

SEQ ID NO: 1293226 - DNA, 17 bp, Homo sapiens
cacctgccggctctggg

SEQ ID NO: 1293227 - DNA, 13 bp, Homo sapiens
cacgctgtctctt

SEQ ID NO: 1293228 - DNA, 20 bp, Homo sapiens
cacggaggccagacacaggc

SEQ ID NO: 1293229 - DNA, 13 bp, Homo sapiens
cacggcctggcat

SEQ ID NO: 1293230 - DNA, 15 bp, Homo sapiens
cacggcctggcatgc

SEQ ID NO: 1293231 - DNA, 17 bp, Homo sapiens
cacggcctggcatgcag

SEQ ID NO: 1293232 - DNA, 19 bp, Homo sapiens
cacggcctggcatgcagct

SEQ ID NO: 1293233 - DNA, 19 bp, Homo sapiens
cacggtttaactgtcccag

SEQ ID NO: 1293234 - DNA, 16 bp, Homo sapiens
cactgaaaagcagcct

SEQ ID NO: 1293235 - DNA, 13 bp, Homo sapiens
cactgtggtcagg

SEQ ID NO: 1293236 - DNA, 14 bp, Homo sapiens
cactgtggtcaggc

SEQ ID NO: 1293237 - DNA, 20 bp, Homo sapiens
cactgtggtcaggcccagcc

SEQ ID NO: 1293238 - DNA, 20 bp, Homo sapiens
cagacatcaagtgccagatg

SEQ ID NO: 1293239 - DNA, 16 bp, Homo sapiens
cagacccaacccatgc

SEQ ID NO: 1293240 - DNA, 21 bp, Homo sapiens
cagacccaacccatgcccctg

SEQ ID NO: 1293241 - DNA, 14 bp, Homo sapiens
cagagacatgggag

SEQ ID NO: 1293242 - DNA, 16 bp, Homo sapiens
cagaggagagtggcct

SEQ ID NO: 1293243 - DNA, 18 bp, Homo sapiens
cagaggagagtggcctgg

SEQ ID NO: 1293244 - DNA, 23 bp, Homo sapiens
cagatctagttctcttctcctgt

SEQ ID NO: 1293245 - DNA, 13 bp, Homo sapiens
cagcaggagggaa

SEQ ID NO: 1293246 - DNA, 19 bp, Homo sapiens
cagccatcggaagagaggg

SEQ ID NO: 1293247 - DNA, 22 bp, Homo sapiens
cagcccagctggccggaaggag

SEQ ID NO: 1293248 - DNA, 18 bp, Homo sapiens
cagcccgggagctttgag

SEQ ID NO: 1293249 - DNA, 12 bp, Homo sapiens
cagccctgagcc

SEQ ID NO: 1293250 - DNA, 13 bp, Homo sapiens
cagccctgagcca

SEQ ID NO: 1293251 - DNA, 16 bp, Homo sapiens
cagccctgagccatgg

SEQ ID NO: 1293252 - DNA, 17 bp, Homo sapiens
cagccctgagccatggc

SEQ ID NO: 1293253 - DNA, 23 bp, Homo sapiens
cagccggagcagttggcctgtgc

SEQ ID NO: 1293254 - DNA, 18 bp, Homo sapiens
cagcctaagggagacagg

SEQ ID NO: 1293255 - DNA, 19 bp, Homo sapiens
cagcctaagggagacaggc

SEQ ID NO: 1293256 - DNA, 22 bp, Homo sapiens
cagcctctctggctcagcccgg

SEQ ID NO: 1293257 - DNA, 23 bp, Homo sapiens
cagcctctctggctcagcccggg

SEQ ID NO: 1293258 - DNA, 15 bp, Homo sapiens
cagcctgcctgaaga

SEQ ID NO: 1293259 - DNA, 16 bp, Homo sapiens
cagcctgcctgaagag

SEQ ID NO: 1293260 - DNA, 18 bp, Homo sapiens
cagcctgcctgaagagag

SEQ ID NO: 1293261 - DNA, 14 bp, Homo sapiens
cagcctggggcctt

SEQ ID NO: 1293262 - DNA, 19 bp, Homo sapiens
cagcctggggccttcctgg

SEQ ID NO: 1293263 - DNA, 22 bp, Homo sapiens
cagcctggggccttcctggctt

SEQ ID NO: 1293264 - DNA, 20 bp, Homo sapiens
cagcctttttcaccatggca

SEQ ID NO: 1293265 - DNA, 23 bp, Homo sapiens
cagcctttttcaccatggcaaac

SEQ ID NO: 1293266 - DNA, 14 bp, Homo sapiens
cagctcctctccag

SEQ ID NO: 1293267 - DNA, 18 bp, Homo sapiens
cagctcctctccagacac

SEQ ID NO: 1293268 - DNA, 17 bp, Homo sapiens
ggcgcatgcctcccagg

SEQ ID NO: 1293269 - DNA, 18 bp, Homo sapiens
ggcgcatgcctcccaggc

SEQ ID NO: 1293270 - DNA, 22 bp, Homo sapiens
ggcgccgcgtggacagccggag

SEQ ID NO: 1293271 - DNA, 15 bp, Homo sapiens
ggcggcccctcagcc

SEQ ID NO: 1293272 - DNA, 16 bp, Homo sapiens
ggcggcccctcagcct

SEQ ID NO: 1293273 - DNA, 21 bp, Homo sapiens
ggcggcccctcagcctgcctg

SEQ ID NO: 1293274 - DNA, 15 bp, Homo sapiens
ggctcactctggccc

SEQ ID NO: 1293275 - DNA, 20 bp, Homo sapiens
ggctcagcccgggatcctga

SEQ ID NO: 1293276 - DNA, 21 bp, Homo sapiens
ggctcagcccgggatcctgat

SEQ ID NO: 1293277 - DNA, 15 bp, Homo sapiens
ggctcccacaggtct

SEQ ID NO: 1293278 - DNA, 21 bp, Homo sapiens
ggctcccacaggtcttcactg

SEQ ID NO: 1293279 - DNA, 21 bp, Homo sapiens
ggctcccagcctaagggagac

SEQ ID NO: 1293280 - DNA, 23 bp, Homo sapiens
ggctcccagcctaagggagacag

SEQ ID NO: 1293281 - DNA, 13 bp, Homo sapiens
ggctctctggacc

SEQ ID NO: 1293282 - DNA, 12 bp, Homo sapiens
ggctctgggctg

SEQ ID NO: 1293283 - DNA, 13 bp, Homo sapiens
ggctctgggctgg

SEQ ID NO: 1293284 - DNA, 16 bp, Homo sapiens
ggctgccagcccagct

SEQ ID NO: 1293285 - DNA, 20 bp, Homo sapiens
ggctgccccattccagctct

SEQ ID NO: 1293286 - DNA, 23 bp, Homo sapiens
ggctgccccattccagctctccc

SEQ ID NO: 1293287 - DNA, 19 bp, Homo sapiens
ggctggacatttgtggcag

SEQ ID NO: 1293288 - DNA, 12 bp, Homo sapiens
ggctggccagga

SEQ ID NO: 1293289 - DNA, 13 bp, Homo sapiens
ggctggccaggac

SEQ ID NO: 1293290 - DNA, 16 bp, Homo sapiens
ggctggccaggacaca

SEQ ID NO: 1293291 - DNA, 19 bp, Homo sapiens
ggctggccaggacacactg

SEQ ID NO: 1293292 - DNA, 15 bp, Homo sapiens
ggctggccctaggca

SEQ ID NO: 1293293 - DNA, 23 bp, Homo sapiens
tagagaactgtcaccctgaggta

SEQ ID NO: 1293294 - DNA, 12 bp, Homo sapiens
tagcctggctgt

SEQ ID NO: 1293295 - DNA, 18 bp, Homo sapiens
tagcttttagcctggctg

SEQ ID NO: 1293296 - DNA, 15 bp, Homo sapiens
tatggagcagccgga

SEQ ID NO: 1293297 - DNA, 20 bp, Homo sapiens
tcaaccaggcagagttctgt

SEQ ID NO: 1293298 - DNA, 18 bp, Homo sapiens
tcaactggcgaagcctga

SEQ ID NO: 1293299 - DNA, 12 bp, Homo sapiens
tcaaggcttgga

SEQ ID NO: 1293300 - DNA, 13 bp, Homo sapiens
tcacacaagcaca

SEQ ID NO: 1293301 - DNA, 23 bp, Homo sapiens
tcacacaagcacacacacacagt

SEQ ID NO: 1293302 - DNA, 13 bp, Homo sapiens
tcacccccaggac

SEQ ID NO: 1293303 - DNA, 22 bp, Homo sapiens
tcaccgcctgctacacaggcag

SEQ ID NO: 1293304 - DNA, 23 bp, Homo sapiens
tcaccgcctgctacacaggcagg

SEQ ID NO: 1293305 - DNA, 18 bp, Homo sapiens
tcacctgccggctctggg

SEQ ID NO: 1293306 - DNA, 19 bp, Homo sapiens
tcacggcctggcatgcagc

SEQ ID NO: 1293307 - DNA, 17 bp, Homo sapiens
tcaggcaatgccctgcg

SEQ ID NO: 1293308 - DNA, 21 bp, Homo sapiens
tcaggcaatgccctgcggctc

SEQ ID NO: 1293309 - DNA, 15 bp, Homo sapiens
tcaggcccagcctct

SEQ ID NO: 1293310 - DNA, 19 bp, Homo sapiens
tcaggcccagcctctctgg

SEQ ID NO: 1293311 - DNA, 17 bp, Homo sapiens
tcaggcccagttctcgt

SEQ ID NO: 1293312 - DNA, 22 bp, Homo sapiens
tcaggcccagttctcgtgccct

SEQ ID NO: 1293313 - DNA, 14 bp, Homo sapiens
tcagtcacaaacca

SEQ ID NO: 1293314 - DNA, 19 bp, Homo sapiens
tcagtctcacctgccggct

SEQ ID NO: 1293315 - DNA, 20 bp, Homo sapiens
tcagtctcacctgccggctc

SEQ ID NO: 1293316 - DNA, 14 bp, Homo sapiens
tcatcccagctgct

SEQ ID NO: 1293317 - DNA, 18 bp, Homo sapiens
tccaatcacccccaggac

SEQ ID NO: 1293318 - DNA, 21 bp, Homo sapiens
tccaccgggcgcatgcctccc

SEQ ID NO: 1293319 - DNA, 23 bp, Homo sapiens
tccacggggctcactctggcccc

SEQ ID NO: 1293320 - DNA, 12 bp, Homo sapiens
tccagaggagag

SEQ ID NO: 1293321 - DNA, 20 bp, Homo sapiens
tccagaggagagtggcctgg

SEQ ID NO: 1293322 - DNA, 22 bp, Homo sapiens
tccagaggagagtggcctgggt

SEQ ID NO: 1293323 - DNA, 13 bp, Homo sapiens
tccagctcctctc

SEQ ID NO: 1293324 - DNA, 18 bp, Homo sapiens
tccagtgtggctcccaca

SEQ ID NO: 1293325 - DNA, 20 bp, Homo sapiens
tccatgctttgctctcaagg

SEQ ID NO: 1293326 - DNA, 18 bp, Homo sapiens
tccatggacatgggcagc

SEQ ID NO: 1293327 - DNA, 18 bp, Homo sapiens
tcccaggccacctcagtc

SEQ ID NO: 1293328 - DNA, 19 bp, Homo sapiens
tcccagggctctctggacc

SEQ ID NO: 1293329 - DNA, 16 bp, Homo sapiens
tcccagggctggccct

SEQ ID NO: 1293330 - DNA, 21 bp, Homo sapiens
tcccagggctggccctaggca

SEQ ID NO: 1293331 - DNA, 18 bp, Homo sapiens
tcccattttccccctgtg

SEQ ID NO: 1293332 - DNA, 14 bp, Homo sapiens
tcccctcctgtaag

SEQ ID NO: 1293333 - DNA, 22 bp, Homo sapiens
tcctacaaaaataaaaggcttc

SEQ ID NO: 1293334 - DNA, 17 bp, Homo sapiens
tcctcacacacggaggc

SEQ ID NO: 1293335 - DNA, 16 bp, Homo sapiens
tcctggaacctggcag

SEQ ID NO: 1293336 - DNA, 13 bp, Homo sapiens
tcctgtgttccct

SEQ ID NO: 1293337 - DNA, 15 bp, Homo sapiens
tccttgctcctggaa

SEQ ID NO: 1293338 - DNA, 19 bp, Homo sapiens
tcggaagagagggctgagc

SEQ ID NO: 1293339 - DNA, 12 bp, Homo sapiens
tcggagggctgg

SEQ ID NO: 1293340 - DNA, 18 bp, Homo sapiens
tcggcctggctggccagg

SEQ ID NO: 1293341 - DNA, 14 bp, Homo sapiens
tcgggctgccagcc

SEQ ID NO: 1293342 - DNA, 20 bp, Homo sapiens
tcgggctgccagcccagctg

SEQ ID NO: 1293343 - DNA, 21 bp, Homo sapiens
tcgggctgccagcccagctgg

SEQ ID NO: 1293344 - DNA, 20 bp, Homo sapiens
tctcacctgccggctctggg

SEQ ID NO: 1293345 - DNA, 14 bp, Homo sapiens
tctcccagggctct

SEQ ID NO: 1293346 - DNA, 18 bp, Homo sapiens
tctcccagggctctctgg

SEQ ID NO: 1293347 - DNA, 20 bp, Homo sapiens
tctcccagggctctctggac

SEQ ID NO: 1293348 - DNA, 13 bp, Homo sapiens
tctcttctcctgt

SEQ ID NO: 1293349 - DNA, 14 bp, Homo sapiens
tctcttctcctgtg

SEQ ID NO: 1293350 - DNA, 21 bp, Homo sapiens
tctcttcttaaccctgaacaa

SEQ ID NO: 1293351 - DNA, 22 bp, Homo sapiens
tctcttcttaaccctgaacaag

SEQ ID NO: 1293352 - DNA, 18 bp, Homo sapiens
tctgggctggctgctcct

SEQ ID NO: 1293353 - DNA, 21 bp, Homo sapiens
tctgtggcgccgcgtggacag

SEQ ID NO: 1293354 - DNA, 18 bp, Homo sapiens
tcttcttaaccctgaaca

SEQ ID NO: 1293355 - DNA, 22 bp, Homo sapiens
tcttgtccacggggctcactct

SEQ ID NO: 1293356 - DNA, 21 bp, Homo sapiens
tctttggggcaagatccaggt

SEQ ID NO: 1293357 - DNA, 14 bp, Homo sapiens
tgacaatcctattt

SEQ ID NO: 1293358 - DNA, 14 bp, Homo sapiens
tgaccagcaggagg

SEQ ID NO: 1293359 - DNA, 22 bp, Homo sapiens
tgacctggtctggtcaggcaat

SEQ ID NO: 1293360 - DNA, 23 bp, Homo sapiens
tgacctggtctggtcaggcaatg

SEQ ID NO: 1293361 - DNA, 15 bp, Homo sapiens
tgagacaggtgcctg

SEQ ID NO: 1293362 - DNA, 22 bp, Homo sapiens
tgagacaggtgcctggggctgg

SEQ ID NO: 1293363 - DNA, 19 bp, Homo sapiens
tgagagagggggcactgtg

SEQ ID NO: 1293364 - DNA, 18 bp, Homo sapiens
tgagatgctgggagggct

SEQ ID NO: 1293365 - DNA, 18 bp, Homo sapiens
tgagcaaagaactaagga

SEQ ID NO: 1293366 - DNA, 12 bp, Homo sapiens
tgagcaggcagg

SEQ ID NO: 1293367 - DNA, 21 bp, Homo sapiens
tgaggtaacagggtcaactgg

SEQ ID NO: 1293368 - DNA, 13 bp, Homo sapiens
tgagtccagtgtg

SEQ ID NO: 1293369 - DNA, 23 bp, Homo sapiens
tgcagcttgtccttgctcctgga

SEQ ID NO: 1293370 - DNA, 24 bp, Homo sapiens
tgcagcttgtccttgctcctggaa

SEQ ID NO: 1293371 - DNA, 19 bp, Homo sapiens
tgccagcccagctggccgg

SEQ ID NO: 1293372 - DNA, 16 bp, Homo sapiens
tgccctgcggctctgg

SEQ ID NO: 1293373 - DNA, 19 bp, Homo sapiens
tgccctgcggctctggaaa

SEQ ID NO: 1293374 - DNA, 20 bp, Homo sapiens
tgccctgcggctctggaaag

SEQ ID NO: 1293375 - DNA, 22 bp, Homo sapiens
tgccctgcggctctggaaagca

SEQ ID NO: 1293376 - DNA, 14 bp, Homo sapiens
tgccggctctgggc

SEQ ID NO: 1293377 - DNA, 14 bp, Homo sapiens
tgcctgaagagagg

SEQ ID NO: 1293378 - DNA, 13 bp, Homo sapiens
tgcctggggctgg

SEQ ID NO: 1293379 - DNA, 19 bp, Homo sapiens
tgcctggggctggctgcag

SEQ ID NO: 1293380 - DNA, 21 bp, Homo sapiens
tgcctggggctggctgcagac

SEQ ID NO: 1293381 - DNA, 16 bp, Homo sapiens
tgcggctctggaaagc

SEQ ID NO: 1293382 - DNA, 13 bp, Homo sapiens
tgcggttgggagg

SEQ ID NO: 1293383 - DNA, 14 bp, Homo sapiens
tgcggttgggaggc

SEQ ID NO: 1293384 - DNA, 17 bp, Homo sapiens
tggcctgggtcccaggg

SEQ ID NO: 1293385 - DNA, 19 bp, Homo sapiens
tggcctgggtcccagggct

SEQ ID NO: 1293386 - DNA, 15 bp, Homo sapiens
tggcctgtgcttgga

SEQ ID NO: 1293387 - DNA, 19 bp, Homo sapiens
tggcctgtgcttggaggcc

SEQ ID NO: 1293388 - DNA, 20 bp, Homo sapiens
tggcctgtgcttggaggcct

SEQ ID NO: 1293389 - DNA, 17 bp, Homo sapiens
tggcgaagcctgagcag

SEQ ID NO: 1293390 - DNA, 21 bp, Homo sapiens
tggcgaagcctgagcaggcag

SEQ ID NO: 1293391 - DNA, 16 bp, Homo sapiens
tggcgatctcccaggg

SEQ ID NO: 1293392 - DNA, 23 bp, Homo sapiens
tggcgatctcccagggctctctg

SEQ ID NO: 1293393 - DNA, 21 bp, Homo sapiens
tggcgccgcgtggacagccgg

SEQ ID NO: 1293394 - DNA, 14 bp, Homo sapiens
tggctcagcccggg

SEQ ID NO: 1293395 - DNA, 20 bp, Homo sapiens
tggctcagcccgggatcctg

SEQ ID NO: 1293396 - DNA, 23 bp, Homo sapiens
tggctcccacaggtcttcactgc

SEQ ID NO: 1293397 - DNA, 13 bp, Homo sapiens
tgggacccaggct

SEQ ID NO: 1293398 - DNA, 17 bp, Homo sapiens
tgggacccaggctccca

SEQ ID NO: 1293399 - DNA, 20 bp, Homo sapiens
tgggacccaggctcccagcc

SEQ ID NO: 1293400 - DNA, 16 bp, Homo sapiens
tgggagggctgaaccc

SEQ ID NO: 1293401 - DNA, 11 bp, Homo sapiens
tgggcctcagc

SEQ ID NO: 1293402 - DNA, 13 bp, Homo sapiens
tgggctggctgct

SEQ ID NO: 1293403 - DNA, 22 bp, Homo sapiens
tggggagcggagcttggccctg

SEQ ID NO: 1293404 - DNA, 17 bp, Homo sapiens
tggggccttcctggctt

SEQ ID NO: 1293405 - DNA, 13 bp, Homo sapiens
tggggtccccctc

SEQ ID NO: 1293406 - DNA, 15 bp, Homo sapiens
tgggtcccagggctg

SEQ ID NO: 1293407 - DNA, 18 bp, Homo sapiens
tgggtcccagggctggcc

SEQ ID NO: 1293408 - DNA, 19 bp, Homo sapiens
tggtcaggcaatgccctgc

SEQ ID NO: 1293409 - DNA, 15 bp, Homo sapiens
tggtcaggcccagcc

SEQ ID NO: 1293410 - DNA, 14 bp, Homo sapiens
tggtctccagctcc

SEQ ID NO: 1293411 - DNA, 20 bp, Homo sapiens
tggtctccagctcctctcca

SEQ ID NO: 1293412 - DNA, 13 bp, Homo sapiens
tggtctggtcagg

SEQ ID NO: 1293413 - DNA, 19 bp, Homo sapiens
tggtggcaaccccagaccc

SEQ ID NO: 1293414 - DNA, 18 bp, Homo sapiens
tgtagatctccatgcttt

SEQ ID NO: 1293415 - DNA, 15 bp, Homo sapiens
tgtccttgctcctgg

SEQ ID NO: 1293416 - DNA, 15 bp, Homo sapiens
tgtgacctggtctgg

SEQ ID NO: 1293417 - DNA, 20 bp, Homo sapiens
tgtgacctggtctggtcagg

SEQ ID NO: 1293418 - DNA, 17 bp, Homo sapiens
tgtgcccctcctgggtg

SEQ ID NO: 1293419 - DNA, 16 bp, Homo sapiens
tgtgcttggaggcctc

SEQ ID NO: 1293420 - DNA, 19 bp, Homo sapiens
tgtgcttggaggcctcaga

SEQ ID NO: 1293421 - DNA, 13 bp, Homo sapiens
tgtggcagtgctg

SEQ ID NO: 1293422 - DNA, 20 bp, Homo sapiens
tgtggcgccgcgtggacagc

SEQ ID NO: 1293423 - DNA, 21 bp, Homo sapiens
tgtggcgccgcgtggacagcc

SEQ ID NO: 1293424 - DNA, 14 bp, Homo sapiens
tgtggtcaggccca

SEQ ID NO: 1293425 - DNA, 19 bp, Homo sapiens
tgtggtcaggcccagcctc

SEQ ID NO: 1293426 - DNA, 14 bp, Homo sapiens
tgtggtctccagct

SEQ ID NO: 1293427 - DNA, 15 bp, Homo sapiens
tgtggtctccagctc

SEQ ID NO: 1293428 - DNA, 16 bp, Homo sapiens
tgtggtctccagctcc

SEQ ID NO: 1293429 - DNA, 13 bp, Homo sapiens
tgtgtggacagcc

SEQ ID NO: 1293430 - DNA, 19 bp, Homo sapiens
tgtgtggacagcccgggag

SEQ ID NO: 1293431 - DNA, 13 bp, Homo sapiens
tgtgtgtggacag

SEQ ID NO: 1293432 - DNA, 14 bp, Homo sapiens
tgtgtgtggacagc

SEQ ID NO: 1293433 - DNA, 15 bp, Homo sapiens
tgtgtgtgtggacag

SEQ ID NO: 1293434 - DNA, 15 bp, Homo sapiens
tgttccctttgagtc

SEQ ID NO: 1293435 - DNA, 13 bp, Homo sapiens
ttagcctggctgt

SEQ ID NO: 1293436 - DNA, 18 bp, Homo sapiens
ttagcttttagcctggct

SEQ ID NO: 1293437 - DNA, 16 bp, Homo sapiens
ttcaccatggcaaacc

SEQ ID NO: 1293438 - DNA, 14 bp, Homo sapiens
ttcacggcctggca

SEQ ID NO: 1293439 - DNA, 15 bp, Homo sapiens
ttcacggcctggcat

SEQ ID NO: 1293440 - DNA, 19 bp, Homo sapiens
ttccatggacatgggcagc

SEQ ID NO: 1293441 - DNA, 16 bp, Homo sapiens
ttcccctcctgtaaga

SEQ ID NO: 1293442 - DNA, 17 bp, Homo sapiens
ttcccttggtggcaacc

SEQ ID NO: 1293443 - DNA, 21 bp, Homo sapiens
ttctgtgtggtctccagctcc

SEQ ID NO: 1293444 - DNA, 15 bp, Homo sapiens
ttcttaaccctgaac

SEQ ID NO: 1293445 - DNA, 14 bp, Homo sapiens
ttgagtccagtgtg

SEQ ID NO: 1293446 - DNA, 18 bp, Homo sapiens
ttgctcctggaacctggc

SEQ ID NO: 1293447 - DNA, 20 bp, Homo sapiens
ttgctcctggaacctggcag

SEQ ID NO: 1293448 - DNA, 13 bp, Homo sapiens
ttggaggcctcag

SEQ ID NO: 1293449 - DNA, 17 bp, Homo sapiens
tttaactgtcccagcga

SEQ ID NO: 1293450 - DNA, 22 bp, Homo sapiens
tttcagggaaaaatattttact

SEQ ID NO: 1293451 - DNA, 18 bp, Homo sapiens
tttccagaactgcacaat

SEQ ID NO: 1293452 - DNA, 20 bp, Homo sapiens
tttccagaactgcacaatga

SEQ ID NO: 1293453 - DNA, 22 bp, Homo sapiens
tttcttcttgtcaccccagttc

SEQ ID NO: 1293454 - DNA, 20 bp, Homo sapiens
tttgagagagggggcactgt

SEQ ID NO: 1293455 - DNA, 23 bp, Homo sapiens
tttgagagagggggcactgtggt

SEQ ID NO: 1293456 - DNA, 15 bp, Homo sapiens
cctggctggccagga

SEQ ID NO: 1293457 - DNA, 18 bp, Homo sapiens
cctggctggccaggacac

SEQ ID NO: 1293458 - DNA, 12 bp, Homo sapiens
cctggggctggc

SEQ ID NO: 1293459 - DNA, 16 bp, Homo sapiens
cctggggctggctgca

SEQ ID NO: 1293460 - DNA, 17 bp, Homo sapiens
cctgggtcccagggctg

SEQ ID NO: 1293461 - DNA, 16 bp, Homo sapiens
cctgtgacctggtctg

SEQ ID NO: 1293462 - DNA, 18 bp, Homo sapiens
ccttagcttttagcctgg

SEQ ID NO: 1293463 - DNA, 19 bp, Homo sapiens
ccttagcttttagcctggc

SEQ ID NO: 1293464 - DNA, 18 bp, Homo sapiens
ccttgctcctggaacctg

SEQ ID NO: 1293465 - DNA, 21 bp, Homo sapiens
ccttggtggcaaccccagacc

SEQ ID NO: 1293466 - DNA, 12 bp, Homo sapiens
cgaagcctgagc

SEQ ID NO: 1293467 - DNA, 19 bp, Homo sapiens
cgaagcctgagcaggcagg

SEQ ID NO: 1293468 - DNA, 23 bp, Homo sapiens
cgaatggggtccccctcccactt

SEQ ID NO: 1293469 - DNA, 19 bp, Homo sapiens
cgagctgtcggagggctgg

SEQ ID NO: 1293470 - DNA, 16 bp, Homo sapiens
cgcatgcctcccaggc

SEQ ID NO: 1293471 - DNA, 23 bp, Homo sapiens
cgccgagctgtcggagggctgga

SEQ ID NO: 1293472 - DNA, 14 bp, Homo sapiens
cgccgcgtggacag

SEQ ID NO: 1293473 - DNA, 15 bp, Homo sapiens
cgccgcgtggacagc

SEQ ID NO: 1293474 - DNA, 20 bp, Homo sapiens
cgcctgctacacaggcagga

SEQ ID NO: 1293475 - DNA, 18 bp, Homo sapiens
cgcggatcaaccaggcag

SEQ ID NO: 1293476 - DNA, 19 bp, Homo sapiens
cgcggatcaaccaggcaga

SEQ ID NO: 1293477 - DNA, 16 bp, Homo sapiens
cgcgtggacagccgga

SEQ ID NO: 1293478 - DNA, 18 bp, Homo sapiens
cgcgtggacagccggagc

SEQ ID NO: 1293479 - DNA, 11 bp, Homo sapiens
cggaggccaga

SEQ ID NO: 1293480 - DNA, 19 bp, Homo sapiens
cggaggccagacacaggcc

SEQ ID NO: 1293481 - DNA, 16 bp, Homo sapiens
cggatcaaccaggcag

SEQ ID NO: 1293482 - DNA, 13 bp, Homo sapiens
cggcccctcagcc

SEQ ID NO: 1293483 - DNA, 15 bp, Homo sapiens
cggcccctcagcctg

SEQ ID NO: 1293484 - DNA, 16 bp, Homo sapiens
cggcctggcatgcagc

SEQ ID NO: 1293485 - DNA, 18 bp, Homo sapiens
cggcctggctggccagga

SEQ ID NO: 1293486 - DNA, 20 bp, Homo sapiens
cgggcgcatgcctcccaggc

SEQ ID NO: 1293487 - DNA, 23 bp, Homo sapiens
cgggcgcatgcctcccaggccac

SEQ ID NO: 1293488 - DNA, 16 bp, Homo sapiens
cggggctcactctggc

SEQ ID NO: 1293489 - DNA, 22 bp, Homo sapiens
cggtgtggttgggggtgggagg

SEQ ID NO: 1293490 - DNA, 21 bp, Homo sapiens
cggtttaactgtcccagcgac

SEQ ID NO: 1293491 - DNA, 19 bp, Homo sapiens
ctaaggatttttccatgga

SEQ ID NO: 1293492 - DNA, 19 bp, Homo sapiens
ctaagggagacaggccttt

SEQ ID NO: 1293493 - DNA, 23 bp, Homo sapiens
ctaagggagacaggcctttccct

SEQ ID NO: 1293494 - DNA, 16 bp, Homo sapiens
ctacacaggcaggaat

SEQ ID NO: 1293495 - DNA, 16 bp, Homo sapiens
ctacctcgccgagctg

SEQ ID NO: 1293496 - DNA, 15 bp, Homo sapiens
ctagacccaaccctt

SEQ ID NO: 1293497 - DNA, 22 bp, Homo sapiens
ctatggagcagccggaagtctg

SEQ ID NO: 1293498 - DNA, 22 bp, Homo sapiens
ctatttttgtagatctccatgc

SEQ ID NO: 1293499 - DNA, 17 bp, Homo sapiens
ctcacacacggaggcca

SEQ ID NO: 1293500 - DNA, 16 bp, Homo sapiens
ctcacctgccggctct

SEQ ID NO: 1293501 - DNA, 18 bp, Homo sapiens
ctcacctgccggctctgg

SEQ ID NO: 1293502 - DNA, 19 bp, Homo sapiens
ctcacctgccggctctggg

SEQ ID NO: 1293503 - DNA, 14 bp, Homo sapiens
ctcactctggcccc

SEQ ID NO: 1293504 - DNA, 20 bp, Homo sapiens
ctcagatagacctgtgacct

SEQ ID NO: 1293505 - DNA, 16 bp, Homo sapiens
ctcagcctgcctgaag

SEQ ID NO: 1293506 - DNA, 22 bp, Homo sapiens
ctcagcctgcctgaagagagga

SEQ ID NO: 1293507 - DNA, 15 bp, Homo sapiens
ctcagtctcacctgc

SEQ ID NO: 1293508 - DNA, 22 bp, Homo sapiens
ctcagtctcacctgccggctct

SEQ ID NO: 1293509 - DNA, 16 bp, Homo sapiens
ctccagacacagagac

SEQ ID NO: 1293510 - DNA, 21 bp, Homo sapiens
ctccagctcctctccagacac

SEQ ID NO: 1293511 - DNA, 21 bp, Homo sapiens
ctccatgctttgctctcaagg

SEQ ID NO: 1293512 - DNA, 15 bp, Homo sapiens
ctcccagcctaaggg

SEQ ID NO: 1293513 - DNA, 17 bp, Homo sapiens
ctcccagggctctctgg

SEQ ID NO: 1293514 - DNA, 18 bp, Homo sapiens
ctcccagggctctctgga

SEQ ID NO: 1293515 - DNA, 21 bp, Homo sapiens
ctcccagggctctctggacca

SEQ ID NO: 1293516 - DNA, 16 bp, Homo sapiens
ctcctggaacctggca

SEQ ID NO: 1293517 - DNA, 19 bp, Homo sapiens
ctcctggaacctggcaggc

SEQ ID NO: 1293518 - DNA, 20 bp, Homo sapiens
ctcctggaacctggcaggcc

SEQ ID NO: 1293519 - DNA, 19 bp, Homo sapiens
ctcctgtgttccctttgag

SEQ ID NO: 1293520 - DNA, 18 bp, Homo sapiens
ctcggcctggctggccag

SEQ ID NO: 1293521 - DNA, 15 bp, Homo sapiens
ctcgtgcccttagag

SEQ ID NO: 1293522 - DNA, 13 bp, Homo sapiens
ctctcaaggcttg

SEQ ID NO: 1293523 - DNA, 23 bp, Homo sapiens
ctctcaaggcttggagaggtatg

SEQ ID NO: 1293524 - DNA, 14 bp, Homo sapiens
ctctgggctggctg

SEQ ID NO: 1293525 - DNA, 22 bp, Homo sapiens
ctcttcagctgctgacaatcct

SEQ ID NO: 1293526 - DNA, 12 bp, Homo sapiens
ctctttggggca

SEQ ID NO: 1293527 - DNA, 17 bp, Homo sapiens
ctgaacaagagtgtcta

SEQ ID NO: 1293528 - DNA, 16 bp, Homo sapiens
ctgaagggggcattgc

SEQ ID NO: 1293529 - DNA, 18 bp, Homo sapiens
ctgcgccctgtgcaggga

SEQ ID NO: 1293530 - DNA, 16 bp, Homo sapiens
ctgctacacaggcagg

SEQ ID NO: 1293531 - DNA, 13 bp, Homo sapiens
ctggaacctggca

SEQ ID NO: 1293532 - DNA, 15 bp, Homo sapiens
ctggaacctggcagg

SEQ ID NO: 1293533 - DNA, 17 bp, Homo sapiens
ctggaacctggcaggcc

SEQ ID NO: 1293534 - DNA, 18 bp, Homo sapiens
ctggaacctggcaggccc

SEQ ID NO: 1293535 - DNA, 19 bp, Homo sapiens
ctggaccatacgcggagga

SEQ ID NO: 1293536 - DNA, 13 bp, Homo sapiens
ctggcaggccctg

SEQ ID NO: 1293537 - DNA, 23 bp, Homo sapiens
ctggcaggccctgcccagccagc

SEQ ID NO: 1293538 - DNA, 22 bp, Homo sapiens
ctggccaggacacactgaaaag

SEQ ID NO: 1293539 - DNA, 23 bp, Homo sapiens
ctggccccctattgtctccaagg

SEQ ID NO: 1293540 - DNA, 22 bp, Homo sapiens
ctggccggaaggagactgtggt

SEQ ID NO: 1293541 - DNA, 23 bp, Homo sapiens
ctggccggaaggagactgtggtt

SEQ ID NO: 1293542 - DNA, 14 bp, Homo sapiens
ctggcgaagcctga

SEQ ID NO: 1293543 - DNA, 18 bp, Homo sapiens
ctggcgaagcctgagcag

SEQ ID NO: 1293544 - DNA, 16 bp, Homo sapiens
ctggcgatctcccagg

SEQ ID NO: 1293545 - DNA, 20 bp, Homo sapiens
ctggcgatctcccagggctc

SEQ ID NO: 1293546 - DNA, 22 bp, Homo sapiens
ctggcgatctcccagggctctc

SEQ ID NO: 1293547 - DNA, 21 bp, Homo sapiens
ctggctcagcccgggatcctg

SEQ ID NO: 1293548 - DNA, 13 bp, Homo sapiens
ctggctgctccta

SEQ ID NO: 1293549 - DNA, 12 bp, Homo sapiens
ctgggctggctg

SEQ ID NO: 1293550 - DNA, 15 bp, Homo sapiens
ctggggccttcctgg

SEQ ID NO: 1293551 - DNA, 14 bp, Homo sapiens
ctggggctggctgc

SEQ ID NO: 1293552 - DNA, 13 bp, Homo sapiens
ctgggtcccaggg

SEQ ID NO: 1293553 - DNA, 20 bp, Homo sapiens
ctgggtcccagggctggccc

SEQ ID NO: 1293554 - DNA, 15 bp, Homo sapiens
ctggtcaggcaatgc

SEQ ID NO: 1293555 - DNA, 13 bp, Homo sapiens
ctgtgacctggtc

SEQ ID NO: 1293556 - DNA, 15 bp, Homo sapiens
ctgtgacctggtctg

SEQ ID NO: 1293557 - DNA, 12 bp, Homo sapiens
ctgtgcttggag

SEQ ID NO: 1293558 - DNA, 15 bp, Homo sapiens
ctgtgcttggaggcc

SEQ ID NO: 1293559 - DNA, 17 bp, Homo sapiens
ctgtgcttggaggcctc

SEQ ID NO: 1293560 - DNA, 20 bp, Homo sapiens
ctgtgcttggaggcctcaga

SEQ ID NO: 1293561 - DNA, 21 bp, Homo sapiens
ctgtggcgccgcgtggacagc

SEQ ID NO: 1293562 - DNA, 22 bp, Homo sapiens
ctgtggcgccgcgtggacagcc

SEQ ID NO: 1293563 - DNA, 17 bp, Homo sapiens
ctgtggtcaggcccagc

SEQ ID NO: 1293564 - DNA, 16 bp, Homo sapiens
ctgtgtggtctccagc

SEQ ID NO: 1293565 - DNA, 17 bp, Homo sapiens
ctgtgtggtctccagct

SEQ ID NO: 1293566 - DNA, 19 bp, Homo sapiens
ctgtgtggtctccagctcc

SEQ ID NO: 1293567 - DNA, 17 bp, Homo sapiens
ctgttctcaaagcagaa

SEQ ID NO: 1293568 - DNA, 13 bp, Homo sapiens
cttaaccctgaac

SEQ ID NO: 1293569 - DNA, 15 bp, Homo sapiens
cttcactgcccaggg

SEQ ID NO: 1293570 - DNA, 14 bp, Homo sapiens
cttccagaggagag

SEQ ID NO: 1293571 - DNA, 20 bp, Homo sapiens
cttccagaggagagtggcct

SEQ ID NO: 1293572 - DNA, 22 bp, Homo sapiens
cttccagaggagagtggcctgg

SEQ ID NO: 1293573 - DNA, 13 bp, Homo sapiens
cttcccctcctgt

SEQ ID NO: 1293574 - DNA, 11 bp, Homo sapiens
cttcctggctt

SEQ ID NO: 1293575 - DNA, 20 bp, Homo sapiens
cttctcaccaaacttcatgt

SEQ ID NO: 1293576 - DNA, 11 bp, Homo sapiens
cttctcctgtg

SEQ ID NO: 1293577 - DNA, 21 bp, Homo sapiens
cttcttaaccctgaacaagag

SEQ ID NO: 1293578 - DNA, 17 bp, Homo sapiens
cttgacctgagatgctg

SEQ ID NO: 1293579 - DNA, 18 bp, Homo sapiens
cttgctcctggaacctgg

SEQ ID NO: 1293580 - DNA, 22 bp, Homo sapiens
cttgctcctggaacctggcagg

SEQ ID NO: 1293581 - DNA, 14 bp, Homo sapiens
cttggaggcctcag

SEQ ID NO: 1293582 - DNA, 11 bp, Homo sapiens
cttggccctgc

SEQ ID NO: 1293583 - DNA, 22 bp, Homo sapiens
cttggccctgcgccctgtgcag

SEQ ID NO: 1293584 - DNA, 23 bp, Homo sapiens
cttggctgccccattccagctct

SEQ ID NO: 1293585 - DNA, 18 bp, Homo sapiens
cttgtccttgctcctgga

SEQ ID NO: 1293586 - DNA, 18 bp, Homo sapiens
cttttagcctggctgtca

SEQ ID NO: 1293587 - DNA, 21 bp, Homo sapiens
gaaactggcgatctcccaggg

SEQ ID NO: 1293588 - DNA, 20 bp, Homo sapiens
gaaagggatggtcaggccca

SEQ ID NO: 1293589 - DNA, 13 bp, Homo sapiens
gaaatgggcctca

SEQ ID NO: 1293590 - DNA, 15 bp, Homo sapiens
gaacccccactcaca

SEQ ID NO: 1293591 - DNA, 13 bp, Homo sapiens
gaacctggcaggc

SEQ ID NO: 1293592 - DNA, 17 bp, Homo sapiens
gaacctggcaggccctg

SEQ ID NO: 1293593 - DNA, 19 bp, Homo sapiens
gaacctggcaggccctgcc

SEQ ID NO: 1293594 - DNA, 19 bp, Homo sapiens
gaactgcacaatgaccagc

SEQ ID NO: 1293595 - DNA, 21 bp, Homo sapiens
aaaccagcctggggccttcct

SEQ ID NO: 1293596 - DNA, 18 bp, Homo sapiens
aaactggcgatctcccag

SEQ ID NO: 1293597 - DNA, 16 bp, Homo sapiens
aaagggatggtcaggc

SEQ ID NO: 1293598 - DNA, 13 bp, Homo sapiens
aacatagagaact

SEQ ID NO: 1293599 - DNA, 22 bp, Homo sapiens
aaccccagacccaacccatgcc

SEQ ID NO: 1293600 - DNA, 23 bp, Homo sapiens
aacccttagcttttagcctggct

SEQ ID NO: 1293601 - DNA, 15 bp, Homo sapiens
aacctggcaggccct

SEQ ID NO: 1293602 - DNA, 20 bp, Homo sapiens
aacctggcaggccctgccca

SEQ ID NO: 1293603 - DNA, 19 bp, Homo sapiens
aactggcgaagcctgagca

SEQ ID NO: 1293604 - DNA, 20 bp, Homo sapiens
aactggcgatctcccagggc

SEQ ID NO: 1293605 - DNA, 16 bp, Homo sapiens
aactgtcaccctgagg

SEQ ID NO: 1293606 - DNA, 13 bp, Homo sapiens
aactgtcccagcg

SEQ ID NO: 1293607 - DNA, 17 bp, Homo sapiens
aacttcatcccagctgc

SEQ ID NO: 1293608 - DNA, 12 bp, Homo sapiens
agcctgcctgaa

SEQ ID NO: 1293609 - DNA, 17 bp, Homo sapiens
agcctgcctgaagagag

SEQ ID NO: 1293610 - DNA, 19 bp, Homo sapiens
agcctgcctgaagagagga

SEQ ID NO: 1293611 - DNA, 21 bp, Homo sapiens
agcctgcctgaagagaggaaa

SEQ ID NO: 1293612 - DNA, 19 bp, Homo sapiens
agcctggggccttcctggc

SEQ ID NO: 1293613 - DNA, 23 bp, Homo sapiens
agcctggggccttcctggctttg

SEQ ID NO: 1293614 - DNA, 14 bp, Homo sapiens
agcggagcttggcc

SEQ ID NO: 1293615 - DNA, 17 bp, Homo sapiens
agcggagcttggccctg

SEQ ID NO: 1293616 - DNA, 22 bp, Homo sapiens
agcggagcttggccctgcgccc

SEQ ID NO: 1293617 - DNA, 16 bp, Homo sapiens
agctagacccaaccct

SEQ ID NO: 1293618 - DNA, 17 bp, Homo sapiens
agctggccggaaggaga

SEQ ID NO: 1293619 - DNA, 13 bp, Homo sapiens
agctgtcggaggg

SEQ ID NO: 1293620 - DNA, 12 bp, Homo sapiens
agcttggccctg

SEQ ID NO: 1293621 - DNA, 20 bp, Homo sapiens
agcttggccctgcgccctgt

SEQ ID NO: 1293622 - DNA, 13 bp, Homo sapiens
agcttttagcctg

SEQ ID NO: 1293623 - DNA, 16 bp, Homo sapiens
agcttttagcctggct

SEQ ID NO: 1293624 - DNA, 17 bp, Homo sapiens
agcttttagcctggctg

SEQ ID NO: 1293625 - DNA, 18 bp, Homo sapiens
agcttttagcctggctgt

SEQ ID NO: 1293626 - DNA, 22 bp, Homo sapiens
agcttttagcctggctgtcacc

SEQ ID NO: 1293627 - DNA, 22 bp, Homo sapiens
aggaaactggcgatctcccagg

SEQ ID NO: 1293628 - DNA, 20 bp, Homo sapiens
aggaatgcggttgggaggca

SEQ ID NO: 1293629 - DNA, 22 bp, Homo sapiens
aggacagacatcaagtgccaga

SEQ ID NO: 1293630 - DNA, 17 bp, Homo sapiens
aggacctctttggggca

SEQ ID NO: 1293631 - DNA, 14 bp, Homo sapiens
aggagactgtggtt

SEQ ID NO: 1293632 - DNA, 15 bp, Homo sapiens
aggagagtggcctgg

SEQ ID NO: 1293633 - DNA, 15 bp, Homo sapiens
aggagttttctgtgt

SEQ ID NO: 1293634 - DNA, 23 bp, Homo sapiens
aggcaatgccctgcggctctgga

SEQ ID NO: 1293635 - DNA, 16 bp, Homo sapiens
aggcagagttctgtgg

SEQ ID NO: 1293636 - DNA, 22 bp, Homo sapiens
aggcaggtcgggctgccagccc

SEQ ID NO: 1293637 - DNA, 19 bp, Homo sapiens
aggccagacacaggccgtg

SEQ ID NO: 1293638 - DNA, 17 bp, Homo sapiens
aggcccagcctctctgg

SEQ ID NO: 1293639 - DNA, 16 bp, Homo sapiens
aggccctgcccagcca

SEQ ID NO: 1293640 - DNA, 18 bp, Homo sapiens
aggccctgcccagccagc

SEQ ID NO: 1293641 - DNA, 19 bp, Homo sapiens
aggcctcagatagacctgt

SEQ ID NO: 1293642 - DNA, 21 bp, Homo sapiens
aggcctcagatagacctgtga

SEQ ID NO: 1293643 - DNA, 13 bp, Homo sapiens
aggctcccagcct

SEQ ID NO: 1293644 - DNA, 16 bp, Homo sapiens
aggctcccagcctaag

SEQ ID NO: 1293645 - DNA, 17 bp, Homo sapiens
aggctcccagcctaagg

SEQ ID NO: 1293646 - DNA, 21 bp, Homo sapiens
aggcttccagaggagagtggc

SEQ ID NO: 1293647 - DNA, 23 bp, Homo sapiens
agggaaagggatggtcaggccca

SEQ ID NO: 1293648 - DNA, 13 bp, Homo sapiens
agggagacaggcc

SEQ ID NO: 1293649 - DNA, 14 bp, Homo sapiens
agggagacaggcct

SEQ ID NO: 1293650 - DNA, 14 bp, Homo sapiens
aggggaatgaacca

SEQ ID NO: 1293651 - DNA, 23 bp, Homo sapiens
agggtgcaagccccattcacggc

SEQ ID NO: 1293652 - DNA, 22 bp, Homo sapiens
aggtatgtgcccctcctgggtg

SEQ ID NO: 1293653 - DNA, 22 bp, Homo sapiens
aggtcccattttccccctgtgt

SEQ ID NO: 1293654 - DNA, 17 bp, Homo sapiens
aggtcttcactgcccag

SEQ ID NO: 1293655 - DNA, 20 bp, Homo sapiens
aggtcttgtgaaaaggcttt

SEQ ID NO: 1293656 - DNA, 21 bp, Homo sapiens
aggtgagctagacccaaccct

SEQ ID NO: 1293657 - DNA, 19 bp, Homo sapiens
aggtgcctggggctggctg

SEQ ID NO: 1293658 - DNA, 20 bp, Homo sapiens
agtaagaaatgggcctcagc

SEQ ID NO: 1293659 - DNA, 14 bp, Homo sapiens
agtattatgtttct

SEQ ID NO: 1293660 - DNA, 21 bp, Homo sapiens
agtcctcacacacggaggcca

SEQ ID NO: 1293661 - DNA, 14 bp, Homo sapiens
gagggaaggacaga

SEQ ID NO: 1293662 - DNA, 22 bp, Homo sapiens
gaggtgagctagacccaaccct

SEQ ID NO: 1293663 - DNA, 13 bp, Homo sapiens
gagtggcctgggt

SEQ ID NO: 1293664 - DNA, 17 bp, Homo sapiens
gagtggcctgggtccca

SEQ ID NO: 1293665 - DNA, 18 bp, Homo sapiens
gatagacctgtgacctgg

SEQ ID NO: 1293666 - DNA, 23 bp, Homo sapiens
gatagacctgtgacctggtctgg

SEQ ID NO: 1293667 - DNA, 19 bp, Homo sapiens
gatatttttttacttgagc

SEQ ID NO: 1293668 - DNA, 20 bp, Homo sapiens
gatctcccagggctctctgg

SEQ ID NO: 1293669 - DNA, 21 bp, Homo sapiens
gatctcccagggctctctgga

SEQ ID NO: 1293670 - DNA, 13 bp, Homo sapiens
gatgctgggaggg

SEQ ID NO: 1293671 - DNA, 16 bp, Homo sapiens
gatgctgggagggctg

SEQ ID NO: 1293672 - DNA, 22 bp, Homo sapiens
gatggtcaggcccagttctcgt

SEQ ID NO: 1293673 - DNA, 21 bp, Homo sapiens
gcaacttcatcccagctgctg

SEQ ID NO: 1293674 - DNA, 20 bp, Homo sapiens
gcaagccccattcacggcct

SEQ ID NO: 1293675 - DNA, 19 bp, Homo sapiens
gcaatgccctgcggctctg

SEQ ID NO: 1293676 - DNA, 19 bp, Homo sapiens
gcacaatgaccagcaggag

SEQ ID NO: 1293677 - DNA, 16 bp, Homo sapiens
gcacacacacacagtc

SEQ ID NO: 1293678 - DNA, 16 bp, Homo sapiens
gcacccacacagagga

SEQ ID NO: 1293679 - DNA, 22 bp, Homo sapiens
gcacctttgagagagggggcac

SEQ ID NO: 1293680 - DNA, 16 bp, Homo sapiens
gcactgtggtcaggcc

SEQ ID NO: 1293681 - DNA, 20 bp, Homo sapiens
gcagcctttttcaccatggc

SEQ ID NO: 1293682 - DNA, 22 bp, Homo sapiens
gcaggaatgcggttgggaggca

SEQ ID NO: 1293683 - DNA, 21 bp, Homo sapiens
gcaggcaggggcttggctgcc

SEQ ID NO: 1293684 - DNA, 16 bp, Homo sapiens
gcaggccctgcccagc

SEQ ID NO: 1293685 - DNA, 15 bp, Homo sapiens
gcaggggcttggctg

SEQ ID NO: 1293686 - DNA, 21 bp, Homo sapiens
gcaggtcgggctgccagccca

SEQ ID NO: 1293687 - DNA, 22 bp, Homo sapiens
gcagtcagtcacaaaccagcct

SEQ ID NO: 1293688 - DNA, 14 bp, Homo sapiens
gcatgcctcccagg

SEQ ID NO: 1293689 - DNA, 17 bp, Homo sapiens
gccagacacaggccgtg

SEQ ID NO: 1293690 - DNA, 21 bp, Homo sapiens
gccagccatcggaagagaggg

SEQ ID NO: 1293691 - DNA, 14 bp, Homo sapiens
gccagcccagctgg

SEQ ID NO: 1293692 - DNA, 14 bp, Homo sapiens
gccaggacacactg

SEQ ID NO: 1293693 - DNA, 18 bp, Homo sapiens
gccatggcggcccctcag

SEQ ID NO: 1293694 - DNA, 16 bp, Homo sapiens
gcccagcctctctggc

SEQ ID NO: 1293695 - DNA, 21 bp, Homo sapiens
gcccagcctctctggctcagc

SEQ ID NO: 1293696 - DNA, 14 bp, Homo sapiens
gcccagctggccgg

SEQ ID NO: 1293697 - DNA, 15 bp, Homo sapiens
gcccagctggccgga

SEQ ID NO: 1293698 - DNA, 16 bp, Homo sapiens
gcccagctggccggaa

SEQ ID NO: 1293699 - DNA, 12 bp, Homo sapiens
gccccattccag

SEQ ID NO: 1293700 - DNA, 21 bp, Homo sapiens
gccccattccagctctcccat

SEQ ID NO: 1293701 - DNA, 22 bp, Homo sapiens
gcccctcagcctgcctgaagag

SEQ ID NO: 1293702 - DNA, 14 bp, Homo sapiens
gcccctcctgggtg

SEQ ID NO: 1293703 - DNA, 21 bp, Homo sapiens
gcccgggagctttgagacagg

SEQ ID NO: 1293704 - DNA, 20 bp, Homo sapiens
gcccgggatcctgatggcac

SEQ ID NO: 1293705 - DNA, 15 bp, Homo sapiens
gccctgagccatggc

SEQ ID NO: 1293706 - DNA, 13 bp, Homo sapiens
gccctgcccagcc

SEQ ID NO: 1293707 - DNA, 14 bp, Homo sapiens
gccctgcccagcca

SEQ ID NO: 1293708 - DNA, 14 bp, Homo sapiens
gccctgcgccctgt

SEQ ID NO: 1293709 - DNA, 17 bp, Homo sapiens
gccctgcgccctgtgca

SEQ ID NO: 1293710 - DNA, 14 bp, Homo sapiens
gccctgcggctctg

SEQ ID NO: 1293711 - DNA, 15 bp, Homo sapiens
gccctgcggctctgg

SEQ ID NO: 1293712 - DNA, 16 bp, Homo sapiens
gccctgcggctctgga

SEQ ID NO: 1293713 - DNA, 20 bp, Homo sapiens
gccctgcggctctggaaagc

SEQ ID NO: 1293714 - DNA, 15 bp, Homo sapiens
gcccttagaggggaa

SEQ ID NO: 1293715 - DNA, 20 bp, Homo sapiens
gccgagctgtcggagggctg

SEQ ID NO: 1293716 - DNA, 15 bp, Homo sapiens
gccggaaggagactg

SEQ ID NO: 1293717 - DNA, 16 bp, Homo sapiens
gccggaagtctgttct

SEQ ID NO: 1293718 - DNA, 18 bp, Homo sapiens
gccggagcagttggcctg

SEQ ID NO: 1293719 - DNA, 15 bp, Homo sapiens
gccggctctgggctg

SEQ ID NO: 1293720 - DNA, 18 bp, Homo sapiens
gccggctctgggctggct

SEQ ID NO: 1293721 - DNA, 24 bp, Homo sapiens
gccggctctgggctggctgctcct

SEQ ID NO: 1293722 - DNA, 16 bp, Homo sapiens
gccgtgggacccaggc

SEQ ID NO: 1293723 - DNA, 19 bp, Homo sapiens
gccgtgggacccaggctcc

SEQ ID NO: 1293724 - DNA, 21 bp, Homo sapiens
gcctctctggctcagcccggg

SEQ ID NO: 1293725 - DNA, 18 bp, Homo sapiens
gcctgaagagaggaaact

SEQ ID NO: 1293726 - DNA, 13 bp, Homo sapiens
gcctgagcaggca

SEQ ID NO: 1293727 - DNA, 18 bp, Homo sapiens
gcctgctacacaggcagg

SEQ ID NO: 1293728 - DNA, 14 bp, Homo sapiens
gcctggctgtcacc

SEQ ID NO: 1293729 - DNA, 16 bp, Homo sapiens
gcctggggccttcctg

SEQ ID NO: 1293730 - DNA, 18 bp, Homo sapiens
gcctggggccttcctggc

SEQ ID NO: 1293731 - DNA, 22 bp, Homo sapiens
gcctggggccttcctggctttg

SEQ ID NO: 1293732 - DNA, 16 bp, Homo sapiens
gcctggggctggctgc

SEQ ID NO: 1293733 - DNA, 16 bp, Homo sapiens
gcctgggtcccagggc

SEQ ID NO: 1293734 - DNA, 19 bp, Homo sapiens
gcctgggtcccagggctgg

SEQ ID NO: 1293735 - DNA, 20 bp, Homo sapiens
gcctgggtcccagggctggc

SEQ ID NO: 1293736 - DNA, 12 bp, Homo sapiens
gcctgtgcttgg

SEQ ID NO: 1293737 - DNA, 16 bp, Homo sapiens
gcctgtgcttggaggc

SEQ ID NO: 1293738 - DNA, 20 bp, Homo sapiens
gcctgtgcttggaggcctca

SEQ ID NO: 1293739 - DNA, 17 bp, Homo sapiens
gccttcctggctttggg

SEQ ID NO: 1293740 - DNA, 20 bp, Homo sapiens
gcgaagcctgagcaggcagg

SEQ ID NO: 1293741 - DNA, 19 bp, Homo sapiens
gtggtcaggcccagcctct

SEQ ID NO: 1293742 - DNA, 22 bp, Homo sapiens
gtggtctccagctcctctccag

SEQ ID NO: 1293743 - DNA, 16 bp, Homo sapiens
gtgtctatggagcagc

SEQ ID NO: 1293744 - DNA, 16 bp, Homo sapiens
gtgtggctcccacagg

SEQ ID NO: 1293745 - DNA, 22 bp, Homo sapiens
gtgtggctcccacaggtcttca

SEQ ID NO: 1293746 - DNA, 13 bp, Homo sapiens
gtgtgtggacagc

SEQ ID NO: 1293747 - DNA, 15 bp, Homo sapiens
gtgtgtgtggacagc

SEQ ID NO: 1293748 - DNA, 15 bp, Homo sapiens
gttcaccagccctga

SEQ ID NO: 1293749 - DNA, 23 bp, Homo sapiens
gttcaccagccctgagccatggc

SEQ ID NO: 1293750 - DNA, 14 bp, Homo sapiens
gttctcgtgccctt

SEQ ID NO: 1293751 - DNA, 15 bp, Homo sapiens
gttctcttctcctgt

SEQ ID NO: 1293752 - DNA, 20 bp, Homo sapiens
gtttcttcttgtcaccccag

SEQ ID NO: 1293753 - DNA, 23 bp, Homo sapiens
taaatgcagtcagtcacaaacca

SEQ ID NO: 1293754 - DNA, 16 bp, Homo sapiens
taacagggtcaactgg

SEQ ID NO: 1293755 - DNA, 15 bp, Homo sapiens
taactgtcccagcga

SEQ ID NO: 1293756 - DNA, 21 bp, Homo sapiens
taagaagttcaccagccctga

SEQ ID NO: 1293757 - DNA, 22 bp, Homo sapiens
taagaagttcaccagccctgag

SEQ ID NO: 1293758 - DNA, 13 bp, Homo sapiens
tacacaggcagga

SEQ ID NO: 1293759 - DNA, 23 bp, Homo sapiens
tactagtccaatcacccccagga

SEQ ID NO: 1293760 - DNA, 20 bp, Homo sapiens
tagacctgtgacctggtctg

SEQ ID NO: 1293761 - DNA, 20 bp, Homo sapiens
tagagaactgtcaccctgag

SEQ ID NO: 1293762 - DNA, 18 bp, Homo sapiens
gcttggccctgcgccctg

SEQ ID NO: 1293763 - DNA, 24 bp, Homo sapiens
gcttggccctgcgccctgtgcagg

SEQ ID NO: 1293764 - DNA, 19 bp, Homo sapiens
gcttgtccttgctcctgga

SEQ ID NO: 1293765 - DNA, 21 bp, Homo sapiens
gcttgtccttgctcctggaac

SEQ ID NO: 1293766 - DNA, 19 bp, Homo sapiens
gctttgagacaggtgcctg

SEQ ID NO: 1293767 - DNA, 21 bp, Homo sapiens
gctttgagacaggtgcctggg

SEQ ID NO: 1293768 - DNA, 19 bp, Homo sapiens
gctttgctctcaaggcttg

SEQ ID NO: 1293769 - DNA, 14 bp, Homo sapiens
gcttttagcctggc

SEQ ID NO: 1293770 - DNA, 21 bp, Homo sapiens
ggaaagcaacttcatcccagc

SEQ ID NO: 1293771 - DNA, 21 bp, Homo sapiens
ggaaagggatggtcaggccca

SEQ ID NO: 1293772 - DNA, 12 bp, Homo sapiens
ggaaatcctatt

SEQ ID NO: 1293773 - DNA, 17 bp, Homo sapiens
ggaacctggcaggccct

SEQ ID NO: 1293774 - DNA, 19 bp, Homo sapiens
ggaacctggcaggccctgc

SEQ ID NO: 1293775 - DNA, 19 bp, Homo sapiens
ggaagagagggctgagcca

SEQ ID NO: 1293776 - DNA, 22 bp, Homo sapiens
ggaagagagggctgagccatgg

SEQ ID NO: 1293777 - DNA, 15 bp, Homo sapiens
ggaaggagactgtgg

SEQ ID NO: 1293778 - DNA, 16 bp, Homo sapiens
ggaatgaaccatggca

SEQ ID NO: 1293779 - DNA, 19 bp, Homo sapiens
ggaatgcggttgggaggca

SEQ ID NO: 1293780 - DNA, 21 bp, Homo sapiens
ggaatgcggttgggaggcagg

SEQ ID NO: 1293781 - DNA, 21 bp, Homo sapiens
ggacacaagggtgcaagcccc

SEQ ID NO: 1293782 - DNA, 13 bp, Homo sapiens
ggacatgggcagc

SEQ ID NO: 1293783 - DNA, 11 bp, Homo sapiens
ggacccaggct

SEQ ID NO: 1293784 - DNA, 12 bp, Homo sapiens
ggacccaggctc

SEQ ID NO: 1293785 - DNA, 12 bp, Homo sapiens
ggagacaggcct

SEQ ID NO: 1293786 - DNA, 20 bp, Homo sapiens
ggagacaggcctttccctgc

SEQ ID NO: 1293787 - DNA, 17 bp, Homo sapiens
ggagagtggcctgggtc

SEQ ID NO: 1293788 - DNA, 15 bp, Homo sapiens
ggagcagttggcctg

SEQ ID NO: 1293789 - DNA, 16 bp, Homo sapiens
ggagcagttggcctgt

SEQ ID NO: 1293790 - DNA, 14 bp, Homo sapiens
ggagcggagcttgg

SEQ ID NO: 1293791 - DNA, 15 bp, Homo sapiens
ggagcggagcttggc

SEQ ID NO: 1293792 - DNA, 19 bp, Homo sapiens
ggagcggagcttggccctg

SEQ ID NO: 1293793 - DNA, 17 bp, Homo sapiens
ggagcttggccctgcgc

SEQ ID NO: 1293794 - DNA, 21 bp, Homo sapiens
ggagcttggccctgcgccctg

SEQ ID NO: 1293795 - DNA, 20 bp, Homo sapiens
ggaggagttttctgtgtggt

SEQ ID NO: 1293796 - DNA, 20 bp, Homo sapiens
ggaggccagacacaggccgt

SEQ ID NO: 1293797 - DNA, 19 bp, Homo sapiens
ggagtaagaaatgggcctc

SEQ ID NO: 1293798 - DNA, 17 bp, Homo sapiens
ggatcaaccaggcagag

SEQ ID NO: 1293799 - DNA, 23 bp, Homo sapiens
ggatcaaccaggcagagttctgt

SEQ ID NO: 1293800 - DNA, 11 bp, Homo sapiens
ggatggtcagg

SEQ ID NO: 1293801 - DNA, 15 bp, Homo sapiens
ggatggtcaggccca

SEQ ID NO: 1293802 - DNA, 14 bp, Homo sapiens
ggcaatgccctgcg

SEQ ID NO: 1293803 - DNA, 20 bp, Homo sapiens
ggcaatgccctgcggctctg

SEQ ID NO: 1293804 - DNA, 21 bp, Homo sapiens
ggcacccacacagaggacctc

SEQ ID NO: 1293805 - DNA, 16 bp, Homo sapiens
ggcactgtggtcaggc

SEQ ID NO: 1293806 - DNA, 19 bp, Homo sapiens
ggcactgtggtcaggccca

SEQ ID NO: 1293807 - DNA, 22 bp, Homo sapiens
ggcaggaatgcggttgggaggc

SEQ ID NO: 1293808 - DNA, 11 bp, Homo sapiens
ggcaggccctg

SEQ ID NO: 1293809 - DNA, 13 bp, Homo sapiens
ggcaggccctgcc

SEQ ID NO: 1293810 - DNA, 15 bp, Homo sapiens
ggcaggccctgccca

SEQ ID NO: 1293811 - DNA, 16 bp, Homo sapiens
ggcaggccctgcccag

SEQ ID NO: 1293812 - DNA, 20 bp, Homo sapiens
ggcaggccctgcccagccag

SEQ ID NO: 1293813 - DNA, 21 bp, Homo sapiens
ggcaggccctgcccagccagc

SEQ ID NO: 1293814 - DNA, 22 bp, Homo sapiens
ggcaggccctgcccagccagcc

SEQ ID NO: 1293815 - DNA, 19 bp, Homo sapiens
ggcaggggcttggctgccc

SEQ ID NO: 1293816 - DNA, 18 bp, Homo sapiens
ggcaggtcgggctgccag

SEQ ID NO: 1293817 - DNA, 20 bp, Homo sapiens
ggcaggtcgggctgccagcc

SEQ ID NO: 1293818 - DNA, 18 bp, Homo sapiens
ggcagtgctgaagggggc

SEQ ID NO: 1293819 - DNA, 13 bp, Homo sapiens
ggcatgcagcttg

SEQ ID NO: 1293820 - DNA, 17 bp, Homo sapiens
ggccagacacaggccgt

SEQ ID NO: 1293821 - DNA, 18 bp, Homo sapiens
ggccagacacaggccgtg

SEQ ID NO: 1293822 - DNA, 20 bp, Homo sapiens
ggccagacacaggccgtggg

SEQ ID NO: 1293823 - DNA, 17 bp, Homo sapiens
ggcccagcctctctggc

SEQ ID NO: 1293824 - DNA, 23 bp, Homo sapiens
ggcccagcctctctggctcagcc

SEQ ID NO: 1293825 - DNA, 20 bp, Homo sapiens
ggcccagttctcgtgccctt

SEQ ID NO: 1293826 - DNA, 13 bp, Homo sapiens
ggccctaggcact

SEQ ID NO: 1293827 - DNA, 13 bp, Homo sapiens
ggccctgcccagc

SEQ ID NO: 1293828 - DNA, 14 bp, Homo sapiens
ggccctgcgccctg

SEQ ID NO: 1293829 - DNA, 16 bp, Homo sapiens
ggccctgcgccctgtg

SEQ ID NO: 1293830 - DNA, 18 bp, Homo sapiens
ggccgtgggacccaggct

SEQ ID NO: 1293831 - DNA, 19 bp, Homo sapiens
ggccgtgggacccaggctc

SEQ ID NO: 1293832 - DNA, 20 bp, Homo sapiens
ggccgtgggacccaggctcc

SEQ ID NO: 1293833 - DNA, 14 bp, Homo sapiens
ggcctggcatgcag

SEQ ID NO: 1293834 - DNA, 16 bp, Homo sapiens
ggcctggcatgcagct

SEQ ID NO: 1293835 - DNA, 15 bp, Homo sapiens
ggcctggctggccag

SEQ ID NO: 1293836 - DNA, 17 bp, Homo sapiens
ggcctggctggccagga

SEQ ID NO: 1293837 - DNA, 17 bp, Homo sapiens
ggcctgtgcttggaggc

SEQ ID NO: 1293838 - DNA, 20 bp, Homo sapiens
ggcctgtgcttggaggcctc

SEQ ID NO: 1293839 - DNA, 15 bp, Homo sapiens
ggcctttccctgccg

SEQ ID NO: 1293840 - DNA, 22 bp, Homo sapiens
ggcgaagcctgagcaggcaggg

SEQ ID NO: 1293841 - DNA, 16 bp, Homo sapiens
ggcgatctcccagggc

SEQ ID NO: 1293842 - DNA, 18 bp, Homo sapiens
ggcgatctcccagggctc

SEQ ID NO: 1293843 - DNA, 22 bp, Homo sapiens
ggcgatctcccagggctctctg

SEQ ID NO: 1293844 - DNA, 16 bp, Homo sapiens
ggcgcatgcctcccag

SEQ ID NO: 1293845 - DNA, 21 bp, Homo sapiens
atctcccagggctctctggac

SEQ ID NO: 1293846 - DNA, 22 bp, Homo sapiens
atctcccagggctctctggacc

SEQ ID NO: 1293847 - DNA, 17 bp, Homo sapiens
atgaccagcaggaggga

SEQ ID NO: 1293848 - DNA, 22 bp, Homo sapiens
atgcagcttgtccttgctcctg

SEQ ID NO: 1293849 - DNA, 24 bp, Homo sapiens
atgcagcttgtccttgctcctgga

SEQ ID NO: 1293850 - DNA, 13 bp, Homo sapiens
atgcccctgacag

SEQ ID NO: 1293851 - DNA, 15 bp, Homo sapiens
atgccctgcggctct

SEQ ID NO: 1293852 - DNA, 16 bp, Homo sapiens
atgccctgcggctctg

SEQ ID NO: 1293853 - DNA, 21 bp, Homo sapiens
atgctttgctctcaaggcttg

SEQ ID NO: 1293854 - DNA, 14 bp, Homo sapiens
atggacatgggcag

SEQ ID NO: 1293855 - DNA, 16 bp, Homo sapiens
atggacatgggcagca

SEQ ID NO: 1293856 - DNA, 14 bp, Homo sapiens
atggagcccctcca

SEQ ID NO: 1293857 - DNA, 18 bp, Homo sapiens
atgggcagcaattcacgc

SEQ ID NO: 1293858 - DNA, 12 bp, Homo sapiens
atgggcctcagc

SEQ ID NO: 1293859 - DNA, 15 bp, Homo sapiens
attcacggcctggca

SEQ ID NO: 1293860 - DNA, 19 bp, Homo sapiens
attccagctctcccatgga

SEQ ID NO: 1293861 - DNA, 18 bp, Homo sapiens
caaaccagcctggggcct

SEQ ID NO: 1293862 - DNA, 17 bp, Homo sapiens
caaacctaaatgcagtc

SEQ ID NO: 1293863 - DNA, 13 bp, Homo sapiens
caaccaggcagag

SEQ ID NO: 1293864 - DNA, 19 bp, Homo sapiens
caaccaggcagagttctgt

SEQ ID NO: 1293865 - DNA, 19 bp, Homo sapiens
caactggcgaagcctgagc

SEQ ID NO: 1293866 - DNA, 13 bp, Homo sapiens
caagatccaggtg

SEQ ID NO: 1293867 - DNA, 17 bp, Homo sapiens
caagatccaggtggtcc

SEQ ID NO: 1293868 - DNA, 22 bp, Homo sapiens
caagcacacacacacagtcctc

SEQ ID NO: 1293869 - DNA, 19 bp, Homo sapiens
caaggatggggttcttgtc

SEQ ID NO: 1293870 - DNA, 17 bp, Homo sapiens
caatcacccccaggacc

SEQ ID NO: 1293871 - DNA, 21 bp, Homo sapiens
caatcacccccaggacctctt

SEQ ID NO: 1293872 - DNA, 17 bp, Homo sapiens
caatgaccagcaggagg

SEQ ID NO: 1293873 - DNA, 11 bp, Homo sapiens
caatgccctgc

SEQ ID NO: 1293874 - DNA, 15 bp, Homo sapiens
cacaaaccagcctgg

SEQ ID NO: 1293875 - DNA, 17 bp, Homo sapiens
cacaaaccagcctgggg

SEQ ID NO: 1293876 - DNA, 17 bp, Homo sapiens
cacacagaggacctctt

SEQ ID NO: 1293877 - DNA, 16 bp, Homo sapiens
cacacggaggccagac

SEQ ID NO: 1293878 - DNA, 13 bp, Homo sapiens
cacagaggacctc

SEQ ID NO: 1293879 - DNA, 16 bp, Homo sapiens
cacagaggacctcttt

SEQ ID NO: 1293880 - DNA, 15 bp, Homo sapiens
cacaggccgtgggac

SEQ ID NO: 1293881 - DNA, 22 bp, Homo sapiens
cacaggccgtgggacccaggct

SEQ ID NO: 1293882 - DNA, 21 bp, Homo sapiens
cacaggtcttcactgcccagg

SEQ ID NO: 1293883 - DNA, 13 bp, Homo sapiens
caccagccctgag

SEQ ID NO: 1293884 - DNA, 13 bp, Homo sapiens
cacccccaggacc

SEQ ID NO: 1293885 - DNA, 23 bp, Homo sapiens
caccgggcgcatgcctcccaggc

SEQ ID NO: 1293886 - DNA, 18 bp, Homo sapiens
cacctcagtctcacctgc

SEQ ID NO: 1293887 - DNA, 14 bp, Homo sapiens
cacctttgagagag

SEQ ID NO: 1293888 - DNA, 13 bp, Homo sapiens
cacggaggccaga

SEQ ID NO: 1293889 - DNA, 16 bp, Homo sapiens
cacggcctggcatgca

SEQ ID NO: 1293890 - DNA, 18 bp, Homo sapiens
cacggggctcactctggc

SEQ ID NO: 1293891 - DNA, 21 bp, Homo sapiens
cactgatagttgccttttctt

SEQ ID NO: 1293892 - DNA, 16 bp, Homo sapiens
cactgtggtcaggccc

SEQ ID NO: 1293893 - DNA, 18 bp, Homo sapiens
cactgtggtcaggcccag

SEQ ID NO: 1293894 - DNA, 21 bp, Homo sapiens
cactgtggtcaggcccagcct

SEQ ID NO: 1293895 - DNA, 14 bp, Homo sapiens
cacttgacctgaga

SEQ ID NO: 1293896 - DNA, 24 bp, Homo sapiens
cacttgacctgagatgctgggagg

SEQ ID NO: 1293897 - DNA, 13 bp, Homo sapiens
cagaactgcacaa

SEQ ID NO: 1293898 - DNA, 14 bp, Homo sapiens
cagacacaggccgt

SEQ ID NO: 1293899 - DNA, 17 bp, Homo sapiens
cagacccaacccatgcc

SEQ ID NO: 1293900 - DNA, 20 bp, Homo sapiens
cagaggagagtggcctgggt

SEQ ID NO: 1293901 - DNA, 15 bp, Homo sapiens
cagatctagttctct

SEQ ID NO: 1293902 - DNA, 20 bp, Homo sapiens
cagcaattcacgctgtctct

SEQ ID NO: 1293903 - DNA, 16 bp, Homo sapiens
cagccatcggaagaga

SEQ ID NO: 1293904 - DNA, 18 bp, Homo sapiens
cagccatcggaagagagg

SEQ ID NO: 1293905 - DNA, 20 bp, Homo sapiens
cagccatcggaagagagggc

SEQ ID NO: 1293906 - DNA, 22 bp, Homo sapiens
cagccatcggaagagagggctg

SEQ ID NO: 1293907 - DNA, 16 bp, Homo sapiens
cagcccagctggccgg

SEQ ID NO: 1293908 - DNA, 18 bp, Homo sapiens
cagcccagctggccggaa

SEQ ID NO: 1293909 - DNA, 21 bp, Homo sapiens
cagccccgcggatcaaccagg

SEQ ID NO: 1293910 - DNA, 23 bp, Homo sapiens
cagccccgcggatcaaccaggca

SEQ ID NO: 1293911 - DNA, 15 bp, Homo sapiens
cagcccgggatcctg

SEQ ID NO: 1293912 - DNA, 17 bp, Homo sapiens
cagcctaagggagacag

SEQ ID NO: 1293913 - DNA, 22 bp, Homo sapiens
cagcctaagggagacaggcctt

SEQ ID NO: 1293914 - DNA, 15 bp, Homo sapiens
cagcctctctggctc

SEQ ID NO: 1293915 - DNA, 16 bp, Homo sapiens
cagcctctctggctca

SEQ ID NO: 1293916 - DNA, 20 bp, Homo sapiens
cagcctgcctgaagagagga

SEQ ID NO: 1293917 - DNA, 21 bp, Homo sapiens
cagcctgcctgaagagaggaa

SEQ ID NO: 1293918 - DNA, 19 bp, Homo sapiens
cagcctttttcaccatggc

SEQ ID NO: 1293919 - DNA, 13 bp, Homo sapiens
cagctcctctcca

SEQ ID NO: 1293920 - DNA, 22 bp, Homo sapiens
cagctcctctccagacacagag

SEQ ID NO: 1293921 - DNA, 14 bp, Homo sapiens
cagctctcccatgg

SEQ ID NO: 1293922 - DNA, 17 bp, Homo sapiens
cagctgctgacaatcct

SEQ ID NO: 1293923 - DNA, 15 bp, Homo sapiens
cagctggccggaagg

SEQ ID NO: 1293924 - DNA, 16 bp, Homo sapiens
cagcttgtccttgctc

SEQ ID NO: 1293925 - DNA, 18 bp, Homo sapiens
cagcttgtccttgctcct

SEQ ID NO: 1293926 - DNA, 20 bp, Homo sapiens
cagcttgtccttgctcctgg

SEQ ID NO: 1293927 - DNA, 21 bp, Homo sapiens
caggaatgcggttgggaggca

SEQ ID NO: 1293928 - DNA, 19 bp, Homo sapiens
caggacctcttcagctgct

SEQ ID NO: 1293929 - DNA, 21 bp, Homo sapiens
caggacctcttcagctgctga

SEQ ID NO: 1293930 - DNA, 14 bp, Homo sapiens
caggcagagttctg

SEQ ID NO: 1293931 - DNA, 19 bp, Homo sapiens
caggcaggggcttggctgc

SEQ ID NO: 1293932 - DNA, 23 bp, Homo sapiens
caggcaggggcttggctgcccca

SEQ ID NO: 1293933 - DNA, 12 bp, Homo sapiens
caggcccagcct

SEQ ID NO: 1293934 - DNA, 18 bp, Homo sapiens
caggcccagcctctctgg

SEQ ID NO: 1293935 - DNA, 19 bp, Homo sapiens
caggcccagcctctctggc

SEQ ID NO: 1293936 - DNA, 18 bp, Homo sapiens
caggccctgcccagccag

SEQ ID NO: 1293937 - DNA, 12 bp, Homo sapiens
cagggctggccc

SEQ ID NO: 1293938 - DNA, 19 bp, Homo sapiens
cagggctggccctaggcac

SEQ ID NO: 1293939 - DNA, 14 bp, Homo sapiens
caggggcttggctg

SEQ ID NO: 1293940 - DNA, 15 bp, Homo sapiens
caggtcgggctgcca

SEQ ID NO: 1293941 - DNA, 17 bp, Homo sapiens
caggtcgggctgccagc

SEQ ID NO: 1293942 - DNA, 20 bp, Homo sapiens
caggtcgggctgccagccca

SEQ ID NO: 1293943 - DNA, 19 bp, Homo sapiens
caggtcttcactgcccagg

SEQ ID NO: 1293944 - DNA, 20 bp, Homo sapiens
caggtcttcactgcccaggg

SEQ ID NO: 1293945 - DNA, 21 bp, Homo sapiens
caggtgcctggggctggctgc

SEQ ID NO: 1293946 - DNA, 15 bp, Homo sapiens
caggtggtcccatag

SEQ ID NO: 1293947 - DNA, 21 bp, Homo sapiens
caggtggtcccataggtcttg

SEQ ID NO: 1293948 - DNA, 17 bp, Homo sapiens
cagtcacaaaccagcct

SEQ ID NO: 1293949 - DNA, 20 bp, Homo sapiens
cagtcacaaaccagcctggg

SEQ ID NO: 1293950 - DNA, 24 bp, Homo sapiens
cagtcctcacacacggaggccaga

SEQ ID NO: 1293951 - DNA, 20 bp, Homo sapiens
cagtctcacctgccggctct

SEQ ID NO: 1293952 - DNA, 17 bp, Homo sapiens
cagtgctgaagggggca

SEQ ID NO: 1293953 - DNA, 13 bp, Homo sapiens
cagtgtggctccc

SEQ ID NO: 1293954 - DNA, 17 bp, Homo sapiens
cagttctcgtgccctta

SEQ ID NO: 1293955 - DNA, 22 bp, Homo sapiens
cagttggcctgtgcttggaggc

SEQ ID NO: 1293956 - DNA, 12 bp, Homo sapiens
ctgcggctctgg

SEQ ID NO: 1293957 - DNA, 13 bp, Homo sapiens
ctgcggctctgga

SEQ ID NO: 1293958 - DNA, 16 bp, Homo sapiens
ctgcggctctggaaag

SEQ ID NO: 1293959 - DNA, 17 bp, Homo sapiens
ctgcggctctggaaagc

SEQ ID NO: 1293960 - DNA, 14 bp, Homo sapiens
ctgctacacaggca

SEQ ID NO: 1293961 - DNA, 14 bp, Homo sapiens
ctgctgacaatcct

SEQ ID NO: 1293962 - DNA, 23 bp, Homo sapiens
ctggaaagcaacttcatcccagc

SEQ ID NO: 1293963 - DNA, 19 bp, Homo sapiens
ctggaacctggcaggccct

SEQ ID NO: 1293964 - DNA, 14 bp, Homo sapiens
ctggcaggccctgc

SEQ ID NO: 1293965 - DNA, 20 bp, Homo sapiens
ctggcaggccctgcccagcc

SEQ ID NO: 1293966 - DNA, 21 bp, Homo sapiens
ctggccaggacacactgaaaa

SEQ ID NO: 1293967 - DNA, 16 bp, Homo sapiens
ctggcgaagcctgagc

SEQ ID NO: 1293968 - DNA, 15 bp, Homo sapiens
ctggcgatctcccag

SEQ ID NO: 1293969 - DNA, 15 bp, Homo sapiens
ctggctgctcctaac

SEQ ID NO: 1293970 - DNA, 15 bp, Homo sapiens
ctggctggccaggac

SEQ ID NO: 1293971 - DNA, 15 bp, Homo sapiens
ctgggagggctgaac

SEQ ID NO: 1293972 - DNA, 15 bp, Homo sapiens
ctgggctggctgctc

SEQ ID NO: 1293973 - DNA, 18 bp, Homo sapiens
ctggggccttcctggctt

SEQ ID NO: 1293974 - DNA, 21 bp, Homo sapiens
ctggggccttcctggctttgg

SEQ ID NO: 1293975 - DNA, 16 bp, Homo sapiens
ctggggctggctgcag

SEQ ID NO: 1293976 - DNA, 12 bp, Homo sapiens
ctgggtcccagg

SEQ ID NO: 1293977 - DNA, 15 bp, Homo sapiens
ctgggtcccagggct

SEQ ID NO: 1293978 - DNA, 21 bp, Homo sapiens
ctgggtcccagggctggccct

SEQ ID NO: 1293979 - DNA, 17 bp, Homo sapiens
ctgggtgctcaccgcct

SEQ ID NO: 1293980 - DNA, 19 bp, Homo sapiens
ctggtcaggcaatgccctg

SEQ ID NO: 1293981 - DNA, 20 bp, Homo sapiens
ctggtcaggcaatgccctgc

SEQ ID NO: 1293982 - DNA, 22 bp, Homo sapiens
ctggtcaggcaatgccctgcgg

SEQ ID NO: 1293983 - DNA, 23 bp, Homo sapiens
ctggtcaggcaatgccctgcggc

SEQ ID NO: 1293984 - DNA, 14 bp, Homo sapiens
ctggtctggtcagg

SEQ ID NO: 1293985 - DNA, 16 bp, Homo sapiens
ctggtctggtcaggca

SEQ ID NO: 1293986 - DNA, 17 bp, Homo sapiens
ctggtctggtcaggcaa

SEQ ID NO: 1293987 - DNA, 14 bp, Homo sapiens
ctgtcaccctgagg

SEQ ID NO: 1293988 - DNA, 15 bp, Homo sapiens
ctgtcaccctgaggt

SEQ ID NO: 1293989 - DNA, 11 bp, Homo sapiens
ctgtcccagcg

SEQ ID NO: 1293990 - DNA, 14 bp, Homo sapiens
ctgtcggagggctg

SEQ ID NO: 1293991 - DNA, 15 bp, Homo sapiens
ctgtcggagggctgg

SEQ ID NO: 1293992 - DNA, 22 bp, Homo sapiens
ctgtctcttcttaaccctgaac

SEQ ID NO: 1293993 - DNA, 18 bp, Homo sapiens
ctgtgcttggaggcctca

SEQ ID NO: 1293994 - DNA, 16 bp, Homo sapiens
ctgtggtcaggcccag

SEQ ID NO: 1293995 - DNA, 14 bp, Homo sapiens
ctgtgtggtctcca

SEQ ID NO: 1293996 - DNA, 19 bp, Homo sapiens
cttagaggggaatgaacca

SEQ ID NO: 1293997 - DNA, 18 bp, Homo sapiens
cttagcttttagcctggc

SEQ ID NO: 1293998 - DNA, 12 bp, Homo sapiens
cttcagctgctg

SEQ ID NO: 1293999 - DNA, 13 bp, Homo sapiens
cttcatcccagct

SEQ ID NO: 1294000 - DNA, 16 bp, Homo sapiens
cttcatcccagctgct

SEQ ID NO: 1294001 - DNA, 17 bp, Homo sapiens
cttcatcccagctgctg

SEQ ID NO: 1294002 - DNA, 18 bp, Homo sapiens
cttcatcccagctgctga

SEQ ID NO: 1294003 - DNA, 13 bp, Homo sapiens
cttccagaggaga

SEQ ID NO: 1294004 - DNA, 13 bp, Homo sapiens
cttcctggctttg

SEQ ID NO: 1294005 - DNA, 17 bp, Homo sapiens
cttcttaaccctgaaca

SEQ ID NO: 1294006 - DNA, 18 bp, Homo sapiens
cttcttaaccctgaacaa

SEQ ID NO: 1294007 - DNA, 19 bp, Homo sapiens
cttgagcaaagaactaagg

SEQ ID NO: 1294008 - DNA, 23 bp, Homo sapiens
cttgctcctggaacctggcaggc

SEQ ID NO: 1294009 - DNA, 13 bp, Homo sapiens
cttggaggcctca

SEQ ID NO: 1294010 - DNA, 12 bp, Homo sapiens
cttggccctgcg

SEQ ID NO: 1294011 - DNA, 16 bp, Homo sapiens
cttggccctgcgccct

SEQ ID NO: 1294012 - DNA, 19 bp, Homo sapiens
cttggccctgcgccctgtg

SEQ ID NO: 1294013 - DNA, 23 bp, Homo sapiens
cttggccctgcgccctgtgcagg

SEQ ID NO: 1294014 - DNA, 20 bp, Homo sapiens
cttggctgccccattccagc

SEQ ID NO: 1294015 - DNA, 11 bp, Homo sapiens
cttggtggcaa

SEQ ID NO: 1294016 - DNA, 20 bp, Homo sapiens
ctttgagacaggtgcctggg

SEQ ID NO: 1294017 - DNA, 21 bp, Homo sapiens
ctttgagacaggtgcctgggg

SEQ ID NO: 1294018 - DNA, 15 bp, Homo sapiens
ctttgagtccagtgt

SEQ ID NO: 1294019 - DNA, 20 bp, Homo sapiens
ctttgctctcaaggcttgga

SEQ ID NO: 1294020 - DNA, 13 bp, Homo sapiens
cttttcttcccct

SEQ ID NO: 1294021 - DNA, 23 bp, Homo sapiens
gaaactggcgatctcccagggct

SEQ ID NO: 1294022 - DNA, 16 bp, Homo sapiens
gaaagggatggtcagg

SEQ ID NO: 1294023 - DNA, 14 bp, Homo sapiens
gaaatgggcctcag

SEQ ID NO: 1294024 - DNA, 12 bp, Homo sapiens
gaacccccactc

SEQ ID NO: 1294025 - DNA, 12 bp, Homo sapiens
gaacctggcagg

SEQ ID NO: 1294026 - DNA, 21 bp, Homo sapiens
gaacctggcaggccctgccca

SEQ ID NO: 1294027 - DNA, 14 bp, Homo sapiens
gaactgcacaatga

SEQ ID NO: 1294028 - DNA, 15 bp, Homo sapiens
gaactgtcaccctga

SEQ ID NO: 1294029 - DNA, 18 bp, Homo sapiens
gaactgtcaccctgaggt

SEQ ID NO: 1294030 - DNA, 13 bp, Homo sapiens
gaagagagggctg

SEQ ID NO: 1294031 - DNA, 21 bp, Homo sapiens
gaagagagggctgagccatgg

SEQ ID NO: 1294032 - DNA, 19 bp, Homo sapiens
gaagtggaatccagtgtgg

SEQ ID NO: 1294033 - DNA, 16 bp, Homo sapiens
gaagttcaccagccct

SEQ ID NO: 1294034 - DNA, 18 bp, Homo sapiens
gaagttcaccagccctga

SEQ ID NO: 1294035 - DNA, 24 bp, Homo sapiens
gaagttcaccagccctgagccatg

SEQ ID NO: 1294036 - DNA, 18 bp, Homo sapiens
gaatccagtgtggctccc

SEQ ID NO: 1294037 - DNA, 19 bp, Homo sapiens
gaatccagtgtggctccca

SEQ ID NO: 1294038 - DNA, 19 bp, Homo sapiens
gaatgggctttcataaatt

SEQ ID NO: 1294039 - DNA, 22 bp, Homo sapiens
gacacggtttaactgtcccagc

SEQ ID NO: 1294040 - DNA, 23 bp, Homo sapiens
gacacggtttaactgtcccagcg

SEQ ID NO: 1294041 - DNA, 19 bp, Homo sapiens
gacagacatcaagtgccag

SEQ ID NO: 1294042 - DNA, 14 bp, Homo sapiens
gacaggtgcctggg

SEQ ID NO: 1294043 - DNA, 21 bp, Homo sapiens
gacaggtgcctggggctggct

SEQ ID NO: 1294044 - DNA, 13 bp, Homo sapiens
gacccaggctccc

SEQ ID NO: 1294045 - DNA, 18 bp, Homo sapiens
gacccaggctcccagcct

SEQ ID NO: 1294046 - DNA, 17 bp, Homo sapiens
gacctcttcagctgctg

SEQ ID NO: 1294047 - DNA, 15 bp, Homo sapiens
gacctggtctggtca

SEQ ID NO: 1294048 - DNA, 17 bp, Homo sapiens
gacctggtctggtcagg

SEQ ID NO: 1294049 - DNA, 20 bp, Homo sapiens
gacctggtctggtcaggcaa

SEQ ID NO: 1294050 - DNA, 15 bp, Homo sapiens
gacctgtgacctggt

SEQ ID NO: 1294051 - DNA, 18 bp, Homo sapiens
gacctgtgacctggtctg

SEQ ID NO: 1294052 - DNA, 15 bp, Homo sapiens
gagacaggtgcctgg

SEQ ID NO: 1294053 - DNA, 23 bp, Homo sapiens
gagacaggtgcctggggctggct

SEQ ID NO: 1294054 - DNA, 13 bp, Homo sapiens
gagagagggggca

SEQ ID NO: 1294055 - DNA, 14 bp, Homo sapiens
gagagtggcctggg

SEQ ID NO: 1294056 - DNA, 15 bp, Homo sapiens
gagagtggcctgggt

SEQ ID NO: 1294057 - DNA, 16 bp, Homo sapiens
gagagtggcctgggtc

SEQ ID NO: 1294058 - DNA, 18 bp, Homo sapiens
gagcaggcaggggcttgg

SEQ ID NO: 1294059 - DNA, 14 bp, Homo sapiens
gagcagttggcctg

SEQ ID NO: 1294060 - DNA, 16 bp, Homo sapiens
gagccatggcggcccc

SEQ ID NO: 1294061 - DNA, 20 bp, Homo sapiens
gagccatggcggcccctcag

SEQ ID NO: 1294062 - DNA, 17 bp, Homo sapiens
gagcggagcttggccct

SEQ ID NO: 1294063 - DNA, 15 bp, Homo sapiens
gagctgtcggagggc

SEQ ID NO: 1294064 - DNA, 14 bp, Homo sapiens
gagcttggccctgc

SEQ ID NO: 1294065 - DNA, 15 bp, Homo sapiens
gagcttggccctgcg

SEQ ID NO: 1294066 - DNA, 22 bp, Homo sapiens
gagctttgagacaggtgcctgg

SEQ ID NO: 1294067 - DNA, 23 bp, Homo sapiens
gagctttgagacaggtgcctggg

SEQ ID NO: 1294068 - DNA, 17 bp, Homo sapiens
gcctttttcaccatggc

SEQ ID NO: 1294069 - DNA, 23 bp, Homo sapiens
gcctttttcaccatggcaaacct

SEQ ID NO: 1294070 - DNA, 14 bp, Homo sapiens
gcgaagcctgagca

SEQ ID NO: 1294071 - DNA, 20 bp, Homo sapiens
gcgcatgcctcccaggccac

SEQ ID NO: 1294072 - DNA, 15 bp, Homo sapiens
gcgccctgtgcaggg

SEQ ID NO: 1294073 - DNA, 17 bp, Homo sapiens
gcgccgcgtggacagcc

SEQ ID NO: 1294074 - DNA, 22 bp, Homo sapiens
gcgccgcgtggacagccggagc

SEQ ID NO: 1294075 - DNA, 17 bp, Homo sapiens
gcggatcaaccaggcag

SEQ ID NO: 1294076 - DNA, 20 bp, Homo sapiens
gcggatcaaccaggcagagt

SEQ ID NO: 1294077 - DNA, 17 bp, Homo sapiens
gcgtggacagccggagc

SEQ ID NO: 1294078 - DNA, 14 bp, Homo sapiens
gctcaccgcctgct

SEQ ID NO: 1294079 - DNA, 15 bp, Homo sapiens
gctcactctggcccc

SEQ ID NO: 1294080 - DNA, 16 bp, Homo sapiens
gctcctaacctacctc

SEQ ID NO: 1294081 - DNA, 13 bp, Homo sapiens
gctcctggaacct

SEQ ID NO: 1294082 - DNA, 18 bp, Homo sapiens
gctcctggaacctggcag

SEQ ID NO: 1294083 - DNA, 20 bp, Homo sapiens
gctcctggaacctggcaggc

SEQ ID NO: 1294084 - DNA, 22 bp, Homo sapiens
gctcctggaacctggcaggccc

SEQ ID NO: 1294085 - DNA, 15 bp, Homo sapiens
gctctcaaggcttgg

SEQ ID NO: 1294086 - DNA, 16 bp, Homo sapiens
gctctcaaggcttgga

SEQ ID NO: 1294087 - DNA, 15 bp, Homo sapiens
gctctgggctggctg

SEQ ID NO: 1294088 - DNA, 19 bp, Homo sapiens
gctctgggctggctgctcc

SEQ ID NO: 1294089 - DNA, 21 bp, Homo sapiens
gctctgggctggctgctccta

SEQ ID NO: 1294090 - DNA, 19 bp, Homo sapiens
gctgccagcccagctggcc

SEQ ID NO: 1294091 - DNA, 13 bp, Homo sapiens
gctgctgaggcga

SEQ ID NO: 1294092 - DNA, 20 bp, Homo sapiens
gctggacatttgtggcagtg

SEQ ID NO: 1294093 - DNA, 12 bp, Homo sapiens
gctggccaggac

SEQ ID NO: 1294094 - DNA, 14 bp, Homo sapiens
gctggccaggacac

SEQ ID NO: 1294095 - DNA, 16 bp, Homo sapiens
gctggccaggacacac

SEQ ID NO: 1294096 - DNA, 12 bp, Homo sapiens
gctggccctagg

SEQ ID NO: 1294097 - DNA, 18 bp, Homo sapiens
gctggccctaggcactga

SEQ ID NO: 1294098 - DNA, 15 bp, Homo sapiens
gctgtcggagggctg

SEQ ID NO: 1294099 - DNA, 23 bp, Homo sapiens
gctgtctcttcttaaccctgaac

SEQ ID NO: 1294100 - DNA, 13 bp, Homo sapiens
gcttccagaggag

SEQ ID NO: 1294101 - DNA, 12 bp, Homo sapiens
gcttggaggcct

SEQ ID NO: 1294102 - DNA, 16 bp, Homo sapiens
gcttggaggcctcaga

SEQ ID NO: 1294103 - DNA, 22 bp, Homo sapiens
gcttggccctgcgccctgtgca

SEQ ID NO: 1294104 - DNA, 17 bp, Homo sapiens
gcttgtccttgctcctg

SEQ ID NO: 1294105 - DNA, 22 bp, Homo sapiens
gctttgagacaggtgcctgggg

SEQ ID NO: 1294106 - DNA, 16 bp, Homo sapiens
gctttgctctcaaggc

SEQ ID NO: 1294107 - DNA, 15 bp, Homo sapiens
gcttttagcctggct

SEQ ID NO: 1294108 - DNA, 16 bp, Homo sapiens
gcttttagcctggctg

SEQ ID NO: 1294109 - DNA, 22 bp, Homo sapiens
ggaaactggcgatctcccaggg

SEQ ID NO: 1294110 - DNA, 17 bp, Homo sapiens
ggaaagggatggtcagg

SEQ ID NO: 1294111 - DNA, 18 bp, Homo sapiens
ggaaagggatggtcaggc

SEQ ID NO: 1294112 - DNA, 15 bp, Homo sapiens
ggaacctggcaggcc

SEQ ID NO: 1294113 - DNA, 18 bp, Homo sapiens
ggaacctggcaggccctg

SEQ ID NO: 1294114 - DNA, 13 bp, Homo sapiens
ggaagagagggct

SEQ ID NO: 1294115 - DNA, 15 bp, Homo sapiens
ggaagagagggctga

SEQ ID NO: 1294116 - DNA, 21 bp, Homo sapiens
ggaagagagggctgagccatg

SEQ ID NO: 1294117 - DNA, 19 bp, Homo sapiens
ggaatccagtgtggctccc

SEQ ID NO: 1294118 - DNA, 24 bp, Homo sapiens
ggaatccagtgtggctcccacagg

SEQ ID NO: 1294119 - DNA, 17 bp, Homo sapiens
ggaatgaaccatggcac

SEQ ID NO: 1294120 - DNA, 19 bp, Homo sapiens
ggaatgaaccatggcacct

SEQ ID NO: 1294121 - DNA, 20 bp, Homo sapiens
ggaatgcggttgggaggcag

SEQ ID NO: 1294122 - DNA, 21 bp, Homo sapiens
ggacacggtttaactgtccca

SEQ ID NO: 1294123 - DNA, 22 bp, Homo sapiens
ggacacggtttaactgtcccag

SEQ ID NO: 1294124 - DNA, 14 bp, Homo sapiens
ggacagcccgggag

SEQ ID NO: 1294125 - DNA, 16 bp, Homo sapiens
ggacagccggagcagt

SEQ ID NO: 1294126 - DNA, 14 bp, Homo sapiens
ggacatgggcagca

SEQ ID NO: 1294127 - DNA, 13 bp, Homo sapiens
ggacccaggctcc

SEQ ID NO: 1294128 - DNA, 17 bp, Homo sapiens
ggacccaggctcccagc

SEQ ID NO: 1294129 - DNA, 18 bp, Homo sapiens
ggacccaggctcccagcc

SEQ ID NO: 1294130 - DNA, 18 bp, Homo sapiens
ggacctcttcagctgctg

SEQ ID NO: 1294131 - DNA, 13 bp, Homo sapiens
ggagagtggcctg

SEQ ID NO: 1294132 - DNA, 16 bp, Homo sapiens
ggagagtggcctgggt

SEQ ID NO: 1294133 - DNA, 23 bp, Homo sapiens
ggagagtggcctgggtcccaggg

SEQ ID NO: 1294134 - DNA, 13 bp, Homo sapiens
ggagcagttggcc

SEQ ID NO: 1294135 - DNA, 17 bp, Homo sapiens
ggagcagttggcctgtg

SEQ ID NO: 1294136 - DNA, 18 bp, Homo sapiens
ggagcagttggcctgtgc

SEQ ID NO: 1294137 - DNA, 17 bp, Homo sapiens
ggagcggagcttggccc

SEQ ID NO: 1294138 - DNA, 13 bp, Homo sapiens
ggagcttggccct

SEQ ID NO: 1294139 - DNA, 18 bp, Homo sapiens
ggagctttgagacaggtg

SEQ ID NO: 1294140 - DNA, 22 bp, Homo sapiens
ggagctttgagacaggtgcctg

SEQ ID NO: 1294141 - DNA, 18 bp, Homo sapiens
ggaggagttttctgtgtg

SEQ ID NO: 1294142 - DNA, 15 bp, Homo sapiens
ggaggcaggtcgggc

SEQ ID NO: 1294143 - DNA, 22 bp, Homo sapiens
ggaggcaggtcgggctgccagc

SEQ ID NO: 1294144 - DNA, 12 bp, Homo sapiens
ggaggccagaca

SEQ ID NO: 1294145 - DNA, 18 bp, Homo sapiens
ggagtggggagcggagct

SEQ ID NO: 1294146 - DNA, 20 bp, Homo sapiens
ggagttttctgtgtggtctc

SEQ ID NO: 1294147 - DNA, 13 bp, Homo sapiens
ggatggtcaggcc

SEQ ID NO: 1294148 - DNA, 16 bp, Homo sapiens
ggatggtcaggcccag

SEQ ID NO: 1294149 - DNA, 23 bp, Homo sapiens
ggatggtcaggcccagttctcgt

SEQ ID NO: 1294150 - DNA, 14 bp, Homo sapiens
ggcaaccccagacc

SEQ ID NO: 1294151 - DNA, 17 bp, Homo sapiens
ggcaatgccctgcggct

SEQ ID NO: 1294152 - DNA, 23 bp, Homo sapiens
ggcaatgccctgcggctctggaa

SEQ ID NO: 1294153 - DNA, 14 bp, Homo sapiens
ggcactgtggtcag

SEQ ID NO: 1294154 - DNA, 23 bp, Homo sapiens
ggcactgtggtcaggcccagcct

SEQ ID NO: 1294155 - DNA, 13 bp, Homo sapiens
ggcagagttctgt

SEQ ID NO: 1294156 - DNA, 13 bp, Homo sapiens
ggcaggaatgcgg

SEQ ID NO: 1294157 - DNA, 12 bp, Homo sapiens
ggcaggccctgc

SEQ ID NO: 1294158 - DNA, 14 bp, Homo sapiens
ggcaggccctgccc

SEQ ID NO: 1294159 - DNA, 20 bp, Homo sapiens
ggcaggggcttggctgcccc

SEQ ID NO: 1294160 - DNA, 22 bp, Homo sapiens
ggcaggtcgggctgccagccca

SEQ ID NO: 1294161 - DNA, 15 bp, Homo sapiens
ggcagtgctgaaggg

SEQ ID NO: 1294162 - DNA, 14 bp, Homo sapiens
ggccacctcagtct

SEQ ID NO: 1294163 - DNA, 22 bp, Homo sapiens
ggccagacacaggccgtgggac

SEQ ID NO: 1294164 - DNA, 15 bp, Homo sapiens
ggccctgcccagcca

SEQ ID NO: 1294165 - DNA, 16 bp, Homo sapiens
ggccctgcccagccag

SEQ ID NO: 1294166 - DNA, 12 bp, Homo sapiens
ggccctgcgccc

SEQ ID NO: 1294167 - DNA, 16 bp, Homo sapiens
ggccgtgggacccagg

SEQ ID NO: 1294168 - DNA, 19 bp, Homo sapiens
ggcctcagatagacctgtg

SEQ ID NO: 1294169 - DNA, 14 bp, Homo sapiens
ggcctcagccccgc

SEQ ID NO: 1294170 - DNA, 10 bp, Homo sapiens
ggcctggctg

SEQ ID NO: 1294171 - DNA, 16 bp, Homo sapiens
ggcctggctggccagg

SEQ ID NO: 1294172 - DNA, 18 bp, Homo sapiens
ggcctgggtcccagggct

SEQ ID NO: 1294173 - DNA, 19 bp, Homo sapiens
ggcctgtgcttggaggcct

SEQ ID NO: 1294174 - DNA, 22 bp, Homo sapiens
ggcctgtgcttggaggcctcag

SEQ ID NO: 1294175 - DNA, 23 bp, Homo sapiens
ggcctgtgcttggaggcctcaga

SEQ ID NO: 1294176 - DNA, 13 bp, Homo sapiens
ggcctttccctgc

SEQ ID NO: 1294177 - DNA, 14 bp, Homo sapiens
ggcgaagcctgagc

SEQ ID NO: 1294178 - DNA, 13 bp, Homo sapiens
ggcgatctcccag

SEQ ID NO: 1294179 - DNA, 15 bp, Homo sapiens
ggcgatctcccaggg

SEQ ID NO: 1294180 - DNA, 18 bp, Homo sapiens
tggcgccgcgtggacagc

SEQ ID NO: 1294181 - DNA, 18 bp, Homo sapiens
tggcggcccctcagcctg

SEQ ID NO: 1294182 - DNA, 19 bp, Homo sapiens
tggctgccccattccagct

SEQ ID NO: 1294183 - DNA, 21 bp, Homo sapiens
tggctgccccattccagctct

SEQ ID NO: 1294184 - DNA, 15 bp, Homo sapiens
tggctggccaggaca

SEQ ID NO: 1294185 - DNA, 14 bp, Homo sapiens
tgggacccaggctc

SEQ ID NO: 1294186 - DNA, 15 bp, Homo sapiens
tgggacccaggctcc

SEQ ID NO: 1294187 - DNA, 12 bp, Homo sapiens
tgggaggcaggt

SEQ ID NO: 1294188 - DNA, 19 bp, Homo sapiens
tgggaggcaggtcgggctg

SEQ ID NO: 1294189 - DNA, 22 bp, Homo sapiens
tgggaggcaggtcgggctgcca

SEQ ID NO: 1294190 - DNA, 13 bp, Homo sapiens
tgggagtggggag

SEQ ID NO: 1294191 - DNA, 19 bp, Homo sapiens
tgggcagcaattcacgctg

SEQ ID NO: 1294192 - DNA, 12 bp, Homo sapiens
tgggcctcagcc

SEQ ID NO: 1294193 - DNA, 14 bp, Homo sapiens
tgggcctcagcccc

SEQ ID NO: 1294194 - DNA, 16 bp, Homo sapiens
tgggcctcagccccgc

SEQ ID NO: 1294195 - DNA, 15 bp, Homo sapiens
tggggcaagatccag

SEQ ID NO: 1294196 - DNA, 18 bp, Homo sapiens
tggggcaagatccaggtg

SEQ ID NO: 1294197 - DNA, 16 bp, Homo sapiens
tggggccttcctggct

SEQ ID NO: 1294198 - DNA, 20 bp, Homo sapiens
tggggccttcctggctttgg

SEQ ID NO: 1294199 - DNA, 15 bp, Homo sapiens
tggggctggctgcag

SEQ ID NO: 1294200 - DNA, 13 bp, Homo sapiens
tgggggtgggagg

SEQ ID NO: 1294201 - DNA, 17 bp, Homo sapiens
tgggtcccagggctggc

SEQ ID NO: 1294202 - DNA, 20 bp, Homo sapiens
tgggtcccagggctggccct

SEQ ID NO: 1294203 - DNA, 13 bp, Homo sapiens
tggtcaggcccag

SEQ ID NO: 1294204 - DNA, 15 bp, Homo sapiens
tggtctggtcaggca

SEQ ID NO: 1294205 - DNA, 15 bp, Homo sapiens
tgtcacctttttaat

SEQ ID NO: 1294206 - DNA, 14 bp, Homo sapiens
tgtccttgctcctg

SEQ ID NO: 1294207 - DNA, 18 bp, Homo sapiens
tgtcggagggctggacat

SEQ ID NO: 1294208 - DNA, 14 bp, Homo sapiens
tgtgaaaaggcttt

SEQ ID NO: 1294209 - DNA, 19 bp, Homo sapiens
tgtgacctggtctggtcag

SEQ ID NO: 1294210 - DNA, 23 bp, Homo sapiens
tgtgacctggtctggtcaggcaa

SEQ ID NO: 1294211 - DNA, 14 bp, Homo sapiens
tgtgcccctcctgg

SEQ ID NO: 1294212 - DNA, 16 bp, Homo sapiens
tgtggacagcccggga

SEQ ID NO: 1294213 - DNA, 12 bp, Homo sapiens
tgtggtcaggcc

SEQ ID NO: 1294214 - DNA, 18 bp, Homo sapiens
tgtggtcaggcccagcct

SEQ ID NO: 1294215 - DNA, 20 bp, Homo sapiens
tgtggttgggggtgggaggt

SEQ ID NO: 1294216 - DNA, 18 bp, Homo sapiens
tgtgtggtctccagctcc

SEQ ID NO: 1294217 - DNA, 20 bp, Homo sapiens
tgttctcaaagcagaagtgg

SEQ ID NO: 1294218 - DNA, 18 bp, Homo sapiens
ttagcatatgcaaatctt

SEQ ID NO: 1294219 - DNA, 18 bp, Homo sapiens
ttcacgctgtctcttctt

SEQ ID NO: 1294220 - DNA, 13 bp, Homo sapiens
ttcacggcctggc

SEQ ID NO: 1294221 - DNA, 15 bp, Homo sapiens
ttcagctgctgacaa

SEQ ID NO: 1294222 - DNA, 12 bp, Homo sapiens
ttctccaagtgg

SEQ ID NO: 1294223 - DNA, 22 bp, Homo sapiens
ttctgtgtggtctccagctcct

SEQ ID NO: 1294224 - DNA, 19 bp, Homo sapiens
ttcttgtcaccccagttcc

SEQ ID NO: 1294225 - DNA, 11 bp, Homo sapiens
ttgagagaggg

SEQ ID NO: 1294226 - DNA, 13 bp, Homo sapiens
ttgagtccagtgt

SEQ ID NO: 1294227 - DNA, 14 bp, Homo sapiens
ttggaggcctcaga

SEQ ID NO: 1294228 - DNA, 15 bp, Homo sapiens
ttggccctgcgccct

SEQ ID NO: 1294229 - DNA, 23 bp, Homo sapiens
ttgtccacggggctcactctggc

SEQ ID NO: 1294230 - DNA, 19 bp, Homo sapiens
ttgtccttgctcctggaac

SEQ ID NO: 1294231 - DNA, 15 bp, Homo sapiens
ttgtggcagtgctga

SEQ ID NO: 1294232 - DNA, 13 bp, Homo sapiens
tttagcctggctg

SEQ ID NO: 1294233 - DNA, 12 bp, Homo sapiens
tttgagagaggg

SEQ ID NO: 1294234 - DNA, 15 bp, Homo sapiens
tttgagtccagtgtg

SEQ ID NO: 1294235 - DNA, 17 bp, Homo sapiens
tttgatatttttttact

SEQ ID NO: 1294236 - DNA, 14 bp, Homo sapiens
ttttacttgagcaa

SEQ ID NO: 1294237 - DNA, 13 bp, Homo sapiens
ttttagcctggct

SEQ ID NO: 1294238 - DNA, 12 bp, Homo sapiens
gcgatctcccag

SEQ ID NO: 1294239 - DNA, 13 bp, Homo sapiens
gcgatctcccagg

SEQ ID NO: 1294240 - DNA, 14 bp, Homo sapiens
gcgcatgcctccca

SEQ ID NO: 1294241 - DNA, 17 bp, Homo sapiens
gcgcatgcctcccaggc

SEQ ID NO: 1294242 - DNA, 14 bp, Homo sapiens
gcgccctgtgcagg

SEQ ID NO: 1294243 - DNA, 15 bp, Homo sapiens
gcggagcttggccct

SEQ ID NO: 1294244 - DNA, 14 bp, Homo sapiens
gcggttgggaggca

SEQ ID NO: 1294245 - DNA, 15 bp, Homo sapiens
gcggttgggaggcag

SEQ ID NO: 1294246 - DNA, 16 bp, Homo sapiens
gcggttgggaggcagg

SEQ ID NO: 1294247 - DNA, 17 bp, Homo sapiens
gcggttgggaggcaggt

SEQ ID NO: 1294248 - DNA, 13 bp, Homo sapiens
gcgtggacagccg

SEQ ID NO: 1294249 - DNA, 21 bp, Homo sapiens
gctaagaagttcaccagccct

SEQ ID NO: 1294250 - DNA, 23 bp, Homo sapiens
gctaagaagttcaccagccctga

SEQ ID NO: 1294251 - DNA, 24 bp, Homo sapiens
gctcaccgcctgctacacaggcag

SEQ ID NO: 1294252 - DNA, 11 bp, Homo sapiens
gctcccagcct

SEQ ID NO: 1294253 - DNA, 17 bp, Homo sapiens
gctcctggaacctggca

SEQ ID NO: 1294254 - DNA, 21 bp, Homo sapiens
gctctcaaggcttggagaggt

SEQ ID NO: 1294255 - DNA, 16 bp, Homo sapiens
gctctgggctggctgc

SEQ ID NO: 1294256 - DNA, 20 bp, Homo sapiens
gctgagccatgggggtttgg

SEQ ID NO: 1294257 - DNA, 21 bp, Homo sapiens
gctgccagcccagctggccgg

SEQ ID NO: 1294258 - DNA, 17 bp, Homo sapiens
gctgccccattccagct

SEQ ID NO: 1294259 - DNA, 20 bp, Homo sapiens
gctgccccattccagctctc

SEQ ID NO: 1294260 - DNA, 13 bp, Homo sapiens
gctggccaggaca

SEQ ID NO: 1294261 - DNA, 15 bp, Homo sapiens
gctggccctaggcac

SEQ ID NO: 1294262 - DNA, 17 bp, Homo sapiens
gctggccctaggcactg

SEQ ID NO: 1294263 - DNA, 19 bp, Homo sapiens
gctggccggaaggagactg

SEQ ID NO: 1294264 - DNA, 14 bp, Homo sapiens
gctgtcggagggct

SEQ ID NO: 1294265 - DNA, 16 bp, Homo sapiens
gctgtcggagggctgg

SEQ ID NO: 1294266 - DNA, 20 bp, Homo sapiens
gcttccagaggagagtggcc

SEQ ID NO: 1294267 - DNA, 14 bp, Homo sapiens
gcttggaggcctca

SEQ ID NO: 1294268 - DNA, 18 bp, Homo sapiens
ggctggccctaggcactg

SEQ ID NO: 1294269 - DNA, 14 bp, Homo sapiens
ggctggctgcagac

SEQ ID NO: 1294270 - DNA, 20 bp, Homo sapiens
ggctggctgctcctaaccta

SEQ ID NO: 1294271 - DNA, 22 bp, Homo sapiens
ggcttggagaggtatgtgcccc

SEQ ID NO: 1294272 - DNA, 15 bp, Homo sapiens
ggcttggctgcccca

SEQ ID NO: 1294273 - DNA, 16 bp, Homo sapiens
ggctttgggagtaaga

SEQ ID NO: 1294274 - DNA, 22 bp, Homo sapiens
gggacacggtttaactgtccca

SEQ ID NO: 1294275 - DNA, 17 bp, Homo sapiens
gggacccaggctcccag

SEQ ID NO: 1294276 - DNA, 15 bp, Homo sapiens
gggagcggagcttgg

SEQ ID NO: 1294277 - DNA, 20 bp, Homo sapiens
gggagcggagcttggccctg

SEQ ID NO: 1294278 - DNA, 11 bp, Homo sapiens
gggaggcaggt

SEQ ID NO: 1294279 - DNA, 12 bp, Homo sapiens
gggaggcaggtc

SEQ ID NO: 1294280 - DNA, 15 bp, Homo sapiens
gggaggtgagctaga

SEQ ID NO: 1294281 - DNA, 23 bp, Homo sapiens
gggagtaagaaatgggcctcagc

SEQ ID NO: 1294282 - DNA, 16 bp, Homo sapiens
gggatggtcaggccca

SEQ ID NO: 1294283 - DNA, 13 bp, Homo sapiens
gggcactgtggtc

SEQ ID NO: 1294284 - DNA, 14 bp, Homo sapiens
gggcactgtggtca

SEQ ID NO: 1294285 - DNA, 16 bp, Homo sapiens
gggcactgtggtcagg

SEQ ID NO: 1294286 - DNA, 17 bp, Homo sapiens
gggcactgtggtcaggc

SEQ ID NO: 1294287 - DNA, 20 bp, Homo sapiens
gggcactgtggtcaggccca

SEQ ID NO: 1294288 - DNA, 22 bp, Homo sapiens
gggcactgtggtcaggcccagc

SEQ ID NO: 1294289 - DNA, 14 bp, Homo sapiens
gggccttcctggct

SEQ ID NO: 1294290 - DNA, 15 bp, Homo sapiens
gggccttcctggctt

SEQ ID NO: 1294291 - DNA, 21 bp, Homo sapiens
gggcgcatgcctcccaggcca

SEQ ID NO: 1294292 - DNA, 22 bp, Homo sapiens
gggcgcatgcctcccaggccac

SEQ ID NO: 1294293 - DNA, 14 bp, Homo sapiens
gggctctctggacc

SEQ ID NO: 1294294 - DNA, 15 bp, Homo sapiens
gggctctctggacca

SEQ ID NO: 1294295 - DNA, 14 bp, Homo sapiens
gggctgagccatgg

SEQ ID NO: 1294296 - DNA, 15 bp, Homo sapiens
gggctgagccatggg

SEQ ID NO: 1294297 - DNA, 18 bp, Homo sapiens
gggctgccagcccagctg

SEQ ID NO: 1294298 - DNA, 19 bp, Homo sapiens
gggctgccagcccagctgg

SEQ ID NO: 1294299 - DNA, 15 bp, Homo sapiens
gggctggctgctcct

SEQ ID NO: 1294300 - DNA, 15 bp, Homo sapiens
gggcttggctgcccc

SEQ ID NO: 1294301 - DNA, 18 bp, Homo sapiens
ggggagcggagcttggcc

SEQ ID NO: 1294302 - DNA, 22 bp, Homo sapiens
ggggagcggagcttggccctgc

SEQ ID NO: 1294303 - DNA, 18 bp, Homo sapiens
ggggcaagatccaggtgg

SEQ ID NO: 1294304 - DNA, 18 bp, Homo sapiens
ggggccttcctggctttg

SEQ ID NO: 1294305 - DNA, 20 bp, Homo sapiens
gggggcactgtggtcaggcc

SEQ ID NO: 1294306 - DNA, 17 bp, Homo sapiens
ggggtcgaatggggtcc

SEQ ID NO: 1294307 - DNA, 18 bp, Homo sapiens
gggtcccagggctggccc

SEQ ID NO: 1294308 - DNA, 21 bp, Homo sapiens
gggtcccagggctggccctag

SEQ ID NO: 1294309 - DNA, 17 bp, Homo sapiens
gggtccccctcccactt

SEQ ID NO: 1294310 - DNA, 14 bp, Homo sapiens
ggtcaggcccagcc

SEQ ID NO: 1294311 - DNA, 14 bp, Homo sapiens
ggtcccagggctgg

SEQ ID NO: 1294312 - DNA, 19 bp, Homo sapiens
ggtcccagggctggcccta

SEQ ID NO: 1294313 - DNA, 18 bp, Homo sapiens
ggtcccattttccccctg

SEQ ID NO: 1294314 - DNA, 14 bp, Homo sapiens
ggtctccagctcct

SEQ ID NO: 1294315 - DNA, 14 bp, Homo sapiens
ggtctggtcaggca

SEQ ID NO: 1294316 - DNA, 15 bp, Homo sapiens
ggtctggtcaggcaa

SEQ ID NO: 1294317 - DNA, 23 bp, Homo sapiens
ggtctggtcaggcaatgccctgc

SEQ ID NO: 1294318 - DNA, 16 bp, Homo sapiens
ggtcttcactgcccag

SEQ ID NO: 1294319 - DNA, 17 bp, Homo sapiens
ggtgctcaccgcctgct

SEQ ID NO: 1294320 - DNA, 13 bp, Homo sapiens
ggttgggaggcag

SEQ ID NO: 1294321 - DNA, 16 bp, Homo sapiens
gtatgtgcccctcctg

SEQ ID NO: 1294322 - DNA, 18 bp, Homo sapiens
gtatgtgcccctcctggg

SEQ ID NO: 1294323 - DNA, 16 bp, Homo sapiens
gtcacaaaccagcctg

SEQ ID NO: 1294324 - DNA, 12 bp, Homo sapiens
gtcaccctgagg

SEQ ID NO: 1294325 - DNA, 17 bp, Homo sapiens
gtcaggcaatgccctgc

SEQ ID NO: 1294326 - DNA, 15 bp, Homo sapiens
gtcagtcacaaacca

SEQ ID NO: 1294327 - DNA, 21 bp, Homo sapiens
gtcagtcacaaaccagcctgg

SEQ ID NO: 1294328 - DNA, 22 bp, Homo sapiens
gtcagtcacaaaccagcctggg

SEQ ID NO: 1294329 - DNA, 19 bp, Homo sapiens
gtccacggggctcactctg

SEQ ID NO: 1294330 - DNA, 20 bp, Homo sapiens
gtccacggggctcactctgg

SEQ ID NO: 1294331 - DNA, 21 bp, Homo sapiens
gtcccagggctggccctaggc

SEQ ID NO: 1294332 - DNA, 21 bp, Homo sapiens
gtcccattttccccctgtgtt

SEQ ID NO: 1294333 - DNA, 18 bp, Homo sapiens
gtcctcacacacggaggc

SEQ ID NO: 1294334 - DNA, 21 bp, Homo sapiens
gtcctcacacacggaggccag

SEQ ID NO: 1294335 - DNA, 22 bp, Homo sapiens
gtcctcacacacggaggccaga

SEQ ID NO: 1294336 - DNA, 15 bp, Homo sapiens
gtcggagggctggac

SEQ ID NO: 1294337 - DNA, 15 bp, Homo sapiens
gtcgggctgccagcc

SEQ ID NO: 1294338 - DNA, 14 bp, Homo sapiens
gtctatggagcagc

SEQ ID NO: 1294339 - DNA, 18 bp, Homo sapiens
gtctcacctgccggctct

SEQ ID NO: 1294340 - DNA, 19 bp, Homo sapiens
gtctccagctcctctccag

SEQ ID NO: 1294341 - DNA, 13 bp, Homo sapiens
gtctggtcaggca

SEQ ID NO: 1294342 - DNA, 21 bp, Homo sapiens
gtctggtcaggcaatgccctg

SEQ ID NO: 1294343 - DNA, 17 bp, Homo sapiens
gtgacctggtctggtca

SEQ ID NO: 1294344 - DNA, 23 bp, Homo sapiens
gtgacctggtctggtcaggcaat

SEQ ID NO: 1294345 - DNA, 13 bp, Homo sapiens
gtgcttggaggcc

SEQ ID NO: 1294346 - DNA, 16 bp, Homo sapiens
gtgcttggaggcctca

SEQ ID NO: 1294347 - DNA, 14 bp, Homo sapiens
gtggacagcccggg

SEQ ID NO: 1294348 - DNA, 19 bp, Homo sapiens
gtggcctgggtcccagggc

SEQ ID NO: 1294349 - DNA, 16 bp, Homo sapiens
gtgggacccaggctcc

SEQ ID NO: 1294350 - DNA, 17 bp, Homo sapiens
gtgggacccaggctccc

SEQ ID NO: 1294351 - DNA, 19 bp, Homo sapiens
gtgggacccaggctcccag

SEQ ID NO: 1294352 - DNA, 13 bp, Homo sapiens
gtggggagcggag

SEQ ID NO: 1294353 - DNA, 15 bp, Homo sapiens
gtggggagcggagct

SEQ ID NO: 1294354 - DNA, 19 bp, Homo sapiens
gtggggagcggagcttggc

SEQ ID NO: 1294355 - DNA, 13 bp, Homo sapiens
gtggtcaggccca

SEQ ID NO: 1294356 - DNA, 19 bp, Homo sapiens
ccctgcggctctggaaagc

SEQ ID NO: 1294357 - DNA, 14 bp, Homo sapiens
cccttagaggggaa

SEQ ID NO: 1294358 - DNA, 17 bp, Homo sapiens
ccgagctgtcggagggc

SEQ ID NO: 1294359 - DNA, 23 bp, Homo sapiens
ccgagctgtcggagggctggaca

SEQ ID NO: 1294360 - DNA, 18 bp, Homo sapiens
ccgcggatcaaccaggca

SEQ ID NO: 1294361 - DNA, 21 bp, Homo sapiens
ccgcggatcaaccaggcagag

SEQ ID NO: 1294362 - DNA, 13 bp, Homo sapiens
ccgggcgcatgcc

SEQ ID NO: 1294363 - DNA, 14 bp, Homo sapiens
ccgggcgcatgcct

SEQ ID NO: 1294364 - DNA, 20 bp, Homo sapiens
ccgggcgcatgcctcccagg

SEQ ID NO: 1294365 - DNA, 23 bp, Homo sapiens
ccgtgggacccaggctcccagcc

SEQ ID NO: 1294366 - DNA, 15 bp, Homo sapiens
cctaagggagacagg

SEQ ID NO: 1294367 - DNA, 22 bp, Homo sapiens
cctatttttgtagatctccatg

SEQ ID NO: 1294368 - DNA, 23 bp, Homo sapiens
cctatttttgtagatctccatgc

SEQ ID NO: 1294369 - DNA, 17 bp, Homo sapiens
cctcacacacggaggcc

SEQ ID NO: 1294370 - DNA, 18 bp, Homo sapiens
cctcacacacggaggcca

SEQ ID NO: 1294371 - DNA, 23 bp, Homo sapiens
cctcacacacggaggccagacac

SEQ ID NO: 1294372 - DNA, 23 bp, Homo sapiens
cctcagatagacctgtgacctgg

SEQ ID NO: 1294373 - DNA, 15 bp, Homo sapiens
cctcgccgagctgtc

SEQ ID NO: 1294374 - DNA, 12 bp, Homo sapiens
cctctccagaca

SEQ ID NO: 1294375 - DNA, 21 bp, Homo sapiens
cctctccagacacagagacat

SEQ ID NO: 1294376 - DNA, 14 bp, Homo sapiens
cctcttcagctgct

SEQ ID NO: 1294377 - DNA, 19 bp, Homo sapiens
cctcttcagctgctgacaa

SEQ ID NO: 1294378 - DNA, 19 bp, Homo sapiens
cctgagatgctgggagggc

SEQ ID NO: 1294379 - DNA, 20 bp, Homo sapiens
cctgagatgctgggagggct

SEQ ID NO: 1294380 - DNA, 15 bp, Homo sapiens
cctgagcaggcaggg

SEQ ID NO: 1294381 - DNA, 23 bp, Homo sapiens
cctgagcaggcaggggcttggct

SEQ ID NO: 1294382 - DNA, 13 bp, Homo sapiens
cctgagccatggc

SEQ ID NO: 1294383 - DNA, 14 bp, Homo sapiens
cctgaggtaacagg

SEQ ID NO: 1294384 - DNA, 14 bp, Homo sapiens
cctgcccagccagc

SEQ ID NO: 1294385 - DNA, 15 bp, Homo sapiens
cctgccggctctggg

SEQ ID NO: 1294386 - DNA, 14 bp, Homo sapiens
cctgcctgaagaga

SEQ ID NO: 1294387 - DNA, 15 bp, Homo sapiens
cctgcctgaagagag

SEQ ID NO: 1294388 - DNA, 16 bp, Homo sapiens
cctgctacacaggcag

SEQ ID NO: 1294389 - DNA, 18 bp, Homo sapiens
cctgctacacaggcagga

SEQ ID NO: 1294390 - DNA, 14 bp, Homo sapiens
cctggaacctggca

SEQ ID NO: 1294391 - DNA, 16 bp, Homo sapiens
cctggaacctggcagg

SEQ ID NO: 1294392 - DNA, 21 bp, Homo sapiens
cctggaacctggcaggccctg

SEQ ID NO: 1294393 - DNA, 14 bp, Homo sapiens
cctggcaggccctg

SEQ ID NO: 1294394 - DNA, 16 bp, Homo sapiens
cctggcaggccctgcc

SEQ ID NO: 1294395 - DNA, 17 bp, Homo sapiens
gaccatacgcggaggag

SEQ ID NO: 1294396 - DNA, 17 bp, Homo sapiens
gacccaacccatgcccc

SEQ ID NO: 1294397 - DNA, 16 bp, Homo sapiens
gacccaacccttagct

SEQ ID NO: 1294398 - DNA, 14 bp, Homo sapiens
gacctgagatgctg

SEQ ID NO: 1294399 - DNA, 19 bp, Homo sapiens
gacctgagatgctgggagg

SEQ ID NO: 1294400 - DNA, 19 bp, Homo sapiens
gacctggtctggtcaggca

SEQ ID NO: 1294401 - DNA, 19 bp, Homo sapiens
gagaactgtcaccctgagg

SEQ ID NO: 1294402 - DNA, 21 bp, Homo sapiens
gagacaggcctttccctgccg

SEQ ID NO: 1294403 - DNA, 21 bp, Homo sapiens
gagacaggtgcctggggctgg

SEQ ID NO: 1294404 - DNA, 15 bp, Homo sapiens
gagacatgggagtgg

SEQ ID NO: 1294405 - DNA, 24 bp, Homo sapiens
gagacatgggagtggggagcggag

SEQ ID NO: 1294406 - DNA, 19 bp, Homo sapiens
gagactgtggtttttgtgt

SEQ ID NO: 1294407 - DNA, 12 bp, Homo sapiens
gagagagggggc

SEQ ID NO: 1294408 - DNA, 16 bp, Homo sapiens
gagagagggggcactg

SEQ ID NO: 1294409 - DNA, 17 bp, Homo sapiens
gagagggctgagccatg

SEQ ID NO: 1294410 - DNA, 22 bp, Homo sapiens
gagagggctgagccatgggggt

SEQ ID NO: 1294411 - DNA, 23 bp, Homo sapiens
gagaggtatgtgcccctcctggg

SEQ ID NO: 1294412 - DNA, 13 bp, Homo sapiens
gagagtggcctgg

SEQ ID NO: 1294413 - DNA, 14 bp, Homo sapiens
gagatgctgggagg

SEQ ID NO: 1294414 - DNA, 23 bp, Homo sapiens
gagatgctgggagggctgaaccc

SEQ ID NO: 1294415 - DNA, 12 bp, Homo sapiens
gagcaggcaggg

SEQ ID NO: 1294416 - DNA, 23 bp, Homo sapiens
gagcaggcaggggcttggctgcc

SEQ ID NO: 1294417 - DNA, 18 bp, Homo sapiens
gagcagttggcctgtgct

SEQ ID NO: 1294418 - DNA, 18 bp, Homo sapiens
gagcggagcttggccctg

SEQ ID NO: 1294419 - DNA, 19 bp, Homo sapiens
gagctgtcggagggctgga

SEQ ID NO: 1294420 - DNA, 12 bp, Homo sapiens
gagcttggccct

SEQ ID NO: 1294421 - DNA, 22 bp, Homo sapiens
gagcttggccctgcgccctgtg

SEQ ID NO: 1294422 - DNA, 15 bp, Homo sapiens
gaggagagtggcctg

SEQ ID NO: 1294423 - DNA, 18 bp, Homo sapiens
gaggagagtggcctgggt

SEQ ID NO: 1294424 - DNA, 21 bp, Homo sapiens
gaggcaggtcgggctgccagc

SEQ ID NO: 1294425 - DNA, 20 bp, Homo sapiens
gaggccagacacaggccgtg

SEQ ID NO: 1294426 - DNA, 18 bp, Homo sapiens
gaggcgaaatataaaact

SEQ ID NO: 1294427 - DNA, 18 bp, Homo sapiens
tgctcctggaacctggca

SEQ ID NO: 1294428 - DNA, 20 bp, Homo sapiens
tgctctcaaggcttggagag

SEQ ID NO: 1294429 - DNA, 14 bp, Homo sapiens
tgctgggagggctg

SEQ ID NO: 1294430 - DNA, 15 bp, Homo sapiens
tgctgggagggctga

SEQ ID NO: 1294431 - DNA, 18 bp, Homo sapiens
tggaacctggcaggccct

SEQ ID NO: 1294432 - DNA, 21 bp, Homo sapiens
tggaacctggcaggccctgcc

SEQ ID NO: 1294433 - DNA, 21 bp, Homo sapiens
tggacatttgtggcagtgctg

SEQ ID NO: 1294434 - DNA, 13 bp, Homo sapiens
tggagcagccgga

SEQ ID NO: 1294435 - DNA, 19 bp, Homo sapiens
tggcacccacacagaggac

SEQ ID NO: 1294436 - DNA, 22 bp, Homo sapiens
tggcacccacacagaggacctc

SEQ ID NO: 1294437 - DNA, 18 bp, Homo sapiens
tggcaggccctgcccagc

SEQ ID NO: 1294438 - DNA, 22 bp, Homo sapiens
tggcaggccctgcccagccagc

SEQ ID NO: 1294439 - DNA, 14 bp, Homo sapiens
tggccaggacacac

SEQ ID NO: 1294440 - DNA, 17 bp, Homo sapiens
tggccaggacacactga

SEQ ID NO: 1294441 - DNA, 15 bp, Homo sapiens
tggccctaggcactg

SEQ ID NO: 1294442 - DNA, 13 bp, Homo sapiens
tggccggaaggag

SEQ ID NO: 1294443 - DNA, 13 bp, Homo sapiens
ctcaccgcctgct

SEQ ID NO: 1294444 - DNA, 23 bp, Homo sapiens
ctcaccgcctgctacacaggcag

SEQ ID NO: 1294445 - DNA, 16 bp, Homo sapiens
ctcagcccgggatcct

SEQ ID NO: 1294446 - DNA, 18 bp, Homo sapiens
ctcagcccgggatcctga

SEQ ID NO: 1294447 - DNA, 13 bp, Homo sapiens
ctcagcctgcctg

SEQ ID NO: 1294448 - DNA, 18 bp, Homo sapiens
ctcagcctgcctgaagag

SEQ ID NO: 1294449 - DNA, 14 bp, Homo sapiens
ctccagacacagag

SEQ ID NO: 1294450 - DNA, 15 bp, Homo sapiens
ctccagctcctctcc

SEQ ID NO: 1294451 - DNA, 18 bp, Homo sapiens
ctcccacttgacctgaga

SEQ ID NO: 1294452 - DNA, 21 bp, Homo sapiens
ctcccaggccacctcagtctc

SEQ ID NO: 1294453 - DNA, 19 bp, Homo sapiens
ctcccagggctctctggac

SEQ ID NO: 1294454 - DNA, 15 bp, Homo sapiens
ctcctggaacctggc

SEQ ID NO: 1294455 - DNA, 17 bp, Homo sapiens
ctcctggaacctggcag

SEQ ID NO: 1294456 - DNA, 22 bp, Homo sapiens
ctcctggaacctggcaggccct

SEQ ID NO: 1294457 - DNA, 23 bp, Homo sapiens
ctcctggaacctggcaggccctg

SEQ ID NO: 1294458 - DNA, 20 bp, Homo sapiens
ctctggaccatacgcggagg

SEQ ID NO: 1294459 - DNA, 22 bp, Homo sapiens
ctctggaccatacgcggaggag

SEQ ID NO: 1294460 - DNA, 15 bp, Homo sapiens
ctctggccccctatt

SEQ ID NO: 1294461 - DNA, 12 bp, Homo sapiens
ctctggctcagc

SEQ ID NO: 1294462 - DNA, 19 bp, Homo sapiens
ctcttcttaaccctgaaca

SEQ ID NO: 1294463 - DNA, 12 bp, Homo sapiens
ctgaagagagga

SEQ ID NO: 1294464 - DNA, 15 bp, Homo sapiens
ctgaagagaggaaac

SEQ ID NO: 1294465 - DNA, 17 bp, Homo sapiens
ctgagatgctgggaggg

SEQ ID NO: 1294466 - DNA, 22 bp, Homo sapiens
ctgagatgctgggagggctgaa

SEQ ID NO: 1294467 - DNA, 20 bp, Homo sapiens
ctgatggcacccacacagag

SEQ ID NO: 1294468 - DNA, 21 bp, Homo sapiens
ctgatggcacccacacagagg

SEQ ID NO: 1294469 - DNA, 13 bp, Homo sapiens
ctgccagcccagc

SEQ ID NO: 1294470 - DNA, 14 bp, Homo sapiens
ctgccagcccagct

SEQ ID NO: 1294471 - DNA, 15 bp, Homo sapiens
ctgccagcccagctg

SEQ ID NO: 1294472 - DNA, 14 bp, Homo sapiens
ctgccggctctggg

SEQ ID NO: 1294473 - DNA, 15 bp, Homo sapiens
ctgccggctctgggc

SEQ ID NO: 1294474 - DNA, 14 bp, Homo sapiens
ctgcctgaagagag

SEQ ID NO: 1294475 - DNA, 23 bp, Homo sapiens
ctgcctgaagagaggaaactggc

SEQ ID NO: 1294476 - DNA, 12 bp, Homo sapiens
ctgcgccctgtg

SEQ ID NO: 1294477 - DNA, 14 bp, Homo sapiens
ctgcgccctgtgca

SEQ ID NO: 1294478 - DNA, 18 bp, Homo sapiens
catcggaagagagggctg

SEQ ID NO: 1294479 - DNA, 20 bp, Homo sapiens
catgcagcttgtccttgctc

SEQ ID NO: 1294480 - DNA, 14 bp, Homo sapiens
catgcccctgacag

SEQ ID NO: 1294481 - DNA, 20 bp, Homo sapiens
catgctttgctctcaaggct

SEQ ID NO: 1294482 - DNA, 17 bp, Homo sapiens
catggacatgggcagca

SEQ ID NO: 1294483 - DNA, 18 bp, Homo sapiens
catggacatgggcagcaa

SEQ ID NO: 1294484 - DNA, 21 bp, Homo sapiens
catggcacctttgagagaggg

SEQ ID NO: 1294485 - DNA, 13 bp, Homo sapiens
catggcggcccct

SEQ ID NO: 1294486 - DNA, 15 bp, Homo sapiens
catgggagtggggag

SEQ ID NO: 1294487 - DNA, 14 bp, Homo sapiens
cattcacggcctgg

SEQ ID NO: 1294488 - DNA, 18 bp, Homo sapiens
cattcacggcctggcatg

SEQ ID NO: 1294489 - DNA, 17 bp, Homo sapiens
cattccagctctcccat

SEQ ID NO: 1294490 - DNA, 19 bp, Homo sapiens
cattccagctctcccatgg

SEQ ID NO: 1294491 - DNA, 20 bp, Homo sapiens
cattccagctctcccatgga

SEQ ID NO: 1294492 - DNA, 16 bp, Homo sapiens
ccacacagaggacctc

SEQ ID NO: 1294493 - DNA, 22 bp, Homo sapiens
ccacaggtcttcactgcccagg

SEQ ID NO: 1294494 - DNA, 19 bp, Homo sapiens
ccacctcagtctcacctgc

SEQ ID NO: 1294495 - DNA, 13 bp, Homo sapiens
ccacttgacctga

SEQ ID NO: 1294496 - DNA, 13 bp, Homo sapiens
ccagaactgcaca

SEQ ID NO: 1294497 - DNA, 16 bp, Homo sapiens
ccagacccaacccatg

SEQ ID NO: 1294498 - DNA, 18 bp, Homo sapiens
ccagcaggagggaaggac

SEQ ID NO: 1294499 - DNA, 19 bp, Homo sapiens
ccagccatcggaagagagg

SEQ ID NO: 1294500 - DNA, 20 bp, Homo sapiens
ccagccatcggaagagaggg

SEQ ID NO: 1294501 - DNA, 22 bp, Homo sapiens
ccagccatcggaagagagggct

SEQ ID NO: 1294502 - DNA, 23 bp, Homo sapiens
ccagccatcggaagagagggctg

SEQ ID NO: 1294503 - DNA, 12 bp, Homo sapiens
ccagcccagctg

SEQ ID NO: 1294504 - DNA, 11 bp, Homo sapiens
ccagccctgag

SEQ ID NO: 1294505 - DNA, 16 bp, Homo sapiens
ccagccctgagccatg

SEQ ID NO: 1294506 - DNA, 14 bp, Homo sapiens
ccagcctaagggag

SEQ ID NO: 1294507 - DNA, 19 bp, Homo sapiens
ccagcctctctggctcagc

SEQ ID NO: 1294508 - DNA, 19 bp, Homo sapiens
ccagctcctctccagacac

SEQ ID NO: 1294509 - DNA, 14 bp, Homo sapiens
ccagctgctgaggc

SEQ ID NO: 1294510 - DNA, 13 bp, Homo sapiens
ccagctggccgga

SEQ ID NO: 1294511 - DNA, 14 bp, Homo sapiens
ccaggacacactga

SEQ ID NO: 1294512 - DNA, 14 bp, Homo sapiens
ccaggctcccagcc

SEQ ID NO: 1294513 - DNA, 13 bp, Homo sapiens
ccagggctggccc

SEQ ID NO: 1294514 - DNA, 15 bp, Homo sapiens
ccatacgcggaggag

SEQ ID NO: 1294515 - DNA, 16 bp, Homo sapiens
ccatacgcggaggagt

SEQ ID NO: 1294516 - DNA, 15 bp, Homo sapiens
ccatcggaagagagg

SEQ ID NO: 1294517 - DNA, 17 bp, Homo sapiens
ccatcggaagagagggc

SEQ ID NO: 1294518 - DNA, 13 bp, Homo sapiens
ccatgcccctgac

SEQ ID NO: 1294519 - DNA, 17 bp, Homo sapiens
ccattccagctctccca

SEQ ID NO: 1294520 - DNA, 22 bp, Homo sapiens
cccacaggtcttcactgcccag

SEQ ID NO: 1294521 - DNA, 23 bp, Homo sapiens
cccagacccaacccatgcccctg

SEQ ID NO: 1294522 - DNA, 23 bp, Homo sapiens
cccagcctaagggagacaggcct

SEQ ID NO: 1294523 - DNA, 14 bp, Homo sapiens
cccagcctctctgg

SEQ ID NO: 1294524 - DNA, 20 bp, Homo sapiens
cccagcgacatttctccaag

SEQ ID NO: 1294525 - DNA, 20 bp, Homo sapiens
cccagctggccggaaggaga

SEQ ID NO: 1294526 - DNA, 11 bp, Homo sapiens
cccaggacctc

SEQ ID NO: 1294527 - DNA, 23 bp, Homo sapiens
cccaggacctcttcagctgctga

SEQ ID NO: 1294528 - DNA, 19 bp, Homo sapiens
cccaggctcccagcctaag

SEQ ID NO: 1294529 - DNA, 12 bp, Homo sapiens
cccagggctctc

SEQ ID NO: 1294530 - DNA, 13 bp, Homo sapiens
cccagggctctct

SEQ ID NO: 1294531 - DNA, 14 bp, Homo sapiens
cccagggctctctg

SEQ ID NO: 1294532 - DNA, 11 bp, Homo sapiens
cccagggctgg

SEQ ID NO: 1294533 - DNA, 18 bp, Homo sapiens
cccagggctggccctagg

SEQ ID NO: 1294534 - DNA, 20 bp, Homo sapiens
cccagggctggccctaggca

SEQ ID NO: 1294535 - DNA, 18 bp, Homo sapiens
cccagttctcgtgccctt

SEQ ID NO: 1294536 - DNA, 17 bp, Homo sapiens
cccatgcccctgacaga

SEQ ID NO: 1294537 - DNA, 17 bp, Homo sapiens
cccattcacggcctggc

SEQ ID NO: 1294538 - DNA, 19 bp, Homo sapiens
cccattcacggcctggcat

SEQ ID NO: 1294539 - DNA, 17 bp, Homo sapiens
cccattttccccctgtg

SEQ ID NO: 1294540 - DNA, 17 bp, Homo sapiens
ccccaaggatggggttc

SEQ ID NO: 1294541 - DNA, 20 bp, Homo sapiens
ccccaaggatggggttcttg

SEQ ID NO: 1294542 - DNA, 13 bp, Homo sapiens
ccccactcacaca

SEQ ID NO: 1294543 - DNA, 24 bp, Homo sapiens
ccccaggacctcttcagctgctga

SEQ ID NO: 1294544 - DNA, 15 bp, Homo sapiens
ccccattcacggcct

SEQ ID NO: 1294545 - DNA, 17 bp, Homo sapiens
ccccattcacggcctgg

SEQ ID NO: 1294546 - DNA, 18 bp, Homo sapiens
ccccattcacggcctggc

SEQ ID NO: 1294547 - DNA, 15 bp, Homo sapiens
ccccattccagctct

SEQ ID NO: 1294548 - DNA, 13 bp, Homo sapiens
cccccactcacac

SEQ ID NO: 1294549 - DNA, 23 bp, Homo sapiens
cccccaggacctcttcagctgct

SEQ ID NO: 1294550 - DNA, 13 bp, Homo sapiens
cccctcctgggtg

SEQ ID NO: 1294551 - DNA, 19 bp, Homo sapiens
cccgcggatcaaccaggca

SEQ ID NO: 1294552 - DNA, 13 bp, Homo sapiens
ccctaggcactga

SEQ ID NO: 1294553 - DNA, 13 bp, Homo sapiens
ccctcagcctgcc

SEQ ID NO: 1294554 - DNA, 14 bp, Homo sapiens
ccctcagcctgcct

SEQ ID NO: 1294555 - DNA, 16 bp, Homo sapiens
ccctcagcctgcctga

SEQ ID NO: 1294556 - DNA, 19 bp, Homo sapiens
ccctcagcctgcctgaaga

SEQ ID NO: 1294557 - DNA, 20 bp, Homo sapiens
ccctcagcctgcctgaagag

SEQ ID NO: 1294558 - DNA, 13 bp, Homo sapiens
ccctcctgtaaga

SEQ ID NO: 1294559 - DNA, 22 bp, Homo sapiens
ccctgacagatctagttctctt

SEQ ID NO: 1294560 - DNA, 14 bp, Homo sapiens
ccctgagccatggc

SEQ ID NO: 1294561 - DNA, 14 bp, Homo sapiens
ccctgcccagccag

SEQ ID NO: 1294562 - DNA, 15 bp, Homo sapiens
ccctgcggctctgga

SEQ ID NO: 1294563 - DNA, 16 bp, Homo sapiens
ccctgcggctctggaa

SEQ ID NO: 1294564 - DNA, 21 bp, Homo sapiens
ccctgtgcagggaaagggatg

SEQ ID NO: 1294565 - DNA, 21 bp, Homo sapiens
cccttagcttttagcctggct

SEQ ID NO: 1294566 - DNA, 23 bp, Homo sapiens
cccttagcttttagcctggctgt

SEQ ID NO: 1294567 - DNA, 15 bp, Homo sapiens
ccgagctgtcggagg

SEQ ID NO: 1294568 - DNA, 19 bp, Homo sapiens
ccgagctgtcggagggctg

SEQ ID NO: 1294569 - DNA, 17 bp, Homo sapiens
ccgcctgctacacaggc

SEQ ID NO: 1294570 - DNA, 19 bp, Homo sapiens
ccgcggatcaaccaggcag

SEQ ID NO: 1294571 - DNA, 17 bp, Homo sapiens
ccggagcagttggcctg

SEQ ID NO: 1294572 - DNA, 14 bp, Homo sapiens
ccggctctgggctg

SEQ ID NO: 1294573 - DNA, 16 bp, Homo sapiens
ccggctctgggctggc

SEQ ID NO: 1294574 - DNA, 20 bp, Homo sapiens
ccggctctgggctggctgct

SEQ ID NO: 1294575 - DNA, 19 bp, Homo sapiens
ccgggagctttgagacagg

SEQ ID NO: 1294576 - DNA, 23 bp, Homo sapiens
ccgggcgcatgcctcccaggcca

SEQ ID NO: 1294577 - DNA, 17 bp, Homo sapiens
ccgtgggacccaggctc

SEQ ID NO: 1294578 - DNA, 18 bp, Homo sapiens
cctaagggagacaggcct

SEQ ID NO: 1294579 - DNA, 19 bp, Homo sapiens
cctcacacacggaggccag

SEQ ID NO: 1294580 - DNA, 20 bp, Homo sapiens
cctcacacacggaggccaga

SEQ ID NO: 1294581 - DNA, 17 bp, Homo sapiens
cctcagatagacctgtg

SEQ ID NO: 1294582 - DNA, 15 bp, Homo sapiens
cctcagcctgcctga

SEQ ID NO: 1294583 - DNA, 20 bp, Homo sapiens
cctcagcctgcctgaagaga

SEQ ID NO: 1294584 - DNA, 21 bp, Homo sapiens
cctcagtctcacctgccggct

SEQ ID NO: 1294585 - DNA, 23 bp, Homo sapiens
cctcagtctcacctgccggctct

SEQ ID NO: 1294586 - DNA, 12 bp, Homo sapiens
cctcccaggcca

SEQ ID NO: 1294587 - DNA, 16 bp, Homo sapiens
cctcggcctggctggc

SEQ ID NO: 1294588 - DNA, 20 bp, Homo sapiens
cctcggcctggctggccagg

SEQ ID NO: 1294589 - DNA, 21 bp, Homo sapiens
cctcggcctggctggccagga

SEQ ID NO: 1294590 - DNA, 13 bp, Homo sapiens
cctctccagacac

SEQ ID NO: 1294591 - DNA, 15 bp, Homo sapiens
agacaggtgcctggg

SEQ ID NO: 1294592 - DNA, 17 bp, Homo sapiens
agacaggtgcctggggc

SEQ ID NO: 1294593 - DNA, 20 bp, Homo sapiens
agacctgtgacctggtctgg

SEQ ID NO: 1294594 - DNA, 20 bp, Homo sapiens
agagaactgtcaccctgagg

SEQ ID NO: 1294595 - DNA, 12 bp, Homo sapiens
agagagggggca

SEQ ID NO: 1294596 - DNA, 16 bp, Homo sapiens
agagagggggcactgt

SEQ ID NO: 1294597 - DNA, 19 bp, Homo sapiens
agagagggggcactgtggt

SEQ ID NO: 1294598 - DNA, 23 bp, Homo sapiens
agagagggggcactgtggtcagg

SEQ ID NO: 1294599 - DNA, 13 bp, Homo sapiens
agagggctgagcc

SEQ ID NO: 1294600 - DNA, 24 bp, Homo sapiens
tctggccccctattgtctccaagg

SEQ ID NO: 1294601 - DNA, 22 bp, Homo sapiens
tctggctcagcccgggatcctg

SEQ ID NO: 1294602 - DNA, 20 bp, Homo sapiens
tctggtcaggcaatgccctg

SEQ ID NO: 1294603 - DNA, 23 bp, Homo sapiens
tctgtgtggtctccagctcctct

SEQ ID NO: 1294604 - DNA, 19 bp, Homo sapiens
tctgttctcaaagcagaag

SEQ ID NO: 1294605 - DNA, 14 bp, Homo sapiens
tcttcactgcccag

SEQ ID NO: 1294606 - DNA, 18 bp, Homo sapiens
tcttcagctgctgacaat

SEQ ID NO: 1294607 - DNA, 22 bp, Homo sapiens
tctttggggcaagatccaggtg

SEQ ID NO: 1294608 - DNA, 17 bp, Homo sapiens
tgaaaaggctttttcag

SEQ ID NO: 1294609 - DNA, 17 bp, Homo sapiens
tgaccagcaggagggaa

SEQ ID NO: 1294610 - DNA, 15 bp, Homo sapiens
tgacctggtctggtc

SEQ ID NO: 1294611 - DNA, 16 bp, Homo sapiens
tgagacaggtgcctgg

SEQ ID NO: 1294612 - DNA, 21 bp, Homo sapiens
tgagacaggtgcctggggctg

SEQ ID NO: 1294613 - DNA, 23 bp, Homo sapiens
tgagcaggcaggggcttggctgc

SEQ ID NO: 1294614 - DNA, 23 bp, Homo sapiens
tgagccatgggggtttggggcta

SEQ ID NO: 1294615 - DNA, 22 bp, Homo sapiens
tgatagttgccttttcttcccc

SEQ ID NO: 1294616 - DNA, 15 bp, Homo sapiens
tgatggcacccacac

SEQ ID NO: 1294617 - DNA, 15 bp, Homo sapiens
tgcacaatgaccagc

SEQ ID NO: 1294618 - DNA, 18 bp, Homo sapiens
tgcacaatgaccagcagg

SEQ ID NO: 1294619 - DNA, 22 bp, Homo sapiens
tgcagcttgtccttgctcctgg

SEQ ID NO: 1294620 - DNA, 22 bp, Homo sapiens
tgcagggaaagggatggtcagg

SEQ ID NO: 1294621 - DNA, 22 bp, Homo sapiens
tgccagcccagctggccggaag

SEQ ID NO: 1294622 - DNA, 23 bp, Homo sapiens
tgccagcccagctggccggaagg

SEQ ID NO: 1294623 - DNA, 22 bp, Homo sapiens
tgcccagccagccatcggaaga

SEQ ID NO: 1294624 - DNA, 16 bp, Homo sapiens
tgccccattccagctc

SEQ ID NO: 1294625 - DNA, 14 bp, Homo sapiens
tgccctgcggctct

SEQ ID NO: 1294626 - DNA, 15 bp, Homo sapiens
tgccctgcggctctg

SEQ ID NO: 1294627 - DNA, 17 bp, Homo sapiens
tgccctgcggctctgga

SEQ ID NO: 1294628 - DNA, 16 bp, Homo sapiens
tgccggctctgggctg

SEQ ID NO: 1294629 - DNA, 16 bp, Homo sapiens
tgcctgaagagaggaa

SEQ ID NO: 1294630 - DNA, 14 bp, Homo sapiens
tgcctggggctggc

SEQ ID NO: 1294631 - DNA, 17 bp, Homo sapiens
tgcctggggctggctgc

SEQ ID NO: 1294632 - DNA, 20 bp, Homo sapiens
tgcctggggctggctgcaga

SEQ ID NO: 1294633 - DNA, 12 bp, Homo sapiens
tgcggctctgga

SEQ ID NO: 1294634 - DNA, 16 bp, Homo sapiens
tgcggttgggaggcag

SEQ ID NO: 1294635 - DNA, 14 bp, Homo sapiens
tgctacacaggcag

SEQ ID NO: 1294636 - DNA, 15 bp, Homo sapiens
tgctacacaggcagg

SEQ ID NO: 1294637 - DNA, 20 bp, Homo sapiens
tgctcctggaacctggcagg

SEQ ID NO: 1294638 - DNA, 21 bp, Homo sapiens
tgctcctggaacctggcaggc

SEQ ID NO: 1294639 - DNA, 22 bp, Homo sapiens
tgctcctggaacctggcaggcc

SEQ ID NO: 1294640 - DNA, 18 bp, Homo sapiens
tgctctcaaggcttggag

SEQ ID NO: 1294641 - DNA, 10 bp, Homo sapiens
tgctgaggcg

SEQ ID NO: 1294642 - DNA, 13 bp, Homo sapiens
tgctgggagggct

SEQ ID NO: 1294643 - DNA, 16 bp, Homo sapiens
tgctgggagggctgaa

SEQ ID NO: 1294644 - DNA, 18 bp, Homo sapiens
tgcttggaggcctcagat

SEQ ID NO: 1294645 - DNA, 13 bp, Homo sapiens
tggaacctggcag

SEQ ID NO: 1294646 - DNA, 14 bp, Homo sapiens
tggaacctggcagg

SEQ ID NO: 1294647 - DNA, 12 bp, Homo sapiens
tggacagcccgg

SEQ ID NO: 1294648 - DNA, 14 bp, Homo sapiens
tggacatgggcagc

SEQ ID NO: 1294649 - DNA, 18 bp, Homo sapiens
tggacatttgtggcagtg

SEQ ID NO: 1294650 - DNA, 15 bp, Homo sapiens
ttttcttcccctcct

SEQ ID NO: 1294651 - DNA, 13 bp, Homo sapiens
tttttccatggac

SEQ ID NO: 1294652 - DNA, 20 bp, Homo sapiens
catagagaactgtcaccctg

SEQ ID NO: 1294653 - DNA, 22 bp, Homo sapiens
catagagaactgtcaccctgag

SEQ ID NO: 1294654 - DNA, 20 bp, Homo sapiens
catatttttaaaacaaacca

SEQ ID NO: 1294655 - DNA, 14 bp, Homo sapiens
catcaagtgccaga

SEQ ID NO: 1294656 - DNA, 14 bp, Homo sapiens
catcggaagagagg

SEQ ID NO: 1294657 - DNA, 12 bp, Homo sapiens
catgcagcttgt

SEQ ID NO: 1294658 - DNA, 15 bp, Homo sapiens
catgcccctgacaga

SEQ ID NO: 1294659 - DNA, 14 bp, Homo sapiens
catgcctcccaggc

SEQ ID NO: 1294660 - DNA, 15 bp, Homo sapiens
catgcctcccaggcc

SEQ ID NO: 1294661 - DNA, 16 bp, Homo sapiens
catgcctcccaggcca

SEQ ID NO: 1294662 - DNA, 19 bp, Homo sapiens
catggcacctttgagagag

SEQ ID NO: 1294663 - DNA, 20 bp, Homo sapiens
catggcacctttgagagagg

SEQ ID NO: 1294664 - DNA, 18 bp, Homo sapiens
catggcggcccctcagcc

SEQ ID NO: 1294665 - DNA, 12 bp, Homo sapiens
catgggcagcaa

SEQ ID NO: 1294666 - DNA, 16 bp, Homo sapiens
cattcacggcctggca

SEQ ID NO: 1294667 - DNA, 21 bp, Homo sapiens
cattcacggcctggcatgcag

SEQ ID NO: 1294668 - DNA, 14 bp, Homo sapiens
cattgccggcgagt

SEQ ID NO: 1294669 - DNA, 12 bp, Homo sapiens
ccaaaggacaca

SEQ ID NO: 1294670 - DNA, 17 bp, Homo sapiens
ccaaaggacacaagggt

SEQ ID NO: 1294671 - DNA, 17 bp, Homo sapiens
ccaacccatgcccctga

SEQ ID NO: 1294672 - DNA, 23 bp, Homo sapiens
ccaacccttagcttttagcctgg

SEQ ID NO: 1294673 - DNA, 19 bp, Homo sapiens
ccaagtggaaatcctattt

SEQ ID NO: 1294674 - DNA, 17 bp, Homo sapiens
ccaatcacccccaggac

SEQ ID NO: 1294675 - DNA, 18 bp, Homo sapiens
ccaatcacccccaggacc

SEQ ID NO: 1294676 - DNA, 20 bp, Homo sapiens
ccagaggagagtggcctggg

SEQ ID NO: 1294677 - DNA, 21 bp, Homo sapiens
ccagaggagagtggcctgggt

SEQ ID NO: 1294678 - DNA, 18 bp, Homo sapiens
ccagatgttgtctgaact

SEQ ID NO: 1294679 - DNA, 13 bp, Homo sapiens
ccagccctgagcc

SEQ ID NO: 1294680 - DNA, 23 bp, Homo sapiens
ccagcctaagggagacaggcctt

SEQ ID NO: 1294681 - DNA, 15 bp, Homo sapiens
ccagcctggggcctt

SEQ ID NO: 1294682 - DNA, 17 bp, Homo sapiens
ccagcctggggccttcc

SEQ ID NO: 1294683 - DNA, 21 bp, Homo sapiens
ccagcctggggccttcctggc

SEQ ID NO: 1294684 - DNA, 12 bp, Homo sapiens
ccagctcctctc

SEQ ID NO: 1294685 - DNA, 16 bp, Homo sapiens
ccagctcctctccaga

SEQ ID NO: 1294686 - DNA, 18 bp, Homo sapiens
ccagctcctctccagaca

SEQ ID NO: 1294687 - DNA, 20 bp, Homo sapiens
ccagctcctctccagacaca

SEQ ID NO: 1294688 - DNA, 13 bp, Homo sapiens
ccagctctcccat

SEQ ID NO: 1294689 - DNA, 16 bp, Homo sapiens
ccagctgctgaggcga

SEQ ID NO: 1294690 - DNA, 22 bp, Homo sapiens
ccagctggccggaaggagactg

SEQ ID NO: 1294691 - DNA, 14 bp, Homo sapiens
ccaggacctcttca

SEQ ID NO: 1294692 - DNA, 15 bp, Homo sapiens
ccaggcagagttctg

SEQ ID NO: 1294693 - DNA, 17 bp, Homo sapiens
ccaggcagagttctgtg

SEQ ID NO: 1294694 - DNA, 13 bp, Homo sapiens
ccaggctcccagc

SEQ ID NO: 1294695 - DNA, 15 bp, Homo sapiens
ccaggctcccagcct

SEQ ID NO: 1294696 - DNA, 19 bp, Homo sapiens
ccaggctcccagcctaagg

SEQ ID NO: 1294697 - DNA, 14 bp, Homo sapiens
ccagggctctctgg

SEQ ID NO: 1294698 - DNA, 16 bp, Homo sapiens
ccagggctctctggac

SEQ ID NO: 1294699 - DNA, 14 bp, Homo sapiens
ccagggctggccct

SEQ ID NO: 1294700 - DNA, 17 bp, Homo sapiens
ccagtgtggctcccaca

SEQ ID NO: 1294701 - DNA, 18 bp, Homo sapiens
ccagtgtggctcccacag

SEQ ID NO: 1294702 - DNA, 19 bp, Homo sapiens
ccatcggaagagagggctg

SEQ ID NO: 1294703 - DNA, 22 bp, Homo sapiens
ccatcggaagagagggctgagc

SEQ ID NO: 1294704 - DNA, 14 bp, Homo sapiens
ccatgcccctgaca

SEQ ID NO: 1294705 - DNA, 15 bp, Homo sapiens
ccatgctttgctctc

SEQ ID NO: 1294706 - DNA, 14 bp, Homo sapiens
ccatggacatgggc

SEQ ID NO: 1294707 - DNA, 17 bp, Homo sapiens
ccatggacatgggcagc

SEQ ID NO: 1294708 - DNA, 13 bp, Homo sapiens
ccatggagcccct

SEQ ID NO: 1294709 - DNA, 21 bp, Homo sapiens
ccatggcacctttgagagagg

SEQ ID NO: 1294710 - DNA, 21 bp, Homo sapiens
ccatggcggcccctcagcctg

SEQ ID NO: 1294711 - DNA, 22 bp, Homo sapiens
ccatgggggtttggggctaaga

SEQ ID NO: 1294712 - DNA, 15 bp, Homo sapiens
ccattcacggcctgg

SEQ ID NO: 1294713 - DNA, 18 bp, Homo sapiens
cccacacagaggacctct

SEQ ID NO: 1294714 - DNA, 14 bp, Homo sapiens
cccacttgacctga

SEQ ID NO: 1294715 - DNA, 22 bp, Homo sapiens
cccagccagccatcggaagaga

SEQ ID NO: 1294716 - DNA, 19 bp, Homo sapiens
cccagcctaagggagacag

SEQ ID NO: 1294717 - DNA, 13 bp, Homo sapiens
cccagcctctctg

SEQ ID NO: 1294718 - DNA, 18 bp, Homo sapiens
cccagcctctctggctca

SEQ ID NO: 1294719 - DNA, 13 bp, Homo sapiens
cccagctggccgg

SEQ ID NO: 1294720 - DNA, 16 bp, Homo sapiens
cccagctggccggaag

SEQ ID NO: 1294721 - DNA, 12 bp, Homo sapiens
cccaggacctct

SEQ ID NO: 1294722 - DNA, 16 bp, Homo sapiens
cccaggctcccagcct

SEQ ID NO: 1294723 - DNA, 16 bp, Homo sapiens
cccagggctctctgga

SEQ ID NO: 1294724 - DNA, 13 bp, Homo sapiens
cccagggctggcc

SEQ ID NO: 1294725 - DNA, 15 bp, Homo sapiens
cccagggctggccct

SEQ ID NO: 1294726 - DNA, 13 bp, Homo sapiens
cccataggtcttg

SEQ ID NO: 1294727 - DNA, 22 bp, Homo sapiens
cccattccagctctcccatgga

SEQ ID NO: 1294728 - DNA, 15 bp, Homo sapiens
ccccagttcccttgg

SEQ ID NO: 1294729 - DNA, 19 bp, Homo sapiens
ccccattcacggcctggca

SEQ ID NO: 1294730 - DNA, 20 bp, Homo sapiens
ccccattcacggcctggcat

SEQ ID NO: 1294731 - DNA, 14 bp, Homo sapiens
cccctccaccgggc

SEQ ID NO: 1294732 - DNA, 24 bp, Homo sapiens
cccctgacagatctagttctcttc

SEQ ID NO: 1294733 - DNA, 13 bp, Homo sapiens
cccgggatcctga

SEQ ID NO: 1294734 - DNA, 22 bp, Homo sapiens
ccctgaacaagagtgtctatgg

SEQ ID NO: 1294735 - DNA, 17 bp, Homo sapiens
ccctgagccatggcggc

SEQ ID NO: 1294736 - DNA, 20 bp, Homo sapiens
ccctgccggccccccaagga

SEQ ID NO: 1294737 - DNA, 16 bp, Homo sapiens
ccctgcgccctgtgca

SEQ ID NO: 1294738 - DNA, 17 bp, Homo sapiens
ccctgcgccctgtgcag

SEQ ID NO: 1294739 - DNA, 17 bp, Homo sapiens
ccctgcggctctggaaa

SEQ ID NO: 1294740 - DNA, 18 bp, Homo sapiens
ccctgcggctctggaaag

SEQ ID NO: 1294741 - DNA, 19 bp, Homo sapiens
cccttagcttttagcctgg

SEQ ID NO: 1294742 - DNA, 20 bp, Homo sapiens
cccttagcttttagcctggc

SEQ ID NO: 1294743 - DNA, 21 bp, Homo sapiens
ccgcctgctacacaggcagga

SEQ ID NO: 1294744 - DNA, 19 bp, Homo sapiens
ccggagcagttggcctgtg

SEQ ID NO: 1294745 - DNA, 21 bp, Homo sapiens
ccggagcagttggcctgtgct

SEQ ID NO: 1294746 - DNA, 22 bp, Homo sapiens
ccgggcgcatgcctcccaggcc

SEQ ID NO: 1294747 - DNA, 16 bp, Homo sapiens
ccgtgggacccaggct

SEQ ID NO: 1294748 - DNA, 12 bp, Homo sapiens
cctcacacacgg

SEQ ID NO: 1294749 - DNA, 21 bp, Homo sapiens
cctcacacacggaggccagac

SEQ ID NO: 1294750 - DNA, 18 bp, Homo sapiens
cctcagcctgcctgaaga

SEQ ID NO: 1294751 - DNA, 23 bp, Homo sapiens
cctcagcctgcctgaagagagga

SEQ ID NO: 1294752 - DNA, 18 bp, Homo sapiens
cctcccacttgacctgag

SEQ ID NO: 1294753 - DNA, 11 bp, Homo sapiens
cctcccaggcc

SEQ ID NO: 1294754 - DNA, 12 bp, Homo sapiens
cctcctgggtgc

SEQ ID NO: 1294755 - DNA, 19 bp, Homo sapiens
cctcctgggtgctcaccgc

SEQ ID NO: 1294756 - DNA, 23 bp, Homo sapiens
cctcggcctggctggccaggaca

SEQ ID NO: 1294757 - DNA, 13 bp, Homo sapiens
cctctctggctca

SEQ ID NO: 1294758 - DNA, 14 bp, Homo sapiens
cctctctggctcag

SEQ ID NO: 1294759 - DNA, 19 bp, Homo sapiens
cctctctggctcagcccgg

SEQ ID NO: 1294760 - DNA, 21 bp, Homo sapiens
cctctctggctcagcccggga

SEQ ID NO: 1294761 - DNA, 16 bp, Homo sapiens
cctcttcagctgctga

SEQ ID NO: 1294762 - DNA, 16 bp, Homo sapiens
cctgagatgctgggag

SEQ ID NO: 1294763 - DNA, 21 bp, Homo sapiens
cctgagatgctgggagggctg

SEQ ID NO: 1294764 - DNA, 20 bp, Homo sapiens
gaggcaggtcgggctgccag

SEQ ID NO: 1294765 - DNA, 13 bp, Homo sapiens
gagggctgaaccc

SEQ ID NO: 1294766 - DNA, 13 bp, Homo sapiens
gagggctgagcca

SEQ ID NO: 1294767 - DNA, 22 bp, Homo sapiens
gagggctggacatttgtggcag

SEQ ID NO: 1294768 - DNA, 23 bp, Homo sapiens
gaggggaatgaaccatggcacct

SEQ ID NO: 1294769 - DNA, 13 bp, Homo sapiens
gagtccagtgtgg

SEQ ID NO: 1294770 - DNA, 18 bp, Homo sapiens
gagtccagtgtgggacac

SEQ ID NO: 1294771 - DNA, 12 bp, Homo sapiens
gagtggcctggg

SEQ ID NO: 1294772 - DNA, 20 bp, Homo sapiens
gagtggcctgggtcccaggg

SEQ ID NO: 1294773 - DNA, 19 bp, Homo sapiens
gagtggggagcggagcttg

SEQ ID NO: 1294774 - DNA, 17 bp, Homo sapiens
gagtgtctatggagcag

SEQ ID NO: 1294775 - DNA, 21 bp, Homo sapiens
gagttttctgtgtggtctcca

SEQ ID NO: 1294776 - DNA, 21 bp, Homo sapiens
gatatttttttacttgagcaa

SEQ ID NO: 1294777 - DNA, 14 bp, Homo sapiens
gatcaaccaggcag

SEQ ID NO: 1294778 - DNA, 19 bp, Homo sapiens
gatctagttctcttctcct

SEQ ID NO: 1294779 - DNA, 22 bp, Homo sapiens
gatctagttctcttctcctgtg

SEQ ID NO: 1294780 - DNA, 12 bp, Homo sapiens
gatctcccaggg

SEQ ID NO: 1294781 - DNA, 16 bp, Homo sapiens
gatctcccagggctct

SEQ ID NO: 1294782 - DNA, 14 bp, Homo sapiens
gatgctgggagggc

SEQ ID NO: 1294783 - DNA, 15 bp, Homo sapiens
gatggtcaggcccag

SEQ ID NO: 1294784 - DNA, 17 bp, Homo sapiens
gcaacttcatcccagct

SEQ ID NO: 1294785 - DNA, 12 bp, Homo sapiens
gcaatgccctgc

SEQ ID NO: 1294786 - DNA, 20 bp, Homo sapiens
gcaatgccctgcggctctgg

SEQ ID NO: 1294787 - DNA, 21 bp, Homo sapiens
gcaatgccctgcggctctgga

SEQ ID NO: 1294788 - DNA, 22 bp, Homo sapiens
gcaatgccctgcggctctggaa

SEQ ID NO: 1294789 - DNA, 15 bp, Homo sapiens
gcacctttgagagag

SEQ ID NO: 1294790 - DNA, 15 bp, Homo sapiens
gcactgtggtcaggc

SEQ ID NO: 1294791 - DNA, 22 bp, Homo sapiens
gcagcaattcacgctgtctctt

SEQ ID NO: 1294792 - DNA, 21 bp, Homo sapiens
gcagcctttttcaccatggca

SEQ ID NO: 1294793 - DNA, 19 bp, Homo sapiens
gcagcttgtccttgctcct

SEQ ID NO: 1294794 - DNA, 22 bp, Homo sapiens
gcagcttgtccttgctcctgga

SEQ ID NO: 1294795 - DNA, 18 bp, Homo sapiens
gcaggagggaaggacaga

SEQ ID NO: 1294796 - DNA, 19 bp, Homo sapiens
gcaggagggaaggacagac

SEQ ID NO: 1294797 - DNA, 20 bp, Homo sapiens
gcaggcaggggcttggctgc

SEQ ID NO: 1294798 - DNA, 23 bp, Homo sapiens
gcaggcaggggcttggctgcccc

SEQ ID NO: 1294799 - DNA, 11 bp, Homo sapiens
gcaggccctgc

SEQ ID NO: 1294800 - DNA, 17 bp, Homo sapiens
gcaggccctgcccagcc

SEQ ID NO: 1294801 - DNA, 18 bp, Homo sapiens
gcaggggcttggctgccc

SEQ ID NO: 1294802 - DNA, 17 bp, Homo sapiens
gcaggtcgggctgccag

SEQ ID NO: 1294803 - DNA, 20 bp, Homo sapiens
gcaggtcgggctgccagccc

SEQ ID NO: 1294804 - DNA, 13 bp, Homo sapiens
gcagtgctgaagg

SEQ ID NO: 1294805 - DNA, 16 bp, Homo sapiens
gcagttggcctgtgct

SEQ ID NO: 1294806 - DNA, 21 bp, Homo sapiens
gcatgcagcttgtccttgctc

SEQ ID NO: 1294807 - DNA, 18 bp, Homo sapiens
gccagacacaggccgtgg

SEQ ID NO: 1294808 - DNA, 23 bp, Homo sapiens
gccagccatcggaagagagggct

SEQ ID NO: 1294809 - DNA, 16 bp, Homo sapiens
gccagcccagctggcc

SEQ ID NO: 1294810 - DNA, 20 bp, Homo sapiens
gccagcccagctggccggaa

SEQ ID NO: 1294811 - DNA, 17 bp, Homo sapiens
gccatcggaagagaggg

SEQ ID NO: 1294812 - DNA, 20 bp, Homo sapiens
gccatcggaagagagggctg

SEQ ID NO: 1294813 - DNA, 22 bp, Homo sapiens
gccatcggaagagagggctgag

SEQ ID NO: 1294814 - DNA, 23 bp, Homo sapiens
gccatcggaagagagggctgagc

SEQ ID NO: 1294815 - DNA, 23 bp, Homo sapiens
gcccagccagccatcggaagaga

SEQ ID NO: 1294816 - DNA, 15 bp, Homo sapiens
gcccagcctctctgg

SEQ ID NO: 1294817 - DNA, 20 bp, Homo sapiens
gcccagcctctctggctcag

SEQ ID NO: 1294818 - DNA, 19 bp, Homo sapiens
gcccagctggccggaagga

SEQ ID NO: 1294819 - DNA, 21 bp, Homo sapiens
gcccagctggccggaaggaga

SEQ ID NO: 1294820 - DNA, 19 bp, Homo sapiens
gccccattcacggcctggc

SEQ ID NO: 1294821 - DNA, 20 bp, Homo sapiens
gccccattcacggcctggca

SEQ ID NO: 1294822 - DNA, 23 bp, Homo sapiens
gccccattccagctctcccatgg

SEQ ID NO: 1294823 - DNA, 20 bp, Homo sapiens
gccccctattgtctccaagg

SEQ ID NO: 1294824 - DNA, 21 bp, Homo sapiens
gccccctattgtctccaaggt

SEQ ID NO: 1294825 - DNA, 20 bp, Homo sapiens
gccccgcggatcaaccaggc

SEQ ID NO: 1294826 - DNA, 21 bp, Homo sapiens
gccccgcggatcaaccaggca

SEQ ID NO: 1294827 - DNA, 22 bp, Homo sapiens
gccccgcggatcaaccaggcag

SEQ ID NO: 1294828 - DNA, 18 bp, Homo sapiens
gcccctcagcctgcctga

SEQ ID NO: 1294829 - DNA, 15 bp, Homo sapiens
gcccctccaccgggc

SEQ ID NO: 1294830 - DNA, 13 bp, Homo sapiens
gcccctcctgggt

SEQ ID NO: 1294831 - DNA, 18 bp, Homo sapiens
gcccgggatcctgatggc

SEQ ID NO: 1294832 - DNA, 20 bp, Homo sapiens
gccctgagccatggcggccc

SEQ ID NO: 1294833 - DNA, 17 bp, Homo sapiens
gccctgcccagccagcc

SEQ ID NO: 1294834 - DNA, 17 bp, Homo sapiens
gccctgcggctctggaa

SEQ ID NO: 1294835 - DNA, 23 bp, Homo sapiens
gccctgtgcagggaaagggatgg

SEQ ID NO: 1294836 - DNA, 22 bp, Homo sapiens
gccgagctgtcggagggctgga

SEQ ID NO: 1294837 - DNA, 20 bp, Homo sapiens
gccgcgtggacagccggagc

SEQ ID NO: 1294838 - DNA, 20 bp, Homo sapiens
gccggagcagttggcctgtg

SEQ ID NO: 1294839 - DNA, 11 bp, Homo sapiens
gccggctctgg

SEQ ID NO: 1294840 - DNA, 13 bp, Homo sapiens
gccggctctgggc

SEQ ID NO: 1294841 - DNA, 14 bp, Homo sapiens
gccggctctgggct

SEQ ID NO: 1294842 - DNA, 16 bp, Homo sapiens
gccggctctgggctgg

SEQ ID NO: 1294843 - DNA, 20 bp, Homo sapiens
gccggctctgggctggctgc

SEQ ID NO: 1294844 - DNA, 19 bp, Homo sapiens
gcctaagggagacaggcct

SEQ ID NO: 1294845 - DNA, 21 bp, Homo sapiens
gcctcggcctggctggccagg

SEQ ID NO: 1294846 - DNA, 22 bp, Homo sapiens
gcctcggcctggctggccagga

SEQ ID NO: 1294847 - DNA, 15 bp, Homo sapiens
gcctctctggctcag

SEQ ID NO: 1294848 - DNA, 17 bp, Homo sapiens
gcctctctggctcagcc

SEQ ID NO: 1294849 - DNA, 14 bp, Homo sapiens
gcctgaagagagga

SEQ ID NO: 1294850 - DNA, 16 bp, Homo sapiens
gcctgagcaggcaggg

SEQ ID NO: 1294851 - DNA, 12 bp, Homo sapiens
gcctgcctgaag

SEQ ID NO: 1294852 - DNA, 13 bp, Homo sapiens
gcctgcctgaaga

SEQ ID NO: 1294853 - DNA, 16 bp, Homo sapiens
gcctgcctgaagagag

SEQ ID NO: 1294854 - DNA, 18 bp, Homo sapiens
gcctgcctgaagagagga

SEQ ID NO: 1294855 - DNA, 22 bp, Homo sapiens
gcctgcctgaagagaggaaact

SEQ ID NO: 1294856 - DNA, 14 bp, Homo sapiens
gcctgctacacagg

SEQ ID NO: 1294857 - DNA, 14 bp, Homo sapiens
gcctggctggccag

SEQ ID NO: 1294858 - DNA, 17 bp, Homo sapiens
gcctggctggccaggac

SEQ ID NO: 1294859 - DNA, 18 bp, Homo sapiens
gcctggctggccaggaca

SEQ ID NO: 1294860 - DNA, 17 bp, Homo sapiens
gcctggggccttcctgg

SEQ ID NO: 1294861 - DNA, 18 bp, Homo sapiens
gcctggggctggctgcag

SEQ ID NO: 1294862 - DNA, 20 bp, Homo sapiens
gcctggggctggctgcagac

SEQ ID NO: 1294863 - DNA, 14 bp, Homo sapiens
gcctgggtcccagg

SEQ ID NO: 1294864 - DNA, 15 bp, Homo sapiens
gcctgggtcccaggg

SEQ ID NO: 1294865 - DNA, 17 bp, Homo sapiens
gcctgggtcccagggct

SEQ ID NO: 1294866 - DNA, 22 bp, Homo sapiens
gcctgggtcccagggctggccc

SEQ ID NO: 1294867 - DNA, 23 bp, Homo sapiens
gcctgggtcccagggctggccct

SEQ ID NO: 1294868 - DNA, 24 bp, Homo sapiens
gcctgggtcccagggctggcccta

SEQ ID NO: 1294869 - DNA, 15 bp, Homo sapiens
gcctgtgcttggagg

SEQ ID NO: 1294870 - DNA, 18 bp, Homo sapiens
gcctgtgcttggaggcct

SEQ ID NO: 1294871 - DNA, 14 bp, Homo sapiens
gcctttccctgccg

SEQ ID NO: 1294872 - DNA, 21 bp, Homo sapiens
gccttttcttcccctcctgta

SEQ ID NO: 1294873 - DNA, 23 bp, Homo sapiens
gccttttcttcccctcctgtaag

SEQ ID NO: 1294874 - DNA, 13 bp, Homo sapiens
tcaaccaggcaga

SEQ ID NO: 1294875 - DNA, 14 bp, Homo sapiens
tcaaccaggcagag

SEQ ID NO: 1294876 - DNA, 16 bp, Homo sapiens
tcaactggcgaagcct

SEQ ID NO: 1294877 - DNA, 21 bp, Homo sapiens
tcaactggcgaagcctgagca

SEQ ID NO: 1294878 - DNA, 14 bp, Homo sapiens
tcaaggcttggaga

SEQ ID NO: 1294879 - DNA, 18 bp, Homo sapiens
tcacaaaccagcctgggg

SEQ ID NO: 1294880 - DNA, 19 bp, Homo sapiens
tcacacacggaggccagac

SEQ ID NO: 1294881 - DNA, 13 bp, Homo sapiens
tcaccagccctga

SEQ ID NO: 1294882 - DNA, 21 bp, Homo sapiens
tcaccagccctgagccatggc

SEQ ID NO: 1294883 - DNA, 23 bp, Homo sapiens
tcaccccagttcccttggtggca

SEQ ID NO: 1294884 - DNA, 12 bp, Homo sapiens
tcacccccagga

SEQ ID NO: 1294885 - DNA, 17 bp, Homo sapiens
tcacccccaggacctct

SEQ ID NO: 1294886 - DNA, 14 bp, Homo sapiens
tcacctgccggctc

SEQ ID NO: 1294887 - DNA, 17 bp, Homo sapiens
tcacctgccggctctgg

SEQ ID NO: 1294888 - DNA, 12 bp, Homo sapiens
tcacggcctggc

SEQ ID NO: 1294889 - DNA, 13 bp, Homo sapiens
tcactctggcccc

SEQ ID NO: 1294890 - DNA, 15 bp, Homo sapiens
tcagatagacctgtg

SEQ ID NO: 1294891 - DNA, 21 bp, Homo sapiens
tcagcccgggatcctgatggc

SEQ ID NO: 1294892 - DNA, 16 bp, Homo sapiens
tcaggcaatgccctgc

SEQ ID NO: 1294893 - DNA, 13 bp, Homo sapiens
tcaggcccagcct

SEQ ID NO: 1294894 - DNA, 20 bp, Homo sapiens
tcaggcccagcctctctggc

SEQ ID NO: 1294895 - DNA, 18 bp, Homo sapiens
tcagtcacaaaccagcct

SEQ ID NO: 1294896 - DNA, 20 bp, Homo sapiens
tcagtcacaaaccagcctgg

SEQ ID NO: 1294897 - DNA, 22 bp, Homo sapiens
tcagtcacaaaccagcctgggg

SEQ ID NO: 1294898 - DNA, 15 bp, Homo sapiens
tcagtctcacctgcc

SEQ ID NO: 1294899 - DNA, 23 bp, Homo sapiens
tcagtctcacctgccggctctgg

SEQ ID NO: 1294900 - DNA, 16 bp, Homo sapiens
tcatcccagctgctga

SEQ ID NO: 1294901 - DNA, 23 bp, Homo sapiens
tccaaggtcccattttccccctg

SEQ ID NO: 1294902 - DNA, 16 bp, Homo sapiens
tccagctcctctccag

SEQ ID NO: 1294903 - DNA, 16 bp, Homo sapiens
tccagctctcccatgg

SEQ ID NO: 1294904 - DNA, 14 bp, Homo sapiens
tccagtgtggctcc

SEQ ID NO: 1294905 - DNA, 20 bp, Homo sapiens
tccagtgtggctcccacagg

SEQ ID NO: 1294906 - DNA, 21 bp, Homo sapiens
tcccacttgacctgagatgct

SEQ ID NO: 1294907 - DNA, 17 bp, Homo sapiens
tcccagggctctctgga

SEQ ID NO: 1294908 - DNA, 20 bp, Homo sapiens
tccctgccggccccccaagg

SEQ ID NO: 1294909 - DNA, 23 bp, Homo sapiens
tcctacaaaaataaaaggcttcc

SEQ ID NO: 1294910 - DNA, 14 bp, Homo sapiens
tcctcacacacgga

SEQ ID NO: 1294911 - DNA, 14 bp, Homo sapiens
tcctgatggcaccc

SEQ ID NO: 1294912 - DNA, 15 bp, Homo sapiens
tcctgggtgctcacc

SEQ ID NO: 1294913 - DNA, 18 bp, Homo sapiens
tccttgctcctggaacct

SEQ ID NO: 1294914 - DNA, 23 bp, Homo sapiens
tccttgctcctggaacctggcag

SEQ ID NO: 1294915 - DNA, 16 bp, Homo sapiens
tcggaagagagggctg

SEQ ID NO: 1294916 - DNA, 17 bp, Homo sapiens
tcggaagagagggctga

SEQ ID NO: 1294917 - DNA, 19 bp, Homo sapiens
tcggcctggctggccagga

SEQ ID NO: 1294918 - DNA, 16 bp, Homo sapiens
tcgggctgccagccca

SEQ ID NO: 1294919 - DNA, 18 bp, Homo sapiens
tcgggctgccagcccagc

SEQ ID NO: 1294920 - DNA, 17 bp, Homo sapiens
tctcacctgccggctct

SEQ ID NO: 1294921 - DNA, 19 bp, Homo sapiens
tctcacctgccggctctgg

SEQ ID NO: 1294922 - DNA, 21 bp, Homo sapiens
tctcacctgccggctctgggc

SEQ ID NO: 1294923 - DNA, 12 bp, Homo sapiens
tctccagacaca

SEQ ID NO: 1294924 - DNA, 16 bp, Homo sapiens
tctccatgctttgctc

SEQ ID NO: 1294925 - DNA, 18 bp, Homo sapiens
tctctggctcagcccggg

SEQ ID NO: 1294926 - DNA, 13 bp, Homo sapiens
tctggtcaggcaa

SEQ ID NO: 1294927 - DNA, 17 bp, Homo sapiens
tcttaaccctgaacaag

SEQ ID NO: 1294928 - DNA, 15 bp, Homo sapiens
tcttcccctcctgta

SEQ ID NO: 1294929 - DNA, 12 bp, Homo sapiens
tcttctcctgtg

SEQ ID NO: 1294930 - DNA, 15 bp, Homo sapiens
tcttcttaaccctga

SEQ ID NO: 1294931 - DNA, 18 bp, Homo sapiens
tgacagatctagttctct

SEQ ID NO: 1294932 - DNA, 20 bp, Homo sapiens
tgacctgagatgctgggagg

SEQ ID NO: 1294933 - DNA, 13 bp, Homo sapiens
tgacctggtctgg

SEQ ID NO: 1294934 - DNA, 17 bp, Homo sapiens
tgacctggtctggtcag

SEQ ID NO: 1294935 - DNA, 21 bp, Homo sapiens
tgacctggtctggtcaggcaa

SEQ ID NO: 1294936 - DNA, 18 bp, Homo sapiens
tgagacaggtgcctgggg

SEQ ID NO: 1294937 - DNA, 15 bp, Homo sapiens
tgagatgctgggagg

SEQ ID NO: 1294938 - DNA, 20 bp, Homo sapiens
tgagatgctgggagggctga

SEQ ID NO: 1294939 - DNA, 13 bp, Homo sapiens
tgagcaggcaggg

SEQ ID NO: 1294940 - DNA, 16 bp, Homo sapiens
tgcacaatgaccagca

SEQ ID NO: 1294941 - DNA, 18 bp, Homo sapiens
tgcagcttgtccttgctc

SEQ ID NO: 1294942 - DNA, 13 bp, Homo sapiens
tgcagtcagtcac

SEQ ID NO: 1294943 - DNA, 17 bp, Homo sapiens
tgccagcccagctggcc

SEQ ID NO: 1294944 - DNA, 12 bp, Homo sapiens
tgcccctcctgg

SEQ ID NO: 1294945 - DNA, 18 bp, Homo sapiens
tgccctgcggctctggaa

SEQ ID NO: 1294946 - DNA, 15 bp, Homo sapiens
tgcccttagagggga

SEQ ID NO: 1294947 - DNA, 12 bp, Homo sapiens
tgccggctctgg

SEQ ID NO: 1294948 - DNA, 13 bp, Homo sapiens
tgccggctctggg

SEQ ID NO: 1294949 - DNA, 17 bp, Homo sapiens
tgccggctctgggctgg

SEQ ID NO: 1294950 - DNA, 20 bp, Homo sapiens
tgccggctctgggctggctg

SEQ ID NO: 1294951 - DNA, 13 bp, Homo sapiens
tgcctcccaggcc

SEQ ID NO: 1294952 - DNA, 15 bp, Homo sapiens
tgcctgaagagagga

SEQ ID NO: 1294953 - DNA, 22 bp, Homo sapiens
tgccttttcttcccctcctgta

SEQ ID NO: 1294954 - DNA, 15 bp, Homo sapiens
tgcggttgggaggca

SEQ ID NO: 1294955 - DNA, 16 bp, Homo sapiens
tgctacacaggcagga

SEQ ID NO: 1294956 - DNA, 15 bp, Homo sapiens
tgctcaccgcctgct

SEQ ID NO: 1294957 - DNA, 14 bp, Homo sapiens
tgctcctggaacct

SEQ ID NO: 1294958 - DNA, 17 bp, Homo sapiens
tgcttggaggcctcaga

SEQ ID NO: 1294959 - DNA, 20 bp, Homo sapiens
tggaacctggcaggccctgc

SEQ ID NO: 1294960 - DNA, 21 bp, Homo sapiens
tggaatccagtgtggctccca

SEQ ID NO: 1294961 - DNA, 13 bp, Homo sapiens
tggacagcccggg

SEQ ID NO: 1294962 - DNA, 14 bp, Homo sapiens
tggacagcccggga

SEQ ID NO: 1294963 - DNA, 13 bp, Homo sapiens
tggacagccggag

SEQ ID NO: 1294964 - DNA, 16 bp, Homo sapiens
tggacagccggagcag

SEQ ID NO: 1294965 - DNA, 17 bp, Homo sapiens
tggacagccggagcagt

SEQ ID NO: 1294966 - DNA, 15 bp, Homo sapiens
tggacatgggcagca

SEQ ID NO: 1294967 - DNA, 16 bp, Homo sapiens
tggacatgggcagcaa

SEQ ID NO: 1294968 - DNA, 16 bp, Homo sapiens
tggacatttgtggcag

SEQ ID NO: 1294969 - DNA, 17 bp, Homo sapiens
tggaccatacgcggagg

SEQ ID NO: 1294970 - DNA, 16 bp, Homo sapiens
tggcaaccccagaccc

SEQ ID NO: 1294971 - DNA, 21 bp, Homo sapiens
tggcacccacacagaggacct

SEQ ID NO: 1294972 - DNA, 17 bp, Homo sapiens
tggcacctttgagagag

SEQ ID NO: 1294973 - DNA, 13 bp, Homo sapiens
tggcaggccctgc

SEQ ID NO: 1294974 - DNA, 14 bp, Homo sapiens
tggcaggccctgcc

SEQ ID NO: 1294975 - DNA, 18 bp, Homo sapiens
tggcagtgctgaaggggg

SEQ ID NO: 1294976 - DNA, 16 bp, Homo sapiens
tggccaggacacactg

SEQ ID NO: 1294977 - DNA, 14 bp, Homo sapiens
tggccctaggcact

SEQ ID NO: 1294978 - DNA, 15 bp, Homo sapiens
tggcctgggtcccag

SEQ ID NO: 1294979 - DNA, 20 bp, Homo sapiens
tggcctgggtcccagggctg

SEQ ID NO: 1294980 - DNA, 21 bp, Homo sapiens
tggcctgggtcccagggctgg

SEQ ID NO: 1294981 - DNA, 22 bp, Homo sapiens
tggcctgggtcccagggctggc

SEQ ID NO: 1294982 - DNA, 15 bp, Homo sapiens
tggcgaagcctgagc

SEQ ID NO: 1294983 - DNA, 23 bp, Homo sapiens
tggcgaagcctgagcaggcaggg

SEQ ID NO: 1294984 - DNA, 17 bp, Homo sapiens
tggcgatctcccagggc

SEQ ID NO: 1294985 - DNA, 17 bp, Homo sapiens
tggcgccgcgtggacag

SEQ ID NO: 1294986 - DNA, 14 bp, Homo sapiens
aaaaaaagatctgt

SEQ ID NO: 1294987 - DNA, 19 bp, Homo sapiens
aaaaggatctttgtggcca

SEQ ID NO: 1294988 - DNA, 20 bp, Homo sapiens
aaaaggatctttgtggccaa

SEQ ID NO: 1294989 - DNA, 23 bp, Homo sapiens
aaaaggatctttgtggccaagga

SEQ ID NO: 1294990 - DNA, 17 bp, Homo sapiens
aaaagtgggcttgattc

SEQ ID NO: 1294991 - DNA, 18 bp, Homo sapiens
aaaagtgggcttgattct

SEQ ID NO: 1294992 - DNA, 16 bp, Homo sapiens
aaaataagaatagaaa

SEQ ID NO: 1294993 - DNA, 18 bp, Homo sapiens
aaaatgcagcagggatgc

SEQ ID NO: 1294994 - DNA, 18 bp, Homo sapiens
aaaatgctttttatttct

SEQ ID NO: 1294995 - DNA, 19 bp, Homo sapiens
aaaatgctttttatttctg

SEQ ID NO: 1294996 - DNA, 19 bp, Homo sapiens
aaaatgtaaaggagtcaaa

SEQ ID NO: 1294997 - DNA, 17 bp, Homo sapiens
aaaattcaattgtaaat

SEQ ID NO: 1294998 - DNA, 15 bp, Homo sapiens
aaaatttctattaaa

SEQ ID NO: 1294999 - DNA, 14 bp, Homo sapiens
aaacaaaatttcta

SEQ ID NO: 1295000 - DNA, 22 bp, Homo sapiens
aaacagacctaatgctccttgt

SEQ ID NO: 1295001 - DNA, 18 bp, Homo sapiens
aaaccttattgtacctct

SEQ ID NO: 1295002 - DNA, 19 bp, Homo sapiens
aaactctgttgcaagtgca

SEQ ID NO: 1295003 - DNA, 20 bp, Homo sapiens
aaactggggcctccagaact

SEQ ID NO: 1295004 - DNA, 17 bp, Homo sapiens
aaacttccccatcttct

SEQ ID NO: 1295005 - DNA, 21 bp, Homo sapiens
aaagagaattgggggcttagg

SEQ ID NO: 1295006 - DNA, 18 bp, Homo sapiens
aaagagtagaattgcatt

SEQ ID NO: 1295007 - DNA, 13 bp, Homo sapiens
aaagatctgtttt

SEQ ID NO: 1295008 - DNA, 16 bp, Homo sapiens
aaagatctgttttgaa

SEQ ID NO: 1295009 - DNA, 15 bp, Homo sapiens
aaagcatttataaat

SEQ ID NO: 1295010 - DNA, 18 bp, Homo sapiens
aaagcttccatgattcta

SEQ ID NO: 1295011 - DNA, 20 bp, Homo sapiens
aaagcttccatgattctatt

SEQ ID NO: 1295012 - DNA, 15 bp, Homo sapiens
aaagcttttagaaat

SEQ ID NO: 1295013 - DNA, 15 bp, Homo sapiens
aaaggaagccaaaga

SEQ ID NO: 1295014 - DNA, 14 bp, Homo sapiens
aaaggtgttgtccc

SEQ ID NO: 1295015 - DNA, 17 bp, Homo sapiens
aaagtgggcttgattct

SEQ ID NO: 1295016 - DNA, 14 bp, Homo sapiens
aaagtgtgctttat

SEQ ID NO: 1295017 - DNA, 20 bp, Homo sapiens
aaagttactaggtaacttca

SEQ ID NO: 1295018 - DNA, 16 bp, Homo sapiens
aaagtttgcttagaaa

SEQ ID NO: 1295019 - DNA, 18 bp, Homo sapiens
aaataaaaggaagccaaa

SEQ ID NO: 1295020 - DNA, 23 bp, Homo sapiens
aaataaaggatgtgattgtggaa

SEQ ID NO: 1295021 - DNA, 19 bp, Homo sapiens
aaataaatttggttctaat

SEQ ID NO: 1295022 - DNA, 17 bp, Homo sapiens
aaatatggaacttacat

SEQ ID NO: 1295023 - DNA, 18 bp, Homo sapiens
aaatatggaacttacatt

SEQ ID NO: 1295024 - DNA, 21 bp, Homo sapiens
aaatatggaacttacattgtt

SEQ ID NO: 1295025 - DNA, 16 bp, Homo sapiens
aaatatggacacttaa

SEQ ID NO: 1295026 - DNA, 12 bp, Homo sapiens
aaatatttatct

SEQ ID NO: 1295027 - DNA, 23 bp, Homo sapiens
aaatcaagtatttgggaagtgaa

SEQ ID NO: 1295028 - DNA, 14 bp, Homo sapiens
aaatctgacccagt

SEQ ID NO: 1295029 - DNA, 13 bp, Homo sapiens
aaatgagccatga

SEQ ID NO: 1295030 - DNA, 18 bp, Homo sapiens
aaatgatgtgtacccaaa

SEQ ID NO: 1295031 - DNA, 14 bp, Homo sapiens
aaatgcatgatttt

SEQ ID NO: 1295032 - DNA, 23 bp, Homo sapiens
aaatggctgcatcccccccacct

SEQ ID NO: 1295033 - DNA, 14 bp, Homo sapiens
acctggcagctctg

SEQ ID NO: 1295034 - DNA, 15 bp, Homo sapiens
acctgtgagcccagc

SEQ ID NO: 1295035 - DNA, 18 bp, Homo sapiens
acctgtgagcccagctgg

SEQ ID NO: 1295036 - DNA, 13 bp, Homo sapiens
accttaggccttc

SEQ ID NO: 1295037 - DNA, 22 bp, Homo sapiens
accttattgtacctctcttata

SEQ ID NO: 1295038 - DNA, 21 bp, Homo sapiens
accttcccaaacgcctcccct

SEQ ID NO: 1295039 - DNA, 16 bp, Homo sapiens
accttcgggctgtgcc

SEQ ID NO: 1295040 - DNA, 22 bp, Homo sapiens
accttttgggaatgttttaaat

SEQ ID NO: 1295041 - DNA, 16 bp, Homo sapiens
acgcacctgcctcagg

SEQ ID NO: 1295042 - DNA, 11 bp, Homo sapiens
acgctttgatt

SEQ ID NO: 1295043 - DNA, 14 bp, Homo sapiens
acgctttgattcat

SEQ ID NO: 1295044 - DNA, 20 bp, Homo sapiens
acggagcccagccctcccca

SEQ ID NO: 1295045 - DNA, 17 bp, Homo sapiens
acggccagggagaagct

SEQ ID NO: 1295046 - DNA, 23 bp, Homo sapiens
acggccagggagaagctcctctc

SEQ ID NO: 1295047 - DNA, 19 bp, Homo sapiens
acggctcgatttctccagg

SEQ ID NO: 1295048 - DNA, 17 bp, Homo sapiens
acgtggctcagccagca

SEQ ID NO: 1295049 - DNA, 16 bp, Homo sapiens
acgtgggcaaacaggc

SEQ ID NO: 1295050 - DNA, 16 bp, Homo sapiens
actaaactcatttata

SEQ ID NO: 1295051 - DNA, 12 bp, Homo sapiens
actaagcagagg

SEQ ID NO: 1295052 - DNA, 15 bp, Homo sapiens
actaagcagaggagg

SEQ ID NO: 1295053 - DNA, 19 bp, Homo sapiens
actaagcagaggaggggcc

SEQ ID NO: 1295054 - DNA, 16 bp, Homo sapiens
actaatttcaaaatgc

SEQ ID NO: 1295055 - DNA, 19 bp, Homo sapiens
actacaaatcaagtatttg

SEQ ID NO: 1295056 - DNA, 18 bp, Homo sapiens
actagatggtgctgagaa

SEQ ID NO: 1295057 - DNA, 15 bp, Homo sapiens
actaggtaacttcat

SEQ ID NO: 1295058 - DNA, 23 bp, Homo sapiens
actatatttgggcctgctccaga

SEQ ID NO: 1295059 - DNA, 24 bp, Homo sapiens
actatgcatggtgccccaggacca

SEQ ID NO: 1295060 - DNA, 20 bp, Homo sapiens
actcaaatggggccagatcc

SEQ ID NO: 1295061 - DNA, 22 bp, Homo sapiens
actcaaatggggccagatccag

SEQ ID NO: 1295062 - DNA, 16 bp, Homo sapiens
actcagatccagggac

SEQ ID NO: 1295063 - DNA, 15 bp, Homo sapiens
actcagcacaaggcc

SEQ ID NO: 1295064 - DNA, 13 bp, Homo sapiens
actcaggaagaac

SEQ ID NO: 1295065 - DNA, 14 bp, Homo sapiens
agacttccttgaga

SEQ ID NO: 1295066 - DNA, 18 bp, Homo sapiens
agagaaaggggagcccac

SEQ ID NO: 1295067 - DNA, 21 bp, Homo sapiens
agagaaaggggagcccactgt

SEQ ID NO: 1295068 - DNA, 22 bp, Homo sapiens
agagacatacttgaagggccag

SEQ ID NO: 1295069 - DNA, 14 bp, Homo sapiens
agagcaagactctg

SEQ ID NO: 1295070 - DNA, 23 bp, Homo sapiens
agagccaggggggtgaggagctg

SEQ ID NO: 1295071 - DNA, 15 bp, Homo sapiens
agagcccagctccaa

SEQ ID NO: 1295072 - DNA, 12 bp, Homo sapiens
agaggaggggcc

SEQ ID NO: 1295073 - DNA, 18 bp, Homo sapiens
agaggaggggccgctgcc

SEQ ID NO: 1295074 - DNA, 15 bp, Homo sapiens
agaggccccagcctc

SEQ ID NO: 1295075 - DNA, 18 bp, Homo sapiens
agaggccctctggagtgg

SEQ ID NO: 1295076 - DNA, 21 bp, Homo sapiens
agaggccctctggagtggcca

SEQ ID NO: 1295077 - DNA, 22 bp, Homo sapiens
agaggccctctggagtggccac

SEQ ID NO: 1295078 - DNA, 19 bp, Homo sapiens
agaggctgaggctggcaca

SEQ ID NO: 1295079 - DNA, 17 bp, Homo sapiens
agagggaggcaagccct

SEQ ID NO: 1295080 - DNA, 18 bp, Homo sapiens
agagtagaattgcattga

SEQ ID NO: 1295081 - DNA, 13 bp, Homo sapiens
agagttgagctct

SEQ ID NO: 1295082 - DNA, 13 bp, Homo sapiens
agataaattataa

SEQ ID NO: 1295083 - DNA, 16 bp, Homo sapiens
agataagtgtattttt

SEQ ID NO: 1295084 - DNA, 19 bp, Homo sapiens
agatactgctactgtaatt

SEQ ID NO: 1295085 - DNA, 23 bp, Homo sapiens
agatactgctactgtaattttat

SEQ ID NO: 1295086 - DNA, 21 bp, Homo sapiens
agatcagtgtaccatttgcct

SEQ ID NO: 1295087 - DNA, 21 bp, Homo sapiens
agatccaaaagaagcccccag

SEQ ID NO: 1295088 - DNA, 23 bp, Homo sapiens
agatccaaaagaagcccccagct

SEQ ID NO: 1295089 - DNA, 12 bp, Homo sapiens
agatccaggact

SEQ ID NO: 1295090 - DNA, 15 bp, Homo sapiens
agatctgtcctcagc

SEQ ID NO: 1295091 - DNA, 17 bp, Homo sapiens
agatctgtcctcagcct

SEQ ID NO: 1295092 - DNA, 14 bp, Homo sapiens
agatctgttttgaa

SEQ ID NO: 1295093 - DNA, 16 bp, Homo sapiens
agatgatacatccaaa

SEQ ID NO: 1295094 - DNA, 17 bp, Homo sapiens
agatgctggcccagggc

SEQ ID NO: 1295095 - DNA, 21 bp, Homo sapiens
agatgctggcccagggcccag

SEQ ID NO: 1295096 - DNA, 21 bp, Homo sapiens
agatgtttccagacttccttg

SEQ ID NO: 1295097 - DNA, 23 bp, Homo sapiens
agatgtttccagacttccttgag

SEQ ID NO: 1295098 - DNA, 22 bp, Homo sapiens
agattggctcacactgagaatg

SEQ ID NO: 1295099 - DNA, 23 bp, Homo sapiens
agattggctcacactgagaatgt

SEQ ID NO: 1295100 - DNA, 18 bp, Homo sapiens
agatttcatctgctctcc

SEQ ID NO: 1295101 - DNA, 15 bp, Homo sapiens
agatttccagtctcc

SEQ ID NO: 1295102 - DNA, 14 bp, Homo sapiens
agattttaattttg

SEQ ID NO: 1295103 - DNA, 14 bp, Homo sapiens
agcaaccccaggct

SEQ ID NO: 1295104 - DNA, 15 bp, Homo sapiens
agcaaccccaggctg

SEQ ID NO: 1295105 - DNA, 14 bp, Homo sapiens
agcaactcttgatt

SEQ ID NO: 1295106 - DNA, 20 bp, Homo sapiens
agcaactcttgattatccat

SEQ ID NO: 1295107 - DNA, 20 bp, Homo sapiens
agcaagggttccctcaagag

SEQ ID NO: 1295108 - DNA, 12 bp, Homo sapiens
agcacagcagcc

SEQ ID NO: 1295109 - DNA, 23 bp, Homo sapiens
agcacagccaacacgcacctgcc

SEQ ID NO: 1295110 - DNA, 14 bp, Homo sapiens
agcactttgggagg

SEQ ID NO: 1295111 - DNA, 16 bp, Homo sapiens
agcagaagggggtggt

SEQ ID NO: 1295112 - DNA, 21 bp, Homo sapiens
agcagaggaggggccgctgcc

SEQ ID NO: 1295113 - DNA, 18 bp, Homo sapiens
agcagcaccgttctgtgc

SEQ ID NO: 1295114 - DNA, 19 bp, Homo sapiens
agcagcaccgttctgtgca

SEQ ID NO: 1295115 - DNA, 21 bp, Homo sapiens
agcagggaaaatgcagcaggg

SEQ ID NO: 1295116 - DNA, 18 bp, Homo sapiens
agcaggttcccaagctca

SEQ ID NO: 1295117 - DNA, 17 bp, Homo sapiens
agcagttttcaagtcaa

SEQ ID NO: 1295118 - DNA, 22 bp, Homo sapiens
agcagttttcaagtcaaattaa

SEQ ID NO: 1295119 - DNA, 22 bp, Homo sapiens
agccaacacgcacctgcctcag

SEQ ID NO: 1295120 - DNA, 22 bp, Homo sapiens
agccacaggcctgagatttcat

SEQ ID NO: 1295121 - DNA, 20 bp, Homo sapiens
agccacatttggaatacttt

SEQ ID NO: 1295122 - DNA, 21 bp, Homo sapiens
agccaccgaagccgcctgtgg

SEQ ID NO: 1295123 - DNA, 22 bp, Homo sapiens
agccaccttttgggaatgtttt

SEQ ID NO: 1295124 - DNA, 23 bp, Homo sapiens
agccaccttttgggaatgtttta

SEQ ID NO: 1295125 - DNA, 21 bp, Homo sapiens
agccagcacttgtccagctga

SEQ ID NO: 1295126 - DNA, 15 bp, Homo sapiens
agccagctccctcta

SEQ ID NO: 1295127 - DNA, 21 bp, Homo sapiens
agccaggaatttcccaggacc

SEQ ID NO: 1295128 - DNA, 13 bp, Homo sapiens
agccatcaaaatg

SEQ ID NO: 1295129 - DNA, 21 bp, Homo sapiens
agccatgagatgatacatcca

SEQ ID NO: 1295130 - DNA, 15 bp, Homo sapiens
agccatgtctgcatt

SEQ ID NO: 1295131 - DNA, 21 bp, Homo sapiens
agcccaagggatctggtccta

SEQ ID NO: 1295132 - DNA, 20 bp, Homo sapiens
agcccaatattataattttt

SEQ ID NO: 1295133 - DNA, 10 bp, Homo sapiens
agcccagaga

SEQ ID NO: 1295134 - DNA, 11 bp, Homo sapiens
agcccagagac

SEQ ID NO: 1295135 - DNA, 15 bp, Homo sapiens
agcccagaggagggc

SEQ ID NO: 1295136 - DNA, 16 bp, Homo sapiens
agcccagctgggtcag

SEQ ID NO: 1295137 - DNA, 17 bp, Homo sapiens
agcccagctgggtcagg

SEQ ID NO: 1295138 - DNA, 21 bp, Homo sapiens
agcccagctgggtcaggcagg

SEQ ID NO: 1295139 - DNA, 16 bp, Homo sapiens
agccccctggcctctg

SEQ ID NO: 1295140 - DNA, 17 bp, Homo sapiens
agccccctggcctctgt

SEQ ID NO: 1295141 - DNA, 20 bp, Homo sapiens
agcccctgtctagagaggga

SEQ ID NO: 1295142 - DNA, 21 bp, Homo sapiens
agcccctgtctagagagggag

SEQ ID NO: 1295143 - DNA, 22 bp, Homo sapiens
agcccctgtctagagagggagg

SEQ ID NO: 1295144 - DNA, 16 bp, Homo sapiens
agccccttctgctcag

SEQ ID NO: 1295145 - DNA, 14 bp, Homo sapiens
agccctcgtctccc

SEQ ID NO: 1295146 - DNA, 17 bp, Homo sapiens
agccctgttgacacagg

SEQ ID NO: 1295147 - DNA, 18 bp, Homo sapiens
agccctgttgacacaggt

SEQ ID NO: 1295148 - DNA, 17 bp, Homo sapiens
agcctcccatccagggc

SEQ ID NO: 1295149 - DNA, 14 bp, Homo sapiens
agcctccctgaagc

SEQ ID NO: 1295150 - DNA, 16 bp, Homo sapiens
agcctctgctccccag

SEQ ID NO: 1295151 - DNA, 12 bp, Homo sapiens
agcctggccaga

SEQ ID NO: 1295152 - DNA, 13 bp, Homo sapiens
agccttgccagag

SEQ ID NO: 1295153 - DNA, 15 bp, Homo sapiens
agccttgccagagat

SEQ ID NO: 1295154 - DNA, 12 bp, Homo sapiens
aagccaaagagt

SEQ ID NO: 1295155 - DNA, 17 bp, Homo sapiens
aagccacaggcctgaga

SEQ ID NO: 1295156 - DNA, 19 bp, Homo sapiens
aagccacaggcctgagatt

SEQ ID NO: 1295157 - DNA, 20 bp, Homo sapiens
aagccaggaatttcccagga

SEQ ID NO: 1295158 - DNA, 21 bp, Homo sapiens
aagccaggaatttcccaggac

SEQ ID NO: 1295159 - DNA, 22 bp, Homo sapiens
aagccaggaatttcccaggacc

SEQ ID NO: 1295160 - DNA, 24 bp, Homo sapiens
aagccaggaatttcccaggaccct

SEQ ID NO: 1295161 - DNA, 20 bp, Homo sapiens
aagcccccaccgtgggcagg

SEQ ID NO: 1295162 - DNA, 23 bp, Homo sapiens
aagcccccagctaagaacctgga

SEQ ID NO: 1295163 - DNA, 22 bp, Homo sapiens
aagctaatttgcattaaattca

SEQ ID NO: 1295164 - DNA, 22 bp, Homo sapiens
aagctactgtgtgtgtgaatga

SEQ ID NO: 1295165 - DNA, 22 bp, Homo sapiens
aagctcagaggcgcactgtgac

SEQ ID NO: 1295166 - DNA, 13 bp, Homo sapiens
aagctcctcctcc

SEQ ID NO: 1295167 - DNA, 17 bp, Homo sapiens
aagctcctcctccctgc

SEQ ID NO: 1295168 - DNA, 16 bp, Homo sapiens
aagctcctctccccag

SEQ ID NO: 1295169 - DNA, 13 bp, Homo sapiens
aagctgtggccag

SEQ ID NO: 1295170 - DNA, 15 bp, Homo sapiens
aagctgtttccatag

SEQ ID NO: 1295171 - DNA, 23 bp, Homo sapiens
aagctgtttccatagggtgacac

SEQ ID NO: 1295172 - DNA, 18 bp, Homo sapiens
aagcttttagaaatactg

SEQ ID NO: 1295173 - DNA, 21 bp, Homo sapiens
aaggacttcctgtccagctcc

SEQ ID NO: 1295174 - DNA, 22 bp, Homo sapiens
aaggacttcctgtccagctcca

SEQ ID NO: 1295175 - DNA, 20 bp, Homo sapiens
aaggagaggcaacatccaaa

SEQ ID NO: 1295176 - DNA, 14 bp, Homo sapiens
aaggagctgctata

SEQ ID NO: 1295177 - DNA, 18 bp, Homo sapiens
aaggagctgctatagcct

SEQ ID NO: 1295178 - DNA, 21 bp, Homo sapiens
aaggagctgctatagcctggg

SEQ ID NO: 1295179 - DNA, 20 bp, Homo sapiens
aaggatagatgctggcccag

SEQ ID NO: 1295180 - DNA, 16 bp, Homo sapiens
aaggatctttgtggcc

SEQ ID NO: 1295181 - DNA, 20 bp, Homo sapiens
aaggatctttgtggccaagg

SEQ ID NO: 1295182 - DNA, 17 bp, Homo sapiens
aaggatgtgattgtgga

SEQ ID NO: 1295183 - DNA, 22 bp, Homo sapiens
aaggatgtgattgtggaatgga

SEQ ID NO: 1295184 - DNA, 14 bp, Homo sapiens
aaggcaaaattgca

SEQ ID NO: 1295185 - DNA, 15 bp, Homo sapiens
aaggctgcttagaat

SEQ ID NO: 1295186 - DNA, 11 bp, Homo sapiens
aagggccagag

SEQ ID NO: 1295187 - DNA, 13 bp, Homo sapiens
aagggccagagcc

SEQ ID NO: 1295188 - DNA, 14 bp, Homo sapiens
aagggccagagcca

SEQ ID NO: 1295189 - DNA, 13 bp, Homo sapiens
aaggggagcccac

SEQ ID NO: 1295190 - DNA, 18 bp, Homo sapiens
aaggggcgtctgttcccc

SEQ ID NO: 1295191 - DNA, 17 bp, Homo sapiens
aagggggtggtgtctcc

SEQ ID NO: 1295192 - DNA, 17 bp, Homo sapiens
aaggtgatatatttaaa

SEQ ID NO: 1295193 - DNA, 18 bp, Homo sapiens
aaggtgctgacggccagg

SEQ ID NO: 1295194 - DNA, 19 bp, Homo sapiens
aaggtttaggctggtggcc

SEQ ID NO: 1295195 - DNA, 22 bp, Homo sapiens
aaggtttaggctggtggcccag

SEQ ID NO: 1295196 - DNA, 22 bp, Homo sapiens
aagtgctggcaaccactaagaa

SEQ ID NO: 1295197 - DNA, 17 bp, Homo sapiens
aagtggactcagggcag

SEQ ID NO: 1295198 - DNA, 18 bp, Homo sapiens
agtaattgacatgtgcca

SEQ ID NO: 1295199 - DNA, 14 bp, Homo sapiens
agtaccatttatac

SEQ ID NO: 1295200 - DNA, 21 bp, Homo sapiens
agtaccatttatacaaattag

SEQ ID NO: 1295201 - DNA, 22 bp, Homo sapiens
agtactttggaggcccctatgt

SEQ ID NO: 1295202 - DNA, 17 bp, Homo sapiens
agtataaacaaagttac

SEQ ID NO: 1295203 - DNA, 15 bp, Homo sapiens
agtatcatgccctgt

SEQ ID NO: 1295204 - DNA, 22 bp, Homo sapiens
agtcaaatggtaggcatttcct

SEQ ID NO: 1295205 - DNA, 23 bp, Homo sapiens
agtcaaatggtaggcatttccta

SEQ ID NO: 1295206 - DNA, 18 bp, Homo sapiens
agtcaagctcctcctccc

SEQ ID NO: 1295207 - DNA, 21 bp, Homo sapiens
agtcataatcattagggggaa

SEQ ID NO: 1295208 - DNA, 15 bp, Homo sapiens
agtcattggctgtct

SEQ ID NO: 1295209 - DNA, 14 bp, Homo sapiens
agtccaatgtggca

SEQ ID NO: 1295210 - DNA, 21 bp, Homo sapiens
agtccgtgctgacagctgctc

SEQ ID NO: 1295211 - DNA, 23 bp, Homo sapiens
agtccgtgctgacagctgctcct

SEQ ID NO: 1295212 - DNA, 17 bp, Homo sapiens
agtcctcataaaaagca

SEQ ID NO: 1295213 - DNA, 18 bp, Homo sapiens
agtcctcataaaaagcaa

SEQ ID NO: 1295214 - DNA, 17 bp, Homo sapiens
agtctagatggctcctc

SEQ ID NO: 1295215 - DNA, 18 bp, Homo sapiens
agtctagatggctcctct

SEQ ID NO: 1295216 - DNA, 19 bp, Homo sapiens
agtctagatggctcctctc

SEQ ID NO: 1295217 - DNA, 16 bp, Homo sapiens
agtctccaccaggaac

SEQ ID NO: 1295218 - DNA, 18 bp, Homo sapiens
atcgaatctactaattcc

SEQ ID NO: 1295219 - DNA, 20 bp, Homo sapiens
atcgaatctactaattccac

SEQ ID NO: 1295220 - DNA, 21 bp, Homo sapiens
atcggatctggggctctggga

SEQ ID NO: 1295221 - DNA, 13 bp, Homo sapiens
atctaagcctgaa

SEQ ID NO: 1295222 - DNA, 16 bp, Homo sapiens
atctaatatggccaca

SEQ ID NO: 1295223 - DNA, 23 bp, Homo sapiens
atctaatatggccacagtagtct

SEQ ID NO: 1295224 - DNA, 19 bp, Homo sapiens
atctactaattccacacct

SEQ ID NO: 1295225 - DNA, 20 bp, Homo sapiens
atctctaacagctcaggatc

SEQ ID NO: 1295226 - DNA, 14 bp, Homo sapiens
atctctctgcccaa

SEQ ID NO: 1295227 - DNA, 13 bp, Homo sapiens
atctcttagctcc

SEQ ID NO: 1295228 - DNA, 22 bp, Homo sapiens
atctcttagctcccctccaacc

SEQ ID NO: 1295229 - DNA, 23 bp, Homo sapiens
atctcttagctcccctccaacct

SEQ ID NO: 1295230 - DNA, 19 bp, Homo sapiens
atctgacatgattccttcc

SEQ ID NO: 1295231 - DNA, 23 bp, Homo sapiens
atctgacatgattccttcctgtt

SEQ ID NO: 1295232 - DNA, 15 bp, Homo sapiens
atctgaccagcagcg

SEQ ID NO: 1295233 - DNA, 13 bp, Homo sapiens
atctgacccagtg

SEQ ID NO: 1295234 - DNA, 21 bp, Homo sapiens
atctgacccagtgcccccact

SEQ ID NO: 1295235 - DNA, 20 bp, Homo sapiens
attccagaatgctgtacatc

SEQ ID NO: 1295236 - DNA, 16 bp, Homo sapiens
attcctctttgctttg

SEQ ID NO: 1295237 - DNA, 17 bp, Homo sapiens
attcctctttgctttgc

SEQ ID NO: 1295238 - DNA, 19 bp, Homo sapiens
attcctgaagaaccagtcc

SEQ ID NO: 1295239 - DNA, 16 bp, Homo sapiens
attccttcctgttctg

SEQ ID NO: 1295240 - DNA, 18 bp, Homo sapiens
attccttcctgttctgaa

SEQ ID NO: 1295241 - DNA, 15 bp, Homo sapiens
attctccttcagccc

SEQ ID NO: 1295242 - DNA, 16 bp, Homo sapiens
attctccttcagccct

SEQ ID NO: 1295243 - DNA, 18 bp, Homo sapiens
attctccttcagccctca

SEQ ID NO: 1295244 - DNA, 23 bp, Homo sapiens
attctccttcagccctcacccct

SEQ ID NO: 1295245 - DNA, 15 bp, Homo sapiens
attctctccaaaaat

SEQ ID NO: 1295246 - DNA, 17 bp, Homo sapiens
attctgcagtaaatctt

SEQ ID NO: 1295247 - DNA, 18 bp, Homo sapiens
attctgcagtaaatcttt

SEQ ID NO: 1295248 - DNA, 16 bp, Homo sapiens
attcttttgtaattta

SEQ ID NO: 1295249 - DNA, 22 bp, Homo sapiens
caagctcctcctccctgcatct

SEQ ID NO: 1295250 - DNA, 13 bp, Homo sapiens
caaggagctgcta

SEQ ID NO: 1295251 - DNA, 22 bp, Homo sapiens
caaggagctgctatagcctggg

SEQ ID NO: 1295252 - DNA, 22 bp, Homo sapiens
caaggatagatgctggcccagg

SEQ ID NO: 1295253 - DNA, 23 bp, Homo sapiens
caaggatagatgctggcccaggg

SEQ ID NO: 1295254 - DNA, 17 bp, Homo sapiens
caagggatctggtccta

SEQ ID NO: 1295255 - DNA, 20 bp, Homo sapiens
caagggatctggtcctaccc

SEQ ID NO: 1295256 - DNA, 18 bp, Homo sapiens
caaggggaatcagaactc

SEQ ID NO: 1295257 - DNA, 20 bp, Homo sapiens
caaggtcctctgtcagtcac

SEQ ID NO: 1295258 - DNA, 13 bp, Homo sapiens
cagaggaggggcc

SEQ ID NO: 1295259 - DNA, 17 bp, Homo sapiens
cagaggccccagcctcc

SEQ ID NO: 1295260 - DNA, 13 bp, Homo sapiens
cagatccagcctg

SEQ ID NO: 1295261 - DNA, 17 bp, Homo sapiens
cagatccagcctggggt

SEQ ID NO: 1295262 - DNA, 23 bp, Homo sapiens
cagatccagggacagaggcccca

SEQ ID NO: 1295263 - DNA, 16 bp, Homo sapiens
ccagcttgttatttat

SEQ ID NO: 1295264 - DNA, 17 bp, Homo sapiens
cccggctaatttttgta

SEQ ID NO: 1295265 - DNA, 22 bp, Homo sapiens
ccctcacccctggttctcatct

SEQ ID NO: 1295266 - DNA, 20 bp, Homo sapiens
ccctcaccttggcaccagac

SEQ ID NO: 1295267 - DNA, 16 bp, Homo sapiens
ccctccccgccctttt

SEQ ID NO: 1295268 - DNA, 19 bp, Homo sapiens
ccctccctgttccccagag

SEQ ID NO: 1295269 - DNA, 13 bp, Homo sapiens
ccctcctctccca

SEQ ID NO: 1295270 - DNA, 14 bp, Homo sapiens
ccctcctctcccat

SEQ ID NO: 1295271 - DNA, 14 bp, Homo sapiens
ccctctccttcctg

SEQ ID NO: 1295272 - DNA, 21 bp, Homo sapiens
ccctctggagtggccactaag

SEQ ID NO: 1295273 - DNA, 22 bp, Homo sapiens
ccctctggagtggccactaagc

SEQ ID NO: 1295274 - DNA, 16 bp, Homo sapiens
ccctgaccctgtatat

SEQ ID NO: 1295275 - DNA, 19 bp, Homo sapiens
ccctgaccctgtggaagca

SEQ ID NO: 1295276 - DNA, 16 bp, Homo sapiens
ccctgcatctgaccag

SEQ ID NO: 1295277 - DNA, 18 bp, Homo sapiens
ccctgcccccaggactgg

SEQ ID NO: 1295278 - DNA, 17 bp, Homo sapiens
ccctgcggtagatggga

SEQ ID NO: 1295279 - DNA, 12 bp, Homo sapiens
ccctggagccca

SEQ ID NO: 1295280 - DNA, 23 bp, Homo sapiens
ccctggctgggacgtggctcagc

SEQ ID NO: 1295281 - DNA, 16 bp, Homo sapiens
ccctggtggttgctgt

SEQ ID NO: 1295282 - DNA, 15 bp, Homo sapiens
ccctggttctcatct

SEQ ID NO: 1295283 - DNA, 17 bp, Homo sapiens
ccctgttccccagagaa

SEQ ID NO: 1295284 - DNA, 20 bp, Homo sapiens
cccttcacaaagcccaaggg

SEQ ID NO: 1295285 - DNA, 13 bp, Homo sapiens
cccttccctcacc

SEQ ID NO: 1295286 - DNA, 23 bp, Homo sapiens
cccttctagggttattgcatttg

SEQ ID NO: 1295287 - DNA, 15 bp, Homo sapiens
cccttctctcatctc

SEQ ID NO: 1295288 - DNA, 18 bp, Homo sapiens
ccgaagccgcctgtggac

SEQ ID NO: 1295289 - DNA, 19 bp, Homo sapiens
ccgagtcattcgttctgtg

SEQ ID NO: 1295290 - DNA, 12 bp, Homo sapiens
ccgagtccaagc

SEQ ID NO: 1295291 - DNA, 13 bp, Homo sapiens
ccgcagagctggc

SEQ ID NO: 1295292 - DNA, 15 bp, Homo sapiens
ccgcagagctggccg

SEQ ID NO: 1295293 - DNA, 22 bp, Homo sapiens
ccgcagtgtgcactaaggggcc

SEQ ID NO: 1295294 - DNA, 23 bp, Homo sapiens
ccgcagtgtgcactaaggggccc

SEQ ID NO: 1295295 - DNA, 22 bp, Homo sapiens
ccgcgccaaataatgtctctgt

SEQ ID NO: 1295296 - DNA, 11 bp, Homo sapiens
ccgctgccacc

SEQ ID NO: 1295297 - DNA, 16 bp, Homo sapiens
ccgctgccacccacct

SEQ ID NO: 1295298 - DNA, 11 bp, Homo sapiens
ccggccagccc

SEQ ID NO: 1295299 - DNA, 15 bp, Homo sapiens
ccggggaaaggcaag

SEQ ID NO: 1295300 - DNA, 16 bp, Homo sapiens
ccgtgctcgccccagc

SEQ ID NO: 1295301 - DNA, 19 bp, Homo sapiens
ccgtgctgacagctgctcc

SEQ ID NO: 1295302 - DNA, 22 bp, Homo sapiens
ccgtttgagaagaaaacatcta

SEQ ID NO: 1295303 - DNA, 22 bp, Homo sapiens
cctaaaagtgggcttgattctg

SEQ ID NO: 1295304 - DNA, 16 bp, Homo sapiens
cctaatgctccttgtt

SEQ ID NO: 1295305 - DNA, 20 bp, Homo sapiens
cctacagctttgatccctga

SEQ ID NO: 1295306 - DNA, 21 bp, Homo sapiens
cctacagctttgatccctgac

SEQ ID NO: 1295307 - DNA, 17 bp, Homo sapiens
cctagagggaggggcct

SEQ ID NO: 1295308 - DNA, 20 bp, Homo sapiens
cctagcagcaccgttctgtg

SEQ ID NO: 1295309 - DNA, 20 bp, Homo sapiens
cctaggagtgccccattctt

SEQ ID NO: 1295310 - DNA, 17 bp, Homo sapiens
cctatcacctatttcca

SEQ ID NO: 1295311 - DNA, 18 bp, Homo sapiens
cctatgtagtccgtgctg

SEQ ID NO: 1295312 - DNA, 15 bp, Homo sapiens
cctcaccttggcacc

SEQ ID NO: 1295313 - DNA, 18 bp, Homo sapiens
cctcagccctgaccctgt

SEQ ID NO: 1295314 - DNA, 21 bp, Homo sapiens
cctcagccctgaccctgtgga

SEQ ID NO: 1295315 - DNA, 12 bp, Homo sapiens
cctcagcctggc

SEQ ID NO: 1295316 - DNA, 19 bp, Homo sapiens
cctcagcctggccagacac

SEQ ID NO: 1295317 - DNA, 22 bp, Homo sapiens
cctcagcctggccagacacagg

SEQ ID NO: 1295318 - DNA, 17 bp, Homo sapiens
cctcagccttgccagag

SEQ ID NO: 1295319 - DNA, 19 bp, Homo sapiens
cctcagccttgccagagat

SEQ ID NO: 1295320 - DNA, 22 bp, Homo sapiens
cctcagccttgccagagatcca

SEQ ID NO: 1295321 - DNA, 19 bp, Homo sapiens
cctcaggaggcaggacctt

SEQ ID NO: 1295322 - DNA, 15 bp, Homo sapiens
cctcaggtggccatg

SEQ ID NO: 1295323 - DNA, 18 bp, Homo sapiens
cctcaggtggccatgcct

SEQ ID NO: 1295324 - DNA, 19 bp, Homo sapiens
cctccaacctggggggcag

SEQ ID NO: 1295325 - DNA, 22 bp, Homo sapiens
cctccagctctttcctccttcc

SEQ ID NO: 1295326 - DNA, 16 bp, Homo sapiens
cctccagggctggact

SEQ ID NO: 1295327 - DNA, 17 bp, Homo sapiens
cctccagggctggactg

SEQ ID NO: 1295328 - DNA, 22 bp, Homo sapiens
cctccagggctggactgaggcc

SEQ ID NO: 1295329 - DNA, 23 bp, Homo sapiens
cctccagggctggactgaggcct

SEQ ID NO: 1295330 - DNA, 19 bp, Homo sapiens
cctcccaatttcagactcc

SEQ ID NO: 1295331 - DNA, 15 bp, Homo sapiens
cctcccatccagggc

SEQ ID NO: 1295332 - DNA, 15 bp, Homo sapiens
cctcccccccatgca

SEQ ID NO: 1295333 - DNA, 17 bp, Homo sapiens
cctcccccccatgcact

SEQ ID NO: 1295334 - DNA, 16 bp, Homo sapiens
cctccccgcccttttt

SEQ ID NO: 1295335 - DNA, 12 bp, Homo sapiens
cctccctgcctc

SEQ ID NO: 1295336 - DNA, 20 bp, Homo sapiens
cctccctgttccccagagaa

SEQ ID NO: 1295337 - DNA, 15 bp, Homo sapiens
cctcccttctgctac

SEQ ID NO: 1295338 - DNA, 14 bp, Homo sapiens
cctccttcagacac

SEQ ID NO: 1295339 - DNA, 22 bp, Homo sapiens
cctccttcagacaccctcaacc

SEQ ID NO: 1295340 - DNA, 16 bp, Homo sapiens
cctcgaaacacagaaa

SEQ ID NO: 1295341 - DNA, 19 bp, Homo sapiens
cctctccccagcccagaga

SEQ ID NO: 1295342 - DNA, 22 bp, Homo sapiens
cctctgccccatcctccagcag

SEQ ID NO: 1295343 - DNA, 16 bp, Homo sapiens
cctctggagtggccac

SEQ ID NO: 1295344 - DNA, 18 bp, Homo sapiens
cctctgtcagtcacagcc

SEQ ID NO: 1295345 - DNA, 22 bp, Homo sapiens
cctctgtccccttctctcatct

SEQ ID NO: 1295346 - DNA, 21 bp, Homo sapiens
cctctgtgccttcttttgatt

SEQ ID NO: 1295347 - DNA, 12 bp, Homo sapiens
cctcttgtaaat

SEQ ID NO: 1295348 - DNA, 14 bp, Homo sapiens
cctcttgtaaataa

SEQ ID NO: 1295349 - DNA, 17 bp, Homo sapiens
cctcttgtaaataaagc

SEQ ID NO: 1295350 - DNA, 17 bp, Homo sapiens
cctgaagaaccagtccc

SEQ ID NO: 1295351 - DNA, 16 bp, Homo sapiens
cctgaaggggcgtctg

SEQ ID NO: 1295352 - DNA, 22 bp, Homo sapiens
cctgaaggggcgtctgttcccc

SEQ ID NO: 1295353 - DNA, 17 bp, Homo sapiens
cctgaccctgtatatag

SEQ ID NO: 1295354 - DNA, 15 bp, Homo sapiens
cctgagatttcatct

SEQ ID NO: 1295355 - DNA, 16 bp, Homo sapiens
cctgagatttcatctg

SEQ ID NO: 1295356 - DNA, 13 bp, Homo sapiens
cctgagcaactct

SEQ ID NO: 1295357 - DNA, 21 bp, Homo sapiens
cctgagcgctcctgccgcaga

SEQ ID NO: 1295358 - DNA, 20 bp, Homo sapiens
cctgaggctttggatttgac

SEQ ID NO: 1295359 - DNA, 13 bp, Homo sapiens
cctgatcctggag

SEQ ID NO: 1295360 - DNA, 18 bp, Homo sapiens
cctgatcctggaggccca

SEQ ID NO: 1295361 - DNA, 18 bp, Homo sapiens
cctgatttaggagaagcc

SEQ ID NO: 1295362 - DNA, 20 bp, Homo sapiens
cctgatttaggagaagccag

SEQ ID NO: 1295363 - DNA, 22 bp, Homo sapiens
cctgatttaggagaagccagga

SEQ ID NO: 1295364 - DNA, 18 bp, Homo sapiens
cctgcatctgaccagcag

SEQ ID NO: 1295365 - DNA, 12 bp, Homo sapiens
cctgccagctgc

SEQ ID NO: 1295366 - DNA, 22 bp, Homo sapiens
cctgcccccaggactgggccac

SEQ ID NO: 1295367 - DNA, 12 bp, Homo sapiens
cctgcctcagga

SEQ ID NO: 1295368 - DNA, 12 bp, Homo sapiens
cctgcctccagg

SEQ ID NO: 1295369 - DNA, 15 bp, Homo sapiens
cctgcctccaggaac

SEQ ID NO: 1295370 - DNA, 20 bp, Homo sapiens
cctgcctccaggaaccacac

SEQ ID NO: 1295371 - DNA, 16 bp, Homo sapiens
cctgcctccagggctg

SEQ ID NO: 1295372 - DNA, 20 bp, Homo sapiens
cctgcctccagggctggact

SEQ ID NO: 1295373 - DNA, 18 bp, Homo sapiens
cctggccgagtccaagct

SEQ ID NO: 1295374 - DNA, 19 bp, Homo sapiens
cctggccgagtccaagctg

SEQ ID NO: 1295375 - DNA, 20 bp, Homo sapiens
cctggctgggacgtggctca

SEQ ID NO: 1295376 - DNA, 12 bp, Homo sapiens
cctgggcctgca

SEQ ID NO: 1295377 - DNA, 19 bp, Homo sapiens
cctggggctggcctcccaa

SEQ ID NO: 1295378 - DNA, 19 bp, Homo sapiens
cctggtaggagtgtgtgat

SEQ ID NO: 1295379 - DNA, 21 bp, Homo sapiens
cctgtatatagcccagccagg

SEQ ID NO: 1295380 - DNA, 17 bp, Homo sapiens
cctgtctagagagggag

SEQ ID NO: 1295381 - DNA, 20 bp, Homo sapiens
cctgtgagcccagctgggtc

SEQ ID NO: 1295382 - DNA, 16 bp, Homo sapiens
cctgttagcagacagg

SEQ ID NO: 1295383 - DNA, 13 bp, Homo sapiens
ccttaggccttcc

SEQ ID NO: 1295384 - DNA, 14 bp, Homo sapiens
ccttaggccttcct

SEQ ID NO: 1295385 - DNA, 15 bp, Homo sapiens
ccttattgtacctct

SEQ ID NO: 1295386 - DNA, 16 bp, Homo sapiens
ccttattgtacctctc

SEQ ID NO: 1295387 - DNA, 11 bp, Homo sapiens
ccttcagacac

SEQ ID NO: 1295388 - DNA, 14 bp, Homo sapiens
ccttcagccctcac

SEQ ID NO: 1295389 - DNA, 22 bp, Homo sapiens
ccttccagtgtccttagaacat

SEQ ID NO: 1295390 - DNA, 21 bp, Homo sapiens
ccttcctggagcccagaggag

SEQ ID NO: 1295391 - DNA, 15 bp, Homo sapiens
ccttcctgttctgaa

SEQ ID NO: 1295392 - DNA, 14 bp, Homo sapiens
ccttcgggctgtgc

SEQ ID NO: 1295393 - DNA, 16 bp, Homo sapiens
ccttcgggctgtgccc

SEQ ID NO: 1295394 - DNA, 14 bp, Homo sapiens
ccttctaaaggtgt

SEQ ID NO: 1295395 - DNA, 16 bp, Homo sapiens
ccttctcctcttgtaa

SEQ ID NO: 1295396 - DNA, 15 bp, Homo sapiens
ccttctctcatctct

SEQ ID NO: 1295397 - DNA, 21 bp, Homo sapiens
ccttctctcatctcttagctc

SEQ ID NO: 1295398 - DNA, 13 bp, Homo sapiens
ccttctgctactg

SEQ ID NO: 1295399 - DNA, 12 bp, Homo sapiens
ccttgaatgtgg

SEQ ID NO: 1295400 - DNA, 23 bp, Homo sapiens
ccttgattgttcgggtgtgcaat

SEQ ID NO: 1295401 - DNA, 13 bp, Homo sapiens
ccttgccagagat

SEQ ID NO: 1295402 - DNA, 16 bp, Homo sapiens
ccttgccagagatcca

SEQ ID NO: 1295403 - DNA, 20 bp, Homo sapiens
ccttggcaccagacacccag

SEQ ID NO: 1295404 - DNA, 20 bp, Homo sapiens
cctttctcccctgcccccag

SEQ ID NO: 1295405 - DNA, 15 bp, Homo sapiens
cctttggttctggcc

SEQ ID NO: 1295406 - DNA, 17 bp, Homo sapiens
cgaaacacagaaacctt

SEQ ID NO: 1295407 - DNA, 18 bp, Homo sapiens
cgaaacctgggattcagg

SEQ ID NO: 1295408 - DNA, 19 bp, Homo sapiens
cgaacatccaaccttccca

SEQ ID NO: 1295409 - DNA, 17 bp, Homo sapiens
cgaatctactaattcca

SEQ ID NO: 1295410 - DNA, 14 bp, Homo sapiens
cgactaatttcaaa

SEQ ID NO: 1295411 - DNA, 16 bp, Homo sapiens
cgagaactttcatttt

SEQ ID NO: 1295412 - DNA, 17 bp, Homo sapiens
cgagaactttcattttt

SEQ ID NO: 1295413 - DNA, 19 bp, Homo sapiens
cgagtcattcgttctgtgg

SEQ ID NO: 1295414 - DNA, 20 bp, Homo sapiens
cgagtcattcgttctgtgga

SEQ ID NO: 1295415 - DNA, 14 bp, Homo sapiens
cgagtccaagctgg

SEQ ID NO: 1295416 - DNA, 17 bp, Homo sapiens
cgcactgtgacccccag

SEQ ID NO: 1295417 - DNA, 22 bp, Homo sapiens
cgcactgtgacccccagctccg

SEQ ID NO: 1295418 - DNA, 23 bp, Homo sapiens
cgccaggatggaacacggccaca

SEQ ID NO: 1295419 - DNA, 20 bp, Homo sapiens
cgcccaggctggagtgcagt

SEQ ID NO: 1295420 - DNA, 14 bp, Homo sapiens
cgcctttcccaact

SEQ ID NO: 1295421 - DNA, 22 bp, Homo sapiens
cgcgactaatttcaaaatgctt

SEQ ID NO: 1295422 - DNA, 21 bp, Homo sapiens
cgcgccaaataatgtctctgt

SEQ ID NO: 1295423 - DNA, 20 bp, Homo sapiens
cgctcctgccgcagagctgg

SEQ ID NO: 1295424 - DNA, 17 bp, Homo sapiens
cgctgccacccacctcc

SEQ ID NO: 1295425 - DNA, 16 bp, Homo sapiens
cgctttctagctgttg

SEQ ID NO: 1295426 - DNA, 17 bp, Homo sapiens
cggaacccaagcttaga

SEQ ID NO: 1295427 - DNA, 18 bp, Homo sapiens
cggaactgcatgctgctg

SEQ ID NO: 1295428 - DNA, 17 bp, Homo sapiens
cggagggattcccctaa

SEQ ID NO: 1295429 - DNA, 12 bp, Homo sapiens
cggcaacatcaa

SEQ ID NO: 1295430 - DNA, 15 bp, Homo sapiens
cggccagccatgtct

SEQ ID NO: 1295431 - DNA, 22 bp, Homo sapiens
cggccagcccctggccccagga

SEQ ID NO: 1295432 - DNA, 17 bp, Homo sapiens
cggccagggagaagctc

SEQ ID NO: 1295433 - DNA, 16 bp, Homo sapiens
cggccggccagcccct

SEQ ID NO: 1295434 - DNA, 15 bp, Homo sapiens
cggcctcccaaagtg

SEQ ID NO: 1295435 - DNA, 22 bp, Homo sapiens
cgggtgtgcaatgtctgagtga

SEQ ID NO: 1295436 - DNA, 21 bp, Homo sapiens
cggtagccagcacacagggca

SEQ ID NO: 1295437 - DNA, 21 bp, Homo sapiens
cggtggctagtcaagctcctc

SEQ ID NO: 1295438 - DNA, 20 bp, Homo sapiens
cggtgtggtgcagtgtgaaa

SEQ ID NO: 1295439 - DNA, 16 bp, Homo sapiens
cgtgaaaacggagctg

SEQ ID NO: 1295440 - DNA, 14 bp, Homo sapiens
cgtggctcagccag

SEQ ID NO: 1295441 - DNA, 18 bp, Homo sapiens
ctaaacatccaatatttt

SEQ ID NO: 1295442 - DNA, 16 bp, Homo sapiens
ctaaacccaatccaaa

SEQ ID NO: 1295443 - DNA, 19 bp, Homo sapiens
ctaaacccaatccaaatgg

SEQ ID NO: 1295444 - DNA, 16 bp, Homo sapiens
ctaaacggattccaaa

SEQ ID NO: 1295445 - DNA, 17 bp, Homo sapiens
ctaaacggattccaaag

SEQ ID NO: 1295446 - DNA, 15 bp, Homo sapiens
ctaaactcatttata

SEQ ID NO: 1295447 - DNA, 17 bp, Homo sapiens
ctaaactcatttataaa

SEQ ID NO: 1295448 - DNA, 20 bp, Homo sapiens
ctaagaaaagattttaatca

SEQ ID NO: 1295449 - DNA, 14 bp, Homo sapiens
ctaagaacctggaa

SEQ ID NO: 1295450 - DNA, 18 bp, Homo sapiens
ctaagagttgagctctcg

SEQ ID NO: 1295451 - DNA, 13 bp, Homo sapiens
ctaagcagaggag

SEQ ID NO: 1295452 - DNA, 18 bp, Homo sapiens
ctaagcagaggaggggcc

SEQ ID NO: 1295453 - DNA, 13 bp, Homo sapiens
ctaaggggcccgg

SEQ ID NO: 1295454 - DNA, 12 bp, Homo sapiens
ctaatgctcctt

SEQ ID NO: 1295455 - DNA, 15 bp, Homo sapiens
ctaattccacacctt

SEQ ID NO: 1295456 - DNA, 17 bp, Homo sapiens
ctaattccacacctttt

SEQ ID NO: 1295457 - DNA, 19 bp, Homo sapiens
ctaatttgcattaaattca

SEQ ID NO: 1295458 - DNA, 22 bp, Homo sapiens
ctaatttgcattaaattcacaa

SEQ ID NO: 1295459 - DNA, 14 bp, Homo sapiens
ctaatttttgtaat

SEQ ID NO: 1295460 - DNA, 17 bp, Homo sapiens
ctacaaacaaaatttct

SEQ ID NO: 1295461 - DNA, 18 bp, Homo sapiens
ctacaatgtgaactttat

SEQ ID NO: 1295462 - DNA, 17 bp, Homo sapiens
ctacatgagaacaaaca

SEQ ID NO: 1295463 - DNA, 13 bp, Homo sapiens
ctacccatccccg

SEQ ID NO: 1295464 - DNA, 14 bp, Homo sapiens
ctaccttgaaaata

SEQ ID NO: 1295465 - DNA, 17 bp, Homo sapiens
ctactaattccacacct

SEQ ID NO: 1295466 - DNA, 17 bp, Homo sapiens
ctactctcctcatctct

SEQ ID NO: 1295467 - DNA, 16 bp, Homo sapiens
ctactgtaattttata

SEQ ID NO: 1295468 - DNA, 12 bp, Homo sapiens
ctacttgggagg

SEQ ID NO: 1295469 - DNA, 16 bp, Homo sapiens
ctagaaattgacacaa

SEQ ID NO: 1295470 - DNA, 22 bp, Homo sapiens
ctagaatttattcaattcctct

SEQ ID NO: 1295471 - DNA, 19 bp, Homo sapiens
ctagagggaggggcctagg

SEQ ID NO: 1295472 - DNA, 22 bp, Homo sapiens
ctagagggaggggcctaggcct

SEQ ID NO: 1295473 - DNA, 14 bp, Homo sapiens
ctagatggctcctc

SEQ ID NO: 1295474 - DNA, 14 bp, Homo sapiens
ctagatggtgctga

SEQ ID NO: 1295475 - DNA, 16 bp, Homo sapiens
ctagatggtgctgaga

SEQ ID NO: 1295476 - DNA, 17 bp, Homo sapiens
ctagatggtgctgagaa

SEQ ID NO: 1295477 - DNA, 22 bp, Homo sapiens
ctagatggtgctgagaagcttt

SEQ ID NO: 1295478 - DNA, 12 bp, Homo sapiens
ctagcagcaccg

SEQ ID NO: 1295479 - DNA, 17 bp, Homo sapiens
taagcagaggaggggcc

SEQ ID NO: 1295480 - DNA, 16 bp, Homo sapiens
taagcctaaaagtggg

SEQ ID NO: 1295481 - DNA, 16 bp, Homo sapiens
taagctgtttccatag

SEQ ID NO: 1295482 - DNA, 16 bp, Homo sapiens
taaggggcccggccag

SEQ ID NO: 1295483 - DNA, 15 bp, Homo sapiens
taagtggaggcactt

SEQ ID NO: 1295484 - DNA, 17 bp, Homo sapiens
taagtggaggcacttta

SEQ ID NO: 1295485 - DNA, 18 bp, Homo sapiens
taagtgtatttttcaata

SEQ ID NO: 1295486 - DNA, 23 bp, Homo sapiens
taagtgtatttttcaataaagca

SEQ ID NO: 1295487 - DNA, 15 bp, Homo sapiens
taatatgaaaactta

SEQ ID NO: 1295488 - DNA, 13 bp, Homo sapiens
taatccagctgat

SEQ ID NO: 1295489 - DNA, 19 bp, Homo sapiens
taatccaggcagatccagg

SEQ ID NO: 1295490 - DNA, 23 bp, Homo sapiens
taatccaggcagatccaggacta

SEQ ID NO: 1295491 - DNA, 19 bp, Homo sapiens
taatcccagcactttggga

SEQ ID NO: 1295492 - DNA, 19 bp, Homo sapiens
taatcccagctacttggga

SEQ ID NO: 1295493 - DNA, 22 bp, Homo sapiens
taatgcatctagattatggagc

SEQ ID NO: 1295494 - DNA, 18 bp, Homo sapiens
taatgctccttgttccta

SEQ ID NO: 1295495 - DNA, 17 bp, Homo sapiens
taattccacacctttta

SEQ ID NO: 1295496 - DNA, 18 bp, Homo sapiens
taatttattaattgcttt

SEQ ID NO: 1295497 - DNA, 20 bp, Homo sapiens
taatttattaattgctttga

SEQ ID NO: 1295498 - DNA, 20 bp, Homo sapiens
taatttcaaaatgcttttta

SEQ ID NO: 1295499 - DNA, 15 bp, Homo sapiens
taattttgaataaat

SEQ ID NO: 1295500 - DNA, 21 bp, Homo sapiens
tacaaatggacataggactca

SEQ ID NO: 1295501 - DNA, 13 bp, Homo sapiens
tacaaattagaaa

SEQ ID NO: 1295502 - DNA, 23 bp, Homo sapiens
tacaactgcctcgaaacacagaa

SEQ ID NO: 1295503 - DNA, 15 bp, Homo sapiens
tacaatgtgaacttt

SEQ ID NO: 1295504 - DNA, 22 bp, Homo sapiens
tacaattaaaaaaaaagatctg

SEQ ID NO: 1295505 - DNA, 17 bp, Homo sapiens
tacaccagcattccttt

SEQ ID NO: 1295506 - DNA, 18 bp, Homo sapiens
tacaccagcattcctttt

SEQ ID NO: 1295507 - DNA, 20 bp, Homo sapiens
tacaccagcattccttttga

SEQ ID NO: 1295508 - DNA, 15 bp, Homo sapiens
tacatacaccagcat

SEQ ID NO: 1295509 - DNA, 16 bp, Homo sapiens
tacatatctttattaa

SEQ ID NO: 1295510 - DNA, 22 bp, Homo sapiens
tacatctattttggattgtata

SEQ ID NO: 1295511 - DNA, 23 bp, Homo sapiens
tacatctattttggattgtatat

SEQ ID NO: 1295512 - DNA, 18 bp, Homo sapiens
tacatgagaacaaacaga

SEQ ID NO: 1295513 - DNA, 16 bp, Homo sapiens
tacatgagaaggaact

SEQ ID NO: 1295514 - DNA, 15 bp, Homo sapiens
tacattcatttagct

SEQ ID NO: 1295515 - DNA, 23 bp, Homo sapiens
tacattgttgagctattgctgtt

SEQ ID NO: 1295516 - DNA, 19 bp, Homo sapiens
tacattgtttgtctgtctt

SEQ ID NO: 1295517 - DNA, 14 bp, Homo sapiens
taccattcagtgat

SEQ ID NO: 1295518 - DNA, 18 bp, Homo sapiens
taccatttatacaaatta

SEQ ID NO: 1295519 - DNA, 15 bp, Homo sapiens
taccatttgcctccc

SEQ ID NO: 1295520 - DNA, 17 bp, Homo sapiens
tacccatccccgcagtg

SEQ ID NO: 1295521 - DNA, 21 bp, Homo sapiens
tacctctcttatagaatattt

SEQ ID NO: 1295522 - DNA, 17 bp, Homo sapiens
tacctctgatacctcaa

SEQ ID NO: 1295523 - DNA, 13 bp, Homo sapiens
tactaattccaca

SEQ ID NO: 1295524 - DNA, 16 bp, Homo sapiens
tactaccttgaaaata

SEQ ID NO: 1295525 - DNA, 19 bp, Homo sapiens
tactaggtaacttcatatt

SEQ ID NO: 1295526 - DNA, 22 bp, Homo sapiens
tactattcagtggcgagaaata

SEQ ID NO: 1295527 - DNA, 16 bp, Homo sapiens
tccaggcagatccagg

SEQ ID NO: 1295528 - DNA, 11 bp, Homo sapiens
tccaggctggt

SEQ ID NO: 1295529 - DNA, 13 bp, Homo sapiens
tccaggctggttc

SEQ ID NO: 1295530 - DNA, 15 bp, Homo sapiens
tccagggacagaggc

SEQ ID NO: 1295531 - DNA, 14 bp, Homo sapiens
tccagggactgaag

SEQ ID NO: 1295532 - DNA, 17 bp, Homo sapiens
tccagggcccccatctc

SEQ ID NO: 1295533 - DNA, 17 bp, Homo sapiens
tccagggctggactgag

SEQ ID NO: 1295534 - DNA, 23 bp, Homo sapiens
tccagggctggactgaggcctga

SEQ ID NO: 1295535 - DNA, 15 bp, Homo sapiens
tccagtaatctaata

SEQ ID NO: 1295536 - DNA, 17 bp, Homo sapiens
tccagtgtccttagaac

SEQ ID NO: 1295537 - DNA, 18 bp, Homo sapiens
tccagtgtccttagaaca

SEQ ID NO: 1295538 - DNA, 20 bp, Homo sapiens
tccagtgtccttagaacatt

SEQ ID NO: 1295539 - DNA, 21 bp, Homo sapiens
tccagtgtccttagaacattt

SEQ ID NO: 1295540 - DNA, 12 bp, Homo sapiens
tccatgattcta

SEQ ID NO: 1295541 - DNA, 12 bp, Homo sapiens
tccattctttct

SEQ ID NO: 1295542 - DNA, 14 bp, Homo sapiens
tccattctttctga

SEQ ID NO: 1295543 - DNA, 18 bp, Homo sapiens
tccattctttctgataac

SEQ ID NO: 1295544 - DNA, 21 bp, Homo sapiens
tcccaaacgcctcccctgccc

SEQ ID NO: 1295545 - DNA, 14 bp, Homo sapiens
tcccaaatgagcca

SEQ ID NO: 1295546 - DNA, 20 bp, Homo sapiens
tcccaaatttgattgatttg

SEQ ID NO: 1295547 - DNA, 16 bp, Homo sapiens
tcccaactctagctgg

SEQ ID NO: 1295548 - DNA, 21 bp, Homo sapiens
tcccagattggctcacactga

SEQ ID NO: 1295549 - DNA, 14 bp, Homo sapiens
tcccaggaccctga

SEQ ID NO: 1295550 - DNA, 16 bp, Homo sapiens
tcccaggaccctgaag

SEQ ID NO: 1295551 - DNA, 14 bp, Homo sapiens
tcccattcctgaag

SEQ ID NO: 1295552 - DNA, 17 bp, Homo sapiens
tcccattgtccctctgc

SEQ ID NO: 1295553 - DNA, 19 bp, Homo sapiens
tcccattgtccctctgccc

SEQ ID NO: 1295554 - DNA, 20 bp, Homo sapiens
tccccaataattgcagaact

SEQ ID NO: 1295555 - DNA, 17 bp, Homo sapiens
tccccagcccagagaca

SEQ ID NO: 1295556 - DNA, 16 bp, Homo sapiens
tccccaggcacctcac

SEQ ID NO: 1295557 - DNA, 13 bp, Homo sapiens
tccccatggagcc

SEQ ID NO: 1295558 - DNA, 16 bp, Homo sapiens
tccccatggagccagc

SEQ ID NO: 1295559 - DNA, 13 bp, Homo sapiens
tcccccccatgca

SEQ ID NO: 1295560 - DNA, 18 bp, Homo sapiens
tcccccccatgcactgtg

SEQ ID NO: 1295561 - DNA, 14 bp, Homo sapiens
tcccccttcacaaa

SEQ ID NO: 1295562 - DNA, 22 bp, Homo sapiens
tcccccttcacaaagcccaagg

SEQ ID NO: 1295563 - DNA, 15 bp, Homo sapiens
tccccgccctttttt

SEQ ID NO: 1295564 - DNA, 12 bp, Homo sapiens
tcccctccaacc

SEQ ID NO: 1295565 - DNA, 13 bp, Homo sapiens
tcccctccaacct

SEQ ID NO: 1295566 - DNA, 14 bp, Homo sapiens
tcccctcctccact

SEQ ID NO: 1295567 - DNA, 16 bp, Homo sapiens
tcccctctccttcctg

SEQ ID NO: 1295568 - DNA, 19 bp, Homo sapiens
gattctgcagtaaatcttt

SEQ ID NO: 1295569 - DNA, 16 bp, Homo sapiens
gattgacagctttgct

SEQ ID NO: 1295570 - DNA, 20 bp, Homo sapiens
gattggctcacactgagaat

SEQ ID NO: 1295571 - DNA, 19 bp, Homo sapiens
gattgggtgggcaggaaaa

SEQ ID NO: 1295572 - DNA, 18 bp, Homo sapiens
gattgttcgggtgtgcaa

SEQ ID NO: 1295573 - DNA, 22 bp, Homo sapiens
gatttccttgaatgtggcttga

SEQ ID NO: 1295574 - DNA, 18 bp, Homo sapiens
gatttgaagaacatgtga

SEQ ID NO: 1295575 - DNA, 15 bp, Homo sapiens
gatttgcattgaaca

SEQ ID NO: 1295576 - DNA, 13 bp, Homo sapiens
gattttaattttg

SEQ ID NO: 1295577 - DNA, 15 bp, Homo sapiens
gattttgctgtatat

SEQ ID NO: 1295578 - DNA, 20 bp, Homo sapiens
gcaaaaggatctttgtggcc

SEQ ID NO: 1295579 - DNA, 23 bp, Homo sapiens
gcaaaaggatctttgtggccaag

SEQ ID NO: 1295580 - DNA, 22 bp, Homo sapiens
gcaaagatctgtcctcagcctt

SEQ ID NO: 1295581 - DNA, 12 bp, Homo sapiens
gcaaataaaagt

SEQ ID NO: 1295582 - DNA, 20 bp, Homo sapiens
gcaacaaggtcctctgtcag

SEQ ID NO: 1295583 - DNA, 23 bp, Homo sapiens
gcaacctcttggcctgatcagac

SEQ ID NO: 1295584 - DNA, 15 bp, Homo sapiens
gcaactcttgattat

SEQ ID NO: 1295585 - DNA, 23 bp, Homo sapiens
gcaaggtttaggctggtggccca

SEQ ID NO: 1295586 - DNA, 18 bp, Homo sapiens
gcaataaatctgacccag

SEQ ID NO: 1295587 - DNA, 19 bp, Homo sapiens
gcaataaatctgacccagt

SEQ ID NO: 1295588 - DNA, 21 bp, Homo sapiens
gcaataaatctgacccagtgc

SEQ ID NO: 1295589 - DNA, 15 bp, Homo sapiens
gcacagcagcctggg

SEQ ID NO: 1295590 - DNA, 21 bp, Homo sapiens
gcacaggacatgcggtagcca

SEQ ID NO: 1295591 - DNA, 16 bp, Homo sapiens
gcacagtgaagtgctg

SEQ ID NO: 1295592 - DNA, 19 bp, Homo sapiens
gcaccagacacccaggact

SEQ ID NO: 1295593 - DNA, 21 bp, Homo sapiens
gcaccagacacccaggactta

SEQ ID NO: 1295594 - DNA, 16 bp, Homo sapiens
gcactgactgggcata

SEQ ID NO: 1295595 - DNA, 17 bp, Homo sapiens
gcactgactgggcatag

SEQ ID NO: 1295596 - DNA, 11 bp, Homo sapiens
gcactgaggaa

SEQ ID NO: 1295597 - DNA, 18 bp, Homo sapiens
gcactgaggaagaacggg

SEQ ID NO: 1295598 - DNA, 17 bp, Homo sapiens
gcactgtgaaggaccct

SEQ ID NO: 1295599 - DNA, 19 bp, Homo sapiens
gcactgtgacccccagctc

SEQ ID NO: 1295600 - DNA, 16 bp, Homo sapiens
gcacttatgatttcat

SEQ ID NO: 1295601 - DNA, 18 bp, Homo sapiens
gcacttatttaatgccga

SEQ ID NO: 1295602 - DNA, 20 bp, Homo sapiens
gcagacaggccccgtgaggc

SEQ ID NO: 1295603 - DNA, 15 bp, Homo sapiens
gcagaggaggggccg

SEQ ID NO: 1295604 - DNA, 21 bp, Homo sapiens
gcagaggaggggccgctgcca

SEQ ID NO: 1295605 - DNA, 17 bp, Homo sapiens
gcagcaccgttctgtgc

SEQ ID NO: 1295606 - DNA, 18 bp, Homo sapiens
gcagcaccgttctgtgca

SEQ ID NO: 1295607 - DNA, 22 bp, Homo sapiens
gcagcagaagggggtggtgtct

SEQ ID NO: 1295608 - DNA, 19 bp, Homo sapiens
gcagcagggatgccctgga

SEQ ID NO: 1295609 - DNA, 22 bp, Homo sapiens
gcagccgtttgagaagaaaaca

SEQ ID NO: 1295610 - DNA, 14 bp, Homo sapiens
gcagcctggggctg

SEQ ID NO: 1295611 - DNA, 15 bp, Homo sapiens
gcagcctttaatgca

SEQ ID NO: 1295612 - DNA, 23 bp, Homo sapiens
gcaggaaaaggtgatatccattc

SEQ ID NO: 1295613 - DNA, 19 bp, Homo sapiens
gcagggagcggccggccag

SEQ ID NO: 1295614 - DNA, 22 bp, Homo sapiens
gcagggtgcagtatcatgccct

SEQ ID NO: 1295615 - DNA, 13 bp, Homo sapiens
gcaggttcccaag

SEQ ID NO: 1295616 - DNA, 18 bp, Homo sapiens
gcaggttcccaagctcag

SEQ ID NO: 1295617 - DNA, 21 bp, Homo sapiens
gcagtatcatgccctgtgcaa

SEQ ID NO: 1295618 - DNA, 21 bp, Homo sapiens
gcagtgtgcactaaggggccc

SEQ ID NO: 1295619 - DNA, 14 bp, Homo sapiens
gcatatgttgaata

SEQ ID NO: 1295620 - DNA, 19 bp, Homo sapiens
gcatatgttgaatactttt

SEQ ID NO: 1295621 - DNA, 21 bp, Homo sapiens
gcatatgttgaatacttttta

SEQ ID NO: 1295622 - DNA, 18 bp, Homo sapiens
gcatctgaccagcagcgc

SEQ ID NO: 1295623 - DNA, 14 bp, Homo sapiens
gcatgacatttctt

SEQ ID NO: 1295624 - DNA, 15 bp, Homo sapiens
gcatggtcacacact

SEQ ID NO: 1295625 - DNA, 15 bp, Homo sapiens
gcatggtgccccagg

SEQ ID NO: 1295626 - DNA, 18 bp, Homo sapiens
gcatggtgccccaggacc

SEQ ID NO: 1295627 - DNA, 20 bp, Homo sapiens
gcatggtgccccaggaccag

SEQ ID NO: 1295628 - DNA, 12 bp, Homo sapiens
gcattgaacaca

SEQ ID NO: 1295629 - DNA, 23 bp, Homo sapiens
gcattgaacacaaactgtaaata

SEQ ID NO: 1295630 - DNA, 22 bp, Homo sapiens
gcattttggagagtttcctgaa

SEQ ID NO: 1295631 - DNA, 18 bp, Homo sapiens
gccaaataatgtctctgt

SEQ ID NO: 1295632 - DNA, 22 bp, Homo sapiens
gccaaataatgtctctgtgaga

SEQ ID NO: 1295633 - DNA, 21 bp, Homo sapiens
gccaacacgcacctgcctcag

SEQ ID NO: 1295634 - DNA, 23 bp, Homo sapiens
gccaacccttctcctcttgtaaa

SEQ ID NO: 1295635 - DNA, 18 bp, Homo sapiens
gccaatattaaatctgct

SEQ ID NO: 1295636 - DNA, 19 bp, Homo sapiens
gccacaaggacttcctgtc

SEQ ID NO: 1295637 - DNA, 22 bp, Homo sapiens
gccacaggcctgagatttcatc

SEQ ID NO: 1295638 - DNA, 18 bp, Homo sapiens
gccacagtagtcttgatg

SEQ ID NO: 1295639 - DNA, 18 bp, Homo sapiens
gccacccacctccctgcc

SEQ ID NO: 1295640 - DNA, 13 bp, Homo sapiens
gccactaagcaga

SEQ ID NO: 1295641 - DNA, 20 bp, Homo sapiens
gccactaagcagaggagggg

SEQ ID NO: 1295642 - DNA, 14 bp, Homo sapiens
gccacttctgggtg

SEQ ID NO: 1295643 - DNA, 23 bp, Homo sapiens
gccacttctgggtggggcagtgg

SEQ ID NO: 1295644 - DNA, 17 bp, Homo sapiens
gccagacacaggccctc

SEQ ID NO: 1295645 - DNA, 18 bp, Homo sapiens
gccagacatgccacaagg

SEQ ID NO: 1295646 - DNA, 13 bp, Homo sapiens
gccagagaagcta

SEQ ID NO: 1295647 - DNA, 13 bp, Homo sapiens
gccagagatccaa

SEQ ID NO: 1295648 - DNA, 20 bp, Homo sapiens
gccagagatccaaaagaagc

SEQ ID NO: 1295649 - DNA, 16 bp, Homo sapiens
gccagcacacagggca

SEQ ID NO: 1295650 - DNA, 18 bp, Homo sapiens
gccagcacacagggcagt

SEQ ID NO: 1295651 - DNA, 22 bp, Homo sapiens
gccagcacacagggcagtgagg

SEQ ID NO: 1295652 - DNA, 13 bp, Homo sapiens
gccagctccctct

SEQ ID NO: 1295653 - DNA, 14 bp, Homo sapiens
gccagctgcactga

SEQ ID NO: 1295654 - DNA, 20 bp, Homo sapiens
gccagctgcactgatgctgc

SEQ ID NO: 1295655 - DNA, 18 bp, Homo sapiens
gccaggaatttcccagga

SEQ ID NO: 1295656 - DNA, 21 bp, Homo sapiens
gccaggaatttcccaggaccc

SEQ ID NO: 1295657 - DNA, 23 bp, Homo sapiens
gccaggaatttcccaggaccctg

SEQ ID NO: 1295658 - DNA, 22 bp, Homo sapiens
gccaggatggaacacggccaca

SEQ ID NO: 1295659 - DNA, 13 bp, Homo sapiens
gccaggccccagg

SEQ ID NO: 1295660 - DNA, 19 bp, Homo sapiens
gccaggctgaccacagcac

SEQ ID NO: 1295661 - DNA, 22 bp, Homo sapiens
gccaggggggtgaggagctggg

SEQ ID NO: 1295662 - DNA, 17 bp, Homo sapiens
gccatgatggcaacaga

SEQ ID NO: 1295663 - DNA, 19 bp, Homo sapiens
gccatgatggcaacagatc

SEQ ID NO: 1295664 - DNA, 23 bp, Homo sapiens
gccatgatggcaacagatctgga

SEQ ID NO: 1295665 - DNA, 14 bp, Homo sapiens
gccatgcctcagcc

SEQ ID NO: 1295666 - DNA, 17 bp, Homo sapiens
gccatgcctcagccctg

SEQ ID NO: 1295667 - DNA, 21 bp, Homo sapiens
gccatgcctcagccctgaccc

SEQ ID NO: 1295668 - DNA, 23 bp, Homo sapiens
gcccactgtcctgggcctgcaga

SEQ ID NO: 1295669 - DNA, 19 bp, Homo sapiens
gcccagagacccaagctgc

SEQ ID NO: 1295670 - DNA, 15 bp, Homo sapiens
gcccagagcccagct

SEQ ID NO: 1295671 - DNA, 16 bp, Homo sapiens
gcccagagcccagctc

SEQ ID NO: 1295672 - DNA, 16 bp, Homo sapiens
gcccagaggagggcag

SEQ ID NO: 1295673 - DNA, 15 bp, Homo sapiens
gcccagctccaaggg

SEQ ID NO: 1295674 - DNA, 13 bp, Homo sapiens
gcccagctgggtc

SEQ ID NO: 1295675 - DNA, 15 bp, Homo sapiens
gcccagctgggtcag

SEQ ID NO: 1295676 - DNA, 17 bp, Homo sapiens
gcccagggcccagagcc

SEQ ID NO: 1295677 - DNA, 20 bp, Homo sapiens
gcccatggacaggctggctc

SEQ ID NO: 1295678 - DNA, 18 bp, Homo sapiens
gccccagcctccctgaag

SEQ ID NO: 1295679 - DNA, 17 bp, Homo sapiens
gccccaggaccagctca

SEQ ID NO: 1295680 - DNA, 22 bp, Homo sapiens
gcccccaccgtgggcagggagc

SEQ ID NO: 1295681 - DNA, 12 bp, Homo sapiens
gcccccaggact

SEQ ID NO: 1295682 - DNA, 13 bp, Homo sapiens
gcccccaggactg

SEQ ID NO: 1295683 - DNA, 14 bp, Homo sapiens
gcccccaggactgg

SEQ ID NO: 1295684 - DNA, 18 bp, Homo sapiens
gcccccatctcatgcccc

SEQ ID NO: 1295685 - DNA, 17 bp, Homo sapiens
gccccctggcctctgtg

SEQ ID NO: 1295686 - DNA, 19 bp, Homo sapiens
gccccctggcctctgtgcc

SEQ ID NO: 1295687 - DNA, 20 bp, Homo sapiens
gcccctatgtagtccgtgct

SEQ ID NO: 1295688 - DNA, 21 bp, Homo sapiens
gcccctcatctctctgcccaa

SEQ ID NO: 1295689 - DNA, 14 bp, Homo sapiens
gccccttctgctca

SEQ ID NO: 1295690 - DNA, 18 bp, Homo sapiens
gccccttctgctcagctc

SEQ ID NO: 1295691 - DNA, 19 bp, Homo sapiens
gccccttctgctcagctct

SEQ ID NO: 1295692 - DNA, 12 bp, Homo sapiens
gcccggccagcc

SEQ ID NO: 1295693 - DNA, 14 bp, Homo sapiens
gccctactattcag

SEQ ID NO: 1295694 - DNA, 18 bp, Homo sapiens
gccctcacccctggttct

SEQ ID NO: 1295695 - DNA, 22 bp, Homo sapiens
gccctcacccctggttctcatc

SEQ ID NO: 1295696 - DNA, 21 bp, Homo sapiens
gccctccagctctttcctcct

SEQ ID NO: 1295697 - DNA, 20 bp, Homo sapiens
gccctcctctcccattgtcc

SEQ ID NO: 1295698 - DNA, 16 bp, Homo sapiens
gccctctggagtggcc

SEQ ID NO: 1295699 - DNA, 17 bp, Homo sapiens
gccctctggagtggcca

SEQ ID NO: 1295700 - DNA, 20 bp, Homo sapiens
gccctctggagtggccacta

SEQ ID NO: 1295701 - DNA, 20 bp, Homo sapiens
gccctggaggtggctgagcc

SEQ ID NO: 1295702 - DNA, 17 bp, Homo sapiens
gccctgggatcactgtg

SEQ ID NO: 1295703 - DNA, 20 bp, Homo sapiens
gccctgttgacacaggtctt

SEQ ID NO: 1295704 - DNA, 15 bp, Homo sapiens
gccgagtccaagctg

SEQ ID NO: 1295705 - DNA, 18 bp, Homo sapiens
gccgagtccaagctggga

SEQ ID NO: 1295706 - DNA, 17 bp, Homo sapiens
gccgatatactctagat

SEQ ID NO: 1295707 - DNA, 12 bp, Homo sapiens
gccgcagagctg

SEQ ID NO: 1295708 - DNA, 21 bp, Homo sapiens
gccgtgctcgccccagcaggt

SEQ ID NO: 1295709 - DNA, 17 bp, Homo sapiens
gcctaggcctcagccag

SEQ ID NO: 1295710 - DNA, 13 bp, Homo sapiens
gcctcagccagag

SEQ ID NO: 1295711 - DNA, 14 bp, Homo sapiens
gcctcagccagaga

SEQ ID NO: 1295712 - DNA, 15 bp, Homo sapiens
gcctcagccagagaa

SEQ ID NO: 1295713 - DNA, 16 bp, Homo sapiens
gcctcagcctcccaag

SEQ ID NO: 1295714 - DNA, 21 bp, Homo sapiens
gcctcatttagagaggaaaag

SEQ ID NO: 1295715 - DNA, 12 bp, Homo sapiens
gcctccagaact

SEQ ID NO: 1295716 - DNA, 16 bp, Homo sapiens
gcctccagggctggac

SEQ ID NO: 1295717 - DNA, 19 bp, Homo sapiens
gcctccagggctggactga

SEQ ID NO: 1295718 - DNA, 20 bp, Homo sapiens
gcctccagggctggactgag

SEQ ID NO: 1295719 - DNA, 22 bp, Homo sapiens
gcctccagggctggactgaggc

SEQ ID NO: 1295720 - DNA, 16 bp, Homo sapiens
gcctcccaaagtgctg

SEQ ID NO: 1295721 - DNA, 19 bp, Homo sapiens
gcctcccctctccttcctg

SEQ ID NO: 1295722 - DNA, 15 bp, Homo sapiens
gcctctgtccccttc

SEQ ID NO: 1295723 - DNA, 18 bp, Homo sapiens
gcctctgtccccttctct

SEQ ID NO: 1295724 - DNA, 21 bp, Homo sapiens
gcctctgtccccttctctcat

SEQ ID NO: 1295725 - DNA, 12 bp, Homo sapiens
gcctctgtgcct

SEQ ID NO: 1295726 - DNA, 18 bp, Homo sapiens
gcctgaaggggcgtctgt

SEQ ID NO: 1295727 - DNA, 16 bp, Homo sapiens
gcctgagatttcatct

SEQ ID NO: 1295728 - DNA, 16 bp, Homo sapiens
gcctgcagaatttggg

SEQ ID NO: 1295729 - DNA, 14 bp, Homo sapiens
gcctgccagctgca

SEQ ID NO: 1295730 - DNA, 17 bp, Homo sapiens
gcctgcctccagggctg

SEQ ID NO: 1295731 - DNA, 13 bp, Homo sapiens
gcctgctccagac

SEQ ID NO: 1295732 - DNA, 14 bp, Homo sapiens
gcctgctccagacc

SEQ ID NO: 1295733 - DNA, 21 bp, Homo sapiens
gcctgctccagacctgatcct

SEQ ID NO: 1295734 - DNA, 20 bp, Homo sapiens
gcctggatgcggatggccgg

SEQ ID NO: 1295735 - DNA, 13 bp, Homo sapiens
gcctggccagaca

SEQ ID NO: 1295736 - DNA, 17 bp, Homo sapiens
gcctggccagacacagg

SEQ ID NO: 1295737 - DNA, 18 bp, Homo sapiens
gcctgtaatcccagcact

SEQ ID NO: 1295738 - DNA, 17 bp, Homo sapiens
gccttcctctctccaga

SEQ ID NO: 1295739 - DNA, 22 bp, Homo sapiens
gccttcttttgattatgttttt

SEQ ID NO: 1295740 - DNA, 13 bp, Homo sapiens
gccttgccagaga

SEQ ID NO: 1295741 - DNA, 21 bp, Homo sapiens
gcgccaggatggaacacggcc

SEQ ID NO: 1295742 - DNA, 20 bp, Homo sapiens
gcgccaggctgaccacagca

SEQ ID NO: 1295743 - DNA, 22 bp, Homo sapiens
gcgggtgaacaaagcagccacg

SEQ ID NO: 1295744 - DNA, 15 bp, Homo sapiens
gcggtagccagcaca

SEQ ID NO: 1295745 - DNA, 21 bp, Homo sapiens
gcgtctggaagtccaatgtgg

SEQ ID NO: 1295746 - DNA, 16 bp, Homo sapiens
gcgtctgttccccctt

SEQ ID NO: 1295747 - DNA, 14 bp, Homo sapiens
gctaagaaaagatt

SEQ ID NO: 1295748 - DNA, 15 bp, Homo sapiens
gctaatttgcattaa

SEQ ID NO: 1295749 - DNA, 16 bp, Homo sapiens
gctaatttttgtaatt

SEQ ID NO: 1295750 - DNA, 17 bp, Homo sapiens
ggtcatgccctcctctc

SEQ ID NO: 1295751 - DNA, 13 bp, Homo sapiens
ggtcctctgtcag

SEQ ID NO: 1295752 - DNA, 15 bp, Homo sapiens
ggtcggaacccaagc

SEQ ID NO: 1295753 - DNA, 22 bp, Homo sapiens
ggtctggcagcctcccatccag

SEQ ID NO: 1295754 - DNA, 19 bp, Homo sapiens
ggtctttcctaaggctgca

SEQ ID NO: 1295755 - DNA, 17 bp, Homo sapiens
ggtgaggggctggcact

SEQ ID NO: 1295756 - DNA, 15 bp, Homo sapiens
ggtgatatccattct

SEQ ID NO: 1295757 - DNA, 21 bp, Homo sapiens
ggtgccccaggaccagctcag

SEQ ID NO: 1295758 - DNA, 19 bp, Homo sapiens
ggtgctgtcctcaggtggc

SEQ ID NO: 1295759 - DNA, 23 bp, Homo sapiens
ggtgctgtcctcaggtggccatg

SEQ ID NO: 1295760 - DNA, 20 bp, Homo sapiens
ggtggccatgcctcagccct

SEQ ID NO: 1295761 - DNA, 23 bp, Homo sapiens
ggtggctagtcaagctcctcctc

SEQ ID NO: 1295762 - DNA, 23 bp, Homo sapiens
ggtggggtcatgccctcctctcc

SEQ ID NO: 1295763 - DNA, 19 bp, Homo sapiens
ggtgtctccaaccccccag

SEQ ID NO: 1295764 - DNA, 18 bp, Homo sapiens
ggtgtgcacatctctgct

SEQ ID NO: 1295765 - DNA, 13 bp, Homo sapiens
ggttcccaagctc

SEQ ID NO: 1295766 - DNA, 12 bp, Homo sapiens
ggttctcatctt

SEQ ID NO: 1295767 - DNA, 20 bp, Homo sapiens
ggttctgcctgccagctgca

SEQ ID NO: 1295768 - DNA, 18 bp, Homo sapiens
ggttgctgttttcctccc

SEQ ID NO: 1295769 - DNA, 19 bp, Homo sapiens
ggttgctgttttcctccct

SEQ ID NO: 1295770 - DNA, 21 bp, Homo sapiens
ggttgctgttttcctcccttc

SEQ ID NO: 1295771 - DNA, 15 bp, Homo sapiens
ggtttttattagtac

SEQ ID NO: 1295772 - DNA, 20 bp, Homo sapiens
gtaatcccagcactttggga

SEQ ID NO: 1295773 - DNA, 16 bp, Homo sapiens
gtaatcccagctactt

SEQ ID NO: 1295774 - DNA, 20 bp, Homo sapiens
gtaatcccagctacttggga

SEQ ID NO: 1295775 - DNA, 20 bp, Homo sapiens
gtaccatagtaccatttata

SEQ ID NO: 1295776 - DNA, 14 bp, Homo sapiens
gtactttggaggcc

SEQ ID NO: 1295777 - DNA, 14 bp, Homo sapiens
gtagaattgcattg

SEQ ID NO: 1295778 - DNA, 18 bp, Homo sapiens
gtagccagcacacagggc

SEQ ID NO: 1295779 - DNA, 19 bp, Homo sapiens
gtagccagcacacagggca

SEQ ID NO: 1295780 - DNA, 21 bp, Homo sapiens
gtagccagcacacagggcagt

SEQ ID NO: 1295781 - DNA, 18 bp, Homo sapiens
gtagccccctggcctctg

SEQ ID NO: 1295782 - DNA, 16 bp, Homo sapiens
gtagtccgtgctgaca

SEQ ID NO: 1295783 - DNA, 12 bp, Homo sapiens
gtagtcttgatg

SEQ ID NO: 1295784 - DNA, 14 bp, Homo sapiens
gtataaacaaagtt

SEQ ID NO: 1295785 - DNA, 19 bp, Homo sapiens
gtatattgtgtttgtgtat

SEQ ID NO: 1295786 - DNA, 18 bp, Homo sapiens
gtatcatgccctgtgcaa

SEQ ID NO: 1295787 - DNA, 18 bp, Homo sapiens
gtatcctgggggacccaa

SEQ ID NO: 1295788 - DNA, 19 bp, Homo sapiens
gtatttacgctttgattca

SEQ ID NO: 1295789 - DNA, 20 bp, Homo sapiens
gtatttgggaagtgaagact

SEQ ID NO: 1295790 - DNA, 22 bp, Homo sapiens
gtattttatctttgattctcct

SEQ ID NO: 1295791 - DNA, 20 bp, Homo sapiens
gtcaaaaagtttggttctgt

SEQ ID NO: 1295792 - DNA, 18 bp, Homo sapiens
gtcactcattgctgagcc

SEQ ID NO: 1295793 - DNA, 14 bp, Homo sapiens
gtcagatttccagt

SEQ ID NO: 1295794 - DNA, 21 bp, Homo sapiens
gtcagatttccagtctccacc

SEQ ID NO: 1295795 - DNA, 13 bp, Homo sapiens
gtcaggagttcct

SEQ ID NO: 1295796 - DNA, 13 bp, Homo sapiens
gtcaggtttgagt

SEQ ID NO: 1295797 - DNA, 13 bp, Homo sapiens
gtcagtcacagcc

SEQ ID NO: 1295798 - DNA, 22 bp, Homo sapiens
gtccatttggcaggggtggctg

SEQ ID NO: 1295799 - DNA, 17 bp, Homo sapiens
gtcccagattggctcac

SEQ ID NO: 1295800 - DNA, 14 bp, Homo sapiens
gtccccttctctca

SEQ ID NO: 1295801 - DNA, 20 bp, Homo sapiens
gtccccttctctcatctctt

SEQ ID NO: 1295802 - DNA, 15 bp, Homo sapiens
gtccctggggctagg

SEQ ID NO: 1295803 - DNA, 15 bp, Homo sapiens
gtccgtgctgacagc

SEQ ID NO: 1295804 - DNA, 19 bp, Homo sapiens
gtccgtgctgacagctgct

SEQ ID NO: 1295805 - DNA, 22 bp, Homo sapiens
gtccgtgctgacagctgctcct

SEQ ID NO: 1295806 - DNA, 18 bp, Homo sapiens
gtcctacccatccccgca

SEQ ID NO: 1295807 - DNA, 20 bp, Homo sapiens
gtcctcagccttgccagaga

SEQ ID NO: 1295808 - DNA, 21 bp, Homo sapiens
gtcctccaacaccaagcacag

SEQ ID NO: 1295809 - DNA, 23 bp, Homo sapiens
gtcctctgtcagtcacagccacc

SEQ ID NO: 1295810 - DNA, 17 bp, Homo sapiens
gtcctggccatcccaca

SEQ ID NO: 1295811 - DNA, 16 bp, Homo sapiens
gtcctttttttccatc

SEQ ID NO: 1295812 - DNA, 17 bp, Homo sapiens
gtgtaccatttgcctcc

SEQ ID NO: 1295813 - DNA, 20 bp, Homo sapiens
gtgtatggagagaaaacaga

SEQ ID NO: 1295814 - DNA, 21 bp, Homo sapiens
gtgtatttacgctttgattca

SEQ ID NO: 1295815 - DNA, 17 bp, Homo sapiens
gtgtctccaacccccca

SEQ ID NO: 1295816 - DNA, 21 bp, Homo sapiens
gtgtctcggagggattcccct

SEQ ID NO: 1295817 - DNA, 14 bp, Homo sapiens
gtgtgaatgaacac

SEQ ID NO: 1295818 - DNA, 15 bp, Homo sapiens
gtgtgaatgaacact

SEQ ID NO: 1295819 - DNA, 16 bp, Homo sapiens
gtgtgattgacagctt

SEQ ID NO: 1295820 - DNA, 23 bp, Homo sapiens
gtgtgattgacagctttgctgct

SEQ ID NO: 1295821 - DNA, 22 bp, Homo sapiens
gtgtgctttatgctgaaacaga

SEQ ID NO: 1295822 - DNA, 19 bp, Homo sapiens
gtgttcctggcagtttaaa

SEQ ID NO: 1295823 - DNA, 17 bp, Homo sapiens
gtgttgccacaggacac

SEQ ID NO: 1295824 - DNA, 17 bp, Homo sapiens
gttaagacatgatttcc

SEQ ID NO: 1295825 - DNA, 14 bp, Homo sapiens
gttaagacctggca

SEQ ID NO: 1295826 - DNA, 16 bp, Homo sapiens
gttaagacctggcagc

SEQ ID NO: 1295827 - DNA, 18 bp, Homo sapiens
gttacagcctgttagtaa

SEQ ID NO: 1295828 - DNA, 13 bp, Homo sapiens
gttactgtaattc

SEQ ID NO: 1295829 - DNA, 18 bp, Homo sapiens
gttagcagacaggccccg

SEQ ID NO: 1295830 - DNA, 22 bp, Homo sapiens
gttagtctcttgtattaaactc

SEQ ID NO: 1295831 - DNA, 19 bp, Homo sapiens
gttcccatgtagccccctg

SEQ ID NO: 1295832 - DNA, 12 bp, Homo sapiens
gttccccagaga

SEQ ID NO: 1295833 - DNA, 14 bp, Homo sapiens
gttccccagagaaa

SEQ ID NO: 1295834 - DNA, 14 bp, Homo sapiens
gttcgcatggtcac

SEQ ID NO: 1295835 - DNA, 20 bp, Homo sapiens
gttcgcatggtcacacactg

SEQ ID NO: 1295836 - DNA, 22 bp, Homo sapiens
gttctgcctgccagctgcactg

SEQ ID NO: 1295837 - DNA, 12 bp, Homo sapiens
gttctggccaga

SEQ ID NO: 1295838 - DNA, 13 bp, Homo sapiens
gttctggccagaa

SEQ ID NO: 1295839 - DNA, 15 bp, Homo sapiens
gttctgtgtctgtgt

SEQ ID NO: 1295840 - DNA, 24 bp, Homo sapiens
gttgagctctcggaactgcatgct

SEQ ID NO: 1295841 - DNA, 17 bp, Homo sapiens
gttgctgttttcctccc

SEQ ID NO: 1295842 - DNA, 16 bp, Homo sapiens
gttggggtctggcagc

SEQ ID NO: 1295843 - DNA, 20 bp, Homo sapiens
gtttacaaatggacatagga

SEQ ID NO: 1295844 - DNA, 18 bp, Homo sapiens
gtttcatgtaatcctcaa

SEQ ID NO: 1295845 - DNA, 15 bp, Homo sapiens
gtttgtctgtcttca

SEQ ID NO: 1295846 - DNA, 13 bp, Homo sapiens
gttttcaagtcaa

SEQ ID NO: 1295847 - DNA, 18 bp, Homo sapiens
gttttgaagctactgtgt

SEQ ID NO: 1295848 - DNA, 19 bp, Homo sapiens
gttttgaagctactgtgtg

SEQ ID NO: 1295849 - DNA, 21 bp, Homo sapiens
gttttgaaggcaaaattgcaa

SEQ ID NO: 1295850 - DNA, 20 bp, Homo sapiens
gttttgttcccctcctccac

SEQ ID NO: 1295851 - DNA, 21 bp, Homo sapiens
gttttgttcccctcctccact

SEQ ID NO: 1295852 - DNA, 14 bp, Homo sapiens
gtttttaagctgtt

SEQ ID NO: 1295853 - DNA, 19 bp, Homo sapiens
gtttttaagctgtttccat

SEQ ID NO: 1295854 - DNA, 14 bp, Homo sapiens
gtttttattagtac

SEQ ID NO: 1295855 - DNA, 21 bp, Homo sapiens
gttttttaaaatatttatctg

SEQ ID NO: 1295856 - DNA, 17 bp, Homo sapiens
taaaaataaatttggtt

SEQ ID NO: 1295857 - DNA, 15 bp, Homo sapiens
taaaatatttatctg

SEQ ID NO: 1295858 - DNA, 14 bp, Homo sapiens
taaacaaagttact

SEQ ID NO: 1295859 - DNA, 17 bp, Homo sapiens
taaacaaagttactagg

SEQ ID NO: 1295860 - DNA, 17 bp, Homo sapiens
taaacatccaatatttt

SEQ ID NO: 1295861 - DNA, 15 bp, Homo sapiens
taaacggattccaaa

SEQ ID NO: 1295862 - DNA, 20 bp, Homo sapiens
taaactcttcacaaaatctg

SEQ ID NO: 1295863 - DNA, 20 bp, Homo sapiens
taaactggtattttatcttt

SEQ ID NO: 1295864 - DNA, 16 bp, Homo sapiens
taaaggatgtgattgt

SEQ ID NO: 1295865 - DNA, 17 bp, Homo sapiens
taaagtttgcttagaaa

SEQ ID NO: 1295866 - DNA, 17 bp, Homo sapiens
taaatacaaaacttcca

SEQ ID NO: 1295867 - DNA, 14 bp, Homo sapiens
taaatctgacccag

SEQ ID NO: 1295868 - DNA, 14 bp, Homo sapiens
taaattcctctttg

SEQ ID NO: 1295869 - DNA, 13 bp, Homo sapiens
taacagctcagga

SEQ ID NO: 1295870 - DNA, 14 bp, Homo sapiens
taacagctcaggat

SEQ ID NO: 1295871 - DNA, 20 bp, Homo sapiens
taacatgaggggacattttg

SEQ ID NO: 1295872 - DNA, 13 bp, Homo sapiens
taacccagatttt

SEQ ID NO: 1295873 - DNA, 15 bp, Homo sapiens
taactagaatttatt

SEQ ID NO: 1295874 - DNA, 21 bp, Homo sapiens
taactagatggtgctgagaag

SEQ ID NO: 1295875 - DNA, 17 bp, Homo sapiens
taacttcttatggaatt

SEQ ID NO: 1295876 - DNA, 21 bp, Homo sapiens
taagaactacaaacaaaattt

SEQ ID NO: 1295877 - DNA, 17 bp, Homo sapiens
taagaaggcaaaaatgt

SEQ ID NO: 1295878 - DNA, 13 bp, Homo sapiens
taagacctggcag

SEQ ID NO: 1295879 - DNA, 23 bp, Homo sapiens
tgaggccacactcagcacaaggc

SEQ ID NO: 1295880 - DNA, 14 bp, Homo sapiens
tgaggctggcacag

SEQ ID NO: 1295881 - DNA, 18 bp, Homo sapiens
tgaggctttggatttgac

SEQ ID NO: 1295882 - DNA, 22 bp, Homo sapiens
tgagggggaatagtctagatgg

SEQ ID NO: 1295883 - DNA, 14 bp, Homo sapiens
tgagtagaggctta

SEQ ID NO: 1295884 - DNA, 17 bp, Homo sapiens
tgagtgaacctgtataa

SEQ ID NO: 1295885 - DNA, 19 bp, Homo sapiens
tgagtgcagccgtttgaga

SEQ ID NO: 1295886 - DNA, 19 bp, Homo sapiens
tgagttggggtctggcagc

SEQ ID NO: 1295887 - DNA, 21 bp, Homo sapiens
tgagttggggtctggcagcct

SEQ ID NO: 1295888 - DNA, 16 bp, Homo sapiens
tgatacatccaaagca

SEQ ID NO: 1295889 - DNA, 14 bp, Homo sapiens
tgatcaacatcttt

SEQ ID NO: 1295890 - DNA, 21 bp, Homo sapiens
tgatcaacatcttttcttgcc

SEQ ID NO: 1295891 - DNA, 15 bp, Homo sapiens
tgatcctggaggccc

SEQ ID NO: 1295892 - DNA, 17 bp, Homo sapiens
tgatcctggaggcccag

SEQ ID NO: 1295893 - DNA, 18 bp, Homo sapiens
tgatcctggaggcccagt

SEQ ID NO: 1295894 - DNA, 13 bp, Homo sapiens
tgatctggaaccc

SEQ ID NO: 1295895 - DNA, 14 bp, Homo sapiens
tgatctggaaccca

SEQ ID NO: 1295896 - DNA, 14 bp, Homo sapiens
tgatgaccaaagtc

SEQ ID NO: 1295897 - DNA, 19 bp, Homo sapiens
tgatggcaacagatctgga

SEQ ID NO: 1295898 - DNA, 23 bp, Homo sapiens
tgatggcaacagatctggaacct

SEQ ID NO: 1295899 - DNA, 21 bp, Homo sapiens
tgattaattcaccttccagtg

SEQ ID NO: 1295900 - DNA, 13 bp, Homo sapiens
tgattactgtcaa

SEQ ID NO: 1295901 - DNA, 24 bp, Homo sapiens
tgattactgtcaaggctgcttaga

SEQ ID NO: 1295902 - DNA, 16 bp, Homo sapiens
tgattatttattattt

SEQ ID NO: 1295903 - DNA, 18 bp, Homo sapiens
tgattcatagtaacttct

SEQ ID NO: 1295904 - DNA, 19 bp, Homo sapiens
tgattccttcctgttctga

SEQ ID NO: 1295905 - DNA, 12 bp, Homo sapiens
tgattctccttc

SEQ ID NO: 1295906 - DNA, 14 bp, Homo sapiens
tgattctccttcag

SEQ ID NO: 1295907 - DNA, 23 bp, Homo sapiens
tgattctccttcagccctcaccc

SEQ ID NO: 1295908 - DNA, 13 bp, Homo sapiens
tgattgacagctt

SEQ ID NO: 1295909 - DNA, 21 bp, Homo sapiens
tgattgtggaatggagattca

SEQ ID NO: 1295910 - DNA, 18 bp, Homo sapiens
tgattgttcgggtgtgca

SEQ ID NO: 1295911 - DNA, 16 bp, Homo sapiens
tgatttaggagaagcc

SEQ ID NO: 1295912 - DNA, 17 bp, Homo sapiens
tgatttccttgaatgtg

SEQ ID NO: 1295913 - DNA, 12 bp, Homo sapiens
tgatttgcattg

SEQ ID NO: 1295914 - DNA, 14 bp, Homo sapiens
tgatttgcattgaa

SEQ ID NO: 1295915 - DNA, 13 bp, Homo sapiens
tgatttggtgacc

SEQ ID NO: 1295916 - DNA, 18 bp, Homo sapiens
tgcaaaaatatttataaa

SEQ ID NO: 1295917 - DNA, 23 bp, Homo sapiens
tgcaaaaatatttataaaacttc

SEQ ID NO: 1295918 - DNA, 20 bp, Homo sapiens
tgcaagaaaatgatgtgtac

SEQ ID NO: 1295919 - DNA, 20 bp, Homo sapiens
tgcaataaatctgacccagt

SEQ ID NO: 1295920 - DNA, 21 bp, Homo sapiens
tgcaataaatctgacccagtg

SEQ ID NO: 1295921 - DNA, 18 bp, Homo sapiens
tgcacaaaacccagacct

SEQ ID NO: 1295922 - DNA, 19 bp, Homo sapiens
tgcacaaaacccagacctg

SEQ ID NO: 1295923 - DNA, 22 bp, Homo sapiens
tgcactgatgctgcccctcatc

SEQ ID NO: 1295924 - DNA, 19 bp, Homo sapiens
tgcactgcccatggacagg

SEQ ID NO: 1295925 - DNA, 19 bp, Homo sapiens
tgcacttatgatttcatgt

SEQ ID NO: 1295926 - DNA, 17 bp, Homo sapiens
tgcacttgtgattattt

SEQ ID NO: 1295927 - DNA, 20 bp, Homo sapiens
tgcacttgtgattatttatt

SEQ ID NO: 1295928 - DNA, 17 bp, Homo sapiens
tgcagcagggatgccct

SEQ ID NO: 1295929 - DNA, 18 bp, Homo sapiens
tgcaggacttgagaagac

SEQ ID NO: 1295930 - DNA, 13 bp, Homo sapiens
tgcagggcagtca

SEQ ID NO: 1295931 - DNA, 14 bp, Homo sapiens
tgcagtaaatcttt

SEQ ID NO: 1295932 - DNA, 18 bp, Homo sapiens
tgcagtaaatcttttaca

SEQ ID NO: 1295933 - DNA, 14 bp, Homo sapiens
tgcagtgtgaaaag

SEQ ID NO: 1295934 - DNA, 15 bp, Homo sapiens
tgcatctgaccagca

SEQ ID NO: 1295935 - DNA, 18 bp, Homo sapiens
tgcatgattttgtaaccc

SEQ ID NO: 1295936 - DNA, 18 bp, Homo sapiens
tgcatggtgccccaggac

SEQ ID NO: 1295937 - DNA, 20 bp, Homo sapiens
tgcattaaattcacaaactt

SEQ ID NO: 1295938 - DNA, 17 bp, Homo sapiens
tgcattgaacacaaact

SEQ ID NO: 1295939 - DNA, 18 bp, Homo sapiens
tgcattgaacacaaactg

SEQ ID NO: 1295940 - DNA, 19 bp, Homo sapiens
tgcattgaacacaaactgt

SEQ ID NO: 1295941 - DNA, 20 bp, Homo sapiens
tgcattgaccgcgactaatt

SEQ ID NO: 1295942 - DNA, 19 bp, Homo sapiens
tgccaatattaaatctgct

SEQ ID NO: 1295943 - DNA, 16 bp, Homo sapiens
tgccacaaggacttcc

SEQ ID NO: 1295944 - DNA, 19 bp, Homo sapiens
tgccacaaggacttcctgt

SEQ ID NO: 1295945 - DNA, 12 bp, Homo sapiens
tgccacaggaca

SEQ ID NO: 1295946 - DNA, 13 bp, Homo sapiens
tgccacaggacac

SEQ ID NO: 1295947 - DNA, 16 bp, Homo sapiens
tgccacccacctccct

SEQ ID NO: 1295948 - DNA, 18 bp, Homo sapiens
tgccacccacctccctgc

SEQ ID NO: 1295949 - DNA, 21 bp, Homo sapiens
tgccacccacctccctgcctc

SEQ ID NO: 1295950 - DNA, 22 bp, Homo sapiens
tgccacccacctccctgcctcc

SEQ ID NO: 1295951 - DNA, 20 bp, Homo sapiens
tgcccaacccttccctcacc

SEQ ID NO: 1295952 - DNA, 12 bp, Homo sapiens
tgcccacaggcc

SEQ ID NO: 1295953 - DNA, 19 bp, Homo sapiens
tgccccaggaccagctcag

SEQ ID NO: 1295954 - DNA, 16 bp, Homo sapiens
tgcccccaggactggg

SEQ ID NO: 1295955 - DNA, 21 bp, Homo sapiens
tgcccggggaaaggcaaggtc

SEQ ID NO: 1295956 - DNA, 18 bp, Homo sapiens
tgccctccagctctttcc

SEQ ID NO: 1295957 - DNA, 12 bp, Homo sapiens
tgccctcctctc

SEQ ID NO: 1295958 - DNA, 14 bp, Homo sapiens
tgccctcctctccc

SEQ ID NO: 1295959 - DNA, 16 bp, Homo sapiens
tgccctcctctcccat

SEQ ID NO: 1295960 - DNA, 12 bp, Homo sapiens
tgccctgtgcaa

SEQ ID NO: 1295961 - DNA, 15 bp, Homo sapiens
tgccgcagagctggc

SEQ ID NO: 1295962 - DNA, 18 bp, Homo sapiens
tgcctcaggaggcaggac

SEQ ID NO: 1295963 - DNA, 21 bp, Homo sapiens
tgcctcaggaggcaggacctt

SEQ ID NO: 1295964 - DNA, 14 bp, Homo sapiens
tgcctccaggaacc

SEQ ID NO: 1295965 - DNA, 17 bp, Homo sapiens
tgcctccaggaaccaca

SEQ ID NO: 1295966 - DNA, 20 bp, Homo sapiens
tgcctccaggaaccacacca

SEQ ID NO: 1295967 - DNA, 15 bp, Homo sapiens
tgcctccagggctgg

SEQ ID NO: 1295968 - DNA, 17 bp, Homo sapiens
tgcctccagggctggac

SEQ ID NO: 1295969 - DNA, 20 bp, Homo sapiens
tgcctccagggctggactga

SEQ ID NO: 1295970 - DNA, 21 bp, Homo sapiens
tgcctccagggctggactgag

SEQ ID NO: 1295971 - DNA, 23 bp, Homo sapiens
tgcctccagggctggactgaggc

SEQ ID NO: 1295972 - DNA, 23 bp, Homo sapiens
tgcctcgaaacacagaaaccttt

SEQ ID NO: 1295973 - DNA, 17 bp, Homo sapiens
tgcctctgtccccttct

SEQ ID NO: 1295974 - DNA, 16 bp, Homo sapiens
tgccttctaaaggtgt

SEQ ID NO: 1295975 - DNA, 16 bp, Homo sapiens
tgccttggctcagaca

SEQ ID NO: 1295976 - DNA, 20 bp, Homo sapiens
acagtcagatttccagtctc

SEQ ID NO: 1295977 - DNA, 18 bp, Homo sapiens
acagttctttgggccaga

SEQ ID NO: 1295978 - DNA, 15 bp, Homo sapiens
acatacttgaagggc

SEQ ID NO: 1295979 - DNA, 20 bp, Homo sapiens
acatacttgaagggccagag

SEQ ID NO: 1295980 - DNA, 15 bp, Homo sapiens
acatccaaagcagac

SEQ ID NO: 1295981 - DNA, 17 bp, Homo sapiens
acatccaaagcagacag

SEQ ID NO: 1295982 - DNA, 22 bp, Homo sapiens
actcagttttaactagaattta

SEQ ID NO: 1295983 - DNA, 18 bp, Homo sapiens
actcattgctgagcctct

SEQ ID NO: 1295984 - DNA, 22 bp, Homo sapiens
actcattgctgagcctctgctc

SEQ ID NO: 1295985 - DNA, 23 bp, Homo sapiens
actcattgctgagcctctgctcc

SEQ ID NO: 1295986 - DNA, 16 bp, Homo sapiens
actccccgaagtcttt

SEQ ID NO: 1295987 - DNA, 13 bp, Homo sapiens
actcgagaacttt

SEQ ID NO: 1295988 - DNA, 22 bp, Homo sapiens
actctagatgaagttttacatt

SEQ ID NO: 1295989 - DNA, 15 bp, Homo sapiens
actctatagactcta

SEQ ID NO: 1295990 - DNA, 17 bp, Homo sapiens
actctggcaaagctttt

SEQ ID NO: 1295991 - DNA, 23 bp, Homo sapiens
actctggcaaagcttttagaaat

SEQ ID NO: 1295992 - DNA, 17 bp, Homo sapiens
actcttaggaagagaaa

SEQ ID NO: 1295993 - DNA, 20 bp, Homo sapiens
actcttaggaagagaaacca

SEQ ID NO: 1295994 - DNA, 17 bp, Homo sapiens
actcttcacaaaatctg

SEQ ID NO: 1295995 - DNA, 21 bp, Homo sapiens
actctttctgtatatactttt

SEQ ID NO: 1295996 - DNA, 22 bp, Homo sapiens
actctttctgtatatacttttt

SEQ ID NO: 1295997 - DNA, 20 bp, Homo sapiens
actgaaaaggaggggtctgg

SEQ ID NO: 1295998 - DNA, 13 bp, Homo sapiens
actgaggcctgag

SEQ ID NO: 1295999 - DNA, 19 bp, Homo sapiens
actgatgctgcccctcatc

SEQ ID NO: 1296000 - DNA, 20 bp, Homo sapiens
actgatgctgcccctcatct

SEQ ID NO: 1296001 - DNA, 16 bp, Homo sapiens
actgcaagaaaatgat

SEQ ID NO: 1296002 - DNA, 20 bp, Homo sapiens
actgccctccagctctttcc

SEQ ID NO: 1296003 - DNA, 23 bp, Homo sapiens
actgccctccagctctttcctcc

SEQ ID NO: 1296004 - DNA, 17 bp, Homo sapiens
actgcctcgaaacacag

SEQ ID NO: 1296005 - DNA, 19 bp, Homo sapiens
actgcctcgaaacacagaa

SEQ ID NO: 1296006 - DNA, 16 bp, Homo sapiens
actggaagctaatttg

SEQ ID NO: 1296007 - DNA, 19 bp, Homo sapiens
actggaagctaatttgcat

SEQ ID NO: 1296008 - DNA, 13 bp, Homo sapiens
actggctttggct

SEQ ID NO: 1296009 - DNA, 15 bp, Homo sapiens
actggctttggcttc

SEQ ID NO: 1296010 - DNA, 16 bp, Homo sapiens
actggctttggcttct

SEQ ID NO: 1296011 - DNA, 18 bp, Homo sapiens
actggctttggcttcttg

SEQ ID NO: 1296012 - DNA, 17 bp, Homo sapiens
actggggcctccagaac

SEQ ID NO: 1296013 - DNA, 14 bp, Homo sapiens
actggtattttatc

SEQ ID NO: 1296014 - DNA, 16 bp, Homo sapiens
actgtaataaagatga

SEQ ID NO: 1296015 - DNA, 16 bp, Homo sapiens
actgtcctgggcctgc

SEQ ID NO: 1296016 - DNA, 12 bp, Homo sapiens
actgtctttcct

SEQ ID NO: 1296017 - DNA, 21 bp, Homo sapiens
actgtctttttttccctacca

SEQ ID NO: 1296018 - DNA, 21 bp, Homo sapiens
actgtgacccccagctccggc

SEQ ID NO: 1296019 - DNA, 16 bp, Homo sapiens
actgtgtgtgtgaatg

SEQ ID NO: 1296020 - DNA, 14 bp, Homo sapiens
actgtgtgttgcca

SEQ ID NO: 1296021 - DNA, 15 bp, Homo sapiens
actgtgtttcaagtt

SEQ ID NO: 1296022 - DNA, 13 bp, Homo sapiens
acttatgatttca

SEQ ID NO: 1296023 - DNA, 13 bp, Homo sapiens
acttatttaatgc

SEQ ID NO: 1296024 - DNA, 24 bp, Homo sapiens
acttcatattgctgagagaaatat

SEQ ID NO: 1296025 - DNA, 21 bp, Homo sapiens
acttcattcttgaaagctgtg

SEQ ID NO: 1296026 - DNA, 12 bp, Homo sapiens
acttctgcctgt

SEQ ID NO: 1296027 - DNA, 20 bp, Homo sapiens
acttcttgaaggtgctgacg

SEQ ID NO: 1296028 - DNA, 14 bp, Homo sapiens
acttgaagggccag

SEQ ID NO: 1296029 - DNA, 17 bp, Homo sapiens
acttgaagggccagagc

SEQ ID NO: 1296030 - DNA, 19 bp, Homo sapiens
acttgaagggccagagcca

SEQ ID NO: 1296031 - DNA, 23 bp, Homo sapiens
acttggggagttaagacctggca

SEQ ID NO: 1296032 - DNA, 14 bp, Homo sapiens
actttaagaggaca

SEQ ID NO: 1296033 - DNA, 22 bp, Homo sapiens
actttagggctgtaaaatgcat

SEQ ID NO: 1296034 - DNA, 12 bp, Homo sapiens
actttattaaat

SEQ ID NO: 1296035 - DNA, 21 bp, Homo sapiens
actttctacaatgtgaacttt

SEQ ID NO: 1296036 - DNA, 23 bp, Homo sapiens
acttttatactctttctgtatat

SEQ ID NO: 1296037 - DNA, 12 bp, Homo sapiens
agaaaacatcta

SEQ ID NO: 1296038 - DNA, 12 bp, Homo sapiens
agaaaattcaat

SEQ ID NO: 1296039 - DNA, 15 bp, Homo sapiens
agaaaattcaattgt

SEQ ID NO: 1296040 - DNA, 17 bp, Homo sapiens
agaaaattcaattgtaa

SEQ ID NO: 1296041 - DNA, 16 bp, Homo sapiens
agaaaccttattgtac

SEQ ID NO: 1296042 - DNA, 18 bp, Homo sapiens
agaaaccttattgtacct

SEQ ID NO: 1296043 - DNA, 16 bp, Homo sapiens
agaaacgtcttctaaa

SEQ ID NO: 1296044 - DNA, 12 bp, Homo sapiens
agaaagaagccc

SEQ ID NO: 1296045 - DNA, 17 bp, Homo sapiens
agaaaggggagcccact

SEQ ID NO: 1296046 - DNA, 16 bp, Homo sapiens
agaaagtgtgctttat

SEQ ID NO: 1296047 - DNA, 18 bp, Homo sapiens
agaaataaaaggaagcca

SEQ ID NO: 1296048 - DNA, 20 bp, Homo sapiens
agaaataaaaggaagccaaa

SEQ ID NO: 1296049 - DNA, 17 bp, Homo sapiens
agaaatatggaacttac

SEQ ID NO: 1296050 - DNA, 20 bp, Homo sapiens
agaaatatggaacttacatt

SEQ ID NO: 1296051 - DNA, 22 bp, Homo sapiens
agaaatatggaacttacattgt

SEQ ID NO: 1296052 - DNA, 22 bp, Homo sapiens
agaacatgtgagaggtttgact

SEQ ID NO: 1296053 - DNA, 17 bp, Homo sapiens
agaacggggctcttctc

SEQ ID NO: 1296054 - DNA, 20 bp, Homo sapiens
agaacggggctcttctcatt

SEQ ID NO: 1296055 - DNA, 19 bp, Homo sapiens
agaactcaaatggggccag

SEQ ID NO: 1296056 - DNA, 19 bp, Homo sapiens
agaactcactggggcctac

SEQ ID NO: 1296057 - DNA, 17 bp, Homo sapiens
agaactcagttttaact

SEQ ID NO: 1296058 - DNA, 17 bp, Homo sapiens
agaagccacaggcctga

SEQ ID NO: 1296059 - DNA, 18 bp, Homo sapiens
agaagccacaggcctgag

SEQ ID NO: 1296060 - DNA, 19 bp, Homo sapiens
agaagccacaggcctgaga

SEQ ID NO: 1296061 - DNA, 14 bp, Homo sapiens
agaagcccccagct

SEQ ID NO: 1296062 - DNA, 20 bp, Homo sapiens
agaagctataaattcctctt

SEQ ID NO: 1296063 - DNA, 20 bp, Homo sapiens
agaagctcctctccccagcc

SEQ ID NO: 1296064 - DNA, 22 bp, Homo sapiens
agaagctcctctccccagccca

SEQ ID NO: 1296065 - DNA, 15 bp, Homo sapiens
agaaggcaaaaatgt

SEQ ID NO: 1296066 - DNA, 13 bp, Homo sapiens
agaagggggtggt

SEQ ID NO: 1296067 - DNA, 20 bp, Homo sapiens
agaagggggtggtgtctcca

SEQ ID NO: 1296068 - DNA, 17 bp, Homo sapiens
agaatagccacatttgg

SEQ ID NO: 1296069 - DNA, 19 bp, Homo sapiens
agaatatttattacctctg

SEQ ID NO: 1296070 - DNA, 22 bp, Homo sapiens
agaatatttattacctctgata

SEQ ID NO: 1296071 - DNA, 12 bp, Homo sapiens
agaatccaaact

SEQ ID NO: 1296072 - DNA, 21 bp, Homo sapiens
agaatccaaacttggattttt

SEQ ID NO: 1296073 - DNA, 19 bp, Homo sapiens
agaatcccaaatttgattg

SEQ ID NO: 1296074 - DNA, 22 bp, Homo sapiens
agaatgctgcaggacttgagaa

SEQ ID NO: 1296075 - DNA, 14 bp, Homo sapiens
agaatgctgtacat

SEQ ID NO: 1296076 - DNA, 13 bp, Homo sapiens
agaatttattcaa

SEQ ID NO: 1296077 - DNA, 14 bp, Homo sapiens
agaatttattcaat

SEQ ID NO: 1296078 - DNA, 12 bp, Homo sapiens
agacacaggccc

SEQ ID NO: 1296079 - DNA, 17 bp, Homo sapiens
agacagctccaccctgg

SEQ ID NO: 1296080 - DNA, 21 bp, Homo sapiens
agacagctccaccctggccga

SEQ ID NO: 1296081 - DNA, 20 bp, Homo sapiens
agacatacttgaagggccag

SEQ ID NO: 1296082 - DNA, 21 bp, Homo sapiens
agacatacttgaagggccaga

SEQ ID NO: 1296083 - DNA, 15 bp, Homo sapiens
agacctgatcctgga

SEQ ID NO: 1296084 - DNA, 16 bp, Homo sapiens
agacctgatcctggag

SEQ ID NO: 1296085 - DNA, 16 bp, Homo sapiens
agacctggcagctctg

SEQ ID NO: 1296086 - DNA, 19 bp, Homo sapiens
agacctgttagcagacagg

SEQ ID NO: 1296087 - DNA, 15 bp, Homo sapiens
agacgagaggacgag

SEQ ID NO: 1296088 - DNA, 19 bp, Homo sapiens
agactcaggccaagaaacg

SEQ ID NO: 1296089 - DNA, 20 bp, Homo sapiens
agactcaggccaagaaacgt

SEQ ID NO: 1296090 - DNA, 14 bp, Homo sapiens
agactcgagaactt

SEQ ID NO: 1296091 - DNA, 15 bp, Homo sapiens
agactcgagaacttt

SEQ ID NO: 1296092 - DNA, 20 bp, Homo sapiens
agactggaagctaatttgca

SEQ ID NO: 1296093 - DNA, 20 bp, Homo sapiens
agagacagttgggtgagaac

SEQ ID NO: 1296094 - DNA, 23 bp, Homo sapiens
agagacagttgggtgagaacaac

SEQ ID NO: 1296095 - DNA, 22 bp, Homo sapiens
agagccaggggggtgaggagct

SEQ ID NO: 1296096 - DNA, 22 bp, Homo sapiens
agaggacgagcgattgaggtgt

SEQ ID NO: 1296097 - DNA, 22 bp, Homo sapiens
agaggaggggccgctgccaccc

SEQ ID NO: 1296098 - DNA, 15 bp, Homo sapiens
agctactgtgtgtgt

SEQ ID NO: 1296099 - DNA, 16 bp, Homo sapiens
agctacttgggaggct

SEQ ID NO: 1296100 - DNA, 17 bp, Homo sapiens
agctacttgggaggctg

SEQ ID NO: 1296101 - DNA, 17 bp, Homo sapiens
agctcaggacagatgcc

SEQ ID NO: 1296102 - DNA, 14 bp, Homo sapiens
agctccaacctgca

SEQ ID NO: 1296103 - DNA, 22 bp, Homo sapiens
agctccaacctgcaaagatctg

SEQ ID NO: 1296104 - DNA, 12 bp, Homo sapiens
ccagcagcgcct

SEQ ID NO: 1296105 - DNA, 17 bp, Homo sapiens
ccagcagcgcctttccc

SEQ ID NO: 1296106 - DNA, 19 bp, Homo sapiens
ccagcagcgcctttcccaa

SEQ ID NO: 1296107 - DNA, 16 bp, Homo sapiens
ccagccatgtctgcat

SEQ ID NO: 1296108 - DNA, 12 bp, Homo sapiens
ccagcccagaga

SEQ ID NO: 1296109 - DNA, 13 bp, Homo sapiens
ccagcccagagac

SEQ ID NO: 1296110 - DNA, 14 bp, Homo sapiens
ccagccctccccat

SEQ ID NO: 1296111 - DNA, 13 bp, Homo sapiens
ccagcctccctga

SEQ ID NO: 1296112 - DNA, 15 bp, Homo sapiens
ccagcctccctgaag

SEQ ID NO: 1296113 - DNA, 13 bp, Homo sapiens
ccagctaagaacc

SEQ ID NO: 1296114 - DNA, 14 bp, Homo sapiens
ccagctaagaacct

SEQ ID NO: 1296115 - DNA, 15 bp, Homo sapiens
ccagctaagaacctg

SEQ ID NO: 1296116 - DNA, 19 bp, Homo sapiens
ccagctcaggacagatgcc

SEQ ID NO: 1296117 - DNA, 20 bp, Homo sapiens
ccagctcaggacagatgcca

SEQ ID NO: 1296118 - DNA, 23 bp, Homo sapiens
ccagctcaggacagatgccacac

SEQ ID NO: 1296119 - DNA, 14 bp, Homo sapiens
ccagctccaacctg

SEQ ID NO: 1296120 - DNA, 14 bp, Homo sapiens
ccagctccctctat

SEQ ID NO: 1296121 - DNA, 16 bp, Homo sapiens
ccagctccctctattt

SEQ ID NO: 1296122 - DNA, 18 bp, Homo sapiens
ccagctccggcctgtcct

SEQ ID NO: 1296123 - DNA, 19 bp, Homo sapiens
ccagctccggcctgtcctc

SEQ ID NO: 1296124 - DNA, 17 bp, Homo sapiens
ccagctgagcgccagga

SEQ ID NO: 1296125 - DNA, 13 bp, Homo sapiens
ccagctgcactga

SEQ ID NO: 1296126 - DNA, 17 bp, Homo sapiens
ccagcttgttatttata

SEQ ID NO: 1296127 - DNA, 24 bp, Homo sapiens
ccaggaaccacaccacatctaagc

SEQ ID NO: 1296128 - DNA, 14 bp, Homo sapiens
ccaggaatttccca

SEQ ID NO: 1296129 - DNA, 23 bp, Homo sapiens
ccaggaatttcccaggaccctga

SEQ ID NO: 1296130 - DNA, 13 bp, Homo sapiens
ccaggaccagctc

SEQ ID NO: 1296131 - DNA, 14 bp, Homo sapiens
ccaggaccagctca

SEQ ID NO: 1296132 - DNA, 14 bp, Homo sapiens
ccaggaccctgaag

SEQ ID NO: 1296133 - DNA, 15 bp, Homo sapiens
ccaggacctggctgc

SEQ ID NO: 1296134 - DNA, 21 bp, Homo sapiens
ccaggacttatttaaactctg

SEQ ID NO: 1296135 - DNA, 20 bp, Homo sapiens
ccaggctgaagcaggttccc

SEQ ID NO: 1296136 - DNA, 15 bp, Homo sapiens
ccaggctgaccacag

SEQ ID NO: 1296137 - DNA, 16 bp, Homo sapiens
ccaggctgaccacagc

SEQ ID NO: 1296138 - DNA, 19 bp, Homo sapiens
ccaggctgaccacagcaca

SEQ ID NO: 1296139 - DNA, 20 bp, Homo sapiens
ccaggctgaccacagcacag

SEQ ID NO: 1296140 - DNA, 21 bp, Homo sapiens
ccaggctgaccacagcacagc

SEQ ID NO: 1296141 - DNA, 13 bp, Homo sapiens
ccagggacagagg

SEQ ID NO: 1296142 - DNA, 18 bp, Homo sapiens
ccagggacagaggcccca

SEQ ID NO: 1296143 - DNA, 14 bp, Homo sapiens
ccagggcccagagc

SEQ ID NO: 1296144 - DNA, 22 bp, Homo sapiens
ccagggctggactgaggcctga

SEQ ID NO: 1296145 - DNA, 17 bp, Homo sapiens
ccaggggggtgaggagc

SEQ ID NO: 1296146 - DNA, 20 bp, Homo sapiens
ccaggggggtgaggagctgg

SEQ ID NO: 1296147 - DNA, 17 bp, Homo sapiens
ccagtccccccaccctc

SEQ ID NO: 1296148 - DNA, 18 bp, Homo sapiens
ccagtctccaccaggaac

SEQ ID NO: 1296149 - DNA, 19 bp, Homo sapiens
ccagtctccaccaggaacc

SEQ ID NO: 1296150 - DNA, 14 bp, Homo sapiens
ccagtgcccccact

SEQ ID NO: 1296151 - DNA, 16 bp, Homo sapiens
ccagtgcccccactga

SEQ ID NO: 1296152 - DNA, 18 bp, Homo sapiens
ccagtgcccccactgacc

SEQ ID NO: 1296153 - DNA, 16 bp, Homo sapiens
ccagtgtccttagaac

SEQ ID NO: 1296154 - DNA, 13 bp, Homo sapiens
ccagttcaccctg

SEQ ID NO: 1296155 - DNA, 18 bp, Homo sapiens
ccatatccttaccctcct

SEQ ID NO: 1296156 - DNA, 23 bp, Homo sapiens
ccatgagatgatacatccaaagc

SEQ ID NO: 1296157 - DNA, 14 bp, Homo sapiens
ccatgatggcaaca

SEQ ID NO: 1296158 - DNA, 23 bp, Homo sapiens
ccatgattctatttatatgtaca

SEQ ID NO: 1296159 - DNA, 17 bp, Homo sapiens
ccatgcactgtgaagga

SEQ ID NO: 1296160 - DNA, 20 bp, Homo sapiens
ccatgcactgtgaaggaccc

SEQ ID NO: 1296161 - DNA, 12 bp, Homo sapiens
ccatgcctcagc

SEQ ID NO: 1296162 - DNA, 20 bp, Homo sapiens
ccatgtagccccctggcctc

SEQ ID NO: 1296163 - DNA, 16 bp, Homo sapiens
ccattcctgaagaacc

SEQ ID NO: 1296164 - DNA, 13 bp, Homo sapiens
ccattctccacag

SEQ ID NO: 1296165 - DNA, 12 bp, Homo sapiens
ccatttctattt

SEQ ID NO: 1296166 - DNA, 14 bp, Homo sapiens
cccaaatgagccat

SEQ ID NO: 1296167 - DNA, 21 bp, Homo sapiens
cccaactctagctgggggtgg

SEQ ID NO: 1296168 - DNA, 20 bp, Homo sapiens
cccaactctcccctgacctg

SEQ ID NO: 1296169 - DNA, 15 bp, Homo sapiens
cccaatattataatt

SEQ ID NO: 1296170 - DNA, 17 bp, Homo sapiens
cccaatattataatttt

SEQ ID NO: 1296171 - DNA, 17 bp, Homo sapiens
cccaatccctttattac

SEQ ID NO: 1296172 - DNA, 16 bp, Homo sapiens
cccacaagtggtggta

SEQ ID NO: 1296173 - DNA, 20 bp, Homo sapiens
cccacaagtggtggtaaccc

SEQ ID NO: 1296174 - DNA, 22 bp, Homo sapiens
cccacaagtggtggtaaccctg

SEQ ID NO: 1296175 - DNA, 17 bp, Homo sapiens
cccaccgtgggcaggga

SEQ ID NO: 1296176 - DNA, 14 bp, Homo sapiens
cccacctccctgcc

SEQ ID NO: 1296177 - DNA, 22 bp, Homo sapiens
cccactgtcctgggcctgcaga

SEQ ID NO: 1296178 - DNA, 12 bp, Homo sapiens
cccagactcaga

SEQ ID NO: 1296179 - DNA, 23 bp, Homo sapiens
cccagagacatacttgaagggcc

SEQ ID NO: 1296180 - DNA, 12 bp, Homo sapiens
cccagagcccag

SEQ ID NO: 1296181 - DNA, 16 bp, Homo sapiens
cccagagcccagctcc

SEQ ID NO: 1296182 - DNA, 15 bp, Homo sapiens
cccagaggagggcag

SEQ ID NO: 1296183 - DNA, 17 bp, Homo sapiens
cccagattggctcacac

SEQ ID NO: 1296184 - DNA, 19 bp, Homo sapiens
cccagattggctcacactg

SEQ ID NO: 1296185 - DNA, 20 bp, Homo sapiens
cccagattggctcacactga

SEQ ID NO: 1296186 - DNA, 21 bp, Homo sapiens
cccagattttgctgtatattt

SEQ ID NO: 1296187 - DNA, 12 bp, Homo sapiens
cccagcccagag

SEQ ID NO: 1296188 - DNA, 14 bp, Homo sapiens
cccagcccagagac

SEQ ID NO: 1296189 - DNA, 19 bp, Homo sapiens
cccagctaagaacctggaa

SEQ ID NO: 1296190 - DNA, 20 bp, Homo sapiens
cccagctaagaacctggaac

SEQ ID NO: 1296191 - DNA, 22 bp, Homo sapiens
cccagctaagaacctggaactt

SEQ ID NO: 1296192 - DNA, 15 bp, Homo sapiens
cccagctacttggga

SEQ ID NO: 1296193 - DNA, 12 bp, Homo sapiens
cccaggaccagc

SEQ ID NO: 1296194 - DNA, 16 bp, Homo sapiens
cccaggaccagctcag

SEQ ID NO: 1296195 - DNA, 18 bp, Homo sapiens
cccaggacctggctgcca

SEQ ID NO: 1296196 - DNA, 13 bp, Homo sapiens
cccaggactgggc

SEQ ID NO: 1296197 - DNA, 15 bp, Homo sapiens
cccaggactgggcca

SEQ ID NO: 1296198 - DNA, 13 bp, Homo sapiens
cccagggcccaga

SEQ ID NO: 1296199 - DNA, 14 bp, Homo sapiens
cccagggcccagag

SEQ ID NO: 1296200 - DNA, 20 bp, Homo sapiens
cccagggcccagagcccagc

SEQ ID NO: 1296201 - DNA, 14 bp, Homo sapiens
cccagttcaccctg

SEQ ID NO: 1296202 - DNA, 20 bp, Homo sapiens
cccatccagtctcccaactt

SEQ ID NO: 1296203 - DNA, 15 bp, Homo sapiens
cccatcctccagcag

SEQ ID NO: 1296204 - DNA, 22 bp, Homo sapiens
cccatctcatgcccctggctgg

SEQ ID NO: 1296205 - DNA, 18 bp, Homo sapiens
cccatgcactgtgaagga

SEQ ID NO: 1296206 - DNA, 19 bp, Homo sapiens
cccatggagccagctccct

SEQ ID NO: 1296207 - DNA, 13 bp, Homo sapiens
cccattcctgaag

SEQ ID NO: 1296208 - DNA, 17 bp, Homo sapiens
cccattcttttgtaatt

SEQ ID NO: 1296209 - DNA, 21 bp, Homo sapiens
cccattcttttgtaatttaaa

SEQ ID NO: 1296210 - DNA, 18 bp, Homo sapiens
cccattgtccctctgccc

SEQ ID NO: 1296211 - DNA, 20 bp, Homo sapiens
cccattgtccctctgcccca

SEQ ID NO: 1296212 - DNA, 17 bp, Homo sapiens
cccatttctatttattt

SEQ ID NO: 1296213 - DNA, 19 bp, Homo sapiens
cccatttctatttatttac

SEQ ID NO: 1296214 - DNA, 15 bp, Homo sapiens
ccccaataattgcag

SEQ ID NO: 1296215 - DNA, 20 bp, Homo sapiens
ccccaccctggtgggccaac

SEQ ID NO: 1296216 - DNA, 12 bp, Homo sapiens
ccccacctctcc

SEQ ID NO: 1296217 - DNA, 12 bp, Homo sapiens
ccccagcactga

SEQ ID NO: 1296218 - DNA, 13 bp, Homo sapiens
ccccagcactgag

SEQ ID NO: 1296219 - DNA, 13 bp, Homo sapiens
ccccagcctccct

SEQ ID NO: 1296220 - DNA, 17 bp, Homo sapiens
ccccagctaagaacctg

SEQ ID NO: 1296221 - DNA, 13 bp, Homo sapiens
ccccagctccggc

SEQ ID NO: 1296222 - DNA, 11 bp, Homo sapiens
ccccaggacca

SEQ ID NO: 1296223 - DNA, 15 bp, Homo sapiens
ccccaggaccagctc

SEQ ID NO: 1296224 - DNA, 21 bp, Homo sapiens
catctgaccagcagcgccttt

SEQ ID NO: 1296225 - DNA, 21 bp, Homo sapiens
catctgtgcactgcccatgga

SEQ ID NO: 1296226 - DNA, 22 bp, Homo sapiens
catctttacaaaactacatgag

SEQ ID NO: 1296227 - DNA, 16 bp, Homo sapiens
catgagaacaaacaga

SEQ ID NO: 1296228 - DNA, 23 bp, Homo sapiens
catgagttggggtctggcagcct

SEQ ID NO: 1296229 - DNA, 14 bp, Homo sapiens
catgattctattta

SEQ ID NO: 1296230 - DNA, 12 bp, Homo sapiens
catgatttcctt

SEQ ID NO: 1296231 - DNA, 16 bp, Homo sapiens
catgatttccttgaat

SEQ ID NO: 1296232 - DNA, 18 bp, Homo sapiens
catgatttccttgaatgt

SEQ ID NO: 1296233 - DNA, 18 bp, Homo sapiens
catgcactgtgaaggacc

SEQ ID NO: 1296234 - DNA, 14 bp, Homo sapiens
catgcccctggctg

SEQ ID NO: 1296235 - DNA, 16 bp, Homo sapiens
catgcccctggctggg

SEQ ID NO: 1296236 - DNA, 14 bp, Homo sapiens
catgccctgtgcaa

SEQ ID NO: 1296237 - DNA, 19 bp, Homo sapiens
catgccctgtgcaacctct

SEQ ID NO: 1296238 - DNA, 16 bp, Homo sapiens
catgcctcagccctga

SEQ ID NO: 1296239 - DNA, 19 bp, Homo sapiens
catgcctcagccctgaccc

SEQ ID NO: 1296240 - DNA, 14 bp, Homo sapiens
catgcggtagccag

SEQ ID NO: 1296241 - DNA, 15 bp, Homo sapiens
catgcggtagccagc

SEQ ID NO: 1296242 - DNA, 17 bp, Homo sapiens
catgcggtagccagcac

SEQ ID NO: 1296243 - DNA, 19 bp, Homo sapiens
catgcggtagccagcacac

SEQ ID NO: 1296244 - DNA, 19 bp, Homo sapiens
catgctgctggacagtatc

SEQ ID NO: 1296245 - DNA, 16 bp, Homo sapiens
catggtcacacactga

SEQ ID NO: 1296246 - DNA, 15 bp, Homo sapiens
catggtgccccagga

SEQ ID NO: 1296247 - DNA, 19 bp, Homo sapiens
catggtgccccaggaccag

SEQ ID NO: 1296248 - DNA, 22 bp, Homo sapiens
catggtgccccaggaccagctc

SEQ ID NO: 1296249 - DNA, 13 bp, Homo sapiens
catgtagccccct

SEQ ID NO: 1296250 - DNA, 17 bp, Homo sapiens
catgtagccccctggcc

SEQ ID NO: 1296251 - DNA, 18 bp, Homo sapiens
catgtagccccctggcct

SEQ ID NO: 1296252 - DNA, 21 bp, Homo sapiens
catgtagccccctggcctctg

SEQ ID NO: 1296253 - DNA, 22 bp, Homo sapiens
catgtagccccctggcctctgt

SEQ ID NO: 1296254 - DNA, 14 bp, Homo sapiens
catgtctgcatttc

SEQ ID NO: 1296255 - DNA, 15 bp, Homo sapiens
catgtctgcatttcg

SEQ ID NO: 1296256 - DNA, 16 bp, Homo sapiens
catgttttcaactgcc

SEQ ID NO: 1296257 - DNA, 17 bp, Homo sapiens
catgttttcaactgcca

SEQ ID NO: 1296258 - DNA, 14 bp, Homo sapiens
catgttttccgtga

SEQ ID NO: 1296259 - DNA, 18 bp, Homo sapiens
cattaaattcacaaactt

SEQ ID NO: 1296260 - DNA, 22 bp, Homo sapiens
cattcacagttctttgggccag

SEQ ID NO: 1296261 - DNA, 19 bp, Homo sapiens
cattcagtgattactgtca

SEQ ID NO: 1296262 - DNA, 20 bp, Homo sapiens
cattcagtgattactgtcaa

SEQ ID NO: 1296263 - DNA, 20 bp, Homo sapiens
cattcatttagctaaacgga

SEQ ID NO: 1296264 - DNA, 14 bp, Homo sapiens
cattccaagcctga

SEQ ID NO: 1296265 - DNA, 20 bp, Homo sapiens
cattcctgaagaaccagtcc

SEQ ID NO: 1296266 - DNA, 21 bp, Homo sapiens
cattcctgaagaaccagtccc

SEQ ID NO: 1296267 - DNA, 17 bp, Homo sapiens
cattctccacagcaacc

SEQ ID NO: 1296268 - DNA, 22 bp, Homo sapiens
cattgaccgcgactaatttcaa

SEQ ID NO: 1296269 - DNA, 17 bp, Homo sapiens
cattgctgagcctctgc

SEQ ID NO: 1296270 - DNA, 15 bp, Homo sapiens
cattgtccctctgcc

SEQ ID NO: 1296271 - DNA, 19 bp, Homo sapiens
cattgtccctctgccccat

SEQ ID NO: 1296272 - DNA, 16 bp, Homo sapiens
cattgttcaattagaa

SEQ ID NO: 1296273 - DNA, 20 bp, Homo sapiens
cattgttgagctattgctgt

SEQ ID NO: 1296274 - DNA, 20 bp, Homo sapiens
catttagagaggaaaagtaa

SEQ ID NO: 1296275 - DNA, 21 bp, Homo sapiens
catttataaagctaaaataac

SEQ ID NO: 1296276 - DNA, 12 bp, Homo sapiens
catttatacaaa

SEQ ID NO: 1296277 - DNA, 13 bp, Homo sapiens
catttctatttat

SEQ ID NO: 1296278 - DNA, 14 bp, Homo sapiens
catttctatttatt

SEQ ID NO: 1296279 - DNA, 18 bp, Homo sapiens
catttctatttatttact

SEQ ID NO: 1296280 - DNA, 18 bp, Homo sapiens
catttctttgtgctttgg

SEQ ID NO: 1296281 - DNA, 20 bp, Homo sapiens
catttggttcattaattcta

SEQ ID NO: 1296282 - DNA, 14 bp, Homo sapiens
cattttaattcatc

SEQ ID NO: 1296283 - DNA, 15 bp, Homo sapiens
cattttggtgagaaa

SEQ ID NO: 1296284 - DNA, 17 bp, Homo sapiens
catttttttccaggctg

SEQ ID NO: 1296285 - DNA, 22 bp, Homo sapiens
ccaaaatgctctagtgccttct

SEQ ID NO: 1296286 - DNA, 13 bp, Homo sapiens
ccaaacgcctccc

SEQ ID NO: 1296287 - DNA, 18 bp, Homo sapiens
ccaaacttggatttttga

SEQ ID NO: 1296288 - DNA, 13 bp, Homo sapiens
ccaaagcagacag

SEQ ID NO: 1296289 - DNA, 15 bp, Homo sapiens
ccaaataatgtctct

SEQ ID NO: 1296290 - DNA, 17 bp, Homo sapiens
ccaaataatgtctctgt

SEQ ID NO: 1296291 - DNA, 20 bp, Homo sapiens
ccaaatttgattgatttgaa

SEQ ID NO: 1296292 - DNA, 19 bp, Homo sapiens
ccaacaaagaacactaact

SEQ ID NO: 1296293 - DNA, 13 bp, Homo sapiens
ccaacaccaagca

SEQ ID NO: 1296294 - DNA, 16 bp, Homo sapiens
ccaacaccaagcacag

SEQ ID NO: 1296295 - DNA, 23 bp, Homo sapiens
ccaacaccaagcacagcagcctg

SEQ ID NO: 1296296 - DNA, 20 bp, Homo sapiens
ccaaccccccagcactgagg

SEQ ID NO: 1296297 - DNA, 19 bp, Homo sapiens
ccaacctgcaaagatctgt

SEQ ID NO: 1296298 - DNA, 21 bp, Homo sapiens
ccaactctagctgggggtggg

SEQ ID NO: 1296299 - DNA, 14 bp, Homo sapiens
ccaagcacagcagc

SEQ ID NO: 1296300 - DNA, 18 bp, Homo sapiens
ccaagcacagcagcctgg

SEQ ID NO: 1296301 - DNA, 13 bp, Homo sapiens
ccaagggatctgg

SEQ ID NO: 1296302 - DNA, 21 bp, Homo sapiens
ccaagggatctggtcctaccc

SEQ ID NO: 1296303 - DNA, 19 bp, Homo sapiens
ccaaggggaatcagaactc

SEQ ID NO: 1296304 - DNA, 15 bp, Homo sapiens
ccaatattaaatctg

SEQ ID NO: 1296305 - DNA, 13 bp, Homo sapiens
ccaatattataat

SEQ ID NO: 1296306 - DNA, 20 bp, Homo sapiens
ccaatattttctttaatgct

SEQ ID NO: 1296307 - DNA, 21 bp, Homo sapiens
ccacaagtggtggtaaccctg

SEQ ID NO: 1296308 - DNA, 20 bp, Homo sapiens
ccacacaaggatagatgctg

SEQ ID NO: 1296309 - DNA, 14 bp, Homo sapiens
ccacactcagcaca

SEQ ID NO: 1296310 - DNA, 15 bp, Homo sapiens
ccacagtagtcttga

SEQ ID NO: 1296311 - DNA, 14 bp, Homo sapiens
ccacatcaaagagg

SEQ ID NO: 1296312 - DNA, 23 bp, Homo sapiens
ccacatctaagcctgaaggggcg

SEQ ID NO: 1296313 - DNA, 13 bp, Homo sapiens
ccacatttggaat

SEQ ID NO: 1296314 - DNA, 19 bp, Homo sapiens
ccacatttggaatactttt

SEQ ID NO: 1296315 - DNA, 21 bp, Homo sapiens
ccaccctggccgagtccaagc

SEQ ID NO: 1296316 - DNA, 18 bp, Homo sapiens
ccaccgaagccgcctgtg

SEQ ID NO: 1296317 - DNA, 13 bp, Homo sapiens
ccacctagcagca

SEQ ID NO: 1296318 - DNA, 23 bp, Homo sapiens
ccacctagcagcaccgttctgtg

SEQ ID NO: 1296319 - DNA, 18 bp, Homo sapiens
ccacctccctgcctccag

SEQ ID NO: 1296320 - DNA, 17 bp, Homo sapiens
ccacctctccctgaccc

SEQ ID NO: 1296321 - DNA, 18 bp, Homo sapiens
ccactaagcagaggaggg

SEQ ID NO: 1296322 - DNA, 22 bp, Homo sapiens
ccactaagcagaggaggggccg

SEQ ID NO: 1296323 - DNA, 13 bp, Homo sapiens
ccactgaccagaa

SEQ ID NO: 1296324 - DNA, 15 bp, Homo sapiens
ccacttctgggtggg

SEQ ID NO: 1296325 - DNA, 19 bp, Homo sapiens
ccagaactcactggggcct

SEQ ID NO: 1296326 - DNA, 13 bp, Homo sapiens
ccagacacccagg

SEQ ID NO: 1296327 - DNA, 16 bp, Homo sapiens
ccagacacccaggact

SEQ ID NO: 1296328 - DNA, 20 bp, Homo sapiens
ccagacatgccacaaggact

SEQ ID NO: 1296329 - DNA, 21 bp, Homo sapiens
ccagacctgatcctggaggcc

SEQ ID NO: 1296330 - DNA, 13 bp, Homo sapiens
ccagacttccttg

SEQ ID NO: 1296331 - DNA, 19 bp, Homo sapiens
ccagagaaaggggagccca

SEQ ID NO: 1296332 - DNA, 20 bp, Homo sapiens
ccagagaaaggggagcccac

SEQ ID NO: 1296333 - DNA, 23 bp, Homo sapiens
ccagagacatacttgaagggcca

SEQ ID NO: 1296334 - DNA, 21 bp, Homo sapiens
ccagagagcctggtgctgctg

SEQ ID NO: 1296335 - DNA, 15 bp, Homo sapiens
ccagatccagcctgg

SEQ ID NO: 1296336 - DNA, 15 bp, Homo sapiens
ccagatgcagggcag

SEQ ID NO: 1296337 - DNA, 15 bp, Homo sapiens
ccagattttgctgta

SEQ ID NO: 1296338 - DNA, 18 bp, Homo sapiens
ccagattttgctgtatat

SEQ ID NO: 1296339 - DNA, 22 bp, Homo sapiens
ccagcactgaggaagaacgggg

SEQ ID NO: 1296340 - DNA, 16 bp, Homo sapiens
ccagcacttgtccagc

SEQ ID NO: 1296341 - DNA, 20 bp, Homo sapiens
ccagcacttgtccagctgag

SEQ ID NO: 1296342 - DNA, 22 bp, Homo sapiens
cagcagggaaaatgcagcaggg

SEQ ID NO: 1296343 - DNA, 18 bp, Homo sapiens
cagcagggatgccctgga

SEQ ID NO: 1296344 - DNA, 21 bp, Homo sapiens
cagcagggatgccctggaggt

SEQ ID NO: 1296345 - DNA, 18 bp, Homo sapiens
cagccacgaggtgcaaca

SEQ ID NO: 1296346 - DNA, 16 bp, Homo sapiens
cagccatcaaaatgct

SEQ ID NO: 1296347 - DNA, 21 bp, Homo sapiens
cagcccagagacatacttgaa

SEQ ID NO: 1296348 - DNA, 18 bp, Homo sapiens
cagccctcacccctggtt

SEQ ID NO: 1296349 - DNA, 18 bp, Homo sapiens
cagcctcccatccagggc

SEQ ID NO: 1296350 - DNA, 12 bp, Homo sapiens
cagcctccctga

SEQ ID NO: 1296351 - DNA, 15 bp, Homo sapiens
cagcctggggtctgg

SEQ ID NO: 1296352 - DNA, 15 bp, Homo sapiens
cagccttgccagaga

SEQ ID NO: 1296353 - DNA, 18 bp, Homo sapiens
cagcgccaggctgaccac

SEQ ID NO: 1296354 - DNA, 19 bp, Homo sapiens
cagcgccaggctgaccaca

SEQ ID NO: 1296355 - DNA, 20 bp, Homo sapiens
cagcgccaggctgaccacag

SEQ ID NO: 1296356 - DNA, 21 bp, Homo sapiens
cagcgccaggctgaccacagc

SEQ ID NO: 1296357 - DNA, 22 bp, Homo sapiens
cagcgcctttcccaactctagc

SEQ ID NO: 1296358 - DNA, 23 bp, Homo sapiens
cagctaagaacctggaacttggg

SEQ ID NO: 1296359 - DNA, 16 bp, Homo sapiens
cagctacttgggaggc

SEQ ID NO: 1296360 - DNA, 10 bp, Homo sapiens
cagctcagga

SEQ ID NO: 1296361 - DNA, 22 bp, Homo sapiens
cagctcaggacagatgccacac

SEQ ID NO: 1296362 - DNA, 17 bp, Homo sapiens
cagctccaacctgcaaa

SEQ ID NO: 1296363 - DNA, 13 bp, Homo sapiens
cagctccaccctg

SEQ ID NO: 1296364 - DNA, 18 bp, Homo sapiens
cagctctggacagcccca

SEQ ID NO: 1296365 - DNA, 19 bp, Homo sapiens
cagctctgggccattctcc

SEQ ID NO: 1296366 - DNA, 16 bp, Homo sapiens
cagctctttcctcctt

SEQ ID NO: 1296367 - DNA, 14 bp, Homo sapiens
cagctgatgagtta

SEQ ID NO: 1296368 - DNA, 23 bp, Homo sapiens
cagctgctcctagagggaggggc

SEQ ID NO: 1296369 - DNA, 14 bp, Homo sapiens
cagctgggtcaggc

SEQ ID NO: 1296370 - DNA, 15 bp, Homo sapiens
cagctgggtcaggca

SEQ ID NO: 1296371 - DNA, 16 bp, Homo sapiens
cagcttctcctgtgtg

SEQ ID NO: 1296372 - DNA, 16 bp, Homo sapiens
cagctttgatccctga

SEQ ID NO: 1296373 - DNA, 12 bp, Homo sapiens
cagctttgctgc

SEQ ID NO: 1296374 - DNA, 13 bp, Homo sapiens
cagctttgctgct

SEQ ID NO: 1296375 - DNA, 13 bp, Homo sapiens
caggacacagtca

SEQ ID NO: 1296376 - DNA, 17 bp, Homo sapiens
caggacagatgccacac

SEQ ID NO: 1296377 - DNA, 23 bp, Homo sapiens
caggacatgcggtagccagcaca

SEQ ID NO: 1296378 - DNA, 13 bp, Homo sapiens
caggaccagctca

SEQ ID NO: 1296379 - DNA, 14 bp, Homo sapiens
caggaccagctcag

SEQ ID NO: 1296380 - DNA, 17 bp, Homo sapiens
caggaccagctcaggac

SEQ ID NO: 1296381 - DNA, 20 bp, Homo sapiens
caggaccagctcaggacaga

SEQ ID NO: 1296382 - DNA, 16 bp, Homo sapiens
caggaccctgaagggg

SEQ ID NO: 1296383 - DNA, 22 bp, Homo sapiens
caggaccttcgggctgtgcccg

SEQ ID NO: 1296384 - DNA, 12 bp, Homo sapiens
caggactgggcc

SEQ ID NO: 1296385 - DNA, 20 bp, Homo sapiens
caggactgggccacttctgg

SEQ ID NO: 1296386 - DNA, 18 bp, Homo sapiens
caggaggcaggaccttcg

SEQ ID NO: 1296387 - DNA, 18 bp, Homo sapiens
caggatctcttagcattt

SEQ ID NO: 1296388 - DNA, 14 bp, Homo sapiens
caggcagatccagg

SEQ ID NO: 1296389 - DNA, 17 bp, Homo sapiens
caggcagatccaggact

SEQ ID NO: 1296390 - DNA, 20 bp, Homo sapiens
caggcagggccaacccttct

SEQ ID NO: 1296391 - DNA, 18 bp, Homo sapiens
caggcctgagatttcatc

SEQ ID NO: 1296392 - DNA, 21 bp, Homo sapiens
caggcctgagatttcatctgc

SEQ ID NO: 1296393 - DNA, 23 bp, Homo sapiens
caggcctgagatttcatctgctc

SEQ ID NO: 1296394 - DNA, 20 bp, Homo sapiens
caggctgaccacagcacagc

SEQ ID NO: 1296395 - DNA, 21 bp, Homo sapiens
caggctgaccacagcacagcc

SEQ ID NO: 1296396 - DNA, 17 bp, Homo sapiens
caggctggctccagatg

SEQ ID NO: 1296397 - DNA, 20 bp, Homo sapiens
caggctggctccagatgcag

SEQ ID NO: 1296398 - DNA, 14 bp, Homo sapiens
cagggacagaggcc

SEQ ID NO: 1296399 - DNA, 16 bp, Homo sapiens
cagggacagaggcccc

SEQ ID NO: 1296400 - DNA, 23 bp, Homo sapiens
cagggagcggccggccagcccct

SEQ ID NO: 1296401 - DNA, 14 bp, Homo sapiens
cagggatgccctgg

SEQ ID NO: 1296402 - DNA, 23 bp, Homo sapiens
cagggatgccctggaggtggctg

SEQ ID NO: 1296403 - DNA, 18 bp, Homo sapiens
cagggcaatgatgaatga

SEQ ID NO: 1296404 - DNA, 15 bp, Homo sapiens
cagggcagcgccagg

SEQ ID NO: 1296405 - DNA, 19 bp, Homo sapiens
cagggcagcgccaggctga

SEQ ID NO: 1296406 - DNA, 15 bp, Homo sapiens
cagggcccccatctc

SEQ ID NO: 1296407 - DNA, 14 bp, Homo sapiens
cagggctggactga

SEQ ID NO: 1296408 - DNA, 15 bp, Homo sapiens
cagggctggactgag

SEQ ID NO: 1296409 - DNA, 16 bp, Homo sapiens
cagggctggactgagg

SEQ ID NO: 1296410 - DNA, 18 bp, Homo sapiens
cagggctggactgaggcc

SEQ ID NO: 1296411 - DNA, 19 bp, Homo sapiens
cagggctggactgaggcct

SEQ ID NO: 1296412 - DNA, 22 bp, Homo sapiens
cagggctggactgaggcctgag

SEQ ID NO: 1296413 - DNA, 23 bp, Homo sapiens
caggtgctgacttcatctcccac

SEQ ID NO: 1296414 - DNA, 15 bp, Homo sapiens
caggtggccatgcct

SEQ ID NO: 1296415 - DNA, 14 bp, Homo sapiens
caggttcccaagct

SEQ ID NO: 1296416 - DNA, 22 bp, Homo sapiens
cagtatcactgtctttcctaga

SEQ ID NO: 1296417 - DNA, 12 bp, Homo sapiens
cagtcacagcca

SEQ ID NO: 1296418 - DNA, 16 bp, Homo sapiens
cagtcacagccacccc

SEQ ID NO: 1296419 - DNA, 13 bp, Homo sapiens
cagtcattggctg

SEQ ID NO: 1296420 - DNA, 20 bp, Homo sapiens
cagtccccccaccctcattc

SEQ ID NO: 1296421 - DNA, 12 bp, Homo sapiens
cagtgcccccac

SEQ ID NO: 1296422 - DNA, 21 bp, Homo sapiens
cagtgcccccactgaccagaa

SEQ ID NO: 1296423 - DNA, 14 bp, Homo sapiens
cagtgtctcggagg

SEQ ID NO: 1296424 - DNA, 16 bp, Homo sapiens
cagttctttgggccag

SEQ ID NO: 1296425 - DNA, 17 bp, Homo sapiens
cagttctttgggccaga

SEQ ID NO: 1296426 - DNA, 18 bp, Homo sapiens
cagttctttgggccagac

SEQ ID NO: 1296427 - DNA, 21 bp, Homo sapiens
cagttctttgggccagacatg

SEQ ID NO: 1296428 - DNA, 22 bp, Homo sapiens
cagttctttgggccagacatgc

SEQ ID NO: 1296429 - DNA, 16 bp, Homo sapiens
cagttggccagagagc

SEQ ID NO: 1296430 - DNA, 18 bp, Homo sapiens
cagtttaaaaaaattggt

SEQ ID NO: 1296431 - DNA, 18 bp, Homo sapiens
cagtttgagacaggagac

SEQ ID NO: 1296432 - DNA, 22 bp, Homo sapiens
cagttttcaagtcaaattaata

SEQ ID NO: 1296433 - DNA, 23 bp, Homo sapiens
cagttttcaagtcaaattaataa

SEQ ID NO: 1296434 - DNA, 13 bp, Homo sapiens
catacaccagcat

SEQ ID NO: 1296435 - DNA, 20 bp, Homo sapiens
catacaccagcattcctttt

SEQ ID NO: 1296436 - DNA, 14 bp, Homo sapiens
catacttgaagggc

SEQ ID NO: 1296437 - DNA, 23 bp, Homo sapiens
catacttgaagggccagagccag

SEQ ID NO: 1296438 - DNA, 23 bp, Homo sapiens
catagtaacttcttatggaattg

SEQ ID NO: 1296439 - DNA, 14 bp, Homo sapiens
catatctttattaa

SEQ ID NO: 1296440 - DNA, 15 bp, Homo sapiens
catatctttattaat

SEQ ID NO: 1296441 - DNA, 16 bp, Homo sapiens
catatctttattaatc

SEQ ID NO: 1296442 - DNA, 17 bp, Homo sapiens
catatctttattaatca

SEQ ID NO: 1296443 - DNA, 16 bp, Homo sapiens
catatgttgaatactt

SEQ ID NO: 1296444 - DNA, 17 bp, Homo sapiens
catatgttgaatacttt

SEQ ID NO: 1296445 - DNA, 16 bp, Homo sapiens
catattgctgagagaa

SEQ ID NO: 1296446 - DNA, 16 bp, Homo sapiens
catccaaagcagacag

SEQ ID NO: 1296447 - DNA, 18 bp, Homo sapiens
catccaaagcagacagct

SEQ ID NO: 1296448 - DNA, 21 bp, Homo sapiens
catccaaagcagacagctcca

SEQ ID NO: 1296449 - DNA, 14 bp, Homo sapiens
catccaaccttccc

SEQ ID NO: 1296450 - DNA, 13 bp, Homo sapiens
catcccaactgtc

SEQ ID NO: 1296451 - DNA, 16 bp, Homo sapiens
catcctccagcaggga

SEQ ID NO: 1296452 - DNA, 16 bp, Homo sapiens
catctaagcctgaagg

SEQ ID NO: 1296453 - DNA, 13 bp, Homo sapiens
catctctctgccc

SEQ ID NO: 1296454 - DNA, 13 bp, Homo sapiens
catctctgcttga

SEQ ID NO: 1296455 - DNA, 21 bp, Homo sapiens
catctctgcttgagtcaggtt

SEQ ID NO: 1296456 - DNA, 16 bp, Homo sapiens
catctcttagctcccc

SEQ ID NO: 1296457 - DNA, 21 bp, Homo sapiens
catctcttagctcccctccaa

SEQ ID NO: 1296458 - DNA, 15 bp, Homo sapiens
catctgaccagcagc

SEQ ID NO: 1296459 - DNA, 19 bp, Homo sapiens
catctgaccagcagcgcct

SEQ ID NO: 1296460 - DNA, 15 bp, Homo sapiens
attccagaatgctgt

SEQ ID NO: 1296461 - DNA, 19 bp, Homo sapiens
attccagaatgctgtacat

SEQ ID NO: 1296462 - DNA, 12 bp, Homo sapiens
attcctctggga

SEQ ID NO: 1296463 - DNA, 13 bp, Homo sapiens
attcctctttgct

SEQ ID NO: 1296464 - DNA, 12 bp, Homo sapiens
attccttcctgt

SEQ ID NO: 1296465 - DNA, 14 bp, Homo sapiens
attccttcctgttc

SEQ ID NO: 1296466 - DNA, 22 bp, Homo sapiens
attctatttatatgtacatgag

SEQ ID NO: 1296467 - DNA, 14 bp, Homo sapiens
attctccttcagcc

SEQ ID NO: 1296468 - DNA, 22 bp, Homo sapiens
attctccttcagccctcacccc

SEQ ID NO: 1296469 - DNA, 14 bp, Homo sapiens
attctctccaaaaa

SEQ ID NO: 1296470 - DNA, 23 bp, Homo sapiens
attctgcagtaaatcttttacaa

SEQ ID NO: 1296471 - DNA, 14 bp, Homo sapiens
attctgtactctta

SEQ ID NO: 1296472 - DNA, 17 bp, Homo sapiens
attcttttgtaatttaa

SEQ ID NO: 1296473 - DNA, 12 bp, Homo sapiens
attgacacagaa

SEQ ID NO: 1296474 - DNA, 17 bp, Homo sapiens
attgacacagaaaatgt

SEQ ID NO: 1296475 - DNA, 13 bp, Homo sapiens
attgacagctttg

SEQ ID NO: 1296476 - DNA, 14 bp, Homo sapiens
attgacagctttgc

SEQ ID NO: 1296477 - DNA, 22 bp, Homo sapiens
attgaggggattaatatgaaaa

SEQ ID NO: 1296478 - DNA, 23 bp, Homo sapiens
attgaggtgtatggagagaaaac

SEQ ID NO: 1296479 - DNA, 16 bp, Homo sapiens
attgatttgaagaaca

SEQ ID NO: 1296480 - DNA, 16 bp, Homo sapiens
attgcaaatcttgaaa

SEQ ID NO: 1296481 - DNA, 21 bp, Homo sapiens
attgcgtttgaccttttatgt

SEQ ID NO: 1296482 - DNA, 15 bp, Homo sapiens
attggctcacactga

SEQ ID NO: 1296483 - DNA, 17 bp, Homo sapiens
attggctcacactgaga

SEQ ID NO: 1296484 - DNA, 17 bp, Homo sapiens
attgtaaattgaatcag

SEQ ID NO: 1296485 - DNA, 18 bp, Homo sapiens
attgtacctctcttatag

SEQ ID NO: 1296486 - DNA, 17 bp, Homo sapiens
attgtatattgtgtttg

SEQ ID NO: 1296487 - DNA, 17 bp, Homo sapiens
attgtccctctgcccca

SEQ ID NO: 1296488 - DNA, 18 bp, Homo sapiens
atttaaaaatatttttgg

SEQ ID NO: 1296489 - DNA, 16 bp, Homo sapiens
atttagagaggaaaag

SEQ ID NO: 1296490 - DNA, 14 bp, Homo sapiens
atttaggagaagcc

SEQ ID NO: 1296491 - DNA, 19 bp, Homo sapiens
atttaggtttttattagta

SEQ ID NO: 1296492 - DNA, 17 bp, Homo sapiens
atttataaagctaaaat

SEQ ID NO: 1296493 - DNA, 15 bp, Homo sapiens
atttatatgtacatg

SEQ ID NO: 1296494 - DNA, 17 bp, Homo sapiens
atttatatgtacatgag

SEQ ID NO: 1296495 - DNA, 13 bp, Homo sapiens
atttatgtttgca

SEQ ID NO: 1296496 - DNA, 16 bp, Homo sapiens
atttattaattgcttt

SEQ ID NO: 1296497 - DNA, 14 bp, Homo sapiens
atttattacctctg

SEQ ID NO: 1296498 - DNA, 15 bp, Homo sapiens
atttattacctctga

SEQ ID NO: 1296499 - DNA, 21 bp, Homo sapiens
atttattattttcacctgttt

SEQ ID NO: 1296500 - DNA, 13 bp, Homo sapiens
atttatttacaga

SEQ ID NO: 1296501 - DNA, 23 bp, Homo sapiens
atttatttacagatgaatgtatt

SEQ ID NO: 1296502 - DNA, 15 bp, Homo sapiens
atttcaaaatgcttt

SEQ ID NO: 1296503 - DNA, 15 bp, Homo sapiens
atttcacccctccct

SEQ ID NO: 1296504 - DNA, 12 bp, Homo sapiens
atttcagactcc

SEQ ID NO: 1296505 - DNA, 12 bp, Homo sapiens
atttctatttat

SEQ ID NO: 1296506 - DNA, 16 bp, Homo sapiens
atttctatttatttac

SEQ ID NO: 1296507 - DNA, 18 bp, Homo sapiens
atttctgcatatgttgaa

SEQ ID NO: 1296508 - DNA, 22 bp, Homo sapiens
atttctgcatatgttgaatact

SEQ ID NO: 1296509 - DNA, 19 bp, Homo sapiens
atttctttgtgctttggct

SEQ ID NO: 1296510 - DNA, 19 bp, Homo sapiens
atttgcattaaattcacaa

SEQ ID NO: 1296511 - DNA, 21 bp, Homo sapiens
atttgcattgaacacaaactg

SEQ ID NO: 1296512 - DNA, 13 bp, Homo sapiens
atttggaatactt

SEQ ID NO: 1296513 - DNA, 21 bp, Homo sapiens
atttgggcctgctccagacct

SEQ ID NO: 1296514 - DNA, 22 bp, Homo sapiens
atttgggcctgctccagacctg

SEQ ID NO: 1296515 - DNA, 17 bp, Homo sapiens
atttgtgatagcacttt

SEQ ID NO: 1296516 - DNA, 12 bp, Homo sapiens
attttaattcat

SEQ ID NO: 1296517 - DNA, 15 bp, Homo sapiens
attttatctttgatt

SEQ ID NO: 1296518 - DNA, 20 bp, Homo sapiens
attttatctttgattctcct

SEQ ID NO: 1296519 - DNA, 21 bp, Homo sapiens
attttcacctgtttttaagct

SEQ ID NO: 1296520 - DNA, 18 bp, Homo sapiens
attttctttaatgctttt

SEQ ID NO: 1296521 - DNA, 19 bp, Homo sapiens
attttctttaatgctttta

SEQ ID NO: 1296522 - DNA, 21 bp, Homo sapiens
attttggtgagaaatgggact

SEQ ID NO: 1296523 - DNA, 23 bp, Homo sapiens
attttggttttgttcccctcctc

SEQ ID NO: 1296524 - DNA, 21 bp, Homo sapiens
atttttcaataaagcatttat

SEQ ID NO: 1296525 - DNA, 12 bp, Homo sapiens
atttttgtaatt

SEQ ID NO: 1296526 - DNA, 15 bp, Homo sapiens
atttttttcaatatt

SEQ ID NO: 1296527 - DNA, 11 bp, Homo sapiens
caaaaattagg

SEQ ID NO: 1296528 - DNA, 17 bp, Homo sapiens
caaaacaaaaattaggt

SEQ ID NO: 1296529 - DNA, 18 bp, Homo sapiens
caaaacaaaaattaggta

SEQ ID NO: 1296530 - DNA, 23 bp, Homo sapiens
caaaacaaaaattaggtattttg

SEQ ID NO: 1296531 - DNA, 13 bp, Homo sapiens
caaaacccagacc

SEQ ID NO: 1296532 - DNA, 15 bp, Homo sapiens
caaaacccagacctg

SEQ ID NO: 1296533 - DNA, 17 bp, Homo sapiens
caaaagaagcccccagc

SEQ ID NO: 1296534 - DNA, 19 bp, Homo sapiens
caaaagaagcccccagcta

SEQ ID NO: 1296535 - DNA, 24 bp, Homo sapiens
caaaaggatctttgtggccaagga

SEQ ID NO: 1296536 - DNA, 17 bp, Homo sapiens
caaaattgcaaatcttg

SEQ ID NO: 1296537 - DNA, 14 bp, Homo sapiens
caaaatttctatta

SEQ ID NO: 1296538 - DNA, 18 bp, Homo sapiens
caaacaaaatttctatta

SEQ ID NO: 1296539 - DNA, 15 bp, Homo sapiens
caaactggggcctcc

SEQ ID NO: 1296540 - DNA, 19 bp, Homo sapiens
caaactggggcctccagaa

SEQ ID NO: 1296541 - DNA, 21 bp, Homo sapiens
caaactggggcctccagaact

SEQ ID NO: 1296542 - DNA, 18 bp, Homo sapiens
caaacttttatactcttt

SEQ ID NO: 1296543 - DNA, 20 bp, Homo sapiens
caaagaggctgaggctggca

SEQ ID NO: 1296544 - DNA, 21 bp, Homo sapiens
caaagatctgtcctcagcctt

SEQ ID NO: 1296545 - DNA, 15 bp, Homo sapiens
caaagcagacagctc

SEQ ID NO: 1296546 - DNA, 16 bp, Homo sapiens
caaagcttttagaaat

SEQ ID NO: 1296547 - DNA, 14 bp, Homo sapiens
caaagtcctttttt

SEQ ID NO: 1296548 - DNA, 19 bp, Homo sapiens
caaagtcctttttttccat

SEQ ID NO: 1296549 - DNA, 23 bp, Homo sapiens
caaagtcctttttttccatcttt

SEQ ID NO: 1296550 - DNA, 16 bp, Homo sapiens
caaagttactaggtaa

SEQ ID NO: 1296551 - DNA, 23 bp, Homo sapiens
caaataatgtctctgtgagactc

SEQ ID NO: 1296552 - DNA, 12 bp, Homo sapiens
caaatcttgaaa

SEQ ID NO: 1296553 - DNA, 13 bp, Homo sapiens
caaatcttgaaat

SEQ ID NO: 1296554 - DNA, 12 bp, Homo sapiens
caaatgagccat

SEQ ID NO: 1296555 - DNA, 22 bp, Homo sapiens
caaatggcgtctggaagtccaa

SEQ ID NO: 1296556 - DNA, 15 bp, Homo sapiens
caaatggggccagat

SEQ ID NO: 1296557 - DNA, 17 bp, Homo sapiens
caaatggggccagatcc

SEQ ID NO: 1296558 - DNA, 18 bp, Homo sapiens
caaatggggccagatcca

SEQ ID NO: 1296559 - DNA, 13 bp, Homo sapiens
caaatggtaggca

SEQ ID NO: 1296560 - DNA, 15 bp, Homo sapiens
caaatggtaggcatt

SEQ ID NO: 1296561 - DNA, 15 bp, Homo sapiens
caaattaataatctt

SEQ ID NO: 1296562 - DNA, 13 bp, Homo sapiens
caaattagaaaat

SEQ ID NO: 1296563 - DNA, 14 bp, Homo sapiens
caacaaagaacact

SEQ ID NO: 1296564 - DNA, 13 bp, Homo sapiens
caacaccaagcac

SEQ ID NO: 1296565 - DNA, 17 bp, Homo sapiens
caacacgcacctgcctc

SEQ ID NO: 1296566 - DNA, 15 bp, Homo sapiens
caacagaagaactgt

SEQ ID NO: 1296567 - DNA, 13 bp, Homo sapiens
caacagatctgga

SEQ ID NO: 1296568 - DNA, 23 bp, Homo sapiens
caacagatctggaacctcagcct

SEQ ID NO: 1296569 - DNA, 21 bp, Homo sapiens
caaccactaagaattcaaact

SEQ ID NO: 1296570 - DNA, 14 bp, Homo sapiens
caaccccccagcac

SEQ ID NO: 1296571 - DNA, 16 bp, Homo sapiens
caaccccccagcactg

SEQ ID NO: 1296572 - DNA, 17 bp, Homo sapiens
caacctcttctggctca

SEQ ID NO: 1296573 - DNA, 13 bp, Homo sapiens
caacctcttggcc

SEQ ID NO: 1296574 - DNA, 12 bp, Homo sapiens
caacctgaacct

SEQ ID NO: 1296575 - DNA, 16 bp, Homo sapiens
caacctgaacctagga

SEQ ID NO: 1296576 - DNA, 20 bp, Homo sapiens
caacctggggggcagtggtg

SEQ ID NO: 1296577 - DNA, 21 bp, Homo sapiens
caatgctgatttggtgaccaa

SEQ ID NO: 1296578 - DNA, 21 bp, Homo sapiens
caatgggagctgaggccacac

SEQ ID NO: 1296579 - DNA, 14 bp, Homo sapiens
caatgtgaacttta

SEQ ID NO: 1296580 - DNA, 14 bp, Homo sapiens
caattcagacaggc

SEQ ID NO: 1296581 - DNA, 15 bp, Homo sapiens
caattcagacaggca

SEQ ID NO: 1296582 - DNA, 14 bp, Homo sapiens
caattcctctggga

SEQ ID NO: 1296583 - DNA, 16 bp, Homo sapiens
cacaaaacccagacct

SEQ ID NO: 1296584 - DNA, 12 bp, Homo sapiens
cacaaactgtaa

SEQ ID NO: 1296585 - DNA, 14 bp, Homo sapiens
cacaaactgtaaat

SEQ ID NO: 1296586 - DNA, 15 bp, Homo sapiens
cacaaactgtaaata

SEQ ID NO: 1296587 - DNA, 19 bp, Homo sapiens
cacaaacttttatactctt

SEQ ID NO: 1296588 - DNA, 18 bp, Homo sapiens
cacaaggatagatgctgg

SEQ ID NO: 1296589 - DNA, 20 bp, Homo sapiens
cacaagtggtggtaaccctg

SEQ ID NO: 1296590 - DNA, 21 bp, Homo sapiens
cacaagtggtggtaaccctgg

SEQ ID NO: 1296591 - DNA, 23 bp, Homo sapiens
cacaccttttattgacacagaaa

SEQ ID NO: 1296592 - DNA, 14 bp, Homo sapiens
cacagcaaccccag

SEQ ID NO: 1296593 - DNA, 17 bp, Homo sapiens
cacagcaaccccaggct

SEQ ID NO: 1296594 - DNA, 12 bp, Homo sapiens
cacagcagcctg

SEQ ID NO: 1296595 - DNA, 14 bp, Homo sapiens
cacagcagcctggg

SEQ ID NO: 1296596 - DNA, 19 bp, Homo sapiens
cacaggacacagtcagatt

SEQ ID NO: 1296597 - DNA, 14 bp, Homo sapiens
cacaggcctgagat

SEQ ID NO: 1296598 - DNA, 20 bp, Homo sapiens
cacaggcctgagatttcatc

SEQ ID NO: 1296599 - DNA, 18 bp, Homo sapiens
cacagttctttgggccag

SEQ ID NO: 1296600 - DNA, 19 bp, Homo sapiens
cacagttctttgggccaga

SEQ ID NO: 1296601 - DNA, 23 bp, Homo sapiens
cacagttctttgggccagacatg

SEQ ID NO: 1296602 - DNA, 11 bp, Homo sapiens
cacatctctgc

SEQ ID NO: 1296603 - DNA, 16 bp, Homo sapiens
cacatttggaatactt

SEQ ID NO: 1296604 - DNA, 17 bp, Homo sapiens
cacatttggaatacttt

SEQ ID NO: 1296605 - DNA, 14 bp, Homo sapiens
caccaagcacagca

SEQ ID NO: 1296606 - DNA, 18 bp, Homo sapiens
caccaagcacagcagcct

SEQ ID NO: 1296607 - DNA, 14 bp, Homo sapiens
caccacatctaagc

SEQ ID NO: 1296608 - DNA, 14 bp, Homo sapiens
caccagacacccag

SEQ ID NO: 1296609 - DNA, 14 bp, Homo sapiens
caccagcattcctt

SEQ ID NO: 1296610 - DNA, 14 bp, Homo sapiens
cacccacctccctg

SEQ ID NO: 1296611 - DNA, 23 bp, Homo sapiens
cacccacctccctgcctccagga

SEQ ID NO: 1296612 - DNA, 16 bp, Homo sapiens
caccccctccccgccc

SEQ ID NO: 1296613 - DNA, 17 bp, Homo sapiens
caccctcattctactga

SEQ ID NO: 1296614 - DNA, 22 bp, Homo sapiens
caccctgatttaggagaagcca

SEQ ID NO: 1296615 - DNA, 21 bp, Homo sapiens
caccctggccgagtccaagct

SEQ ID NO: 1296616 - DNA, 22 bp, Homo sapiens
caccctggccgagtccaagctg

SEQ ID NO: 1296617 - DNA, 21 bp, Homo sapiens
cacctaatccaggcagatcca

SEQ ID NO: 1296618 - DNA, 14 bp, Homo sapiens
cacctagcagcacc

SEQ ID NO: 1296619 - DNA, 13 bp, Homo sapiens
cacctatttccat

SEQ ID NO: 1296620 - DNA, 16 bp, Homo sapiens
cacctgccccaactct

SEQ ID NO: 1296621 - DNA, 20 bp, Homo sapiens
cacctgcctcaggactgcga

SEQ ID NO: 1296622 - DNA, 19 bp, Homo sapiens
cacggagcccagccctccc

SEQ ID NO: 1296623 - DNA, 15 bp, Homo sapiens
cactaagcagaggag

SEQ ID NO: 1296624 - DNA, 20 bp, Homo sapiens
cactctcccccaccccctcc

SEQ ID NO: 1296625 - DNA, 15 bp, Homo sapiens
cactcttttgcttta

SEQ ID NO: 1296626 - DNA, 14 bp, Homo sapiens
cactgaccagaact

SEQ ID NO: 1296627 - DNA, 18 bp, Homo sapiens
cactgagaatgtaagaac

SEQ ID NO: 1296628 - DNA, 15 bp, Homo sapiens
cactgaggaagaacg

SEQ ID NO: 1296629 - DNA, 17 bp, Homo sapiens
cactgaggaagaacggg

SEQ ID NO: 1296630 - DNA, 12 bp, Homo sapiens
cactgatgctgc

SEQ ID NO: 1296631 - DNA, 17 bp, Homo sapiens
cactgatgctgcccctc

SEQ ID NO: 1296632 - DNA, 17 bp, Homo sapiens
cactgcccatggacagg

SEQ ID NO: 1296633 - DNA, 13 bp, Homo sapiens
cactgtctttcct

SEQ ID NO: 1296634 - DNA, 17 bp, Homo sapiens
cactgtgaaggaccctt

SEQ ID NO: 1296635 - DNA, 12 bp, Homo sapiens
cacttatgattt

SEQ ID NO: 1296636 - DNA, 22 bp, Homo sapiens
cacttcattcttgaaagctgtg

SEQ ID NO: 1296637 - DNA, 19 bp, Homo sapiens
cacttctgggtggggcagt

SEQ ID NO: 1296638 - DNA, 22 bp, Homo sapiens
cacttgaggtcaggagttccta

SEQ ID NO: 1296639 - DNA, 16 bp, Homo sapiens
cagaaagtgtgcttta

SEQ ID NO: 1296640 - DNA, 23 bp, Homo sapiens
cagaaagtgtgctttatgctgaa

SEQ ID NO: 1296641 - DNA, 18 bp, Homo sapiens
cagaactaaactcattta

SEQ ID NO: 1296642 - DNA, 21 bp, Homo sapiens
cagaactcaaatggggccaga

SEQ ID NO: 1296643 - DNA, 22 bp, Homo sapiens
cagaatactgttaaaggaaaaa

SEQ ID NO: 1296644 - DNA, 15 bp, Homo sapiens
cagaatagccacatt

SEQ ID NO: 1296645 - DNA, 21 bp, Homo sapiens
cagaatagccacatttggaat

SEQ ID NO: 1296646 - DNA, 14 bp, Homo sapiens
cagacacaggccct

SEQ ID NO: 1296647 - DNA, 18 bp, Homo sapiens
cagacacaggccctccct

SEQ ID NO: 1296648 - DNA, 12 bp, Homo sapiens
cagacacccagg

SEQ ID NO: 1296649 - DNA, 17 bp, Homo sapiens
cagacacccaggactta

SEQ ID NO: 1296650 - DNA, 14 bp, Homo sapiens
cagacaccctcaac

SEQ ID NO: 1296651 - DNA, 21 bp, Homo sapiens
cagacaccctcaacctcttct

SEQ ID NO: 1296652 - DNA, 21 bp, Homo sapiens
cagacagctccaccctggccg

SEQ ID NO: 1296653 - DNA, 18 bp, Homo sapiens
cagacaggcaaataaaag

SEQ ID NO: 1296654 - DNA, 12 bp, Homo sapiens
cagacatgtttt

SEQ ID NO: 1296655 - DNA, 18 bp, Homo sapiens
cagacatgttttccgtga

SEQ ID NO: 1296656 - DNA, 13 bp, Homo sapiens
cagaccacggctc

SEQ ID NO: 1296657 - DNA, 20 bp, Homo sapiens
cagacctgatcctggaggcc

SEQ ID NO: 1296658 - DNA, 22 bp, Homo sapiens
cagacctgatcctggaggccca

SEQ ID NO: 1296659 - DNA, 19 bp, Homo sapiens
cagacctgttagcagacag

SEQ ID NO: 1296660 - DNA, 19 bp, Homo sapiens
cagactcccattcctgaag

SEQ ID NO: 1296661 - DNA, 20 bp, Homo sapiens
cagactcccattcctgaaga

SEQ ID NO: 1296662 - DNA, 18 bp, Homo sapiens
cagagaaaggggagccca

SEQ ID NO: 1296663 - DNA, 19 bp, Homo sapiens
cagagacatacttgaaggg

SEQ ID NO: 1296664 - DNA, 14 bp, Homo sapiens
cagagaccattgca

SEQ ID NO: 1296665 - DNA, 23 bp, Homo sapiens
cagagccaggggggtgaggagct

SEQ ID NO: 1296666 - DNA, 11 bp, Homo sapiens
cagagcccagc

SEQ ID NO: 1296667 - DNA, 17 bp, Homo sapiens
ccccaggacctggctgc

SEQ ID NO: 1296668 - DNA, 20 bp, Homo sapiens
ccccaggacctggctgccat

SEQ ID NO: 1296669 - DNA, 21 bp, Homo sapiens
ccccaggacctggctgccata

SEQ ID NO: 1296670 - DNA, 13 bp, Homo sapiens
ccccaggactggg

SEQ ID NO: 1296671 - DNA, 14 bp, Homo sapiens
ccccaggactgggc

SEQ ID NO: 1296672 - DNA, 13 bp, Homo sapiens
ccccatgcactgt

SEQ ID NO: 1296673 - DNA, 19 bp, Homo sapiens
ccccatgcactgtgaagga

SEQ ID NO: 1296674 - DNA, 17 bp, Homo sapiens
ccccatttctatttatt

SEQ ID NO: 1296675 - DNA, 13 bp, Homo sapiens
cccccagctaaga

SEQ ID NO: 1296676 - DNA, 13 bp, Homo sapiens
ccccccacccctg

SEQ ID NO: 1296677 - DNA, 14 bp, Homo sapiens
ccccccagcactga

SEQ ID NO: 1296678 - DNA, 19 bp, Homo sapiens
ccccctggcctctgtgcct

SEQ ID NO: 1296679 - DNA, 14 bp, Homo sapiens
cccctccaacctgg

SEQ ID NO: 1296680 - DNA, 15 bp, Homo sapiens
cccctgacctgtgag

SEQ ID NO: 1296681 - DNA, 17 bp, Homo sapiens
cccctgcccccaggact

SEQ ID NO: 1296682 - DNA, 23 bp, Homo sapiens
cccctgcccccaggactgggcca

SEQ ID NO: 1296683 - DNA, 19 bp, Homo sapiens
cccctgggggctctcatgt

SEQ ID NO: 1296684 - DNA, 15 bp, Homo sapiens
cccctggttctcatc

SEQ ID NO: 1296685 - DNA, 14 bp, Homo sapiens
cccctgtactccag

SEQ ID NO: 1296686 - DNA, 14 bp, Homo sapiens
ccccttcacaaagc

SEQ ID NO: 1296687 - DNA, 21 bp, Homo sapiens
ccccttctgctcagctctggg

SEQ ID NO: 1296688 - DNA, 20 bp, Homo sapiens
cccctttgatgattaattca

SEQ ID NO: 1296689 - DNA, 11 bp, Homo sapiens
cccggccagcc

SEQ ID NO: 1296690 - DNA, 22 bp, Homo sapiens
cccggggaaaggcaaggtccgg

SEQ ID NO: 1296691 - DNA, 18 bp, Homo sapiens
ccctcccccccatgcact

SEQ ID NO: 1296692 - DNA, 20 bp, Homo sapiens
ccctccctgttccccagaga

SEQ ID NO: 1296693 - DNA, 14 bp, Homo sapiens
ccctcctccactct

SEQ ID NO: 1296694 - DNA, 17 bp, Homo sapiens
ccctctccttcctgtgt

SEQ ID NO: 1296695 - DNA, 13 bp, Homo sapiens
ccctctgccccat

SEQ ID NO: 1296696 - DNA, 18 bp, Homo sapiens
ccctctggagtggccact

SEQ ID NO: 1296697 - DNA, 17 bp, Homo sapiens
ccctgaaggggccatga

SEQ ID NO: 1296698 - DNA, 16 bp, Homo sapiens
ccctgacctgtgagcc

SEQ ID NO: 1296699 - DNA, 21 bp, Homo sapiens
ccctgatttaggagaagccag

SEQ ID NO: 1296700 - DNA, 18 bp, Homo sapiens
ccctgcatctgaccagca

SEQ ID NO: 1296701 - DNA, 21 bp, Homo sapiens
ccctggagaggccctctggag

SEQ ID NO: 1296702 - DNA, 16 bp, Homo sapiens
ccctggtgggccaaca

SEQ ID NO: 1296703 - DNA, 23 bp, Homo sapiens
ccctggtgggccaacaaagaaca

SEQ ID NO: 1296704 - DNA, 14 bp, Homo sapiens
ccctggttctcatc

SEQ ID NO: 1296705 - DNA, 17 bp, Homo sapiens
ccctggttctcatcttt

SEQ ID NO: 1296706 - DNA, 17 bp, Homo sapiens
ccctgtatatagcccag

SEQ ID NO: 1296707 - DNA, 16 bp, Homo sapiens
ccctgtctagagaggg

SEQ ID NO: 1296708 - DNA, 22 bp, Homo sapiens
ccctgtgcaacctcttggcctg

SEQ ID NO: 1296709 - DNA, 14 bp, Homo sapiens
ccctgttccccaga

SEQ ID NO: 1296710 - DNA, 13 bp, Homo sapiens
cccttcacaaagc

SEQ ID NO: 1296711 - DNA, 22 bp, Homo sapiens
cccttgagaaaccttattgtac

SEQ ID NO: 1296712 - DNA, 14 bp, Homo sapiens
ccctttctcccctg

SEQ ID NO: 1296713 - DNA, 13 bp, Homo sapiens
ccgagtccaagct

SEQ ID NO: 1296714 - DNA, 15 bp, Homo sapiens
ccgcagtgtgcacta

SEQ ID NO: 1296715 - DNA, 22 bp, Homo sapiens
ccgcccagagacccaagctgcc

SEQ ID NO: 1296716 - DNA, 12 bp, Homo sapiens
ccgctgccaccc

SEQ ID NO: 1296717 - DNA, 17 bp, Homo sapiens
ccgctgccacccacctc

SEQ ID NO: 1296718 - DNA, 14 bp, Homo sapiens
ccggagaggaccgg

SEQ ID NO: 1296719 - DNA, 20 bp, Homo sapiens
ccggggtgcccacaggccgc

SEQ ID NO: 1296720 - DNA, 17 bp, Homo sapiens
ccgtgctcgccccagca

SEQ ID NO: 1296721 - DNA, 14 bp, Homo sapiens
ccgtgctgacagct

SEQ ID NO: 1296722 - DNA, 18 bp, Homo sapiens
cctaagagttgagctctc

SEQ ID NO: 1296723 - DNA, 21 bp, Homo sapiens
cctgacctgtgagcccagctg

SEQ ID NO: 1296724 - DNA, 11 bp, Homo sapiens
cctgagatttc

SEQ ID NO: 1296725 - DNA, 23 bp, Homo sapiens
cctgagatttcatctgctctcct

SEQ ID NO: 1296726 - DNA, 15 bp, Homo sapiens
cctgagcaactcttg

SEQ ID NO: 1296727 - DNA, 12 bp, Homo sapiens
cctgagcgctcc

SEQ ID NO: 1296728 - DNA, 16 bp, Homo sapiens
cctgagcgctcctgcc

SEQ ID NO: 1296729 - DNA, 14 bp, Homo sapiens
cctgatcagaccac

SEQ ID NO: 1296730 - DNA, 20 bp, Homo sapiens
cctgatcctggaggcccagt

SEQ ID NO: 1296731 - DNA, 16 bp, Homo sapiens
cctgcagaatttgggt

SEQ ID NO: 1296732 - DNA, 17 bp, Homo sapiens
cctgccagctgcactga

SEQ ID NO: 1296733 - DNA, 15 bp, Homo sapiens
cctgcccccaggact

SEQ ID NO: 1296734 - DNA, 16 bp, Homo sapiens
cctgcccccaggactg

SEQ ID NO: 1296735 - DNA, 17 bp, Homo sapiens
cctgcccccaggactgg

SEQ ID NO: 1296736 - DNA, 20 bp, Homo sapiens
cctgcccccaggactgggcc

SEQ ID NO: 1296737 - DNA, 16 bp, Homo sapiens
cctgccgcagagctgg

SEQ ID NO: 1296738 - DNA, 15 bp, Homo sapiens
cctgcctccagggct

SEQ ID NO: 1296739 - DNA, 21 bp, Homo sapiens
cctgcctccagggctggactg

SEQ ID NO: 1296740 - DNA, 11 bp, Homo sapiens
cctgctccaga

SEQ ID NO: 1296741 - DNA, 13 bp, Homo sapiens
cctgctccagacc

SEQ ID NO: 1296742 - DNA, 14 bp, Homo sapiens
cctgctccagacct

SEQ ID NO: 1296743 - DNA, 14 bp, Homo sapiens
cctggaggtggctg

SEQ ID NO: 1296744 - DNA, 20 bp, Homo sapiens
cctggcagctctggacagcc

SEQ ID NO: 1296745 - DNA, 12 bp, Homo sapiens
cctggccagaca

SEQ ID NO: 1296746 - DNA, 14 bp, Homo sapiens
cctggccagacaca

SEQ ID NO: 1296747 - DNA, 15 bp, Homo sapiens
cctggccatcccaca

SEQ ID NO: 1296748 - DNA, 13 bp, Homo sapiens
cctggcctctgtg

SEQ ID NO: 1296749 - DNA, 14 bp, Homo sapiens
cctggcctctgtgc

SEQ ID NO: 1296750 - DNA, 21 bp, Homo sapiens
cctggctgggacgtggctcag

SEQ ID NO: 1296751 - DNA, 22 bp, Homo sapiens
cctggctgggacgtggctcagc

SEQ ID NO: 1296752 - DNA, 15 bp, Homo sapiens
cctggggctggcctc

SEQ ID NO: 1296753 - DNA, 17 bp, Homo sapiens
cctggggctggcctccc

SEQ ID NO: 1296754 - DNA, 13 bp, Homo sapiens
cctgggggctctc

SEQ ID NO: 1296755 - DNA, 12 bp, Homo sapiens
cctggggggcag

SEQ ID NO: 1296756 - DNA, 13 bp, Homo sapiens
cctggtgctgctg

SEQ ID NO: 1296757 - DNA, 14 bp, Homo sapiens
cctggtgggccaac

SEQ ID NO: 1296758 - DNA, 21 bp, Homo sapiens
cctggtggttgctgttttcct

SEQ ID NO: 1296759 - DNA, 15 bp, Homo sapiens
cctggttctcatctt

SEQ ID NO: 1296760 - DNA, 16 bp, Homo sapiens
cctgtataagtggagg

SEQ ID NO: 1296761 - DNA, 23 bp, Homo sapiens
cctgtataagtggaggcacttta

SEQ ID NO: 1296762 - DNA, 19 bp, Homo sapiens
tctgtcctcagccttgcca

SEQ ID NO: 1296763 - DNA, 17 bp, Homo sapiens
tctgtgaacgatttaga

SEQ ID NO: 1296764 - DNA, 17 bp, Homo sapiens
tctgtgagactcgagaa

SEQ ID NO: 1296765 - DNA, 22 bp, Homo sapiens
tctgtgccttcttttgattatg

SEQ ID NO: 1296766 - DNA, 13 bp, Homo sapiens
tctgtgttttaat

SEQ ID NO: 1296767 - DNA, 18 bp, Homo sapiens
tctgttcccccttcacaa

SEQ ID NO: 1296768 - DNA, 20 bp, Homo sapiens
tctgttcccccttcacaaag

SEQ ID NO: 1296769 - DNA, 19 bp, Homo sapiens
tcttaggaagagaaaccag

SEQ ID NO: 1296770 - DNA, 19 bp, Homo sapiens
tcttatagaatatttatta

SEQ ID NO: 1296771 - DNA, 20 bp, Homo sapiens
tcttatcatggtctcagtca

SEQ ID NO: 1296772 - DNA, 10 bp, Homo sapiens
tcttctcatt

SEQ ID NO: 1296773 - DNA, 19 bp, Homo sapiens
tcttctcatttcacccctc

SEQ ID NO: 1296774 - DNA, 21 bp, Homo sapiens
tcttctggctcaaaaagagaa

SEQ ID NO: 1296775 - DNA, 14 bp, Homo sapiens
tcttgaaagctgtg

SEQ ID NO: 1296776 - DNA, 14 bp, Homo sapiens
tcttgaaattaaga

SEQ ID NO: 1296777 - DNA, 20 bp, Homo sapiens
tcttgatcaacatcttttct

SEQ ID NO: 1296778 - DNA, 12 bp, Homo sapiens
tcttgatgacca

SEQ ID NO: 1296779 - DNA, 21 bp, Homo sapiens
tcttgcctctgtccccttctc

SEQ ID NO: 1296780 - DNA, 13 bp, Homo sapiens
tcttgggaactga

SEQ ID NO: 1296781 - DNA, 13 bp, Homo sapiens
tcttgtaaataaa

SEQ ID NO: 1296782 - DNA, 13 bp, Homo sapiens
tcttgtctctggg

SEQ ID NO: 1296783 - DNA, 15 bp, Homo sapiens
tcttgtctctgggct

SEQ ID NO: 1296784 - DNA, 11 bp, Homo sapiens
tctttaatgct

SEQ ID NO: 1296785 - DNA, 13 bp, Homo sapiens
tctttaatgcttt

SEQ ID NO: 1296786 - DNA, 17 bp, Homo sapiens
tctttcctaaggctgca

SEQ ID NO: 1296787 - DNA, 22 bp, Homo sapiens
tctttcctagatggcagtcact

SEQ ID NO: 1296788 - DNA, 23 bp, Homo sapiens
tctttctgataactagatggtgc

SEQ ID NO: 1296789 - DNA, 16 bp, Homo sapiens
tctttgattctccttc

SEQ ID NO: 1296790 - DNA, 20 bp, Homo sapiens
tctttgattctccttcagcc

SEQ ID NO: 1296791 - DNA, 11 bp, Homo sapiens
tctttgctttg

SEQ ID NO: 1296792 - DNA, 13 bp, Homo sapiens
tctttgctttgct

SEQ ID NO: 1296793 - DNA, 20 bp, Homo sapiens
tctttgggccagacatgcca

SEQ ID NO: 1296794 - DNA, 23 bp, Homo sapiens
tctttgtggccaaggagctgcta

SEQ ID NO: 1296795 - DNA, 16 bp, Homo sapiens
tcttttcttgcctctg

SEQ ID NO: 1296796 - DNA, 16 bp, Homo sapiens
tgaaaataagaataga

SEQ ID NO: 1296797 - DNA, 22 bp, Homo sapiens
tgaaataaaactggctttggct

SEQ ID NO: 1296798 - DNA, 23 bp, Homo sapiens
tgaaattaagaaggcaaaaatgt

SEQ ID NO: 1296799 - DNA, 14 bp, Homo sapiens
tgaacaaagcagcc

SEQ ID NO: 1296800 - DNA, 16 bp, Homo sapiens
tgaacaaagcagccac

SEQ ID NO: 1296801 - DNA, 18 bp, Homo sapiens
tgaactcactttcctcct

SEQ ID NO: 1296802 - DNA, 18 bp, Homo sapiens
tgaagactggaagctaat

SEQ ID NO: 1296803 - DNA, 21 bp, Homo sapiens
tgaagataagtgtatttttca

SEQ ID NO: 1296804 - DNA, 20 bp, Homo sapiens
tgaagcaggttcccaagctc

SEQ ID NO: 1296805 - DNA, 23 bp, Homo sapiens
ggcctacagctttgatccctgac

SEQ ID NO: 1296806 - DNA, 15 bp, Homo sapiens
ggcctcagccagaga

SEQ ID NO: 1296807 - DNA, 20 bp, Homo sapiens
ggcctccagaactcactggg

SEQ ID NO: 1296808 - DNA, 16 bp, Homo sapiens
ggcctcccaaagtgct

SEQ ID NO: 1296809 - DNA, 18 bp, Homo sapiens
ggcctgatcagaccacgg

SEQ ID NO: 1296810 - DNA, 14 bp, Homo sapiens
ggcctgcacagtga

SEQ ID NO: 1296811 - DNA, 20 bp, Homo sapiens
ggcctgcctccagggctgga

SEQ ID NO: 1296812 - DNA, 16 bp, Homo sapiens
ggcctgctccagacct

SEQ ID NO: 1296813 - DNA, 18 bp, Homo sapiens
ggcctgctccagacctga

SEQ ID NO: 1296814 - DNA, 13 bp, Homo sapiens
ggctaatttttgt

SEQ ID NO: 1296815 - DNA, 13 bp, Homo sapiens
tcctcccttctgc

SEQ ID NO: 1296816 - DNA, 16 bp, Homo sapiens
tcctcccttctgctac

SEQ ID NO: 1296817 - DNA, 13 bp, Homo sapiens
tcctcctccctgc

SEQ ID NO: 1296818 - DNA, 13 bp, Homo sapiens
tcctccttccatg

SEQ ID NO: 1296819 - DNA, 15 bp, Homo sapiens
tcctccttccatgga

SEQ ID NO: 1296820 - DNA, 17 bp, Homo sapiens
tcctctccccagcccag

SEQ ID NO: 1296821 - DNA, 19 bp, Homo sapiens
tcctctccccagcccagag

SEQ ID NO: 1296822 - DNA, 19 bp, Homo sapiens
tcctctgtcagtcacagcc

SEQ ID NO: 1296823 - DNA, 15 bp, Homo sapiens
tcctctttgctttgc

SEQ ID NO: 1296824 - DNA, 16 bp, Homo sapiens
tcctctttgctttgct

SEQ ID NO: 1296825 - DNA, 23 bp, Homo sapiens
tcctctttgctttgctttctgct

SEQ ID NO: 1296826 - DNA, 16 bp, Homo sapiens
tcctgaagaaccagtc

SEQ ID NO: 1296827 - DNA, 16 bp, Homo sapiens
tcctgacctcaggtga

SEQ ID NO: 1296828 - DNA, 15 bp, Homo sapiens
tcctgccgcagagct

SEQ ID NO: 1296829 - DNA, 16 bp, Homo sapiens
tcctgccgcagagctg

SEQ ID NO: 1296830 - DNA, 20 bp, Homo sapiens
tcctgccgcagagctggccg

SEQ ID NO: 1296831 - DNA, 18 bp, Homo sapiens
tcctgctttgggaagccg

SEQ ID NO: 1296832 - DNA, 22 bp, Homo sapiens
tcctggagcccagaggagggca

SEQ ID NO: 1296833 - DNA, 13 bp, Homo sapiens
tcctggaggccca

SEQ ID NO: 1296834 - DNA, 15 bp, Homo sapiens
tcctggaggcccagt

SEQ ID NO: 1296835 - DNA, 18 bp, Homo sapiens
tcctggaggcccagttca

SEQ ID NO: 1296836 - DNA, 15 bp, Homo sapiens
tcctggccatcccac

SEQ ID NO: 1296837 - DNA, 20 bp, Homo sapiens
tcctggccatcccacaagtg

SEQ ID NO: 1296838 - DNA, 15 bp, Homo sapiens
tcctgtccagctcca

SEQ ID NO: 1296839 - DNA, 12 bp, Homo sapiens
tccttcagacac

SEQ ID NO: 1296840 - DNA, 14 bp, Homo sapiens
tccttcagccctca

SEQ ID NO: 1296841 - DNA, 23 bp, Homo sapiens
tcctttaggagggagttatctaa

SEQ ID NO: 1296842 - DNA, 21 bp, Homo sapiens
tcctttttttccatctttaca

SEQ ID NO: 1296843 - DNA, 20 bp, Homo sapiens
tcgaatctactaattccaca

SEQ ID NO: 1296844 - DNA, 19 bp, Homo sapiens
tcgcccaggctggagtgca

SEQ ID NO: 1296845 - DNA, 18 bp, Homo sapiens
tcggaactgcatgctgct

SEQ ID NO: 1296846 - DNA, 11 bp, Homo sapiens
tcgttctgtgg

SEQ ID NO: 1296847 - DNA, 20 bp, Homo sapiens
tctaaacaatgctgatttgg

SEQ ID NO: 1296848 - DNA, 19 bp, Homo sapiens
tctaacagctcaggatctc

SEQ ID NO: 1296849 - DNA, 14 bp, Homo sapiens
tctaagcctgaagg

SEQ ID NO: 1296850 - DNA, 20 bp, Homo sapiens
tctactctcctcatctctaa

SEQ ID NO: 1296851 - DNA, 13 bp, Homo sapiens
tctagagagggag

SEQ ID NO: 1296852 - DNA, 23 bp, Homo sapiens
tctagagagggaggcaagccctg

SEQ ID NO: 1296853 - DNA, 15 bp, Homo sapiens
tttcctaaggctgca

SEQ ID NO: 1296854 - DNA, 17 bp, Homo sapiens
tttcctaaggctgcaag

SEQ ID NO: 1296855 - DNA, 11 bp, Homo sapiens
tttcctccctt

SEQ ID NO: 1296856 - DNA, 19 bp, Homo sapiens
tttcctcccttctgctact

SEQ ID NO: 1296857 - DNA, 20 bp, Homo sapiens
tttcctcccttctgctactg

SEQ ID NO: 1296858 - DNA, 21 bp, Homo sapiens
tttcctcctgaggctttggat

SEQ ID NO: 1296859 - DNA, 17 bp, Homo sapiens
tttctacaatgtgaact

SEQ ID NO: 1296860 - DNA, 19 bp, Homo sapiens
tttctagctgttgagctgt

SEQ ID NO: 1296861 - DNA, 14 bp, Homo sapiens
tttctcccctgccc

SEQ ID NO: 1296862 - DNA, 15 bp, Homo sapiens
tttctgctcagcttc

SEQ ID NO: 1296863 - DNA, 21 bp, Homo sapiens
tttcttgatcaacatcttttc

SEQ ID NO: 1296864 - DNA, 18 bp, Homo sapiens
tttcttgcctctgtcccc

SEQ ID NO: 1296865 - DNA, 19 bp, Homo sapiens
tttgactagatgatggatg

SEQ ID NO: 1296866 - DNA, 12 bp, Homo sapiens
tttgattctcct

SEQ ID NO: 1296867 - DNA, 16 bp, Homo sapiens
tttgattctccttcag

SEQ ID NO: 1296868 - DNA, 16 bp, Homo sapiens
tttggatttgacattg

SEQ ID NO: 1296869 - DNA, 13 bp, Homo sapiens
tttggttctaata

SEQ ID NO: 1296870 - DNA, 12 bp, Homo sapiens
tttgttcccctc

SEQ ID NO: 1296871 - DNA, 15 bp, Homo sapiens
tttgttcccctcctc

SEQ ID NO: 1296872 - DNA, 19 bp, Homo sapiens
tttgttcccctcctccact

SEQ ID NO: 1296873 - DNA, 17 bp, Homo sapiens
ttttaaaaatagacact

SEQ ID NO: 1296874 - DNA, 16 bp, Homo sapiens
ttttaactagaattta

SEQ ID NO: 1296875 - DNA, 21 bp, Homo sapiens
ttttagacagtctcactttgt

SEQ ID NO: 1296876 - DNA, 13 bp, Homo sapiens
ttttatactcttt

SEQ ID NO: 1296877 - DNA, 19 bp, Homo sapiens
ttttatgtagtaattgaca

SEQ ID NO: 1296878 - DNA, 16 bp, Homo sapiens
ttttattgacacagaa

SEQ ID NO: 1296879 - DNA, 13 bp, Homo sapiens
ttttcaactgcca

SEQ ID NO: 1296880 - DNA, 12 bp, Homo sapiens
ttttccaggctg

SEQ ID NO: 1296881 - DNA, 17 bp, Homo sapiens
ttttcctcccttctgct

SEQ ID NO: 1296882 - DNA, 21 bp, Homo sapiens
ttttcttgcctctgtcccctt

SEQ ID NO: 1296883 - DNA, 12 bp, Homo sapiens
ttttgattatgt

SEQ ID NO: 1296884 - DNA, 20 bp, Homo sapiens
ttttggttttgttcccctcc

SEQ ID NO: 1296885 - DNA, 14 bp, Homo sapiens
ttttgtaatttaaa

SEQ ID NO: 1296886 - DNA, 19 bp, Homo sapiens
ttttgttcccctcctccac

SEQ ID NO: 1296887 - DNA, 23 bp, Homo sapiens
ttttgttcgcatggtcacacact

SEQ ID NO: 1296888 - DNA, 16 bp, Homo sapiens
tttttaaaatatttat

SEQ ID NO: 1296889 - DNA, 18 bp, Homo sapiens
tttttaagctgtttccat

SEQ ID NO: 1296890 - DNA, 20 bp, Homo sapiens
tttttccttaatccagctga

SEQ ID NO: 1296891 - DNA, 22 bp, Homo sapiens
ttagatgttccagtaatctaat

SEQ ID NO: 1296892 - DNA, 21 bp, Homo sapiens
ttagcagcagcctttaatgca

SEQ ID NO: 1296893 - DNA, 13 bp, Homo sapiens
ttaggagaagcca

SEQ ID NO: 1296894 - DNA, 16 bp, Homo sapiens
ttaggctggtggccca

SEQ ID NO: 1296895 - DNA, 18 bp, Homo sapiens
ttaggctggtggcccagg

SEQ ID NO: 1296896 - DNA, 17 bp, Homo sapiens
ttagggagaaaattcaa

SEQ ID NO: 1296897 - DNA, 22 bp, Homo sapiens
ttagtctcttgtattaaactct

SEQ ID NO: 1296898 - DNA, 12 bp, Homo sapiens
ttataaaacttc

SEQ ID NO: 1296899 - DNA, 21 bp, Homo sapiens
ttatatagggatcaaccagct

SEQ ID NO: 1296900 - DNA, 15 bp, Homo sapiens
ttatcagtcaatatt

SEQ ID NO: 1296901 - DNA, 23 bp, Homo sapiens
ttatcagtcaatatttttagata

SEQ ID NO: 1296902 - DNA, 18 bp, Homo sapiens
ttatgacctcttccttta

SEQ ID NO: 1296903 - DNA, 20 bp, Homo sapiens
ttatgcaagggactgtgtgt

SEQ ID NO: 1296904 - DNA, 13 bp, Homo sapiens
ttatgctgaaaca

SEQ ID NO: 1296905 - DNA, 21 bp, Homo sapiens
ttatggaattgatttgcattg

SEQ ID NO: 1296906 - DNA, 18 bp, Homo sapiens
ttattaaatacaaaactt

SEQ ID NO: 1296907 - DNA, 13 bp, Homo sapiens
ttattaatcacta

SEQ ID NO: 1296908 - DNA, 13 bp, Homo sapiens
ttattacctctga

SEQ ID NO: 1296909 - DNA, 16 bp, Homo sapiens
ttattagggagaaaat

SEQ ID NO: 1296910 - DNA, 19 bp, Homo sapiens
ttattagggagaaaattca

SEQ ID NO: 1296911 - DNA, 20 bp, Homo sapiens
ttattagggagaaaattcaa

SEQ ID NO: 1296912 - DNA, 16 bp, Homo sapiens
ttattattatttttta

SEQ ID NO: 1296913 - DNA, 12 bp, Homo sapiens
ttattgtacctc

SEQ ID NO: 1296914 - DNA, 14 bp, Homo sapiens
ttattgtacctctc

SEQ ID NO: 1296915 - DNA, 15 bp, Homo sapiens
ttatttctgcatatg

SEQ ID NO: 1296916 - DNA, 22 bp, Homo sapiens
ttatttctgcatatgttgaata

SEQ ID NO: 1296917 - DNA, 17 bp, Homo sapiens
ttcaaaatgctttttat

SEQ ID NO: 1296918 - DNA, 15 bp, Homo sapiens
ttcaaactggggcct

SEQ ID NO: 1296919 - DNA, 16 bp, Homo sapiens
ttcaataaagcattta

SEQ ID NO: 1296920 - DNA, 18 bp, Homo sapiens
ttcaataaagcatttata

SEQ ID NO: 1296921 - DNA, 20 bp, Homo sapiens
ttcaataaagcatttataaa

SEQ ID NO: 1296922 - DNA, 17 bp, Homo sapiens
ttcacaaacttttatac

SEQ ID NO: 1296923 - DNA, 21 bp, Homo sapiens
ttcacagttctttgggccaga

SEQ ID NO: 1296924 - DNA, 20 bp, Homo sapiens
ttcacccctccctttctccc

SEQ ID NO: 1296925 - DNA, 22 bp, Homo sapiens
ttcacccctccctttctcccct

SEQ ID NO: 1296926 - DNA, 12 bp, Homo sapiens
ttcagccctcac

SEQ ID NO: 1296927 - DNA, 17 bp, Homo sapiens
ttcatagtaacttctta

SEQ ID NO: 1296928 - DNA, 15 bp, Homo sapiens
ttcatctgctctcct

SEQ ID NO: 1296929 - DNA, 19 bp, Homo sapiens
ttcatctgctctccttcct

SEQ ID NO: 1296930 - DNA, 21 bp, Homo sapiens
ttcatgtacaagatgaaggag

SEQ ID NO: 1296931 - DNA, 19 bp, Homo sapiens
ttcattcttgaaagctgtg

SEQ ID NO: 1296932 - DNA, 18 bp, Homo sapiens
ttccagaatgctgtacat

SEQ ID NO: 1296933 - DNA, 19 bp, Homo sapiens
ttccagaatgctgtacatc

SEQ ID NO: 1296934 - DNA, 18 bp, Homo sapiens
ttccatctttacaaaact

SEQ ID NO: 1296935 - DNA, 11 bp, Homo sapiens
ttccccagaga

SEQ ID NO: 1296936 - DNA, 17 bp, Homo sapiens
ttccccatcttctaaac

SEQ ID NO: 1296937 - DNA, 19 bp, Homo sapiens
ttcctagatggcagtcact

SEQ ID NO: 1296938 - DNA, 13 bp, Homo sapiens
ttcctctttgctt

SEQ ID NO: 1296939 - DNA, 14 bp, Homo sapiens
ttcctctttgcttt

SEQ ID NO: 1296940 - DNA, 16 bp, Homo sapiens
ttcctggagcccagag

SEQ ID NO: 1296941 - DNA, 17 bp, Homo sapiens
ttcctgtccagctccaa

SEQ ID NO: 1296942 - DNA, 13 bp, Homo sapiens
ttcctgttctgaa

SEQ ID NO: 1296943 - DNA, 15 bp, Homo sapiens
ttcctgttctgaact

SEQ ID NO: 1296944 - DNA, 20 bp, Homo sapiens
ttcgcatggtcacacactga

SEQ ID NO: 1296945 - DNA, 17 bp, Homo sapiens
ttcggatttggggtgga

SEQ ID NO: 1296946 - DNA, 12 bp, Homo sapiens
ttcgttctgtgg

SEQ ID NO: 1296947 - DNA, 23 bp, Homo sapiens
ttctaaacccaatccaaatggcg

SEQ ID NO: 1296948 - DNA, 22 bp, Homo sapiens
ttctaaaggtgttgtcccttct

SEQ ID NO: 1296949 - DNA, 12 bp, Homo sapiens
ttctagctgttg

SEQ ID NO: 1296950 - DNA, 18 bp, Homo sapiens
ttctatttatatgtacat

SEQ ID NO: 1296951 - DNA, 16 bp, Homo sapiens
ttctcatttcacccct

SEQ ID NO: 1296952 - DNA, 15 bp, Homo sapiens
ttctccacagcaacc

SEQ ID NO: 1296953 - DNA, 22 bp, Homo sapiens
ttctccacagcaaccccaggct

SEQ ID NO: 1296954 - DNA, 17 bp, Homo sapiens
ttctcccctgcccccag

SEQ ID NO: 1296955 - DNA, 22 bp, Homo sapiens
ttctcccctgcccccaggactg

SEQ ID NO: 1296956 - DNA, 23 bp, Homo sapiens
ttctcccctgcccccaggactgg

SEQ ID NO: 1296957 - DNA, 19 bp, Homo sapiens
ttctcctcttgtaaataaa

SEQ ID NO: 1296958 - DNA, 23 bp, Homo sapiens
ttctctcatctcttagctcccct

SEQ ID NO: 1296959 - DNA, 12 bp, Homo sapiens
ttctctgtgaac

SEQ ID NO: 1296960 - DNA, 22 bp, Homo sapiens
ttctgataactagatggtgctg

SEQ ID NO: 1296961 - DNA, 22 bp, Homo sapiens
ttctgcagtaaatcttttacaa

SEQ ID NO: 1296962 - DNA, 16 bp, Homo sapiens
ttctgcctgccagctg

SEQ ID NO: 1296963 - DNA, 17 bp, Homo sapiens
ttctgcctgccagctgc

SEQ ID NO: 1296964 - DNA, 20 bp, Homo sapiens
ttctgctcagctctgggcca

SEQ ID NO: 1296965 - DNA, 16 bp, Homo sapiens
ttctgtatatactttt

SEQ ID NO: 1296966 - DNA, 17 bp, Homo sapiens
ttcttatggaattgatt

SEQ ID NO: 1296967 - DNA, 12 bp, Homo sapiens
ttctttaatgct

SEQ ID NO: 1296968 - DNA, 21 bp, Homo sapiens
ttgaaaataagaatagaaata

SEQ ID NO: 1296969 - DNA, 17 bp, Homo sapiens
ttgaatcagtataaaca

SEQ ID NO: 1296970 - DNA, 19 bp, Homo sapiens
ttgaatgtggcttgagaaa

SEQ ID NO: 1296971 - DNA, 13 bp, Homo sapiens
ttgacaacatctg

SEQ ID NO: 1296972 - DNA, 14 bp, Homo sapiens
ttgacacaagtgga

SEQ ID NO: 1296973 - DNA, 19 bp, Homo sapiens
ttgacacaggtctttccta

SEQ ID NO: 1296974 - DNA, 17 bp, Homo sapiens
ttgacagctttgctgct

SEQ ID NO: 1296975 - DNA, 21 bp, Homo sapiens
ttgaccttttatgtagtaatt

SEQ ID NO: 1296976 - DNA, 19 bp, Homo sapiens
ttgactctggcaaagcttt

SEQ ID NO: 1296977 - DNA, 22 bp, Homo sapiens
ttgagaaaccttattgtacctc

SEQ ID NO: 1296978 - DNA, 22 bp, Homo sapiens
ttgagaagacctcacctagaaa

SEQ ID NO: 1296979 - DNA, 18 bp, Homo sapiens
ttgagctgttttccctga

SEQ ID NO: 1296980 - DNA, 15 bp, Homo sapiens
ttgaggggattaata

SEQ ID NO: 1296981 - DNA, 16 bp, Homo sapiens
ttgaggggattaatat

SEQ ID NO: 1296982 - DNA, 22 bp, Homo sapiens
ttgaggggattaatatgaaaac

SEQ ID NO: 1296983 - DNA, 17 bp, Homo sapiens
ttgagtgttttaagata

SEQ ID NO: 1296984 - DNA, 22 bp, Homo sapiens
ttgatcaacatcttttcttgcc

SEQ ID NO: 1296985 - DNA, 18 bp, Homo sapiens
ttgatcagatctgacatg

SEQ ID NO: 1296986 - DNA, 14 bp, Homo sapiens
ttgatctggaaccc

SEQ ID NO: 1296987 - DNA, 15 bp, Homo sapiens
ttgatctggaaccca

SEQ ID NO: 1296988 - DNA, 16 bp, Homo sapiens
ttgatctggaacccag

SEQ ID NO: 1296989 - DNA, 17 bp, Homo sapiens
ttgatctggaacccaga

SEQ ID NO: 1296990 - DNA, 19 bp, Homo sapiens
ttgattcatagtaacttct

SEQ ID NO: 1296991 - DNA, 13 bp, Homo sapiens
ttgattctccttc

SEQ ID NO: 1296992 - DNA, 13 bp, Homo sapiens
ttgatttgcattg

SEQ ID NO: 1296993 - DNA, 14 bp, Homo sapiens
ttgatttgcattga

SEQ ID NO: 1296994 - DNA, 15 bp, Homo sapiens
ttgatttgcattgaa

SEQ ID NO: 1296995 - DNA, 17 bp, Homo sapiens
ttgatttgcattgaaca

SEQ ID NO: 1296996 - DNA, 17 bp, Homo sapiens
ttgcacttgtgattatt

SEQ ID NO: 1296997 - DNA, 19 bp, Homo sapiens
ttgcagaactaaactcatt

SEQ ID NO: 1296998 - DNA, 13 bp, Homo sapiens
ttgcattaaattc

SEQ ID NO: 1296999 - DNA, 18 bp, Homo sapiens
ttgcattgaacacaaact

SEQ ID NO: 1297000 - DNA, 21 bp, Homo sapiens
ttgcattgaccgcgactaatt

SEQ ID NO: 1297001 - DNA, 18 bp, Homo sapiens
ttgccacaggacacagtc

SEQ ID NO: 1297002 - DNA, 19 bp, Homo sapiens
ttgccagagatccaaaaga

SEQ ID NO: 1297003 - DNA, 17 bp, Homo sapiens
ttgcctctgtccccttc

SEQ ID NO: 1297004 - DNA, 18 bp, Homo sapiens
ttgcctctgtccccttct

SEQ ID NO: 1297005 - DNA, 19 bp, Homo sapiens
ttgcctctgtccccttctc

SEQ ID NO: 1297006 - DNA, 19 bp, Homo sapiens
ttgctgttttcctcccttc

SEQ ID NO: 1297007 - DNA, 22 bp, Homo sapiens
ttgctgttttcctcccttctgc

SEQ ID NO: 1297008 - DNA, 20 bp, Homo sapiens
ttgctttctgctcagcttct

SEQ ID NO: 1297009 - DNA, 13 bp, Homo sapiens
tgggcttgattct

SEQ ID NO: 1297010 - DNA, 15 bp, Homo sapiens
tggggccagatccag

SEQ ID NO: 1297011 - DNA, 13 bp, Homo sapiens
tggggctctggga

SEQ ID NO: 1297012 - DNA, 13 bp, Homo sapiens
tgggggtgggcca

SEQ ID NO: 1297013 - DNA, 20 bp, Homo sapiens
tggggtcatgccctcctctc

SEQ ID NO: 1297014 - DNA, 21 bp, Homo sapiens
tggggtctggagttgatctgg

SEQ ID NO: 1297015 - DNA, 20 bp, Homo sapiens
tgggtgttcctggcagttta

SEQ ID NO: 1297016 - DNA, 22 bp, Homo sapiens
tgggttctgcctgccagctgca

SEQ ID NO: 1297017 - DNA, 15 bp, Homo sapiens
tggtcacacactgat

SEQ ID NO: 1297018 - DNA, 16 bp, Homo sapiens
tggtcacacactgatg

SEQ ID NO: 1297019 - DNA, 14 bp, Homo sapiens
tggtgccccaggac

SEQ ID NO: 1297020 - DNA, 17 bp, Homo sapiens
tggtgccccaggaccag

SEQ ID NO: 1297021 - DNA, 15 bp, Homo sapiens
tggtgctgagaagct

SEQ ID NO: 1297022 - DNA, 19 bp, Homo sapiens
tggtgtctccaacccccca

SEQ ID NO: 1297023 - DNA, 20 bp, Homo sapiens
tggtgtctccaaccccccag

SEQ ID NO: 1297024 - DNA, 11 bp, Homo sapiens
tggttctcatc

SEQ ID NO: 1297025 - DNA, 12 bp, Homo sapiens
tggttctggcca

SEQ ID NO: 1297026 - DNA, 15 bp, Homo sapiens
tggtttcgaactcct

SEQ ID NO: 1297027 - DNA, 16 bp, Homo sapiens
tggttttgttcccctc

SEQ ID NO: 1297028 - DNA, 16 bp, Homo sapiens
tgtaaaggagtcaaaa

SEQ ID NO: 1297029 - DNA, 19 bp, Homo sapiens
tgtaaaggagtcaaaacta

SEQ ID NO: 1297030 - DNA, 14 bp, Homo sapiens
tgtaaataaaaaga

SEQ ID NO: 1297031 - DNA, 13 bp, Homo sapiens
tgtaaataaagcc

SEQ ID NO: 1297032 - DNA, 22 bp, Homo sapiens
tgtaatcccagcactttgggag

SEQ ID NO: 1297033 - DNA, 22 bp, Homo sapiens
tgtaatcccagctacttgggag

SEQ ID NO: 1297034 - DNA, 15 bp, Homo sapiens
tgtaattgtttgtct

SEQ ID NO: 1297035 - DNA, 19 bp, Homo sapiens
tgtaattgtttgtctttaa

SEQ ID NO: 1297036 - DNA, 16 bp, Homo sapiens
tgtacaagatgaagga

SEQ ID NO: 1297037 - DNA, 20 bp, Homo sapiens
tgtacatctattttggattg

SEQ ID NO: 1297038 - DNA, 15 bp, Homo sapiens
tgtaggagctgcctt

SEQ ID NO: 1297039 - DNA, 22 bp, Homo sapiens
tgtagtccgtgctgacagctgc

SEQ ID NO: 1297040 - DNA, 16 bp, Homo sapiens
tgtataagtggaggca

SEQ ID NO: 1297041 - DNA, 21 bp, Homo sapiens
tgtataagtggaggcacttta

SEQ ID NO: 1297042 - DNA, 12 bp, Homo sapiens
tgtatatacttt

SEQ ID NO: 1297043 - DNA, 22 bp, Homo sapiens
tgtatatttgtgatagcacttt

SEQ ID NO: 1297044 - DNA, 19 bp, Homo sapiens
tgtcaaggctgcttagaat

SEQ ID NO: 1297045 - DNA, 15 bp, Homo sapiens
tgtcactcattgctg

SEQ ID NO: 1297046 - DNA, 16 bp, Homo sapiens
tgtcactcattgctga

SEQ ID NO: 1297047 - DNA, 14 bp, Homo sapiens
tgtcagtcacagcc

SEQ ID NO: 1297048 - DNA, 17 bp, Homo sapiens
tgtcagtcacagccacc

SEQ ID NO: 1297049 - DNA, 13 bp, Homo sapiens
tgtcatctgtgca

SEQ ID NO: 1297050 - DNA, 17 bp, Homo sapiens
tgtccagctgagcgcca

SEQ ID NO: 1297051 - DNA, 16 bp, Homo sapiens
tgtccccttctctcat

SEQ ID NO: 1297052 - DNA, 22 bp, Homo sapiens
tgtcctaaaacacctggtagga

SEQ ID NO: 1297053 - DNA, 14 bp, Homo sapiens
tgtcctcagcagct

SEQ ID NO: 1297054 - DNA, 16 bp, Homo sapiens
tgtcctcagccttgcc

SEQ ID NO: 1297055 - DNA, 18 bp, Homo sapiens
tgtcctcaggtggccatg

SEQ ID NO: 1297056 - DNA, 12 bp, Homo sapiens
tgtccttagaac

SEQ ID NO: 1297057 - DNA, 18 bp, Homo sapiens
tgtccttagaacatttta

SEQ ID NO: 1297058 - DNA, 14 bp, Homo sapiens
tgtctagagaggga

SEQ ID NO: 1297059 - DNA, 17 bp, Homo sapiens
tgtctccaaccccccag

SEQ ID NO: 1297060 - DNA, 20 bp, Homo sapiens
tgtctccaaccccccagcac

SEQ ID NO: 1297061 - DNA, 13 bp, Homo sapiens
tgtctctgtgaga

SEQ ID NO: 1297062 - DNA, 10 bp, Homo sapiens
tgtgaagcca

SEQ ID NO: 1297063 - DNA, 21 bp, Homo sapiens
tgtgaagccaattcagacagg

SEQ ID NO: 1297064 - DNA, 17 bp, Homo sapiens
tgtgaatgaacactctt

SEQ ID NO: 1297065 - DNA, 20 bp, Homo sapiens
tgtgacccccagctccggcc

SEQ ID NO: 1297066 - DNA, 15 bp, Homo sapiens
tgtgagcccagctgg

SEQ ID NO: 1297067 - DNA, 14 bp, Homo sapiens
tgtgatagcacttt

SEQ ID NO: 1297068 - DNA, 15 bp, Homo sapiens
tgtgatagcactttc

SEQ ID NO: 1297069 - DNA, 15 bp, Homo sapiens
tgtgatgtgaagcca

SEQ ID NO: 1297070 - DNA, 16 bp, Homo sapiens
tgtgattgacagcttt

SEQ ID NO: 1297071 - DNA, 11 bp, Homo sapiens
tgtgatttttt

SEQ ID NO: 1297072 - DNA, 13 bp, Homo sapiens
tgtgcacatctct

SEQ ID NO: 1297073 - DNA, 14 bp, Homo sapiens
tgtgcacatctctg

SEQ ID NO: 1297074 - DNA, 19 bp, Homo sapiens
tgtgcacatctctgcttga

SEQ ID NO: 1297075 - DNA, 18 bp, Homo sapiens
tgtgctttatgctgaaac

SEQ ID NO: 1297076 - DNA, 20 bp, Homo sapiens
tgtgctttatgctgaaacag

SEQ ID NO: 1297077 - DNA, 19 bp, Homo sapiens
tgtggagaagccacaggcc

SEQ ID NO: 1297078 - DNA, 17 bp, Homo sapiens
tgtggccaaggagctgc

SEQ ID NO: 1297079 - DNA, 19 bp, Homo sapiens
tgtggccaaggagctgcta

SEQ ID NO: 1297080 - DNA, 11 bp, Homo sapiens
tgtggcctgca

SEQ ID NO: 1297081 - DNA, 22 bp, Homo sapiens
tgtggggtgtgcacatctctgc

SEQ ID NO: 1297082 - DNA, 16 bp, Homo sapiens
tgtggtgcagtgtgaa

SEQ ID NO: 1297083 - DNA, 16 bp, Homo sapiens
tgtgtgaatgaacact

SEQ ID NO: 1297084 - DNA, 16 bp, Homo sapiens
tgtgtgtccaaaactg

SEQ ID NO: 1297085 - DNA, 19 bp, Homo sapiens
tgtgtgtccaaaactgcct

SEQ ID NO: 1297086 - DNA, 16 bp, Homo sapiens
tgtgtgtgaatgaaca

SEQ ID NO: 1297087 - DNA, 20 bp, Homo sapiens
tgtgtgtgaatgaacactct

SEQ ID NO: 1297088 - DNA, 20 bp, Homo sapiens
tgtgtgttgccacaggacac

SEQ ID NO: 1297089 - DNA, 14 bp, Homo sapiens
tgttagcagacagg

SEQ ID NO: 1297090 - DNA, 13 bp, Homo sapiens
tgttagtaacatg

SEQ ID NO: 1297091 - DNA, 18 bp, Homo sapiens
tgttatttaacagctgaa

SEQ ID NO: 1297092 - DNA, 14 bp, Homo sapiens
tgttccagcagttt

SEQ ID NO: 1297093 - DNA, 20 bp, Homo sapiens
tgttcccatgtagccccctg

SEQ ID NO: 1297094 - DNA, 13 bp, Homo sapiens
tgttccccagaga

SEQ ID NO: 1297095 - DNA, 14 bp, Homo sapiens
tgttccccagagaa

SEQ ID NO: 1297096 - DNA, 19 bp, Homo sapiens
tgttcccctcctccactct

SEQ ID NO: 1297097 - DNA, 19 bp, Homo sapiens
tgttcctggcagtttaaaa

SEQ ID NO: 1297098 - DNA, 14 bp, Homo sapiens
tgttgccacaggac

SEQ ID NO: 1297099 - DNA, 15 bp, Homo sapiens
tgttgccacaggaca

SEQ ID NO: 1297100 - DNA, 19 bp, Homo sapiens
tgtttgtctgtcttcatag

SEQ ID NO: 1297101 - DNA, 14 bp, Homo sapiens
tgtttgtgtattta

SEQ ID NO: 1297102 - DNA, 14 bp, Homo sapiens
tgttttcctccctt

SEQ ID NO: 1297103 - DNA, 15 bp, Homo sapiens
tgtttttaagctgtt

SEQ ID NO: 1297104 - DNA, 17 bp, Homo sapiens
tgtttttaagctgtttc

SEQ ID NO: 1297105 - DNA, 13 bp, Homo sapiens
ttaaaaaaaaaga

SEQ ID NO: 1297106 - DNA, 21 bp, Homo sapiens
ttaaaaaaattggttggagaa

SEQ ID NO: 1297107 - DNA, 19 bp, Homo sapiens
ttaaactcttcacaaaatc

SEQ ID NO: 1297108 - DNA, 23 bp, Homo sapiens
ttaaattctccagttttttgtta

SEQ ID NO: 1297109 - DNA, 14 bp, Homo sapiens
ttaactagaattta

SEQ ID NO: 1297110 - DNA, 11 bp, Homo sapiens
ttaagacctgg

SEQ ID NO: 1297111 - DNA, 14 bp, Homo sapiens
ttaagacctggcag

SEQ ID NO: 1297112 - DNA, 18 bp, Homo sapiens
ttaagacctggcagctct

SEQ ID NO: 1297113 - DNA, 15 bp, Homo sapiens
ttaatactaccttga

SEQ ID NO: 1297114 - DNA, 17 bp, Homo sapiens
ttaatcaagttgaattg

SEQ ID NO: 1297115 - DNA, 17 bp, Homo sapiens
ttaatcactattgttcc

SEQ ID NO: 1297116 - DNA, 13 bp, Homo sapiens
ttaattgctttga

SEQ ID NO: 1297117 - DNA, 17 bp, Homo sapiens
ttacaaaactacatgag

SEQ ID NO: 1297118 - DNA, 18 bp, Homo sapiens
ttacaaaactacatgaga

SEQ ID NO: 1297119 - DNA, 22 bp, Homo sapiens
ttacaactgcctcgaaacacag

SEQ ID NO: 1297120 - DNA, 23 bp, Homo sapiens
ttacaactgcctcgaaacacaga

SEQ ID NO: 1297121 - DNA, 11 bp, Homo sapiens
ttacctctgat

SEQ ID NO: 1297122 - DNA, 21 bp, Homo sapiens
ttacctctgatacctcaaccc

SEQ ID NO: 1297123 - DNA, 14 bp, Homo sapiens
ttactgagcttctc

SEQ ID NO: 1297124 - DNA, 18 bp, Homo sapiens
ttactgagcttctctgtg

SEQ ID NO: 1297125 - DNA, 23 bp, Homo sapiens
ttactgtcaaggctgcttagaat

SEQ ID NO: 1297126 - DNA, 18 bp, Homo sapiens
ttagaacattttaattca

SEQ ID NO: 1297127 - DNA, 17 bp, Homo sapiens
ttagatggattctccac

SEQ ID NO: 1297128 - DNA, 23 bp, Homo sapiens
ttagatggattctccactcagtt

SEQ ID NO: 1297129 - DNA, 18 bp, Homo sapiens
cttcctgtccagctccaa

SEQ ID NO: 1297130 - DNA, 23 bp, Homo sapiens
cttcctgtgtgtccaaaactgcc

SEQ ID NO: 1297131 - DNA, 14 bp, Homo sapiens
cttcctgttctgaa

SEQ ID NO: 1297132 - DNA, 15 bp, Homo sapiens
cttcgaaacctggga

SEQ ID NO: 1297133 - DNA, 21 bp, Homo sapiens
cttctagggttattgcatttg

SEQ ID NO: 1297134 - DNA, 15 bp, Homo sapiens
cttctcatttcaccc

SEQ ID NO: 1297135 - DNA, 14 bp, Homo sapiens
cttctctcatctct

SEQ ID NO: 1297136 - DNA, 21 bp, Homo sapiens
cttctctgtgaacgatttaga

SEQ ID NO: 1297137 - DNA, 22 bp, Homo sapiens
cttctctgtgaacgatttagaa

SEQ ID NO: 1297138 - DNA, 12 bp, Homo sapiens
cttctgcctgca

SEQ ID NO: 1297139 - DNA, 13 bp, Homo sapiens
cttctgctactgg

SEQ ID NO: 1297140 - DNA, 19 bp, Homo sapiens
cttctgctactggcaaaag

SEQ ID NO: 1297141 - DNA, 15 bp, Homo sapiens
cttctgggtggggca

SEQ ID NO: 1297142 - DNA, 19 bp, Homo sapiens
cttcttatggaattgattt

SEQ ID NO: 1297143 - DNA, 23 bp, Homo sapiens
cttcttatggaattgatttgcat

SEQ ID NO: 1297144 - DNA, 12 bp, Homo sapiens
cttcttgaaggt

SEQ ID NO: 1297145 - DNA, 13 bp, Homo sapiens
cttcttttgatta

SEQ ID NO: 1297146 - DNA, 14 bp, Homo sapiens
cttcttttgattat

SEQ ID NO: 1297147 - DNA, 20 bp, Homo sapiens
cttgaaattaagaaggcaaa

SEQ ID NO: 1297148 - DNA, 21 bp, Homo sapiens
cttgaaattaagaaggcaaaa

SEQ ID NO: 1297149 - DNA, 15 bp, Homo sapiens
cttgaacccaggaga

SEQ ID NO: 1297150 - DNA, 17 bp, Homo sapiens
cttgaagggccagagcc

SEQ ID NO: 1297151 - DNA, 19 bp, Homo sapiens
cttgaagggccagagccag

SEQ ID NO: 1297152 - DNA, 21 bp, Homo sapiens
cttgaagggccagagccaggg

SEQ ID NO: 1297153 - DNA, 19 bp, Homo sapiens
cttgaatgtggcttgagaa

SEQ ID NO: 1297154 - DNA, 20 bp, Homo sapiens
cttgaatgtggcttgagaaa

SEQ ID NO: 1297155 - DNA, 18 bp, Homo sapiens
cttgatgaccaaagtcct

SEQ ID NO: 1297156 - DNA, 16 bp, Homo sapiens
cttgattatccatatt

SEQ ID NO: 1297157 - DNA, 17 bp, Homo sapiens
cttgattctgcagtaaa

SEQ ID NO: 1297158 - DNA, 16 bp, Homo sapiens
cttgccagagatccaa

SEQ ID NO: 1297159 - DNA, 23 bp, Homo sapiens
cttgccagagatccaaaagaagc

SEQ ID NO: 1297160 - DNA, 19 bp, Homo sapiens
cttgcctctgtccccttct

SEQ ID NO: 1297161 - DNA, 19 bp, Homo sapiens
cttggcaccagacacccag

SEQ ID NO: 1297162 - DNA, 20 bp, Homo sapiens
cttggcaccagacacccagg

SEQ ID NO: 1297163 - DNA, 15 bp, Homo sapiens
cttgtaaataaagcc

SEQ ID NO: 1297164 - DNA, 17 bp, Homo sapiens
cttgtaaataaagccct

SEQ ID NO: 1297165 - DNA, 17 bp, Homo sapiens
cttgtattaaagacaga

SEQ ID NO: 1297166 - DNA, 13 bp, Homo sapiens
cttgtctctgggc

SEQ ID NO: 1297167 - DNA, 17 bp, Homo sapiens
cttgtgattatttatta

SEQ ID NO: 1297168 - DNA, 13 bp, Homo sapiens
cttgttatttata

SEQ ID NO: 1297169 - DNA, 14 bp, Homo sapiens
ctttaagaggacat

SEQ ID NO: 1297170 - DNA, 14 bp, Homo sapiens
ctttaatgcatcta

SEQ ID NO: 1297171 - DNA, 12 bp, Homo sapiens
ctttaatgcttt

SEQ ID NO: 1297172 - DNA, 12 bp, Homo sapiens
ctttatgctgaa

SEQ ID NO: 1297173 - DNA, 20 bp, Homo sapiens
ctttattaccccctccttca

SEQ ID NO: 1297174 - DNA, 20 bp, Homo sapiens
ctttattccagaatgctgta

SEQ ID NO: 1297175 - DNA, 19 bp, Homo sapiens
ctttcatttttttccaggc

SEQ ID NO: 1297176 - DNA, 16 bp, Homo sapiens
ctttcccaactctagc

SEQ ID NO: 1297177 - DNA, 16 bp, Homo sapiens
ctttcctccttccatg

SEQ ID NO: 1297178 - DNA, 23 bp, Homo sapiens
ctttctagctgttgagctgtttt

SEQ ID NO: 1297179 - DNA, 19 bp, Homo sapiens
ctttctcccctgcccccag

SEQ ID NO: 1297180 - DNA, 19 bp, Homo sapiens
ctttctgctcagcttctcc

SEQ ID NO: 1297181 - DNA, 13 bp, Homo sapiens
ctttctgtatata

SEQ ID NO: 1297182 - DNA, 22 bp, Homo sapiens
ctttcttgatcaacatcttttc

SEQ ID NO: 1297183 - DNA, 13 bp, Homo sapiens
ctttgattctcct

SEQ ID NO: 1297184 - DNA, 16 bp, Homo sapiens
ctttgattctccttca

SEQ ID NO: 1297185 - DNA, 18 bp, Homo sapiens
ctttgattctccttcagc

SEQ ID NO: 1297186 - DNA, 14 bp, Homo sapiens
ctttgcattttgga

SEQ ID NO: 1297187 - DNA, 11 bp, Homo sapiens
ctttgctgctg

SEQ ID NO: 1297188 - DNA, 16 bp, Homo sapiens
ctttgctttctgctca

SEQ ID NO: 1297189 - DNA, 17 bp, Homo sapiens
ctttgctttctgctcag

SEQ ID NO: 1297190 - DNA, 14 bp, Homo sapiens
ctttggaggcccct

SEQ ID NO: 1297191 - DNA, 21 bp, Homo sapiens
ctttgggccagacatgccaca

SEQ ID NO: 1297192 - DNA, 13 bp, Homo sapiens
ctttgtggccaag

SEQ ID NO: 1297193 - DNA, 15 bp, Homo sapiens
ctttgtggccaagga

SEQ ID NO: 1297194 - DNA, 21 bp, Homo sapiens
ctttgtggccaaggagctgct

SEQ ID NO: 1297195 - DNA, 19 bp, Homo sapiens
cttttagaaatactgcaag

SEQ ID NO: 1297196 - DNA, 22 bp, Homo sapiens
cttttatgtagtaattgacatg

SEQ ID NO: 1297197 - DNA, 23 bp, Homo sapiens
cttttatgtagtaattgacatgt

SEQ ID NO: 1297198 - DNA, 17 bp, Homo sapiens
cttttattgacacagaa

SEQ ID NO: 1297199 - DNA, 19 bp, Homo sapiens
ctttttaaaaatagacact

SEQ ID NO: 1297200 - DNA, 16 bp, Homo sapiens
ctttttatttctgcat

SEQ ID NO: 1297201 - DNA, 18 bp, Homo sapiens
cttttttccttaatccag

SEQ ID NO: 1297202 - DNA, 14 bp, Homo sapiens
cttttttttcttta

SEQ ID NO: 1297203 - DNA, 20 bp, Homo sapiens
gaaaaaaaatgttctttggg

SEQ ID NO: 1297204 - DNA, 13 bp, Homo sapiens
gaaaacggagctg

SEQ ID NO: 1297205 - DNA, 14 bp, Homo sapiens
gaaaacggagctga

SEQ ID NO: 1297206 - DNA, 23 bp, Homo sapiens
gaaaacttatgacctcttccttt

SEQ ID NO: 1297207 - DNA, 13 bp, Homo sapiens
gaaaagattttaa

SEQ ID NO: 1297208 - DNA, 23 bp, Homo sapiens
gaaaatgcagcagggatgccctg

SEQ ID NO: 1297209 - DNA, 14 bp, Homo sapiens
gaaacacagaaacc

SEQ ID NO: 1297210 - DNA, 16 bp, Homo sapiens
gaaacgtcttctaaac

SEQ ID NO: 1297211 - DNA, 13 bp, Homo sapiens
gaaaggggagccc

SEQ ID NO: 1297212 - DNA, 18 bp, Homo sapiens
gaaataaaaggaagccaa

SEQ ID NO: 1297213 - DNA, 23 bp, Homo sapiens
gaaataaaaggaagccaaagagt

SEQ ID NO: 1297214 - DNA, 17 bp, Homo sapiens
gaaataaagtttgctta

SEQ ID NO: 1297215 - DNA, 18 bp, Homo sapiens
gaaattaagaaggcaaaa

SEQ ID NO: 1297216 - DNA, 16 bp, Homo sapiens
gaacaaagcagccacg

SEQ ID NO: 1297217 - DNA, 19 bp, Homo sapiens
gaacacaaactgtaaataa

SEQ ID NO: 1297218 - DNA, 22 bp, Homo sapiens
gaacacggccacatcaaagagg

SEQ ID NO: 1297219 - DNA, 16 bp, Homo sapiens
gaacccagactcagac

SEQ ID NO: 1297220 - DNA, 20 bp, Homo sapiens
gaaccccggggtgcccacag

SEQ ID NO: 1297221 - DNA, 18 bp, Homo sapiens
gaaccgttttgaagctac

SEQ ID NO: 1297222 - DNA, 19 bp, Homo sapiens
gaaccgttttgaagctact

SEQ ID NO: 1297223 - DNA, 13 bp, Homo sapiens
gaacctcagcctg

SEQ ID NO: 1297224 - DNA, 19 bp, Homo sapiens
gaacctcagcctggccaga

SEQ ID NO: 1297225 - DNA, 23 bp, Homo sapiens
gaactcaaatggggccagatcca

SEQ ID NO: 1297226 - DNA, 16 bp, Homo sapiens
gaactcagatccaggg

SEQ ID NO: 1297227 - DNA, 18 bp, Homo sapiens
gaactcagatccagggac

SEQ ID NO: 1297228 - DNA, 15 bp, Homo sapiens
gaactgcatgctgct

SEQ ID NO: 1297229 - DNA, 22 bp, Homo sapiens
gaacttggggagttaagacctg

SEQ ID NO: 1297230 - DNA, 12 bp, Homo sapiens
gaactttcattt

SEQ ID NO: 1297231 - DNA, 23 bp, Homo sapiens
gaactttcatttttttccaggct

SEQ ID NO: 1297232 - DNA, 13 bp, Homo sapiens
gaagaaccagtcc

SEQ ID NO: 1297233 - DNA, 20 bp, Homo sapiens
gaagacctcacctagaaatt

SEQ ID NO: 1297234 - DNA, 16 bp, Homo sapiens
gaagactggaagctaa

SEQ ID NO: 1297235 - DNA, 17 bp, Homo sapiens
gaagactggaagctaat

SEQ ID NO: 1297236 - DNA, 13 bp, Homo sapiens
gaagccaaagagt

SEQ ID NO: 1297237 - DNA, 16 bp, Homo sapiens
gaagccacaggcctga

SEQ ID NO: 1297238 - DNA, 21 bp, Homo sapiens
gaagccaggaatttcccagga

SEQ ID NO: 1297239 - DNA, 20 bp, Homo sapiens
gaagcccccaccgtgggcag

SEQ ID NO: 1297240 - DNA, 17 bp, Homo sapiens
gaagcccccagctaaga

SEQ ID NO: 1297241 - DNA, 17 bp, Homo sapiens
gaagctaatttgcatta

SEQ ID NO: 1297242 - DNA, 15 bp, Homo sapiens
gaagctactgtgtgt

SEQ ID NO: 1297243 - DNA, 20 bp, Homo sapiens
gaagctactgtgtgtgtgaa

SEQ ID NO: 1297244 - DNA, 19 bp, Homo sapiens
gaagctataaattcctctt

SEQ ID NO: 1297245 - DNA, 16 bp, Homo sapiens
gcctcgaaacacagaa

SEQ ID NO: 1297246 - DNA, 22 bp, Homo sapiens
gcctctgtccccttctctcatc

SEQ ID NO: 1297247 - DNA, 17 bp, Homo sapiens
gcctgaaggggcgtctg

SEQ ID NO: 1297248 - DNA, 23 bp, Homo sapiens
gcctgagatttcatctgctctcc

SEQ ID NO: 1297249 - DNA, 18 bp, Homo sapiens
gcctgagcaactcttgat

SEQ ID NO: 1297250 - DNA, 13 bp, Homo sapiens
gcctgagtcacct

SEQ ID NO: 1297251 - DNA, 16 bp, Homo sapiens
gcctgatcagaccacg

SEQ ID NO: 1297252 - DNA, 18 bp, Homo sapiens
gcctgcctccagggctgg

SEQ ID NO: 1297253 - DNA, 22 bp, Homo sapiens
gcctgcctccagggctggactg

SEQ ID NO: 1297254 - DNA, 21 bp, Homo sapiens
gcctgcgccaccgcccagaga

SEQ ID NO: 1297255 - DNA, 15 bp, Homo sapiens
gcctgctccagacct

SEQ ID NO: 1297256 - DNA, 16 bp, Homo sapiens
gcctgctccagacctg

SEQ ID NO: 1297257 - DNA, 14 bp, Homo sapiens
gcctggggctggcc

SEQ ID NO: 1297258 - DNA, 14 bp, Homo sapiens
gcctggggtggggt

SEQ ID NO: 1297259 - DNA, 16 bp, Homo sapiens
gcctggggtggggtca

SEQ ID NO: 1297260 - DNA, 15 bp, Homo sapiens
gccttctaaaggtgt

SEQ ID NO: 1297261 - DNA, 14 bp, Homo sapiens
gccttgccagagat

SEQ ID NO: 1297262 - DNA, 17 bp, Homo sapiens
gccttgccagagatcca

SEQ ID NO: 1297263 - DNA, 16 bp, Homo sapiens
gccttggctcagacat

SEQ ID NO: 1297264 - DNA, 19 bp, Homo sapiens
gcctttcccaactctagct

SEQ ID NO: 1297265 - DNA, 21 bp, Homo sapiens
gcgactaatttcaaaatgctt

SEQ ID NO: 1297266 - DNA, 21 bp, Homo sapiens
gcgactctatagactctagga

SEQ ID NO: 1297267 - DNA, 22 bp, Homo sapiens
gcgcactgtgacccccagctcc

SEQ ID NO: 1297268 - DNA, 18 bp, Homo sapiens
gcgccaaataatgtctct

SEQ ID NO: 1297269 - DNA, 15 bp, Homo sapiens
gcgccaggctgacca

SEQ ID NO: 1297270 - DNA, 22 bp, Homo sapiens
gcgccaggctgaccacagcaca

SEQ ID NO: 1297271 - DNA, 21 bp, Homo sapiens
gcgctcctgccgcagagctgg

SEQ ID NO: 1297272 - DNA, 13 bp, Homo sapiens
gcggatggccgga

SEQ ID NO: 1297273 - DNA, 21 bp, Homo sapiens
gcgggtgaacaaagcagccac

SEQ ID NO: 1297274 - DNA, 22 bp, Homo sapiens
gcggtagccagcacacagggca

SEQ ID NO: 1297275 - DNA, 23 bp, Homo sapiens
gcggtagccagcacacagggcag

SEQ ID NO: 1297276 - DNA, 16 bp, Homo sapiens
gcggtgctgtcctcag

SEQ ID NO: 1297277 - DNA, 22 bp, Homo sapiens
gcgtttgaccttttatgtagta

SEQ ID NO: 1297278 - DNA, 16 bp, Homo sapiens
gctaagaacctggaac

SEQ ID NO: 1297279 - DNA, 17 bp, Homo sapiens
gctaagaacctggaact

SEQ ID NO: 1297280 - DNA, 13 bp, Homo sapiens
gctaatttgcatt

SEQ ID NO: 1297281 - DNA, 23 bp, Homo sapiens
gctactggcaaaaggatctttgt

SEQ ID NO: 1297282 - DNA, 15 bp, Homo sapiens
gctactgtgtgtgtg

SEQ ID NO: 1297283 - DNA, 18 bp, Homo sapiens
gctactgtgtgtgtgaat

SEQ ID NO: 1297284 - DNA, 21 bp, Homo sapiens
gctactgtgtgtgtgaatgaa

SEQ ID NO: 1297285 - DNA, 13 bp, Homo sapiens
gctacttgggagg

SEQ ID NO: 1297286 - DNA, 16 bp, Homo sapiens
gctagtcaagctcctc

SEQ ID NO: 1297287 - DNA, 23 bp, Homo sapiens
gctagtcaagctcctcctccctg

SEQ ID NO: 1297288 - DNA, 14 bp, Homo sapiens
gctcacactgagaa

SEQ ID NO: 1297289 - DNA, 22 bp, Homo sapiens
gctcacactgagaatgtaagaa

SEQ ID NO: 1297290 - DNA, 16 bp, Homo sapiens
gctcagacatgttttc

SEQ ID NO: 1297291 - DNA, 21 bp, Homo sapiens
gctcagacatgttttccgtga

SEQ ID NO: 1297292 - DNA, 19 bp, Homo sapiens
gctcagaggcgcactgtga

SEQ ID NO: 1297293 - DNA, 21 bp, Homo sapiens
gctcagaggcgcactgtgacc

SEQ ID NO: 1297294 - DNA, 16 bp, Homo sapiens
gctcagctctgggcca

SEQ ID NO: 1297295 - DNA, 14 bp, Homo sapiens
gctcaggatctctt

SEQ ID NO: 1297296 - DNA, 18 bp, Homo sapiens
gctcaggatctcttagca

SEQ ID NO: 1297297 - DNA, 18 bp, Homo sapiens
gctccaacctgcaaagat

SEQ ID NO: 1297298 - DNA, 19 bp, Homo sapiens
gctccaccctggccgagtc

SEQ ID NO: 1297299 - DNA, 21 bp, Homo sapiens
gctccagacctgatcctggag

SEQ ID NO: 1297300 - DNA, 18 bp, Homo sapiens
gctccagatgcagggcag

SEQ ID NO: 1297301 - DNA, 12 bp, Homo sapiens
gctcccctccaa

SEQ ID NO: 1297302 - DNA, 13 bp, Homo sapiens
gctcctagaggga

SEQ ID NO: 1297303 - DNA, 14 bp, Homo sapiens
gctcctagagggag

SEQ ID NO: 1297304 - DNA, 19 bp, Homo sapiens
gctcctagagggaggggcc

SEQ ID NO: 1297305 - DNA, 15 bp, Homo sapiens
gctcctctccccagc

SEQ ID NO: 1297306 - DNA, 20 bp, Homo sapiens
gctcctctccccagcccaga

SEQ ID NO: 1297307 - DNA, 23 bp, Homo sapiens
gctcctctccccagcccagagac

SEQ ID NO: 1297308 - DNA, 15 bp, Homo sapiens
gctcctgccgcagag

SEQ ID NO: 1297309 - DNA, 17 bp, Homo sapiens
gctcctgccgcagagct

SEQ ID NO: 1297310 - DNA, 19 bp, Homo sapiens
gctcctgccgcagagctgg

SEQ ID NO: 1297311 - DNA, 22 bp, Homo sapiens
gctcctgccgcagagctggccg

SEQ ID NO: 1297312 - DNA, 16 bp, Homo sapiens
gctccttgttcctaga

SEQ ID NO: 1297313 - DNA, 15 bp, Homo sapiens
gctctagtgccttct

SEQ ID NO: 1297314 - DNA, 12 bp, Homo sapiens
gctctccttcct

SEQ ID NO: 1297315 - DNA, 21 bp, Homo sapiens
gctctcggaactgcatgctgc

SEQ ID NO: 1297316 - DNA, 14 bp, Homo sapiens
gctctgcttgacaa

SEQ ID NO: 1297317 - DNA, 21 bp, Homo sapiens
gctctgcttgacaacatctga

SEQ ID NO: 1297318 - DNA, 21 bp, Homo sapiens
gctctgggatagctgacccag

SEQ ID NO: 1297319 - DNA, 23 bp, Homo sapiens
gctctgggccattctccacagca

SEQ ID NO: 1297320 - DNA, 14 bp, Homo sapiens
gctctttcctcctt

SEQ ID NO: 1297321 - DNA, 15 bp, Homo sapiens
gctctttcctccttc

SEQ ID NO: 1297322 - DNA, 16 bp, Homo sapiens
gctgaaacagaatact

SEQ ID NO: 1297323 - DNA, 17 bp, Homo sapiens
gctgacagctgctccta

SEQ ID NO: 1297324 - DNA, 19 bp, Homo sapiens
gctgacttcatctcccacc

SEQ ID NO: 1297325 - DNA, 15 bp, Homo sapiens
gctgagcccctgtct

SEQ ID NO: 1297326 - DNA, 13 bp, Homo sapiens
gctgaggctggca

SEQ ID NO: 1297327 - DNA, 20 bp, Homo sapiens
gctgcactgatgctgcccct

SEQ ID NO: 1297328 - DNA, 14 bp, Homo sapiens
gctgccacccacct

SEQ ID NO: 1297329 - DNA, 21 bp, Homo sapiens
gctgccacccacctccctgcc

SEQ ID NO: 1297330 - DNA, 21 bp, Homo sapiens
gctgccttggctcagacatgt

SEQ ID NO: 1297331 - DNA, 18 bp, Homo sapiens
gctgctcctagagggagg

SEQ ID NO: 1297332 - DNA, 20 bp, Homo sapiens
gctggacagtatcactgtct

SEQ ID NO: 1297333 - DNA, 20 bp, Homo sapiens
gctggagtgcagtggtgtga

SEQ ID NO: 1297334 - DNA, 15 bp, Homo sapiens
gctggcccagggccc

SEQ ID NO: 1297335 - DNA, 20 bp, Homo sapiens
gctggcccagggcccagagc

SEQ ID NO: 1297336 - DNA, 21 bp, Homo sapiens
gctggcccagggcccagagcc

SEQ ID NO: 1297337 - DNA, 21 bp, Homo sapiens
gctggctccagatgcagggca

SEQ ID NO: 1297338 - DNA, 22 bp, Homo sapiens
gctggctccagatgcagggcag

SEQ ID NO: 1297339 - DNA, 22 bp, Homo sapiens
gctgggacgtggctcagccagc

SEQ ID NO: 1297340 - DNA, 12 bp, Homo sapiens
gctggtggccca

SEQ ID NO: 1297341 - DNA, 20 bp, Homo sapiens
gctggttcggatttggggtg

SEQ ID NO: 1297342 - DNA, 20 bp, Homo sapiens
gctgtaaaatgcatgatttt

SEQ ID NO: 1297343 - DNA, 13 bp, Homo sapiens
gctgtcctcaggt

SEQ ID NO: 1297344 - DNA, 12 bp, Homo sapiens
gctgttgagctg

SEQ ID NO: 1297345 - DNA, 16 bp, Homo sapiens
gctgttttcctccctt

SEQ ID NO: 1297346 - DNA, 18 bp, Homo sapiens
gctgttttcctcccttct

SEQ ID NO: 1297347 - DNA, 21 bp, Homo sapiens
gctgttttcctcccttctgct

SEQ ID NO: 1297348 - DNA, 14 bp, Homo sapiens
gcttccatgattct

SEQ ID NO: 1297349 - DNA, 15 bp, Homo sapiens
gcttccatgattcta

SEQ ID NO: 1297350 - DNA, 13 bp, Homo sapiens
gcttgaacccagg

SEQ ID NO: 1297351 - DNA, 20 bp, Homo sapiens
gcttgagaaatatggacact

SEQ ID NO: 1297352 - DNA, 13 bp, Homo sapiens
gctttctgctcag

SEQ ID NO: 1297353 - DNA, 19 bp, Homo sapiens
gctttctgctcagcttctc

SEQ ID NO: 1297354 - DNA, 13 bp, Homo sapiens
gctttggcttctt

SEQ ID NO: 1297355 - DNA, 15 bp, Homo sapiens
gctttttatttctgc

SEQ ID NO: 1297356 - DNA, 14 bp, Homo sapiens
ggaacacggccaca

SEQ ID NO: 1297357 - DNA, 15 bp, Homo sapiens
ggaacctcagcctgg

SEQ ID NO: 1297358 - DNA, 21 bp, Homo sapiens
ggaacctcagcctggccagac

SEQ ID NO: 1297359 - DNA, 22 bp, Homo sapiens
ggaacctcagcctggccagaca

SEQ ID NO: 1297360 - DNA, 13 bp, Homo sapiens
ggaactcagatcc

SEQ ID NO: 1297361 - DNA, 18 bp, Homo sapiens
tttaggctggtggcccag

SEQ ID NO: 1297362 - DNA, 13 bp, Homo sapiens
tttataaaacttc

SEQ ID NO: 1297363 - DNA, 19 bp, Homo sapiens
tttatatgaagataagtgt

SEQ ID NO: 1297364 - DNA, 17 bp, Homo sapiens
tttatatgtacatgaga

SEQ ID NO: 1297365 - DNA, 17 bp, Homo sapiens
tttattaattgctttga

SEQ ID NO: 1297366 - DNA, 16 bp, Homo sapiens
tccactctcccccacc

SEQ ID NO: 1297367 - DNA, 18 bp, Homo sapiens
tccactctcccccacccc

SEQ ID NO: 1297368 - DNA, 17 bp, Homo sapiens
tccagaatgctgtacat

SEQ ID NO: 1297369 - DNA, 11 bp, Homo sapiens
tccagacctga

SEQ ID NO: 1297370 - DNA, 13 bp, Homo sapiens
tccagacctgatc

SEQ ID NO: 1297371 - DNA, 19 bp, Homo sapiens
tccagacttccttgagaca

SEQ ID NO: 1297372 - DNA, 20 bp, Homo sapiens
tccagacttccttgagacac

SEQ ID NO: 1297373 - DNA, 18 bp, Homo sapiens
tccagatgcagggcagtc

SEQ ID NO: 1297374 - DNA, 19 bp, Homo sapiens
tccagatgcagggcagtca

SEQ ID NO: 1297375 - DNA, 17 bp, Homo sapiens
tccagcctggggtctgg

SEQ ID NO: 1297376 - DNA, 21 bp, Homo sapiens
tccagctctttcctccttcca

SEQ ID NO: 1297377 - DNA, 16 bp, Homo sapiens
tccagctgagcgccag

SEQ ID NO: 1297378 - DNA, 18 bp, Homo sapiens
tccaggaaccacaccaca

SEQ ID NO: 1297379 - DNA, 13 bp, Homo sapiens
tccaggcagatcc

SEQ ID NO: 1297380 - DNA, 18 bp, Homo sapiens
tccaggcagatccaggac

SEQ ID NO: 1297381 - DNA, 20 bp, Homo sapiens
tccaggcagatccaggacta

SEQ ID NO: 1297382 - DNA, 21 bp, Homo sapiens
tccaggcagatccaggactat

SEQ ID NO: 1297383 - DNA, 21 bp, Homo sapiens
tccagggacagaggccccagc

SEQ ID NO: 1297384 - DNA, 23 bp, Homo sapiens
tccagggacagaggccccagcct

SEQ ID NO: 1297385 - DNA, 14 bp, Homo sapiens
tccagggctggact

SEQ ID NO: 1297386 - DNA, 22 bp, Homo sapiens
tccagggctggactgaggcctg

SEQ ID NO: 1297387 - DNA, 16 bp, Homo sapiens
tccaggtgttactgta

SEQ ID NO: 1297388 - DNA, 19 bp, Homo sapiens
tccagtaatctaatatggc

SEQ ID NO: 1297389 - DNA, 16 bp, Homo sapiens
tccagtctccaccagg

SEQ ID NO: 1297390 - DNA, 19 bp, Homo sapiens
tccagtctccaccaggaac

SEQ ID NO: 1297391 - DNA, 16 bp, Homo sapiens
tccagtgtctcggagg

SEQ ID NO: 1297392 - DNA, 22 bp, Homo sapiens
tccattcacagttctttgggcc

SEQ ID NO: 1297393 - DNA, 23 bp, Homo sapiens
tccattttttcaaggtaatttct

SEQ ID NO: 1297394 - DNA, 17 bp, Homo sapiens
tcccaaatttgattgat

SEQ ID NO: 1297395 - DNA, 19 bp, Homo sapiens
tcccaaatttgattgattt

SEQ ID NO: 1297396 - DNA, 14 bp, Homo sapiens
tcccaactctagct

SEQ ID NO: 1297397 - DNA, 18 bp, Homo sapiens
tcccaatttcagactccc

SEQ ID NO: 1297398 - DNA, 17 bp, Homo sapiens
tcccacctagcagcacc

SEQ ID NO: 1297399 - DNA, 22 bp, Homo sapiens
tcccagattggctcacactgag

SEQ ID NO: 1297400 - DNA, 17 bp, Homo sapiens
tcccagctacttgggag

SEQ ID NO: 1297401 - DNA, 11 bp, Homo sapiens
tcccaggaccc

SEQ ID NO: 1297402 - DNA, 13 bp, Homo sapiens
tcccatccagggc

SEQ ID NO: 1297403 - DNA, 13 bp, Homo sapiens
tcccattcctgaa

SEQ ID NO: 1297404 - DNA, 15 bp, Homo sapiens
tcccattcctgaaga

SEQ ID NO: 1297405 - DNA, 17 bp, Homo sapiens
tcccattcctgaagaac

SEQ ID NO: 1297406 - DNA, 13 bp, Homo sapiens
tcccattgtccct

SEQ ID NO: 1297407 - DNA, 12 bp, Homo sapiens
tccccagcccag

SEQ ID NO: 1297408 - DNA, 14 bp, Homo sapiens
tccccagcccagag

SEQ ID NO: 1297409 - DNA, 16 bp, Homo sapiens
tccccagcccagagac

SEQ ID NO: 1297410 - DNA, 15 bp, Homo sapiens
tccccaggggagttg

SEQ ID NO: 1297411 - DNA, 17 bp, Homo sapiens
tcccccccatgcactgt

SEQ ID NO: 1297412 - DNA, 20 bp, Homo sapiens
tccccgcagtgtgcactaag

SEQ ID NO: 1297413 - DNA, 16 bp, Homo sapiens
tcccctcctccactct

SEQ ID NO: 1297414 - DNA, 14 bp, Homo sapiens
tcccctgcccccag

SEQ ID NO: 1297415 - DNA, 16 bp, Homo sapiens
tcccctgcccccagga

SEQ ID NO: 1297416 - DNA, 20 bp, Homo sapiens
tcccctgcccccaggactgg

SEQ ID NO: 1297417 - DNA, 22 bp, Homo sapiens
tcccctgcccccaggactgggc

SEQ ID NO: 1297418 - DNA, 15 bp, Homo sapiens
tccccttctctcatc

SEQ ID NO: 1297419 - DNA, 21 bp, Homo sapiens
tccctcaccttggcaccagac

SEQ ID NO: 1297420 - DNA, 12 bp, Homo sapiens
tccctccccccc

SEQ ID NO: 1297421 - DNA, 16 bp, Homo sapiens
tccctctaatttatct

SEQ ID NO: 1297422 - DNA, 13 bp, Homo sapiens
tccctctgcccca

SEQ ID NO: 1297423 - DNA, 16 bp, Homo sapiens
tccctgcatctgacca

SEQ ID NO: 1297424 - DNA, 22 bp, Homo sapiens
tccctgcatctgaccagcagcg

SEQ ID NO: 1297425 - DNA, 17 bp, Homo sapiens
tccctgttccccagaga

SEQ ID NO: 1297426 - DNA, 22 bp, Homo sapiens
tcccttctagggttattgcatt

SEQ ID NO: 1297427 - DNA, 13 bp, Homo sapiens
tcccttctgctac

SEQ ID NO: 1297428 - DNA, 14 bp, Homo sapiens
tcccttctgctact

SEQ ID NO: 1297429 - DNA, 20 bp, Homo sapiens
tcccttctgctactggcaaa

SEQ ID NO: 1297430 - DNA, 16 bp, Homo sapiens
tccctttctcccctgc

SEQ ID NO: 1297431 - DNA, 18 bp, Homo sapiens
tccctttctcccctgccc

SEQ ID NO: 1297432 - DNA, 23 bp, Homo sapiens
tccctttctcccctgcccccagg

SEQ ID NO: 1297433 - DNA, 18 bp, Homo sapiens
tccgtgaaaacggagctg

SEQ ID NO: 1297434 - DNA, 20 bp, Homo sapiens
tcctagagggaggggcctag

SEQ ID NO: 1297435 - DNA, 14 bp, Homo sapiens
tcctagagtagagt

SEQ ID NO: 1297436 - DNA, 18 bp, Homo sapiens
tcctagatggcagtcact

SEQ ID NO: 1297437 - DNA, 21 bp, Homo sapiens
tcctagatggcagtcactgaa

SEQ ID NO: 1297438 - DNA, 19 bp, Homo sapiens
tcctatcacctatttccat

SEQ ID NO: 1297439 - DNA, 21 bp, Homo sapiens
tcctcagccttgccagagatc

SEQ ID NO: 1297440 - DNA, 22 bp, Homo sapiens
tcctcaggtggccatgcctcag

SEQ ID NO: 1297441 - DNA, 23 bp, Homo sapiens
tcctcaggtggccatgcctcagc

SEQ ID NO: 1297442 - DNA, 22 bp, Homo sapiens
tcctcatctctaacagctcagg

SEQ ID NO: 1297443 - DNA, 17 bp, Homo sapiens
tcctccaacaccaagca

SEQ ID NO: 1297444 - DNA, 22 bp, Homo sapiens
tcctccaacaccaagcacagca

SEQ ID NO: 1297445 - DNA, 21 bp, Homo sapiens
tcctcccaatttcagactccc

SEQ ID NO: 1297446 - DNA, 14 bp, Homo sapiens
tcctccctgcatct

SEQ ID NO: 1297447 - DNA, 16 bp, Homo sapiens
aatactaccttgaaaa

SEQ ID NO: 1297448 - DNA, 23 bp, Homo sapiens
aatactcttaggaagagaaacca

SEQ ID NO: 1297449 - DNA, 10 bp, Homo sapiens
aatacttttt

SEQ ID NO: 1297450 - DNA, 22 bp, Homo sapiens
aatagaaataaaggatgtgatt

SEQ ID NO: 1297451 - DNA, 20 bp, Homo sapiens
aatagccacatttggaatac

SEQ ID NO: 1297452 - DNA, 14 bp, Homo sapiens
aatagtctagatgg

SEQ ID NO: 1297453 - DNA, 21 bp, Homo sapiens
aatagttaagacatgatttcc

SEQ ID NO: 1297454 - DNA, 23 bp, Homo sapiens
aatagttaagacatgatttcctt

SEQ ID NO: 1297455 - DNA, 15 bp, Homo sapiens
aatatggaacttaca

SEQ ID NO: 1297456 - DNA, 17 bp, Homo sapiens
aatatggaacttacatt

SEQ ID NO: 1297457 - DNA, 21 bp, Homo sapiens
aatatggacacttaatactac

SEQ ID NO: 1297458 - DNA, 17 bp, Homo sapiens
aatatttataaaacttc

SEQ ID NO: 1297459 - DNA, 12 bp, Homo sapiens
aatatttattac

SEQ ID NO: 1297460 - DNA, 14 bp, Homo sapiens
aatatttattacct

SEQ ID NO: 1297461 - DNA, 21 bp, Homo sapiens
aatattttctttaatgctttt

SEQ ID NO: 1297462 - DNA, 14 bp, Homo sapiens
aatatttttagata

SEQ ID NO: 1297463 - DNA, 11 bp, Homo sapiens
aatcccaaatt

SEQ ID NO: 1297464 - DNA, 19 bp, Homo sapiens
aatccctttattaccccct

SEQ ID NO: 1297465 - DNA, 21 bp, Homo sapiens
aatcggatctggggctctggg

SEQ ID NO: 1297466 - DNA, 14 bp, Homo sapiens
aatctgacccagtg

SEQ ID NO: 1297467 - DNA, 15 bp, Homo sapiens
aatcttatcatggtc

SEQ ID NO: 1297468 - DNA, 14 bp, Homo sapiens
aatcttgaaattaa

SEQ ID NO: 1297469 - DNA, 17 bp, Homo sapiens
aatcttgaaattaagaa

SEQ ID NO: 1297470 - DNA, 13 bp, Homo sapiens
aatcttgctctgc

SEQ ID NO: 1297471 - DNA, 12 bp, Homo sapiens
aatcttttacaa

SEQ ID NO: 1297472 - DNA, 21 bp, Homo sapiens
aatgatgtgtacccaaacgtg

SEQ ID NO: 1297473 - DNA, 20 bp, Homo sapiens
aatgcagcagggatgccctg

SEQ ID NO: 1297474 - DNA, 19 bp, Homo sapiens
aatgcatctagattatgga

SEQ ID NO: 1297475 - DNA, 16 bp, Homo sapiens
aatgcatgattttgta

SEQ ID NO: 1297476 - DNA, 13 bp, Homo sapiens
aatgctgtacatc

SEQ ID NO: 1297477 - DNA, 17 bp, Homo sapiens
aatgctgtacatctatt

SEQ ID NO: 1297478 - DNA, 20 bp, Homo sapiens
aatggcgtctggaagtccaa

SEQ ID NO: 1297479 - DNA, 14 bp, Homo sapiens
aatggggccagatc

SEQ ID NO: 1297480 - DNA, 22 bp, Homo sapiens
aatggggccagatccagcctgg

SEQ ID NO: 1297481 - DNA, 23 bp, Homo sapiens
aatgtaaaggagtcaaaactaca

SEQ ID NO: 1297482 - DNA, 17 bp, Homo sapiens
aatgtctgagtgaacct

SEQ ID NO: 1297483 - DNA, 12 bp, Homo sapiens
aatgtggcttga

SEQ ID NO: 1297484 - DNA, 14 bp, Homo sapiens
aatgttatttaaca

SEQ ID NO: 1297485 - DNA, 15 bp, Homo sapiens
aatgttttaaattct

SEQ ID NO: 1297486 - DNA, 21 bp, Homo sapiens
aattaaaaaaaaagatctgtt

SEQ ID NO: 1297487 - DNA, 18 bp, Homo sapiens
aattaaattttgtgtctc

SEQ ID NO: 1297488 - DNA, 13 bp, Homo sapiens
aattaagaaggca

SEQ ID NO: 1297489 - DNA, 19 bp, Homo sapiens
aattaagaaggcaaaaatg

SEQ ID NO: 1297490 - DNA, 19 bp, Homo sapiens
aattactcaggaagaacac

SEQ ID NO: 1297491 - DNA, 15 bp, Homo sapiens
aattagaatagtgtt

SEQ ID NO: 1297492 - DNA, 23 bp, Homo sapiens
aattcaattgtaaattgaatcag

SEQ ID NO: 1297493 - DNA, 19 bp, Homo sapiens
aattcacaaacttttatac

SEQ ID NO: 1297494 - DNA, 17 bp, Homo sapiens
aattcctctttgctttg

SEQ ID NO: 1297495 - DNA, 16 bp, Homo sapiens
aattctataaggccat

SEQ ID NO: 1297496 - DNA, 17 bp, Homo sapiens
aattgaggggattaata

SEQ ID NO: 1297497 - DNA, 13 bp, Homo sapiens
aattgatttgcat

SEQ ID NO: 1297498 - DNA, 16 bp, Homo sapiens
aattgatttgcattga

SEQ ID NO: 1297499 - DNA, 11 bp, Homo sapiens
aattgcattga

SEQ ID NO: 1297500 - DNA, 10 bp, Homo sapiens
aattgctttg

SEQ ID NO: 1297501 - DNA, 16 bp, Homo sapiens
aattgtttgtctttaa

SEQ ID NO: 1297502 - DNA, 18 bp, Homo sapiens
aatttaggtttttattag

SEQ ID NO: 1297503 - DNA, 23 bp, Homo sapiens
aatttcagactcccattcctgaa

SEQ ID NO: 1297504 - DNA, 16 bp, Homo sapiens
aatttcccaggaccct

SEQ ID NO: 1297505 - DNA, 16 bp, Homo sapiens
aatttgattgatttga

SEQ ID NO: 1297506 - DNA, 15 bp, Homo sapiens
aatttgcattaaatt

SEQ ID NO: 1297507 - DNA, 17 bp, Homo sapiens
aatttgcattaaattca

SEQ ID NO: 1297508 - DNA, 18 bp, Homo sapiens
aatttgcattaaattcac

SEQ ID NO: 1297509 - DNA, 22 bp, Homo sapiens
aatttggttctaatagaactca

SEQ ID NO: 1297510 - DNA, 17 bp, Homo sapiens
aatttggttctaggccg

SEQ ID NO: 1297511 - DNA, 15 bp, Homo sapiens
aatttttttcaatat

SEQ ID NO: 1297512 - DNA, 19 bp, Homo sapiens
acaaacaaaatttctatta

SEQ ID NO: 1297513 - DNA, 21 bp, Homo sapiens
acaactgcctcgaaacacaga

SEQ ID NO: 1297514 - DNA, 15 bp, Homo sapiens
acaagagcactacat

SEQ ID NO: 1297515 - DNA, 15 bp, Homo sapiens
acaaggacttcctgt

SEQ ID NO: 1297516 - DNA, 17 bp, Homo sapiens
acaaggatagatgctgg

SEQ ID NO: 1297517 - DNA, 18 bp, Homo sapiens
acaaggatagatgctggc

SEQ ID NO: 1297518 - DNA, 15 bp, Homo sapiens
acaagtggactcagg

SEQ ID NO: 1297519 - DNA, 15 bp, Homo sapiens
acacaaactgtaaat

SEQ ID NO: 1297520 - DNA, 19 bp, Homo sapiens
acacaaactgtaaataaaa

SEQ ID NO: 1297521 - DNA, 18 bp, Homo sapiens
acacagaaacctttttaa

SEQ ID NO: 1297522 - DNA, 16 bp, Homo sapiens
acacaggccctccctg

SEQ ID NO: 1297523 - DNA, 15 bp, Homo sapiens
acacaggtctttcct

SEQ ID NO: 1297524 - DNA, 17 bp, Homo sapiens
acacatatgagggggaa

SEQ ID NO: 1297525 - DNA, 14 bp, Homo sapiens
acaccaagcacagc

SEQ ID NO: 1297526 - DNA, 20 bp, Homo sapiens
acaccaagcacagcagcctg

SEQ ID NO: 1297527 - DNA, 21 bp, Homo sapiens
acaccaagcacagcagcctgg

SEQ ID NO: 1297528 - DNA, 16 bp, Homo sapiens
acacgcacctgcctca

SEQ ID NO: 1297529 - DNA, 20 bp, Homo sapiens
acagaaacctttttaaaaat

SEQ ID NO: 1297530 - DNA, 13 bp, Homo sapiens
acagaagcttcca

SEQ ID NO: 1297531 - DNA, 16 bp, Homo sapiens
acagacctaatgctcc

SEQ ID NO: 1297532 - DNA, 15 bp, Homo sapiens
acagagcaagactct

SEQ ID NO: 1297533 - DNA, 18 bp, Homo sapiens
acagaggccccagcctcc

SEQ ID NO: 1297534 - DNA, 12 bp, Homo sapiens
acagatctggaa

SEQ ID NO: 1297535 - DNA, 16 bp, Homo sapiens
acagatctggaacctc

SEQ ID NO: 1297536 - DNA, 17 bp, Homo sapiens
acagatgaatgtattta

SEQ ID NO: 1297537 - DNA, 12 bp, Homo sapiens
acagcacagcca

SEQ ID NO: 1297538 - DNA, 24 bp, Homo sapiens
acagccaacacgcacctgcctcag

SEQ ID NO: 1297539 - DNA, 12 bp, Homo sapiens
acagccccaccc

SEQ ID NO: 1297540 - DNA, 14 bp, Homo sapiens
acagccccaccctg

SEQ ID NO: 1297541 - DNA, 11 bp, Homo sapiens
acagctttgct

SEQ ID NO: 1297542 - DNA, 16 bp, Homo sapiens
acaggacacagtcaga

SEQ ID NO: 1297543 - DNA, 15 bp, Homo sapiens
acaggcctgagattt

SEQ ID NO: 1297544 - DNA, 17 bp, Homo sapiens
acaggcctgagatttca

SEQ ID NO: 1297545 - DNA, 15 bp, Homo sapiens
acaggtaatataaaa

SEQ ID NO: 1297546 - DNA, 16 bp, Homo sapiens
acaggtcttcatcgaa

SEQ ID NO: 1297547 - DNA, 21 bp, Homo sapiens
acaggtctttcctaaggctgc

SEQ ID NO: 1297548 - DNA, 14 bp, Homo sapiens
acagtagtcttgat

SEQ ID NO: 1297549 - DNA, 21 bp, Homo sapiens
acagtatcactgtctttccta

SEQ ID NO: 1297550 - DNA, 15 bp, Homo sapiens
acagtcagatttcca

SEQ ID NO: 1297551 - DNA, 21 bp, Homo sapiens
acagtcagatttccagtctcc

SEQ ID NO: 1297552 - DNA, 17 bp, Homo sapiens
acagttctttgggccag

SEQ ID NO: 1297553 - DNA, 20 bp, Homo sapiens
acagttctttgggccagaca

SEQ ID NO: 1297554 - DNA, 22 bp, Homo sapiens
acagttctttgggccagacatg

SEQ ID NO: 1297555 - DNA, 14 bp, Homo sapiens
acagttgggtgaga

SEQ ID NO: 1297556 - DNA, 16 bp, Homo sapiens
acatacttgaagggcc

SEQ ID NO: 1297557 - DNA, 21 bp, Homo sapiens
acatacttgaagggccagagc

SEQ ID NO: 1297558 - DNA, 22 bp, Homo sapiens
acatacttgaagggccagagcc

SEQ ID NO: 1297559 - DNA, 21 bp, Homo sapiens
acatagcatgacatttctttg

SEQ ID NO: 1297560 - DNA, 15 bp, Homo sapiens
acatatctttattaa

SEQ ID NO: 1297561 - DNA, 16 bp, Homo sapiens
acatatctttattaat

SEQ ID NO: 1297562 - DNA, 18 bp, Homo sapiens
acatatctttattaatca

SEQ ID NO: 1297563 - DNA, 12 bp, Homo sapiens
acatcaaagagg

SEQ ID NO: 1297564 - DNA, 21 bp, Homo sapiens
actggggattgggtgggcagg

SEQ ID NO: 1297565 - DNA, 13 bp, Homo sapiens
actggggcctcca

SEQ ID NO: 1297566 - DNA, 17 bp, Homo sapiens
actgtaattttatatga

SEQ ID NO: 1297567 - DNA, 21 bp, Homo sapiens
actgtcaaggctgcttagaat

SEQ ID NO: 1297568 - DNA, 19 bp, Homo sapiens
actgtgacccccagctccg

SEQ ID NO: 1297569 - DNA, 18 bp, Homo sapiens
actgtgtgtgtgaatgaa

SEQ ID NO: 1297570 - DNA, 22 bp, Homo sapiens
actgtgtgttgccacaggacac

SEQ ID NO: 1297571 - DNA, 14 bp, Homo sapiens
actgtgtttcaagt

SEQ ID NO: 1297572 - DNA, 16 bp, Homo sapiens
actgttaaaggaaaaa

SEQ ID NO: 1297573 - DNA, 21 bp, Homo sapiens
acttaatactaccttgaaaat

SEQ ID NO: 1297574 - DNA, 23 bp, Homo sapiens
acttacattgttcaattagaata

SEQ ID NO: 1297575 - DNA, 17 bp, Homo sapiens
acttatgatttcatgtg

SEQ ID NO: 1297576 - DNA, 15 bp, Homo sapiens
acttatttaaactct

SEQ ID NO: 1297577 - DNA, 20 bp, Homo sapiens
acttccaggtgttactgtaa

SEQ ID NO: 1297578 - DNA, 18 bp, Homo sapiens
acttcctgtccagctcca

SEQ ID NO: 1297579 - DNA, 23 bp, Homo sapiens
acttcctgtccagctccaacctg

SEQ ID NO: 1297580 - DNA, 14 bp, Homo sapiens
acttccttgagaca

SEQ ID NO: 1297581 - DNA, 21 bp, Homo sapiens
acttcttatggaattgatttg

SEQ ID NO: 1297582 - DNA, 12 bp, Homo sapiens
acttcttgaagg

SEQ ID NO: 1297583 - DNA, 22 bp, Homo sapiens
acttgaagggccagagccaggg

SEQ ID NO: 1297584 - DNA, 18 bp, Homo sapiens
acttgtattaaagacaga

SEQ ID NO: 1297585 - DNA, 16 bp, Homo sapiens
acttgtgattatttat

SEQ ID NO: 1297586 - DNA, 17 bp, Homo sapiens
actttcatttttttcca

SEQ ID NO: 1297587 - DNA, 21 bp, Homo sapiens
actttcatttttttccaggct

SEQ ID NO: 1297588 - DNA, 23 bp, Homo sapiens
actttcatttttttccaggctgg

SEQ ID NO: 1297589 - DNA, 19 bp, Homo sapiens
actttctacaatgtgaact

SEQ ID NO: 1297590 - DNA, 12 bp, Homo sapiens
agaaaagatttt

SEQ ID NO: 1297591 - DNA, 15 bp, Homo sapiens
agaaaagattttaat

SEQ ID NO: 1297592 - DNA, 18 bp, Homo sapiens
agaaaagattttaatcaa

SEQ ID NO: 1297593 - DNA, 16 bp, Homo sapiens
agaaaatgttatttaa

SEQ ID NO: 1297594 - DNA, 20 bp, Homo sapiens
agaaaccttattgtacctct

SEQ ID NO: 1297595 - DNA, 18 bp, Homo sapiens
agaaacctttttaaaaat

SEQ ID NO: 1297596 - DNA, 18 bp, Homo sapiens
agaaacgtcttctaaact

SEQ ID NO: 1297597 - DNA, 16 bp, Homo sapiens
agaaaggggagcccac

SEQ ID NO: 1297598 - DNA, 21 bp, Homo sapiens
agaaataaagtttgcttagaa

SEQ ID NO: 1297599 - DNA, 17 bp, Homo sapiens
agaaatatggacactta

SEQ ID NO: 1297600 - DNA, 15 bp, Homo sapiens
agaacaccctctaaa

SEQ ID NO: 1297601 - DNA, 13 bp, Homo sapiens
agaacattttaat

SEQ ID NO: 1297602 - DNA, 13 bp, Homo sapiens
agaacctggaact

SEQ ID NO: 1297603 - DNA, 14 bp, Homo sapiens
agaactcactgggg

SEQ ID NO: 1297604 - DNA, 16 bp, Homo sapiens
agaactcactggggcc

SEQ ID NO: 1297605 - DNA, 19 bp, Homo sapiens
agaactgtgtttcaagttc

SEQ ID NO: 1297606 - DNA, 21 bp, Homo sapiens
agaactgtgtttcaagttcaa

SEQ ID NO: 1297607 - DNA, 14 bp, Homo sapiens
agaactttcatttt

SEQ ID NO: 1297608 - DNA, 15 bp, Homo sapiens
agaactttcattttt

SEQ ID NO: 1297609 - DNA, 16 bp, Homo sapiens
agaactttcatttttt

SEQ ID NO: 1297610 - DNA, 15 bp, Homo sapiens
agaagaaaacatcta

SEQ ID NO: 1297611 - DNA, 23 bp, Homo sapiens
agaagaaaacatctattctctcc

SEQ ID NO: 1297612 - DNA, 21 bp, Homo sapiens
agaagaactgtgtttcaagtt

SEQ ID NO: 1297613 - DNA, 21 bp, Homo sapiens
agaagccacaggcctgagatt

SEQ ID NO: 1297614 - DNA, 17 bp, Homo sapiens
agaagcctgatgctgac

SEQ ID NO: 1297615 - DNA, 21 bp, Homo sapiens
agaagcctgatgctgacattc

SEQ ID NO: 1297616 - DNA, 21 bp, Homo sapiens
agaagctataaattcctcttt

SEQ ID NO: 1297617 - DNA, 18 bp, Homo sapiens
agaagcttccattccaag

SEQ ID NO: 1297618 - DNA, 20 bp, Homo sapiens
agaatactgttaaaggaaaa

SEQ ID NO: 1297619 - DNA, 20 bp, Homo sapiens
agaatagccacatttggaat

SEQ ID NO: 1297620 - DNA, 21 bp, Homo sapiens
agaatagccacatttggaata

SEQ ID NO: 1297621 - DNA, 16 bp, Homo sapiens
agaatatttattacct

SEQ ID NO: 1297622 - DNA, 14 bp, Homo sapiens
agaatccaaacttg

SEQ ID NO: 1297623 - DNA, 16 bp, Homo sapiens
agaatccaaacttgga

SEQ ID NO: 1297624 - DNA, 15 bp, Homo sapiens
agaatcccaaatttg

SEQ ID NO: 1297625 - DNA, 15 bp, Homo sapiens
agaatgctgtacatc

SEQ ID NO: 1297626 - DNA, 15 bp, Homo sapiens
agaatgtaagaacta

SEQ ID NO: 1297627 - DNA, 20 bp, Homo sapiens
agaattcaaactggggcctc

SEQ ID NO: 1297628 - DNA, 12 bp, Homo sapiens
agacacccagga

SEQ ID NO: 1297629 - DNA, 16 bp, Homo sapiens
agacacccaggactta

SEQ ID NO: 1297630 - DNA, 19 bp, Homo sapiens
agacaccctcaacctcttc

SEQ ID NO: 1297631 - DNA, 17 bp, Homo sapiens
agacatacttgaagggc

SEQ ID NO: 1297632 - DNA, 15 bp, Homo sapiens
agacatgatttcctt

SEQ ID NO: 1297633 - DNA, 23 bp, Homo sapiens
agacatgccacaaggacttcctg

SEQ ID NO: 1297634 - DNA, 18 bp, Homo sapiens
agacatgttttccgtgaa

SEQ ID NO: 1297635 - DNA, 15 bp, Homo sapiens
agacattggcaccta

SEQ ID NO: 1297636 - DNA, 15 bp, Homo sapiens
agaccagggagcctt

SEQ ID NO: 1297637 - DNA, 15 bp, Homo sapiens
agacctaatgctcct

SEQ ID NO: 1297638 - DNA, 21 bp, Homo sapiens
agacctgatcctggaggccca

SEQ ID NO: 1297639 - DNA, 23 bp, Homo sapiens
agacctgatcctggaggcccagt

SEQ ID NO: 1297640 - DNA, 14 bp, Homo sapiens
agacctggcagctc

SEQ ID NO: 1297641 - DNA, 17 bp, Homo sapiens
agacctggcagctctgg

SEQ ID NO: 1297642 - DNA, 18 bp, Homo sapiens
agacctgttagcagacag

SEQ ID NO: 1297643 - DNA, 14 bp, Homo sapiens
agactggaagctaa

SEQ ID NO: 1297644 - DNA, 16 bp, Homo sapiens
agacttccttgagaca

SEQ ID NO: 1297645 - DNA, 23 bp, Homo sapiens
agagaaaggggagcccactgtcc

SEQ ID NO: 1297646 - DNA, 14 bp, Homo sapiens
agagaaatatggaa

SEQ ID NO: 1297647 - DNA, 22 bp, Homo sapiens
agagacagttgggtgagaacaa

SEQ ID NO: 1297648 - DNA, 17 bp, Homo sapiens
agagagggaggcaagcc

SEQ ID NO: 1297649 - DNA, 18 bp, Homo sapiens
agagatccaaaagaagcc

SEQ ID NO: 1297650 - DNA, 13 bp, Homo sapiens
agagcccagctcc

SEQ ID NO: 1297651 - DNA, 14 bp, Homo sapiens
agagcccagctcca

SEQ ID NO: 1297652 - DNA, 23 bp, Homo sapiens
agaggagggcagcagaagggggt

SEQ ID NO: 1297653 - DNA, 14 bp, Homo sapiens
agaggaggggccgc

SEQ ID NO: 1297654 - DNA, 20 bp, Homo sapiens
agaggaggggccgctgccac

SEQ ID NO: 1297655 - DNA, 14 bp, Homo sapiens
agaggccctctgga

SEQ ID NO: 1297656 - DNA, 23 bp, Homo sapiens
agaggccctctggagtggccact

SEQ ID NO: 1297657 - DNA, 20 bp, Homo sapiens
agaggcctgcctccagggct

SEQ ID NO: 1297658 - DNA, 21 bp, Homo sapiens
agaggcctgcctccagggctg

SEQ ID NO: 1297659 - DNA, 22 bp, Homo sapiens
agaggcctgcctccagggctgg

SEQ ID NO: 1297660 - DNA, 14 bp, Homo sapiens
agagggaggggcct

SEQ ID NO: 1297661 - DNA, 22 bp, Homo sapiens
agaggggggaagatcaggtcat

SEQ ID NO: 1297662 - DNA, 22 bp, Homo sapiens
agaggtttgactagatgatgga

SEQ ID NO: 1297663 - DNA, 15 bp, Homo sapiens
agagtagaattgcat

SEQ ID NO: 1297664 - DNA, 16 bp, Homo sapiens
agagtagaattgcatt

SEQ ID NO: 1297665 - DNA, 18 bp, Homo sapiens
agatccaaaagaagcccc

SEQ ID NO: 1297666 - DNA, 13 bp, Homo sapiens
agatctggaacct

SEQ ID NO: 1297667 - DNA, 17 bp, Homo sapiens
agatctggaacctcagc

SEQ ID NO: 1297668 - DNA, 18 bp, Homo sapiens
agatctgtcctcagcctt

SEQ ID NO: 1297669 - DNA, 18 bp, Homo sapiens
agatctgttttgaaggca

SEQ ID NO: 1297670 - DNA, 21 bp, Homo sapiens
agatctgttttgaaggcaaaa

SEQ ID NO: 1297671 - DNA, 20 bp, Homo sapiens
agatgatacatccaaagcag

SEQ ID NO: 1297672 - DNA, 19 bp, Homo sapiens
agatgatggatgccaatat

SEQ ID NO: 1297673 - DNA, 16 bp, Homo sapiens
agatgcagggcagtca

SEQ ID NO: 1297674 - DNA, 18 bp, Homo sapiens
agatgctggcccagggcc

SEQ ID NO: 1297675 - DNA, 19 bp, Homo sapiens
agatgctggcccagggccc

SEQ ID NO: 1297676 - DNA, 20 bp, Homo sapiens
agatgctggcccagggccca

SEQ ID NO: 1297677 - DNA, 22 bp, Homo sapiens
agatgctggcccagggcccaga

SEQ ID NO: 1297678 - DNA, 23 bp, Homo sapiens
agatggattctccactcagttgc

SEQ ID NO: 1297679 - DNA, 22 bp, Homo sapiens
agatgtaattgtttgtctttaa

SEQ ID NO: 1297680 - DNA, 16 bp, Homo sapiens
atgctttttatttctg

SEQ ID NO: 1297681 - DNA, 13 bp, Homo sapiens
atggaattgattt

SEQ ID NO: 1297682 - DNA, 16 bp, Homo sapiens
atggaattgatttgca

SEQ ID NO: 1297683 - DNA, 18 bp, Homo sapiens
atggaattgatttgcatt

SEQ ID NO: 1297684 - DNA, 13 bp, Homo sapiens
atggagagaaaac

SEQ ID NO: 1297685 - DNA, 11 bp, Homo sapiens
atggagccagc

SEQ ID NO: 1297686 - DNA, 18 bp, Homo sapiens
atggagccagctccctct

SEQ ID NO: 1297687 - DNA, 16 bp, Homo sapiens
atggcaacagatctgg

SEQ ID NO: 1297688 - DNA, 23 bp, Homo sapiens
atgggagctgaggccacactcag

SEQ ID NO: 1297689 - DNA, 18 bp, Homo sapiens
atgggagggaggctcagg

SEQ ID NO: 1297690 - DNA, 14 bp, Homo sapiens
atggggccagatcc

SEQ ID NO: 1297691 - DNA, 15 bp, Homo sapiens
atggggccagatcca

SEQ ID NO: 1297692 - DNA, 19 bp, Homo sapiens
atgggggaactcagatcca

SEQ ID NO: 1297693 - DNA, 16 bp, Homo sapiens
atggtcacacactgat

SEQ ID NO: 1297694 - DNA, 18 bp, Homo sapiens
atggtcacacactgatgc

SEQ ID NO: 1297695 - DNA, 19 bp, Homo sapiens
atggtcacacactgatgct

SEQ ID NO: 1297696 - DNA, 20 bp, Homo sapiens
atggtcacacactgatgctt

SEQ ID NO: 1297697 - DNA, 21 bp, Homo sapiens
atggtgccccaggaccagctc

SEQ ID NO: 1297698 - DNA, 16 bp, Homo sapiens
atggtgctgagaagct

SEQ ID NO: 1297699 - DNA, 14 bp, Homo sapiens
atgtacaagatgaa

SEQ ID NO: 1297700 - DNA, 15 bp, Homo sapiens
atgtctgagtgaacc

SEQ ID NO: 1297701 - DNA, 22 bp, Homo sapiens
atgtctgagtgaacctgtataa

SEQ ID NO: 1297702 - DNA, 17 bp, Homo sapiens
atgtgaactttattaaa

SEQ ID NO: 1297703 - DNA, 21 bp, Homo sapiens
atgtgaagccaattcagacag

SEQ ID NO: 1297704 - DNA, 21 bp, Homo sapiens
atgtgccagggcaatgatgaa

SEQ ID NO: 1297705 - DNA, 14 bp, Homo sapiens
atgtgtggcctgca

SEQ ID NO: 1297706 - DNA, 16 bp, Homo sapiens
atgtttgcacttgtga

SEQ ID NO: 1297707 - DNA, 14 bp, Homo sapiens
attaaaaaaaaaga

SEQ ID NO: 1297708 - DNA, 20 bp, Homo sapiens
attaaaaaaaaagatctgtt

SEQ ID NO: 1297709 - DNA, 16 bp, Homo sapiens
attaaatacaaaactt

SEQ ID NO: 1297710 - DNA, 14 bp, Homo sapiens
attaaattcacaaa

SEQ ID NO: 1297711 - DNA, 12 bp, Homo sapiens
attaataatctt

SEQ ID NO: 1297712 - DNA, 12 bp, Homo sapiens
attaatatgaaa

SEQ ID NO: 1297713 - DNA, 13 bp, Homo sapiens
attaatcactatt

SEQ ID NO: 1297714 - DNA, 19 bp, Homo sapiens
attaattcaccttccagtg

SEQ ID NO: 1297715 - DNA, 13 bp, Homo sapiens
attaattctataa

SEQ ID NO: 1297716 - DNA, 15 bp, Homo sapiens
attacaggcttgagc

SEQ ID NO: 1297717 - DNA, 18 bp, Homo sapiens
attaccccctccttcaga

SEQ ID NO: 1297718 - DNA, 18 bp, Homo sapiens
attagccgggcatggtgg

SEQ ID NO: 1297719 - DNA, 17 bp, Homo sapiens
attagggagaaaattca

SEQ ID NO: 1297720 - DNA, 23 bp, Homo sapiens
attagggagaaaattcaattgta

SEQ ID NO: 1297721 - DNA, 22 bp, Homo sapiens
attagtaccatagtaccattta

SEQ ID NO: 1297722 - DNA, 14 bp, Homo sapiens
attatccatattga

SEQ ID NO: 1297723 - DNA, 14 bp, Homo sapiens
attatctatacata

SEQ ID NO: 1297724 - DNA, 19 bp, Homo sapiens
attatctatacatatcttt

SEQ ID NO: 1297725 - DNA, 13 bp, Homo sapiens
attatttattatt

SEQ ID NO: 1297726 - DNA, 14 bp, Homo sapiens
attcacaaactttt

SEQ ID NO: 1297727 - DNA, 15 bp, Homo sapiens
attcagtgattactg

SEQ ID NO: 1297728 - DNA, 17 bp, Homo sapiens
attcagtgattactgtc

SEQ ID NO: 1297729 - DNA, 16 bp, Homo sapiens
attcatagtaacttct

SEQ ID NO: 1297730 - DNA, 18 bp, Homo sapiens
attcatagtaacttctta

SEQ ID NO: 1297731 - DNA, 19 bp, Homo sapiens
attcatagtaacttcttat

SEQ ID NO: 1297732 - DNA, 17 bp, Homo sapiens
attcatcccaactgtct

SEQ ID NO: 1297733 - DNA, 23 bp, Homo sapiens
attccagaatgctgtacatctat

SEQ ID NO: 1297734 - DNA, 17 bp, Homo sapiens
attcctcaacgtattgt

SEQ ID NO: 1297735 - DNA, 22 bp, Homo sapiens
attcctctgggaatgttacatt

SEQ ID NO: 1297736 - DNA, 18 bp, Homo sapiens
attcctctttgctttgct

SEQ ID NO: 1297737 - DNA, 15 bp, Homo sapiens
attcctgaagaacca

SEQ ID NO: 1297738 - DNA, 17 bp, Homo sapiens
attccttcctgttctga

SEQ ID NO: 1297739 - DNA, 23 bp, Homo sapiens
attcggtgtggtgcagtgtgaaa

SEQ ID NO: 1297740 - DNA, 20 bp, Homo sapiens
attctatttatatgtacatg

SEQ ID NO: 1297741 - DNA, 13 bp, Homo sapiens
attctccttcagc

SEQ ID NO: 1297742 - DNA, 13 bp, Homo sapiens
attcttttgtaat

SEQ ID NO: 1297743 - DNA, 15 bp, Homo sapiens
attgaacacaaactg

SEQ ID NO: 1297744 - DNA, 20 bp, Homo sapiens
attgaacacaaactgtaaat

SEQ ID NO: 1297745 - DNA, 13 bp, Homo sapiens
attgaatcagtat

SEQ ID NO: 1297746 - DNA, 16 bp, Homo sapiens
attgacagctttgctg

SEQ ID NO: 1297747 - DNA, 18 bp, Homo sapiens
attgacagctttgctgct

SEQ ID NO: 1297748 - DNA, 19 bp, Homo sapiens
attgacagctttgctgctg

SEQ ID NO: 1297749 - DNA, 20 bp, Homo sapiens
attgaccgcgactaatttca

SEQ ID NO: 1297750 - DNA, 14 bp, Homo sapiens
attgatttgaagaa

SEQ ID NO: 1297751 - DNA, 15 bp, Homo sapiens
attgatttgcattga

SEQ ID NO: 1297752 - DNA, 20 bp, Homo sapiens
attgcgtttgaccttttatg

SEQ ID NO: 1297753 - DNA, 23 bp, Homo sapiens
attgctgagagaaatatggaact

SEQ ID NO: 1297754 - DNA, 14 bp, Homo sapiens
attgctgagcctct

SEQ ID NO: 1297755 - DNA, 22 bp, Homo sapiens
attgctgagcctctgctcccca

SEQ ID NO: 1297756 - DNA, 23 bp, Homo sapiens
attgctgagcctctgctccccag

SEQ ID NO: 1297757 - DNA, 15 bp, Homo sapiens
attggggtccctcta

SEQ ID NO: 1297758 - DNA, 23 bp, Homo sapiens
attgtaaattgaatcagtataaa

SEQ ID NO: 1297759 - DNA, 12 bp, Homo sapiens
attgtacctctc

SEQ ID NO: 1297760 - DNA, 19 bp, Homo sapiens
attgtacctctcttataga

SEQ ID NO: 1297761 - DNA, 23 bp, Homo sapiens
attgtccctctgccccatcctcc

SEQ ID NO: 1297762 - DNA, 24 bp, Homo sapiens
attgttccagcagttttcaagtca

SEQ ID NO: 1297763 - DNA, 20 bp, Homo sapiens
attgtttgtctgtcttcata

SEQ ID NO: 1297764 - DNA, 21 bp, Homo sapiens
atttaacagctgaattatcta

SEQ ID NO: 1297765 - DNA, 19 bp, Homo sapiens
atttacagatgaatgtatt

SEQ ID NO: 1297766 - DNA, 15 bp, Homo sapiens
atttacgctttgatt

SEQ ID NO: 1297767 - DNA, 19 bp, Homo sapiens
atttacgctttgattcata

SEQ ID NO: 1297768 - DNA, 18 bp, Homo sapiens
atttaggtttttattagt

SEQ ID NO: 1297769 - DNA, 21 bp, Homo sapiens
atttataaaacttctcaagat

SEQ ID NO: 1297770 - DNA, 22 bp, Homo sapiens
atttatgtttgcacttgtgatt

SEQ ID NO: 1297771 - DNA, 11 bp, Homo sapiens
atttattattt

SEQ ID NO: 1297772 - DNA, 14 bp, Homo sapiens
atttattattttca

SEQ ID NO: 1297773 - DNA, 14 bp, Homo sapiens
atttcaaaatgctt

SEQ ID NO: 1297774 - DNA, 16 bp, Homo sapiens
atttcaaaatgctttt

SEQ ID NO: 1297775 - DNA, 21 bp, Homo sapiens
atttcacccctccctttctcc

SEQ ID NO: 1297776 - DNA, 18 bp, Homo sapiens
atttcagactcccattcc

SEQ ID NO: 1297777 - DNA, 11 bp, Homo sapiens
atttcatctgc

SEQ ID NO: 1297778 - DNA, 15 bp, Homo sapiens
atttcatctgctctc

SEQ ID NO: 1297779 - DNA, 13 bp, Homo sapiens
atttccagtctcc

SEQ ID NO: 1297780 - DNA, 17 bp, Homo sapiens
atttccagtctccacca

SEQ ID NO: 1297781 - DNA, 12 bp, Homo sapiens
atttcccaggac

SEQ ID NO: 1297782 - DNA, 18 bp, Homo sapiens
atttcctatcacctattt

SEQ ID NO: 1297783 - DNA, 23 bp, Homo sapiens
atttccttgaatgtggcttgaga

SEQ ID NO: 1297784 - DNA, 13 bp, Homo sapiens
atttctgcatatg

SEQ ID NO: 1297785 - DNA, 23 bp, Homo sapiens
atttctgcatatgttgaatactt

SEQ ID NO: 1297786 - DNA, 19 bp, Homo sapiens
atttgagtgttttaagata

SEQ ID NO: 1297787 - DNA, 13 bp, Homo sapiens
atttgattgattt

SEQ ID NO: 1297788 - DNA, 23 bp, Homo sapiens
atttgcattaaattcacaaactt

SEQ ID NO: 1297789 - DNA, 15 bp, Homo sapiens
atttggaatactttt

SEQ ID NO: 1297790 - DNA, 14 bp, Homo sapiens
atttgggaagtgaa

SEQ ID NO: 1297791 - DNA, 16 bp, Homo sapiens
atttggttcattaatt

SEQ ID NO: 1297792 - DNA, 21 bp, Homo sapiens
atttggttcattaattctata

SEQ ID NO: 1297793 - DNA, 15 bp, Homo sapiens
atttggttctaatag

SEQ ID NO: 1297794 - DNA, 18 bp, Homo sapiens
atttgtgatagcactttc

SEQ ID NO: 1297795 - DNA, 24 bp, Homo sapiens
attttaattcatcccaactgtctt

SEQ ID NO: 1297796 - DNA, 22 bp, Homo sapiens
attttatctttgattctccttc

SEQ ID NO: 1297797 - DNA, 13 bp, Homo sapiens
cattgttgagcta

SEQ ID NO: 1297798 - DNA, 22 bp, Homo sapiens
cattgtttgtctgtcttcatag

SEQ ID NO: 1297799 - DNA, 21 bp, Homo sapiens
catttagagaggaaaagtaac

SEQ ID NO: 1297800 - DNA, 15 bp, Homo sapiens
catttatacaaatta

SEQ ID NO: 1297801 - DNA, 17 bp, Homo sapiens
catttatacaaattaga

SEQ ID NO: 1297802 - DNA, 18 bp, Homo sapiens
catttatacaaattagaa

SEQ ID NO: 1297803 - DNA, 19 bp, Homo sapiens
catttatacaaattagaaa

SEQ ID NO: 1297804 - DNA, 17 bp, Homo sapiens
catttcacccctccctt

SEQ ID NO: 1297805 - DNA, 18 bp, Homo sapiens
catttcacccctcccttt

SEQ ID NO: 1297806 - DNA, 23 bp, Homo sapiens
catttcacccctccctttctccc

SEQ ID NO: 1297807 - DNA, 23 bp, Homo sapiens
catttggattggggtccctctaa

SEQ ID NO: 1297808 - DNA, 21 bp, Homo sapiens
catttggttcattaattctat

SEQ ID NO: 1297809 - DNA, 22 bp, Homo sapiens
cattttaatttattaattgctt

SEQ ID NO: 1297810 - DNA, 22 bp, Homo sapiens
cattttggagagtttcctgaaa

SEQ ID NO: 1297811 - DNA, 9 bp, Homo sapiens
ccaaagagt

SEQ ID NO: 1297812 - DNA, 14 bp, Homo sapiens
ccaaagcagacagc

SEQ ID NO: 1297813 - DNA, 15 bp, Homo sapiens
ccaaatttgattgat

SEQ ID NO: 1297814 - DNA, 17 bp, Homo sapiens
ccaacaccaagcacagc

SEQ ID NO: 1297815 - DNA, 19 bp, Homo sapiens
ccaacaccaagcacagcag

SEQ ID NO: 1297816 - DNA, 22 bp, Homo sapiens
ccaacaccaagcacagcagcct

SEQ ID NO: 1297817 - DNA, 17 bp, Homo sapiens
ccaacacgcacctgcct

SEQ ID NO: 1297818 - DNA, 20 bp, Homo sapiens
ccaacacgcacctgcctcag

SEQ ID NO: 1297819 - DNA, 21 bp, Homo sapiens
ccaacacgcacctgcctcagg

SEQ ID NO: 1297820 - DNA, 14 bp, Homo sapiens
ccaaccccccagca

SEQ ID NO: 1297821 - DNA, 15 bp, Homo sapiens
ccaaccccccagcac

SEQ ID NO: 1297822 - DNA, 18 bp, Homo sapiens
ccaaccccccagcactga

SEQ ID NO: 1297823 - DNA, 19 bp, Homo sapiens
ccaaccccccagcactgag

SEQ ID NO: 1297824 - DNA, 21 bp, Homo sapiens
ccaaccccccagcactgagga

SEQ ID NO: 1297825 - DNA, 13 bp, Homo sapiens
ccaacccttctcc

SEQ ID NO: 1297826 - DNA, 21 bp, Homo sapiens
ccaacccttctcctcttgtaa

SEQ ID NO: 1297827 - DNA, 17 bp, Homo sapiens
ccaacctgcaaagatct

SEQ ID NO: 1297828 - DNA, 18 bp, Homo sapiens
ccaacctgcaaagatctg

SEQ ID NO: 1297829 - DNA, 12 bp, Homo sapiens
ccaagcacagca

SEQ ID NO: 1297830 - DNA, 13 bp, Homo sapiens
ccaagcacagcag

SEQ ID NO: 1297831 - DNA, 15 bp, Homo sapiens
ccaagcacagcagcc

SEQ ID NO: 1297832 - DNA, 17 bp, Homo sapiens
ccaagcacagcagcctg

SEQ ID NO: 1297833 - DNA, 23 bp, Homo sapiens
ccaagctgcctcccctctccttc

SEQ ID NO: 1297834 - DNA, 12 bp, Homo sapiens
ccaaggagctgc

SEQ ID NO: 1297835 - DNA, 14 bp, Homo sapiens
ccaaggagctgcta

SEQ ID NO: 1297836 - DNA, 15 bp, Homo sapiens
ccaaggagctgctat

SEQ ID NO: 1297837 - DNA, 16 bp, Homo sapiens
ccaaggagctgctata

SEQ ID NO: 1297838 - DNA, 22 bp, Homo sapiens
ccaaggagctgctatagcctgg

SEQ ID NO: 1297839 - DNA, 20 bp, Homo sapiens
ccaagtagctgggattacag

SEQ ID NO: 1297840 - DNA, 12 bp, Homo sapiens
ccaatattataa

SEQ ID NO: 1297841 - DNA, 22 bp, Homo sapiens
ccaatattttctttaatgcttt

SEQ ID NO: 1297842 - DNA, 14 bp, Homo sapiens
ccaattcagacagg

SEQ ID NO: 1297843 - DNA, 20 bp, Homo sapiens
ccacagcaaccccaggctga

SEQ ID NO: 1297844 - DNA, 16 bp, Homo sapiens
ccacaggacacagtca

SEQ ID NO: 1297845 - DNA, 17 bp, Homo sapiens
ccacaggccgccctgcg

SEQ ID NO: 1297846 - DNA, 22 bp, Homo sapiens
ccacaggcctgagatttcatct

SEQ ID NO: 1297847 - DNA, 17 bp, Homo sapiens
ccacagtagtcttgatg

SEQ ID NO: 1297848 - DNA, 22 bp, Homo sapiens
ccacatctaagcctgaaggggc

SEQ ID NO: 1297849 - DNA, 19 bp, Homo sapiens
ccacccacctccctgcctc

SEQ ID NO: 1297850 - DNA, 20 bp, Homo sapiens
ccaccctggccgagtccaag

SEQ ID NO: 1297851 - DNA, 22 bp, Homo sapiens
ccaccctggccgagtccaagct

SEQ ID NO: 1297852 - DNA, 14 bp, Homo sapiens
ccacctagcagcac

SEQ ID NO: 1297853 - DNA, 14 bp, Homo sapiens
ccacctccctgcct

SEQ ID NO: 1297854 - DNA, 16 bp, Homo sapiens
ccacctctccctgacc

SEQ ID NO: 1297855 - DNA, 18 bp, Homo sapiens
ccacctctccctgaccct

SEQ ID NO: 1297856 - DNA, 21 bp, Homo sapiens
ccactaagcagaggaggggcc

SEQ ID NO: 1297857 - DNA, 19 bp, Homo sapiens
ccactgtcctgggcctgca

SEQ ID NO: 1297858 - DNA, 20 bp, Homo sapiens
ccactgtcctgggcctgcag

SEQ ID NO: 1297859 - DNA, 21 bp, Homo sapiens
ccacttcattcttgaaagctg

SEQ ID NO: 1297860 - DNA, 23 bp, Homo sapiens
ccacttcattcttgaaagctgtg

SEQ ID NO: 1297861 - DNA, 16 bp, Homo sapiens
ccagaatgctgtacat

SEQ ID NO: 1297862 - DNA, 14 bp, Homo sapiens
ccagacacaggccc

SEQ ID NO: 1297863 - DNA, 15 bp, Homo sapiens
ccagacacaggccct

SEQ ID NO: 1297864 - DNA, 18 bp, Homo sapiens
ccagacctgatcctggag

SEQ ID NO: 1297865 - DNA, 19 bp, Homo sapiens
ccagacctgatcctggagg

SEQ ID NO: 1297866 - DNA, 20 bp, Homo sapiens
ccagacctgttagcagacag

SEQ ID NO: 1297867 - DNA, 23 bp, Homo sapiens
ccagacctgttagcagacaggcc

SEQ ID NO: 1297868 - DNA, 15 bp, Homo sapiens
ccagacttccttgag

SEQ ID NO: 1297869 - DNA, 12 bp, Homo sapiens
ccagagaagcta

SEQ ID NO: 1297870 - DNA, 22 bp, Homo sapiens
ccagagacatacttgaagggcc

SEQ ID NO: 1297871 - DNA, 20 bp, Homo sapiens
ccagagatccaaaagaagcc

SEQ ID NO: 1297872 - DNA, 22 bp, Homo sapiens
ccagagccaggggggtgaggag

SEQ ID NO: 1297873 - DNA, 23 bp, Homo sapiens
ccagagccaggggggtgaggagc

SEQ ID NO: 1297874 - DNA, 11 bp, Homo sapiens
ccagagcccag

SEQ ID NO: 1297875 - DNA, 18 bp, Homo sapiens
ccagagcccagctccaag

SEQ ID NO: 1297876 - DNA, 22 bp, Homo sapiens
ccagaggagggcagcagaaggg

SEQ ID NO: 1297877 - DNA, 13 bp, Homo sapiens
ccagatccagcct

SEQ ID NO: 1297878 - DNA, 18 bp, Homo sapiens
ccagatgcagggcagtca

SEQ ID NO: 1297879 - DNA, 15 bp, Homo sapiens
ccagcactgaggaag

SEQ ID NO: 1297880 - DNA, 17 bp, Homo sapiens
ccagcactgaggaagaa

SEQ ID NO: 1297881 - DNA, 19 bp, Homo sapiens
ccagcacttgtccagctga

SEQ ID NO: 1297882 - DNA, 18 bp, Homo sapiens
ccagcaggtgctgacttc

SEQ ID NO: 1297883 - DNA, 17 bp, Homo sapiens
ccagccaggccccaggc

SEQ ID NO: 1297884 - DNA, 16 bp, Homo sapiens
ccagccatcaaaatgc

SEQ ID NO: 1297885 - DNA, 14 bp, Homo sapiens
ccagccatgtctgc

SEQ ID NO: 1297886 - DNA, 18 bp, Homo sapiens
ccagccatgtctgcattt

SEQ ID NO: 1297887 - DNA, 14 bp, Homo sapiens
ccagcccagagaca

SEQ ID NO: 1297888 - DNA, 22 bp, Homo sapiens
ccagcccagagacatacttgaa

SEQ ID NO: 1297889 - DNA, 14 bp, Homo sapiens
ccagccccttgaga

SEQ ID NO: 1297890 - DNA, 21 bp, Homo sapiens
ccagccctccccatggagcca

SEQ ID NO: 1297891 - DNA, 17 bp, Homo sapiens
ccagcctccctgaagcc

SEQ ID NO: 1297892 - DNA, 13 bp, Homo sapiens
ccagcctggggtc

SEQ ID NO: 1297893 - DNA, 13 bp, Homo sapiens
ccagctcaggaca

SEQ ID NO: 1297894 - DNA, 20 bp, Homo sapiens
ccagctccaacctgcaaaga

SEQ ID NO: 1297895 - DNA, 17 bp, Homo sapiens
ccagctctttcctcctt

SEQ ID NO: 1297896 - DNA, 18 bp, Homo sapiens
ccagctgcactgatgctg

SEQ ID NO: 1297897 - DNA, 17 bp, Homo sapiens
ccagctgggtcaggcag

SEQ ID NO: 1297898 - DNA, 15 bp, Homo sapiens
ccagcttgttattta

SEQ ID NO: 1297899 - DNA, 17 bp, Homo sapiens
ccaggaatttcccagga

SEQ ID NO: 1297900 - DNA, 19 bp, Homo sapiens
ccaggaatttcccaggacc

SEQ ID NO: 1297901 - DNA, 20 bp, Homo sapiens
ccaggaatttcccaggaccc

SEQ ID NO: 1297902 - DNA, 21 bp, Homo sapiens
ccaggaatttcccaggaccct

SEQ ID NO: 1297903 - DNA, 17 bp, Homo sapiens
ccaggaccagctcagga

SEQ ID NO: 1297904 - DNA, 15 bp, Homo sapiens
ccaggaccatcatcc

SEQ ID NO: 1297905 - DNA, 16 bp, Homo sapiens
ccaggaccctgaaggg

SEQ ID NO: 1297906 - DNA, 18 bp, Homo sapiens
ccaggaccctgaaggggc

SEQ ID NO: 1297907 - DNA, 23 bp, Homo sapiens
ccaggaccctgaaggggccatga

SEQ ID NO: 1297908 - DNA, 17 bp, Homo sapiens
ccaggactgggccactt

SEQ ID NO: 1297909 - DNA, 21 bp, Homo sapiens
ccaggatggaacacggccaca

SEQ ID NO: 1297910 - DNA, 13 bp, Homo sapiens
ccaggcagatcca

SEQ ID NO: 1297911 - DNA, 16 bp, Homo sapiens
ccaggcagatccagga

SEQ ID NO: 1297912 - DNA, 17 bp, Homo sapiens
ccaggcagatccaggac

SEQ ID NO: 1297913 - DNA, 15 bp, Homo sapiens
ctaagaacctggaac

SEQ ID NO: 1297914 - DNA, 16 bp, Homo sapiens
ctaagaacctggaact

SEQ ID NO: 1297915 - DNA, 21 bp, Homo sapiens
ctaagagttgagctctcggaa

SEQ ID NO: 1297916 - DNA, 14 bp, Homo sapiens
ctaagcagaggagg

SEQ ID NO: 1297917 - DNA, 16 bp, Homo sapiens
ctaagcagaggagggg

SEQ ID NO: 1297918 - DNA, 19 bp, Homo sapiens
ctaagcagaggaggggccg

SEQ ID NO: 1297919 - DNA, 20 bp, Homo sapiens
ctaagcagaggaggggccgc

SEQ ID NO: 1297920 - DNA, 20 bp, Homo sapiens
ctaatagaactcagttttaa

SEQ ID NO: 1297921 - DNA, 20 bp, Homo sapiens
ctaatatggccacagtagtc

SEQ ID NO: 1297922 - DNA, 17 bp, Homo sapiens
ctaatccaggcagatcc

SEQ ID NO: 1297923 - DNA, 19 bp, Homo sapiens
ctaatccaggcagatccag

SEQ ID NO: 1297924 - DNA, 20 bp, Homo sapiens
ctaatccaggcagatccagg

SEQ ID NO: 1297925 - DNA, 18 bp, Homo sapiens
ctaatttcaaaatgcttt

SEQ ID NO: 1297926 - DNA, 21 bp, Homo sapiens
ctaatttgcattaaattcaca

SEQ ID NO: 1297927 - DNA, 19 bp, Homo sapiens
ctacagctttgatccctga

SEQ ID NO: 1297928 - DNA, 14 bp, Homo sapiens
ctacatgagaacaa

SEQ ID NO: 1297929 - DNA, 15 bp, Homo sapiens
ctacccatccccgca

SEQ ID NO: 1297930 - DNA, 12 bp, Homo sapiens
ctactaattcca

SEQ ID NO: 1297931 - DNA, 15 bp, Homo sapiens
ctactaattccacac

SEQ ID NO: 1297932 - DNA, 17 bp, Homo sapiens
ctactgtaattttatat

SEQ ID NO: 1297933 - DNA, 15 bp, Homo sapiens
ctagaatttattcaa

SEQ ID NO: 1297934 - DNA, 23 bp, Homo sapiens
ctagaatttattcaattcctctg

SEQ ID NO: 1297935 - DNA, 21 bp, Homo sapiens
ctagagggaggggcctaggcc

SEQ ID NO: 1297936 - DNA, 17 bp, Homo sapiens
ctagagtagagtggagg

SEQ ID NO: 1297937 - DNA, 19 bp, Homo sapiens
ctagatggtgctgagaagc

SEQ ID NO: 1297938 - DNA, 19 bp, Homo sapiens
ctagcagcaccgttctgtg

SEQ ID NO: 1297939 - DNA, 21 bp, Homo sapiens
ctagcagcaccgttctgtgca

SEQ ID NO: 1297940 - DNA, 20 bp, Homo sapiens
ctagctctatgtttacaaat

SEQ ID NO: 1297941 - DNA, 18 bp, Homo sapiens
ctagctgggggtgggcca

SEQ ID NO: 1297942 - DNA, 19 bp, Homo sapiens
ctagctgggggtgggccag

SEQ ID NO: 1297943 - DNA, 18 bp, Homo sapiens
ctagctgttgagctgttt

SEQ ID NO: 1297944 - DNA, 18 bp, Homo sapiens
ctaggcctcagccagaga

SEQ ID NO: 1297945 - DNA, 16 bp, Homo sapiens
ctagtcaagctcctcc

SEQ ID NO: 1297946 - DNA, 22 bp, Homo sapiens
ctagtcaagctcctcctccctg

SEQ ID NO: 1297947 - DNA, 17 bp, Homo sapiens
ctagtgccttctaaagg

SEQ ID NO: 1297948 - DNA, 15 bp, Homo sapiens
ctataaattcctctt

SEQ ID NO: 1297949 - DNA, 19 bp, Homo sapiens
ctataaattcctctttgct

SEQ ID NO: 1297950 - DNA, 14 bp, Homo sapiens
ctatacatatcttt

SEQ ID NO: 1297951 - DNA, 12 bp, Homo sapiens
ctatagcctggg

SEQ ID NO: 1297952 - DNA, 14 bp, Homo sapiens
ctatagcctggggt

SEQ ID NO: 1297953 - DNA, 16 bp, Homo sapiens
ctatcacctatttcca

SEQ ID NO: 1297954 - DNA, 17 bp, Homo sapiens
ctatctactctcctcat

SEQ ID NO: 1297955 - DNA, 13 bp, Homo sapiens
ctatgcatggtgc

SEQ ID NO: 1297956 - DNA, 19 bp, Homo sapiens
ctatgcatggtgccccagg

SEQ ID NO: 1297957 - DNA, 23 bp, Homo sapiens
ctatgcatggtgccccaggacca

SEQ ID NO: 1297958 - DNA, 21 bp, Homo sapiens
ctattaaggtgatatatttaa

SEQ ID NO: 1297959 - DNA, 14 bp, Homo sapiens
ctattctctccaaa

SEQ ID NO: 1297960 - DNA, 15 bp, Homo sapiens
ctatttatttactga

SEQ ID NO: 1297961 - DNA, 12 bp, Homo sapiens
ctcaacctcttc

SEQ ID NO: 1297962 - DNA, 18 bp, Homo sapiens
ctcaacctcttctggctc

SEQ ID NO: 1297963 - DNA, 16 bp, Homo sapiens
ctcacaacctgaacct

SEQ ID NO: 1297964 - DNA, 17 bp, Homo sapiens
ctcacaacctgaaccta

SEQ ID NO: 1297965 - DNA, 12 bp, Homo sapiens
ctcacactgaga

SEQ ID NO: 1297966 - DNA, 14 bp, Homo sapiens
ctcacccctggttc

SEQ ID NO: 1297967 - DNA, 20 bp, Homo sapiens
ctcacccctggttctcatct

SEQ ID NO: 1297968 - DNA, 21 bp, Homo sapiens
ctcacccctggttctcatctt

SEQ ID NO: 1297969 - DNA, 16 bp, Homo sapiens
ctcaccttggcaccag

SEQ ID NO: 1297970 - DNA, 13 bp, Homo sapiens
ctcactggggcct

SEQ ID NO: 1297971 - DNA, 18 bp, Homo sapiens
ctcactggggcctacagc

SEQ ID NO: 1297972 - DNA, 19 bp, Homo sapiens
ctcagacatgttttccgtg

SEQ ID NO: 1297973 - DNA, 17 bp, Homo sapiens
ctcagacattggcacct

SEQ ID NO: 1297974 - DNA, 19 bp, Homo sapiens
ctcagaggcgcactgtgac

SEQ ID NO: 1297975 - DNA, 14 bp, Homo sapiens
ctcagatccaggga

SEQ ID NO: 1297976 - DNA, 18 bp, Homo sapiens
ctcagatccagggacaga

SEQ ID NO: 1297977 - DNA, 20 bp, Homo sapiens
ctcagatccagggacagagg

SEQ ID NO: 1297978 - DNA, 12 bp, Homo sapiens
ctcagccagaga

SEQ ID NO: 1297979 - DNA, 13 bp, Homo sapiens
ctcagccctgacc

SEQ ID NO: 1297980 - DNA, 15 bp, Homo sapiens
ctcagcctggccaga

SEQ ID NO: 1297981 - DNA, 20 bp, Homo sapiens
ctcagcctggccagacacag

SEQ ID NO: 1297982 - DNA, 17 bp, Homo sapiens
ctcagccttgccagaga

SEQ ID NO: 1297983 - DNA, 19 bp, Homo sapiens
ctcagccttgccagagatc

SEQ ID NO: 1297984 - DNA, 22 bp, Homo sapiens
ctcagccttgccagagatccaa

SEQ ID NO: 1297985 - DNA, 14 bp, Homo sapiens
ctcagctctgggcc

SEQ ID NO: 1297986 - DNA, 12 bp, Homo sapiens
ctcaggtggcca

SEQ ID NO: 1297987 - DNA, 15 bp, Homo sapiens
ctcaggtggccatgc

SEQ ID NO: 1297988 - DNA, 18 bp, Homo sapiens
ctcaggtggccatgcctc

SEQ ID NO: 1297989 - DNA, 21 bp, Homo sapiens
ctcaggtggccatgcctcagc

SEQ ID NO: 1297990 - DNA, 17 bp, Homo sapiens
ctcagtactttggaggc

SEQ ID NO: 1297991 - DNA, 19 bp, Homo sapiens
ctcagtactttggaggccc

SEQ ID NO: 1297992 - DNA, 18 bp, Homo sapiens
ctcatctctaacagctca

SEQ ID NO: 1297993 - DNA, 22 bp, Homo sapiens
ctcatctctaacagctcaggat

SEQ ID NO: 1297994 - DNA, 23 bp, Homo sapiens
ctcatctctaacagctcaggatc

SEQ ID NO: 1297995 - DNA, 16 bp, Homo sapiens
ctcatctctctgccca

SEQ ID NO: 1297996 - DNA, 17 bp, Homo sapiens
ctcatctcttagctccc

SEQ ID NO: 1297997 - DNA, 20 bp, Homo sapiens
ctcatctcttagctcccctc

SEQ ID NO: 1297998 - DNA, 12 bp, Homo sapiens
ctcatctttctt

SEQ ID NO: 1297999 - DNA, 15 bp, Homo sapiens
ctcatctttcttgat

SEQ ID NO: 1298000 - DNA, 16 bp, Homo sapiens
ctcatgcccctggctg

SEQ ID NO: 1298001 - DNA, 16 bp, Homo sapiens
ctcatgttttcaactg

SEQ ID NO: 1298002 - DNA, 17 bp, Homo sapiens
ctcatgttttcaactgc

SEQ ID NO: 1298003 - DNA, 17 bp, Homo sapiens
ctcatttcacccctccc

SEQ ID NO: 1298004 - DNA, 16 bp, Homo sapiens
ctccaacaccaagcac

SEQ ID NO: 1298005 - DNA, 14 bp, Homo sapiens
ctccaaccccccag

SEQ ID NO: 1298006 - DNA, 19 bp, Homo sapiens
ctccaaccccccagcactg

SEQ ID NO: 1298007 - DNA, 21 bp, Homo sapiens
ctccaaccccccagcactgag

SEQ ID NO: 1298008 - DNA, 22 bp, Homo sapiens
ctccaaccccccagcactgagg

SEQ ID NO: 1298009 - DNA, 13 bp, Homo sapiens
ctccaacctgcaa

SEQ ID NO: 1298010 - DNA, 14 bp, Homo sapiens
ctccaccctggccg

SEQ ID NO: 1298011 - DNA, 15 bp, Homo sapiens
ctccaccctggccga

SEQ ID NO: 1298012 - DNA, 13 bp, Homo sapiens
ctccactctcccc

SEQ ID NO: 1298013 - DNA, 11 bp, Homo sapiens
ctccagacctg

SEQ ID NO: 1298014 - DNA, 12 bp, Homo sapiens
ctccagacctga

SEQ ID NO: 1298015 - DNA, 19 bp, Homo sapiens
ctccagacctgatcctgga

SEQ ID NO: 1298016 - DNA, 16 bp, Homo sapiens
ctccagatgcagggca

SEQ ID NO: 1298017 - DNA, 17 bp, Homo sapiens
ctccagatgcagggcag

SEQ ID NO: 1298018 - DNA, 12 bp, Homo sapiens
ctccaggaacca

SEQ ID NO: 1298019 - DNA, 18 bp, Homo sapiens
ctccaggaaccacaccac

SEQ ID NO: 1298020 - DNA, 16 bp, Homo sapiens
ctccagggctggactg

SEQ ID NO: 1298021 - DNA, 19 bp, Homo sapiens
ctccagggctggactgagg

SEQ ID NO: 1298022 - DNA, 14 bp, Homo sapiens
ctcccatccagggc

SEQ ID NO: 1298023 - DNA, 15 bp, Homo sapiens
ctcccatccagggcc

SEQ ID NO: 1298024 - DNA, 15 bp, Homo sapiens
ctcccattcctgaag

SEQ ID NO: 1298025 - DNA, 22 bp, Homo sapiens
ctcccattgtccctctgcccca

SEQ ID NO: 1298026 - DNA, 15 bp, Homo sapiens
ctccccagcccagag

SEQ ID NO: 1298027 - DNA, 17 bp, Homo sapiens
ctccccatggagccagc

SEQ ID NO: 1298028 - DNA, 14 bp, Homo sapiens
ctccccgcttctgc

SEQ ID NO: 1298029 - DNA, 16 bp, Homo sapiens
ctcccctctccttcct

SEQ ID NO: 1298030 - DNA, 13 bp, Homo sapiens
tacattcatttag

SEQ ID NO: 1298031 - DNA, 15 bp, Homo sapiens
tacattgttcaatta

SEQ ID NO: 1298032 - DNA, 20 bp, Homo sapiens
taccatagtaccatttatac

SEQ ID NO: 1298033 - DNA, 17 bp, Homo sapiens
taccatttatacaaatt

SEQ ID NO: 1298034 - DNA, 17 bp, Homo sapiens
taccccctccttcagac

SEQ ID NO: 1298035 - DNA, 23 bp, Homo sapiens
tacctctcttatagaatatttat

SEQ ID NO: 1298036 - DNA, 14 bp, Homo sapiens
tacctctgatacct

SEQ ID NO: 1298037 - DNA, 22 bp, Homo sapiens
taccttgaaaataagaatagaa

SEQ ID NO: 1298038 - DNA, 14 bp, Homo sapiens
tacgctttgattca

SEQ ID NO: 1298039 - DNA, 16 bp, Homo sapiens
tactaattccacacct

SEQ ID NO: 1298040 - DNA, 13 bp, Homo sapiens
tactaccttgaaa

SEQ ID NO: 1298041 - DNA, 20 bp, Homo sapiens
tactaccttgaaaataagaa

SEQ ID NO: 1298042 - DNA, 15 bp, Homo sapiens
tactaggtaacttca

SEQ ID NO: 1298043 - DNA, 15 bp, Homo sapiens
tactatctactctcc

SEQ ID NO: 1298044 - DNA, 17 bp, Homo sapiens
tactatctactctcctc

SEQ ID NO: 1298045 - DNA, 13 bp, Homo sapiens
tactcaggaagaa

SEQ ID NO: 1298046 - DNA, 14 bp, Homo sapiens
tactctagatgaag

SEQ ID NO: 1298047 - DNA, 14 bp, Homo sapiens
tactctcctcatct

SEQ ID NO: 1298048 - DNA, 16 bp, Homo sapiens
tactctcctcatctct

SEQ ID NO: 1298049 - DNA, 18 bp, Homo sapiens
tactcttaggaagagaaa

SEQ ID NO: 1298050 - DNA, 15 bp, Homo sapiens
tactctttctgtata

SEQ ID NO: 1298051 - DNA, 18 bp, Homo sapiens
tactgagcttctctgtga

SEQ ID NO: 1298052 - DNA, 23 bp, Homo sapiens
tactgccctccagctctttcctc

SEQ ID NO: 1298053 - DNA, 15 bp, Homo sapiens
tactgctactgtaat

SEQ ID NO: 1298054 - DNA, 15 bp, Homo sapiens
tactgtaattcctca

SEQ ID NO: 1298055 - DNA, 16 bp, Homo sapiens
tactgtaattcctcaa

SEQ ID NO: 1298056 - DNA, 20 bp, Homo sapiens
tactgtaattttatatgaag

SEQ ID NO: 1298057 - DNA, 18 bp, Homo sapiens
tactgtgtgtgtgaatga

SEQ ID NO: 1298058 - DNA, 12 bp, Homo sapiens
tacttgaagggc

SEQ ID NO: 1298059 - DNA, 16 bp, Homo sapiens
tacttgaagggccaga

SEQ ID NO: 1298060 - DNA, 17 bp, Homo sapiens
tacttgaagggccagag

SEQ ID NO: 1298061 - DNA, 19 bp, Homo sapiens
tacttgaagggccagagcc

SEQ ID NO: 1298062 - DNA, 12 bp, Homo sapiens
tacttgggaggc

SEQ ID NO: 1298063 - DNA, 23 bp, Homo sapiens
tagaatagtgttctgcaaaaata

SEQ ID NO: 1298064 - DNA, 15 bp, Homo sapiens
tagaatatttattac

SEQ ID NO: 1298065 - DNA, 20 bp, Homo sapiens
tagaatatttattacctctg

SEQ ID NO: 1298066 - DNA, 23 bp, Homo sapiens
tagaatccaaacttggatttttg

SEQ ID NO: 1298067 - DNA, 13 bp, Homo sapiens
tagaattgcattg

SEQ ID NO: 1298068 - DNA, 15 bp, Homo sapiens
tagaatttattcaat

SEQ ID NO: 1298069 - DNA, 22 bp, Homo sapiens
tagaatttattcaattcctctg

SEQ ID NO: 1298070 - DNA, 16 bp, Homo sapiens
tagattatggagcttt

SEQ ID NO: 1298071 - DNA, 19 bp, Homo sapiens
tagcagacaggccccgtga

SEQ ID NO: 1298072 - DNA, 20 bp, Homo sapiens
tagcagattttaattttgaa

SEQ ID NO: 1298073 - DNA, 20 bp, Homo sapiens
tagcagcaccgttctgtgca

SEQ ID NO: 1298074 - DNA, 16 bp, Homo sapiens
tagcatgacatttctt

SEQ ID NO: 1298075 - DNA, 16 bp, Homo sapiens
tagccacatttggaat

SEQ ID NO: 1298076 - DNA, 20 bp, Homo sapiens
tagccagcacacagggcagt

SEQ ID NO: 1298077 - DNA, 13 bp, Homo sapiens
tagctgttgagct

SEQ ID NO: 1298078 - DNA, 14 bp, Homo sapiens
taggaagagaaacc

SEQ ID NO: 1298079 - DNA, 18 bp, Homo sapiens
taggagctgccttggctc

SEQ ID NO: 1298080 - DNA, 23 bp, Homo sapiens
taggagctgccttggctcagaca

SEQ ID NO: 1298081 - DNA, 16 bp, Homo sapiens
taggagggagttatct

SEQ ID NO: 1298082 - DNA, 17 bp, Homo sapiens
taggagtgtgtgatttt

SEQ ID NO: 1298083 - DNA, 18 bp, Homo sapiens
taggcctcagccagagaa

SEQ ID NO: 1298084 - DNA, 16 bp, Homo sapiens
taggctggtggcccag

SEQ ID NO: 1298085 - DNA, 13 bp, Homo sapiens
taggtaacttcat

SEQ ID NO: 1298086 - DNA, 15 bp, Homo sapiens
taggtttttattagt

SEQ ID NO: 1298087 - DNA, 19 bp, Homo sapiens
tagtaacttcttatggaat

SEQ ID NO: 1298088 - DNA, 16 bp, Homo sapiens
tagtaccatttataca

SEQ ID NO: 1298089 - DNA, 15 bp, Homo sapiens
tagtcaagctcctcc

SEQ ID NO: 1298090 - DNA, 21 bp, Homo sapiens
tagtccgtgctgacagctgct

SEQ ID NO: 1298091 - DNA, 19 bp, Homo sapiens
tagtgccttctaaaggtgt

SEQ ID NO: 1298092 - DNA, 14 bp, Homo sapiens
tagttaagacatga

SEQ ID NO: 1298093 - DNA, 21 bp, Homo sapiens
tagttaagacatgatttcctt

SEQ ID NO: 1298094 - DNA, 18 bp, Homo sapiens
tataaaaagcttccatga

SEQ ID NO: 1298095 - DNA, 18 bp, Homo sapiens
tataagtggaggcacttt

SEQ ID NO: 1298096 - DNA, 21 bp, Homo sapiens
tataatttttttcaatattta

SEQ ID NO: 1298097 - DNA, 13 bp, Homo sapiens
tatacaaattaga

SEQ ID NO: 1298098 - DNA, 17 bp, Homo sapiens
tatacaaattagaaaat

SEQ ID NO: 1298099 - DNA, 18 bp, Homo sapiens
tatacaaattagaaaatg

SEQ ID NO: 1298100 - DNA, 21 bp, Homo sapiens
tatacatatctttattaatca

SEQ ID NO: 1298101 - DNA, 11 bp, Homo sapiens
tatactttttt

SEQ ID NO: 1298102 - DNA, 11 bp, Homo sapiens
tatagactcta

SEQ ID NO: 1298103 - DNA, 18 bp, Homo sapiens
tatattgtgtttgtgtat

SEQ ID NO: 1298104 - DNA, 21 bp, Homo sapiens
tatatttgtgatagcactttc

SEQ ID NO: 1298105 - DNA, 21 bp, Homo sapiens
tatcagtcaatatttttagat

SEQ ID NO: 1298106 - DNA, 12 bp, Homo sapiens
tatcatggtctc

SEQ ID NO: 1298107 - DNA, 14 bp, Homo sapiens
tatctactctcctc

SEQ ID NO: 1298108 - DNA, 20 bp, Homo sapiens
tatctactctcctcatctct

SEQ ID NO: 1298109 - DNA, 21 bp, Homo sapiens
tatctactctcctcatctcta

SEQ ID NO: 1298110 - DNA, 15 bp, Homo sapiens
tatcttgtctctggg

SEQ ID NO: 1298111 - DNA, 17 bp, Homo sapiens
tatctttgattctcctt

SEQ ID NO: 1298112 - DNA, 19 bp, Homo sapiens
tatgaagataagtgtattt

SEQ ID NO: 1298113 - DNA, 21 bp, Homo sapiens
tatgcatggtgccccaggacc

SEQ ID NO: 1298114 - DNA, 22 bp, Homo sapiens
tatgcatggtgccccaggacca

SEQ ID NO: 1298115 - DNA, 19 bp, Homo sapiens
tatgctgaaacagaatact

SEQ ID NO: 1298116 - DNA, 15 bp, Homo sapiens
tatggagagaaaaca

SEQ ID NO: 1298117 - DNA, 15 bp, Homo sapiens
tatgtacatgagaag

SEQ ID NO: 1298118 - DNA, 12 bp, Homo sapiens
tatgttgaatac

SEQ ID NO: 1298119 - DNA, 15 bp, Homo sapiens
tattattttcacctg

SEQ ID NO: 1298120 - DNA, 18 bp, Homo sapiens
tattcaattcctctggga

SEQ ID NO: 1298121 - DNA, 17 bp, Homo sapiens
tattccagaatgctgta

SEQ ID NO: 1298122 - DNA, 18 bp, Homo sapiens
tattgacacagaaaatgt

SEQ ID NO: 1298123 - DNA, 14 bp, Homo sapiens
tattgagtcaaatg

SEQ ID NO: 1298124 - DNA, 15 bp, Homo sapiens
tattgctgagagaaa

SEQ ID NO: 1298125 - DNA, 11 bp, Homo sapiens
tattgtacctc

SEQ ID NO: 1298126 - DNA, 15 bp, Homo sapiens
tatttaacagctgaa

SEQ ID NO: 1298127 - DNA, 21 bp, Homo sapiens
tatttaacagctgaattatct

SEQ ID NO: 1298128 - DNA, 21 bp, Homo sapiens
tatttaatgccgatatactct

SEQ ID NO: 1298129 - DNA, 22 bp, Homo sapiens
tatttacgctttgattcatagt

SEQ ID NO: 1298130 - DNA, 16 bp, Homo sapiens
tatttactgagcttct

SEQ ID NO: 1298131 - DNA, 19 bp, Homo sapiens
tatttataacaacctaaat

SEQ ID NO: 1298132 - DNA, 20 bp, Homo sapiens
tatttataacaacctaaatt

SEQ ID NO: 1298133 - DNA, 21 bp, Homo sapiens
tatttatctgattaagttgtc

SEQ ID NO: 1298134 - DNA, 13 bp, Homo sapiens
tatttatgtttgc

SEQ ID NO: 1298135 - DNA, 15 bp, Homo sapiens
tatttattacctctg

SEQ ID NO: 1298136 - DNA, 16 bp, Homo sapiens
tatttattacctctga

SEQ ID NO: 1298137 - DNA, 19 bp, Homo sapiens
tatttattattttcacctg

SEQ ID NO: 1298138 - DNA, 13 bp, Homo sapiens
tatttatttactg

SEQ ID NO: 1298139 - DNA, 17 bp, Homo sapiens
tatttatttactgagct

SEQ ID NO: 1298140 - DNA, 18 bp, Homo sapiens
tatttccattcaacaaga

SEQ ID NO: 1298141 - DNA, 23 bp, Homo sapiens
tatttgggcctgctccagacctg

SEQ ID NO: 1298142 - DNA, 23 bp, Homo sapiens
tattttatctttgattctccttc

SEQ ID NO: 1298143 - DNA, 18 bp, Homo sapiens
tatttttcaataaagcat

SEQ ID NO: 1298144 - DNA, 20 bp, Homo sapiens
tcaaactggggcctccagaa

SEQ ID NO: 1298145 - DNA, 23 bp, Homo sapiens
tcaaactggggcctccagaactc

SEQ ID NO: 1298146 - DNA, 18 bp, Homo sapiens
tcaaatggggccagatcc

SEQ ID NO: 1298147 - DNA, 17 bp, Homo sapiens
tccgtgctgacagctgc

SEQ ID NO: 1298148 - DNA, 15 bp, Homo sapiens
tcctacccatccccg

SEQ ID NO: 1298149 - DNA, 21 bp, Homo sapiens
tcctagagggaggggcctagg

SEQ ID NO: 1298150 - DNA, 17 bp, Homo sapiens
tcctcaagaaataaaag

SEQ ID NO: 1298151 - DNA, 23 bp, Homo sapiens
tcctcaagaaataaaaggaagcc

SEQ ID NO: 1298152 - DNA, 13 bp, Homo sapiens
tcctcaggtggcc

SEQ ID NO: 1298153 - DNA, 16 bp, Homo sapiens
tcctcataaaaagcaa

SEQ ID NO: 1298154 - DNA, 23 bp, Homo sapiens
tcctcataaaaagcaaaacaaaa

SEQ ID NO: 1298155 - DNA, 20 bp, Homo sapiens
tcctcatctctaacagctca

SEQ ID NO: 1298156 - DNA, 23 bp, Homo sapiens
tcctcatctctaacagctcagga

SEQ ID NO: 1298157 - DNA, 14 bp, Homo sapiens
tcctccagcaggga

SEQ ID NO: 1298158 - DNA, 20 bp, Homo sapiens
tcctccagcagggaaaatgc

SEQ ID NO: 1298159 - DNA, 22 bp, Homo sapiens
tcctccctgcatctgaccagca

SEQ ID NO: 1298160 - DNA, 14 bp, Homo sapiens
tcctcccttctgct

SEQ ID NO: 1298161 - DNA, 18 bp, Homo sapiens
tcctcctccctgcatctg

SEQ ID NO: 1298162 - DNA, 14 bp, Homo sapiens
tcctctccccagcc

SEQ ID NO: 1298163 - DNA, 19 bp, Homo sapiens
tcctctctccagatgtttc

SEQ ID NO: 1298164 - DNA, 22 bp, Homo sapiens
tcctctgtcagtcacagccacc

SEQ ID NO: 1298165 - DNA, 19 bp, Homo sapiens
tcctcttgtaaataaagcc

SEQ ID NO: 1298166 - DNA, 20 bp, Homo sapiens
tcctcttgtaaataaagccc

SEQ ID NO: 1298167 - DNA, 20 bp, Homo sapiens
tcctctttgctttgctttct

SEQ ID NO: 1298168 - DNA, 18 bp, Homo sapiens
tcctgaggctttggattt

SEQ ID NO: 1298169 - DNA, 13 bp, Homo sapiens
tcctgccgcagag

SEQ ID NO: 1298170 - DNA, 18 bp, Homo sapiens
tcctgccgcagagctggc

SEQ ID NO: 1298171 - DNA, 12 bp, Homo sapiens
tcctgggcctgc

SEQ ID NO: 1298172 - DNA, 13 bp, Homo sapiens
tcctgggcctgca

SEQ ID NO: 1298173 - DNA, 14 bp, Homo sapiens
tcctgtccagctcc

SEQ ID NO: 1298174 - DNA, 22 bp, Homo sapiens
tcctgtgtgtccaaaactgcct

SEQ ID NO: 1298175 - DNA, 12 bp, Homo sapiens
tcctgttctgaa

SEQ ID NO: 1298176 - DNA, 20 bp, Homo sapiens
tccttagaacattttaattc

SEQ ID NO: 1298177 - DNA, 15 bp, Homo sapiens
tccttcagccctcac

SEQ ID NO: 1298178 - DNA, 20 bp, Homo sapiens
tccttcctggagcccagagg

SEQ ID NO: 1298179 - DNA, 16 bp, Homo sapiens
tcgagaactttcattt

SEQ ID NO: 1298180 - DNA, 15 bp, Homo sapiens
tcgatttctccagga

SEQ ID NO: 1298181 - DNA, 13 bp, Homo sapiens
tcgggctgtgccc

SEQ ID NO: 1298182 - DNA, 16 bp, Homo sapiens
tctaaacccaatccaa

SEQ ID NO: 1298183 - DNA, 19 bp, Homo sapiens
tctaaacccaatccaaatg

SEQ ID NO: 1298184 - DNA, 15 bp, Homo sapiens
tctaacagctcagga

SEQ ID NO: 1298185 - DNA, 15 bp, Homo sapiens
tctaagcctgaaggg

SEQ ID NO: 1298186 - DNA, 16 bp, Homo sapiens
tctaagcctgaagggg

SEQ ID NO: 1298187 - DNA, 19 bp, Homo sapiens
tctaatagaactcagtttt

SEQ ID NO: 1298188 - DNA, 22 bp, Homo sapiens
tctaatagaactcagttttaac

SEQ ID NO: 1298189 - DNA, 15 bp, Homo sapiens
tctactaattccaca

SEQ ID NO: 1298190 - DNA, 20 bp, Homo sapiens
tctagatgaagttttacatt

SEQ ID NO: 1298191 - DNA, 22 bp, Homo sapiens
tctagatgaagttttacattgt

SEQ ID NO: 1298192 - DNA, 19 bp, Homo sapiens
tctagatggctcctctcag

SEQ ID NO: 1298193 - DNA, 20 bp, Homo sapiens
tctagatggctcctctcagt

SEQ ID NO: 1298194 - DNA, 23 bp, Homo sapiens
tctagtgccttctaaaggtgttg

SEQ ID NO: 1298195 - DNA, 22 bp, Homo sapiens
tctatgtttacaaatggacata

SEQ ID NO: 1298196 - DNA, 13 bp, Homo sapiens
tctattctctcca

SEQ ID NO: 1298197 - DNA, 13 bp, Homo sapiens
tctatttatatgt

SEQ ID NO: 1298198 - DNA, 22 bp, Homo sapiens
tctatttatttactgagcttct

SEQ ID NO: 1298199 - DNA, 13 bp, Homo sapiens
tctcatctttctt

SEQ ID NO: 1298200 - DNA, 18 bp, Homo sapiens
tctcatgttttcaactgc

SEQ ID NO: 1298201 - DNA, 16 bp, Homo sapiens
tctcatttcacccctc

SEQ ID NO: 1298202 - DNA, 14 bp, Homo sapiens
tctccagatgtttc

SEQ ID NO: 1298203 - DNA, 15 bp, Homo sapiens
tctccagatgtttcc

SEQ ID NO: 1298204 - DNA, 18 bp, Homo sapiens
tctccagatgtttccaga

SEQ ID NO: 1298205 - DNA, 14 bp, Homo sapiens
tctcccacctagca

SEQ ID NO: 1298206 - DNA, 17 bp, Homo sapiens
tctcccattgtccctct

SEQ ID NO: 1298207 - DNA, 12 bp, Homo sapiens
tctcccctgccc

SEQ ID NO: 1298208 - DNA, 14 bp, Homo sapiens
tctcccctgccccc

SEQ ID NO: 1298209 - DNA, 20 bp, Homo sapiens
tctcccctgcccccaggact

SEQ ID NO: 1298210 - DNA, 18 bp, Homo sapiens
tctcctcatctctaacag

SEQ ID NO: 1298211 - DNA, 13 bp, Homo sapiens
tctcctcttgtaa

SEQ ID NO: 1298212 - DNA, 23 bp, Homo sapiens
tctcctcttgtaaataaagccct

SEQ ID NO: 1298213 - DNA, 15 bp, Homo sapiens
tctccttcagccctc

SEQ ID NO: 1298214 - DNA, 21 bp, Homo sapiens
tctcggaactgcatgctgctg

SEQ ID NO: 1298215 - DNA, 17 bp, Homo sapiens
tctctaacagctcagga

SEQ ID NO: 1298216 - DNA, 18 bp, Homo sapiens
tctctaacagctcaggat

SEQ ID NO: 1298217 - DNA, 12 bp, Homo sapiens
tctctgcccaac

SEQ ID NO: 1298218 - DNA, 13 bp, Homo sapiens
tctctgcccaacc

SEQ ID NO: 1298219 - DNA, 16 bp, Homo sapiens
tctctgtgaacgattt

SEQ ID NO: 1298220 - DNA, 14 bp, Homo sapiens
tctctgtgagactc

SEQ ID NO: 1298221 - DNA, 19 bp, Homo sapiens
tctctgtgagactcgagaa

SEQ ID NO: 1298222 - DNA, 16 bp, Homo sapiens
tctcttgggaactgaa

SEQ ID NO: 1298223 - DNA, 23 bp, Homo sapiens
tctcttgggaactgaactcactt

SEQ ID NO: 1298224 - DNA, 22 bp, Homo sapiens
tctgacatgattccttcctgtt

SEQ ID NO: 1298225 - DNA, 13 bp, Homo sapiens
tctgaccagcagc

SEQ ID NO: 1298226 - DNA, 16 bp, Homo sapiens
tctgaccagcagcgcc

SEQ ID NO: 1298227 - DNA, 18 bp, Homo sapiens
tctgaccagcagcgcctt

SEQ ID NO: 1298228 - DNA, 23 bp, Homo sapiens
tctgacccagtgcccccactgac

SEQ ID NO: 1298229 - DNA, 14 bp, Homo sapiens
tctgataactagat

SEQ ID NO: 1298230 - DNA, 22 bp, Homo sapiens
tctgataactagatggtgctga

SEQ ID NO: 1298231 - DNA, 19 bp, Homo sapiens
tctgcatatgttgaatact

SEQ ID NO: 1298232 - DNA, 18 bp, Homo sapiens
tctgcatttcggtggcta

SEQ ID NO: 1298233 - DNA, 12 bp, Homo sapiens
tctgcccaaccc

SEQ ID NO: 1298234 - DNA, 17 bp, Homo sapiens
tctgcctgccagctgca

SEQ ID NO: 1298235 - DNA, 18 bp, Homo sapiens
tctgcctgccagctgcac

SEQ ID NO: 1298236 - DNA, 18 bp, Homo sapiens
tctgctcagcttctcctg

SEQ ID NO: 1298237 - DNA, 13 bp, Homo sapiens
tctgctctccttc

SEQ ID NO: 1298238 - DNA, 19 bp, Homo sapiens
tctgctctccttcctggag

SEQ ID NO: 1298239 - DNA, 20 bp, Homo sapiens
tctgctctccttcctggagc

SEQ ID NO: 1298240 - DNA, 13 bp, Homo sapiens
tctgctggagttt

SEQ ID NO: 1298241 - DNA, 19 bp, Homo sapiens
tctgctggagtttcatgta

SEQ ID NO: 1298242 - DNA, 23 bp, Homo sapiens
tctgctggagtttcatgtacaag

SEQ ID NO: 1298243 - DNA, 12 bp, Homo sapiens
tctgcttgagtc

SEQ ID NO: 1298244 - DNA, 14 bp, Homo sapiens
tctgcttgagtcag

SEQ ID NO: 1298245 - DNA, 20 bp, Homo sapiens
tctgcttgagtcaggtttga

SEQ ID NO: 1298246 - DNA, 16 bp, Homo sapiens
tctggaacctcagcct

SEQ ID NO: 1298247 - DNA, 18 bp, Homo sapiens
tctggaacctcagcctgg

SEQ ID NO: 1298248 - DNA, 19 bp, Homo sapiens
tctggaacctcagcctggc

SEQ ID NO: 1298249 - DNA, 13 bp, Homo sapiens
tctggaagtccaa

SEQ ID NO: 1298250 - DNA, 18 bp, Homo sapiens
tctggacagccccaccct

SEQ ID NO: 1298251 - DNA, 19 bp, Homo sapiens
tctggacagccccaccctg

SEQ ID NO: 1298252 - DNA, 15 bp, Homo sapiens
tctggagaccaggga

SEQ ID NO: 1298253 - DNA, 14 bp, Homo sapiens
tctggagtggccac

SEQ ID NO: 1298254 - DNA, 21 bp, Homo sapiens
tctggagttgatctggaaccc

SEQ ID NO: 1298255 - DNA, 16 bp, Homo sapiens
tctggcagcctcccat

SEQ ID NO: 1298256 - DNA, 21 bp, Homo sapiens
tctgggccattctccacagca

SEQ ID NO: 1298257 - DNA, 21 bp, Homo sapiens
tctgggcttggggcttcctaa

SEQ ID NO: 1298258 - DNA, 13 bp, Homo sapiens
tctggtcctaccc

SEQ ID NO: 1298259 - DNA, 19 bp, Homo sapiens
tctgtccccttctctcatc

SEQ ID NO: 1298260 - DNA, 20 bp, Homo sapiens
tctgtccccttctctcatct

SEQ ID NO: 1298261 - DNA, 21 bp, Homo sapiens
tctgtccccttctctcatctc

SEQ ID NO: 1298262 - DNA, 21 bp, Homo sapiens
tctgtcctcagccttgccaga

SEQ ID NO: 1298263 - DNA, 15 bp, Homo sapiens
tgtcctgggcctgca

SEQ ID NO: 1298264 - DNA, 17 bp, Homo sapiens
tgtctaaacaatgctga

SEQ ID NO: 1298265 - DNA, 16 bp, Homo sapiens
tgtctccaacccccca

SEQ ID NO: 1298266 - DNA, 21 bp, Homo sapiens
tgtctccaaccccccagcact

SEQ ID NO: 1298267 - DNA, 22 bp, Homo sapiens
tgtctccaaccccccagcactg

SEQ ID NO: 1298268 - DNA, 15 bp, Homo sapiens
tgtctgagtgaacct

SEQ ID NO: 1298269 - DNA, 13 bp, Homo sapiens
tgtctgcatttcg

SEQ ID NO: 1298270 - DNA, 13 bp, Homo sapiens
tgtctttcctaga

SEQ ID NO: 1298271 - DNA, 14 bp, Homo sapiens
tgtgaaggaccctt

SEQ ID NO: 1298272 - DNA, 14 bp, Homo sapiens
tgtgaatgaacact

SEQ ID NO: 1298273 - DNA, 23 bp, Homo sapiens
tgtgaatgaacactcttttgctt

SEQ ID NO: 1298274 - DNA, 16 bp, Homo sapiens
tgtgacccccagctcc

SEQ ID NO: 1298275 - DNA, 17 bp, Homo sapiens
tgtgacccccagctccg

SEQ ID NO: 1298276 - DNA, 15 bp, Homo sapiens
tgtgagaggtttgac

SEQ ID NO: 1298277 - DNA, 16 bp, Homo sapiens
tgtgagaggtttgact

SEQ ID NO: 1298278 - DNA, 18 bp, Homo sapiens
tgtgagcccagctgggtc

SEQ ID NO: 1298279 - DNA, 23 bp, Homo sapiens
tgtgattgacagctttgctgctg

SEQ ID NO: 1298280 - DNA, 14 bp, Homo sapiens
tgtgattgtggaat

SEQ ID NO: 1298281 - DNA, 16 bp, Homo sapiens
tgtgcactaaggggcc

SEQ ID NO: 1298282 - DNA, 21 bp, Homo sapiens
tgtgcactgcccatggacagg

SEQ ID NO: 1298283 - DNA, 19 bp, Homo sapiens
tgtgctttatgctgaaaca

SEQ ID NO: 1298284 - DNA, 17 bp, Homo sapiens
tgtggcaaggaaaaaca

SEQ ID NO: 1298285 - DNA, 18 bp, Homo sapiens
tgtggccaaggagctgct

SEQ ID NO: 1298286 - DNA, 21 bp, Homo sapiens
tgtggccaaggagctgctata

SEQ ID NO: 1298287 - DNA, 17 bp, Homo sapiens
tgtggtgcagtgtgaaa

SEQ ID NO: 1298288 - DNA, 16 bp, Homo sapiens
tgtgtccaaaactgcc

SEQ ID NO: 1298289 - DNA, 17 bp, Homo sapiens
tgtgtgaatgaacactc

SEQ ID NO: 1298290 - DNA, 15 bp, Homo sapiens
tgtgtgattgacagc

SEQ ID NO: 1298291 - DNA, 18 bp, Homo sapiens
tgtgtgattgacagcttt

SEQ ID NO: 1298292 - DNA, 11 bp, Homo sapiens
tgtgtggcctg

SEQ ID NO: 1298293 - DNA, 16 bp, Homo sapiens
tgtgtgttgccacagg

SEQ ID NO: 1298294 - DNA, 17 bp, Homo sapiens
tgtgtgttgccacagga

SEQ ID NO: 1298295 - DNA, 15 bp, Homo sapiens
tgtgtttcaagttca

SEQ ID NO: 1298296 - DNA, 15 bp, Homo sapiens
tgtgtttgtgtattt

SEQ ID NO: 1298297 - DNA, 12 bp, Homo sapiens
tgttactgtaat

SEQ ID NO: 1298298 - DNA, 12 bp, Homo sapiens
tgttcccctcct

SEQ ID NO: 1298299 - DNA, 15 bp, Homo sapiens
tgttcccctcctcca

SEQ ID NO: 1298300 - DNA, 14 bp, Homo sapiens
tgttcctagagtag

SEQ ID NO: 1298301 - DNA, 16 bp, Homo sapiens
tgttcctagagtagag

SEQ ID NO: 1298302 - DNA, 15 bp, Homo sapiens
tgttcctggcagttt

SEQ ID NO: 1298303 - DNA, 23 bp, Homo sapiens
tgttctcttgggaactgaactca

SEQ ID NO: 1298304 - DNA, 13 bp, Homo sapiens
tgttctttgggga

SEQ ID NO: 1298305 - DNA, 13 bp, Homo sapiens
tgttgaatacttt

SEQ ID NO: 1298306 - DNA, 22 bp, Homo sapiens
tgttgagaatcccaaatttgat

SEQ ID NO: 1298307 - DNA, 13 bp, Homo sapiens
tgttgagctgttt

SEQ ID NO: 1298308 - DNA, 17 bp, Homo sapiens
tgttgcaagtgcaataa

SEQ ID NO: 1298309 - DNA, 16 bp, Homo sapiens
tgttgccacaggacac

SEQ ID NO: 1298310 - DNA, 12 bp, Homo sapiens
tgttgtcccttc

SEQ ID NO: 1298311 - DNA, 20 bp, Homo sapiens
tgtttccagacttccttgag

SEQ ID NO: 1298312 - DNA, 23 bp, Homo sapiens
tgtttccagacttccttgagaca

SEQ ID NO: 1298313 - DNA, 12 bp, Homo sapiens
tgtttgtgtatt

SEQ ID NO: 1298314 - DNA, 19 bp, Homo sapiens
tgttttccgtgaaaacgga

SEQ ID NO: 1298315 - DNA, 21 bp, Homo sapiens
tgttttcctcccttctgctac

SEQ ID NO: 1298316 - DNA, 22 bp, Homo sapiens
tgttttcctcccttctgctact

SEQ ID NO: 1298317 - DNA, 22 bp, Homo sapiens
tgtttttaagctgtttccatag

SEQ ID NO: 1298318 - DNA, 18 bp, Homo sapiens
ttaaaaaaaaagatctgt

SEQ ID NO: 1298319 - DNA, 19 bp, Homo sapiens
ttaaactggtattttatct

SEQ ID NO: 1298320 - DNA, 12 bp, Homo sapiens
ttaaaggaaaaa

SEQ ID NO: 1298321 - DNA, 12 bp, Homo sapiens
ttaactagaatt

SEQ ID NO: 1298322 - DNA, 15 bp, Homo sapiens
ttaactagaatttat

SEQ ID NO: 1298323 - DNA, 18 bp, Homo sapiens
ttaaggtgatatatttaa

SEQ ID NO: 1298324 - DNA, 16 bp, Homo sapiens
ttaatatgaaaactta

SEQ ID NO: 1298325 - DNA, 12 bp, Homo sapiens
ttaattgctttg

SEQ ID NO: 1298326 - DNA, 20 bp, Homo sapiens
ttacagatgaatgtatttat

SEQ ID NO: 1298327 - DNA, 13 bp, Homo sapiens
ttacattgttcaa

SEQ ID NO: 1298328 - DNA, 22 bp, Homo sapiens
ttagaaagaagcccaatattat

SEQ ID NO: 1298329 - DNA, 23 bp, Homo sapiens
ttagagacagttgggtgagaaca

SEQ ID NO: 1298330 - DNA, 21 bp, Homo sapiens
ttagatgttccagtaatctaa

SEQ ID NO: 1298331 - DNA, 12 bp, Homo sapiens
ttagcagacagg

SEQ ID NO: 1298332 - DNA, 14 bp, Homo sapiens
ttagctcccctcca

SEQ ID NO: 1298333 - DNA, 24 bp, Homo sapiens
ttagtaacatgaggggacattttg

SEQ ID NO: 1298334 - DNA, 19 bp, Homo sapiens
ttatacaaattagaaaatg

SEQ ID NO: 1298335 - DNA, 23 bp, Homo sapiens
ttatagaatatttattacctctg

SEQ ID NO: 1298336 - DNA, 16 bp, Homo sapiens
ttatatgtacatgaga

SEQ ID NO: 1298337 - DNA, 17 bp, Homo sapiens
ttatccatattgagtca

SEQ ID NO: 1298338 - DNA, 19 bp, Homo sapiens
ttatccatattgagtcaaa

SEQ ID NO: 1298339 - DNA, 21 bp, Homo sapiens
ttatctaaaagaaatgtctat

SEQ ID NO: 1298340 - DNA, 15 bp, Homo sapiens
ttatgtagtaattga

SEQ ID NO: 1298341 - DNA, 16 bp, Homo sapiens
ttatgtagtaattgac

SEQ ID NO: 1298342 - DNA, 20 bp, Homo sapiens
ttattaaatacaaaacttcc

SEQ ID NO: 1298343 - DNA, 15 bp, Homo sapiens
ttattaattgctttg

SEQ ID NO: 1298344 - DNA, 20 bp, Homo sapiens
ttattaccccctccttcaga

SEQ ID NO: 1298345 - DNA, 15 bp, Homo sapiens
ttattacctctgata

SEQ ID NO: 1298346 - DNA, 23 bp, Homo sapiens
ttattagggagaaaattcaattg

SEQ ID NO: 1298347 - DNA, 16 bp, Homo sapiens
ttattattttcacctg

SEQ ID NO: 1298348 - DNA, 23 bp, Homo sapiens
ttattgacacagaaaatgttgag

SEQ ID NO: 1298349 - DNA, 17 bp, Homo sapiens
ttattgtacctctctta

SEQ ID NO: 1298350 - DNA, 20 bp, Homo sapiens
ttatttaaactctgttgcaa

SEQ ID NO: 1298351 - DNA, 20 bp, Homo sapiens
ttatttacagatgaatgtat

SEQ ID NO: 1298352 - DNA, 13 bp, Homo sapiens
ttatttctgcata

SEQ ID NO: 1298353 - DNA, 20 bp, Homo sapiens
ttatttctgcatatgttgaa

SEQ ID NO: 1298354 - DNA, 21 bp, Homo sapiens
ttcaaactggggcctccagaa

SEQ ID NO: 1298355 - DNA, 19 bp, Homo sapiens
ttcaaggtaatttcttgtg

SEQ ID NO: 1298356 - DNA, 11 bp, Homo sapiens
ttcaatattta

SEQ ID NO: 1298357 - DNA, 14 bp, Homo sapiens
ttcaattgtaaatt

SEQ ID NO: 1298358 - DNA, 15 bp, Homo sapiens
ttcacaaacttttat

SEQ ID NO: 1298359 - DNA, 22 bp, Homo sapiens
ttcacaaacttttatactcttt

SEQ ID NO: 1298360 - DNA, 15 bp, Homo sapiens
ttcacccctcccttt

SEQ ID NO: 1298361 - DNA, 16 bp, Homo sapiens
ttcacccctccctttc

SEQ ID NO: 1298362 - DNA, 17 bp, Homo sapiens
ttcacccctccctttct

SEQ ID NO: 1298363 - DNA, 18 bp, Homo sapiens
ttcacccctccctttctc

SEQ ID NO: 1298364 - DNA, 20 bp, Homo sapiens
ttcagactcccattcctgaa

SEQ ID NO: 1298365 - DNA, 19 bp, Homo sapiens
ttcaggaatgtgtggcctg

SEQ ID NO: 1298366 - DNA, 21 bp, Homo sapiens
ttcagttttcatttggttcat

SEQ ID NO: 1298367 - DNA, 18 bp, Homo sapiens
ttcatattgctgagagaa

SEQ ID NO: 1298368 - DNA, 18 bp, Homo sapiens
ttcatcgaatctactaat

SEQ ID NO: 1298369 - DNA, 16 bp, Homo sapiens
ttcatctgctctcctt

SEQ ID NO: 1298370 - DNA, 17 bp, Homo sapiens
ttcatgtacaagatgaa

SEQ ID NO: 1298371 - DNA, 21 bp, Homo sapiens
ttccaggctaaacatccaata

SEQ ID NO: 1298372 - DNA, 13 bp, Homo sapiens
ttccatctttaca

SEQ ID NO: 1298373 - DNA, 18 bp, Homo sapiens
ttccatgattctatttat

SEQ ID NO: 1298374 - DNA, 20 bp, Homo sapiens
ttcccaggaccctgaagggg

SEQ ID NO: 1298375 - DNA, 18 bp, Homo sapiens
ttccccatcttctaaacc

SEQ ID NO: 1298376 - DNA, 17 bp, Homo sapiens
ttcccccttcacaaagc

SEQ ID NO: 1298377 - DNA, 19 bp, Homo sapiens
ttcccctaacctcattccc

SEQ ID NO: 1298378 - DNA, 15 bp, Homo sapiens
ttcccctcctccact

SEQ ID NO: 1298379 - DNA, 14 bp, Homo sapiens
ttcctaaggctgca

SEQ ID NO: 1298380 - DNA, 21 bp, Homo sapiens
aaatggcgtctggaagtccaa

SEQ ID NO: 1298381 - DNA, 21 bp, Homo sapiens
aaatggggccagatccagcct

SEQ ID NO: 1298382 - DNA, 15 bp, Homo sapiens
aaatgttctttgggg

SEQ ID NO: 1298383 - DNA, 14 bp, Homo sapiens
aaattaagaaggca

SEQ ID NO: 1298384 - DNA, 20 bp, Homo sapiens
aaattactcaggaagaacac

SEQ ID NO: 1298385 - DNA, 11 bp, Homo sapiens
aaattagaaaa

SEQ ID NO: 1298386 - DNA, 18 bp, Homo sapiens
aaattaggtattttgtcc

SEQ ID NO: 1298387 - DNA, 15 bp, Homo sapiens
aaattcaattgtaaa

SEQ ID NO: 1298388 - DNA, 17 bp, Homo sapiens
aaattcaattgtaaatt

SEQ ID NO: 1298389 - DNA, 14 bp, Homo sapiens
aaattcacaaactt

SEQ ID NO: 1298390 - DNA, 19 bp, Homo sapiens
aaattcctctttgctttgc

SEQ ID NO: 1298391 - DNA, 20 bp, Homo sapiens
aaattcctctttgctttgct

SEQ ID NO: 1298392 - DNA, 16 bp, Homo sapiens
aaatttggttctaata

SEQ ID NO: 1298393 - DNA, 13 bp, Homo sapiens
aacaaaaattagg

SEQ ID NO: 1298394 - DNA, 14 bp, Homo sapiens
aacaaaaattaggt

SEQ ID NO: 1298395 - DNA, 13 bp, Homo sapiens
aacaaaatttcta

SEQ ID NO: 1298396 - DNA, 14 bp, Homo sapiens
aacaaagcagccac

SEQ ID NO: 1298397 - DNA, 18 bp, Homo sapiens
aacaataggctgttccca

SEQ ID NO: 1298398 - DNA, 18 bp, Homo sapiens
aacaccaagcacagcagc

SEQ ID NO: 1298399 - DNA, 15 bp, Homo sapiens
aacacgcacctgcct

SEQ ID NO: 1298400 - DNA, 19 bp, Homo sapiens
aacactcttttgctttatt

SEQ ID NO: 1298401 - DNA, 22 bp, Homo sapiens
aacagatctggaacctcagcct

SEQ ID NO: 1298402 - DNA, 10 bp, Homo sapiens
aacagctcag

SEQ ID NO: 1298403 - DNA, 16 bp, Homo sapiens
aacatccaaccttccc

SEQ ID NO: 1298404 - DNA, 15 bp, Homo sapiens
aacatccaatatttt

SEQ ID NO: 1298405 - DNA, 11 bp, Homo sapiens
aacatcttttc

SEQ ID NO: 1298406 - DNA, 21 bp, Homo sapiens
aacatgaggggacattttggt

SEQ ID NO: 1298407 - DNA, 21 bp, Homo sapiens
aaccacaccacatctaagcct

SEQ ID NO: 1298408 - DNA, 14 bp, Homo sapiens
aaccagctaagaaa

SEQ ID NO: 1298409 - DNA, 16 bp, Homo sapiens
aaccagctaagaaaag

SEQ ID NO: 1298410 - DNA, 21 bp, Homo sapiens
aacccagattttgctgtatat

SEQ ID NO: 1298411 - DNA, 11 bp, Homo sapiens
aaccccccagc

SEQ ID NO: 1298412 - DNA, 14 bp, Homo sapiens
aaccccccagcact

SEQ ID NO: 1298413 - DNA, 18 bp, Homo sapiens
aaccccccagcactgagg

SEQ ID NO: 1298414 - DNA, 19 bp, Homo sapiens
aaccccccagcactgagga

SEQ ID NO: 1298415 - DNA, 21 bp, Homo sapiens
aacccttctcctcttgtaaat

SEQ ID NO: 1298416 - DNA, 14 bp, Homo sapiens
aacctcagcctggc

SEQ ID NO: 1298417 - DNA, 18 bp, Homo sapiens
aacctctcacttcaccct

SEQ ID NO: 1298418 - DNA, 17 bp, Homo sapiens
aacctcttctggctcaa

SEQ ID NO: 1298419 - DNA, 21 bp, Homo sapiens
aacctgggattcaggaatgtg

SEQ ID NO: 1298420 - DNA, 19 bp, Homo sapiens
aaccttattgtacctctct

SEQ ID NO: 1298421 - DNA, 18 bp, Homo sapiens
aacggggctcttctcatt

SEQ ID NO: 1298422 - DNA, 15 bp, Homo sapiens
aactacaaacaaaat

SEQ ID NO: 1298423 - DNA, 13 bp, Homo sapiens
aactacaaatcaa

SEQ ID NO: 1298424 - DNA, 13 bp, Homo sapiens
aactacatgagaa

SEQ ID NO: 1298425 - DNA, 22 bp, Homo sapiens
aactacatgagaacaaacagat

SEQ ID NO: 1298426 - DNA, 17 bp, Homo sapiens
aactagatggtgctgag

SEQ ID NO: 1298427 - DNA, 20 bp, Homo sapiens
aactagctctatgtttacaa

SEQ ID NO: 1298428 - DNA, 17 bp, Homo sapiens
aactatgcatggtgccc

SEQ ID NO: 1298429 - DNA, 15 bp, Homo sapiens
aactcagatccaggg

SEQ ID NO: 1298430 - DNA, 13 bp, Homo sapiens
aactgtaaataaa

SEQ ID NO: 1298431 - DNA, 19 bp, Homo sapiens
aactgtgtttcaagttcaa

SEQ ID NO: 1298432 - DNA, 22 bp, Homo sapiens
aacttccaggtgttactgtaat

SEQ ID NO: 1298433 - DNA, 18 bp, Homo sapiens
aacttccccatcttctaa

SEQ ID NO: 1298434 - DNA, 15 bp, Homo sapiens
aacttcttatggaat

SEQ ID NO: 1298435 - DNA, 22 bp, Homo sapiens
aacttggggagttaagacctgg

SEQ ID NO: 1298436 - DNA, 23 bp, Homo sapiens
aacttggggagttaagacctggc

SEQ ID NO: 1298437 - DNA, 13 bp, Homo sapiens
aactttaagagga

SEQ ID NO: 1298438 - DNA, 17 bp, Homo sapiens
aactttcatttttttcc

SEQ ID NO: 1298439 - DNA, 13 bp, Homo sapiens
aagaaaacatcta

SEQ ID NO: 1298440 - DNA, 11 bp, Homo sapiens
aagaacatgtg

SEQ ID NO: 1298441 - DNA, 18 bp, Homo sapiens
aagaacggggctcttctc

SEQ ID NO: 1298442 - DNA, 16 bp, Homo sapiens
aagaaggcaaaaatgt

SEQ ID NO: 1298443 - DNA, 18 bp, Homo sapiens
aagaccaccacttcgaaa

SEQ ID NO: 1298444 - DNA, 20 bp, Homo sapiens
aagactggaagctaatttgc

SEQ ID NO: 1298445 - DNA, 20 bp, Homo sapiens
aagatctgtcctcagccttg

SEQ ID NO: 1298446 - DNA, 20 bp, Homo sapiens
aagatctgttttgaaggcaa

SEQ ID NO: 1298447 - DNA, 22 bp, Homo sapiens
aagatctgttttgaaggcaaaa

SEQ ID NO: 1298448 - DNA, 23 bp, Homo sapiens
aagatgaaggagaggcaacatcc

SEQ ID NO: 1298449 - DNA, 16 bp, Homo sapiens
aagcacagcagcctgg

SEQ ID NO: 1298450 - DNA, 12 bp, Homo sapiens
aagcagacagct

SEQ ID NO: 1298451 - DNA, 14 bp, Homo sapiens
aagcagacagctcc

SEQ ID NO: 1298452 - DNA, 12 bp, Homo sapiens
aagcagaggagg

SEQ ID NO: 1298453 - DNA, 12 bp, Homo sapiens
aagcatttataa

SEQ ID NO: 1298454 - DNA, 24 bp, Homo sapiens
aagcctgaaggggcgtctgttccc

SEQ ID NO: 1298455 - DNA, 14 bp, Homo sapiens
aagcgattctcctg

SEQ ID NO: 1298456 - DNA, 16 bp, Homo sapiens
aagctcctcctccctg

SEQ ID NO: 1298457 - DNA, 18 bp, Homo sapiens
aagctcctcctccctgca

SEQ ID NO: 1298458 - DNA, 21 bp, Homo sapiens
aagctcctcctccctgcatct

SEQ ID NO: 1298459 - DNA, 20 bp, Homo sapiens
aagctcctctccccagccca

SEQ ID NO: 1298460 - DNA, 21 bp, Homo sapiens
aagctcctctccccagcccag

SEQ ID NO: 1298461 - DNA, 20 bp, Homo sapiens
aaggagctgctatagcctgg

SEQ ID NO: 1298462 - DNA, 17 bp, Homo sapiens
aaggagtcaaaactaca

SEQ ID NO: 1298463 - DNA, 19 bp, Homo sapiens
aaggatagatgctggccca

SEQ ID NO: 1298464 - DNA, 18 bp, Homo sapiens
aaggatctttgtggccaa

SEQ ID NO: 1298465 - DNA, 15 bp, Homo sapiens
aaggatgtgattgtg

SEQ ID NO: 1298466 - DNA, 15 bp, Homo sapiens
aaggcaaaaatgtaa

SEQ ID NO: 1298467 - DNA, 24 bp, Homo sapiens
aaggccataaaacaggtaatataa

SEQ ID NO: 1298468 - DNA, 12 bp, Homo sapiens
aagggccagagc

SEQ ID NO: 1298469 - DNA, 17 bp, Homo sapiens
aagggccagagccaggg

SEQ ID NO: 1298470 - DNA, 16 bp, Homo sapiens
aagggttccctcaaga

SEQ ID NO: 1298471 - DNA, 15 bp, Homo sapiens
aaggtttaggctggt

SEQ ID NO: 1298472 - DNA, 12 bp, Homo sapiens
aagtccaatgtg

SEQ ID NO: 1298473 - DNA, 17 bp, Homo sapiens
aagtggtggtaaccctg

SEQ ID NO: 1298474 - DNA, 20 bp, Homo sapiens
aagttactaggtaacttcat

SEQ ID NO: 1298475 - DNA, 22 bp, Homo sapiens
aagttgcagtgagctgatatca

SEQ ID NO: 1298476 - DNA, 16 bp, Homo sapiens
aataaaaataaatttg

SEQ ID NO: 1298477 - DNA, 20 bp, Homo sapiens
aataaaaggaagccaaagag

SEQ ID NO: 1298478 - DNA, 15 bp, Homo sapiens
aataaagccctggga

SEQ ID NO: 1298479 - DNA, 18 bp, Homo sapiens
aataaaggatgtgattgt

SEQ ID NO: 1298480 - DNA, 15 bp, Homo sapiens
aataaatctgaccca

SEQ ID NO: 1298481 - DNA, 21 bp, Homo sapiens
aataaatgtatcttattcaca

SEQ ID NO: 1298482 - DNA, 18 bp, Homo sapiens
aataaatttggttctaat

SEQ ID NO: 1298483 - DNA, 17 bp, Homo sapiens
aataaccggatatatac

SEQ ID NO: 1298484 - DNA, 15 bp, Homo sapiens
agtagaggcttagag

SEQ ID NO: 1298485 - DNA, 13 bp, Homo sapiens
agtataaacaaag

SEQ ID NO: 1298486 - DNA, 19 bp, Homo sapiens
agtataaacaaagttacta

SEQ ID NO: 1298487 - DNA, 16 bp, Homo sapiens
agtcaagctcctcctc

SEQ ID NO: 1298488 - DNA, 20 bp, Homo sapiens
agtcaagctcctcctccctg

SEQ ID NO: 1298489 - DNA, 22 bp, Homo sapiens
agtccgtgctgacagctgctcc

SEQ ID NO: 1298490 - DNA, 19 bp, Homo sapiens
agtcgcatctcagtgcagg

SEQ ID NO: 1298491 - DNA, 20 bp, Homo sapiens
agtctagatggctcctctca

SEQ ID NO: 1298492 - DNA, 17 bp, Homo sapiens
agtcttttgttcgcatg

SEQ ID NO: 1298493 - DNA, 19 bp, Homo sapiens
agtgagggagggctgtcat

SEQ ID NO: 1298494 - DNA, 22 bp, Homo sapiens
agtgcaataaatctgacccagt

SEQ ID NO: 1298495 - DNA, 17 bp, Homo sapiens
agtgcagccgtttgaga

SEQ ID NO: 1298496 - DNA, 20 bp, Homo sapiens
agtgccccattcttttgtaa

SEQ ID NO: 1298497 - DNA, 16 bp, Homo sapiens
agtgtatttttcaata

SEQ ID NO: 1298498 - DNA, 14 bp, Homo sapiens
agtgtccttagaac

SEQ ID NO: 1298499 - DNA, 22 bp, Homo sapiens
agtgtgcactaaggggcccggc

SEQ ID NO: 1298500 - DNA, 21 bp, Homo sapiens
agtgtgtgattttttgcattc

SEQ ID NO: 1298501 - DNA, 20 bp, Homo sapiens
agttaagacatgatttcctt

SEQ ID NO: 1298502 - DNA, 13 bp, Homo sapiens
agttaagacctgg

SEQ ID NO: 1298503 - DNA, 16 bp, Homo sapiens
agttactaggtaactt

SEQ ID NO: 1298504 - DNA, 17 bp, Homo sapiens
agttactaggtaacttc

SEQ ID NO: 1298505 - DNA, 13 bp, Homo sapiens
agttcaatcctac

SEQ ID NO: 1298506 - DNA, 17 bp, Homo sapiens
agttctttgggccagac

SEQ ID NO: 1298507 - DNA, 15 bp, Homo sapiens
agttgatctggaacc

SEQ ID NO: 1298508 - DNA, 23 bp, Homo sapiens
agttgatctggaacccagactca

SEQ ID NO: 1298509 - DNA, 17 bp, Homo sapiens
agttggggtctggcagc

SEQ ID NO: 1298510 - DNA, 21 bp, Homo sapiens
agttggggtctggcagcctcc

SEQ ID NO: 1298511 - DNA, 15 bp, Homo sapiens
agttgggtgagaaca

SEQ ID NO: 1298512 - DNA, 15 bp, Homo sapiens
agtttcatgtacaag

SEQ ID NO: 1298513 - DNA, 21 bp, Homo sapiens
agtttcatgtacaagatgaag

SEQ ID NO: 1298514 - DNA, 11 bp, Homo sapiens
agtttgcttag

SEQ ID NO: 1298515 - DNA, 17 bp, Homo sapiens
ataaaaagcttccatga

SEQ ID NO: 1298516 - DNA, 15 bp, Homo sapiens
ataaaactggctttg

SEQ ID NO: 1298517 - DNA, 15 bp, Homo sapiens
ataaacaaagttact

SEQ ID NO: 1298518 - DNA, 14 bp, Homo sapiens
ataaagcatttata

SEQ ID NO: 1298519 - DNA, 17 bp, Homo sapiens
ataaaggatgtgattgt

SEQ ID NO: 1298520 - DNA, 13 bp, Homo sapiens
ataaattataagt

SEQ ID NO: 1298521 - DNA, 20 bp, Homo sapiens
ataagtggaggcactttagg

SEQ ID NO: 1298522 - DNA, 16 bp, Homo sapiens
ataagtgtatttttca

SEQ ID NO: 1298523 - DNA, 19 bp, Homo sapiens
ataatggggtcctggccat

SEQ ID NO: 1298524 - DNA, 11 bp, Homo sapiens
ataatgtctct

SEQ ID NO: 1298525 - DNA, 20 bp, Homo sapiens
ataatttttttcaatattta

SEQ ID NO: 1298526 - DNA, 17 bp, Homo sapiens
atacaaattagaaaatg

SEQ ID NO: 1298527 - DNA, 17 bp, Homo sapiens
atacatatctttattaa

SEQ ID NO: 1298528 - DNA, 20 bp, Homo sapiens
atacatatctttattaatca

SEQ ID NO: 1298529 - DNA, 17 bp, Homo sapiens
atactctagatgaagtt

SEQ ID NO: 1298530 - DNA, 15 bp, Homo sapiens
atactctttctgtat

SEQ ID NO: 1298531 - DNA, 16 bp, Homo sapiens
atactctttctgtata

SEQ ID NO: 1298532 - DNA, 17 bp, Homo sapiens
atactctttctgtatat

SEQ ID NO: 1298533 - DNA, 22 bp, Homo sapiens
atactctttctgtatatacttt

SEQ ID NO: 1298534 - DNA, 14 bp, Homo sapiens
atactgcaagaaaa

SEQ ID NO: 1298535 - DNA, 16 bp, Homo sapiens
atactgctactgtaat

SEQ ID NO: 1298536 - DNA, 19 bp, Homo sapiens
atactgctactgtaatttt

SEQ ID NO: 1298537 - DNA, 18 bp, Homo sapiens
atacttgaagggccagag

SEQ ID NO: 1298538 - DNA, 22 bp, Homo sapiens
atacttgaagggccagagccag

SEQ ID NO: 1298539 - DNA, 22 bp, Homo sapiens
atagaaataaaggatgtgattg

SEQ ID NO: 1298540 - DNA, 21 bp, Homo sapiens
atagaactcagttttaactag

SEQ ID NO: 1298541 - DNA, 13 bp, Homo sapiens
atagaatatttat

SEQ ID NO: 1298542 - DNA, 22 bp, Homo sapiens
atagaatatttattacctctga

SEQ ID NO: 1298543 - DNA, 16 bp, Homo sapiens
atagatgctggcccag

SEQ ID NO: 1298544 - DNA, 17 bp, Homo sapiens
atagatgctggcccagg

SEQ ID NO: 1298545 - DNA, 20 bp, Homo sapiens
atagatgctggcccagggcc

SEQ ID NO: 1298546 - DNA, 21 bp, Homo sapiens
atagccacatttggaatactt

SEQ ID NO: 1298547 - DNA, 22 bp, Homo sapiens
atagccacatttggaatacttt

SEQ ID NO: 1298548 - DNA, 20 bp, Homo sapiens
atagctccccgcttctgcct

SEQ ID NO: 1298549 - DNA, 22 bp, Homo sapiens
atagtgttctgcaaaaatattt

SEQ ID NO: 1298550 - DNA, 20 bp, Homo sapiens
atatggacacttaatactac

SEQ ID NO: 1298551 - DNA, 13 bp, Homo sapiens
atatggccacagt

SEQ ID NO: 1298552 - DNA, 14 bp, Homo sapiens
atatgttgaatact

SEQ ID NO: 1298553 - DNA, 22 bp, Homo sapiens
atattataatttttttcaatat

SEQ ID NO: 1298554 - DNA, 16 bp, Homo sapiens
atatttattacctctg

SEQ ID NO: 1298555 - DNA, 15 bp, Homo sapiens
atcaacatcttttct

SEQ ID NO: 1298556 - DNA, 20 bp, Homo sapiens
atcaagtatttgggaagtga

SEQ ID NO: 1298557 - DNA, 21 bp, Homo sapiens
atcaagtatttgggaagtgaa

SEQ ID NO: 1298558 - DNA, 14 bp, Homo sapiens
atcacctatttcca

SEQ ID NO: 1298559 - DNA, 15 bp, Homo sapiens
atcacctatttccat

SEQ ID NO: 1298560 - DNA, 19 bp, Homo sapiens
atcactgtctttcctagat

SEQ ID NO: 1298561 - DNA, 16 bp, Homo sapiens
atcagtataaacaaag

SEQ ID NO: 1298562 - DNA, 19 bp, Homo sapiens
atccaaaagaagcccccag

SEQ ID NO: 1298563 - DNA, 20 bp, Homo sapiens
atccaaacttggatttttga

SEQ ID NO: 1298564 - DNA, 16 bp, Homo sapiens
atccaggcagatccag

SEQ ID NO: 1298565 - DNA, 20 bp, Homo sapiens
atccagggacagaggcccca

SEQ ID NO: 1298566 - DNA, 21 bp, Homo sapiens
atccagggacagaggccccag

SEQ ID NO: 1298567 - DNA, 15 bp, Homo sapiens
atccattctttctga

SEQ ID NO: 1298568 - DNA, 15 bp, Homo sapiens
atcccaactgtcttt

SEQ ID NO: 1298569 - DNA, 19 bp, Homo sapiens
atccccaataattgcagaa

SEQ ID NO: 1298570 - DNA, 18 bp, Homo sapiens
atccccgcagtgtgcact

SEQ ID NO: 1298571 - DNA, 18 bp, Homo sapiens
atccctcccccccatgca

SEQ ID NO: 1298572 - DNA, 11 bp, Homo sapiens
atcctccagca

SEQ ID NO: 1298573 - DNA, 14 bp, Homo sapiens
atcctggaggccca

SEQ ID NO: 1298574 - DNA, 20 bp, Homo sapiens
atcctggaggcccagttcac

SEQ ID NO: 1298575 - DNA, 15 bp, Homo sapiens
atcgaaccgttttga

SEQ ID NO: 1298576 - DNA, 23 bp, Homo sapiens
atctattctctccaaaaatgcac

SEQ ID NO: 1298577 - DNA, 14 bp, Homo sapiens
atctattttggatt

SEQ ID NO: 1298578 - DNA, 22 bp, Homo sapiens
atctattttggattgtatattg

SEQ ID NO: 1298579 - DNA, 23 bp, Homo sapiens
atctcatgcccctggctgggacg

SEQ ID NO: 1298580 - DNA, 19 bp, Homo sapiens
atctcccacctagcagcac

SEQ ID NO: 1298581 - DNA, 18 bp, Homo sapiens
atctctaacagctcagga

SEQ ID NO: 1298582 - DNA, 19 bp, Homo sapiens
atctcttagctcccctcca

SEQ ID NO: 1298583 - DNA, 14 bp, Homo sapiens
atctgaccagcagc

SEQ ID NO: 1298584 - DNA, 16 bp, Homo sapiens
atctgaccagcagcgc

SEQ ID NO: 1298585 - DNA, 20 bp, Homo sapiens
atctgaccagcagcgccttt

SEQ ID NO: 1298586 - DNA, 14 bp, Homo sapiens
atctgacccagtgc

SEQ ID NO: 1298587 - DNA, 18 bp, Homo sapiens
atctgctggagtttcatg

SEQ ID NO: 1298588 - DNA, 11 bp, Homo sapiens
atctggaaccc

SEQ ID NO: 1298589 - DNA, 17 bp, Homo sapiens
atctggaacccagactc

SEQ ID NO: 1298590 - DNA, 17 bp, Homo sapiens
atctggaacctcagcct

SEQ ID NO: 1298591 - DNA, 16 bp, Homo sapiens
atctggggctctggga

SEQ ID NO: 1298592 - DNA, 14 bp, Homo sapiens
atctgtcctcagcc

SEQ ID NO: 1298593 - DNA, 15 bp, Homo sapiens
atctgtcctcagcct

SEQ ID NO: 1298594 - DNA, 17 bp, Homo sapiens
atctgttttgaaggcaa

SEQ ID NO: 1298595 - DNA, 18 bp, Homo sapiens
atctgttttgaaggcaaa

SEQ ID NO: 1298596 - DNA, 20 bp, Homo sapiens
atcttatcatggtctcagtc

SEQ ID NO: 1298597 - DNA, 22 bp, Homo sapiens
atcttattagggagaaaattca

SEQ ID NO: 1298598 - DNA, 12 bp, Homo sapiens
atcttgaaatta

SEQ ID NO: 1298599 - DNA, 21 bp, Homo sapiens
atcttgaaattaagaaggcaa

SEQ ID NO: 1298600 - DNA, 14 bp, Homo sapiens
atcttgtctctggg

SEQ ID NO: 1298601 - DNA, 17 bp, Homo sapiens
atctttacaaaactaca

SEQ ID NO: 1298602 - DNA, 16 bp, Homo sapiens
agaggctgaggctggc

SEQ ID NO: 1298603 - DNA, 18 bp, Homo sapiens
agagggaggcaagccctg

SEQ ID NO: 1298604 - DNA, 13 bp, Homo sapiens
agagggaggggcc

SEQ ID NO: 1298605 - DNA, 20 bp, Homo sapiens
agagggaggggcctaggcct

SEQ ID NO: 1298606 - DNA, 17 bp, Homo sapiens
agagtagaattgcattg

SEQ ID NO: 1298607 - DNA, 13 bp, Homo sapiens
agagtttcctgaa

SEQ ID NO: 1298608 - DNA, 18 bp, Homo sapiens
agataagtgtatttttca

SEQ ID NO: 1298609 - DNA, 20 bp, Homo sapiens
agataagtgtatttttcaat

SEQ ID NO: 1298610 - DNA, 13 bp, Homo sapiens
agatccaggacta

SEQ ID NO: 1298611 - DNA, 19 bp, Homo sapiens
agatccagggacagaggcc

SEQ ID NO: 1298612 - DNA, 16 bp, Homo sapiens
agatccagggactgaa

SEQ ID NO: 1298613 - DNA, 14 bp, Homo sapiens
agatctggaacctc

SEQ ID NO: 1298614 - DNA, 15 bp, Homo sapiens
agatctggaacctca

SEQ ID NO: 1298615 - DNA, 20 bp, Homo sapiens
agatctggaacctcagcctg

SEQ ID NO: 1298616 - DNA, 16 bp, Homo sapiens
agatgaaggagaggca

SEQ ID NO: 1298617 - DNA, 15 bp, Homo sapiens
agatgaagttttaca

SEQ ID NO: 1298618 - DNA, 19 bp, Homo sapiens
agatgaagttttacattgt

SEQ ID NO: 1298619 - DNA, 16 bp, Homo sapiens
agatgatggatgccaa

SEQ ID NO: 1298620 - DNA, 14 bp, Homo sapiens
agatgctggcccag

SEQ ID NO: 1298621 - DNA, 15 bp, Homo sapiens
agatgctggcccagg

SEQ ID NO: 1298622 - DNA, 22 bp, Homo sapiens
agatggaagttgcagtgagctg

SEQ ID NO: 1298623 - DNA, 23 bp, Homo sapiens
agatggaagttgcagtgagctga

SEQ ID NO: 1298624 - DNA, 13 bp, Homo sapiens
agatggattctcc

SEQ ID NO: 1298625 - DNA, 18 bp, Homo sapiens
agatggattctccactca

SEQ ID NO: 1298626 - DNA, 14 bp, Homo sapiens
agatggcagtcact

SEQ ID NO: 1298627 - DNA, 15 bp, Homo sapiens
agatggctcctctca

SEQ ID NO: 1298628 - DNA, 14 bp, Homo sapiens
agatggtgctgaga

SEQ ID NO: 1298629 - DNA, 17 bp, Homo sapiens
agatggtgctgagaagc

SEQ ID NO: 1298630 - DNA, 14 bp, Homo sapiens
agatgtttccagac

SEQ ID NO: 1298631 - DNA, 13 bp, Homo sapiens
agatttcatctgc

SEQ ID NO: 1298632 - DNA, 15 bp, Homo sapiens
agatttcatctgctc

SEQ ID NO: 1298633 - DNA, 21 bp, Homo sapiens
agatttcatctgctctccttc

SEQ ID NO: 1298634 - DNA, 21 bp, Homo sapiens
agattttaattttgaataaat

SEQ ID NO: 1298635 - DNA, 23 bp, Homo sapiens
agcacagcagcctggggctggcc

SEQ ID NO: 1298636 - DNA, 15 bp, Homo sapiens
agcaccgttctgtgc

SEQ ID NO: 1298637 - DNA, 17 bp, Homo sapiens
agcaccgttctgtgcac

SEQ ID NO: 1298638 - DNA, 14 bp, Homo sapiens
agcactgaggaaga

SEQ ID NO: 1298639 - DNA, 16 bp, Homo sapiens
agcacttgtccagctg

SEQ ID NO: 1298640 - DNA, 16 bp, Homo sapiens
agcactttgggaggct

SEQ ID NO: 1298641 - DNA, 23 bp, Homo sapiens
agcagaagggggtggtgtctcca

SEQ ID NO: 1298642 - DNA, 13 bp, Homo sapiens
agcagattttaat

SEQ ID NO: 1298643 - DNA, 20 bp, Homo sapiens
agcagcaccgttctgtgcac

SEQ ID NO: 1298644 - DNA, 22 bp, Homo sapiens
agcagctggtaatcttgctctg

SEQ ID NO: 1298645 - DNA, 22 bp, Homo sapiens
agcagggatgccctggaggtgg

SEQ ID NO: 1298646 - DNA, 17 bp, Homo sapiens
agcaggttcccaagctc

SEQ ID NO: 1298647 - DNA, 21 bp, Homo sapiens
agcagttttcaagtcaaatta

SEQ ID NO: 1298648 - DNA, 14 bp, Homo sapiens
agcatgacatttct

SEQ ID NO: 1298649 - DNA, 15 bp, Homo sapiens
agcatgacatttctt

SEQ ID NO: 1298650 - DNA, 20 bp, Homo sapiens
agcatttcgcgatggacaga

SEQ ID NO: 1298651 - DNA, 18 bp, Homo sapiens
agccaacacgcacctgcc

SEQ ID NO: 1298652 - DNA, 16 bp, Homo sapiens
agccaattcagacagg

SEQ ID NO: 1298653 - DNA, 17 bp, Homo sapiens
agccaattcagacaggc

SEQ ID NO: 1298654 - DNA, 13 bp, Homo sapiens
agccacaggcctg

SEQ ID NO: 1298655 - DNA, 17 bp, Homo sapiens
agccacaggcctgagat

SEQ ID NO: 1298656 - DNA, 21 bp, Homo sapiens
agccacaggcctgagatttca

SEQ ID NO: 1298657 - DNA, 23 bp, Homo sapiens
agccacaggcctgagatttcatc

SEQ ID NO: 1298658 - DNA, 15 bp, Homo sapiens
agccacatttggaat

SEQ ID NO: 1298659 - DNA, 21 bp, Homo sapiens
agccacatttggaatactttt

SEQ ID NO: 1298660 - DNA, 15 bp, Homo sapiens
agccaccgaagccgc

SEQ ID NO: 1298661 - DNA, 15 bp, Homo sapiens
agccagcacacaggg

SEQ ID NO: 1298662 - DNA, 18 bp, Homo sapiens
agccagcacacagggcag

SEQ ID NO: 1298663 - DNA, 20 bp, Homo sapiens
agccagcacttgtccagctg

SEQ ID NO: 1298664 - DNA, 19 bp, Homo sapiens
agccagctccctctattta

SEQ ID NO: 1298665 - DNA, 22 bp, Homo sapiens
agccagctccctctatttatgt

SEQ ID NO: 1298666 - DNA, 19 bp, Homo sapiens
agccaggaatttcccagga

SEQ ID NO: 1298667 - DNA, 22 bp, Homo sapiens
agccaggaatttcccaggaccc

SEQ ID NO: 1298668 - DNA, 15 bp, Homo sapiens
agccaggccccaggc

SEQ ID NO: 1298669 - DNA, 14 bp, Homo sapiens
agccatcaaaatgc

SEQ ID NO: 1298670 - DNA, 18 bp, Homo sapiens
agccatcaaaatgctttt

SEQ ID NO: 1298671 - DNA, 14 bp, Homo sapiens
agccatgtctgcat

SEQ ID NO: 1298672 - DNA, 16 bp, Homo sapiens
agcccaatattataat

SEQ ID NO: 1298673 - DNA, 15 bp, Homo sapiens
agcccactgtcctgg

SEQ ID NO: 1298674 - DNA, 17 bp, Homo sapiens
agcccactgtcctgggc

SEQ ID NO: 1298675 - DNA, 19 bp, Homo sapiens
agcccactgtcctgggcct

SEQ ID NO: 1298676 - DNA, 20 bp, Homo sapiens
agcccactgtcctgggcctg

SEQ ID NO: 1298677 - DNA, 12 bp, Homo sapiens
agcccagagaca

SEQ ID NO: 1298678 - DNA, 22 bp, Homo sapiens
agcccagagacatacttgaagg

SEQ ID NO: 1298679 - DNA, 14 bp, Homo sapiens
agcccagaggaggg

SEQ ID NO: 1298680 - DNA, 12 bp, Homo sapiens
agcccagctcca

SEQ ID NO: 1298681 - DNA, 15 bp, Homo sapiens
agcccagctgggtca

SEQ ID NO: 1298682 - DNA, 20 bp, Homo sapiens
agcccagctgggtcaggcag

SEQ ID NO: 1298683 - DNA, 19 bp, Homo sapiens
agcccccaccgtgggcagg

SEQ ID NO: 1298684 - DNA, 15 bp, Homo sapiens
agccccctggcctct

SEQ ID NO: 1298685 - DNA, 22 bp, Homo sapiens
agccccttctgctcagctctgg

SEQ ID NO: 1298686 - DNA, 17 bp, Homo sapiens
agccccttgagaaacct

SEQ ID NO: 1298687 - DNA, 19 bp, Homo sapiens
agccctccccatggagcca

SEQ ID NO: 1298688 - DNA, 21 bp, Homo sapiens
agccctccccatggagccagc

SEQ ID NO: 1298689 - DNA, 13 bp, Homo sapiens
agccctgaccctg

SEQ ID NO: 1298690 - DNA, 16 bp, Homo sapiens
agccctgggatcactg

SEQ ID NO: 1298691 - DNA, 18 bp, Homo sapiens
agccctgggatcactgtg

SEQ ID NO: 1298692 - DNA, 20 bp, Homo sapiens
agccctgttgacacaggtct

SEQ ID NO: 1298693 - DNA, 18 bp, Homo sapiens
agcctcccatccagggcc

SEQ ID NO: 1298694 - DNA, 13 bp, Homo sapiens
agcctccctgaag

SEQ ID NO: 1298695 - DNA, 15 bp, Homo sapiens
agcctccctgaagcc

SEQ ID NO: 1298696 - DNA, 22 bp, Homo sapiens
agcctgaaggggcgtctgttcc

SEQ ID NO: 1298697 - DNA, 16 bp, Homo sapiens
agcctgagcaactctt

SEQ ID NO: 1298698 - DNA, 16 bp, Homo sapiens
agcctgagtcacctgc

SEQ ID NO: 1298699 - DNA, 21 bp, Homo sapiens
agcctgcgccaccgcccagag

SEQ ID NO: 1298700 - DNA, 21 bp, Homo sapiens
agcctggccagacacaggccc

SEQ ID NO: 1298701 - DNA, 22 bp, Homo sapiens
agcctggccagacacaggccct

SEQ ID NO: 1298702 - DNA, 14 bp, Homo sapiens
agcctggggctggc

SEQ ID NO: 1298703 - DNA, 15 bp, Homo sapiens
agcctggggtctgga

SEQ ID NO: 1298704 - DNA, 20 bp, Homo sapiens
agcctggggtggggtcatgc

SEQ ID NO: 1298705 - DNA, 17 bp, Homo sapiens
agccttgccagagatcc

SEQ ID NO: 1298706 - DNA, 12 bp, Homo sapiens
agcgccaggctg

SEQ ID NO: 1298707 - DNA, 21 bp, Homo sapiens
agcgccaggctgaccacagca

SEQ ID NO: 1298708 - DNA, 20 bp, Homo sapiens
agcgcctttcccaactctag

SEQ ID NO: 1298709 - DNA, 21 bp, Homo sapiens
agcgctcctgccgcagagctg

SEQ ID NO: 1298710 - DNA, 22 bp, Homo sapiens
agcggccggccagcccctggcc

SEQ ID NO: 1298711 - DNA, 17 bp, Homo sapiens
agctaaacggattccaa

SEQ ID NO: 1298712 - DNA, 14 bp, Homo sapiens
agctaagaaaagat

SEQ ID NO: 1298713 - DNA, 12 bp, Homo sapiens
agctaagaacct

SEQ ID NO: 1298714 - DNA, 20 bp, Homo sapiens
agctaatttgcattaaattc

SEQ ID NO: 1298715 - DNA, 18 bp, Homo sapiens
aatattttctttaatgct

SEQ ID NO: 1298716 - DNA, 23 bp, Homo sapiens
aatcagaactcaaatggggccag

SEQ ID NO: 1298717 - DNA, 14 bp, Homo sapiens
aatccaaacttgga

SEQ ID NO: 1298718 - DNA, 21 bp, Homo sapiens
aatccaaacttggatttttga

SEQ ID NO: 1298719 - DNA, 17 bp, Homo sapiens
aatccaggcagatccag

SEQ ID NO: 1298720 - DNA, 18 bp, Homo sapiens
aatccaggcagatccagg

SEQ ID NO: 1298721 - DNA, 21 bp, Homo sapiens
aatccaggcagatccaggact

SEQ ID NO: 1298722 - DNA, 18 bp, Homo sapiens
aatcccaaatttgattga

SEQ ID NO: 1298723 - DNA, 23 bp, Homo sapiens
aatccctttattaccccctcctt

SEQ ID NO: 1298724 - DNA, 15 bp, Homo sapiens
aatcctacctgtttt

SEQ ID NO: 1298725 - DNA, 17 bp, Homo sapiens
aatctactaattccaca

SEQ ID NO: 1298726 - DNA, 12 bp, Homo sapiens
aatctgacccag

SEQ ID NO: 1298727 - DNA, 13 bp, Homo sapiens
aatctgacccagt

SEQ ID NO: 1298728 - DNA, 23 bp, Homo sapiens
aatcttttacaactgcctcgaaa

SEQ ID NO: 1298729 - DNA, 15 bp, Homo sapiens
aatgaacactctttt

SEQ ID NO: 1298730 - DNA, 19 bp, Homo sapiens
aatgcatgattttgtaacc

SEQ ID NO: 1298731 - DNA, 23 bp, Homo sapiens
aatgctgtacatctattttggat

SEQ ID NO: 1298732 - DNA, 19 bp, Homo sapiens
aatgctttttatttctgca

SEQ ID NO: 1298733 - DNA, 19 bp, Homo sapiens
aatggacataggactcaaa

SEQ ID NO: 1298734 - DNA, 12 bp, Homo sapiens
aatggggccaga

SEQ ID NO: 1298735 - DNA, 17 bp, Homo sapiens
aatggggtcctggccat

SEQ ID NO: 1298736 - DNA, 17 bp, Homo sapiens
aatggtttaacttctgc

SEQ ID NO: 1298737 - DNA, 21 bp, Homo sapiens
aatgtaaaggagtcaaaacta

SEQ ID NO: 1298738 - DNA, 14 bp, Homo sapiens
aatgtctattaagg

SEQ ID NO: 1298739 - DNA, 15 bp, Homo sapiens
aatgtgaactttatt

SEQ ID NO: 1298740 - DNA, 15 bp, Homo sapiens
aatgttacattgttt

SEQ ID NO: 1298741 - DNA, 14 bp, Homo sapiens
aatgttttaaattc

SEQ ID NO: 1298742 - DNA, 17 bp, Homo sapiens
aattaaattttgtgtct

SEQ ID NO: 1298743 - DNA, 14 bp, Homo sapiens
aattaagaaggcaa

SEQ ID NO: 1298744 - DNA, 15 bp, Homo sapiens
aattaataatcttat

SEQ ID NO: 1298745 - DNA, 13 bp, Homo sapiens
aattactcaggaa

SEQ ID NO: 1298746 - DNA, 20 bp, Homo sapiens
aattcaaactggggcctcca

SEQ ID NO: 1298747 - DNA, 14 bp, Homo sapiens
aattcaattgtaaa

SEQ ID NO: 1298748 - DNA, 14 bp, Homo sapiens
aattcacaaacttt

SEQ ID NO: 1298749 - DNA, 16 bp, Homo sapiens
aattccacacctttta

SEQ ID NO: 1298750 - DNA, 13 bp, Homo sapiens
aattcctctggga

SEQ ID NO: 1298751 - DNA, 14 bp, Homo sapiens
aattcctctgggaa

SEQ ID NO: 1298752 - DNA, 14 bp, Homo sapiens
aattgatttgcatt

SEQ ID NO: 1298753 - DNA, 20 bp, Homo sapiens
aattgatttgcattgaacac

SEQ ID NO: 1298754 - DNA, 18 bp, Homo sapiens
aattgcaaatcttgaaat

SEQ ID NO: 1298755 - DNA, 14 bp, Homo sapiens
aattgcagaactaa

SEQ ID NO: 1298756 - DNA, 11 bp, Homo sapiens
aattgctttga

SEQ ID NO: 1298757 - DNA, 18 bp, Homo sapiens
aatttattaattgctttg

SEQ ID NO: 1298758 - DNA, 19 bp, Homo sapiens
aatttattaattgctttga

SEQ ID NO: 1298759 - DNA, 12 bp, Homo sapiens
aatttcaaaatg

SEQ ID NO: 1298760 - DNA, 16 bp, Homo sapiens
aatttcaaaatgcttt

SEQ ID NO: 1298761 - DNA, 14 bp, Homo sapiens
aatttcccaggacc

SEQ ID NO: 1298762 - DNA, 15 bp, Homo sapiens
aatttcccaggaccc

SEQ ID NO: 1298763 - DNA, 13 bp, Homo sapiens
aatttctattaaa

SEQ ID NO: 1298764 - DNA, 12 bp, Homo sapiens
aatttgattgat

SEQ ID NO: 1298765 - DNA, 23 bp, Homo sapiens
aatttgcattaaattcacaaact

SEQ ID NO: 1298766 - DNA, 16 bp, Homo sapiens
aatttggttctaatag

SEQ ID NO: 1298767 - DNA, 21 bp, Homo sapiens
aattttgaataaataaatgta

SEQ ID NO: 1298768 - DNA, 14 bp, Homo sapiens
aatttttgtaattt

SEQ ID NO: 1298769 - DNA, 14 bp, Homo sapiens
acaaaaattaggta

SEQ ID NO: 1298770 - DNA, 11 bp, Homo sapiens
acaaaacttcc

SEQ ID NO: 1298771 - DNA, 14 bp, Homo sapiens
acaaaatttctatt

SEQ ID NO: 1298772 - DNA, 18 bp, Homo sapiens
acaaacaaaatttctatt

SEQ ID NO: 1298773 - DNA, 13 bp, Homo sapiens
acaaactgtaaat

SEQ ID NO: 1298774 - DNA, 14 bp, Homo sapiens
acaaagcagccacg

SEQ ID NO: 1298775 - DNA, 11 bp, Homo sapiens
acaaagcccaa

SEQ ID NO: 1298776 - DNA, 23 bp, Homo sapiens
acaaatactcttaggaagagaaa

SEQ ID NO: 1298777 - DNA, 15 bp, Homo sapiens
acaaatggacatagg

SEQ ID NO: 1298778 - DNA, 22 bp, Homo sapiens
acaaattagaaaatgttattta

SEQ ID NO: 1298779 - DNA, 18 bp, Homo sapiens
acaacctgaacctaggag

SEQ ID NO: 1298780 - DNA, 17 bp, Homo sapiens
acaactatggatcagaa

SEQ ID NO: 1298781 - DNA, 17 bp, Homo sapiens
acaactttaagaggaca

SEQ ID NO: 1298782 - DNA, 22 bp, Homo sapiens
acaaggatagatgctggcccag

SEQ ID NO: 1298783 - DNA, 18 bp, Homo sapiens
acaaggccatctgggctc

SEQ ID NO: 1298784 - DNA, 19 bp, Homo sapiens
acaagtggactcagggcag

SEQ ID NO: 1298785 - DNA, 17 bp, Homo sapiens
acaatgctgatttggtg

SEQ ID NO: 1298786 - DNA, 12 bp, Homo sapiens
acaatgtgaact

SEQ ID NO: 1298787 - DNA, 17 bp, Homo sapiens
acaatgtgaactttatt

SEQ ID NO: 1298788 - DNA, 14 bp, Homo sapiens
acacaaactgtaaa

SEQ ID NO: 1298789 - DNA, 16 bp, Homo sapiens
acacaaactgtaaata

SEQ ID NO: 1298790 - DNA, 23 bp, Homo sapiens
acacaaggatagatgctggccca

SEQ ID NO: 1298791 - DNA, 17 bp, Homo sapiens
acacactgatgcttaga

SEQ ID NO: 1298792 - DNA, 18 bp, Homo sapiens
acacagaaaatgttgaga

SEQ ID NO: 1298793 - DNA, 14 bp, Homo sapiens
acacaggtctttcc

SEQ ID NO: 1298794 - DNA, 16 bp, Homo sapiens
acacaggtctttccta

SEQ ID NO: 1298795 - DNA, 16 bp, Homo sapiens
acaccagcattccttt

SEQ ID NO: 1298796 - DNA, 19 bp, Homo sapiens
acaccagcattccttttga

SEQ ID NO: 1298797 - DNA, 18 bp, Homo sapiens
acaccctcaacctcttct

SEQ ID NO: 1298798 - DNA, 21 bp, Homo sapiens
acaccttttattgacacagaa

SEQ ID NO: 1298799 - DNA, 23 bp, Homo sapiens
acaccttttattgacacagaaaa

SEQ ID NO: 1298800 - DNA, 14 bp, Homo sapiens
acacgcacctgcct

SEQ ID NO: 1298801 - DNA, 17 bp, Homo sapiens
acacgcacctgcctcag

SEQ ID NO: 1298802 - DNA, 18 bp, Homo sapiens
acacggagcccagccctc

SEQ ID NO: 1298803 - DNA, 12 bp, Homo sapiens
acacggccacat

SEQ ID NO: 1298804 - DNA, 20 bp, Homo sapiens
acacggccacatcaaagagg

SEQ ID NO: 1298805 - DNA, 21 bp, Homo sapiens
acactcttttgctttattcca

SEQ ID NO: 1298806 - DNA, 21 bp, Homo sapiens
acactgctgctccagtgcagg

SEQ ID NO: 1298807 - DNA, 14 bp, Homo sapiens
acacttaatactac

SEQ ID NO: 1298808 - DNA, 15 bp, Homo sapiens
acagaaaccttttta

SEQ ID NO: 1298809 - DNA, 22 bp, Homo sapiens
acagaatactgttaaaggaaaa

SEQ ID NO: 1298810 - DNA, 14 bp, Homo sapiens
acagatctggaacc

SEQ ID NO: 1298811 - DNA, 20 bp, Homo sapiens
acagatctggaacctcagcc

SEQ ID NO: 1298812 - DNA, 21 bp, Homo sapiens
acagatctggaacctcagcct

SEQ ID NO: 1298813 - DNA, 22 bp, Homo sapiens
acagcagcctggggctggcctc

SEQ ID NO: 1298814 - DNA, 22 bp, Homo sapiens
acagccaacacgcacctgcctc

SEQ ID NO: 1298815 - DNA, 21 bp, Homo sapiens
acagctcaggatctcttagca

SEQ ID NO: 1298816 - DNA, 16 bp, Homo sapiens
acagctgaattatcta

SEQ ID NO: 1298817 - DNA, 22 bp, Homo sapiens
acagctgctcctagagggaggg

SEQ ID NO: 1298818 - DNA, 23 bp, Homo sapiens
acagctgctcctagagggagggg

SEQ ID NO: 1298819 - DNA, 21 bp, Homo sapiens
acagctttgctgctgaaggct

SEQ ID NO: 1298820 - DNA, 14 bp, Homo sapiens
acaggagacctggc

SEQ ID NO: 1298821 - DNA, 21 bp, Homo sapiens
acaggcctgagatttcatctg

SEQ ID NO: 1298822 - DNA, 23 bp, Homo sapiens
acagtagtcttgatgaccaaagt

SEQ ID NO: 1298823 - DNA, 14 bp, Homo sapiens
atctttattaatca

SEQ ID NO: 1298824 - DNA, 15 bp, Homo sapiens
atctttgattctcct

SEQ ID NO: 1298825 - DNA, 15 bp, Homo sapiens
atctttgtggccaag

SEQ ID NO: 1298826 - DNA, 19 bp, Homo sapiens
atctttgtggccaaggagc

SEQ ID NO: 1298827 - DNA, 21 bp, Homo sapiens
atgaaggagaggcaacatcca

SEQ ID NO: 1298828 - DNA, 16 bp, Homo sapiens
atgaatgagaatctac

SEQ ID NO: 1298829 - DNA, 22 bp, Homo sapiens
atgacatttctttgtgctttgg

SEQ ID NO: 1298830 - DNA, 16 bp, Homo sapiens
atgagaaggaacttcc

SEQ ID NO: 1298831 - DNA, 15 bp, Homo sapiens
atgatacatccaaag

SEQ ID NO: 1298832 - DNA, 19 bp, Homo sapiens
atgatggatgccaatatta

SEQ ID NO: 1298833 - DNA, 19 bp, Homo sapiens
atgatgtgtacccaaacgt

SEQ ID NO: 1298834 - DNA, 20 bp, Homo sapiens
atgcactgtgaaggaccctt

SEQ ID NO: 1298835 - DNA, 13 bp, Homo sapiens
atgcagggcagtc

SEQ ID NO: 1298836 - DNA, 16 bp, Homo sapiens
atgcatggtgccccag

SEQ ID NO: 1298837 - DNA, 18 bp, Homo sapiens
atgcatggtgccccagga

SEQ ID NO: 1298838 - DNA, 17 bp, Homo sapiens
atgccaatattaaatct

SEQ ID NO: 1298839 - DNA, 16 bp, Homo sapiens
atgccacaaggacttc

SEQ ID NO: 1298840 - DNA, 20 bp, Homo sapiens
atgcccctgtactccagcct

SEQ ID NO: 1298841 - DNA, 17 bp, Homo sapiens
atgcccggctaattttt

SEQ ID NO: 1298842 - DNA, 14 bp, Homo sapiens
atgccctcctctcc

SEQ ID NO: 1298843 - DNA, 15 bp, Homo sapiens
atgccctcctctccc

SEQ ID NO: 1298844 - DNA, 13 bp, Homo sapiens
atgccctgtgcaa

SEQ ID NO: 1298845 - DNA, 14 bp, Homo sapiens
atgcggtagccagc

SEQ ID NO: 1298846 - DNA, 22 bp, Homo sapiens
atgctgacattcacctgcccca

SEQ ID NO: 1298847 - DNA, 19 bp, Homo sapiens
atgctgcaggacttgagaa

SEQ ID NO: 1298848 - DNA, 15 bp, Homo sapiens
atgctggcccagggc

SEQ ID NO: 1298849 - DNA, 23 bp, Homo sapiens
atgctgtacatctattttggatt

SEQ ID NO: 1298850 - DNA, 22 bp, Homo sapiens
atgcttttatatttttttaaaa

SEQ ID NO: 1298851 - DNA, 18 bp, Homo sapiens
atggaacctgacgtagct

SEQ ID NO: 1298852 - DNA, 21 bp, Homo sapiens
atggaacctgacgtagctgca

SEQ ID NO: 1298853 - DNA, 19 bp, Homo sapiens
atggaattgatttgcattg

SEQ ID NO: 1298854 - DNA, 19 bp, Homo sapiens
atggagattcagttttcat

SEQ ID NO: 1298855 - DNA, 20 bp, Homo sapiens
atggagattcagttttcatt

SEQ ID NO: 1298856 - DNA, 22 bp, Homo sapiens
atggatgccaatattaaatctg

SEQ ID NO: 1298857 - DNA, 23 bp, Homo sapiens
atggatgccaatattaaatctgc

SEQ ID NO: 1298858 - DNA, 14 bp, Homo sapiens
atggcaacagatct

SEQ ID NO: 1298859 - DNA, 15 bp, Homo sapiens
atggcaacagatctg

SEQ ID NO: 1298860 - DNA, 13 bp, Homo sapiens
atgggaaagtatt

SEQ ID NO: 1298861 - DNA, 19 bp, Homo sapiens
atggggccagatccagcct

SEQ ID NO: 1298862 - DNA, 21 bp, Homo sapiens
atggggccagatccagcctgg

SEQ ID NO: 1298863 - DNA, 22 bp, Homo sapiens
atggggccagatccagcctggg

SEQ ID NO: 1298864 - DNA, 18 bp, Homo sapiens
atgggggaactcagatcc

SEQ ID NO: 1298865 - DNA, 17 bp, Homo sapiens
atggggtcctggccatc

SEQ ID NO: 1298866 - DNA, 14 bp, Homo sapiens
atggtcacacactg

SEQ ID NO: 1298867 - DNA, 16 bp, Homo sapiens
atggtgccccaggacc

SEQ ID NO: 1298868 - DNA, 17 bp, Homo sapiens
atggtgccccaggacca

SEQ ID NO: 1298869 - DNA, 18 bp, Homo sapiens
atggtgccccaggaccag

SEQ ID NO: 1298870 - DNA, 19 bp, Homo sapiens
atggtgccccaggaccagc

SEQ ID NO: 1298871 - DNA, 12 bp, Homo sapiens
atggtgctgaga

SEQ ID NO: 1298872 - DNA, 13 bp, Homo sapiens
atggtgctgagaa

SEQ ID NO: 1298873 - DNA, 20 bp, Homo sapiens
atgtaaaggagtcaaaacta

SEQ ID NO: 1298874 - DNA, 20 bp, Homo sapiens
atgtaattgtttgtctttaa

SEQ ID NO: 1298875 - DNA, 15 bp, Homo sapiens
atgtacatgagaagg

SEQ ID NO: 1298876 - DNA, 23 bp, Homo sapiens
atgtaggagctgccttggctcag

SEQ ID NO: 1298877 - DNA, 13 bp, Homo sapiens
atgtagtaattga

SEQ ID NO: 1298878 - DNA, 18 bp, Homo sapiens
atgtagtaattgacatgt

SEQ ID NO: 1298879 - DNA, 23 bp, Homo sapiens
atgtctctgtgagactcgagaac

SEQ ID NO: 1298880 - DNA, 14 bp, Homo sapiens
atgtctgcatttcg

SEQ ID NO: 1298881 - DNA, 15 bp, Homo sapiens
atgtgaactttatta

SEQ ID NO: 1298882 - DNA, 14 bp, Homo sapiens
atgtgattgtggaa

SEQ ID NO: 1298883 - DNA, 15 bp, Homo sapiens
atgtgattgtggaat

SEQ ID NO: 1298884 - DNA, 18 bp, Homo sapiens
atgtggcaaggaaaaaca

SEQ ID NO: 1298885 - DNA, 16 bp, Homo sapiens
atgtggcttgagaaat

SEQ ID NO: 1298886 - DNA, 21 bp, Homo sapiens
atgtggcttgagaaatatgga

SEQ ID NO: 1298887 - DNA, 14 bp, Homo sapiens
atgttacattgttt

SEQ ID NO: 1298888 - DNA, 13 bp, Homo sapiens
atgttatttaaca

SEQ ID NO: 1298889 - DNA, 15 bp, Homo sapiens
atgttgaatactttt

SEQ ID NO: 1298890 - DNA, 19 bp, Homo sapiens
atgttgaatactttttaca

SEQ ID NO: 1298891 - DNA, 22 bp, Homo sapiens
atgttgagaatcccaaatttga

SEQ ID NO: 1298892 - DNA, 16 bp, Homo sapiens
attaaattcacaaact

SEQ ID NO: 1298893 - DNA, 17 bp, Homo sapiens
attaaattcacaaactt

SEQ ID NO: 1298894 - DNA, 15 bp, Homo sapiens
attaagaaggcaaaa

SEQ ID NO: 1298895 - DNA, 13 bp, Homo sapiens
attaataatctta

SEQ ID NO: 1298896 - DNA, 14 bp, Homo sapiens
attaatatgaaaac

SEQ ID NO: 1298897 - DNA, 16 bp, Homo sapiens
attaatcactattgtt

SEQ ID NO: 1298898 - DNA, 12 bp, Homo sapiens
attaattgcttt

SEQ ID NO: 1298899 - DNA, 20 bp, Homo sapiens
attacaggcacctgccacca

SEQ ID NO: 1298900 - DNA, 22 bp, Homo sapiens
attacaggcacctgccaccatg

SEQ ID NO: 1298901 - DNA, 21 bp, Homo sapiens
attaccccctccttcagacac

SEQ ID NO: 1298902 - DNA, 13 bp, Homo sapiens
attagaaaatgtt

SEQ ID NO: 1298903 - DNA, 13 bp, Homo sapiens
attagaatagtgt

SEQ ID NO: 1298904 - DNA, 16 bp, Homo sapiens
attagggagaaaattc

SEQ ID NO: 1298905 - DNA, 18 bp, Homo sapiens
attagggagaaaattcaa

SEQ ID NO: 1298906 - DNA, 13 bp, Homo sapiens
attaggtattttg

SEQ ID NO: 1298907 - DNA, 23 bp, Homo sapiens
attataatttttttcaatattta

SEQ ID NO: 1298908 - DNA, 22 bp, Homo sapiens
attatctatacatatctttatt

SEQ ID NO: 1298909 - DNA, 22 bp, Homo sapiens
attcaaactggggcctccagaa

SEQ ID NO: 1298910 - DNA, 21 bp, Homo sapiens
attcaattgtaaattgaatca

SEQ ID NO: 1298911 - DNA, 22 bp, Homo sapiens
attcaattgtaaattgaatcag

SEQ ID NO: 1298912 - DNA, 17 bp, Homo sapiens
attcacaaacttttata

SEQ ID NO: 1298913 - DNA, 22 bp, Homo sapiens
attcacagttctttgggccaga

SEQ ID NO: 1298914 - DNA, 23 bp, Homo sapiens
attcacagttctttgggccagac

SEQ ID NO: 1298915 - DNA, 23 bp, Homo sapiens
attcaccttccagtgtctcggag

SEQ ID NO: 1298916 - DNA, 21 bp, Homo sapiens
attcaggaatgtgtggcctgc

SEQ ID NO: 1298917 - DNA, 15 bp, Homo sapiens
attcagttttcattt

SEQ ID NO: 1298918 - DNA, 17 bp, Homo sapiens
caactatggatcagaat

SEQ ID NO: 1298919 - DNA, 23 bp, Homo sapiens
caactgcctcgaaacacagaaac

SEQ ID NO: 1298920 - DNA, 16 bp, Homo sapiens
caactttaagaggaca

SEQ ID NO: 1298921 - DNA, 19 bp, Homo sapiens
caagaaataaaaggaagcc

SEQ ID NO: 1298922 - DNA, 18 bp, Homo sapiens
caagatgaaggagaggca

SEQ ID NO: 1298923 - DNA, 12 bp, Homo sapiens
caagcacagcag

SEQ ID NO: 1298924 - DNA, 21 bp, Homo sapiens
caagcagcctgagcaactctt

SEQ ID NO: 1298925 - DNA, 14 bp, Homo sapiens
caaggacttcctgt

SEQ ID NO: 1298926 - DNA, 23 bp, Homo sapiens
caaggacttcctgtccagctcca

SEQ ID NO: 1298927 - DNA, 16 bp, Homo sapiens
caaggatagatgctgg

SEQ ID NO: 1298928 - DNA, 14 bp, Homo sapiens
caaggccatctggg

SEQ ID NO: 1298929 - DNA, 17 bp, Homo sapiens
caaggccatctgggctc

SEQ ID NO: 1298930 - DNA, 16 bp, Homo sapiens
caaggctgcttagaat

SEQ ID NO: 1298931 - DNA, 21 bp, Homo sapiens
caagggatctggtcctaccca

SEQ ID NO: 1298932 - DNA, 17 bp, Homo sapiens
caaggtttaggctggtg

SEQ ID NO: 1298933 - DNA, 19 bp, Homo sapiens
caagtatttgggaagtgaa

SEQ ID NO: 1298934 - DNA, 16 bp, Homo sapiens
caagtcaaattaataa

SEQ ID NO: 1298935 - DNA, 23 bp, Homo sapiens
caagtggactcagggcagcgcca

SEQ ID NO: 1298936 - DNA, 20 bp, Homo sapiens
caagtggtggtaaccctggt

SEQ ID NO: 1298937 - DNA, 15 bp, Homo sapiens
caataggctgttccc

SEQ ID NO: 1298938 - DNA, 13 bp, Homo sapiens
caatattataatt

SEQ ID NO: 1298939 - DNA, 12 bp, Homo sapiens
caatatttatta

SEQ ID NO: 1298940 - DNA, 20 bp, Homo sapiens
caatattttctttaatgctt

SEQ ID NO: 1298941 - DNA, 14 bp, Homo sapiens
caatatttttagat

SEQ ID NO: 1298942 - DNA, 16 bp, Homo sapiens
caatgctgatttggtg

SEQ ID NO: 1298943 - DNA, 14 bp, Homo sapiens
cagaggaggggccg

SEQ ID NO: 1298944 - DNA, 16 bp, Homo sapiens
cagaggccccagcctc

SEQ ID NO: 1298945 - DNA, 17 bp, Homo sapiens
cagaggcgcactgtgac

SEQ ID NO: 1298946 - DNA, 16 bp, Homo sapiens
cagatcagtgtaccat

SEQ ID NO: 1298947 - DNA, 12 bp, Homo sapiens
cagatccagcct

SEQ ID NO: 1298948 - DNA, 15 bp, Homo sapiens
cagatccagcctggg

SEQ ID NO: 1298949 - DNA, 13 bp, Homo sapiens
cagatccagggac

SEQ ID NO: 1298950 - DNA, 24 bp, Homo sapiens
cagatctgacatgattccttcctg

SEQ ID NO: 1298951 - DNA, 14 bp, Homo sapiens
cagatctggaacct

SEQ ID NO: 1298952 - DNA, 15 bp, Homo sapiens
cagatctggaacctc

SEQ ID NO: 1298953 - DNA, 19 bp, Homo sapiens
cagatctggaacctcagcc

SEQ ID NO: 1298954 - DNA, 20 bp, Homo sapiens
cagatctggaacctcagcct

SEQ ID NO: 1298955 - DNA, 19 bp, Homo sapiens
cagatgaatgtatttattt

SEQ ID NO: 1298956 - DNA, 17 bp, Homo sapiens
cagatgcagggcagtca

SEQ ID NO: 1298957 - DNA, 18 bp, Homo sapiens
cagattggctcacactga

SEQ ID NO: 1298958 - DNA, 20 bp, Homo sapiens
cagattggctcacactgaga

SEQ ID NO: 1298959 - DNA, 22 bp, Homo sapiens
cagattggctcacactgagaat

SEQ ID NO: 1298960 - DNA, 24 bp, Homo sapiens
cagatttccagtctccaccaggaa

SEQ ID NO: 1298961 - DNA, 23 bp, Homo sapiens
cagattttgctgtatatttgtga

SEQ ID NO: 1298962 - DNA, 16 bp, Homo sapiens
cagcacaaggccatct

SEQ ID NO: 1298963 - DNA, 14 bp, Homo sapiens
cagcacacagggca

SEQ ID NO: 1298964 - DNA, 15 bp, Homo sapiens
cagcacacagggcag

SEQ ID NO: 1298965 - DNA, 18 bp, Homo sapiens
cagcacacagggcagtga

SEQ ID NO: 1298966 - DNA, 19 bp, Homo sapiens
cagcacacagggcagtgag

SEQ ID NO: 1298967 - DNA, 11 bp, Homo sapiens
cagcactgagg

SEQ ID NO: 1298968 - DNA, 12 bp, Homo sapiens
cagcactgagga

SEQ ID NO: 1298969 - DNA, 17 bp, Homo sapiens
cagcactgaggaagaac

SEQ ID NO: 1298970 - DNA, 18 bp, Homo sapiens
cagcacttgtccagctga

SEQ ID NO: 1298971 - DNA, 17 bp, Homo sapiens
cagcagaagggggtggt

SEQ ID NO: 1298972 - DNA, 14 bp, Homo sapiens
agctcctcctccct

SEQ ID NO: 1298973 - DNA, 15 bp, Homo sapiens
agctcctcctccctg

SEQ ID NO: 1298974 - DNA, 17 bp, Homo sapiens
agctcctctccccagcc

SEQ ID NO: 1298975 - DNA, 21 bp, Homo sapiens
agctcctctccccagcccaga

SEQ ID NO: 1298976 - DNA, 20 bp, Homo sapiens
agctctcggaactgcatgct

SEQ ID NO: 1298977 - DNA, 22 bp, Homo sapiens
agctctcggaactgcatgctgc

SEQ ID NO: 1298978 - DNA, 18 bp, Homo sapiens
agctctggacagccccac

SEQ ID NO: 1298979 - DNA, 17 bp, Homo sapiens
agctctttcctccttcc

SEQ ID NO: 1298980 - DNA, 22 bp, Homo sapiens
agctgaacaataggctgttccc

SEQ ID NO: 1298981 - DNA, 23 bp, Homo sapiens
agctgaacaataggctgttccca

SEQ ID NO: 1298982 - DNA, 23 bp, Homo sapiens
agctgacccagccccttgagaaa

SEQ ID NO: 1298983 - DNA, 15 bp, Homo sapiens
agctgagcgccagga

SEQ ID NO: 1298984 - DNA, 13 bp, Homo sapiens
agctgaggccaca

SEQ ID NO: 1298985 - DNA, 21 bp, Homo sapiens
agctgaggccacactcagcac

SEQ ID NO: 1298986 - DNA, 14 bp, Homo sapiens
agctgcaaaggaca

SEQ ID NO: 1298987 - DNA, 20 bp, Homo sapiens
agctgcactgatgctgcccc

SEQ ID NO: 1298988 - DNA, 17 bp, Homo sapiens
agctgccttggctcaga

SEQ ID NO: 1298989 - DNA, 15 bp, Homo sapiens
agctgctatagcctg

SEQ ID NO: 1298990 - DNA, 21 bp, Homo sapiens
agctgctatagcctggggtgg

SEQ ID NO: 1298991 - DNA, 15 bp, Homo sapiens
agctggggatccctc

SEQ ID NO: 1298992 - DNA, 20 bp, Homo sapiens
agctgggggtgggccaggct

SEQ ID NO: 1298993 - DNA, 15 bp, Homo sapiens
agctgggtcaggcag

SEQ ID NO: 1298994 - DNA, 16 bp, Homo sapiens
agctgggtcaggcagg

SEQ ID NO: 1298995 - DNA, 17 bp, Homo sapiens
agctgttgagctgtttt

SEQ ID NO: 1298996 - DNA, 14 bp, Homo sapiens
agctgtttccatag

SEQ ID NO: 1298997 - DNA, 15 bp, Homo sapiens
agctgttttccctga

SEQ ID NO: 1298998 - DNA, 22 bp, Homo sapiens
agctttgctgctgaaggctcat

SEQ ID NO: 1298999 - DNA, 18 bp, Homo sapiens
aggaaaaggtgatatcca

SEQ ID NO: 1299000 - DNA, 15 bp, Homo sapiens
aggaaccacaccaca

SEQ ID NO: 1299001 - DNA, 17 bp, Homo sapiens
aggaaccacaccacatc

SEQ ID NO: 1299002 - DNA, 21 bp, Homo sapiens
aggaagaacaccctctaaatg

SEQ ID NO: 1299003 - DNA, 12 bp, Homo sapiens
aggaagaacggg

SEQ ID NO: 1299004 - DNA, 18 bp, Homo sapiens
aggaagaacggggctctt

SEQ ID NO: 1299005 - DNA, 15 bp, Homo sapiens
aggaatttcccagga

SEQ ID NO: 1299006 - DNA, 19 bp, Homo sapiens
aggaatttcccaggaccct

SEQ ID NO: 1299007 - DNA, 19 bp, Homo sapiens
aggacagatccagggactg

SEQ ID NO: 1299008 - DNA, 24 bp, Homo sapiens
aggacataatggggtcctggccat

SEQ ID NO: 1299009 - DNA, 20 bp, Homo sapiens
aggacatgcggtagccagca

SEQ ID NO: 1299010 - DNA, 13 bp, Homo sapiens
aggaccagctcag

SEQ ID NO: 1299011 - DNA, 15 bp, Homo sapiens
aggaccagctcagga

SEQ ID NO: 1299012 - DNA, 23 bp, Homo sapiens
aggaccagctcaggacagatgcc

SEQ ID NO: 1299013 - DNA, 17 bp, Homo sapiens
aggacctggctgccata

SEQ ID NO: 1299014 - DNA, 19 bp, Homo sapiens
aggaccttcgggctgtgcc

SEQ ID NO: 1299015 - DNA, 20 bp, Homo sapiens
aggactatatttgggcctgc

SEQ ID NO: 1299016 - DNA, 21 bp, Homo sapiens
aggacttcctgtccagctcca

SEQ ID NO: 1299017 - DNA, 12 bp, Homo sapiens
aggagaagccag

SEQ ID NO: 1299018 - DNA, 21 bp, Homo sapiens
aggagaggcaacatccaaaat

SEQ ID NO: 1299019 - DNA, 20 bp, Homo sapiens
aggagatggaagttgcagtg

SEQ ID NO: 1299020 - DNA, 18 bp, Homo sapiens
aggagctgccttggctca

SEQ ID NO: 1299021 - DNA, 21 bp, Homo sapiens
aggagctgctatagcctgggg

SEQ ID NO: 1299022 - DNA, 16 bp, Homo sapiens
aggagtgtggccacgt

SEQ ID NO: 1299023 - DNA, 19 bp, Homo sapiens
aggatagatgctggcccag

SEQ ID NO: 1299024 - DNA, 15 bp, Homo sapiens
aggatctttgtggcc

SEQ ID NO: 1299025 - DNA, 17 bp, Homo sapiens
aggatctttgtggccaa

SEQ ID NO: 1299026 - DNA, 14 bp, Homo sapiens
aggatggaacacgg

SEQ ID NO: 1299027 - DNA, 20 bp, Homo sapiens
aggcactttagggctgtaaa

SEQ ID NO: 1299028 - DNA, 15 bp, Homo sapiens
aggcagatccaggac

SEQ ID NO: 1299029 - DNA, 21 bp, Homo sapiens
aggcaggaccttcgggctgtg

SEQ ID NO: 1299030 - DNA, 22 bp, Homo sapiens
aggcaggaccttcgggctgtgc

SEQ ID NO: 1299031 - DNA, 23 bp, Homo sapiens
aggcaggaccttcgggctgtgcc

SEQ ID NO: 1299032 - DNA, 17 bp, Homo sapiens
aggccaagaaacgtctt

SEQ ID NO: 1299033 - DNA, 12 bp, Homo sapiens
aggccccagcct

SEQ ID NO: 1299034 - DNA, 23 bp, Homo sapiens
aggccctccctgttccccagaga

SEQ ID NO: 1299035 - DNA, 15 bp, Homo sapiens
aggccctctggagtg

SEQ ID NO: 1299036 - DNA, 15 bp, Homo sapiens
aggcctcagccagag

SEQ ID NO: 1299037 - DNA, 19 bp, Homo sapiens
aggcctgagatttcatctg

SEQ ID NO: 1299038 - DNA, 15 bp, Homo sapiens
aggccttcctctctc

SEQ ID NO: 1299039 - DNA, 16 bp, Homo sapiens
aggccttcctctctcc

SEQ ID NO: 1299040 - DNA, 18 bp, Homo sapiens
aggccttcctctctccag

SEQ ID NO: 1299041 - DNA, 10 bp, Homo sapiens
aggctcaggt

SEQ ID NO: 1299042 - DNA, 14 bp, Homo sapiens
aggctgaccacagc

SEQ ID NO: 1299043 - DNA, 16 bp, Homo sapiens
aggctgaccacagcac

SEQ ID NO: 1299044 - DNA, 21 bp, Homo sapiens
aggctgaccacagcacagcca

SEQ ID NO: 1299045 - DNA, 18 bp, Homo sapiens
aggctgaggctggcacag

SEQ ID NO: 1299046 - DNA, 22 bp, Homo sapiens
aggctgcaaggtttaggctggt

SEQ ID NO: 1299047 - DNA, 14 bp, Homo sapiens
aggctggcacagga

SEQ ID NO: 1299048 - DNA, 13 bp, Homo sapiens
aggctggtggccc

SEQ ID NO: 1299049 - DNA, 14 bp, Homo sapiens
aggctggtggccca

SEQ ID NO: 1299050 - DNA, 21 bp, Homo sapiens
agggagcggccggccagcccc

SEQ ID NO: 1299051 - DNA, 15 bp, Homo sapiens
agggagggctgtcat

SEQ ID NO: 1299052 - DNA, 17 bp, Homo sapiens
agggatgccctggaggt

SEQ ID NO: 1299053 - DNA, 21 bp, Homo sapiens
agggcagcagaagggggtggt

SEQ ID NO: 1299054 - DNA, 14 bp, Homo sapiens
agggccagagccag

SEQ ID NO: 1299055 - DNA, 15 bp, Homo sapiens
agggccagagccagg

SEQ ID NO: 1299056 - DNA, 12 bp, Homo sapiens
agggcccagagc

SEQ ID NO: 1299057 - DNA, 13 bp, Homo sapiens
agggcccagagcc

SEQ ID NO: 1299058 - DNA, 19 bp, Homo sapiens
agggcccagagcccagctc

SEQ ID NO: 1299059 - DNA, 20 bp, Homo sapiens
agggctgtcatctgtgcact

SEQ ID NO: 1299060 - DNA, 12 bp, Homo sapiens
aggggagcccac

SEQ ID NO: 1299061 - DNA, 13 bp, Homo sapiens
aggggagcccact

SEQ ID NO: 1299062 - DNA, 21 bp, Homo sapiens
aggggagcccactgtcctggg

SEQ ID NO: 1299063 - DNA, 18 bp, Homo sapiens
aggggattaatatgaaaa

SEQ ID NO: 1299064 - DNA, 13 bp, Homo sapiens
aggggcccggcca

SEQ ID NO: 1299065 - DNA, 19 bp, Homo sapiens
aggggcccggccagccatg

SEQ ID NO: 1299066 - DNA, 17 bp, Homo sapiens
aggggccgctgccaccc

SEQ ID NO: 1299067 - DNA, 19 bp, Homo sapiens
aggggcctaggcctcagcc

SEQ ID NO: 1299068 - DNA, 19 bp, Homo sapiens
aggggcgtctgttccccct

SEQ ID NO: 1299069 - DNA, 21 bp, Homo sapiens
aggggcgtctgttcccccttc

SEQ ID NO: 1299070 - DNA, 22 bp, Homo sapiens
aggggcgtctgttcccccttca

SEQ ID NO: 1299071 - DNA, 22 bp, Homo sapiens
agggggagccccttctgctcag

SEQ ID NO: 1299072 - DNA, 17 bp, Homo sapiens
aggggggaagatcaggt

SEQ ID NO: 1299073 - DNA, 20 bp, Homo sapiens
aggggtggctgcctcattta

SEQ ID NO: 1299074 - DNA, 17 bp, Homo sapiens
agggtcggaacccaagc

SEQ ID NO: 1299075 - DNA, 22 bp, Homo sapiens
agggtcggaacccaagcttaga

SEQ ID NO: 1299076 - DNA, 19 bp, Homo sapiens
aggtaatttcttgtgcctc

SEQ ID NO: 1299077 - DNA, 16 bp, Homo sapiens
aggtcaggagttccta

SEQ ID NO: 1299078 - DNA, 18 bp, Homo sapiens
aggtgatatatttaaaaa

SEQ ID NO: 1299079 - DNA, 17 bp, Homo sapiens
aggtgctgacggccagg

SEQ ID NO: 1299080 - DNA, 19 bp, Homo sapiens
aggtggccatgcctcagcc

SEQ ID NO: 1299081 - DNA, 14 bp, Homo sapiens
aggttcccaagctc

SEQ ID NO: 1299082 - DNA, 15 bp, Homo sapiens
aggttcccaagctca

SEQ ID NO: 1299083 - DNA, 16 bp, Homo sapiens
aggttcccaagctcag

SEQ ID NO: 1299084 - DNA, 16 bp, Homo sapiens
aggttgatcagatctg

SEQ ID NO: 1299085 - DNA, 21 bp, Homo sapiens
aggtttaggctggtggcccag

SEQ ID NO: 1299086 - DNA, 15 bp, Homo sapiens
aggtttttattagta

SEQ ID NO: 1299087 - DNA, 19 bp, Homo sapiens
agtaccatagtaccattta

SEQ ID NO: 1299088 - DNA, 19 bp, Homo sapiens
agtactttggaggccccta

SEQ ID NO: 1299089 - DNA, 14 bp, Homo sapiens
agtagaattgcatt

SEQ ID NO: 1299090 - DNA, 22 bp, Homo sapiens
cctaaggctgcaaggtttaggc

SEQ ID NO: 1299091 - DNA, 15 bp, Homo sapiens
cctaatccaggcaga

SEQ ID NO: 1299092 - DNA, 20 bp, Homo sapiens
cctaatccaggcagatccag

SEQ ID NO: 1299093 - DNA, 14 bp, Homo sapiens
cctacccatccccg

SEQ ID NO: 1299094 - DNA, 13 bp, Homo sapiens
cctagagggaggg

SEQ ID NO: 1299095 - DNA, 16 bp, Homo sapiens
cctagagggaggggcc

SEQ ID NO: 1299096 - DNA, 18 bp, Homo sapiens
cctagagtagagtggagg

SEQ ID NO: 1299097 - DNA, 23 bp, Homo sapiens
cctagcagcaccgttctgtgcac

SEQ ID NO: 1299098 - DNA, 19 bp, Homo sapiens
cctaggcctcagccagaga

SEQ ID NO: 1299099 - DNA, 18 bp, Homo sapiens
cctcaacgtattgtttcg

SEQ ID NO: 1299100 - DNA, 20 bp, Homo sapiens
cctcacccctggttctcatc

SEQ ID NO: 1299101 - DNA, 21 bp, Homo sapiens
cctcacccctggttctcatct

SEQ ID NO: 1299102 - DNA, 16 bp, Homo sapiens
cctcaccttggcacca

SEQ ID NO: 1299103 - DNA, 16 bp, Homo sapiens
cctcagccagagaagc

SEQ ID NO: 1299104 - DNA, 13 bp, Homo sapiens
cctcagccctgac

SEQ ID NO: 1299105 - DNA, 16 bp, Homo sapiens
cctcagccctgaccct

SEQ ID NO: 1299106 - DNA, 11 bp, Homo sapiens
cctcagcctgg

SEQ ID NO: 1299107 - DNA, 15 bp, Homo sapiens
cctcagcctggccag

SEQ ID NO: 1299108 - DNA, 20 bp, Homo sapiens
cctcagccttgccagagatc

SEQ ID NO: 1299109 - DNA, 11 bp, Homo sapiens
cctcaggtggc

SEQ ID NO: 1299110 - DNA, 19 bp, Homo sapiens
cctccaacaccaagcacag

SEQ ID NO: 1299111 - DNA, 19 bp, Homo sapiens
cctccactctcccccaccc

SEQ ID NO: 1299112 - DNA, 22 bp, Homo sapiens
cctccactctcccccaccccct

SEQ ID NO: 1299113 - DNA, 21 bp, Homo sapiens
cctccagaactcactggggcc

SEQ ID NO: 1299114 - DNA, 13 bp, Homo sapiens
cctccagcaggga

SEQ ID NO: 1299115 - DNA, 16 bp, Homo sapiens
cctccagctctttcct

SEQ ID NO: 1299116 - DNA, 19 bp, Homo sapiens
cctccagctctttcctcct

SEQ ID NO: 1299117 - DNA, 15 bp, Homo sapiens
cctccaggaaccaca

SEQ ID NO: 1299118 - DNA, 18 bp, Homo sapiens
cctccagggctggactga

SEQ ID NO: 1299119 - DNA, 21 bp, Homo sapiens
cctccagggctggactgaggc

SEQ ID NO: 1299120 - DNA, 20 bp, Homo sapiens
cctcccaatttcagactccc

SEQ ID NO: 1299121 - DNA, 16 bp, Homo sapiens
cctcccccccatgcac

SEQ ID NO: 1299122 - DNA, 17 bp, Homo sapiens
cctcccctctccttcct

SEQ ID NO: 1299123 - DNA, 13 bp, Homo sapiens
cctccctctaatt

SEQ ID NO: 1299124 - DNA, 19 bp, Homo sapiens
cctccctgaagcctttgca

SEQ ID NO: 1299125 - DNA, 20 bp, Homo sapiens
cctccctgcatctgaccagc

SEQ ID NO: 1299126 - DNA, 14 bp, Homo sapiens
cctccctgcctcca

SEQ ID NO: 1299127 - DNA, 15 bp, Homo sapiens
cctccctgcctccag

SEQ ID NO: 1299128 - DNA, 13 bp, Homo sapiens
cctcccttctgct

SEQ ID NO: 1299129 - DNA, 16 bp, Homo sapiens
cctcccttctgctact

SEQ ID NO: 1299130 - DNA, 15 bp, Homo sapiens
cctccctttctcccc

SEQ ID NO: 1299131 - DNA, 12 bp, Homo sapiens
cctccttcagac

SEQ ID NO: 1299132 - DNA, 22 bp, Homo sapiens
cctcggcctcccaaagtgctgg

SEQ ID NO: 1299133 - DNA, 21 bp, Homo sapiens
cctctatttatgtttgcactt

SEQ ID NO: 1299134 - DNA, 12 bp, Homo sapiens
cctctccccagc

SEQ ID NO: 1299135 - DNA, 17 bp, Homo sapiens
cctctccccagcccaga

SEQ ID NO: 1299136 - DNA, 20 bp, Homo sapiens
cctctccccagcccagagac

SEQ ID NO: 1299137 - DNA, 19 bp, Homo sapiens
cctctccccattcggtgtg

SEQ ID NO: 1299138 - DNA, 21 bp, Homo sapiens
cctctccctgaccctgtatat

SEQ ID NO: 1299139 - DNA, 13 bp, Homo sapiens
cctctccttcctg

SEQ ID NO: 1299140 - DNA, 15 bp, Homo sapiens
cctctgatacctcaa

SEQ ID NO: 1299141 - DNA, 13 bp, Homo sapiens
cctctgctcccca

SEQ ID NO: 1299142 - DNA, 21 bp, Homo sapiens
cctctggagtggccactaagc

SEQ ID NO: 1299143 - DNA, 21 bp, Homo sapiens
cctctgtcagtcacagccacc

SEQ ID NO: 1299144 - DNA, 21 bp, Homo sapiens
cctctgtccccttctctcatc

SEQ ID NO: 1299145 - DNA, 15 bp, Homo sapiens
cctcttcctttagga

SEQ ID NO: 1299146 - DNA, 15 bp, Homo sapiens
cctcttctggctcaa

SEQ ID NO: 1299147 - DNA, 13 bp, Homo sapiens
cctcttgtaaata

SEQ ID NO: 1299148 - DNA, 11 bp, Homo sapiens
cctctttgctt

SEQ ID NO: 1299149 - DNA, 21 bp, Homo sapiens
cctctttgctttgctttctgc

SEQ ID NO: 1299150 - DNA, 13 bp, Homo sapiens
cctgaagaaccag

SEQ ID NO: 1299151 - DNA, 14 bp, Homo sapiens
cctgacctgtgagc

SEQ ID NO: 1299152 - DNA, 19 bp, Homo sapiens
cctgacctgtgagcccagc

SEQ ID NO: 1299153 - DNA, 13 bp, Homo sapiens
cctgtcctccaac

SEQ ID NO: 1299154 - DNA, 21 bp, Homo sapiens
cctgtcctccaacaccaagca

SEQ ID NO: 1299155 - DNA, 16 bp, Homo sapiens
cctgtctagagaggga

SEQ ID NO: 1299156 - DNA, 15 bp, Homo sapiens
cctgttccccagaga

SEQ ID NO: 1299157 - DNA, 23 bp, Homo sapiens
cctgttccccagagaaaggggag

SEQ ID NO: 1299158 - DNA, 21 bp, Homo sapiens
cctgttctgaactgtggggtg

SEQ ID NO: 1299159 - DNA, 22 bp, Homo sapiens
cctgttgacacaggtctttcct

SEQ ID NO: 1299160 - DNA, 17 bp, Homo sapiens
cctgtttttaagctgtt

SEQ ID NO: 1299161 - DNA, 20 bp, Homo sapiens
ccttagaacattttaattca

SEQ ID NO: 1299162 - DNA, 17 bp, Homo sapiens
ccttcagacaccctcaa

SEQ ID NO: 1299163 - DNA, 20 bp, Homo sapiens
ccttcagacaccctcaacct

SEQ ID NO: 1299164 - DNA, 13 bp, Homo sapiens
ccttcagccctca

SEQ ID NO: 1299165 - DNA, 15 bp, Homo sapiens
ccttcagccctcacc

SEQ ID NO: 1299166 - DNA, 18 bp, Homo sapiens
ccttcagccctcacccct

SEQ ID NO: 1299167 - DNA, 17 bp, Homo sapiens
ccttcctctctccagat

SEQ ID NO: 1299168 - DNA, 17 bp, Homo sapiens
ccttcctgttctgaact

SEQ ID NO: 1299169 - DNA, 15 bp, Homo sapiens
ccttcgggctgtgcc

SEQ ID NO: 1299170 - DNA, 22 bp, Homo sapiens
ccttctaaaggtgttgtccctt

SEQ ID NO: 1299171 - DNA, 15 bp, Homo sapiens
ccttctcctcttgta

SEQ ID NO: 1299172 - DNA, 21 bp, Homo sapiens
ccttggcaccagacacccagg

SEQ ID NO: 1299173 - DNA, 19 bp, Homo sapiens
ccttgtttacacataccct

SEQ ID NO: 1299174 - DNA, 22 bp, Homo sapiens
ccttttatgtagtaattgacat

SEQ ID NO: 1299175 - DNA, 15 bp, Homo sapiens
ccttttattgacaca

SEQ ID NO: 1299176 - DNA, 18 bp, Homo sapiens
cgactctatagactctag

SEQ ID NO: 1299177 - DNA, 20 bp, Homo sapiens
cgactctatagactctagga

SEQ ID NO: 1299178 - DNA, 20 bp, Homo sapiens
cgagaaataaagtttgctta

SEQ ID NO: 1299179 - DNA, 18 bp, Homo sapiens
cgagtcattcgttctgtg

SEQ ID NO: 1299180 - DNA, 15 bp, Homo sapiens
cgagtccaagctggg

SEQ ID NO: 1299181 - DNA, 22 bp, Homo sapiens
cgcagtgtgcactaaggggccc

SEQ ID NO: 1299182 - DNA, 16 bp, Homo sapiens
cgcatggtcacacact

SEQ ID NO: 1299183 - DNA, 21 bp, Homo sapiens
cgccaggctgaccacagcaca

SEQ ID NO: 1299184 - DNA, 19 bp, Homo sapiens
cgcctggctgcagcctgcg

SEQ ID NO: 1299185 - DNA, 14 bp, Homo sapiens
cgcttctgcctgca

SEQ ID NO: 1299186 - DNA, 16 bp, Homo sapiens
cgctttgattcatagt

SEQ ID NO: 1299187 - DNA, 19 bp, Homo sapiens
cggaacccaagcttagaac

SEQ ID NO: 1299188 - DNA, 17 bp, Homo sapiens
cggaactgcatgctgct

SEQ ID NO: 1299189 - DNA, 15 bp, Homo sapiens
cggatttggggtgga

SEQ ID NO: 1299190 - DNA, 16 bp, Homo sapiens
cggccagggagaagct

SEQ ID NO: 1299191 - DNA, 20 bp, Homo sapiens
cggcccatccccaggcacct

SEQ ID NO: 1299192 - DNA, 14 bp, Homo sapiens
cggccggccagccc

SEQ ID NO: 1299193 - DNA, 21 bp, Homo sapiens
cggcctgtcctccaacaccaa

SEQ ID NO: 1299194 - DNA, 16 bp, Homo sapiens
cggggctcttctcatt

SEQ ID NO: 1299195 - DNA, 17 bp, Homo sapiens
cggggctcttctcattt

SEQ ID NO: 1299196 - DNA, 15 bp, Homo sapiens
cggggtatcctgggg

SEQ ID NO: 1299197 - DNA, 21 bp, Homo sapiens
cggggtatcctgggggaccca

SEQ ID NO: 1299198 - DNA, 20 bp, Homo sapiens
cgggtgaacaaagcagccac

SEQ ID NO: 1299199 - DNA, 15 bp, Homo sapiens
cggtagccagcacac

SEQ ID NO: 1299200 - DNA, 22 bp, Homo sapiens
cggtgctgtcctcaggtggcca

SEQ ID NO: 1299201 - DNA, 15 bp, Homo sapiens
cgtctggaagtccaa

SEQ ID NO: 1299202 - DNA, 15 bp, Homo sapiens
cgtggctcagccagc

SEQ ID NO: 1299203 - DNA, 18 bp, Homo sapiens
cgtggctcagccagcact

SEQ ID NO: 1299204 - DNA, 17 bp, Homo sapiens
cgtttgaccttttatgt

SEQ ID NO: 1299205 - DNA, 20 bp, Homo sapiens
ctaaaagtgggcttgattct

SEQ ID NO: 1299206 - DNA, 15 bp, Homo sapiens
ctaaacccaatccaa

SEQ ID NO: 1299207 - DNA, 22 bp, Homo sapiens
ctaaactcatttataaagctaa

SEQ ID NO: 1299208 - DNA, 16 bp, Homo sapiens
ctaaacttccccatct

SEQ ID NO: 1299209 - DNA, 17 bp, Homo sapiens
ctaacagctcaggatct

SEQ ID NO: 1299210 - DNA, 20 bp, Homo sapiens
ctaactgctacaaatactct

SEQ ID NO: 1299211 - DNA, 12 bp, Homo sapiens
ctaagcagagga

SEQ ID NO: 1299212 - DNA, 15 bp, Homo sapiens
ctaagcagaggaggg

SEQ ID NO: 1299213 - DNA, 23 bp, Homo sapiens
ctaagcagaggaggggccgctgc

SEQ ID NO: 1299214 - DNA, 12 bp, Homo sapiens
ctaaggggcccg

SEQ ID NO: 1299215 - DNA, 22 bp, Homo sapiens
ctaaggggcccggccagccatg

SEQ ID NO: 1299216 - DNA, 13 bp, Homo sapiens
ctaatagaactca

SEQ ID NO: 1299217 - DNA, 19 bp, Homo sapiens
ctaatgctccttgttccta

SEQ ID NO: 1299218 - DNA, 13 bp, Homo sapiens
ctaatttgcatta

SEQ ID NO: 1299219 - DNA, 20 bp, Homo sapiens
ctaatttttgtaattttagt

SEQ ID NO: 1299220 - DNA, 13 bp, Homo sapiens
ctacaaacaaaat

SEQ ID NO: 1299221 - DNA, 15 bp, Homo sapiens
ctacaaacaaaattt

SEQ ID NO: 1299222 - DNA, 20 bp, Homo sapiens
ctacaaacaaaatttctatt

SEQ ID NO: 1299223 - DNA, 21 bp, Homo sapiens
ctacaaacaaaatttctatta

SEQ ID NO: 1299224 - DNA, 17 bp, Homo sapiens
ctacaatgtgaacttta

SEQ ID NO: 1299225 - DNA, 13 bp, Homo sapiens
ctaccattcagtg

SEQ ID NO: 1299226 - DNA, 12 bp, Homo sapiens
ctactctcctca

SEQ ID NO: 1299227 - DNA, 13 bp, Homo sapiens
ctactctcctcat

SEQ ID NO: 1299228 - DNA, 22 bp, Homo sapiens
ctactgtaataaagatgattgt

SEQ ID NO: 1299229 - DNA, 19 bp, Homo sapiens
ctactgtaattttatatga

SEQ ID NO: 1299230 - DNA, 15 bp, Homo sapiens
ctactgtgtgtgtga

SEQ ID NO: 1299231 - DNA, 17 bp, Homo sapiens
ctactgtgtgtgtgaat

SEQ ID NO: 1299232 - DNA, 19 bp, Homo sapiens
ctactgtgtgtgtgaatga

SEQ ID NO: 1299233 - DNA, 16 bp, Homo sapiens
aagtggaggcacttta

SEQ ID NO: 1299234 - DNA, 16 bp, Homo sapiens
aagtgggcttgattct

SEQ ID NO: 1299235 - DNA, 18 bp, Homo sapiens
aagtggtggtaaccctgg

SEQ ID NO: 1299236 - DNA, 22 bp, Homo sapiens
aagtgtatttttcaataaagca

SEQ ID NO: 1299237 - DNA, 21 bp, Homo sapiens
aagtgtgctttatgctgaaac

SEQ ID NO: 1299238 - DNA, 23 bp, Homo sapiens
aagttgaattgaggggattaata

SEQ ID NO: 1299239 - DNA, 19 bp, Homo sapiens
aataaagtttgcttagaaa

SEQ ID NO: 1299240 - DNA, 17 bp, Homo sapiens
aataaatctgacccagt

SEQ ID NO: 1299241 - DNA, 20 bp, Homo sapiens
aataaatctgacccagtgcc

SEQ ID NO: 1299242 - DNA, 13 bp, Homo sapiens
aataatcttatta

SEQ ID NO: 1299243 - DNA, 13 bp, Homo sapiens
aatacaaaacttc

SEQ ID NO: 1299244 - DNA, 14 bp, Homo sapiens
aatactaccttgaa

SEQ ID NO: 1299245 - DNA, 17 bp, Homo sapiens
aatactaccttgaaaat

SEQ ID NO: 1299246 - DNA, 21 bp, Homo sapiens
aatactaccttgaaaataaga

SEQ ID NO: 1299247 - DNA, 15 bp, Homo sapiens
aatactttttacaat

SEQ ID NO: 1299248 - DNA, 23 bp, Homo sapiens
aatagacactccccgaagtcttt

SEQ ID NO: 1299249 - DNA, 22 bp, Homo sapiens
aatagccacatttggaatactt

SEQ ID NO: 1299250 - DNA, 21 bp, Homo sapiens
aatagtctagatggctcctct

SEQ ID NO: 1299251 - DNA, 13 bp, Homo sapiens
aatatgaaaactt

SEQ ID NO: 1299252 - DNA, 16 bp, Homo sapiens
aatatggaacttacat

SEQ ID NO: 1299253 - DNA, 24 bp, Homo sapiens
aatatggaacttacattgttcaat

SEQ ID NO: 1299254 - DNA, 17 bp, Homo sapiens
aatatggacacttaata

SEQ ID NO: 1299255 - DNA, 21 bp, Homo sapiens
aatattaaatctgctggagtt

SEQ ID NO: 1299256 - DNA, 19 bp, Homo sapiens
aatatttataaaacttctc

SEQ ID NO: 1299257 - DNA, 15 bp, Homo sapiens
aatatttattacctc

SEQ ID NO: 1299258 - DNA, 18 bp, Homo sapiens
aatatttattacctctga

SEQ ID NO: 1299259 - DNA, 12 bp, Homo sapiens
aatatttattat

SEQ ID NO: 1299260 - DNA, 19 bp, Homo sapiens
aatatttattattttcacc

SEQ ID NO: 1299261 - DNA, 12 bp, Homo sapiens
aatcagaactca

SEQ ID NO: 1299262 - DNA, 15 bp, Homo sapiens
aatcagtataaacaa

SEQ ID NO: 1299263 - DNA, 13 bp, Homo sapiens
aatccaaatggcg

SEQ ID NO: 1299264 - DNA, 20 bp, Homo sapiens
aatccaggcagatccaggac

SEQ ID NO: 1299265 - DNA, 22 bp, Homo sapiens
aatccaggcagatccaggacta

SEQ ID NO: 1299266 - DNA, 17 bp, Homo sapiens
aatcctacctgttttgt

SEQ ID NO: 1299267 - DNA, 22 bp, Homo sapiens
aatcggatctggggctctggga

SEQ ID NO: 1299268 - DNA, 23 bp, Homo sapiens
aatcggatctggggctctgggat

SEQ ID NO: 1299269 - DNA, 17 bp, Homo sapiens
aatctgacccagtgccc

SEQ ID NO: 1299270 - DNA, 15 bp, Homo sapiens
aatctggagaccagg

SEQ ID NO: 1299271 - DNA, 21 bp, Homo sapiens
aatcttatcatggtctcagtc

SEQ ID NO: 1299272 - DNA, 21 bp, Homo sapiens
aatcttttacaactgcctcga

SEQ ID NO: 1299273 - DNA, 21 bp, Homo sapiens
aatgaacactcttttgcttta

SEQ ID NO: 1299274 - DNA, 13 bp, Homo sapiens
aatgagaatctac

SEQ ID NO: 1299275 - DNA, 12 bp, Homo sapiens
aatgctgtacat

SEQ ID NO: 1299276 - DNA, 15 bp, Homo sapiens
aatgctgtacatcta

SEQ ID NO: 1299277 - DNA, 20 bp, Homo sapiens
aatgctttttatttctgcat

SEQ ID NO: 1299278 - DNA, 13 bp, Homo sapiens
aatggggccagat

SEQ ID NO: 1299279 - DNA, 17 bp, Homo sapiens
aatggggccagatccag

SEQ ID NO: 1299280 - DNA, 18 bp, Homo sapiens
aatggggtcctggccatc

SEQ ID NO: 1299281 - DNA, 17 bp, Homo sapiens
aatggtaggcatttcct

SEQ ID NO: 1299282 - DNA, 20 bp, Homo sapiens
aatgtaaaggagtcaaaact

SEQ ID NO: 1299283 - DNA, 16 bp, Homo sapiens
aatgtatcttattcac

SEQ ID NO: 1299284 - DNA, 18 bp, Homo sapiens
aatgtatcttattcacat

SEQ ID NO: 1299285 - DNA, 16 bp, Homo sapiens
aatgtggcttgagaaa

SEQ ID NO: 1299286 - DNA, 21 bp, Homo sapiens
aatgtggcttgagaaatatgg

SEQ ID NO: 1299287 - DNA, 16 bp, Homo sapiens
aatgtgtggcctgcac

SEQ ID NO: 1299288 - DNA, 16 bp, Homo sapiens
aattaagaaggcaaaa

SEQ ID NO: 1299289 - DNA, 23 bp, Homo sapiens
aattaagaaggcaaaaatgtaaa

SEQ ID NO: 1299290 - DNA, 22 bp, Homo sapiens
aattagaaaatgttatttaaca

SEQ ID NO: 1299291 - DNA, 16 bp, Homo sapiens
aattatctatacatat

SEQ ID NO: 1299292 - DNA, 17 bp, Homo sapiens
aattcaattgtaaattg

SEQ ID NO: 1299293 - DNA, 19 bp, Homo sapiens
aattcaattgtaaattgaa

SEQ ID NO: 1299294 - DNA, 13 bp, Homo sapiens
aattcacaaactt

SEQ ID NO: 1299295 - DNA, 18 bp, Homo sapiens
aattcatcccaactgtct

SEQ ID NO: 1299296 - DNA, 20 bp, Homo sapiens
aattccacaccttttattga

SEQ ID NO: 1299297 - DNA, 18 bp, Homo sapiens
aattcctctttgctttgc

SEQ ID NO: 1299298 - DNA, 22 bp, Homo sapiens
aattctataaggccataaaaca

SEQ ID NO: 1299299 - DNA, 22 bp, Homo sapiens
aattgatttgcattgaacacaa

SEQ ID NO: 1299300 - DNA, 14 bp, Homo sapiens
aattgcaaatcttg

SEQ ID NO: 1299301 - DNA, 24 bp, Homo sapiens
aattgtaaattgaatcagtataaa

SEQ ID NO: 1299302 - DNA, 23 bp, Homo sapiens
aattgtgtgtgatgtgaagccaa

SEQ ID NO: 1299303 - DNA, 20 bp, Homo sapiens
aatttaggtttttattagta

SEQ ID NO: 1299304 - DNA, 18 bp, Homo sapiens
aatttatcttgtctctgg

SEQ ID NO: 1299305 - DNA, 19 bp, Homo sapiens
aatttatcttgtctctggg

SEQ ID NO: 1299306 - DNA, 15 bp, Homo sapiens
acagaggccccagcc

SEQ ID NO: 1299307 - DNA, 17 bp, Homo sapiens
acagaggccccagcctc

SEQ ID NO: 1299308 - DNA, 22 bp, Homo sapiens
acagaggccccagcctccctga

SEQ ID NO: 1299309 - DNA, 14 bp, Homo sapiens
acagcaaccccagg

SEQ ID NO: 1299310 - DNA, 21 bp, Homo sapiens
acagccaacacgcacctgcct

SEQ ID NO: 1299311 - DNA, 13 bp, Homo sapiens
acagccccaccct

SEQ ID NO: 1299312 - DNA, 15 bp, Homo sapiens
acagccccaccctgg

SEQ ID NO: 1299313 - DNA, 17 bp, Homo sapiens
acagctccaccctggcc

SEQ ID NO: 1299314 - DNA, 15 bp, Homo sapiens
acagctttgctgctg

SEQ ID NO: 1299315 - DNA, 14 bp, Homo sapiens
acaggacacagtca

SEQ ID NO: 1299316 - DNA, 21 bp, Homo sapiens
acaggccctccctgttcccca

SEQ ID NO: 1299317 - DNA, 23 bp, Homo sapiens
acaggccctccctgttccccaga

SEQ ID NO: 1299318 - DNA, 16 bp, Homo sapiens
acaggccgccctgcgg

SEQ ID NO: 1299319 - DNA, 15 bp, Homo sapiens
acagggtttcaccat

SEQ ID NO: 1299320 - DNA, 19 bp, Homo sapiens
acagttctttgggccagac

SEQ ID NO: 1299321 - DNA, 21 bp, Homo sapiens
acagttctttgggccagacat

SEQ ID NO: 1299322 - DNA, 15 bp, Homo sapiens
acatacaccagcatt

SEQ ID NO: 1299323 - DNA, 17 bp, Homo sapiens
acatacttgaagggcca

SEQ ID NO: 1299324 - DNA, 18 bp, Homo sapiens
acatacttgaagggccag

SEQ ID NO: 1299325 - DNA, 19 bp, Homo sapiens
acatacttgaagggccaga

SEQ ID NO: 1299326 - DNA, 14 bp, Homo sapiens
acatatgaggggga

SEQ ID NO: 1299327 - DNA, 18 bp, Homo sapiens
acatcaacccgagtcatt

SEQ ID NO: 1299328 - DNA, 20 bp, Homo sapiens
acatccaatattttctttaa

SEQ ID NO: 1299329 - DNA, 15 bp, Homo sapiens
acatctaagcctgaa

SEQ ID NO: 1299330 - DNA, 13 bp, Homo sapiens
acatgattccttc

SEQ ID NO: 1299331 - DNA, 22 bp, Homo sapiens
acatgattccttcctgttctga

SEQ ID NO: 1299332 - DNA, 17 bp, Homo sapiens
acatgcggtagccagca

SEQ ID NO: 1299333 - DNA, 20 bp, Homo sapiens
acatgcggtagccagcacac

SEQ ID NO: 1299334 - DNA, 22 bp, Homo sapiens
acattggcacctaatccaggca

SEQ ID NO: 1299335 - DNA, 17 bp, Homo sapiens
acattgttgagctattg

SEQ ID NO: 1299336 - DNA, 19 bp, Homo sapiens
acatttctttgtgctttgg

SEQ ID NO: 1299337 - DNA, 16 bp, Homo sapiens
acatttggaatacttt

SEQ ID NO: 1299338 - DNA, 17 bp, Homo sapiens
acatttggaatactttt

SEQ ID NO: 1299339 - DNA, 18 bp, Homo sapiens
acattttggtgagaaatg

SEQ ID NO: 1299340 - DNA, 21 bp, Homo sapiens
accaaagtcctttttttccat

SEQ ID NO: 1299341 - DNA, 23 bp, Homo sapiens
accaactgtcactcattgctgag

SEQ ID NO: 1299342 - DNA, 15 bp, Homo sapiens
accacagcacagcca

SEQ ID NO: 1299343 - DNA, 16 bp, Homo sapiens
accacagcacagccaa

SEQ ID NO: 1299344 - DNA, 14 bp, Homo sapiens
accagacacccagg

SEQ ID NO: 1299345 - DNA, 15 bp, Homo sapiens
accagacacccagga

SEQ ID NO: 1299346 - DNA, 17 bp, Homo sapiens
accagcattccttttga

SEQ ID NO: 1299347 - DNA, 20 bp, Homo sapiens
accagcctggtcaacatggt

SEQ ID NO: 1299348 - DNA, 23 bp, Homo sapiens
accagctaagaaaagattttaat

SEQ ID NO: 1299349 - DNA, 14 bp, Homo sapiens
accagctcaggaca

SEQ ID NO: 1299350 - DNA, 15 bp, Homo sapiens
accagctcaggacag

SEQ ID NO: 1299351 - DNA, 23 bp, Homo sapiens
accagctcaggacagatgccaca

SEQ ID NO: 1299352 - DNA, 17 bp, Homo sapiens
accaggaacctcttcag

SEQ ID NO: 1299353 - DNA, 20 bp, Homo sapiens
accatgcccggctaattttt

SEQ ID NO: 1299354 - DNA, 16 bp, Homo sapiens
accatttatacaaatt

SEQ ID NO: 1299355 - DNA, 19 bp, Homo sapiens
accatttatacaaattaga

SEQ ID NO: 1299356 - DNA, 22 bp, Homo sapiens
accatttatacaaattagaaaa

SEQ ID NO: 1299357 - DNA, 13 bp, Homo sapiens
acccaatccaaat

SEQ ID NO: 1299358 - DNA, 15 bp, Homo sapiens
acccagactcagaca

SEQ ID NO: 1299359 - DNA, 20 bp, Homo sapiens
acccagccccttgagaaacc

SEQ ID NO: 1299360 - DNA, 15 bp, Homo sapiens
acccagtgcccccac

SEQ ID NO: 1299361 - DNA, 18 bp, Homo sapiens
acccccagctccggcctg

SEQ ID NO: 1299362 - DNA, 18 bp, Homo sapiens
acccccatttctatttat

SEQ ID NO: 1299363 - DNA, 15 bp, Homo sapiens
accccccagcactga

SEQ ID NO: 1299364 - DNA, 17 bp, Homo sapiens
accccccagcactgagg

SEQ ID NO: 1299365 - DNA, 19 bp, Homo sapiens
accccccagcactgaggaa

SEQ ID NO: 1299366 - DNA, 20 bp, Homo sapiens
accccggggtgcccacaggc

SEQ ID NO: 1299367 - DNA, 23 bp, Homo sapiens
accccggggtgcccacaggccgc

SEQ ID NO: 1299368 - DNA, 23 bp, Homo sapiens
acccctccctttctcccctgccc

SEQ ID NO: 1299369 - DNA, 14 bp, Homo sapiens
acccctggttctca

SEQ ID NO: 1299370 - DNA, 22 bp, Homo sapiens
acccctggttctcatctttctt

SEQ ID NO: 1299371 - DNA, 12 bp, Homo sapiens
accctgaagggg

SEQ ID NO: 1299372 - DNA, 20 bp, Homo sapiens
accctgatttaggagaagcc

SEQ ID NO: 1299373 - DNA, 15 bp, Homo sapiens
accctggtgggccaa

SEQ ID NO: 1299374 - DNA, 19 bp, Homo sapiens
accctggtggttgctgttt

SEQ ID NO: 1299375 - DNA, 15 bp, Homo sapiens
acccttctcctcttg

SEQ ID NO: 1299376 - DNA, 20 bp, Homo sapiens
accgcgactaatttcaaaat

SEQ ID NO: 1299377 - DNA, 15 bp, Homo sapiens
acctaatccaggcag

SEQ ID NO: 1299378 - DNA, 20 bp, Homo sapiens
acctaatgctccttgttcct

SEQ ID NO: 1299379 - DNA, 22 bp, Homo sapiens
acctagaaattgacacaagtgg

SEQ ID NO: 1299380 - DNA, 22 bp, Homo sapiens
acctagcagcaccgttctgtgc

SEQ ID NO: 1299381 - DNA, 22 bp, Homo sapiens
acctcaacccccatttctattt

SEQ ID NO: 1299382 - DNA, 16 bp, Homo sapiens
acctcagcctggccag

SEQ ID NO: 1299383 - DNA, 17 bp, Homo sapiens
acctctccctgaccctg

SEQ ID NO: 1299384 - DNA, 15 bp, Homo sapiens
acctctgatacctca

SEQ ID NO: 1299385 - DNA, 19 bp, Homo sapiens
acctgacgtagctgcaaag

SEQ ID NO: 1299386 - DNA, 20 bp, Homo sapiens
acctgatcctggaggcccag

SEQ ID NO: 1299387 - DNA, 18 bp, Homo sapiens
acctggaacttggggagt

SEQ ID NO: 1299388 - DNA, 19 bp, Homo sapiens
agccttgccagagatccaa

SEQ ID NO: 1299389 - DNA, 13 bp, Homo sapiens
agcctttaatgca

SEQ ID NO: 1299390 - DNA, 14 bp, Homo sapiens
agcctttaatgcat

SEQ ID NO: 1299391 - DNA, 17 bp, Homo sapiens
agcgcctttcccaactc

SEQ ID NO: 1299392 - DNA, 17 bp, Homo sapiens
agcgctcctgccgcaga

SEQ ID NO: 1299393 - DNA, 18 bp, Homo sapiens
agctaaacggattccaaa

SEQ ID NO: 1299394 - DNA, 14 bp, Homo sapiens
agctaagaacctgg

SEQ ID NO: 1299395 - DNA, 17 bp, Homo sapiens
agctaagaacctggaac

SEQ ID NO: 1299396 - DNA, 14 bp, Homo sapiens
agctaatttgcatt

SEQ ID NO: 1299397 - DNA, 14 bp, Homo sapiens
agctacttgggagg

SEQ ID NO: 1299398 - DNA, 22 bp, Homo sapiens
agctcagaggcgcactgtgacc

SEQ ID NO: 1299399 - DNA, 13 bp, Homo sapiens
agctccaacctgc

SEQ ID NO: 1299400 - DNA, 16 bp, Homo sapiens
agctccaacctgcaaa

SEQ ID NO: 1299401 - DNA, 21 bp, Homo sapiens
agctccccgcttctgcctgca

SEQ ID NO: 1299402 - DNA, 16 bp, Homo sapiens
agctcctcctccctgc

SEQ ID NO: 1299403 - DNA, 23 bp, Homo sapiens
agctcctcctccctgcatctgac

SEQ ID NO: 1299404 - DNA, 18 bp, Homo sapiens
agctcctctccccagccc

SEQ ID NO: 1299405 - DNA, 20 bp, Homo sapiens
agctcctctccccagcccag

SEQ ID NO: 1299406 - DNA, 22 bp, Homo sapiens
agctcctctccccagcccagag

SEQ ID NO: 1299407 - DNA, 24 bp, Homo sapiens
agctcctctccccagcccagagac

SEQ ID NO: 1299408 - DNA, 13 bp, Homo sapiens
agctctttcctcc

SEQ ID NO: 1299409 - DNA, 15 bp, Homo sapiens
agctctttcctcctt

SEQ ID NO: 1299410 - DNA, 22 bp, Homo sapiens
agctctttcctccttccatgga

SEQ ID NO: 1299411 - DNA, 21 bp, Homo sapiens
agctgaacaataggctgttcc

SEQ ID NO: 1299412 - DNA, 15 bp, Homo sapiens
agtgaacctgtataa

SEQ ID NO: 1299413 - DNA, 19 bp, Homo sapiens
agtgctgggattacaggct

SEQ ID NO: 1299414 - DNA, 20 bp, Homo sapiens
agtggaccttaggccttcct

SEQ ID NO: 1299415 - DNA, 23 bp, Homo sapiens
agtggaccttaggccttcctctc

SEQ ID NO: 1299416 - DNA, 16 bp, Homo sapiens
agtggactcagggcag

SEQ ID NO: 1299417 - DNA, 14 bp, Homo sapiens
agtggccactaagc

SEQ ID NO: 1299418 - DNA, 19 bp, Homo sapiens
agtggccactaagcagagg

SEQ ID NO: 1299419 - DNA, 20 bp, Homo sapiens
agtggccactaagcagagga

SEQ ID NO: 1299420 - DNA, 16 bp, Homo sapiens
agtgggcttgattctg

SEQ ID NO: 1299421 - DNA, 22 bp, Homo sapiens
agtgggcttgattctgcagtaa

SEQ ID NO: 1299422 - DNA, 14 bp, Homo sapiens
agtgggtcccagat

SEQ ID NO: 1299423 - DNA, 19 bp, Homo sapiens
agtggtggtaaccctggtg

SEQ ID NO: 1299424 - DNA, 22 bp, Homo sapiens
agtgtctcggagggattcccct

SEQ ID NO: 1299425 - DNA, 17 bp, Homo sapiens
agtgtgcactaaggggc

SEQ ID NO: 1299426 - DNA, 21 bp, Homo sapiens
agtgtgctttatgctgaaaca

SEQ ID NO: 1299427 - DNA, 20 bp, Homo sapiens
agttacagcctgttagtaac

SEQ ID NO: 1299428 - DNA, 21 bp, Homo sapiens
agttctttgggccagacatgc

SEQ ID NO: 1299429 - DNA, 17 bp, Homo sapiens
agttgatctggaaccca

SEQ ID NO: 1299430 - DNA, 19 bp, Homo sapiens
agttgatctggaacccaga

SEQ ID NO: 1299431 - DNA, 13 bp, Homo sapiens
agttgtctaaaca

SEQ ID NO: 1299432 - DNA, 18 bp, Homo sapiens
agtttcatgtacaagatg

SEQ ID NO: 1299433 - DNA, 12 bp, Homo sapiens
agtttcctgaaa

SEQ ID NO: 1299434 - DNA, 13 bp, Homo sapiens
agtttgcttagaa

SEQ ID NO: 1299435 - DNA, 21 bp, Homo sapiens
agttttcaagtcaaattaata

SEQ ID NO: 1299436 - DNA, 12 bp, Homo sapiens
ataaaaagcaaa

SEQ ID NO: 1299437 - DNA, 16 bp, Homo sapiens
ataaaaagcaaaacaa

SEQ ID NO: 1299438 - DNA, 21 bp, Homo sapiens
ataaaaagcttccatgattct

SEQ ID NO: 1299439 - DNA, 17 bp, Homo sapiens
ataaaaggaagccaaag

SEQ ID NO: 1299440 - DNA, 19 bp, Homo sapiens
ataaaaggaagccaaagag

SEQ ID NO: 1299441 - DNA, 20 bp, Homo sapiens
ataaaaggaagccaaagagt

SEQ ID NO: 1299442 - DNA, 19 bp, Homo sapiens
ataaagtttgcttagaaaa

SEQ ID NO: 1299443 - DNA, 12 bp, Homo sapiens
ataaataaatgt

SEQ ID NO: 1299444 - DNA, 18 bp, Homo sapiens
ataaatctgacccagtgc

SEQ ID NO: 1299445 - DNA, 18 bp, Homo sapiens
ataagtggaggcacttta

SEQ ID NO: 1299446 - DNA, 14 bp, Homo sapiens
ataagtgtattttt

SEQ ID NO: 1299447 - DNA, 15 bp, Homo sapiens
ataatcttattaggg

SEQ ID NO: 1299448 - DNA, 19 bp, Homo sapiens
ataatgtctctgtgagact

SEQ ID NO: 1299449 - DNA, 15 bp, Homo sapiens
atacaaattagaaaa

SEQ ID NO: 1299450 - DNA, 18 bp, Homo sapiens
atacaccagcattccttt

SEQ ID NO: 1299451 - DNA, 21 bp, Homo sapiens
atacatatctttattaatcac

SEQ ID NO: 1299452 - DNA, 14 bp, Homo sapiens
atactaccttgaaa

SEQ ID NO: 1299453 - DNA, 19 bp, Homo sapiens
atactcttaggaagagaaa

SEQ ID NO: 1299454 - DNA, 21 bp, Homo sapiens
atactcttaggaagagaaacc

SEQ ID NO: 1299455 - DNA, 15 bp, Homo sapiens
atactgctactgtaa

SEQ ID NO: 1299456 - DNA, 20 bp, Homo sapiens
atacttgaagggccagagcc

SEQ ID NO: 1299457 - DNA, 20 bp, Homo sapiens
atactttttacaattaaaaa

SEQ ID NO: 1299458 - DNA, 21 bp, Homo sapiens
atacttttttttctttaaaaa

SEQ ID NO: 1299459 - DNA, 19 bp, Homo sapiens
atagaatatttattacctc

SEQ ID NO: 1299460 - DNA, 22 bp, Homo sapiens
atagcagattttaattttgaat

SEQ ID NO: 1299461 - DNA, 22 bp, Homo sapiens
ataggactcaaagtttcagaga

SEQ ID NO: 1299462 - DNA, 20 bp, Homo sapiens
atagtctagatggctcctct

SEQ ID NO: 1299463 - DNA, 15 bp, Homo sapiens
atagttagaacctgg

SEQ ID NO: 1299464 - DNA, 22 bp, Homo sapiens
atatatacatagcatgacattt

SEQ ID NO: 1299465 - DNA, 17 bp, Homo sapiens
atatccattctttctga

SEQ ID NO: 1299466 - DNA, 16 bp, Homo sapiens
atatctttattaatca

SEQ ID NO: 1299467 - DNA, 16 bp, Homo sapiens
atatgttgaatacttt

SEQ ID NO: 1299468 - DNA, 18 bp, Homo sapiens
atatgttgaatacttttt

SEQ ID NO: 1299469 - DNA, 12 bp, Homo sapiens
atattaaatctg

SEQ ID NO: 1299470 - DNA, 13 bp, Homo sapiens
atattgtgtttgt

SEQ ID NO: 1299471 - DNA, 21 bp, Homo sapiens
atattgtgtttgtgtatttac

SEQ ID NO: 1299472 - DNA, 14 bp, Homo sapiens
atatttattacctc

SEQ ID NO: 1299473 - DNA, 23 bp, Homo sapiens
atatttattattttcacctgttt

SEQ ID NO: 1299474 - DNA, 22 bp, Homo sapiens
atatttgtgatagcactttcta

SEQ ID NO: 1299475 - DNA, 18 bp, Homo sapiens
atattttctttaatgctt

SEQ ID NO: 1299476 - DNA, 13 bp, Homo sapiens
atatttttagata

SEQ ID NO: 1299477 - DNA, 21 bp, Homo sapiens
atatttttttaaaatgttaaa

SEQ ID NO: 1299478 - DNA, 13 bp, Homo sapiens
atcaacatctttt

SEQ ID NO: 1299479 - DNA, 22 bp, Homo sapiens
atcactggttgcacttatgatt

SEQ ID NO: 1299480 - DNA, 15 bp, Homo sapiens
atcactgtctttcct

SEQ ID NO: 1299481 - DNA, 19 bp, Homo sapiens
atcacttgaggtcaggagt

SEQ ID NO: 1299482 - DNA, 19 bp, Homo sapiens
atcagaatagccacatttg

SEQ ID NO: 1299483 - DNA, 14 bp, Homo sapiens
atcagtataaacaa

SEQ ID NO: 1299484 - DNA, 19 bp, Homo sapiens
atcagtgtaccatttgcct

SEQ ID NO: 1299485 - DNA, 12 bp, Homo sapiens
atcatcctactg

SEQ ID NO: 1299486 - DNA, 12 bp, Homo sapiens
atcatgccctgt

SEQ ID NO: 1299487 - DNA, 13 bp, Homo sapiens
atccaaaagaagc

SEQ ID NO: 1299488 - DNA, 18 bp, Homo sapiens
atccaaaagaagccccca

SEQ ID NO: 1299489 - DNA, 22 bp, Homo sapiens
atccaaaagaagcccccagcta

SEQ ID NO: 1299490 - DNA, 15 bp, Homo sapiens
atccaaagcagacag

SEQ ID NO: 1299491 - DNA, 22 bp, Homo sapiens
atccaatattttctttaatgct

SEQ ID NO: 1299492 - DNA, 17 bp, Homo sapiens
atccagcctggggtctg

SEQ ID NO: 1299493 - DNA, 22 bp, Homo sapiens
atccaggactatatttgggcct

SEQ ID NO: 1299494 - DNA, 23 bp, Homo sapiens
atccaggactatatttgggcctg

SEQ ID NO: 1299495 - DNA, 19 bp, Homo sapiens
atccaggcagatccaggac

SEQ ID NO: 1299496 - DNA, 13 bp, Homo sapiens
atccagggacaga

SEQ ID NO: 1299497 - DNA, 19 bp, Homo sapiens
atccagggacagaggcccc

SEQ ID NO: 1299498 - DNA, 17 bp, Homo sapiens
atcccaactgtcttttt

SEQ ID NO: 1299499 - DNA, 19 bp, Homo sapiens
atcccagcactttgggagg

SEQ ID NO: 1299500 - DNA, 22 bp, Homo sapiens
atccccaataattgcagaacta

SEQ ID NO: 1299501 - DNA, 19 bp, Homo sapiens
atccctcccccccatgcac

SEQ ID NO: 1299502 - DNA, 21 bp, Homo sapiens
atccctcccccccatgcactg

SEQ ID NO: 1299503 - DNA, 13 bp, Homo sapiens
atccctttattac

SEQ ID NO: 1299504 - DNA, 14 bp, Homo sapiens
atccctttattacc

SEQ ID NO: 1299505 - DNA, 16 bp, Homo sapiens
atcctacctgttttgt

SEQ ID NO: 1299506 - DNA, 13 bp, Homo sapiens
atcctccagcagg

SEQ ID NO: 1299507 - DNA, 15 bp, Homo sapiens
atcctggaggcccag

SEQ ID NO: 1299508 - DNA, 19 bp, Homo sapiens
atcctggaggcccagttca

SEQ ID NO: 1299509 - DNA, 21 bp, Homo sapiens
atcctgggggacccaatgtag

SEQ ID NO: 1299510 - DNA, 24 bp, Homo sapiens
caaggtttaggctggtggcccagg

SEQ ID NO: 1299511 - DNA, 15 bp, Homo sapiens
caagtcaaattaata

SEQ ID NO: 1299512 - DNA, 21 bp, Homo sapiens
caagtggaccttaggccttcc

SEQ ID NO: 1299513 - DNA, 23 bp, Homo sapiens
caagtggaccttaggccttcctc

SEQ ID NO: 1299514 - DNA, 18 bp, Homo sapiens
caagtggactcagggcag

SEQ ID NO: 1299515 - DNA, 18 bp, Homo sapiens
caagtggtggtaaccctg

SEQ ID NO: 1299516 - DNA, 22 bp, Homo sapiens
caagtggtggtaaccctggtgg

SEQ ID NO: 1299517 - DNA, 15 bp, Homo sapiens
caagttgaattgagg

SEQ ID NO: 1299518 - DNA, 15 bp, Homo sapiens
caataaagcatttat

SEQ ID NO: 1299519 - DNA, 17 bp, Homo sapiens
caataaatctgacccag

SEQ ID NO: 1299520 - DNA, 14 bp, Homo sapiens
caatattaaatctg

SEQ ID NO: 1299521 - DNA, 14 bp, Homo sapiens
caatattataattt

SEQ ID NO: 1299522 - DNA, 22 bp, Homo sapiens
caatattataatttttttcaat

SEQ ID NO: 1299523 - DNA, 13 bp, Homo sapiens
caatatttattat

SEQ ID NO: 1299524 - DNA, 14 bp, Homo sapiens
caatatttattatt

SEQ ID NO: 1299525 - DNA, 19 bp, Homo sapiens
caatatttattattttcac

SEQ ID NO: 1299526 - DNA, 20 bp, Homo sapiens
caatccctttattaccccct

SEQ ID NO: 1299527 - DNA, 21 bp, Homo sapiens
caatgatgaatgagaatctac

SEQ ID NO: 1299528 - DNA, 14 bp, Homo sapiens
caatgctgatttgg

SEQ ID NO: 1299529 - DNA, 23 bp, Homo sapiens
caatgggagctgaggccacactc

SEQ ID NO: 1299530 - DNA, 15 bp, Homo sapiens
caatgtctgagtgaa

SEQ ID NO: 1299531 - DNA, 18 bp, Homo sapiens
caatgtgaactttattaa

SEQ ID NO: 1299532 - DNA, 19 bp, Homo sapiens
caatgtgaactttattaaa

SEQ ID NO: 1299533 - DNA, 23 bp, Homo sapiens
caattaaaaaaaaagatctgttt

SEQ ID NO: 1299534 - DNA, 23 bp, Homo sapiens
caattcagacaggcaaataaaag

SEQ ID NO: 1299535 - DNA, 13 bp, Homo sapiens
caattcctctggg

SEQ ID NO: 1299536 - DNA, 14 bp, Homo sapiens
caattgtaaattga

SEQ ID NO: 1299537 - DNA, 11 bp, Homo sapiens
cacaaagccca

SEQ ID NO: 1299538 - DNA, 12 bp, Homo sapiens
cacagaaacctt

SEQ ID NO: 1299539 - DNA, 12 bp, Homo sapiens
cacagcacagcc

SEQ ID NO: 1299540 - DNA, 13 bp, Homo sapiens
cacaggcctgaga

SEQ ID NO: 1299541 - DNA, 19 bp, Homo sapiens
cacaggcctgagatttcat

SEQ ID NO: 1299542 - DNA, 22 bp, Homo sapiens
cacaggcctgagatttcatctg

SEQ ID NO: 1299543 - DNA, 15 bp, Homo sapiens
cacaggtctttccta

SEQ ID NO: 1299544 - DNA, 20 bp, Homo sapiens
cacaggtctttcctaaggct

SEQ ID NO: 1299545 - DNA, 15 bp, Homo sapiens
cacagtgaagtgctg

SEQ ID NO: 1299546 - DNA, 22 bp, Homo sapiens
cacataccctcttcatggatgg

SEQ ID NO: 1299547 - DNA, 13 bp, Homo sapiens
cacatatgagggg

SEQ ID NO: 1299548 - DNA, 13 bp, Homo sapiens
cacatctaagcct

SEQ ID NO: 1299549 - DNA, 14 bp, Homo sapiens
cacatctaagcctg

SEQ ID NO: 1299550 - DNA, 13 bp, Homo sapiens
caccaagcacagc

SEQ ID NO: 1299551 - DNA, 16 bp, Homo sapiens
caccagacacccagga

SEQ ID NO: 1299552 - DNA, 15 bp, Homo sapiens
caccagcattccttt

SEQ ID NO: 1299553 - DNA, 12 bp, Homo sapiens
cacccctggggg

SEQ ID NO: 1299554 - DNA, 17 bp, Homo sapiens
cacccctggttctcatc

SEQ ID NO: 1299555 - DNA, 18 bp, Homo sapiens
cacccctggttctcatct

SEQ ID NO: 1299556 - DNA, 16 bp, Homo sapiens
caccctggtgggccaa

SEQ ID NO: 1299557 - DNA, 14 bp, Homo sapiens
caccgttctgtgca

SEQ ID NO: 1299558 - DNA, 20 bp, Homo sapiens
cacctaatccaggcagatcc

SEQ ID NO: 1299559 - DNA, 22 bp, Homo sapiens
cacctaatccaggcagatccag

SEQ ID NO: 1299560 - DNA, 10 bp, Homo sapiens
cacctccctg

SEQ ID NO: 1299561 - DNA, 12 bp, Homo sapiens
cacctccctgcc

SEQ ID NO: 1299562 - DNA, 15 bp, Homo sapiens
cacctccctgcctcc

SEQ ID NO: 1299563 - DNA, 17 bp, Homo sapiens
cacctccctgcctccag

SEQ ID NO: 1299564 - DNA, 19 bp, Homo sapiens
cacctctccctgaccctgt

SEQ ID NO: 1299565 - DNA, 13 bp, Homo sapiens
cacctgcctcagg

SEQ ID NO: 1299566 - DNA, 14 bp, Homo sapiens
cacctgcctcagga

SEQ ID NO: 1299567 - DNA, 19 bp, Homo sapiens
cacctgtttttaagctgtt

SEQ ID NO: 1299568 - DNA, 17 bp, Homo sapiens
caccttggcaccagaca

SEQ ID NO: 1299569 - DNA, 15 bp, Homo sapiens
cacgcacctgcctca

SEQ ID NO: 1299570 - DNA, 17 bp, Homo sapiens
cacgctttctagctgtt

SEQ ID NO: 1299571 - DNA, 19 bp, Homo sapiens
cacggccacatcaaagagg

SEQ ID NO: 1299572 - DNA, 16 bp, Homo sapiens
cactaagcagaggagg

SEQ ID NO: 1299573 - DNA, 17 bp, Homo sapiens
cactaagcagaggaggg

SEQ ID NO: 1299574 - DNA, 15 bp, Homo sapiens
cactcagcacaaggc

SEQ ID NO: 1299575 - DNA, 17 bp, Homo sapiens
cactgaattccattttt

SEQ ID NO: 1299576 - DNA, 15 bp, Homo sapiens
cactgaccagaacta

SEQ ID NO: 1299577 - DNA, 16 bp, Homo sapiens
cactgagaatgtaaga

SEQ ID NO: 1299578 - DNA, 19 bp, Homo sapiens
cactgagaatgtaagaact

SEQ ID NO: 1299579 - DNA, 20 bp, Homo sapiens
cactgagaatgtaagaacta

SEQ ID NO: 1299580 - DNA, 14 bp, Homo sapiens
cactgaggaagaac

SEQ ID NO: 1299581 - DNA, 15 bp, Homo sapiens
cactgatgcttagat

SEQ ID NO: 1299582 - DNA, 16 bp, Homo sapiens
cactgatgcttagatg

SEQ ID NO: 1299583 - DNA, 15 bp, Homo sapiens
cactgtcctgggcct

SEQ ID NO: 1299584 - DNA, 13 bp, Homo sapiens
cactgtgaaggac

SEQ ID NO: 1299585 - DNA, 19 bp, Homo sapiens
cactgtgacccccagctcc

SEQ ID NO: 1299586 - DNA, 20 bp, Homo sapiens
cactgtgacccccagctccg

SEQ ID NO: 1299587 - DNA, 22 bp, Homo sapiens
cactgtgacccccagctccggc

SEQ ID NO: 1299588 - DNA, 14 bp, Homo sapiens
cacttcaccctgga

SEQ ID NO: 1299589 - DNA, 14 bp, Homo sapiens
cacttgtccagctg

SEQ ID NO: 1299590 - DNA, 17 bp, Homo sapiens
cacttgtgattatttat

SEQ ID NO: 1299591 - DNA, 15 bp, Homo sapiens
cactttagggctgta

SEQ ID NO: 1299592 - DNA, 23 bp, Homo sapiens
cactttagggctgtaaaatgcat

SEQ ID NO: 1299593 - DNA, 23 bp, Homo sapiens
cactttctacaatgtgaacttta

SEQ ID NO: 1299594 - DNA, 12 bp, Homo sapiens
cactttgggagg

SEQ ID NO: 1299595 - DNA, 13 bp, Homo sapiens
cactttgggaggc

SEQ ID NO: 1299596 - DNA, 17 bp, Homo sapiens
cagaaagtgtgctttat

SEQ ID NO: 1299597 - DNA, 20 bp, Homo sapiens
cagaactaaactcatttata

SEQ ID NO: 1299598 - DNA, 22 bp, Homo sapiens
cagaactcaaatggggccagat

SEQ ID NO: 1299599 - DNA, 15 bp, Homo sapiens
cagaactcactgggg

SEQ ID NO: 1299600 - DNA, 12 bp, Homo sapiens
cagaagcttcca

SEQ ID NO: 1299601 - DNA, 19 bp, Homo sapiens
cagaagggggtggtgtctc

SEQ ID NO: 1299602 - DNA, 21 bp, Homo sapiens
cagaagggggtggtgtctcca

SEQ ID NO: 1299603 - DNA, 18 bp, Homo sapiens
cagaatgctgcaggactt

SEQ ID NO: 1299604 - DNA, 23 bp, Homo sapiens
cagaattggatacatacaccagc

SEQ ID NO: 1299605 - DNA, 15 bp, Homo sapiens
cagacacaggccctc

SEQ ID NO: 1299606 - DNA, 15 bp, Homo sapiens
cagacaggccccgtg

SEQ ID NO: 1299607 - DNA, 20 bp, Homo sapiens
cagacaggccccgtgaggca

SEQ ID NO: 1299608 - DNA, 23 bp, Homo sapiens
cagacctgatcctggaggcccag

SEQ ID NO: 1299609 - DNA, 19 bp, Homo sapiens
cagactcacaacctgaacc

SEQ ID NO: 1299610 - DNA, 21 bp, Homo sapiens
cagactcacaacctgaaccta

SEQ ID NO: 1299611 - DNA, 14 bp, Homo sapiens
cagactcagacatt

SEQ ID NO: 1299612 - DNA, 18 bp, Homo sapiens
cagactcccattcctgaa

SEQ ID NO: 1299613 - DNA, 23 bp, Homo sapiens
cagagaagctataaattcctctt

SEQ ID NO: 1299614 - DNA, 17 bp, Homo sapiens
cagagacatacttgaag

SEQ ID NO: 1299615 - DNA, 19 bp, Homo sapiens
cagagagcctggtgctgct

SEQ ID NO: 1299616 - DNA, 19 bp, Homo sapiens
cagagatccaaaagaagcc

SEQ ID NO: 1299617 - DNA, 20 bp, Homo sapiens
cagagatccaaaagaagccc

SEQ ID NO: 1299618 - DNA, 21 bp, Homo sapiens
cagagatccaaaagaagcccc

SEQ ID NO: 1299619 - DNA, 13 bp, Homo sapiens
cagagcccagctc

SEQ ID NO: 1299620 - DNA, 16 bp, Homo sapiens
ccaggaatttcccagg

SEQ ID NO: 1299621 - DNA, 18 bp, Homo sapiens
ccaggaatttcccaggac

SEQ ID NO: 1299622 - DNA, 22 bp, Homo sapiens
ccaggaatttcccaggaccctg

SEQ ID NO: 1299623 - DNA, 16 bp, Homo sapiens
ccaggaccagctcagg

SEQ ID NO: 1299624 - DNA, 20 bp, Homo sapiens
ccaggaccagctcaggacag

SEQ ID NO: 1299625 - DNA, 17 bp, Homo sapiens
ccaggacctggctgcca

SEQ ID NO: 1299626 - DNA, 21 bp, Homo sapiens
ccaggactatatttgggcctg

SEQ ID NO: 1299627 - DNA, 12 bp, Homo sapiens
ccaggactgggc

SEQ ID NO: 1299628 - DNA, 13 bp, Homo sapiens
ccaggactgggcc

SEQ ID NO: 1299629 - DNA, 18 bp, Homo sapiens
ccaggcagatccaggact

SEQ ID NO: 1299630 - DNA, 19 bp, Homo sapiens
ccaggcagatccaggacta

SEQ ID NO: 1299631 - DNA, 19 bp, Homo sapiens
ccaggcagggccaaccctt

SEQ ID NO: 1299632 - DNA, 23 bp, Homo sapiens
ccaggcagggccaacccttctcc

SEQ ID NO: 1299633 - DNA, 13 bp, Homo sapiens
ccaggctgaagca

SEQ ID NO: 1299634 - DNA, 20 bp, Homo sapiens
ccagggacagaggccccagc

SEQ ID NO: 1299635 - DNA, 13 bp, Homo sapiens
ccagggagccttt

SEQ ID NO: 1299636 - DNA, 18 bp, Homo sapiens
ccagggagcctttggttc

SEQ ID NO: 1299637 - DNA, 16 bp, Homo sapiens
ccagggcccagagccc

SEQ ID NO: 1299638 - DNA, 17 bp, Homo sapiens
ccagggcccagagccca

SEQ ID NO: 1299639 - DNA, 19 bp, Homo sapiens
ccagggcccagagcccagc

SEQ ID NO: 1299640 - DNA, 21 bp, Homo sapiens
ccagggcccagagcccagctc

SEQ ID NO: 1299641 - DNA, 22 bp, Homo sapiens
ccagggcccagagcccagctcc

SEQ ID NO: 1299642 - DNA, 17 bp, Homo sapiens
ccagggcccccatctca

SEQ ID NO: 1299643 - DNA, 13 bp, Homo sapiens
ccagggctggact

SEQ ID NO: 1299644 - DNA, 21 bp, Homo sapiens
ccaggtgttactgtaattcct

SEQ ID NO: 1299645 - DNA, 16 bp, Homo sapiens
ccagtctccaccagga

SEQ ID NO: 1299646 - DNA, 23 bp, Homo sapiens
ccagtctccaccaggaacctctt

SEQ ID NO: 1299647 - DNA, 15 bp, Homo sapiens
ccatagtaccattta

SEQ ID NO: 1299648 - DNA, 14 bp, Homo sapiens
ccatccccgcagtg

SEQ ID NO: 1299649 - DNA, 20 bp, Homo sapiens
ccatctcatgcccctggctg

SEQ ID NO: 1299650 - DNA, 12 bp, Homo sapiens
ccatctgggctc

SEQ ID NO: 1299651 - DNA, 21 bp, Homo sapiens
ccatgagttggggtctggcag

SEQ ID NO: 1299652 - DNA, 15 bp, Homo sapiens
ccatgatggcaacag

SEQ ID NO: 1299653 - DNA, 13 bp, Homo sapiens
ccatgcactgtga

SEQ ID NO: 1299654 - DNA, 16 bp, Homo sapiens
ccatgcactgtgaagg

SEQ ID NO: 1299655 - DNA, 19 bp, Homo sapiens
ccatgcactgtgaaggacc

SEQ ID NO: 1299656 - DNA, 14 bp, Homo sapiens
ccatgcctcagccc

SEQ ID NO: 1299657 - DNA, 16 bp, Homo sapiens
ccatgcctcagccctg

SEQ ID NO: 1299658 - DNA, 21 bp, Homo sapiens
ccatgcctcagccctgaccct

SEQ ID NO: 1299659 - DNA, 14 bp, Homo sapiens
ccatggacaggctg

SEQ ID NO: 1299660 - DNA, 18 bp, Homo sapiens
ccatggacaggctggctc

SEQ ID NO: 1299661 - DNA, 19 bp, Homo sapiens
ccatggacaggctggctcc

SEQ ID NO: 1299662 - DNA, 14 bp, Homo sapiens
ccatggagccagct

SEQ ID NO: 1299663 - DNA, 22 bp, Homo sapiens
ccatggagccagctccctctat

SEQ ID NO: 1299664 - DNA, 23 bp, Homo sapiens
ccatgtagccccctggcctctgt

SEQ ID NO: 1299665 - DNA, 13 bp, Homo sapiens
ccattctttctga

SEQ ID NO: 1299666 - DNA, 17 bp, Homo sapiens
ccattctttctgataac

SEQ ID NO: 1299667 - DNA, 16 bp, Homo sapiens
ccattcttttgtaatt

SEQ ID NO: 1299668 - DNA, 17 bp, Homo sapiens
ccattgtccctctgccc

SEQ ID NO: 1299669 - DNA, 13 bp, Homo sapiens
ccatttctattta

SEQ ID NO: 1299670 - DNA, 14 bp, Homo sapiens
ccatttctatttat

SEQ ID NO: 1299671 - DNA, 15 bp, Homo sapiens
cccaagaatgggagg

SEQ ID NO: 1299672 - DNA, 14 bp, Homo sapiens
cccaagcttagaac

SEQ ID NO: 1299673 - DNA, 12 bp, Homo sapiens
cccaatattata

SEQ ID NO: 1299674 - DNA, 23 bp, Homo sapiens
cccacaagtggtggtaaccctgg

SEQ ID NO: 1299675 - DNA, 18 bp, Homo sapiens
cccaccctggtgggccaa

SEQ ID NO: 1299676 - DNA, 19 bp, Homo sapiens
cccaccgtgggcagggagc

SEQ ID NO: 1299677 - DNA, 16 bp, Homo sapiens
cccacctccctgcctc

SEQ ID NO: 1299678 - DNA, 16 bp, Homo sapiens
cccactgtcctgggcc

SEQ ID NO: 1299679 - DNA, 22 bp, Homo sapiens
cccagacctgttagcagacagg

SEQ ID NO: 1299680 - DNA, 13 bp, Homo sapiens
cccagactcagac

SEQ ID NO: 1299681 - DNA, 20 bp, Homo sapiens
cccagactcagacattggca

SEQ ID NO: 1299682 - DNA, 21 bp, Homo sapiens
cccagagacatacttgaaggg

SEQ ID NO: 1299683 - DNA, 13 bp, Homo sapiens
cccagcactgagg

SEQ ID NO: 1299684 - DNA, 14 bp, Homo sapiens
cccagcactgagga

SEQ ID NO: 1299685 - DNA, 15 bp, Homo sapiens
cccagcactttggga

SEQ ID NO: 1299686 - DNA, 21 bp, Homo sapiens
cccagccaggccccaggcagg

SEQ ID NO: 1299687 - DNA, 15 bp, Homo sapiens
cccagcccagagaca

SEQ ID NO: 1299688 - DNA, 16 bp, Homo sapiens
cccagcccagagacat

SEQ ID NO: 1299689 - DNA, 16 bp, Homo sapiens
cccagctaagaacctg

SEQ ID NO: 1299690 - DNA, 21 bp, Homo sapiens
cccaggaccagctcaggacag

SEQ ID NO: 1299691 - DNA, 22 bp, Homo sapiens
cccaggaccagctcaggacaga

SEQ ID NO: 1299692 - DNA, 12 bp, Homo sapiens
cccaggaccctg

SEQ ID NO: 1299693 - DNA, 14 bp, Homo sapiens
cccaggactgggcc

SEQ ID NO: 1299694 - DNA, 23 bp, Homo sapiens
cccaggcagggccaacccttctc

SEQ ID NO: 1299695 - DNA, 19 bp, Homo sapiens
cccaggctggagtgcagtg

SEQ ID NO: 1299696 - DNA, 21 bp, Homo sapiens
cccatctcatgcccctggctg

SEQ ID NO: 1299697 - DNA, 14 bp, Homo sapiens
cccatgcactgtga

SEQ ID NO: 1299698 - DNA, 19 bp, Homo sapiens
cccatgcactgtgaaggac

SEQ ID NO: 1299699 - DNA, 13 bp, Homo sapiens
cccatggagccag

SEQ ID NO: 1299700 - DNA, 15 bp, Homo sapiens
cccatgtagccccct

SEQ ID NO: 1299701 - DNA, 23 bp, Homo sapiens
cccatgtagccccctggcctctg

SEQ ID NO: 1299702 - DNA, 14 bp, Homo sapiens
cccattcttttgta

SEQ ID NO: 1299703 - DNA, 22 bp, Homo sapiens
cccattcttttgtaatttaaat

SEQ ID NO: 1299704 - DNA, 20 bp, Homo sapiens
ccccacccctgggggctctc

SEQ ID NO: 1299705 - DNA, 14 bp, Homo sapiens
ccccactgaccaga

SEQ ID NO: 1299706 - DNA, 15 bp, Homo sapiens
ccccactgaccagaa

SEQ ID NO: 1299707 - DNA, 12 bp, Homo sapiens
ccccagcccaga

SEQ ID NO: 1299708 - DNA, 16 bp, Homo sapiens
ccccagcccagagaca

SEQ ID NO: 1299709 - DNA, 15 bp, Homo sapiens
ccccagcctccctga

SEQ ID NO: 1299710 - DNA, 13 bp, Homo sapiens
ccccaggaccagc

SEQ ID NO: 1299711 - DNA, 19 bp, Homo sapiens
ccccaggaccagctcagga

SEQ ID NO: 1299712 - DNA, 21 bp, Homo sapiens
ccccatctcatgcccctggct

SEQ ID NO: 1299713 - DNA, 23 bp, Homo sapiens
ccccatctcatgcccctggctgg

SEQ ID NO: 1299714 - DNA, 13 bp, Homo sapiens
ccccatttctatt

SEQ ID NO: 1299715 - DNA, 22 bp, Homo sapiens
cccccacctctccctgaccctg

SEQ ID NO: 1299716 - DNA, 13 bp, Homo sapiens
cccccagcactga

SEQ ID NO: 1299717 - DNA, 17 bp, Homo sapiens
cccccagcactgaggaa

SEQ ID NO: 1299718 - DNA, 18 bp, Homo sapiens
cccccagcactgaggaag

SEQ ID NO: 1299719 - DNA, 11 bp, Homo sapiens
cccccaggact

SEQ ID NO: 1299720 - DNA, 13 bp, Homo sapiens
cccccaggactgg

SEQ ID NO: 1299721 - DNA, 18 bp, Homo sapiens
cccccatgcactgtgaag

SEQ ID NO: 1299722 - DNA, 12 bp, Homo sapiens
ccccccacccct

SEQ ID NO: 1299723 - DNA, 12 bp, Homo sapiens
ccccccagcact

SEQ ID NO: 1299724 - DNA, 13 bp, Homo sapiens
ccccccagcactg

SEQ ID NO: 1299725 - DNA, 22 bp, Homo sapiens
ccccctggcctctgtgccttct

SEQ ID NO: 1299726 - DNA, 14 bp, Homo sapiens
ccccgcttctgcct

SEQ ID NO: 1299727 - DNA, 15 bp, Homo sapiens
cccctccctttctcc

SEQ ID NO: 1299728 - DNA, 15 bp, Homo sapiens
cccctcctccactct

SEQ ID NO: 1299729 - DNA, 18 bp, Homo sapiens
cccctcctccactctccc

SEQ ID NO: 1299730 - DNA, 14 bp, Homo sapiens
cccctctccttcct

SEQ ID NO: 1299731 - DNA, 18 bp, Homo sapiens
cccctgcccccaggactg

SEQ ID NO: 1299732 - DNA, 12 bp, Homo sapiens
cccctggcctct

SEQ ID NO: 1299733 - DNA, 22 bp, Homo sapiens
cccctggctgggacgtggctca

SEQ ID NO: 1299734 - DNA, 22 bp, Homo sapiens
ctagcagcaccgttctgtgcac

SEQ ID NO: 1299735 - DNA, 23 bp, Homo sapiens
ctagccaaatggtttaacttctg

SEQ ID NO: 1299736 - DNA, 23 bp, Homo sapiens
ctagctctatgtttacaaatgga

SEQ ID NO: 1299737 - DNA, 21 bp, Homo sapiens
ctagctgggggtgggccaggc

SEQ ID NO: 1299738 - DNA, 22 bp, Homo sapiens
ctagctgggggtgggccaggct

SEQ ID NO: 1299739 - DNA, 17 bp, Homo sapiens
ctaggcctcagccagag

SEQ ID NO: 1299740 - DNA, 23 bp, Homo sapiens
ctagtcaagctcctcctccctgc

SEQ ID NO: 1299741 - DNA, 23 bp, Homo sapiens
ctataaattcctctttgctttgc

SEQ ID NO: 1299742 - DNA, 15 bp, Homo sapiens
ctatacatatcttta

SEQ ID NO: 1299743 - DNA, 17 bp, Homo sapiens
ctatacatatctttatt

SEQ ID NO: 1299744 - DNA, 12 bp, Homo sapiens
ctatagactcta

SEQ ID NO: 1299745 - DNA, 15 bp, Homo sapiens
ctatctactctcctc

SEQ ID NO: 1299746 - DNA, 19 bp, Homo sapiens
ctattcagtggcgagaaat

SEQ ID NO: 1299747 - DNA, 17 bp, Homo sapiens
atctgctctccttcctg

SEQ ID NO: 1299748 - DNA, 18 bp, Homo sapiens
atctggaacccagactca

SEQ ID NO: 1299749 - DNA, 23 bp, Homo sapiens
atctggaacccagactcagacat

SEQ ID NO: 1299750 - DNA, 20 bp, Homo sapiens
atctggaacctcagcctggc

SEQ ID NO: 1299751 - DNA, 21 bp, Homo sapiens
atctggaatctggagaccagg

SEQ ID NO: 1299752 - DNA, 14 bp, Homo sapiens
atctggtcctaccc

SEQ ID NO: 1299753 - DNA, 14 bp, Homo sapiens
atcttccctctccc

SEQ ID NO: 1299754 - DNA, 23 bp, Homo sapiens
atcttgaaattaagaaggcaaaa

SEQ ID NO: 1299755 - DNA, 13 bp, Homo sapiens
atcttgctctgct

SEQ ID NO: 1299756 - DNA, 15 bp, Homo sapiens
atcttgtctctgggc

SEQ ID NO: 1299757 - DNA, 21 bp, Homo sapiens
atctttacaaaactacatgag

SEQ ID NO: 1299758 - DNA, 13 bp, Homo sapiens
atctttcttgatc

SEQ ID NO: 1299759 - DNA, 16 bp, Homo sapiens
atctttgattctcctt

SEQ ID NO: 1299760 - DNA, 14 bp, Homo sapiens
atctttgtggccaa

SEQ ID NO: 1299761 - DNA, 16 bp, Homo sapiens
atgaagttttacattg

SEQ ID NO: 1299762 - DNA, 15 bp, Homo sapiens
atgaatgtatttatt

SEQ ID NO: 1299763 - DNA, 20 bp, Homo sapiens
atgaatgtatttatttggga

SEQ ID NO: 1299764 - DNA, 15 bp, Homo sapiens
atgaccaaagtcctt

SEQ ID NO: 1299765 - DNA, 18 bp, Homo sapiens
atgacctcttcctttagg

SEQ ID NO: 1299766 - DNA, 23 bp, Homo sapiens
atgagatgatacatccaaagcag

SEQ ID NO: 1299767 - DNA, 24 bp, Homo sapiens
atgagatgatacatccaaagcaga

SEQ ID NO: 1299768 - DNA, 19 bp, Homo sapiens
atgaggggacattttggtg

SEQ ID NO: 1299769 - DNA, 15 bp, Homo sapiens
atgatggatgccaat

SEQ ID NO: 1299770 - DNA, 15 bp, Homo sapiens
atgattccttcctgt

SEQ ID NO: 1299771 - DNA, 22 bp, Homo sapiens
atgattctatttatatgtacat

SEQ ID NO: 1299772 - DNA, 15 bp, Homo sapiens
atgatttccttgaat

SEQ ID NO: 1299773 - DNA, 17 bp, Homo sapiens
atgatttccttgaatgt

SEQ ID NO: 1299774 - DNA, 18 bp, Homo sapiens
atgcaagggactgtgtgt

SEQ ID NO: 1299775 - DNA, 13 bp, Homo sapiens
atgcactgtgaag

SEQ ID NO: 1299776 - DNA, 15 bp, Homo sapiens
atgcagggcagtcat

SEQ ID NO: 1299777 - DNA, 19 bp, Homo sapiens
atgcatggtgccccaggac

SEQ ID NO: 1299778 - DNA, 13 bp, Homo sapiens
atgccctcctctc

SEQ ID NO: 1299779 - DNA, 23 bp, Homo sapiens
atgccctcctctcccattgtccc

SEQ ID NO: 1299780 - DNA, 15 bp, Homo sapiens
atgccctggaggtgg

SEQ ID NO: 1299781 - DNA, 12 bp, Homo sapiens
atgccctgtgca

SEQ ID NO: 1299782 - DNA, 19 bp, Homo sapiens
atgccgatatactctagat

SEQ ID NO: 1299783 - DNA, 13 bp, Homo sapiens
atgcctcagccct

SEQ ID NO: 1299784 - DNA, 21 bp, Homo sapiens
atgcggtagccagcacacagg

SEQ ID NO: 1299785 - DNA, 15 bp, Homo sapiens
atgctccttgttcct

SEQ ID NO: 1299786 - DNA, 12 bp, Homo sapiens
atgctggcccag

SEQ ID NO: 1299787 - DNA, 18 bp, Homo sapiens
atgctggcccagggccca

SEQ ID NO: 1299788 - DNA, 20 bp, Homo sapiens
atgctggcccagggcccaga

SEQ ID NO: 1299789 - DNA, 12 bp, Homo sapiens
atgctgtacatc

SEQ ID NO: 1299790 - DNA, 16 bp, Homo sapiens
atgctgtacatctatt

SEQ ID NO: 1299791 - DNA, 17 bp, Homo sapiens
atgcttagatgttccag

SEQ ID NO: 1299792 - DNA, 22 bp, Homo sapiens
atgctttttattattattattt

SEQ ID NO: 1299793 - DNA, 23 bp, Homo sapiens
atgctttttatttctgcatatgt

SEQ ID NO: 1299794 - DNA, 14 bp, Homo sapiens
atggaattgatttg

SEQ ID NO: 1299795 - DNA, 17 bp, Homo sapiens
atggaattgatttgcat

SEQ ID NO: 1299796 - DNA, 14 bp, Homo sapiens
atggacaggctggc

SEQ ID NO: 1299797 - DNA, 19 bp, Homo sapiens
atggacaggctggctccag

SEQ ID NO: 1299798 - DNA, 15 bp, Homo sapiens
atggagccagctccc

SEQ ID NO: 1299799 - DNA, 23 bp, Homo sapiens
atggagccagctccctctattta

SEQ ID NO: 1299800 - DNA, 19 bp, Homo sapiens
atggattctccactcagtt

SEQ ID NO: 1299801 - DNA, 17 bp, Homo sapiens
atggcaacagatctgga

SEQ ID NO: 1299802 - DNA, 18 bp, Homo sapiens
atggccggagaggaccgg

SEQ ID NO: 1299803 - DNA, 13 bp, Homo sapiens
atggctcctctca

SEQ ID NO: 1299804 - DNA, 21 bp, Homo sapiens
atgggaaagtattctgtactc

SEQ ID NO: 1299805 - DNA, 13 bp, Homo sapiens
atggggccagatc

SEQ ID NO: 1299806 - DNA, 21 bp, Homo sapiens
atgggggaactcagatccagg

SEQ ID NO: 1299807 - DNA, 18 bp, Homo sapiens
atggtaggcatttcctat

SEQ ID NO: 1299808 - DNA, 14 bp, Homo sapiens
atggtgccccagga

SEQ ID NO: 1299809 - DNA, 15 bp, Homo sapiens
atggtgccccaggac

SEQ ID NO: 1299810 - DNA, 20 bp, Homo sapiens
atggtgccccaggaccagct

SEQ ID NO: 1299811 - DNA, 22 bp, Homo sapiens
atggtgccccaggaccagctca

SEQ ID NO: 1299812 - DNA, 14 bp, Homo sapiens
atggtgctgagaag

SEQ ID NO: 1299813 - DNA, 19 bp, Homo sapiens
atgtagccccctggcctct

SEQ ID NO: 1299814 - DNA, 21 bp, Homo sapiens
atgtagccccctggcctctgt

SEQ ID NO: 1299815 - DNA, 23 bp, Homo sapiens
atgtagccccctggcctctgtgc

SEQ ID NO: 1299816 - DNA, 17 bp, Homo sapiens
atgtctattaaggtgat

SEQ ID NO: 1299817 - DNA, 16 bp, Homo sapiens
atgtctgagtgaacct

SEQ ID NO: 1299818 - DNA, 12 bp, Homo sapiens
atgtgaagccaa

SEQ ID NO: 1299819 - DNA, 22 bp, Homo sapiens
atgtgaagccaattcagacagg

SEQ ID NO: 1299820 - DNA, 20 bp, Homo sapiens
atgtgccagggcaatgatga

SEQ ID NO: 1299821 - DNA, 23 bp, Homo sapiens
atgttatttaacagctgaattat

SEQ ID NO: 1299822 - DNA, 14 bp, Homo sapiens
atgttgaatacttt

SEQ ID NO: 1299823 - DNA, 16 bp, Homo sapiens
atgtttacaaatggac

SEQ ID NO: 1299824 - DNA, 22 bp, Homo sapiens
atgttttttaaaatatttatct

SEQ ID NO: 1299825 - DNA, 23 bp, Homo sapiens
attaaactcttcacaaaatctgt

SEQ ID NO: 1299826 - DNA, 19 bp, Homo sapiens
attaagaaggcaaaaatgt

SEQ ID NO: 1299827 - DNA, 15 bp, Homo sapiens
attaatatgaaaact

SEQ ID NO: 1299828 - DNA, 19 bp, Homo sapiens
attaccccctccttcagac

SEQ ID NO: 1299829 - DNA, 20 bp, Homo sapiens
attaccccctccttcagaca

SEQ ID NO: 1299830 - DNA, 13 bp, Homo sapiens
attacctctgata

SEQ ID NO: 1299831 - DNA, 19 bp, Homo sapiens
attagaaaatgttatttaa

SEQ ID NO: 1299832 - DNA, 22 bp, Homo sapiens
attagaatagtgttctgcaaaa

SEQ ID NO: 1299833 - DNA, 20 bp, Homo sapiens
attagggagaaaattcaatt

SEQ ID NO: 1299834 - DNA, 22 bp, Homo sapiens
attataatttttttcaatattt

SEQ ID NO: 1299835 - DNA, 16 bp, Homo sapiens
attatgttttttaaaa

SEQ ID NO: 1299836 - DNA, 15 bp, Homo sapiens
attatttatttattt

SEQ ID NO: 1299837 - DNA, 17 bp, Homo sapiens
attcaaactggggcctc

SEQ ID NO: 1299838 - DNA, 13 bp, Homo sapiens
attcaattgtaaa

SEQ ID NO: 1299839 - DNA, 14 bp, Homo sapiens
attcaattgtaaat

SEQ ID NO: 1299840 - DNA, 18 bp, Homo sapiens
attcaattgtaaattgaa

SEQ ID NO: 1299841 - DNA, 19 bp, Homo sapiens
attcacctgccccaactct

SEQ ID NO: 1299842 - DNA, 13 bp, Homo sapiens
attcagacaggca

SEQ ID NO: 1299843 - DNA, 14 bp, Homo sapiens
attcagacaggcaa

SEQ ID NO: 1299844 - DNA, 19 bp, Homo sapiens
attcagtgattactgtcaa

SEQ ID NO: 1299845 - DNA, 17 bp, Homo sapiens
attcatagtaacttctt

SEQ ID NO: 1299846 - DNA, 16 bp, Homo sapiens
attcatcccaactgtc

SEQ ID NO: 1299847 - DNA, 14 bp, Homo sapiens
attccagaatgctg

SEQ ID NO: 1299848 - DNA, 14 bp, Homo sapiens
attgaacacaaact

SEQ ID NO: 1299849 - DNA, 16 bp, Homo sapiens
attgaacacaaactgt

SEQ ID NO: 1299850 - DNA, 17 bp, Homo sapiens
attgaacacaaactgta

SEQ ID NO: 1299851 - DNA, 19 bp, Homo sapiens
attgaacacaaactgtaaa

SEQ ID NO: 1299852 - DNA, 20 bp, Homo sapiens
attgaatcagtataaacaaa

SEQ ID NO: 1299853 - DNA, 14 bp, Homo sapiens
attgacacagaaaa

SEQ ID NO: 1299854 - DNA, 17 bp, Homo sapiens
attgaccgcgactaatt

SEQ ID NO: 1299855 - DNA, 17 bp, Homo sapiens
attgaggggattaatat

SEQ ID NO: 1299856 - DNA, 15 bp, Homo sapiens
attgagtcaaatggt

SEQ ID NO: 1299857 - DNA, 16 bp, Homo sapiens
attgatttgcattgaa

SEQ ID NO: 1299858 - DNA, 20 bp, Homo sapiens
attgatttgcattgaacaca

SEQ ID NO: 1299859 - DNA, 12 bp, Homo sapiens
attgcaaatctt

SEQ ID NO: 1299860 - DNA, 17 bp, Homo sapiens
attgcaaatcttgaaat

SEQ ID NO: 1299861 - DNA, 22 bp, Homo sapiens
attgcagaactaaactcattta

SEQ ID NO: 1299862 - DNA, 11 bp, Homo sapiens
attgcattgac

SEQ ID NO: 1299863 - DNA, 22 bp, Homo sapiens
attgctgagagaaatatggaac

SEQ ID NO: 1299864 - DNA, 16 bp, Homo sapiens
attgctgagcctctgc

SEQ ID NO: 1299865 - DNA, 10 bp, Homo sapiens
attgctttga

SEQ ID NO: 1299866 - DNA, 20 bp, Homo sapiens
attggcacctaatccaggca

SEQ ID NO: 1299867 - DNA, 13 bp, Homo sapiens
attggctcacact

SEQ ID NO: 1299868 - DNA, 18 bp, Homo sapiens
attgggtgggcaggaaaa

SEQ ID NO: 1299869 - DNA, 16 bp, Homo sapiens
attgtaaattgaatca

SEQ ID NO: 1299870 - DNA, 12 bp, Homo sapiens
attgtccctctg

SEQ ID NO: 1299871 - DNA, 23 bp, Homo sapiens
attgtgaaataaaactggctttg

SEQ ID NO: 1299872 - DNA, 16 bp, Homo sapiens
attgttgagctattgc

SEQ ID NO: 1299873 - DNA, 19 bp, Homo sapiens
attgttgagctattgctgt

SEQ ID NO: 1299874 - DNA, 15 bp, Homo sapiens
atttaacagctgaat

SEQ ID NO: 1299875 - DNA, 17 bp, Homo sapiens
atttacgctttgattca

SEQ ID NO: 1299876 - DNA, 21 bp, Homo sapiens
atttactgagcttctctgtga

SEQ ID NO: 1299877 - DNA, 17 bp, Homo sapiens
atttaggagaagccagg

SEQ ID NO: 1299878 - DNA, 14 bp, Homo sapiens
atttataaaacttc

SEQ ID NO: 1299879 - DNA, 15 bp, Homo sapiens
atttataaaacttct

SEQ ID NO: 1299880 - DNA, 14 bp, Homo sapiens
atttatacaaatta

SEQ ID NO: 1299881 - DNA, 16 bp, Homo sapiens
atttatatgtacatga

SEQ ID NO: 1299882 - DNA, 18 bp, Homo sapiens
atttattaattgctttga

SEQ ID NO: 1299883 - DNA, 18 bp, Homo sapiens
atttattcaattcctctg

SEQ ID NO: 1299884 - DNA, 13 bp, Homo sapiens
atttcaaaatgct

SEQ ID NO: 1299885 - DNA, 16 bp, Homo sapiens
atttcatctgctctcc

SEQ ID NO: 1299886 - DNA, 19 bp, Homo sapiens
atttcatctgctctccttc

SEQ ID NO: 1299887 - DNA, 13 bp, Homo sapiens
atttcccaggacc

SEQ ID NO: 1299888 - DNA, 14 bp, Homo sapiens
atttcccaggaccc

SEQ ID NO: 1299889 - DNA, 16 bp, Homo sapiens
atttcccaggaccctg

SEQ ID NO: 1299890 - DNA, 19 bp, Homo sapiens
atttcccaggaccctgaag

SEQ ID NO: 1299891 - DNA, 14 bp, Homo sapiens
atttccttgaatgt

SEQ ID NO: 1299892 - DNA, 17 bp, Homo sapiens
atttctatttatttact

SEQ ID NO: 1299893 - DNA, 12 bp, Homo sapiens
atttgagtgttt

SEQ ID NO: 1299894 - DNA, 16 bp, Homo sapiens
atttgcattgaacaca

SEQ ID NO: 1299895 - DNA, 14 bp, Homo sapiens
atttggaatacttt

SEQ ID NO: 1299896 - DNA, 12 bp, Homo sapiens
atttggggtgga

SEQ ID NO: 1299897 - DNA, 17 bp, Homo sapiens
atttgggttctgcctgc

SEQ ID NO: 1299898 - DNA, 14 bp, Homo sapiens
attttaatcaagtt

SEQ ID NO: 1299899 - DNA, 18 bp, Homo sapiens
attttaatcaagttgaat

SEQ ID NO: 1299900 - DNA, 21 bp, Homo sapiens
attttatctttgattctcctt

SEQ ID NO: 1299901 - DNA, 23 bp, Homo sapiens
attttatctttgattctccttca

SEQ ID NO: 1299902 - DNA, 15 bp, Homo sapiens
attttctttaatgct

SEQ ID NO: 1299903 - DNA, 20 bp, Homo sapiens
attttggagagtttcctgaa

SEQ ID NO: 1299904 - DNA, 15 bp, Homo sapiens
attttggtgagaaat

SEQ ID NO: 1299905 - DNA, 16 bp, Homo sapiens
attttggtgagaaatg

SEQ ID NO: 1299906 - DNA, 17 bp, Homo sapiens
attttggttttgttccc

SEQ ID NO: 1299907 - DNA, 21 bp, Homo sapiens
attttggttttgttcccctcc

SEQ ID NO: 1299908 - DNA, 21 bp, Homo sapiens
atttttagatagttagaacct

SEQ ID NO: 1299909 - DNA, 17 bp, Homo sapiens
caaaaattagccgggca

SEQ ID NO: 1299910 - DNA, 22 bp, Homo sapiens
caaaacaaaaattaggtatttt

SEQ ID NO: 1299911 - DNA, 16 bp, Homo sapiens
caaaagaagcccccag

SEQ ID NO: 1299912 - DNA, 19 bp, Homo sapiens
caaaaggatctttgtggcc

SEQ ID NO: 1299913 - DNA, 22 bp, Homo sapiens
caaaaggatctttgtggccaag

SEQ ID NO: 1299914 - DNA, 18 bp, Homo sapiens
caaaatgctttttatttc

SEQ ID NO: 1299915 - DNA, 22 bp, Homo sapiens
caaaattgcaaatcttgaaatt

SEQ ID NO: 1299916 - DNA, 15 bp, Homo sapiens
caaacaaaatttcta

SEQ ID NO: 1299917 - DNA, 12 bp, Homo sapiens
caaactgtaaat

SEQ ID NO: 1299918 - DNA, 21 bp, Homo sapiens
caaactgtaaataaaaagaaa

SEQ ID NO: 1299919 - DNA, 20 bp, Homo sapiens
caaagatctgtcctcagcct

SEQ ID NO: 1299920 - DNA, 17 bp, Homo sapiens
caaagcagacagctcca

SEQ ID NO: 1299921 - DNA, 19 bp, Homo sapiens
caaagcagacagctccacc

SEQ ID NO: 1299922 - DNA, 20 bp, Homo sapiens
caaagcttttagaaatactg

SEQ ID NO: 1299923 - DNA, 17 bp, Homo sapiens
caaagtcctttttttcc

SEQ ID NO: 1299924 - DNA, 21 bp, Homo sapiens
caaagttactaggtaacttca

SEQ ID NO: 1299925 - DNA, 20 bp, Homo sapiens
caaataatgtctctgtgaga

SEQ ID NO: 1299926 - DNA, 14 bp, Homo sapiens
caaatactcttagg

SEQ ID NO: 1299927 - DNA, 19 bp, Homo sapiens
caaatggcgtctggaagtc

SEQ ID NO: 1299928 - DNA, 16 bp, Homo sapiens
caaatggggccagatc

SEQ ID NO: 1299929 - DNA, 19 bp, Homo sapiens
caaatggggccagatccag

SEQ ID NO: 1299930 - DNA, 20 bp, Homo sapiens
caaatggggccagatccagc

SEQ ID NO: 1299931 - DNA, 14 bp, Homo sapiens
caaatttgattgat

SEQ ID NO: 1299932 - DNA, 17 bp, Homo sapiens
caaatttgattgatttg

SEQ ID NO: 1299933 - DNA, 19 bp, Homo sapiens
caacacgcacctgcctcag

SEQ ID NO: 1299934 - DNA, 15 bp, Homo sapiens
caacagaagcttcca

SEQ ID NO: 1299935 - DNA, 22 bp, Homo sapiens
caaccagctaagaaaagatttt

SEQ ID NO: 1299936 - DNA, 13 bp, Homo sapiens
caaccccaggctg

SEQ ID NO: 1299937 - DNA, 16 bp, Homo sapiens
caacccccatttctat

SEQ ID NO: 1299938 - DNA, 15 bp, Homo sapiens
caaccccccagcact

SEQ ID NO: 1299939 - DNA, 18 bp, Homo sapiens
caaccccccagcactgag

SEQ ID NO: 1299940 - DNA, 10 bp, Homo sapiens
caacccttct

SEQ ID NO: 1299941 - DNA, 15 bp, Homo sapiens
caacctcttggcctg

SEQ ID NO: 1299942 - DNA, 13 bp, Homo sapiens
caacctgaaccta

SEQ ID NO: 1299943 - DNA, 18 bp, Homo sapiens
caactctcccctgacctg

SEQ ID NO: 1299944 - DNA, 18 bp, Homo sapiens
caactcttgattatccat

SEQ ID NO: 1299945 - DNA, 23 bp, Homo sapiens
caacttgtattaaagacagaggc

SEQ ID NO: 1299946 - DNA, 20 bp, Homo sapiens
caagaaataaaaggaagcca

SEQ ID NO: 1299947 - DNA, 21 bp, Homo sapiens
caagaaataaaaggaagccaa

SEQ ID NO: 1299948 - DNA, 22 bp, Homo sapiens
caagagaattgcttgaacccag

SEQ ID NO: 1299949 - DNA, 17 bp, Homo sapiens
caagcacagcagcctgg

SEQ ID NO: 1299950 - DNA, 21 bp, Homo sapiens
caagcctgaccacgctttcta

SEQ ID NO: 1299951 - DNA, 14 bp, Homo sapiens
caagctcctcctcc

SEQ ID NO: 1299952 - DNA, 17 bp, Homo sapiens
caagctcctcctccctg

SEQ ID NO: 1299953 - DNA, 23 bp, Homo sapiens
cagatctgacatgattccttcct

SEQ ID NO: 1299954 - DNA, 21 bp, Homo sapiens
cagatctggaacctcagcctg

SEQ ID NO: 1299955 - DNA, 15 bp, Homo sapiens
cagatgaatgtattt

SEQ ID NO: 1299956 - DNA, 23 bp, Homo sapiens
cagatgaatgtatttatttggga

SEQ ID NO: 1299957 - DNA, 13 bp, Homo sapiens
cagatgcagggca

SEQ ID NO: 1299958 - DNA, 23 bp, Homo sapiens
cagatgtttccagacttccttga

SEQ ID NO: 1299959 - DNA, 16 bp, Homo sapiens
cagatttccagtctcc

SEQ ID NO: 1299960 - DNA, 15 bp, Homo sapiens
cagattttaattttg

SEQ ID NO: 1299961 - DNA, 19 bp, Homo sapiens
cagattttgctgtatattt

SEQ ID NO: 1299962 - DNA, 12 bp, Homo sapiens
cagcaaccccag

SEQ ID NO: 1299963 - DNA, 16 bp, Homo sapiens
cagcaaccccaggctg

SEQ ID NO: 1299964 - DNA, 17 bp, Homo sapiens
cagcaaccccaggctga

SEQ ID NO: 1299965 - DNA, 13 bp, Homo sapiens
cagcacacagggc

SEQ ID NO: 1299966 - DNA, 17 bp, Homo sapiens
cagcaccgttctgtgca

SEQ ID NO: 1299967 - DNA, 13 bp, Homo sapiens
cagcacttattta

SEQ ID NO: 1299968 - DNA, 17 bp, Homo sapiens
cagcacttgtccagctg

SEQ ID NO: 1299969 - DNA, 15 bp, Homo sapiens
cagcactttgggagg

SEQ ID NO: 1299970 - DNA, 13 bp, Homo sapiens
cagcagaaggggg

SEQ ID NO: 1299971 - DNA, 20 bp, Homo sapiens
cagcagcctggggctggcct

SEQ ID NO: 1299972 - DNA, 17 bp, Homo sapiens
cagcagcctttaatgca

SEQ ID NO: 1299973 - DNA, 23 bp, Homo sapiens
cagcagggaaaatgcagcaggga

SEQ ID NO: 1299974 - DNA, 24 bp, Homo sapiens
cagcagggaaaatgcagcagggat

SEQ ID NO: 1299975 - DNA, 19 bp, Homo sapiens
cagccaacacgcacctgcc

SEQ ID NO: 1299976 - DNA, 20 bp, Homo sapiens
cagccaacacgcacctgcct

SEQ ID NO: 1299977 - DNA, 22 bp, Homo sapiens
cagccaacacgcacctgcctca

SEQ ID NO: 1299978 - DNA, 22 bp, Homo sapiens
cagcccagagacatacttgaag

SEQ ID NO: 1299979 - DNA, 13 bp, Homo sapiens
cagcccctggccc

SEQ ID NO: 1299980 - DNA, 18 bp, Homo sapiens
cagccccttgagaaacct

SEQ ID NO: 1299981 - DNA, 21 bp, Homo sapiens
cagccctccccatggagccag

SEQ ID NO: 1299982 - DNA, 13 bp, Homo sapiens
cagccctgaccct

SEQ ID NO: 1299983 - DNA, 16 bp, Homo sapiens
cagcctcccatccagg

SEQ ID NO: 1299984 - DNA, 16 bp, Homo sapiens
cagcctgagcaactct

SEQ ID NO: 1299985 - DNA, 20 bp, Homo sapiens
cagcctgagcaactcttgat

SEQ ID NO: 1299986 - DNA, 13 bp, Homo sapiens
cagcctggccaga

SEQ ID NO: 1299987 - DNA, 17 bp, Homo sapiens
cagcctggccagacaca

SEQ ID NO: 1299988 - DNA, 18 bp, Homo sapiens
cagcctggggctggcctc

SEQ ID NO: 1299989 - DNA, 19 bp, Homo sapiens
cagcctggggtctggagtt

SEQ ID NO: 1299990 - DNA, 13 bp, Homo sapiens
cagccttgccaga

SEQ ID NO: 1299991 - DNA, 16 bp, Homo sapiens
cagccttgccagagat

SEQ ID NO: 1299992 - DNA, 12 bp, Homo sapiens
cagcgccaggct

SEQ ID NO: 1299993 - DNA, 12 bp, Homo sapiens
cagcgcctttcc

SEQ ID NO: 1299994 - DNA, 13 bp, Homo sapiens
cagcgcctttccc

SEQ ID NO: 1299995 - DNA, 14 bp, Homo sapiens
cagcgcctttccca

SEQ ID NO: 1299996 - DNA, 23 bp, Homo sapiens
cagctaagaaaagattttaatca

SEQ ID NO: 1299997 - DNA, 13 bp, Homo sapiens
cagctaagaacct

SEQ ID NO: 1299998 - DNA, 16 bp, Homo sapiens
cagctaagaacctgga

SEQ ID NO: 1299999 - DNA, 15 bp, Homo sapiens
cagctacttgggagg

SEQ ID NO: 1300000 - DNA, 12 bp, Homo sapiens
cagctcaggaca

SEQ ID NO: 1300001 - DNA, 13 bp, Homo sapiens
cagctcaggacag

SEQ ID NO: 1300002 - DNA, 18 bp, Homo sapiens
cagctcaggacagatgcc

SEQ ID NO: 1300003 - DNA, 20 bp, Homo sapiens
cagctccaacctgcaaagat

SEQ ID NO: 1300004 - DNA, 21 bp, Homo sapiens
cagctccggcctgtcctccaa

SEQ ID NO: 1300005 - DNA, 17 bp, Homo sapiens
cagctctttcctccttc

SEQ ID NO: 1300006 - DNA, 16 bp, Homo sapiens
cagctgagcgccagga

SEQ ID NO: 1300007 - DNA, 16 bp, Homo sapiens
cagctgggtcaggcag

SEQ ID NO: 1300008 - DNA, 20 bp, Homo sapiens
cagctgggtcaggcagggtg

SEQ ID NO: 1300009 - DNA, 19 bp, Homo sapiens
caggaaccacaccacatct

SEQ ID NO: 1300010 - DNA, 16 bp, Homo sapiens
caggaatgtgtggcct

SEQ ID NO: 1300011 - DNA, 21 bp, Homo sapiens
caggaatgtgtggcctgcaca

SEQ ID NO: 1300012 - DNA, 23 bp, Homo sapiens
caggaatgtgtggcctgcacagt

SEQ ID NO: 1300013 - DNA, 16 bp, Homo sapiens
caggaatttcccagga

SEQ ID NO: 1300014 - DNA, 18 bp, Homo sapiens
caggaatttcccaggacc

SEQ ID NO: 1300015 - DNA, 19 bp, Homo sapiens
caggaatttcccaggaccc

SEQ ID NO: 1300016 - DNA, 21 bp, Homo sapiens
caggaatttcccaggaccctg

SEQ ID NO: 1300017 - DNA, 14 bp, Homo sapiens
caggacagatgcca

SEQ ID NO: 1300018 - DNA, 15 bp, Homo sapiens
caggaccagctcagg

SEQ ID NO: 1300019 - DNA, 17 bp, Homo sapiens
caggacctggctgccat

SEQ ID NO: 1300020 - DNA, 18 bp, Homo sapiens
caggacctggctgccata

SEQ ID NO: 1300021 - DNA, 20 bp, Homo sapiens
caggactatatttgggcctg

SEQ ID NO: 1300022 - DNA, 16 bp, Homo sapiens
caggactgggccactt

SEQ ID NO: 1300023 - DNA, 13 bp, Homo sapiens
caggcagatccag

SEQ ID NO: 1300024 - DNA, 22 bp, Homo sapiens
caggcagggccaacccttctcc

SEQ ID NO: 1300025 - DNA, 17 bp, Homo sapiens
caggccaagaaacgtct

SEQ ID NO: 1300026 - DNA, 16 bp, Homo sapiens
caggctggctccagat

SEQ ID NO: 1300027 - DNA, 18 bp, Homo sapiens
caggctggctccagatgc

SEQ ID NO: 1300028 - DNA, 20 bp, Homo sapiens
cagggaaaatgcagcaggga

SEQ ID NO: 1300029 - DNA, 17 bp, Homo sapiens
cagggagcggccggcca

SEQ ID NO: 1300030 - DNA, 19 bp, Homo sapiens
cagggagcggccggccagc

SEQ ID NO: 1300031 - DNA, 21 bp, Homo sapiens
cagggagcggccggccagccc

SEQ ID NO: 1300032 - DNA, 14 bp, Homo sapiens
cagggcagcgccag

SEQ ID NO: 1300033 - DNA, 18 bp, Homo sapiens
cagggcagcgccaggctg

SEQ ID NO: 1300034 - DNA, 21 bp, Homo sapiens
cagggcagtcattggctgtct

SEQ ID NO: 1300035 - DNA, 15 bp, Homo sapiens
cagggcccagagccc

SEQ ID NO: 1300036 - DNA, 21 bp, Homo sapiens
cagggcccagagcccagctcc

SEQ ID NO: 1300037 - DNA, 22 bp, Homo sapiens
cagggcccagagcccagctcca

SEQ ID NO: 1300038 - DNA, 20 bp, Homo sapiens
cagggtgcagtatcatgccc

SEQ ID NO: 1300039 - DNA, 14 bp, Homo sapiens
caggtctttcctaa

SEQ ID NO: 1300040 - DNA, 19 bp, Homo sapiens
caggtctttcctaaggctg

SEQ ID NO: 1300041 - DNA, 21 bp, Homo sapiens
caggtctttcctaaggctgca

SEQ ID NO: 1300042 - DNA, 22 bp, Homo sapiens
caggtgttactgtaattcctca

SEQ ID NO: 1300043 - DNA, 20 bp, Homo sapiens
cagtaaatcttttacaactg

SEQ ID NO: 1300044 - DNA, 16 bp, Homo sapiens
cagtactttggaggcc

SEQ ID NO: 1300045 - DNA, 20 bp, Homo sapiens
cagtactttggaggccccta

SEQ ID NO: 1300046 - DNA, 19 bp, Homo sapiens
cagtataaacaaagttact

SEQ ID NO: 1300047 - DNA, 16 bp, Homo sapiens
cagtatcatgccctgt

SEQ ID NO: 1300048 - DNA, 15 bp, Homo sapiens
cagtcaatattttta

SEQ ID NO: 1300049 - DNA, 13 bp, Homo sapiens
cagtcacagccac

SEQ ID NO: 1300050 - DNA, 17 bp, Homo sapiens
cagtcactgaattccat

SEQ ID NO: 1300051 - DNA, 20 bp, Homo sapiens
cagtcagatttccagtctcc

SEQ ID NO: 1300052 - DNA, 17 bp, Homo sapiens
cagtgcccccactgacc

SEQ ID NO: 1300053 - DNA, 20 bp, Homo sapiens
cagtgcccccactgaccaga

SEQ ID NO: 1300054 - DNA, 22 bp, Homo sapiens
cagtgcccccactgaccagaac

SEQ ID NO: 1300055 - DNA, 16 bp, Homo sapiens
cagtgtccttagaaca

SEQ ID NO: 1300056 - DNA, 19 bp, Homo sapiens
cagttctttgggccagaca

SEQ ID NO: 1300057 - DNA, 16 bp, Homo sapiens
cagttttaactagaat

SEQ ID NO: 1300058 - DNA, 12 bp, Homo sapiens
cataaaacaggt

SEQ ID NO: 1300059 - DNA, 22 bp, Homo sapiens
cataatggggtcctggccatcc

SEQ ID NO: 1300060 - DNA, 17 bp, Homo sapiens
catacttgaagggccag

SEQ ID NO: 1300061 - DNA, 21 bp, Homo sapiens
catacttgaagggccagagcc

SEQ ID NO: 1300062 - DNA, 16 bp, Homo sapiens
catagcagattttaat

SEQ ID NO: 1300063 - DNA, 19 bp, Homo sapiens
catagtaccatttatacaa

SEQ ID NO: 1300064 - DNA, 20 bp, Homo sapiens
catagtaccatttatacaaa

SEQ ID NO: 1300065 - DNA, 11 bp, Homo sapiens
catcaaagagg

SEQ ID NO: 1300066 - DNA, 23 bp, Homo sapiens
ctctgtccccttctctcatctct

SEQ ID NO: 1300067 - DNA, 18 bp, Homo sapiens
ctctgtgaacgatttaga

SEQ ID NO: 1300068 - DNA, 21 bp, Homo sapiens
ctctgtgaacgatttagaaag

SEQ ID NO: 1300069 - DNA, 23 bp, Homo sapiens
ctctgtgaacgatttagaaagaa

SEQ ID NO: 1300070 - DNA, 18 bp, Homo sapiens
ctctgtgagactcgagaa

SEQ ID NO: 1300071 - DNA, 18 bp, Homo sapiens
ctcttagctcccctccaa

SEQ ID NO: 1300072 - DNA, 17 bp, Homo sapiens
ctcttatagaatattta

SEQ ID NO: 1300073 - DNA, 18 bp, Homo sapiens
ctcttatagaatatttat

SEQ ID NO: 1300074 - DNA, 21 bp, Homo sapiens
ctcttatagaatatttattac

SEQ ID NO: 1300075 - DNA, 15 bp, Homo sapiens
ctcttctcatttcac

SEQ ID NO: 1300076 - DNA, 21 bp, Homo sapiens
ctcttgggaactgaactcact

SEQ ID NO: 1300077 - DNA, 24 bp, Homo sapiens
ctcttgtaaataaagccctgggat

SEQ ID NO: 1300078 - DNA, 15 bp, Homo sapiens
ctctttctgtatata

SEQ ID NO: 1300079 - DNA, 16 bp, Homo sapiens
ctctttgctttgcttt

SEQ ID NO: 1300080 - DNA, 22 bp, Homo sapiens
ctctttgctttgctttctgctc

SEQ ID NO: 1300081 - DNA, 21 bp, Homo sapiens
ctcttttgctttattccagaa

SEQ ID NO: 1300082 - DNA, 15 bp, Homo sapiens
ctgaaacaacttgga

SEQ ID NO: 1300083 - DNA, 21 bp, Homo sapiens
ctgaacaataggctgttccca

SEQ ID NO: 1300084 - DNA, 20 bp, Homo sapiens
ctgaagcaggttcccaagct

SEQ ID NO: 1300085 - DNA, 20 bp, Homo sapiens
ctgaaggggcgtctgttccc

SEQ ID NO: 1300086 - DNA, 14 bp, Homo sapiens
ctgacagctgctcc

SEQ ID NO: 1300087 - DNA, 15 bp, Homo sapiens
ctgacagctgctcct

SEQ ID NO: 1300088 - DNA, 17 bp, Homo sapiens
ctgacagctgctcctag

SEQ ID NO: 1300089 - DNA, 17 bp, Homo sapiens
ctttgctttgctttctg

SEQ ID NO: 1300090 - DNA, 13 bp, Homo sapiens
ctttggatttgac

SEQ ID NO: 1300091 - DNA, 14 bp, Homo sapiens
ctttggttctggcc

SEQ ID NO: 1300092 - DNA, 19 bp, Homo sapiens
ctttggttctggccagaat

SEQ ID NO: 1300093 - DNA, 21 bp, Homo sapiens
ctttggttctggccagaatgc

SEQ ID NO: 1300094 - DNA, 11 bp, Homo sapiens
ctttgtggcca

SEQ ID NO: 1300095 - DNA, 20 bp, Homo sapiens
ctttgtggccaaggagctgc

SEQ ID NO: 1300096 - DNA, 15 bp, Homo sapiens
cttttagaaatactg

SEQ ID NO: 1300097 - DNA, 21 bp, Homo sapiens
cttttagaaatactgcaagaa

SEQ ID NO: 1300098 - DNA, 23 bp, Homo sapiens
cttttagaaatactgcaagaaaa

SEQ ID NO: 1300099 - DNA, 19 bp, Homo sapiens
cttttatactctttctgta

SEQ ID NO: 1300100 - DNA, 12 bp, Homo sapiens
cttttgtaattt

SEQ ID NO: 1300101 - DNA, 13 bp, Homo sapiens
cttttgttcgcat

SEQ ID NO: 1300102 - DNA, 13 bp, Homo sapiens
gaaaacagaccta

SEQ ID NO: 1300103 - DNA, 21 bp, Homo sapiens
gaaaacagacctaatgctcct

SEQ ID NO: 1300104 - DNA, 17 bp, Homo sapiens
gaaaagattttaatcaa

SEQ ID NO: 1300105 - DNA, 23 bp, Homo sapiens
gaaaagattttaatcaagttgaa

SEQ ID NO: 1300106 - DNA, 23 bp, Homo sapiens
gaaaatgatgtgtacccaaacgt

SEQ ID NO: 1300107 - DNA, 15 bp, Homo sapiens
gaaaatgttgagaat

SEQ ID NO: 1300108 - DNA, 17 bp, Homo sapiens
gaaaatgttgagaatcc

SEQ ID NO: 1300109 - DNA, 20 bp, Homo sapiens
gaaaatgttgagaatcccaa

SEQ ID NO: 1300110 - DNA, 14 bp, Homo sapiens
gaaacaacttggaa

SEQ ID NO: 1300111 - DNA, 13 bp, Homo sapiens
gaaacacagaaac

SEQ ID NO: 1300112 - DNA, 17 bp, Homo sapiens
gaaaccttattgtacct

SEQ ID NO: 1300113 - DNA, 19 bp, Homo sapiens
gaaaccttattgtacctct

SEQ ID NO: 1300114 - DNA, 20 bp, Homo sapiens
gaaaccttattgtacctctc

SEQ ID NO: 1300115 - DNA, 15 bp, Homo sapiens
gaaaggggagcccac

SEQ ID NO: 1300116 - DNA, 16 bp, Homo sapiens
gaaaggggagcccact

SEQ ID NO: 1300117 - DNA, 19 bp, Homo sapiens
gaaataaaaggaagccaaa

SEQ ID NO: 1300118 - DNA, 18 bp, Homo sapiens
gaaatactgcaagaaaat

SEQ ID NO: 1300119 - DNA, 14 bp, Homo sapiens
gaaatccattcaca

SEQ ID NO: 1300120 - DNA, 19 bp, Homo sapiens
gaaatgggacttaactcct

SEQ ID NO: 1300121 - DNA, 22 bp, Homo sapiens
gaaattaagaaggcaaaaatgt

SEQ ID NO: 1300122 - DNA, 19 bp, Homo sapiens
gaacaaagcagccacgagg

SEQ ID NO: 1300123 - DNA, 16 bp, Homo sapiens
gaacactcttttgctt

SEQ ID NO: 1300124 - DNA, 12 bp, Homo sapiens
gaacctcagcct

SEQ ID NO: 1300125 - DNA, 15 bp, Homo sapiens
gaacctcagcctggc

SEQ ID NO: 1300126 - DNA, 17 bp, Homo sapiens
gaacctcagcctggcca

SEQ ID NO: 1300127 - DNA, 18 bp, Homo sapiens
gaacctcagcctggccag

SEQ ID NO: 1300128 - DNA, 21 bp, Homo sapiens
gaacctcagcctggccagaca

SEQ ID NO: 1300129 - DNA, 18 bp, Homo sapiens
gaacgcccccccccaccc

SEQ ID NO: 1300130 - DNA, 19 bp, Homo sapiens
gaacggggctcttctcatt

SEQ ID NO: 1300131 - DNA, 22 bp, Homo sapiens
gaactacaaacaaaatttctat

SEQ ID NO: 1300132 - DNA, 13 bp, Homo sapiens
gaactcagatcca

SEQ ID NO: 1300133 - DNA, 21 bp, Homo sapiens
gaactcagatccagggacaga

SEQ ID NO: 1300134 - DNA, 15 bp, Homo sapiens
gaactcctgacctca

SEQ ID NO: 1300135 - DNA, 19 bp, Homo sapiens
gaactgcatgctgctggac

SEQ ID NO: 1300136 - DNA, 13 bp, Homo sapiens
gaactttcatttt

SEQ ID NO: 1300137 - DNA, 14 bp, Homo sapiens
gaactttcattttt

SEQ ID NO: 1300138 - DNA, 22 bp, Homo sapiens
gaagaaaacatctattctctcc

SEQ ID NO: 1300139 - DNA, 22 bp, Homo sapiens
gaagaaccagtccccccaccct

SEQ ID NO: 1300140 - DNA, 23 bp, Homo sapiens
gaagaacggggctcttctcattt

SEQ ID NO: 1300141 - DNA, 22 bp, Homo sapiens
gaagaactgtgtttcaagttca

SEQ ID NO: 1300142 - DNA, 12 bp, Homo sapiens
gaagcaggttcc

SEQ ID NO: 1300143 - DNA, 19 bp, Homo sapiens
gaagcaggttcccaagctc

SEQ ID NO: 1300144 - DNA, 18 bp, Homo sapiens
gaagccaattcagacagg

SEQ ID NO: 1300145 - DNA, 15 bp, Homo sapiens
gaagccacaggcctg

SEQ ID NO: 1300146 - DNA, 18 bp, Homo sapiens
gaagccacaggcctgaga

SEQ ID NO: 1300147 - DNA, 21 bp, Homo sapiens
gaagcccccagctaagaacct

SEQ ID NO: 1300148 - DNA, 22 bp, Homo sapiens
gaagcccccagctaagaacctg

SEQ ID NO: 1300149 - DNA, 14 bp, Homo sapiens
gaagctaatttgca

SEQ ID NO: 1300150 - DNA, 16 bp, Homo sapiens
gaagctaatttgcatt

SEQ ID NO: 1300151 - DNA, 23 bp, Homo sapiens
gaagctactgtgtgtgtgaatga

SEQ ID NO: 1300152 - DNA, 19 bp, Homo sapiens
gaagctcctctccccagcc

SEQ ID NO: 1300153 - DNA, 13 bp, Homo sapiens
gaagggccagagc

SEQ ID NO: 1300154 - DNA, 18 bp, Homo sapiens
gaagggccagagccaggg

SEQ ID NO: 1300155 - DNA, 18 bp, Homo sapiens
gaaggtgctgacggccag

SEQ ID NO: 1300156 - DNA, 19 bp, Homo sapiens
gaaggtgctgacggccagg

SEQ ID NO: 1300157 - DNA, 21 bp, Homo sapiens
gaaggtgctgacggccaggga

SEQ ID NO: 1300158 - DNA, 17 bp, Homo sapiens
gaagtccaatgtggcaa

SEQ ID NO: 1300159 - DNA, 22 bp, Homo sapiens
gaataaataaatgtatcttatt

SEQ ID NO: 1300160 - DNA, 14 bp, Homo sapiens
gaatactttttaca

SEQ ID NO: 1300161 - DNA, 23 bp, Homo sapiens
gaatagaaataaaggatgtgatt

SEQ ID NO: 1300162 - DNA, 18 bp, Homo sapiens
gaatagccacatttggaa

SEQ ID NO: 1300163 - DNA, 23 bp, Homo sapiens
gaatagccacatttggaatactt

SEQ ID NO: 1300164 - DNA, 16 bp, Homo sapiens
gaccacagcacagcca

SEQ ID NO: 1300165 - DNA, 14 bp, Homo sapiens
gaccagcagcgcct

SEQ ID NO: 1300166 - DNA, 15 bp, Homo sapiens
gaccagggagccttt

SEQ ID NO: 1300167 - DNA, 22 bp, Homo sapiens
gaccagggagcctttggttctg

SEQ ID NO: 1300168 - DNA, 22 bp, Homo sapiens
gacccagccccttgagaaacct

SEQ ID NO: 1300169 - DNA, 15 bp, Homo sapiens
gacccagtgccccca

SEQ ID NO: 1300170 - DNA, 16 bp, Homo sapiens
gacccagtgcccccac

SEQ ID NO: 1300171 - DNA, 16 bp, Homo sapiens
gaccctgaaggggcca

SEQ ID NO: 1300172 - DNA, 15 bp, Homo sapiens
gacctaatgctcctt

SEQ ID NO: 1300173 - DNA, 14 bp, Homo sapiens
gacctgatcctgga

SEQ ID NO: 1300174 - DNA, 15 bp, Homo sapiens
gacctgtgagcccag

SEQ ID NO: 1300175 - DNA, 16 bp, Homo sapiens
gacctgtgagcccagc

SEQ ID NO: 1300176 - DNA, 19 bp, Homo sapiens
gacctgtgagcccagctgg

SEQ ID NO: 1300177 - DNA, 16 bp, Homo sapiens
gaccttcgggctgtgc

SEQ ID NO: 1300178 - DNA, 19 bp, Homo sapiens
gaccttcgggctgtgcccg

SEQ ID NO: 1300179 - DNA, 21 bp, Homo sapiens
gacgtagctgcaaaggacaga

SEQ ID NO: 1300180 - DNA, 12 bp, Homo sapiens
gacgtggctcag

SEQ ID NO: 1300181 - DNA, 15 bp, Homo sapiens
gacgtggctcagcca

SEQ ID NO: 1300182 - DNA, 16 bp, Homo sapiens
gactagatgatggatg

SEQ ID NO: 1300183 - DNA, 12 bp, Homo sapiens
gactcagggcag

SEQ ID NO: 1300184 - DNA, 13 bp, Homo sapiens
gactcagggcagc

SEQ ID NO: 1300185 - DNA, 22 bp, Homo sapiens
gactcccattcctgaagaacca

SEQ ID NO: 1300186 - DNA, 23 bp, Homo sapiens
gactcccattcctgaagaaccag

SEQ ID NO: 1300187 - DNA, 19 bp, Homo sapiens
gactcgagaactttcattt

SEQ ID NO: 1300188 - DNA, 16 bp, Homo sapiens
gacttaactccttcca

SEQ ID NO: 1300189 - DNA, 20 bp, Homo sapiens
gacttccttgagacacggag

SEQ ID NO: 1300190 - DNA, 15 bp, Homo sapiens
gagaaaacagaccta

SEQ ID NO: 1300191 - DNA, 21 bp, Homo sapiens
gagaaaccttattgtacctct

SEQ ID NO: 1300192 - DNA, 17 bp, Homo sapiens
gagaaaggggagcccac

SEQ ID NO: 1300193 - DNA, 15 bp, Homo sapiens
gagaactttcatttt

SEQ ID NO: 1300194 - DNA, 17 bp, Homo sapiens
gagaactttcatttttt

SEQ ID NO: 1300195 - DNA, 21 bp, Homo sapiens
gagaatctacccccagatcca

SEQ ID NO: 1300196 - DNA, 22 bp, Homo sapiens
gagacagttgggtgagaacaac

SEQ ID NO: 1300197 - DNA, 16 bp, Homo sapiens
gagactcgagaacttt

SEQ ID NO: 1300198 - DNA, 14 bp, Homo sapiens
gagagtttcctgaa

SEQ ID NO: 1300199 - DNA, 19 bp, Homo sapiens
gagatttcatctgctctcc

SEQ ID NO: 1300200 - DNA, 21 bp, Homo sapiens
gagatttcatctgctctcctt

SEQ ID NO: 1300201 - DNA, 22 bp, Homo sapiens
gagatttcatctgctctccttc

SEQ ID NO: 1300202 - DNA, 23 bp, Homo sapiens
gagatttcatctgctctccttcc

SEQ ID NO: 1300203 - DNA, 18 bp, Homo sapiens
gagccagctccctctatt

SEQ ID NO: 1300204 - DNA, 22 bp, Homo sapiens
gagcccagaggagggcagcaga

SEQ ID NO: 1300205 - DNA, 12 bp, Homo sapiens
gagcccagctcc

SEQ ID NO: 1300206 - DNA, 13 bp, Homo sapiens
gagcccagctggg

SEQ ID NO: 1300207 - DNA, 19 bp, Homo sapiens
gagcccagctgggtcaggc

SEQ ID NO: 1300208 - DNA, 21 bp, Homo sapiens
gagcccagctgggtcaggcag

SEQ ID NO: 1300209 - DNA, 22 bp, Homo sapiens
gagcccctgtctagagagggag

SEQ ID NO: 1300210 - DNA, 21 bp, Homo sapiens
gagccccttctgctcagctct

SEQ ID NO: 1300211 - DNA, 16 bp, Homo sapiens
gagcctctgctcccca

SEQ ID NO: 1300212 - DNA, 17 bp, Homo sapiens
gagcctggtgctgctgc

SEQ ID NO: 1300213 - DNA, 23 bp, Homo sapiens
gagcgctcctgccgcagagctgg

SEQ ID NO: 1300214 - DNA, 21 bp, Homo sapiens
gagctgctatagcctggggtg

SEQ ID NO: 1300215 - DNA, 14 bp, Homo sapiens
gagcttctctgtga

SEQ ID NO: 1300216 - DNA, 23 bp, Homo sapiens
gaggaagaacggggctcttctca

SEQ ID NO: 1300217 - DNA, 22 bp, Homo sapiens
gaggacgagcgattgaggtgta

SEQ ID NO: 1300218 - DNA, 17 bp, Homo sapiens
gaggaggggccgctgcc

SEQ ID NO: 1300219 - DNA, 20 bp, Homo sapiens
gaggcccagttcaccctgat

SEQ ID NO: 1300220 - DNA, 12 bp, Homo sapiens
gaggccccagcc

SEQ ID NO: 1300221 - DNA, 20 bp, Homo sapiens
gaggcctgagcgctcctgcc

SEQ ID NO: 1300222 - DNA, 19 bp, Homo sapiens
gaggcgggtggatcacttg

SEQ ID NO: 1300223 - DNA, 10 bp, Homo sapiens
gaggctcagg

SEQ ID NO: 1300224 - DNA, 19 bp, Homo sapiens
gagggcagcagaagggggt

SEQ ID NO: 1300225 - DNA, 17 bp, Homo sapiens
gagtagaattgcattga

SEQ ID NO: 1300226 - DNA, 14 bp, Homo sapiens
gagtccaagctggg

SEQ ID NO: 1300227 - DNA, 21 bp, Homo sapiens
gagttaagacctggcagctct

SEQ ID NO: 1300228 - DNA, 14 bp, Homo sapiens
gagttgatctggaa

SEQ ID NO: 1300229 - DNA, 16 bp, Homo sapiens
gagttgatctggaacc

SEQ ID NO: 1300230 - DNA, 18 bp, Homo sapiens
gagtttcatgtacaagat

SEQ ID NO: 1300231 - DNA, 13 bp, Homo sapiens
gataactagatgg

SEQ ID NO: 1300232 - DNA, 21 bp, Homo sapiens
gatacatacaccagcattcct

SEQ ID NO: 1300233 - DNA, 21 bp, Homo sapiens
gatagatgctggcccagggcc

SEQ ID NO: 1300234 - DNA, 17 bp, Homo sapiens
gatatactctagatgaa

SEQ ID NO: 1300235 - DNA, 17 bp, Homo sapiens
gctaatttttgtaattt

SEQ ID NO: 1300236 - DNA, 18 bp, Homo sapiens
gctactgtaattttatat

SEQ ID NO: 1300237 - DNA, 19 bp, Homo sapiens
gctagtcaagctcctcctc

SEQ ID NO: 1300238 - DNA, 23 bp, Homo sapiens
gctataaattcctctttgctttg

SEQ ID NO: 1300239 - DNA, 18 bp, Homo sapiens
gctcagaggcgcactgtg

SEQ ID NO: 1300240 - DNA, 12 bp, Homo sapiens
gctcagcttctc

SEQ ID NO: 1300241 - DNA, 15 bp, Homo sapiens
gctcaggtccctggg

SEQ ID NO: 1300242 - DNA, 19 bp, Homo sapiens
gctcaggtccctggggcta

SEQ ID NO: 1300243 - DNA, 15 bp, Homo sapiens
gctccaacctgcaaa

SEQ ID NO: 1300244 - DNA, 21 bp, Homo sapiens
gctccaacctgcaaagatctg

SEQ ID NO: 1300245 - DNA, 21 bp, Homo sapiens
gctccaaggggaatcagaact

SEQ ID NO: 1300246 - DNA, 23 bp, Homo sapiens
gctccagacctgatcctggaggc

SEQ ID NO: 1300247 - DNA, 19 bp, Homo sapiens
gctccagatgcagggcagt

SEQ ID NO: 1300248 - DNA, 16 bp, Homo sapiens
gctcctagagggaggg

SEQ ID NO: 1300249 - DNA, 18 bp, Homo sapiens
gctcctagagggaggggc

SEQ ID NO: 1300250 - DNA, 20 bp, Homo sapiens
gctcctccagggtgtgtgct

SEQ ID NO: 1300251 - DNA, 14 bp, Homo sapiens
gctcctcctccctg

SEQ ID NO: 1300252 - DNA, 16 bp, Homo sapiens
gctcctcctccctgca

SEQ ID NO: 1300253 - DNA, 16 bp, Homo sapiens
gctcctctccccagcc

SEQ ID NO: 1300254 - DNA, 21 bp, Homo sapiens
gctcctctccccagcccagag

SEQ ID NO: 1300255 - DNA, 22 bp, Homo sapiens
gctcctctccccagcccagaga

SEQ ID NO: 1300256 - DNA, 15 bp, Homo sapiens
gctcggaggaagccc

SEQ ID NO: 1300257 - DNA, 12 bp, Homo sapiens
gctctagtgcct

SEQ ID NO: 1300258 - DNA, 11 bp, Homo sapiens
gctctccttcc

SEQ ID NO: 1300259 - DNA, 20 bp, Homo sapiens
gctctggacagccccaccct

SEQ ID NO: 1300260 - DNA, 20 bp, Homo sapiens
gctctgggccattctccaca

SEQ ID NO: 1300261 - DNA, 12 bp, Homo sapiens
gctcttctcatt

SEQ ID NO: 1300262 - DNA, 14 bp, Homo sapiens
gctcttctcatttc

SEQ ID NO: 1300263 - DNA, 15 bp, Homo sapiens
gctcttctcatttca

SEQ ID NO: 1300264 - DNA, 14 bp, Homo sapiens
gctgaattatctat

SEQ ID NO: 1300265 - DNA, 14 bp, Homo sapiens
gctgacagctgctc

SEQ ID NO: 1300266 - DNA, 18 bp, Homo sapiens
gctgacagctgctcctag

SEQ ID NO: 1300267 - DNA, 16 bp, Homo sapiens
gctgacattcacctgc

SEQ ID NO: 1300268 - DNA, 14 bp, Homo sapiens
gctgaccacagcac

SEQ ID NO: 1300269 - DNA, 17 bp, Homo sapiens
gctgaccacagcacagc

SEQ ID NO: 1300270 - DNA, 19 bp, Homo sapiens
gctgaccacagcacagcca

SEQ ID NO: 1300271 - DNA, 13 bp, Homo sapiens
gctgagcccctgt

SEQ ID NO: 1300272 - DNA, 23 bp, Homo sapiens
gctgagcccctgtctagagaggg

SEQ ID NO: 1300273 - DNA, 14 bp, Homo sapiens
gctgagcgccagga

SEQ ID NO: 1300274 - DNA, 16 bp, Homo sapiens
gctgaggctggcacag

SEQ ID NO: 1300275 - DNA, 15 bp, Homo sapiens
gctgcaaaggacaga

SEQ ID NO: 1300276 - DNA, 12 bp, Homo sapiens
gctgcaaggttt

SEQ ID NO: 1300277 - DNA, 21 bp, Homo sapiens
gctgcaaggtttaggctggtg

SEQ ID NO: 1300278 - DNA, 21 bp, Homo sapiens
gctgcagcctgcgccaccgcc

SEQ ID NO: 1300279 - DNA, 17 bp, Homo sapiens
gctgcaggacttgagaa

SEQ ID NO: 1300280 - DNA, 19 bp, Homo sapiens
gctgccacccacctccctg

SEQ ID NO: 1300281 - DNA, 22 bp, Homo sapiens
gctgccacccacctccctgcct

SEQ ID NO: 1300282 - DNA, 14 bp, Homo sapiens
gctgccttggctca

SEQ ID NO: 1300283 - DNA, 17 bp, Homo sapiens
gctgccttggctcagac

SEQ ID NO: 1300284 - DNA, 23 bp, Homo sapiens
gctgccttggctcagacatgttt

SEQ ID NO: 1300285 - DNA, 15 bp, Homo sapiens
gctgctcctagaggg

SEQ ID NO: 1300286 - DNA, 16 bp, Homo sapiens
gctgctcctagaggga

SEQ ID NO: 1300287 - DNA, 16 bp, Homo sapiens
gctggactgaggcctg

SEQ ID NO: 1300288 - DNA, 17 bp, Homo sapiens
gctggactgaggcctga

SEQ ID NO: 1300289 - DNA, 22 bp, Homo sapiens
ggagggctgtcatctgtgcact

SEQ ID NO: 1300290 - DNA, 13 bp, Homo sapiens
ggaggggcctagg

SEQ ID NO: 1300291 - DNA, 19 bp, Homo sapiens
ggaggttgatcagatctga

SEQ ID NO: 1300292 - DNA, 23 bp, Homo sapiens
ggagttaagacctggcagctctg

SEQ ID NO: 1300293 - DNA, 14 bp, Homo sapiens
ggagttgatctgga

SEQ ID NO: 1300294 - DNA, 17 bp, Homo sapiens
ggagttgatctggaacc

SEQ ID NO: 1300295 - DNA, 13 bp, Homo sapiens
ggatagatgctgg

SEQ ID NO: 1300296 - DNA, 20 bp, Homo sapiens
ggatagatgctggcccaggg

SEQ ID NO: 1300297 - DNA, 12 bp, Homo sapiens
ggatcagaatag

SEQ ID NO: 1300298 - DNA, 17 bp, Homo sapiens
ggatctttgtggccaag

SEQ ID NO: 1300299 - DNA, 23 bp, Homo sapiens
ggatgggggaactcagatccagg

SEQ ID NO: 1300300 - DNA, 15 bp, Homo sapiens
ggattaatatgaaaa

SEQ ID NO: 1300301 - DNA, 23 bp, Homo sapiens
ggcaaaaggatctttgtggccaa

SEQ ID NO: 1300302 - DNA, 18 bp, Homo sapiens
ggcaaagcttttagaaat

SEQ ID NO: 1300303 - DNA, 14 bp, Homo sapiens
ggcaacagatctgg

SEQ ID NO: 1300304 - DNA, 19 bp, Homo sapiens
ggcacctaatccaggcaga

SEQ ID NO: 1300305 - DNA, 22 bp, Homo sapiens
ggcacctaatccaggcagatcc

SEQ ID NO: 1300306 - DNA, 14 bp, Homo sapiens
ggcagcgccaggct

SEQ ID NO: 1300307 - DNA, 21 bp, Homo sapiens
ggcagcgccaggctgaccaca

SEQ ID NO: 1300308 - DNA, 22 bp, Homo sapiens
ggcagcgccaggctgaccacag

SEQ ID NO: 1300309 - DNA, 15 bp, Homo sapiens
ggcagctctggacag

SEQ ID NO: 1300310 - DNA, 20 bp, Homo sapiens
ggcagctctggacagcccca

SEQ ID NO: 1300311 - DNA, 11 bp, Homo sapiens
ggcaggaaaag

SEQ ID NO: 1300312 - DNA, 14 bp, Homo sapiens
ggcagttggccaga

SEQ ID NO: 1300313 - DNA, 21 bp, Homo sapiens
ggcatagctccccgcttctgc

SEQ ID NO: 1300314 - DNA, 14 bp, Homo sapiens
ggccaacaaagaac

SEQ ID NO: 1300315 - DNA, 20 bp, Homo sapiens
ggccaacccttctcctcttg

SEQ ID NO: 1300316 - DNA, 23 bp, Homo sapiens
ggccaacccttctcctcttgtaa

SEQ ID NO: 1300317 - DNA, 19 bp, Homo sapiens
ggccacatcaaagaggctg

SEQ ID NO: 1300318 - DNA, 21 bp, Homo sapiens
ggccacttctgggtggggcag

SEQ ID NO: 1300319 - DNA, 16 bp, Homo sapiens
ggccagacacaggccc

SEQ ID NO: 1300320 - DNA, 18 bp, Homo sapiens
ggccagacacaggccctc

SEQ ID NO: 1300321 - DNA, 14 bp, Homo sapiens
ggccagagccaggg

SEQ ID NO: 1300322 - DNA, 15 bp, Homo sapiens
ggccagccatgtctg

SEQ ID NO: 1300323 - DNA, 15 bp, Homo sapiens
ggccatgatggcaac

SEQ ID NO: 1300324 - DNA, 14 bp, Homo sapiens
ggccatgcctcagc

SEQ ID NO: 1300325 - DNA, 12 bp, Homo sapiens
ggcccagagccc

SEQ ID NO: 1300326 - DNA, 18 bp, Homo sapiens
ggcccagggcccagagcc

SEQ ID NO: 1300327 - DNA, 16 bp, Homo sapiens
ggccccaggacctggc

SEQ ID NO: 1300328 - DNA, 21 bp, Homo sapiens
ggccccaggacctggctgcca

SEQ ID NO: 1300329 - DNA, 19 bp, Homo sapiens
ggccctccctgttccccag

SEQ ID NO: 1300330 - DNA, 19 bp, Homo sapiens
ggccctctggagtggccac

SEQ ID NO: 1300331 - DNA, 13 bp, Homo sapiens
ggccgctgccacc

SEQ ID NO: 1300332 - DNA, 23 bp, Homo sapiens
ggccgctgccacccacctccctg

SEQ ID NO: 1300333 - DNA, 17 bp, Homo sapiens
ggcctcagccagagaag

SEQ ID NO: 1300334 - DNA, 16 bp, Homo sapiens
ggcctctgtgccttct

SEQ ID NO: 1300335 - DNA, 20 bp, Homo sapiens
ggcctgatcagaccacggct

SEQ ID NO: 1300336 - DNA, 19 bp, Homo sapiens
ggcctgcctccagggctgg

SEQ ID NO: 1300337 - DNA, 13 bp, Homo sapiens
ggcctgctccaga

SEQ ID NO: 1300338 - DNA, 15 bp, Homo sapiens
ggcctgctccagacc

SEQ ID NO: 1300339 - DNA, 14 bp, Homo sapiens
ggcctgtcctccaa

SEQ ID NO: 1300340 - DNA, 12 bp, Homo sapiens
ggcgcactgtga

SEQ ID NO: 1300341 - DNA, 21 bp, Homo sapiens
ggctaaacatccaatattttc

SEQ ID NO: 1300342 - DNA, 18 bp, Homo sapiens
ggctgaccacagcacagc

SEQ ID NO: 1300343 - DNA, 18 bp, Homo sapiens
ggctgaggctggcacagg

SEQ ID NO: 1300344 - DNA, 18 bp, Homo sapiens
ggctggactgaggcctga

SEQ ID NO: 1300345 - DNA, 13 bp, Homo sapiens
ggctggcacagga

SEQ ID NO: 1300346 - DNA, 15 bp, Homo sapiens
ggctggcacaggaca

SEQ ID NO: 1300347 - DNA, 20 bp, Homo sapiens
ggctggcctcccaaatgagc

SEQ ID NO: 1300348 - DNA, 21 bp, Homo sapiens
gtctagagagggaggcaagcc

SEQ ID NO: 1300349 - DNA, 19 bp, Homo sapiens
gtctagatggctcctctca

SEQ ID NO: 1300350 - DNA, 21 bp, Homo sapiens
gtctagatggctcctctcagt

SEQ ID NO: 1300351 - DNA, 12 bp, Homo sapiens
gtctccaccagg

SEQ ID NO: 1300352 - DNA, 15 bp, Homo sapiens
gtctccaccaggaac

SEQ ID NO: 1300353 - DNA, 21 bp, Homo sapiens
gtctccaccaggaacctcttc

SEQ ID NO: 1300354 - DNA, 15 bp, Homo sapiens
gtctctgtgagactc

SEQ ID NO: 1300355 - DNA, 16 bp, Homo sapiens
gtctcttgtattaaac

SEQ ID NO: 1300356 - DNA, 14 bp, Homo sapiens
gtctggaagtccaa

SEQ ID NO: 1300357 - DNA, 14 bp, Homo sapiens
gtcttctaaacttc

SEQ ID NO: 1300358 - DNA, 12 bp, Homo sapiens
gtctttcctaga

SEQ ID NO: 1300359 - DNA, 15 bp, Homo sapiens
gtgaaaacggagctg

SEQ ID NO: 1300360 - DNA, 19 bp, Homo sapiens
gtgaaaagtccttgattgt

SEQ ID NO: 1300361 - DNA, 14 bp, Homo sapiens
gtgaacgatttaga

SEQ ID NO: 1300362 - DNA, 10 bp, Homo sapiens
gtgaagccaa

SEQ ID NO: 1300363 - DNA, 13 bp, Homo sapiens
gtgaatgaacact

SEQ ID NO: 1300364 - DNA, 22 bp, Homo sapiens
gtgagactcgagaactttcatt

SEQ ID NO: 1300365 - DNA, 13 bp, Homo sapiens
gtgaggagctggg

SEQ ID NO: 1300366 - DNA, 13 bp, Homo sapiens
gtgatagcacttt

SEQ ID NO: 1300367 - DNA, 14 bp, Homo sapiens
gtgatagcactttc

SEQ ID NO: 1300368 - DNA, 14 bp, Homo sapiens
gtgatctcagatca

SEQ ID NO: 1300369 - DNA, 15 bp, Homo sapiens
gtgatgtgaagccaa

SEQ ID NO: 1300370 - DNA, 21 bp, Homo sapiens
gtgattgacagctttgctgct

SEQ ID NO: 1300371 - DNA, 22 bp, Homo sapiens
gtgattgacagctttgctgctg

SEQ ID NO: 1300372 - DNA, 14 bp, Homo sapiens
gtgattgtggaatg

SEQ ID NO: 1300373 - DNA, 22 bp, Homo sapiens
gtgcaataaatctgacccagtg

SEQ ID NO: 1300374 - DNA, 18 bp, Homo sapiens
gtgcacaaaacccagacc

SEQ ID NO: 1300375 - DNA, 19 bp, Homo sapiens
gtgcactgcccatggacag

SEQ ID NO: 1300376 - DNA, 14 bp, Homo sapiens
gtgccccaggacca

SEQ ID NO: 1300377 - DNA, 15 bp, Homo sapiens
gtgccccaggaccag

SEQ ID NO: 1300378 - DNA, 13 bp, Homo sapiens
gtgcccccactga

SEQ ID NO: 1300379 - DNA, 15 bp, Homo sapiens
gtgcccccactgacc

SEQ ID NO: 1300380 - DNA, 17 bp, Homo sapiens
gtgctgacagctgctcc

SEQ ID NO: 1300381 - DNA, 21 bp, Homo sapiens
gtgctgacggccagggagaag

SEQ ID NO: 1300382 - DNA, 18 bp, Homo sapiens
gtgctgtcctcaggtggc

SEQ ID NO: 1300383 - DNA, 15 bp, Homo sapiens
gtgctttatgctgaa

SEQ ID NO: 1300384 - DNA, 17 bp, Homo sapiens
gtgctttatgctgaaac

SEQ ID NO: 1300385 - DNA, 17 bp, Homo sapiens
gtggaccttaggccttc

SEQ ID NO: 1300386 - DNA, 21 bp, Homo sapiens
gtggactcagggcagcgccag

SEQ ID NO: 1300387 - DNA, 13 bp, Homo sapiens
gtggaggcacttt

SEQ ID NO: 1300388 - DNA, 14 bp, Homo sapiens
gtggaggcacttta

SEQ ID NO: 1300389 - DNA, 21 bp, Homo sapiens
gtggattttggttttgttccc

SEQ ID NO: 1300390 - DNA, 18 bp, Homo sapiens
gtggccaaggagctgcta

SEQ ID NO: 1300391 - DNA, 13 bp, Homo sapiens
gtggcccaggacc

SEQ ID NO: 1300392 - DNA, 20 bp, Homo sapiens
gtggctagtcaagctcctcc

SEQ ID NO: 1300393 - DNA, 22 bp, Homo sapiens
gtggctagtcaagctcctcctc

SEQ ID NO: 1300394 - DNA, 23 bp, Homo sapiens
gtggctagtcaagctcctcctcc

SEQ ID NO: 1300395 - DNA, 15 bp, Homo sapiens
gtggctgagcccctg

SEQ ID NO: 1300396 - DNA, 15 bp, Homo sapiens
gtggggtcatgccct

SEQ ID NO: 1300397 - DNA, 21 bp, Homo sapiens
gtggggtcatgccctcctctc

SEQ ID NO: 1300398 - DNA, 16 bp, Homo sapiens
gtggtggtaaccctgg

SEQ ID NO: 1300399 - DNA, 14 bp, Homo sapiens
gtggtgtggagaag

SEQ ID NO: 1300400 - DNA, 14 bp, Homo sapiens
tactcaggaagaac

SEQ ID NO: 1300401 - DNA, 21 bp, Homo sapiens
tactcttaggaagagaaacca

SEQ ID NO: 1300402 - DNA, 14 bp, Homo sapiens
tactctttctgtat

SEQ ID NO: 1300403 - DNA, 16 bp, Homo sapiens
tactctttctgtatat

SEQ ID NO: 1300404 - DNA, 14 bp, Homo sapiens
tactgagcttctct

SEQ ID NO: 1300405 - DNA, 22 bp, Homo sapiens
tactgccctccagctctttcct

SEQ ID NO: 1300406 - DNA, 20 bp, Homo sapiens
tactgctactgtaattttat

SEQ ID NO: 1300407 - DNA, 22 bp, Homo sapiens
tactggcaaaaggatctttgtg

SEQ ID NO: 1300408 - DNA, 13 bp, Homo sapiens
tactgtaattcct

SEQ ID NO: 1300409 - DNA, 12 bp, Homo sapiens
tactgtaatttt

SEQ ID NO: 1300410 - DNA, 14 bp, Homo sapiens
tactgtgtgtgtga

SEQ ID NO: 1300411 - DNA, 15 bp, Homo sapiens
tacttgaagggccag

SEQ ID NO: 1300412 - DNA, 20 bp, Homo sapiens
tacttgaagggccagagcca

SEQ ID NO: 1300413 - DNA, 22 bp, Homo sapiens
tacttgaagggccagagccagg

SEQ ID NO: 1300414 - DNA, 13 bp, Homo sapiens
tactttttgttat

SEQ ID NO: 1300415 - DNA, 14 bp, Homo sapiens
tagaaagaagccca

SEQ ID NO: 1300416 - DNA, 21 bp, Homo sapiens
tagaaagaagcccaatattat

SEQ ID NO: 1300417 - DNA, 23 bp, Homo sapiens
tagaaagaagcccaatattataa

SEQ ID NO: 1300418 - DNA, 19 bp, Homo sapiens
tagaaataaaggatgtgat

SEQ ID NO: 1300419 - DNA, 19 bp, Homo sapiens
tagaactcagttttaacta

SEQ ID NO: 1300420 - DNA, 22 bp, Homo sapiens
tagaactcagttttaactagaa

SEQ ID NO: 1300421 - DNA, 14 bp, Homo sapiens
tagaatccaaactt

SEQ ID NO: 1300422 - DNA, 19 bp, Homo sapiens
tagacacatatgaggggga

SEQ ID NO: 1300423 - DNA, 18 bp, Homo sapiens
tagacagtctcactttgt

SEQ ID NO: 1300424 - DNA, 13 bp, Homo sapiens
tagagaggaaaag

SEQ ID NO: 1300425 - DNA, 16 bp, Homo sapiens
tagatgaagttttaca

SEQ ID NO: 1300426 - DNA, 13 bp, Homo sapiens
tagatgctggccc

SEQ ID NO: 1300427 - DNA, 15 bp, Homo sapiens
tagatgctggcccag

SEQ ID NO: 1300428 - DNA, 14 bp, Homo sapiens
tagatggattctcc

SEQ ID NO: 1300429 - DNA, 21 bp, Homo sapiens
tagatgggagggaggctcagg

SEQ ID NO: 1300430 - DNA, 15 bp, Homo sapiens
tagatggtgctgaga

SEQ ID NO: 1300431 - DNA, 19 bp, Homo sapiens
tagatggtgctgagaagct

SEQ ID NO: 1300432 - DNA, 11 bp, Homo sapiens
tagcagacagg

SEQ ID NO: 1300433 - DNA, 18 bp, Homo sapiens
tagcagattttaattttg

SEQ ID NO: 1300434 - DNA, 15 bp, Homo sapiens
tagcatgacatttct

SEQ ID NO: 1300435 - DNA, 20 bp, Homo sapiens
tagccaaatggtttaacttc

SEQ ID NO: 1300436 - DNA, 20 bp, Homo sapiens
tagccacatttggaatactt

SEQ ID NO: 1300437 - DNA, 18 bp, Homo sapiens
tagccagcacacagggca

SEQ ID NO: 1300438 - DNA, 16 bp, Homo sapiens
tagccccctggcctct

SEQ ID NO: 1300439 - DNA, 17 bp, Homo sapiens
tagccccctggcctctg

SEQ ID NO: 1300440 - DNA, 18 bp, Homo sapiens
tagccccctggcctctgt

SEQ ID NO: 1300441 - DNA, 19 bp, Homo sapiens
tagctaaacggattccaaa

SEQ ID NO: 1300442 - DNA, 17 bp, Homo sapiens
tagctctatgtttacaa

SEQ ID NO: 1300443 - DNA, 21 bp, Homo sapiens
tagctgacccagccccttgag

SEQ ID NO: 1300444 - DNA, 23 bp, Homo sapiens
tagctgacccagccccttgagaa

SEQ ID NO: 1300445 - DNA, 20 bp, Homo sapiens
tagctgggggtgggccaggc

SEQ ID NO: 1300446 - DNA, 12 bp, Homo sapiens
taggagaagcca

SEQ ID NO: 1300447 - DNA, 18 bp, Homo sapiens
taggagggagttatctaa

SEQ ID NO: 1300448 - DNA, 12 bp, Homo sapiens
taggcatttcct

SEQ ID NO: 1300449 - DNA, 14 bp, Homo sapiens
taggcctcagccag

SEQ ID NO: 1300450 - DNA, 16 bp, Homo sapiens
tagggggaactctagc

SEQ ID NO: 1300451 - DNA, 15 bp, Homo sapiens
tagggtcggaaccca

SEQ ID NO: 1300452 - DNA, 18 bp, Homo sapiens
tagtctagatggctcctc

SEQ ID NO: 1300453 - DNA, 19 bp, Homo sapiens
tagtctagatggctcctct

SEQ ID NO: 1300454 - DNA, 21 bp, Homo sapiens
tagtctcttgtattaaactct

SEQ ID NO: 1300455 - DNA, 16 bp, Homo sapiens
tagtgccttctaaagg

SEQ ID NO: 1300456 - DNA, 23 bp, Homo sapiens
tagttaagacatgatttccttga

SEQ ID NO: 1300457 - DNA, 12 bp, Homo sapiens
tataaaacttct

SEQ ID NO: 1300458 - DNA, 18 bp, Homo sapiens
tataatttttttcaatat

SEQ ID NO: 1300459 - DNA, 14 bp, Homo sapiens
tatacaaattagaa

SEQ ID NO: 1300460 - DNA, 16 bp, Homo sapiens
tatacatagcatgaca

SEQ ID NO: 1300461 - DNA, 16 bp, Homo sapiens
tatactctttctgtat

SEQ ID NO: 1300462 - DNA, 19 bp, Homo sapiens
tatactctttctgtatata

SEQ ID NO: 1300463 - DNA, 22 bp, Homo sapiens
tatactctttctgtatatactt

SEQ ID NO: 1300464 - DNA, 15 bp, Homo sapiens
tatagaatatttatt

SEQ ID NO: 1300465 - DNA, 22 bp, Homo sapiens
tatagcccagccaggccccagg

SEQ ID NO: 1300466 - DNA, 17 bp, Homo sapiens
tatcatggtctcagtca

SEQ ID NO: 1300467 - DNA, 22 bp, Homo sapiens
tatccatattgagtcaaatggt

SEQ ID NO: 1300468 - DNA, 20 bp, Homo sapiens
tatctatacatatctttatt

SEQ ID NO: 1300469 - DNA, 16 bp, Homo sapiens
tatctttgattctcct

SEQ ID NO: 1300470 - DNA, 22 bp, Homo sapiens
tatctttgattctccttcagcc

SEQ ID NO: 1300471 - DNA, 13 bp, Homo sapiens
tatgaaaacttat

SEQ ID NO: 1300472 - DNA, 14 bp, Homo sapiens
tatggtatttgagt

SEQ ID NO: 1300473 - DNA, 17 bp, Homo sapiens
tatgtagtaattgacat

SEQ ID NO: 1300474 - DNA, 20 bp, Homo sapiens
tatgtagtaattgacatgtg

SEQ ID NO: 1300475 - DNA, 18 bp, Homo sapiens
tatgttgaatacttttta

SEQ ID NO: 1300476 - DNA, 16 bp, Homo sapiens
tattaaatacaaaact

SEQ ID NO: 1300477 - DNA, 19 bp, Homo sapiens
tattaaattaaattttgtg

SEQ ID NO: 1300478 - DNA, 14 bp, Homo sapiens
tattaattgctttg

SEQ ID NO: 1300479 - DNA, 21 bp, Homo sapiens
tattaccccctccttcagaca

SEQ ID NO: 1300480 - DNA, 22 bp, Homo sapiens
tattaccccctccttcagacac

SEQ ID NO: 1300481 - DNA, 11 bp, Homo sapiens
tattacctctg

SEQ ID NO: 1300482 - DNA, 14 bp, Homo sapiens
tattacctctgata

SEQ ID NO: 1300483 - DNA, 19 bp, Homo sapiens
tattacctctgatacctca

SEQ ID NO: 1300484 - DNA, 16 bp, Homo sapiens
tattcaattcctctgg

SEQ ID NO: 1300485 - DNA, 17 bp, Homo sapiens
tattcaattcctctggg

SEQ ID NO: 1300486 - DNA, 16 bp, Homo sapiens
tattccagaatgctgt

SEQ ID NO: 1300487 - DNA, 16 bp, Homo sapiens
tattgctgagagaaat

SEQ ID NO: 1300488 - DNA, 16 bp, Homo sapiens
tattgtgtttgtgtat

SEQ ID NO: 1300489 - DNA, 24 bp, Homo sapiens
tatttaaactctgttgcaagtgca

SEQ ID NO: 1300490 - DNA, 23 bp, Homo sapiens
tatttaacagctgaattatctat

SEQ ID NO: 1300491 - DNA, 19 bp, Homo sapiens
tatttacgctttgattcat

SEQ ID NO: 1300492 - DNA, 14 bp, Homo sapiens
tatttgggaagtga

SEQ ID NO: 1300493 - DNA, 14 bp, Homo sapiens
tattttctttaatg

SEQ ID NO: 1300494 - DNA, 23 bp, Homo sapiens
tattttggattgtatattgtgtt

SEQ ID NO: 1300495 - DNA, 19 bp, Homo sapiens
tcaaaatgctttttatttc

SEQ ID NO: 1300496 - DNA, 14 bp, Homo sapiens
tcaaactggggcct

SEQ ID NO: 1300497 - DNA, 21 bp, Homo sapiens
tcaaatggtaggcatttccta

SEQ ID NO: 1300498 - DNA, 17 bp, Homo sapiens
tcaaattaataatctta

SEQ ID NO: 1300499 - DNA, 15 bp, Homo sapiens
tcaacgtattgtttc

SEQ ID NO: 1300500 - DNA, 20 bp, Homo sapiens
tcaagaaataaaaggaagcc

SEQ ID NO: 1300501 - DNA, 21 bp, Homo sapiens
tcaagatactgctactgtaat

SEQ ID NO: 1300502 - DNA, 22 bp, Homo sapiens
tcaagatactgctactgtaatt

SEQ ID NO: 1300503 - DNA, 15 bp, Homo sapiens
tcaagcgattctcct

SEQ ID NO: 1300504 - DNA, 13 bp, Homo sapiens
tcaagctcctcct

SEQ ID NO: 1300505 - DNA, 14 bp, Homo sapiens
tcaagctcctcctc

SEQ ID NO: 1300506 - DNA, 16 bp, Homo sapiens
tcaagctcctcctccc

SEQ ID NO: 1300507 - DNA, 18 bp, Homo sapiens
tcaagctcctcctccctg

SEQ ID NO: 1300508 - DNA, 13 bp, Homo sapiens
tcaatatttatta

SEQ ID NO: 1300509 - DNA, 20 bp, Homo sapiens
tcaatatttattattttcac

SEQ ID NO: 1300510 - DNA, 15 bp, Homo sapiens
tcaatcctacctgtt

SEQ ID NO: 1300511 - DNA, 17 bp, Homo sapiens
tcacaaacttttatact

SEQ ID NO: 1300512 - DNA, 12 bp, Homo sapiens
tcacacactgat

SEQ ID NO: 1300513 - DNA, 11 bp, Homo sapiens
tcacactgaga

SEQ ID NO: 1300514 - DNA, 20 bp, Homo sapiens
tcacagttctttgggccaga

SEQ ID NO: 1300515 - DNA, 14 bp, Homo sapiens
tcacccctcccttt

SEQ ID NO: 1300516 - DNA, 18 bp, Homo sapiens
tcacccctggttctcatc

SEQ ID NO: 1300517 - DNA, 15 bp, Homo sapiens
tcacctagaaattga

SEQ ID NO: 1300518 - DNA, 20 bp, Homo sapiens
tcacctatttccattcaaca

SEQ ID NO: 1300519 - DNA, 18 bp, Homo sapiens
tcacctgtttttaagctg

SEQ ID NO: 1300520 - DNA, 19 bp, Homo sapiens
tcacctgtttttaagctgt

SEQ ID NO: 1300521 - DNA, 15 bp, Homo sapiens
tcactcattgctgag

SEQ ID NO: 1300522 - DNA, 17 bp, Homo sapiens
tcactcattgctgagcc

SEQ ID NO: 1300523 - DNA, 22 bp, Homo sapiens
tcacttgaggtcaggagttcct

SEQ ID NO: 1300524 - DNA, 21 bp, Homo sapiens
tcagaactcaaatggggccag

SEQ ID NO: 1300525 - DNA, 22 bp, Homo sapiens
tcagaactcaaatggggccaga

SEQ ID NO: 1300526 - DNA, 21 bp, Homo sapiens
tcagaatagccacatttggaa

SEQ ID NO: 1300527 - DNA, 23 bp, Homo sapiens
tcagaatagccacatttggaata

SEQ ID NO: 1300528 - DNA, 22 bp, Homo sapiens
tcagacaccctcaacctcttct

SEQ ID NO: 1300529 - DNA, 15 bp, Homo sapiens
tcagacatgttttcc

SEQ ID NO: 1300530 - DNA, 16 bp, Homo sapiens
tcagaggcgcactgtg

SEQ ID NO: 1300531 - DNA, 17 bp, Homo sapiens
tcagatttccagtctcc

SEQ ID NO: 1300532 - DNA, 19 bp, Homo sapiens
tcagcacaaggccatctgg

SEQ ID NO: 1300533 - DNA, 12 bp, Homo sapiens
tcagccagcact

SEQ ID NO: 1300534 - DNA, 12 bp, Homo sapiens
tcagcctggcca

SEQ ID NO: 1300535 - DNA, 14 bp, Homo sapiens
tcagcctggccaga

SEQ ID NO: 1300536 - DNA, 17 bp, Homo sapiens
tcagcctggccagacac

SEQ ID NO: 1300537 - DNA, 22 bp, Homo sapiens
tcaggaagaacaccctctaaat

SEQ ID NO: 1300538 - DNA, 17 bp, Homo sapiens
tcagtataaacaaagtt

SEQ ID NO: 1300539 - DNA, 13 bp, Homo sapiens
tcagtcacagcca

SEQ ID NO: 1300540 - DNA, 14 bp, Homo sapiens
tcagtcacagccac

SEQ ID NO: 1300541 - DNA, 15 bp, Homo sapiens
tcagtcacagccacc

SEQ ID NO: 1300542 - DNA, 18 bp, Homo sapiens
tcagtgtaccatttgcct

SEQ ID NO: 1300543 - DNA, 13 bp, Homo sapiens
tcagttttcattt

SEQ ID NO: 1300544 - DNA, 20 bp, Homo sapiens
tcataaaaagcaaaacaaaa

SEQ ID NO: 1300545 - DNA, 14 bp, Homo sapiens
tcatagtaacttct

SEQ ID NO: 1300546 - DNA, 21 bp, Homo sapiens
tcatagtaacttcttatggaa

SEQ ID NO: 1300547 - DNA, 21 bp, Homo sapiens
tcatcgaatctactaattcca

SEQ ID NO: 1300548 - DNA, 13 bp, Homo sapiens
tcatctcttagct

SEQ ID NO: 1300549 - DNA, 19 bp, Homo sapiens
tcatctcttagctcccctc

SEQ ID NO: 1300550 - DNA, 21 bp, Homo sapiens
tcatctcttagctcccctcca

SEQ ID NO: 1300551 - DNA, 13 bp, Homo sapiens
tcatctgccgtgc

SEQ ID NO: 1300552 - DNA, 12 bp, Homo sapiens
tcatctgtgcac

SEQ ID NO: 1300553 - DNA, 23 bp, Homo sapiens
tcatggatgggggaactcagatc

SEQ ID NO: 1300554 - DNA, 13 bp, Homo sapiens
tcatggtctcagt

SEQ ID NO: 1300555 - DNA, 15 bp, Homo sapiens
tcatgtaatcctcaa

SEQ ID NO: 1300556 - DNA, 17 bp, Homo sapiens
tcatgtacaagatgaag

SEQ ID NO: 1300557 - DNA, 15 bp, Homo sapiens
tcatttcacccctcc

SEQ ID NO: 1300558 - DNA, 23 bp, Homo sapiens
tcatttcacccctccctttctcc

SEQ ID NO: 1300559 - DNA, 20 bp, Homo sapiens
tcatttggttcattaattct

SEQ ID NO: 1300560 - DNA, 13 bp, Homo sapiens
tcatttttttcca

SEQ ID NO: 1300561 - DNA, 18 bp, Homo sapiens
tcatttttttccaggctg

SEQ ID NO: 1300562 - DNA, 12 bp, Homo sapiens
tccaaaactgcc

SEQ ID NO: 1300563 - DNA, 15 bp, Homo sapiens
tccaaaagaagcccc

SEQ ID NO: 1300564 - DNA, 14 bp, Homo sapiens
tccaaagcagacag

SEQ ID NO: 1300565 - DNA, 18 bp, Homo sapiens
tccaaatggcgtctggaa

SEQ ID NO: 1300566 - DNA, 23 bp, Homo sapiens
tccaacaccaagcacagcagcct

SEQ ID NO: 1300567 - DNA, 17 bp, Homo sapiens
tccaacagaagaactgt

SEQ ID NO: 1300568 - DNA, 14 bp, Homo sapiens
tccaaccccccagc

SEQ ID NO: 1300569 - DNA, 18 bp, Homo sapiens
tccaaccccccagcactg

SEQ ID NO: 1300570 - DNA, 20 bp, Homo sapiens
tccaaccccccagcactgag

SEQ ID NO: 1300571 - DNA, 13 bp, Homo sapiens
tccaaccttccca

SEQ ID NO: 1300572 - DNA, 23 bp, Homo sapiens
tccaagcagcctgagcaactctt

SEQ ID NO: 1300573 - DNA, 21 bp, Homo sapiens
tccaaggggaatcagaactca

SEQ ID NO: 1300574 - DNA, 21 bp, Homo sapiens
tccacaccttttattgacaca

SEQ ID NO: 1300575 - DNA, 12 bp, Homo sapiens
tccactctcccc

SEQ ID NO: 1300576 - DNA, 22 bp, Homo sapiens
tccactctcccccaccccctcc

SEQ ID NO: 1300577 - DNA, 22 bp, Homo sapiens
tccagaactcactggggcctac

SEQ ID NO: 1300578 - DNA, 16 bp, Homo sapiens
tccagaatgctgtaca

SEQ ID NO: 1300579 - DNA, 18 bp, Homo sapiens
tccagaatgctgtacatc

SEQ ID NO: 1300580 - DNA, 21 bp, Homo sapiens
tccagaatgctgtacatctat

SEQ ID NO: 1300581 - DNA, 18 bp, Homo sapiens
tccagacctgatcctgga

SEQ ID NO: 1300582 - DNA, 14 bp, Homo sapiens
tccagacttccttg

SEQ ID NO: 1300583 - DNA, 17 bp, Homo sapiens
tccagatgcagggcagt

SEQ ID NO: 1300584 - DNA, 18 bp, Homo sapiens
tccagatgtttccagact

SEQ ID NO: 1300585 - DNA, 12 bp, Homo sapiens
tccagcagggaa

SEQ ID NO: 1300586 - DNA, 11 bp, Homo sapiens
tccagcctggg

SEQ ID NO: 1300587 - DNA, 20 bp, Homo sapiens
tccaggactatatttgggcc

SEQ ID NO: 1300588 - DNA, 23 bp, Homo sapiens
tccaggactatatttgggcctgc

SEQ ID NO: 1300589 - DNA, 18 bp, Homo sapiens
tcccctgcccccaggact

SEQ ID NO: 1300590 - DNA, 16 bp, Homo sapiens
tccccttctctcatct

SEQ ID NO: 1300591 - DNA, 21 bp, Homo sapiens
tccctcccccccatgcactgt

SEQ ID NO: 1300592 - DNA, 19 bp, Homo sapiens
tccctctatttatgtttgc

SEQ ID NO: 1300593 - DNA, 16 bp, Homo sapiens
tccctgaccctgtata

SEQ ID NO: 1300594 - DNA, 22 bp, Homo sapiens
tccctgaccctgtatatagccc

SEQ ID NO: 1300595 - DNA, 21 bp, Homo sapiens
tccctgacctccctctaattt

SEQ ID NO: 1300596 - DNA, 20 bp, Homo sapiens
tccctgcatctgaccagcag

SEQ ID NO: 1300597 - DNA, 18 bp, Homo sapiens
tccctgttccccagagaa

SEQ ID NO: 1300598 - DNA, 15 bp, Homo sapiens
tccctttctcccctg

SEQ ID NO: 1300599 - DNA, 17 bp, Homo sapiens
tccctttctcccctgcc

SEQ ID NO: 1300600 - DNA, 18 bp, Homo sapiens
tccgtgctgacagctgct

SEQ ID NO: 1300601 - DNA, 19 bp, Homo sapiens
tccgtgctgacagctgctc

SEQ ID NO: 1300602 - DNA, 14 bp, Homo sapiens
tcctacccatcccc

SEQ ID NO: 1300603 - DNA, 20 bp, Homo sapiens
tcctcagccttgccagagat

SEQ ID NO: 1300604 - DNA, 12 bp, Homo sapiens
tcctcatctcta

SEQ ID NO: 1300605 - DNA, 23 bp, Homo sapiens
tcctccactctcccccaccccct

SEQ ID NO: 1300606 - DNA, 12 bp, Homo sapiens
tcctccagcagg

SEQ ID NO: 1300607 - DNA, 15 bp, Homo sapiens
tcctcccttctgcta

SEQ ID NO: 1300608 - DNA, 18 bp, Homo sapiens
tcctcccttctgctactg

SEQ ID NO: 1300609 - DNA, 17 bp, Homo sapiens
tcctcctccctgcatct

SEQ ID NO: 1300610 - DNA, 19 bp, Homo sapiens
tcctctcccattgtccctc

SEQ ID NO: 1300611 - DNA, 20 bp, Homo sapiens
tcctctcccattgtccctct

SEQ ID NO: 1300612 - DNA, 22 bp, Homo sapiens
tcctctcccattgtccctctgc

SEQ ID NO: 1300613 - DNA, 23 bp, Homo sapiens
tcctctcccattgtccctctgcc

SEQ ID NO: 1300614 - DNA, 15 bp, Homo sapiens
tcctctccccagccc

SEQ ID NO: 1300615 - DNA, 18 bp, Homo sapiens
tcctctccccagcccaga

SEQ ID NO: 1300616 - DNA, 21 bp, Homo sapiens
tcctctccccagcccagagac

SEQ ID NO: 1300617 - DNA, 23 bp, Homo sapiens
tcctctccccagcccagagacat

SEQ ID NO: 1300618 - DNA, 21 bp, Homo sapiens
tcctctgtcagtcacagccac

SEQ ID NO: 1300619 - DNA, 12 bp, Homo sapiens
tcctcttgtaaa

SEQ ID NO: 1300620 - DNA, 18 bp, Homo sapiens
tcctcttgtaaataaagc

SEQ ID NO: 1300621 - DNA, 21 bp, Homo sapiens
tcctcttgtaaataaagccct

SEQ ID NO: 1300622 - DNA, 17 bp, Homo sapiens
tcctgaaacaacttgga

SEQ ID NO: 1300623 - DNA, 13 bp, Homo sapiens
tcctgaagaacca

SEQ ID NO: 1300624 - DNA, 18 bp, Homo sapiens
tcctgaagaaccagtccc

SEQ ID NO: 1300625 - DNA, 17 bp, Homo sapiens
tcctgccgcagagctgg

SEQ ID NO: 1300626 - DNA, 15 bp, Homo sapiens
tcctggagcccagag

SEQ ID NO: 1300627 - DNA, 17 bp, Homo sapiens
tcctggcagtttaaaaa

SEQ ID NO: 1300628 - DNA, 20 bp, Homo sapiens
tcctggcagtttaaaaaaat

SEQ ID NO: 1300629 - DNA, 11 bp, Homo sapiens
tcctggccatc

SEQ ID NO: 1300630 - DNA, 14 bp, Homo sapiens
tcctggccatccca

SEQ ID NO: 1300631 - DNA, 16 bp, Homo sapiens
tcctggccatcccaca

SEQ ID NO: 1300632 - DNA, 15 bp, Homo sapiens
tcctgggcctgcaga

SEQ ID NO: 1300633 - DNA, 16 bp, Homo sapiens
tcctgggcctgcagaa

SEQ ID NO: 1300634 - DNA, 13 bp, Homo sapiens
tcctgtccagctc

SEQ ID NO: 1300635 - DNA, 17 bp, Homo sapiens
tccttaatccagctgat

SEQ ID NO: 1300636 - DNA, 13 bp, Homo sapiens
tccttcagacacc

SEQ ID NO: 1300637 - DNA, 23 bp, Homo sapiens
tccttcagacaccctcaacctct

SEQ ID NO: 1300638 - DNA, 13 bp, Homo sapiens
tccttcagccctc

SEQ ID NO: 1300639 - DNA, 21 bp, Homo sapiens
tccttcagccctcacccctgg

SEQ ID NO: 1300640 - DNA, 21 bp, Homo sapiens
tccttgagacacggagcccag

SEQ ID NO: 1300641 - DNA, 23 bp, Homo sapiens
tccttgagacacggagcccagcc

SEQ ID NO: 1300642 - DNA, 14 bp, Homo sapiens
tccttgttcctaga

SEQ ID NO: 1300643 - DNA, 13 bp, Homo sapiens
tcgaaacacagaa

SEQ ID NO: 1300644 - DNA, 18 bp, Homo sapiens
tcgaaacacagaaacctt

SEQ ID NO: 1300645 - DNA, 19 bp, Homo sapiens
tcgaaacctgggattcagg

SEQ ID NO: 1300646 - DNA, 15 bp, Homo sapiens
tcgaaccgttttgaa

SEQ ID NO: 1300647 - DNA, 15 bp, Homo sapiens
tcgagaactttcatt

SEQ ID NO: 1300648 - DNA, 22 bp, Homo sapiens
tcgagaactttcatttttttcc

SEQ ID NO: 1300649 - DNA, 19 bp, Homo sapiens
tcgcatggtcacacactga

SEQ ID NO: 1300650 - DNA, 14 bp, Homo sapiens
tcgccccagcaggt

SEQ ID NO: 1300651 - DNA, 20 bp, Homo sapiens
tcggaacccaagcttagaac

SEQ ID NO: 1300652 - DNA, 12 bp, Homo sapiens
tcggaggaagcc

SEQ ID NO: 1300653 - DNA, 13 bp, Homo sapiens
tcggaggaagccc

SEQ ID NO: 1300654 - DNA, 11 bp, Homo sapiens
tctaaaagaaa

SEQ ID NO: 1300655 - DNA, 17 bp, Homo sapiens
tctaacagctcaggatc

SEQ ID NO: 1300656 - DNA, 15 bp, Homo sapiens
tctacaatgtgaact

SEQ ID NO: 1300657 - DNA, 20 bp, Homo sapiens
tctacaatgtgaactttatt

SEQ ID NO: 1300658 - DNA, 18 bp, Homo sapiens
tctactaattccacacct

SEQ ID NO: 1300659 - DNA, 19 bp, Homo sapiens
tctagatgaagttttacat

SEQ ID NO: 1300660 - DNA, 23 bp, Homo sapiens
tctagatgaagttttacattgtt

SEQ ID NO: 1300661 - DNA, 18 bp, Homo sapiens
tctagatggctcctctca

SEQ ID NO: 1300662 - DNA, 11 bp, Homo sapiens
tctagctgttg

SEQ ID NO: 1300663 - DNA, 19 bp, Homo sapiens
tctagctgttgagctgttt

SEQ ID NO: 1300664 - DNA, 14 bp, Homo sapiens
tctagtgccttcta

SEQ ID NO: 1300665 - DNA, 13 bp, Homo sapiens
tctataaggccat

SEQ ID NO: 1300666 - DNA, 22 bp, Homo sapiens
tctataaggccataaaacaggt

SEQ ID NO: 1300667 - DNA, 16 bp, Homo sapiens
tctatagactctagga

SEQ ID NO: 1300668 - DNA, 18 bp, Homo sapiens
tctatttatatgtacatg

SEQ ID NO: 1300669 - DNA, 13 bp, Homo sapiens
tctatttatgttt

SEQ ID NO: 1300670 - DNA, 15 bp, Homo sapiens
tctatttatttactg

SEQ ID NO: 1300671 - DNA, 15 bp, Homo sapiens
tctattttggattgt

SEQ ID NO: 1300672 - DNA, 18 bp, Homo sapiens
tctattttggattgtata

SEQ ID NO: 1300673 - DNA, 20 bp, Homo sapiens
tctcatctcttagctcccct

SEQ ID NO: 1300674 - DNA, 12 bp, Homo sapiens
tctcatctttct

SEQ ID NO: 1300675 - DNA, 18 bp, Homo sapiens
tctcatgcccctggctgg

SEQ ID NO: 1300676 - DNA, 21 bp, Homo sapiens
tctcatgcccctggctgggac

SEQ ID NO: 1300677 - DNA, 19 bp, Homo sapiens
tctcatgttttcaactgcc

SEQ ID NO: 1300678 - DNA, 17 bp, Homo sapiens
tctcatttcacccctcc

SEQ ID NO: 1300679 - DNA, 17 bp, Homo sapiens
tctccaaccccccagca

SEQ ID NO: 1300680 - DNA, 23 bp, Homo sapiens
tctccaaccccccagcactgagg

SEQ ID NO: 1300681 - DNA, 14 bp, Homo sapiens
tctccacagcaacc

SEQ ID NO: 1300682 - DNA, 18 bp, Homo sapiens
tctcccattgtccctctg

SEQ ID NO: 1300683 - DNA, 16 bp, Homo sapiens
tctccccagcccagag

SEQ ID NO: 1300684 - DNA, 12 bp, Homo sapiens
tctcccccaccc

SEQ ID NO: 1300685 - DNA, 15 bp, Homo sapiens
tctcccccaccccct

SEQ ID NO: 1300686 - DNA, 19 bp, Homo sapiens
tctcccccaccccctcccc

SEQ ID NO: 1300687 - DNA, 21 bp, Homo sapiens
tctcccctgcccccaggactg

SEQ ID NO: 1300688 - DNA, 22 bp, Homo sapiens
tctcccctgcccccaggactgg

SEQ ID NO: 1300689 - DNA, 23 bp, Homo sapiens
tctcccctgcccccaggactggg

SEQ ID NO: 1300690 - DNA, 15 bp, Homo sapiens
tctcctcatctctaa

SEQ ID NO: 1300691 - DNA, 14 bp, Homo sapiens
tctcctcttgtaaa

SEQ ID NO: 1300692 - DNA, 15 bp, Homo sapiens
tctcctcttgtaaat

SEQ ID NO: 1300693 - DNA, 20 bp, Homo sapiens
tctccttcagccctcacccc

SEQ ID NO: 1300694 - DNA, 14 bp, Homo sapiens
tctctcatctctta

SEQ ID NO: 1300695 - DNA, 22 bp, Homo sapiens
tctctcatctcttagctcccct

SEQ ID NO: 1300696 - DNA, 23 bp, Homo sapiens
tctctcatctcttagctcccctc

SEQ ID NO: 1300697 - DNA, 22 bp, Homo sapiens
tctctgtgaacgatttagaaag

SEQ ID NO: 1300698 - DNA, 16 bp, Homo sapiens
tctcttagctcccctc

SEQ ID NO: 1300699 - DNA, 15 bp, Homo sapiens
tctcttatagaatat

SEQ ID NO: 1300700 - DNA, 21 bp, Homo sapiens
tctcttatagaatatttatta

SEQ ID NO: 1300701 - DNA, 14 bp, Homo sapiens
tctgacccagtgcc

SEQ ID NO: 1300702 - DNA, 20 bp, Homo sapiens
tctgataactagatggtgct

SEQ ID NO: 1300703 - DNA, 21 bp, Homo sapiens
tctgataactagatggtgctg

SEQ ID NO: 1300704 - DNA, 19 bp, Homo sapiens
tctgcaaaaatatttataa

SEQ ID NO: 1300705 - DNA, 18 bp, Homo sapiens
tctgcatatgttgaatac

SEQ ID NO: 1300706 - DNA, 21 bp, Homo sapiens
tctgcatatgttgaatacttt

SEQ ID NO: 1300707 - DNA, 15 bp, Homo sapiens
tctgcatttcggtgg

SEQ ID NO: 1300708 - DNA, 16 bp, Homo sapiens
tctgcctgccagctgc

SEQ ID NO: 1300709 - DNA, 21 bp, Homo sapiens
tctgcctgccagctgcactga

SEQ ID NO: 1300710 - DNA, 16 bp, Homo sapiens
tctgcctgtggaactg

SEQ ID NO: 1300711 - DNA, 14 bp, Homo sapiens
tctgctcagctctg

SEQ ID NO: 1300712 - DNA, 12 bp, Homo sapiens
tctgctctcctt

SEQ ID NO: 1300713 - DNA, 13 bp, Homo sapiens
tctggaacccaga

SEQ ID NO: 1300714 - DNA, 16 bp, Homo sapiens
tctggaacccagactc

SEQ ID NO: 1300715 - DNA, 15 bp, Homo sapiens
tctggaacctcagcc

SEQ ID NO: 1300716 - DNA, 21 bp, Homo sapiens
tctggaacctcagcctggcca

SEQ ID NO: 1300717 - DNA, 23 bp, Homo sapiens
tctggaacctcagcctggccaga

SEQ ID NO: 1300718 - DNA, 20 bp, Homo sapiens
tctggagaccagggagcctt

SEQ ID NO: 1300719 - DNA, 16 bp, Homo sapiens
tctggagttgatctgg

SEQ ID NO: 1300720 - DNA, 17 bp, Homo sapiens
tctggagttgatctgga

SEQ ID NO: 1300721 - DNA, 21 bp, Homo sapiens
tctggcaaagcttttagaaat

SEQ ID NO: 1300722 - DNA, 17 bp, Homo sapiens
tctgtcagtcacagcca

SEQ ID NO: 1300723 - DNA, 14 bp, Homo sapiens
tctgtcctcagcct

SEQ ID NO: 1300724 - DNA, 15 bp, Homo sapiens
tctgtcctcagcctt

SEQ ID NO: 1300725 - DNA, 23 bp, Homo sapiens
tctgtcctcagccttgccagaga

SEQ ID NO: 1300726 - DNA, 21 bp, Homo sapiens
tctgtctcaaaaaataaaaat

SEQ ID NO: 1300727 - DNA, 21 bp, Homo sapiens
tctgtgagactcgagaacttt

SEQ ID NO: 1300728 - DNA, 13 bp, Homo sapiens
tctgttccccctt

SEQ ID NO: 1300729 - DNA, 17 bp, Homo sapiens
tctgttttgaaggcaaa

SEQ ID NO: 1300730 - DNA, 14 bp, Homo sapiens
tcttagctcccctc

SEQ ID NO: 1300731 - DNA, 16 bp, Homo sapiens
tcttagctcccctcca

SEQ ID NO: 1300732 - DNA, 15 bp, Homo sapiens
tcttaggaagagaaa

SEQ ID NO: 1300733 - DNA, 17 bp, Homo sapiens
tcttatggaattgattt

SEQ ID NO: 1300734 - DNA, 21 bp, Homo sapiens
tcttatggaattgatttgcat

SEQ ID NO: 1300735 - DNA, 13 bp, Homo sapiens
tcttcacaaaatc

SEQ ID NO: 1300736 - DNA, 20 bp, Homo sapiens
tcttcagaaagtgtgcttta

SEQ ID NO: 1300737 - DNA, 23 bp, Homo sapiens
tcttcagaaagtgtgctttatgc

SEQ ID NO: 1300738 - DNA, 15 bp, Homo sapiens
tcttctcatttcacc

SEQ ID NO: 1300739 - DNA, 22 bp, Homo sapiens
tcttctcatttcacccctccct

SEQ ID NO: 1300740 - DNA, 12 bp, Homo sapiens
tcttctggctca

SEQ ID NO: 1300741 - DNA, 20 bp, Homo sapiens
tcttgaaattaagaaggcaa

SEQ ID NO: 1300742 - DNA, 21 bp, Homo sapiens
tcttgaaattaagaaggcaaa

SEQ ID NO: 1300743 - DNA, 22 bp, Homo sapiens
tcttgaaattaagaaggcaaaa

SEQ ID NO: 1300744 - DNA, 13 bp, Homo sapiens
tcttgaaggtgct

SEQ ID NO: 1300745 - DNA, 23 bp, Homo sapiens
tcttgattatccatattgagtca

SEQ ID NO: 1300746 - DNA, 17 bp, Homo sapiens
tcttgtaaataaagccc

SEQ ID NO: 1300747 - DNA, 12 bp, Homo sapiens
tcttgtctctgg

SEQ ID NO: 1300748 - DNA, 12 bp, Homo sapiens
tctttcctcctt

SEQ ID NO: 1300749 - DNA, 14 bp, Homo sapiens
tctttctgataact

SEQ ID NO: 1300750 - DNA, 15 bp, Homo sapiens
tctttgattctcctt

SEQ ID NO: 1300751 - DNA, 23 bp, Homo sapiens
tctttgctttgctttctgctcag

SEQ ID NO: 1300752 - DNA, 15 bp, Homo sapiens
tctttgggccagaca

SEQ ID NO: 1300753 - DNA, 16 bp, Homo sapiens
tctttgtgctttggct

SEQ ID NO: 1300754 - DNA, 13 bp, Homo sapiens
tctttgtggccaa

SEQ ID NO: 1300755 - DNA, 12 bp, Homo sapiens
tcttttacaact

SEQ ID NO: 1300756 - DNA, 16 bp, Homo sapiens
tcttttgattatgttt

SEQ ID NO: 1300757 - DNA, 15 bp, Homo sapiens
tcttttgtaatttaa

SEQ ID NO: 1300758 - DNA, 20 bp, Homo sapiens
tcttttgttcgcatggtcac

SEQ ID NO: 1300759 - DNA, 21 bp, Homo sapiens
tgaaattaagaaggcaaaaat

SEQ ID NO: 1300760 - DNA, 21 bp, Homo sapiens
tgaacctaggagtgccccatt

SEQ ID NO: 1300761 - DNA, 14 bp, Homo sapiens
tgaagaacatgtga

SEQ ID NO: 1300762 - DNA, 19 bp, Homo sapiens
tgaagaaccagtcccccca

SEQ ID NO: 1300763 - DNA, 14 bp, Homo sapiens
tgaagctactgtgt

SEQ ID NO: 1300764 - DNA, 16 bp, Homo sapiens
tgaaggcaaaattgca

SEQ ID NO: 1300765 - DNA, 17 bp, Homo sapiens
tgaaggcaaaattgcaa

SEQ ID NO: 1300766 - DNA, 10 bp, Homo sapiens
tgaaggggcg

SEQ ID NO: 1300767 - DNA, 14 bp, Homo sapiens
tgaataaaaacttt

SEQ ID NO: 1300768 - DNA, 16 bp, Homo sapiens
tgaataaataaatgta

SEQ ID NO: 1300769 - DNA, 16 bp, Homo sapiens
tgaatactttttacaa

SEQ ID NO: 1300770 - DNA, 16 bp, Homo sapiens
tgaatcagtataaaca

SEQ ID NO: 1300771 - DNA, 19 bp, Homo sapiens
tgaatcagtataaacaaag

SEQ ID NO: 1300772 - DNA, 19 bp, Homo sapiens
tgaatgtatttatttggga

SEQ ID NO: 1300773 - DNA, 15 bp, Homo sapiens
tgaattatctataca

SEQ ID NO: 1300774 - DNA, 19 bp, Homo sapiens
tgacacaagtggaccttag

SEQ ID NO: 1300775 - DNA, 18 bp, Homo sapiens
tgacagagcaagactctg

SEQ ID NO: 1300776 - DNA, 22 bp, Homo sapiens
tgacagctgctcctagagggag

SEQ ID NO: 1300777 - DNA, 17 bp, Homo sapiens
tgacagctttgctgctg

SEQ ID NO: 1300778 - DNA, 18 bp, Homo sapiens
tgacagctttgctgctga

SEQ ID NO: 1300779 - DNA, 18 bp, Homo sapiens
tgacatgattccttcctg

SEQ ID NO: 1300780 - DNA, 18 bp, Homo sapiens
tgacattcacctgcccca

SEQ ID NO: 1300781 - DNA, 19 bp, Homo sapiens
tgacattgcgtttgacctt

SEQ ID NO: 1300782 - DNA, 13 bp, Homo sapiens
tgacatttctttg

SEQ ID NO: 1300783 - DNA, 14 bp, Homo sapiens
tgaccacagcacag

SEQ ID NO: 1300784 - DNA, 22 bp, Homo sapiens
tgaccacgctttctagctgttg

SEQ ID NO: 1300785 - DNA, 19 bp, Homo sapiens
tgacccagccccttgagaa

SEQ ID NO: 1300786 - DNA, 18 bp, Homo sapiens
tgacccagtgcccccact

SEQ ID NO: 1300787 - DNA, 17 bp, Homo sapiens
tgaccctgtatatagcc

SEQ ID NO: 1300788 - DNA, 13 bp, Homo sapiens
tgacctccctcta

SEQ ID NO: 1300789 - DNA, 17 bp, Homo sapiens
tgaccttttatgtagta

SEQ ID NO: 1300790 - DNA, 19 bp, Homo sapiens
tgacggccagggagaagct

SEQ ID NO: 1300791 - DNA, 15 bp, Homo sapiens
tgagaaatatggaca

SEQ ID NO: 1300792 - DNA, 17 bp, Homo sapiens
tgagaaatatggacact

SEQ ID NO: 1300793 - DNA, 13 bp, Homo sapiens
tgagaatcccaaa

SEQ ID NO: 1300794 - DNA, 20 bp, Homo sapiens
tgagaatcccaaatttgatt

SEQ ID NO: 1300795 - DNA, 15 bp, Homo sapiens
tgagactcgagaact

SEQ ID NO: 1300796 - DNA, 13 bp, Homo sapiens
tgagatttcatct

SEQ ID NO: 1300797 - DNA, 14 bp, Homo sapiens
tgagatttcatctg

SEQ ID NO: 1300798 - DNA, 22 bp, Homo sapiens
tgagatttcatctgctctcctt

SEQ ID NO: 1300799 - DNA, 16 bp, Homo sapiens
tgagcaactcttgatt

SEQ ID NO: 1300800 - DNA, 22 bp, Homo sapiens
tgagcacaactttaagaggaca

SEQ ID NO: 1300801 - DNA, 11 bp, Homo sapiens
tgagctgtttt

SEQ ID NO: 1300802 - DNA, 15 bp, Homo sapiens
tgagcttctctgtga

SEQ ID NO: 1300803 - DNA, 16 bp, Homo sapiens
tgagcttctctgtgaa

SEQ ID NO: 1300804 - DNA, 23 bp, Homo sapiens
tgaggaagaacggggctcttctc

SEQ ID NO: 1300805 - DNA, 20 bp, Homo sapiens
tgaggagctggggatccctc

SEQ ID NO: 1300806 - DNA, 19 bp, Homo sapiens
tgaggccacactcagcaca

SEQ ID NO: 1300807 - DNA, 17 bp, Homo sapiens
tgccttggctcagacat

SEQ ID NO: 1300808 - DNA, 13 bp, Homo sapiens
tgcggatggccgg

SEQ ID NO: 1300809 - DNA, 23 bp, Homo sapiens
tgcgggtgaacaaagcagccacg

SEQ ID NO: 1300810 - DNA, 14 bp, Homo sapiens
tgctatagcctggg

SEQ ID NO: 1300811 - DNA, 12 bp, Homo sapiens
tgctcagcttct

SEQ ID NO: 1300812 - DNA, 16 bp, Homo sapiens
tgctccttgttcctag

SEQ ID NO: 1300813 - DNA, 13 bp, Homo sapiens
tgctctagtgcct

SEQ ID NO: 1300814 - DNA, 18 bp, Homo sapiens
tgctctccttcctggagc

SEQ ID NO: 1300815 - DNA, 23 bp, Homo sapiens
tgctctccttcctggagcccaga

SEQ ID NO: 1300816 - DNA, 14 bp, Homo sapiens
tgctgacagctgct

SEQ ID NO: 1300817 - DNA, 22 bp, Homo sapiens
tgctgacggccagggagaagct

SEQ ID NO: 1300818 - DNA, 14 bp, Homo sapiens
tgctgagagaaata

SEQ ID NO: 1300819 - DNA, 12 bp, Homo sapiens
tgctggcccagg

SEQ ID NO: 1300820 - DNA, 16 bp, Homo sapiens
tgctggcccagggccc

SEQ ID NO: 1300821 - DNA, 18 bp, Homo sapiens
tgctggcccagggcccag

SEQ ID NO: 1300822 - DNA, 21 bp, Homo sapiens
tgctgtacatctattttggat

SEQ ID NO: 1300823 - DNA, 19 bp, Homo sapiens
tgctgtcctcaggtggcca

SEQ ID NO: 1300824 - DNA, 18 bp, Homo sapiens
gcccggccagccatgtct

SEQ ID NO: 1300825 - DNA, 18 bp, Homo sapiens
gcccggctaatttttgta

SEQ ID NO: 1300826 - DNA, 21 bp, Homo sapiens
gccctccctgttccccagaga

SEQ ID NO: 1300827 - DNA, 12 bp, Homo sapiens
gccctcctctcc

SEQ ID NO: 1300828 - DNA, 14 bp, Homo sapiens
gccctcctctccca

SEQ ID NO: 1300829 - DNA, 14 bp, Homo sapiens
gccctctggagtgg

SEQ ID NO: 1300830 - DNA, 18 bp, Homo sapiens
gccctgcggtagatggga

SEQ ID NO: 1300831 - DNA, 14 bp, Homo sapiens
gccctggaggtggc

SEQ ID NO: 1300832 - DNA, 15 bp, Homo sapiens
gccctggaggtggct

SEQ ID NO: 1300833 - DNA, 22 bp, Homo sapiens
gccgatatactctagatgaagt

SEQ ID NO: 1300834 - DNA, 12 bp, Homo sapiens
gccggccagccc

SEQ ID NO: 1300835 - DNA, 16 bp, Homo sapiens
gcctaggcctcagcca

SEQ ID NO: 1300836 - DNA, 17 bp, Homo sapiens
gcctcagccctgaccct

SEQ ID NO: 1300837 - DNA, 14 bp, Homo sapiens
gcctccagggctgg

SEQ ID NO: 1300838 - DNA, 21 bp, Homo sapiens
gcctccagggctggactgagg

SEQ ID NO: 1300839 - DNA, 23 bp, Homo sapiens
gcctccagggctggactgaggcc

SEQ ID NO: 1300840 - DNA, 24 bp, Homo sapiens
gcctccagggctggactgaggcct

SEQ ID NO: 1300841 - DNA, 21 bp, Homo sapiens
gcctcccctctccttcctgtg

SEQ ID NO: 1300842 - DNA, 18 bp, Homo sapiens
gcctccctgaagcctttg

SEQ ID NO: 1300843 - DNA, 20 bp, Homo sapiens
gcctctgtccccttctctca

SEQ ID NO: 1300844 - DNA, 22 bp, Homo sapiens
gcctgaaggggcgtctgttccc

SEQ ID NO: 1300845 - DNA, 18 bp, Homo sapiens
gcctgagatttcatctgc

SEQ ID NO: 1300846 - DNA, 22 bp, Homo sapiens
gcctgagatttcatctgctctc

SEQ ID NO: 1300847 - DNA, 22 bp, Homo sapiens
gcctgagcgctcctgccgcaga

SEQ ID NO: 1300848 - DNA, 23 bp, Homo sapiens
gcctgagcgctcctgccgcagag

SEQ ID NO: 1300849 - DNA, 20 bp, Homo sapiens
gcctgatcagaccacggctc

SEQ ID NO: 1300850 - DNA, 11 bp, Homo sapiens
gcctgcctcca

SEQ ID NO: 1300851 - DNA, 16 bp, Homo sapiens
gcctgcctccagggct

SEQ ID NO: 1300852 - DNA, 12 bp, Homo sapiens
gcctgctccaga

SEQ ID NO: 1300853 - DNA, 16 bp, Homo sapiens
gcctggccagacacag

SEQ ID NO: 1300854 - DNA, 21 bp, Homo sapiens
gcctggccagacacaggccct

SEQ ID NO: 1300855 - DNA, 14 bp, Homo sapiens
gcctggggtctgga

SEQ ID NO: 1300856 - DNA, 22 bp, Homo sapiens
gcctggggtggggtcatgccct

SEQ ID NO: 1300857 - DNA, 20 bp, Homo sapiens
gcctgggtgacagagcaaga

SEQ ID NO: 1300858 - DNA, 22 bp, Homo sapiens
gcctgtcctccaacaccaagca

SEQ ID NO: 1300859 - DNA, 13 bp, Homo sapiens
gccttcctctctc

SEQ ID NO: 1300860 - DNA, 16 bp, Homo sapiens
gccttcctctctccag

SEQ ID NO: 1300861 - DNA, 15 bp, Homo sapiens
gccttcttttgatta

SEQ ID NO: 1300862 - DNA, 15 bp, Homo sapiens
gccttggctcagaca

SEQ ID NO: 1300863 - DNA, 18 bp, Homo sapiens
gcctttcccaactctagc

SEQ ID NO: 1300864 - DNA, 13 bp, Homo sapiens
gcgactaatttca

SEQ ID NO: 1300865 - DNA, 23 bp, Homo sapiens
gcgactaatttcaaaatgctttt

SEQ ID NO: 1300866 - DNA, 17 bp, Homo sapiens
gcgattctcctgcctca

SEQ ID NO: 1300867 - DNA, 14 bp, Homo sapiens
gcgcctttcccaac

SEQ ID NO: 1300868 - DNA, 16 bp, Homo sapiens
gcgcctttcccaactc

SEQ ID NO: 1300869 - DNA, 19 bp, Homo sapiens
gcgctcctgccgcagagct

SEQ ID NO: 1300870 - DNA, 18 bp, Homo sapiens
gcggtgctgtcctcaggt

SEQ ID NO: 1300871 - DNA, 17 bp, Homo sapiens
gcgtctgttcccccttc

SEQ ID NO: 1300872 - DNA, 12 bp, Homo sapiens
gctaatttgcat

SEQ ID NO: 1300873 - DNA, 15 bp, Homo sapiens
gctaatttttgtaat

SEQ ID NO: 1300874 - DNA, 20 bp, Homo sapiens
gctacaaatactcttaggaa

SEQ ID NO: 1300875 - DNA, 19 bp, Homo sapiens
gctactgtgtgtgtgaatg

SEQ ID NO: 1300876 - DNA, 18 bp, Homo sapiens
gctagtcaagctcctcct

SEQ ID NO: 1300877 - DNA, 21 bp, Homo sapiens
gctagtcaagctcctcctccc

SEQ ID NO: 1300878 - DNA, 18 bp, Homo sapiens
gctataaattcctctttg

SEQ ID NO: 1300879 - DNA, 20 bp, Homo sapiens
gctcagaggcgcactgtgac

SEQ ID NO: 1300880 - DNA, 14 bp, Homo sapiens
gctcagccagcact

SEQ ID NO: 1300881 - DNA, 15 bp, Homo sapiens
gctcagccagcactt

SEQ ID NO: 1300882 - DNA, 17 bp, Homo sapiens
gctcaggacagatgcca

SEQ ID NO: 1300883 - DNA, 20 bp, Homo sapiens
gctcaggacagatgccacac

SEQ ID NO: 1300884 - DNA, 20 bp, Homo sapiens
gctccaaggggaatcagaac

SEQ ID NO: 1300885 - DNA, 23 bp, Homo sapiens
gctccaaggggaatcagaactca

SEQ ID NO: 1300886 - DNA, 15 bp, Homo sapiens
ctgcctcgaaacaca

SEQ ID NO: 1300887 - DNA, 16 bp, Homo sapiens
ctgcctgccagctgca

SEQ ID NO: 1300888 - DNA, 21 bp, Homo sapiens
ctgcctgccagctgcactgat

SEQ ID NO: 1300889 - DNA, 22 bp, Homo sapiens
ctgcgggtgaacaaagcagcca

SEQ ID NO: 1300890 - DNA, 22 bp, Homo sapiens
ctgcggtagatgggagggaggc

SEQ ID NO: 1300891 - DNA, 15 bp, Homo sapiens
ctgctatagcctggg

SEQ ID NO: 1300892 - DNA, 13 bp, Homo sapiens
ctgctcagctctg

SEQ ID NO: 1300893 - DNA, 16 bp, Homo sapiens
ctgctcagctctgggc

SEQ ID NO: 1300894 - DNA, 15 bp, Homo sapiens
ctgctcagcttctcc

SEQ ID NO: 1300895 - DNA, 16 bp, Homo sapiens
ctgctcagcttctcct

SEQ ID NO: 1300896 - DNA, 22 bp, Homo sapiens
ctgctccagacctgatcctgga

SEQ ID NO: 1300897 - DNA, 17 bp, Homo sapiens
ctgctctccttcctgga

SEQ ID NO: 1300898 - DNA, 19 bp, Homo sapiens
ctgctctccttcctggagc

SEQ ID NO: 1300899 - DNA, 22 bp, Homo sapiens
ctgctggacagtatcactgtct

SEQ ID NO: 1300900 - DNA, 17 bp, Homo sapiens
ctgcttgacaacatctg

SEQ ID NO: 1300901 - DNA, 17 bp, Homo sapiens
ctggaacctcagcctgg

SEQ ID NO: 1300902 - DNA, 22 bp, Homo sapiens
ctggaagctaatttgcattaaa

SEQ ID NO: 1300903 - DNA, 19 bp, Homo sapiens
ctggaatctggagaccagg

SEQ ID NO: 1300904 - DNA, 14 bp, Homo sapiens
ctggacagccccac

SEQ ID NO: 1300905 - DNA, 16 bp, Homo sapiens
ctggactgaggcctga

SEQ ID NO: 1300906 - DNA, 18 bp, Homo sapiens
ctggactgaggcctgagc

SEQ ID NO: 1300907 - DNA, 16 bp, Homo sapiens
ctggagcccagaggag

SEQ ID NO: 1300908 - DNA, 23 bp, Homo sapiens
ctggagcccagaggagggcagca

SEQ ID NO: 1300909 - DNA, 12 bp, Homo sapiens
ctggaggcccag

SEQ ID NO: 1300910 - DNA, 13 bp, Homo sapiens
ctggaggcccagt

SEQ ID NO: 1300911 - DNA, 14 bp, Homo sapiens
ctggaggcccagtt

SEQ ID NO: 1300912 - DNA, 13 bp, Homo sapiens
ctggagtggccac

SEQ ID NO: 1300913 - DNA, 16 bp, Homo sapiens
ctggagttgatctgga

SEQ ID NO: 1300914 - DNA, 22 bp, Homo sapiens
ctggagtttcatgtacaagatg

SEQ ID NO: 1300915 - DNA, 20 bp, Homo sapiens
ctggcaaaaggatctttgtg

SEQ ID NO: 1300916 - DNA, 19 bp, Homo sapiens
ctggcaaagcttttagaaa

SEQ ID NO: 1300917 - DNA, 12 bp, Homo sapiens
ctggcagctctg

SEQ ID NO: 1300918 - DNA, 13 bp, Homo sapiens
ctggccagacaca

SEQ ID NO: 1300919 - DNA, 15 bp, Homo sapiens
ctggccagacacagg

SEQ ID NO: 1300920 - DNA, 11 bp, Homo sapiens
ctggcccaggg

SEQ ID NO: 1300921 - DNA, 21 bp, Homo sapiens
ctggcccagggcccagagccc

SEQ ID NO: 1300922 - DNA, 13 bp, Homo sapiens
ctggccccaggac

SEQ ID NO: 1300923 - DNA, 20 bp, Homo sapiens
ctggccgagtccaagctggg

SEQ ID NO: 1300924 - DNA, 18 bp, Homo sapiens
ctggccgcgccaaataat

SEQ ID NO: 1300925 - DNA, 12 bp, Homo sapiens
ctggctgggacg

SEQ ID NO: 1300926 - DNA, 16 bp, Homo sapiens
ctggctgggacgtggc

SEQ ID NO: 1300927 - DNA, 16 bp, Homo sapiens
ctgggacgtggctcag

SEQ ID NO: 1300928 - DNA, 20 bp, Homo sapiens
ctgggacgtggctcagccag

SEQ ID NO: 1300929 - DNA, 23 bp, Homo sapiens
ctgggacgtggctcagccagcac

SEQ ID NO: 1300930 - DNA, 18 bp, Homo sapiens
ctgggccacttctgggtg

SEQ ID NO: 1300931 - DNA, 19 bp, Homo sapiens
ctgggccattctccacagc

SEQ ID NO: 1300932 - DNA, 20 bp, Homo sapiens
ctgggccattctccacagca

SEQ ID NO: 1300933 - DNA, 18 bp, Homo sapiens
ctggggctagggggagcc

SEQ ID NO: 1300934 - DNA, 14 bp, Homo sapiens
ctggggctggcctc

SEQ ID NO: 1300935 - DNA, 15 bp, Homo sapiens
ctggggctggcctcc

SEQ ID NO: 1300936 - DNA, 18 bp, Homo sapiens
ctggggctggcctcccaa

SEQ ID NO: 1300937 - DNA, 16 bp, Homo sapiens
ctggggggcagtggtg

SEQ ID NO: 1300938 - DNA, 15 bp, Homo sapiens
ctgggggtgggccag

SEQ ID NO: 1300939 - DNA, 17 bp, Homo sapiens
ctgggggtgggccaggc

SEQ ID NO: 1300940 - DNA, 13 bp, Homo sapiens
ctggggtctggag

SEQ ID NO: 1300941 - DNA, 22 bp, Homo sapiens
ctggggtctggagttgatctgg

SEQ ID NO: 1300942 - DNA, 20 bp, Homo sapiens
ctggggtggggtcatgccct

SEQ ID NO: 1300943 - DNA, 15 bp, Homo sapiens
ctggtaatcttgctc

SEQ ID NO: 1300944 - DNA, 16 bp, Homo sapiens
ctggtcctacccatcc

SEQ ID NO: 1300945 - DNA, 12 bp, Homo sapiens
ctggtgctgctg

SEQ ID NO: 1300946 - DNA, 15 bp, Homo sapiens
ctggtggttgctgtt

SEQ ID NO: 1300947 - DNA, 20 bp, Homo sapiens
ctggtggttgctgttttcct

SEQ ID NO: 1300948 - DNA, 23 bp, Homo sapiens
ctggttcggatttggggtggatt

SEQ ID NO: 1300949 - DNA, 15 bp, Homo sapiens
ctggttctcatcttt

SEQ ID NO: 1300950 - DNA, 20 bp, Homo sapiens
ctggttctcatctttcttga

SEQ ID NO: 1300951 - DNA, 20 bp, Homo sapiens
ctgtaataaagatgattgtg

SEQ ID NO: 1300952 - DNA, 20 bp, Homo sapiens
ctgtaatcccagcactttgg

SEQ ID NO: 1300953 - DNA, 20 bp, Homo sapiens
ctgtaatcgccctactattc

SEQ ID NO: 1300954 - DNA, 22 bp, Homo sapiens
ctgtataagtggaggcacttta

SEQ ID NO: 1300955 - DNA, 14 bp, Homo sapiens
ctgtcactcattgc

SEQ ID NO: 1300956 - DNA, 15 bp, Homo sapiens
ctgtcagtcacagcc

SEQ ID NO: 1300957 - DNA, 17 bp, Homo sapiens
ctgtccagctccaacct

SEQ ID NO: 1300958 - DNA, 21 bp, Homo sapiens
ctgtccagctccaacctgcaa

SEQ ID NO: 1300959 - DNA, 20 bp, Homo sapiens
ctgtccccttctctcatctc

SEQ ID NO: 1300960 - DNA, 23 bp, Homo sapiens
ctgtccccttctctcatctctta

SEQ ID NO: 1300961 - DNA, 18 bp, Homo sapiens
ctgtcctcagccttgcca

SEQ ID NO: 1300962 - DNA, 16 bp, Homo sapiens
ctgtcctcaggtggcc

SEQ ID NO: 1300963 - DNA, 15 bp, Homo sapiens
ctgtcctccaacacc

SEQ ID NO: 1300964 - DNA, 18 bp, Homo sapiens
ctgtctagagagggaggc

SEQ ID NO: 1300965 - DNA, 13 bp, Homo sapiens
ctgtctcctagga

SEQ ID NO: 1300966 - DNA, 22 bp, Homo sapiens
ctgtcttcatagcagattttaa

SEQ ID NO: 1300967 - DNA, 13 bp, Homo sapiens
ctgtctttcctag

SEQ ID NO: 1300968 - DNA, 14 bp, Homo sapiens
ctgtctttcctaga

SEQ ID NO: 1300969 - DNA, 14 bp, Homo sapiens
ctgtgaaggaccct

SEQ ID NO: 1300970 - DNA, 13 bp, Homo sapiens
ctgtgacccccag

SEQ ID NO: 1300971 - DNA, 18 bp, Homo sapiens
ctgtgagactcgagaact

SEQ ID NO: 1300972 - DNA, 17 bp, Homo sapiens
ctgtgagcccagctggg

SEQ ID NO: 1300973 - DNA, 22 bp, Homo sapiens
ctgtgcacaaaacccagacctg

SEQ ID NO: 1300974 - DNA, 22 bp, Homo sapiens
ctgtggccagcttgttatttat

SEQ ID NO: 1300975 - DNA, 13 bp, Homo sapiens
ctgtgtctgtgtt

SEQ ID NO: 1300976 - DNA, 22 bp, Homo sapiens
ctgtgtgattgacagctttgct

SEQ ID NO: 1300977 - DNA, 18 bp, Homo sapiens
ctgtgtgtgtgaatgaac

SEQ ID NO: 1300978 - DNA, 19 bp, Homo sapiens
ctgtgtgttgccacaggac

SEQ ID NO: 1300979 - DNA, 20 bp, Homo sapiens
ctgtgtgttgccacaggaca

SEQ ID NO: 1300980 - DNA, 16 bp, Homo sapiens
ctgttccccagagaaa

SEQ ID NO: 1300981 - DNA, 16 bp, Homo sapiens
ctgttcccccttcaca

SEQ ID NO: 1300982 - DNA, 15 bp, Homo sapiens
ctgttctcttgggaa

SEQ ID NO: 1300983 - DNA, 21 bp, Homo sapiens
ctgttgacacaggtctttcct

SEQ ID NO: 1300984 - DNA, 15 bp, Homo sapiens
ctgttttcctccctt

SEQ ID NO: 1300985 - DNA, 20 bp, Homo sapiens
ctgttttgtggtcagctgta

SEQ ID NO: 1300986 - DNA, 17 bp, Homo sapiens
ctgtttttaagctgttt

SEQ ID NO: 1300987 - DNA, 18 bp, Homo sapiens
ctgtttttaagctgtttc

SEQ ID NO: 1300988 - DNA, 18 bp, Homo sapiens
cttaatactaccttgaaa

SEQ ID NO: 1300989 - DNA, 17 bp, Homo sapiens
cttagaatccaaacttg

SEQ ID NO: 1300990 - DNA, 17 bp, Homo sapiens
cttagctcccctccaac

SEQ ID NO: 1300991 - DNA, 15 bp, Homo sapiens
cttaggccttcctct

SEQ ID NO: 1300992 - DNA, 16 bp, Homo sapiens
cttatagaatatttat

SEQ ID NO: 1300993 - DNA, 17 bp, Homo sapiens
cttatggaattgatttg

SEQ ID NO: 1300994 - DNA, 21 bp, Homo sapiens
cttatggaattgatttgcatt

SEQ ID NO: 1300995 - DNA, 14 bp, Homo sapiens
cttattgtacctct

SEQ ID NO: 1300996 - DNA, 15 bp, Homo sapiens
cttcacaaagcccaa

SEQ ID NO: 1300997 - DNA, 19 bp, Homo sapiens
cttcagccctcacccctgg

SEQ ID NO: 1300998 - DNA, 19 bp, Homo sapiens
cttccaggtgttactgtaa

SEQ ID NO: 1300999 - DNA, 22 bp, Homo sapiens
cttccaggtgttactgtaattc

SEQ ID NO: 1301000 - DNA, 18 bp, Homo sapiens
cttccccatcttctaaac

SEQ ID NO: 1301001 - DNA, 16 bp, Homo sapiens
cttcctggagcccaga

SEQ ID NO: 1301002 - DNA, 18 bp, Homo sapiens
gcaggggtggctgcctca

SEQ ID NO: 1301003 - DNA, 16 bp, Homo sapiens
gcaggttcccaagctc

SEQ ID NO: 1301004 - DNA, 20 bp, Homo sapiens
gcagtgtgcactaaggggcc

SEQ ID NO: 1301005 - DNA, 20 bp, Homo sapiens
gcatatgttgaatacttttt

SEQ ID NO: 1301006 - DNA, 14 bp, Homo sapiens
gcatctgaccagca

SEQ ID NO: 1301007 - DNA, 20 bp, Homo sapiens
gcatctgaccagcagcgcct

SEQ ID NO: 1301008 - DNA, 23 bp, Homo sapiens
gcatgatagacacatatgagggg

SEQ ID NO: 1301009 - DNA, 16 bp, Homo sapiens
gcatgctgctggacag

SEQ ID NO: 1301010 - DNA, 16 bp, Homo sapiens
gcatggtgccccagga

SEQ ID NO: 1301011 - DNA, 22 bp, Homo sapiens
gcattgaacacaaactgtaaat

SEQ ID NO: 1301012 - DNA, 16 bp, Homo sapiens
gcatttggattggggt

SEQ ID NO: 1301013 - DNA, 23 bp, Homo sapiens
gcatttggattggggtccctcta

SEQ ID NO: 1301014 - DNA, 22 bp, Homo sapiens
gccaaatggtttaacttctgcc

SEQ ID NO: 1301015 - DNA, 17 bp, Homo sapiens
gccaacacgcacctgcc

SEQ ID NO: 1301016 - DNA, 17 bp, Homo sapiens
gccaacagaagcttcca

SEQ ID NO: 1301017 - DNA, 19 bp, Homo sapiens
gccaacagaagcttccatt

SEQ ID NO: 1301018 - DNA, 13 bp, Homo sapiens
gccaacccttctc

SEQ ID NO: 1301019 - DNA, 15 bp, Homo sapiens
gccaagaaacgtctt

SEQ ID NO: 1301020 - DNA, 22 bp, Homo sapiens
gccaagaaacgtcttctaaact

SEQ ID NO: 1301021 - DNA, 14 bp, Homo sapiens
gccaaggagctgct

SEQ ID NO: 1301022 - DNA, 18 bp, Homo sapiens
gccaattcagacaggcaa

SEQ ID NO: 1301023 - DNA, 17 bp, Homo sapiens
gccacaaggacttcctg

SEQ ID NO: 1301024 - DNA, 13 bp, Homo sapiens
gccacactcagca

SEQ ID NO: 1301025 - DNA, 12 bp, Homo sapiens
gccacaggacac

SEQ ID NO: 1301026 - DNA, 12 bp, Homo sapiens
gccacaggcctg

SEQ ID NO: 1301027 - DNA, 23 bp, Homo sapiens
gccacaggcctgagatttcatct

SEQ ID NO: 1301028 - DNA, 14 bp, Homo sapiens
gccacatttggaat

SEQ ID NO: 1301029 - DNA, 22 bp, Homo sapiens
gccacatttggaatactttttg

SEQ ID NO: 1301030 - DNA, 16 bp, Homo sapiens
gccacccacctccctg

SEQ ID NO: 1301031 - DNA, 21 bp, Homo sapiens
gccacgtgggcaaacaggcag

SEQ ID NO: 1301032 - DNA, 14 bp, Homo sapiens
gccactaagcagag

SEQ ID NO: 1301033 - DNA, 23 bp, Homo sapiens
gccagagatccaaaagaagcccc

SEQ ID NO: 1301034 - DNA, 14 bp, Homo sapiens
gccagagccagggg

SEQ ID NO: 1301035 - DNA, 15 bp, Homo sapiens
gccagatccagcctg

SEQ ID NO: 1301036 - DNA, 20 bp, Homo sapiens
gccagatccagcctggggtc

SEQ ID NO: 1301037 - DNA, 13 bp, Homo sapiens
gccagcacacagg

SEQ ID NO: 1301038 - DNA, 19 bp, Homo sapiens
gccagcacttgtccagctg

SEQ ID NO: 1301039 - DNA, 19 bp, Homo sapiens
gccagcccctggccccagg

SEQ ID NO: 1301040 - DNA, 18 bp, Homo sapiens
gccagcttgttatttata

SEQ ID NO: 1301041 - DNA, 17 bp, Homo sapiens
gccaggaatttcccagg

SEQ ID NO: 1301042 - DNA, 19 bp, Homo sapiens
gccaggaatttcccaggac

SEQ ID NO: 1301043 - DNA, 20 bp, Homo sapiens
gccaggaatttcccaggacc

SEQ ID NO: 1301044 - DNA, 22 bp, Homo sapiens
gccaggaatttcccaggaccct

SEQ ID NO: 1301045 - DNA, 20 bp, Homo sapiens
gccaggatggaacacggcca

SEQ ID NO: 1301046 - DNA, 17 bp, Homo sapiens
gccaggctgaccacagc

SEQ ID NO: 1301047 - DNA, 22 bp, Homo sapiens
gccaggctgaccacagcacagc

SEQ ID NO: 1301048 - DNA, 16 bp, Homo sapiens
gccagggagaagctcc

SEQ ID NO: 1301049 - DNA, 21 bp, Homo sapiens
gccaggggggtgaggagctgg

SEQ ID NO: 1301050 - DNA, 15 bp, Homo sapiens
gccatcaaaatgctt

SEQ ID NO: 1301051 - DNA, 16 bp, Homo sapiens
gccatcaaaatgcttt

SEQ ID NO: 1301052 - DNA, 13 bp, Homo sapiens
gccatgcctcagc

SEQ ID NO: 1301053 - DNA, 19 bp, Homo sapiens
gcccaagggatctggtcct

SEQ ID NO: 1301054 - DNA, 12 bp, Homo sapiens
gcccaatattat

SEQ ID NO: 1301055 - DNA, 23 bp, Homo sapiens
gcccagagacatacttgaagggc

SEQ ID NO: 1301056 - DNA, 23 bp, Homo sapiens
gcccagaggagggcagcagaagg

SEQ ID NO: 1301057 - DNA, 14 bp, Homo sapiens
gcccagccaggccc

SEQ ID NO: 1301058 - DNA, 15 bp, Homo sapiens
gcccagccaggcccc

SEQ ID NO: 1301059 - DNA, 16 bp, Homo sapiens
gcccagccaggcccca

SEQ ID NO: 1301060 - DNA, 16 bp, Homo sapiens
gcccagccctccccat

SEQ ID NO: 1301061 - DNA, 12 bp, Homo sapiens
gcccagctccaa

SEQ ID NO: 1301062 - DNA, 19 bp, Homo sapiens
gcccagctgggtcaggcag

SEQ ID NO: 1301063 - DNA, 20 bp, Homo sapiens
gcccagctgggtcaggcagg

SEQ ID NO: 1301064 - DNA, 20 bp, Homo sapiens
gcccaggctggagtgcagtg

SEQ ID NO: 1301065 - DNA, 14 bp, Homo sapiens
gcccagggcccaga

SEQ ID NO: 1301066 - DNA, 15 bp, Homo sapiens
gcccagggcccagag

SEQ ID NO: 1301067 - DNA, 16 bp, Homo sapiens
gcccagggcccagagc

SEQ ID NO: 1301068 - DNA, 23 bp, Homo sapiens
gcccagggcccagagcccagctc

SEQ ID NO: 1301069 - DNA, 19 bp, Homo sapiens
gcccagttcaccctgattt

SEQ ID NO: 1301070 - DNA, 18 bp, Homo sapiens
gcccatccccaggcacct

SEQ ID NO: 1301071 - DNA, 23 bp, Homo sapiens
gcccatggacaggctggctccag

SEQ ID NO: 1301072 - DNA, 21 bp, Homo sapiens
gccccaactctcccctgacct

SEQ ID NO: 1301073 - DNA, 21 bp, Homo sapiens
gccccagcctccctgaagcct

SEQ ID NO: 1301074 - DNA, 14 bp, Homo sapiens
gccccaggaccagc

SEQ ID NO: 1301075 - DNA, 15 bp, Homo sapiens
gccccaggaccagct

SEQ ID NO: 1301076 - DNA, 18 bp, Homo sapiens
gccccaggaccagctcag

SEQ ID NO: 1301077 - DNA, 21 bp, Homo sapiens
gccccaggacctggctgccat

SEQ ID NO: 1301078 - DNA, 14 bp, Homo sapiens
gccccatcctccag

SEQ ID NO: 1301079 - DNA, 16 bp, Homo sapiens
gccccatcctccagca

SEQ ID NO: 1301080 - DNA, 20 bp, Homo sapiens
gccccattcttttgtaattt

SEQ ID NO: 1301081 - DNA, 17 bp, Homo sapiens
gcccccaccgtgggcag

SEQ ID NO: 1301082 - DNA, 17 bp, Homo sapiens
gcccccactgaccagaa

SEQ ID NO: 1301083 - DNA, 16 bp, Homo sapiens
gcccccaggactgggc

SEQ ID NO: 1301084 - DNA, 18 bp, Homo sapiens
gcccccaggactgggcca

SEQ ID NO: 1301085 - DNA, 13 bp, Homo sapiens
gccccctggcctc

SEQ ID NO: 1301086 - DNA, 15 bp, Homo sapiens
gccccctggcctctg

SEQ ID NO: 1301087 - DNA, 13 bp, Homo sapiens
gccccgtgaggca

SEQ ID NO: 1301088 - DNA, 23 bp, Homo sapiens
gcccctggctgggacgtggctca

SEQ ID NO: 1301089 - DNA, 23 bp, Homo sapiens
gccccttctgctcagctctgggc

SEQ ID NO: 1301090 - DNA, 21 bp, Homo sapiens
gccctcacccctggttctcat

SEQ ID NO: 1301091 - DNA, 18 bp, Homo sapiens
gccctccccatggagcca

SEQ ID NO: 1301092 - DNA, 19 bp, Homo sapiens
gccctccccatggagccag

SEQ ID NO: 1301093 - DNA, 18 bp, Homo sapiens
gccctccctgttccccag

SEQ ID NO: 1301094 - DNA, 20 bp, Homo sapiens
gccctccctgttccccagag

SEQ ID NO: 1301095 - DNA, 19 bp, Homo sapiens
gccctctggagtggccact

SEQ ID NO: 1301096 - DNA, 14 bp, Homo sapiens
gccctgaccctgtg

SEQ ID NO: 1301097 - DNA, 17 bp, Homo sapiens
gccctgaccctgtggaa

SEQ ID NO: 1301098 - DNA, 16 bp, Homo sapiens
gccctgttgacacagg

SEQ ID NO: 1301099 - DNA, 19 bp, Homo sapiens
gccctgttgacacaggtct

SEQ ID NO: 1301100 - DNA, 14 bp, Homo sapiens
gccgagtccaagct

SEQ ID NO: 1301101 - DNA, 12 bp, Homo sapiens
gccgctgccacc

SEQ ID NO: 1301102 - DNA, 17 bp, Homo sapiens
gccgctgccacccacct

SEQ ID NO: 1301103 - DNA, 14 bp, Homo sapiens
gccggccagcccct

SEQ ID NO: 1301104 - DNA, 17 bp, Homo sapiens
gccgtgctcgccccagc

SEQ ID NO: 1301105 - DNA, 22 bp, Homo sapiens
gcctaaaagtgggcttgattct

SEQ ID NO: 1301106 - DNA, 23 bp, Homo sapiens
gcctaaaagtgggcttgattctg

SEQ ID NO: 1301107 - DNA, 23 bp, Homo sapiens
gcctacagctttgatccctgaca

SEQ ID NO: 1301108 - DNA, 18 bp, Homo sapiens
gcctaggcctcagccaga

SEQ ID NO: 1301109 - DNA, 20 bp, Homo sapiens
gcctaggcctcagccagaga

SEQ ID NO: 1301110 - DNA, 22 bp, Homo sapiens
gcctcagccctgaccctgtgga

SEQ ID NO: 1301111 - DNA, 17 bp, Homo sapiens
gcctccagaactcactg

SEQ ID NO: 1301112 - DNA, 19 bp, Homo sapiens
gcctccagaactcactggg

SEQ ID NO: 1301113 - DNA, 12 bp, Homo sapiens
gcctccagggct

SEQ ID NO: 1301114 - DNA, 18 bp, Homo sapiens
gcctccagggctggactg

SEQ ID NO: 1301115 - DNA, 15 bp, Homo sapiens
gcctcccaaatgagc

SEQ ID NO: 1301116 - DNA, 22 bp, Homo sapiens
gcctcccatccagggcccccat

SEQ ID NO: 1301117 - DNA, 13 bp, Homo sapiens
gcctccctgaagc

SEQ ID NO: 1301118 - DNA, 19 bp, Homo sapiens
ttcccaggaccctgaaggg

SEQ ID NO: 1301119 - DNA, 12 bp, Homo sapiens
ttccccagagaa

SEQ ID NO: 1301120 - DNA, 15 bp, Homo sapiens
ttccctttgtgcaca

SEQ ID NO: 1301121 - DNA, 14 bp, Homo sapiens
ttcctcccttctgc

SEQ ID NO: 1301122 - DNA, 15 bp, Homo sapiens
ttcctctctccagat

SEQ ID NO: 1301123 - DNA, 12 bp, Homo sapiens
ttcctctgggaa

SEQ ID NO: 1301124 - DNA, 15 bp, Homo sapiens
ttcctctttgctttg

SEQ ID NO: 1301125 - DNA, 18 bp, Homo sapiens
ttcctgaaacaacttgga

SEQ ID NO: 1301126 - DNA, 15 bp, Homo sapiens
ttcctgaagaaccag

SEQ ID NO: 1301127 - DNA, 15 bp, Homo sapiens
ttcctgtccagctcc

SEQ ID NO: 1301128 - DNA, 22 bp, Homo sapiens
ttcctgtgtgtccaaaactgcc

SEQ ID NO: 1301129 - DNA, 15 bp, Homo sapiens
ttccttcctgttctg

SEQ ID NO: 1301130 - DNA, 22 bp, Homo sapiens
ttccttgagacacggagcccag

SEQ ID NO: 1301131 - DNA, 14 bp, Homo sapiens
ttcgcatggtcaca

SEQ ID NO: 1301132 - DNA, 19 bp, Homo sapiens
ttcgcatggtcacacactg

SEQ ID NO: 1301133 - DNA, 12 bp, Homo sapiens
ttcgggctgtgc

SEQ ID NO: 1301134 - DNA, 13 bp, Homo sapiens
ttcgggctgtgcc

SEQ ID NO: 1301135 - DNA, 21 bp, Homo sapiens
ttcgggtgtgcaatgtctgag

SEQ ID NO: 1301136 - DNA, 18 bp, Homo sapiens
ttctaaacccaatccaaa

SEQ ID NO: 1301137 - DNA, 20 bp, Homo sapiens
ttctaaaggtgttgtccctt

SEQ ID NO: 1301138 - DNA, 12 bp, Homo sapiens
ttctaatagaac

SEQ ID NO: 1301139 - DNA, 15 bp, Homo sapiens
ttctacaatgtgaac

SEQ ID NO: 1301140 - DNA, 19 bp, Homo sapiens
ttctacaatgtgaacttta

SEQ ID NO: 1301141 - DNA, 20 bp, Homo sapiens
ttctagctgttgagctgttt

SEQ ID NO: 1301142 - DNA, 13 bp, Homo sapiens
ttctataaggcca

SEQ ID NO: 1301143 - DNA, 14 bp, Homo sapiens
ttctataaggccat

SEQ ID NO: 1301144 - DNA, 19 bp, Homo sapiens
ttctatttatatgtacatg

SEQ ID NO: 1301145 - DNA, 18 bp, Homo sapiens
ttctcatctttcttgatc

SEQ ID NO: 1301146 - DNA, 15 bp, Homo sapiens
ttctcatttcacccc

SEQ ID NO: 1301147 - DNA, 15 bp, Homo sapiens
ttctcccctgccccc

SEQ ID NO: 1301148 - DNA, 21 bp, Homo sapiens
ttctcccctgcccccaggact

SEQ ID NO: 1301149 - DNA, 17 bp, Homo sapiens
ttctcctcttgtaaata

SEQ ID NO: 1301150 - DNA, 12 bp, Homo sapiens
ttctctcatctc

SEQ ID NO: 1301151 - DNA, 19 bp, Homo sapiens
ttctgcaaaaatatttata

SEQ ID NO: 1301152 - DNA, 18 bp, Homo sapiens
ttctgcagtaaatctttt

SEQ ID NO: 1301153 - DNA, 17 bp, Homo sapiens
ttctgcatatgttgaat

SEQ ID NO: 1301154 - DNA, 21 bp, Homo sapiens
ttctgcatatgttgaatactt

SEQ ID NO: 1301155 - DNA, 19 bp, Homo sapiens
ttctgcctgccagctgcac

SEQ ID NO: 1301156 - DNA, 10 bp, Homo sapiens
ttctggctca

SEQ ID NO: 1301157 - DNA, 15 bp, Homo sapiens
ttctgtatatacttt

SEQ ID NO: 1301158 - DNA, 22 bp, Homo sapiens
ttcttatggaattgatttgcat

SEQ ID NO: 1301159 - DNA, 15 bp, Homo sapiens
ttcttgaaagctgtg

SEQ ID NO: 1301160 - DNA, 21 bp, Homo sapiens
ttcttgatcaacatcttttct

SEQ ID NO: 1301161 - DNA, 18 bp, Homo sapiens
ttcttgcctctgtcccct

SEQ ID NO: 1301162 - DNA, 20 bp, Homo sapiens
ttcttgcctctgtccccttc

SEQ ID NO: 1301163 - DNA, 20 bp, Homo sapiens
ttgaacacaaactgtaaata

SEQ ID NO: 1301164 - DNA, 15 bp, Homo sapiens
ttgaaggcaaaattg

SEQ ID NO: 1301165 - DNA, 17 bp, Homo sapiens
ttgaaggcaaaattgca

SEQ ID NO: 1301166 - DNA, 15 bp, Homo sapiens
ttgaagggccagagc

SEQ ID NO: 1301167 - DNA, 19 bp, Homo sapiens
ttgaagggccagagccagg

SEQ ID NO: 1301168 - DNA, 23 bp, Homo sapiens
ttgaaggtgctgacggccaggga

SEQ ID NO: 1301169 - DNA, 12 bp, Homo sapiens
ttgaatactttt

SEQ ID NO: 1301170 - DNA, 21 bp, Homo sapiens
ttgaatgtggcttgagaaata

SEQ ID NO: 1301171 - DNA, 20 bp, Homo sapiens
ttgaattgaggggattaata

SEQ ID NO: 1301172 - DNA, 12 bp, Homo sapiens
ttgacaacatct

SEQ ID NO: 1301173 - DNA, 17 bp, Homo sapiens
ttgacacaagtggacct

SEQ ID NO: 1301174 - DNA, 16 bp, Homo sapiens
ttgacacagaaaatgt

SEQ ID NO: 1301175 - DNA, 13 bp, Homo sapiens
ttgacacaggtct

SEQ ID NO: 1301176 - DNA, 18 bp, Homo sapiens
ttgacagctttgctgctg

SEQ ID NO: 1301177 - DNA, 18 bp, Homo sapiens
ttgacattgcgtttgacc

SEQ ID NO: 1301178 - DNA, 23 bp, Homo sapiens
ttgagaaaccttattgtacctct

SEQ ID NO: 1301179 - DNA, 15 bp, Homo sapiens
ttgagaagaaaacat

SEQ ID NO: 1301180 - DNA, 23 bp, Homo sapiens
ttgagaatcccaaatttgattga

SEQ ID NO: 1301181 - DNA, 15 bp, Homo sapiens
ttgagctattgctgt

SEQ ID NO: 1301182 - DNA, 12 bp, Homo sapiens
ttgagctgtttt

SEQ ID NO: 1301183 - DNA, 18 bp, Homo sapiens
ttgatcaacatcttttct

SEQ ID NO: 1301184 - DNA, 19 bp, Homo sapiens
ttgatctggaacccagact

SEQ ID NO: 1301185 - DNA, 12 bp, Homo sapiens
ttgattctcctt

SEQ ID NO: 1301186 - DNA, 14 bp, Homo sapiens
ttgatttgaagaac

SEQ ID NO: 1301187 - DNA, 12 bp, Homo sapiens
ttgcaaatcttg

SEQ ID NO: 1301188 - DNA, 15 bp, Homo sapiens
ttgcaaatcttgaaa

SEQ ID NO: 1301189 - DNA, 16 bp, Homo sapiens
ttgcaaatcttgaaat

SEQ ID NO: 1301190 - DNA, 14 bp, Homo sapiens
ttgctgagcctctg

SEQ ID NO: 1301191 - DNA, 20 bp, Homo sapiens
ttgctgttttcctcccttct

SEQ ID NO: 1301192 - DNA, 15 bp, Homo sapiens
ttgctttctgctcag

SEQ ID NO: 1301193 - DNA, 11 bp, Homo sapiens
ttgctttgagc

SEQ ID NO: 1301194 - DNA, 13 bp, Homo sapiens
ttggaatactttt

SEQ ID NO: 1301195 - DNA, 21 bp, Homo sapiens
ttggagagtttcctgaaacaa

SEQ ID NO: 1301196 - DNA, 14 bp, Homo sapiens
ttggattgtatatt

SEQ ID NO: 1301197 - DNA, 17 bp, Homo sapiens
ttggcaccagacaccca

SEQ ID NO: 1301198 - DNA, 19 bp, Homo sapiens
ttggcacctaatccaggca

SEQ ID NO: 1301199 - DNA, 19 bp, Homo sapiens
ttggcctgatcagaccacg

SEQ ID NO: 1301200 - DNA, 14 bp, Homo sapiens
ttggctcagacatg

SEQ ID NO: 1301201 - DNA, 19 bp, Homo sapiens
ttgggcctgctccagacct

SEQ ID NO: 1301202 - DNA, 17 bp, Homo sapiens
ttggggtctggcagcct

SEQ ID NO: 1301203 - DNA, 17 bp, Homo sapiens
ttgggtgggcaggaaaa

SEQ ID NO: 1301204 - DNA, 13 bp, Homo sapiens
ttgtatattgtgt

SEQ ID NO: 1301205 - DNA, 16 bp, Homo sapiens
ttgtattaaactcttc

SEQ ID NO: 1301206 - DNA, 16 bp, Homo sapiens
ttgtattaaagacaga

SEQ ID NO: 1301207 - DNA, 15 bp, Homo sapiens
ttgtccctctgcccc

SEQ ID NO: 1301208 - DNA, 16 bp, Homo sapiens
ttgtccctctgcccca

SEQ ID NO: 1301209 - DNA, 15 bp, Homo sapiens
ttgtgatagcacttt

SEQ ID NO: 1301210 - DNA, 19 bp, Homo sapiens
ttgtgatagcactttctac

SEQ ID NO: 1301211 - DNA, 22 bp, Homo sapiens
ttgtggaatggagattcagttt

SEQ ID NO: 1301212 - DNA, 19 bp, Homo sapiens
ttgtggccaaggagctgct

SEQ ID NO: 1301213 - DNA, 20 bp, Homo sapiens
ttgtggccaaggagctgcta

SEQ ID NO: 1301214 - DNA, 19 bp, Homo sapiens
ttgtgtatttacgctttga

SEQ ID NO: 1301215 - DNA, 23 bp, Homo sapiens
ttgtgtatttacgctttgattca

SEQ ID NO: 1301216 - DNA, 14 bp, Homo sapiens
ttgttcccctcctc

SEQ ID NO: 1301217 - DNA, 16 bp, Homo sapiens
ttgttcccctcctcca

SEQ ID NO: 1301218 - DNA, 19 bp, Homo sapiens
ttgttcccctcctccactc

SEQ ID NO: 1301219 - DNA, 16 bp, Homo sapiens
tttaaaatatttatct

SEQ ID NO: 1301220 - DNA, 15 bp, Homo sapiens
tttaactagaattta

SEQ ID NO: 1301221 - DNA, 17 bp, Homo sapiens
tttaactagaatttatt

SEQ ID NO: 1301222 - DNA, 15 bp, Homo sapiens
tttaagataaattat

SEQ ID NO: 1301223 - DNA, 23 bp, Homo sapiens
tttaatgccgatatactctagat

SEQ ID NO: 1301224 - DNA, 22 bp, Homo sapiens
tttaatttattaattgctttga

SEQ ID NO: 1301225 - DNA, 13 bp, Homo sapiens
tttacgctttgat

SEQ ID NO: 1301226 - DNA, 18 bp, Homo sapiens
tttactgagcttctctgt

SEQ ID NO: 1301227 - DNA, 20 bp, Homo sapiens
tttagaaatactgcaagaaa

SEQ ID NO: 1301228 - DNA, 20 bp, Homo sapiens
tttaggagggagttatctaa

SEQ ID NO: 1301229 - DNA, 11 bp, Homo sapiens
tatggaattga

SEQ ID NO: 1301230 - DNA, 14 bp, Homo sapiens
tatgtagtaattga

SEQ ID NO: 1301231 - DNA, 12 bp, Homo sapiens
tatgtttacaaa

SEQ ID NO: 1301232 - DNA, 21 bp, Homo sapiens
tattaaattaaattttgtgtc

SEQ ID NO: 1301233 - DNA, 15 bp, Homo sapiens
tattagggagaaaat

SEQ ID NO: 1301234 - DNA, 14 bp, Homo sapiens
tattagtaccatag

SEQ ID NO: 1301235 - DNA, 19 bp, Homo sapiens
tattataatttttttcaat

SEQ ID NO: 1301236 - DNA, 15 bp, Homo sapiens
tattcaattcctctg

SEQ ID NO: 1301237 - DNA, 20 bp, Homo sapiens
tattccagaatgctgtacat

SEQ ID NO: 1301238 - DNA, 21 bp, Homo sapiens
tattccagaatgctgtacatc

SEQ ID NO: 1301239 - DNA, 23 bp, Homo sapiens
tattccagaatgctgtacatcta

SEQ ID NO: 1301240 - DNA, 23 bp, Homo sapiens
tattgacacagaaaatgttgaga

SEQ ID NO: 1301241 - DNA, 19 bp, Homo sapiens
tattgctgagagaaatatg

SEQ ID NO: 1301242 - DNA, 13 bp, Homo sapiens
tattgtacctctc

SEQ ID NO: 1301243 - DNA, 14 bp, Homo sapiens
tattgtacctctct

SEQ ID NO: 1301244 - DNA, 17 bp, Homo sapiens
tattgttccagcagttt

SEQ ID NO: 1301245 - DNA, 18 bp, Homo sapiens
tatttaaaaatatttttg

SEQ ID NO: 1301246 - DNA, 14 bp, Homo sapiens
tatttacgctttga

SEQ ID NO: 1301247 - DNA, 22 bp, Homo sapiens
tatttactgagcttctctgtga

SEQ ID NO: 1301248 - DNA, 14 bp, Homo sapiens
tatttataaaactt

SEQ ID NO: 1301249 - DNA, 17 bp, Homo sapiens
tatttataaaacttctc

SEQ ID NO: 1301250 - DNA, 15 bp, Homo sapiens
tatttatatgtacat

SEQ ID NO: 1301251 - DNA, 17 bp, Homo sapiens
tatttatatgtacatga

SEQ ID NO: 1301252 - DNA, 15 bp, Homo sapiens
tatttatctgattaa

SEQ ID NO: 1301253 - DNA, 15 bp, Homo sapiens
tatttgggaagtgaa

SEQ ID NO: 1301254 - DNA, 18 bp, Homo sapiens
tatttgtgatagcacttt

SEQ ID NO: 1301255 - DNA, 20 bp, Homo sapiens
tattttggattgtatattgt

SEQ ID NO: 1301256 - DNA, 12 bp, Homo sapiens
tcaaaatgcttt

SEQ ID NO: 1301257 - DNA, 17 bp, Homo sapiens
tcaaaatgctttttatt

SEQ ID NO: 1301258 - DNA, 16 bp, Homo sapiens
tcaaactggggcctcc

SEQ ID NO: 1301259 - DNA, 19 bp, Homo sapiens
tcaaactggggcctccaga

SEQ ID NO: 1301260 - DNA, 22 bp, Homo sapiens
tcaaactggggcctccagaact

SEQ ID NO: 1301261 - DNA, 22 bp, Homo sapiens
tcaaattaataatcttattagg

SEQ ID NO: 1301262 - DNA, 17 bp, Homo sapiens
tcaacctcttctggctc

SEQ ID NO: 1301263 - DNA, 18 bp, Homo sapiens
tcaacctcttctggctca

SEQ ID NO: 1301264 - DNA, 19 bp, Homo sapiens
tcaacctcttctggctcaa

SEQ ID NO: 1301265 - DNA, 22 bp, Homo sapiens
tcaagaaataaaaggaagccaa

SEQ ID NO: 1301266 - DNA, 20 bp, Homo sapiens
tcaagctcctcctccctgca

SEQ ID NO: 1301267 - DNA, 12 bp, Homo sapiens
tcaagtatttgg

SEQ ID NO: 1301268 - DNA, 11 bp, Homo sapiens
tcaatatttat

SEQ ID NO: 1301269 - DNA, 19 bp, Homo sapiens
tcaattagaatagtgttct

SEQ ID NO: 1301270 - DNA, 14 bp, Homo sapiens
tcaattcctctggg

SEQ ID NO: 1301271 - DNA, 15 bp, Homo sapiens
tcaattcctctggga

SEQ ID NO: 1301272 - DNA, 16 bp, Homo sapiens
tcaattcctctgggaa

SEQ ID NO: 1301273 - DNA, 13 bp, Homo sapiens
tcaattgtaaatt

SEQ ID NO: 1301274 - DNA, 14 bp, Homo sapiens
tcaattgtaaattg

SEQ ID NO: 1301275 - DNA, 15 bp, Homo sapiens
tcacaaacttttata

SEQ ID NO: 1301276 - DNA, 21 bp, Homo sapiens
tcacaaacttttatactcttt

SEQ ID NO: 1301277 - DNA, 15 bp, Homo sapiens
tcacaaagcccaagg

SEQ ID NO: 1301278 - DNA, 20 bp, Homo sapiens
tcacactgagaatgtaagaa

SEQ ID NO: 1301279 - DNA, 21 bp, Homo sapiens
tcacactgagaatgtaagaac

SEQ ID NO: 1301280 - DNA, 23 bp, Homo sapiens
tcacactgagaatgtaagaacta

SEQ ID NO: 1301281 - DNA, 19 bp, Homo sapiens
tcacaggccccaggaaagg

SEQ ID NO: 1301282 - DNA, 22 bp, Homo sapiens
tcacagttctttgggccagaca

SEQ ID NO: 1301283 - DNA, 17 bp, Homo sapiens
tcacccctccctttctc

SEQ ID NO: 1301284 - DNA, 18 bp, Homo sapiens
tcacccctccctttctcc

SEQ ID NO: 1301285 - DNA, 15 bp, Homo sapiens
tcacccctggttctc

SEQ ID NO: 1301286 - DNA, 19 bp, Homo sapiens
tcacccctggttctcatct

SEQ ID NO: 1301287 - DNA, 23 bp, Homo sapiens
tcaccctgatttaggagaagcca

SEQ ID NO: 1301288 - DNA, 16 bp, Homo sapiens
tcacctgccccaactc

SEQ ID NO: 1301289 - DNA, 20 bp, Homo sapiens
tcacctgtttttaagctgtt

SEQ ID NO: 1301290 - DNA, 18 bp, Homo sapiens
tcaccttggcaccagaca

SEQ ID NO: 1301291 - DNA, 19 bp, Homo sapiens
tcaccttggcaccagacac

SEQ ID NO: 1301292 - DNA, 23 bp, Homo sapiens
tcaccttggcaccagacacccag

SEQ ID NO: 1301293 - DNA, 22 bp, Homo sapiens
tcacgtttcatgtaatcctcaa

SEQ ID NO: 1301294 - DNA, 19 bp, Homo sapiens
tcactcattgctgagcctc

SEQ ID NO: 1301295 - DNA, 20 bp, Homo sapiens
tcactcattgctgagcctct

SEQ ID NO: 1301296 - DNA, 17 bp, Homo sapiens
tcactggggcctacagc

SEQ ID NO: 1301297 - DNA, 14 bp, Homo sapiens
tcactgtctttcct

SEQ ID NO: 1301298 - DNA, 15 bp, Homo sapiens
tcactgtctttccta

SEQ ID NO: 1301299 - DNA, 16 bp, Homo sapiens
tcactgtctttcctag

SEQ ID NO: 1301300 - DNA, 15 bp, Homo sapiens
tcacttcaccctgga

SEQ ID NO: 1301301 - DNA, 23 bp, Homo sapiens
tcagaaagtgtgctttatgctga

SEQ ID NO: 1301302 - DNA, 22 bp, Homo sapiens
tcagaatagccacatttggaat

SEQ ID NO: 1301303 - DNA, 23 bp, Homo sapiens
tcagacaccctcaacctcttctg

SEQ ID NO: 1301304 - DNA, 14 bp, Homo sapiens
tcagacatgttttc

SEQ ID NO: 1301305 - DNA, 21 bp, Homo sapiens
tcagactcccattcctgaaga

SEQ ID NO: 1301306 - DNA, 14 bp, Homo sapiens
tcagatccagggac

SEQ ID NO: 1301307 - DNA, 15 bp, Homo sapiens
tcagatccagggaca

SEQ ID NO: 1301308 - DNA, 14 bp, Homo sapiens
tcagccagagaagc

SEQ ID NO: 1301309 - DNA, 13 bp, Homo sapiens
tcagccctgaccc

SEQ ID NO: 1301310 - DNA, 20 bp, Homo sapiens
tcagcctcccaagtagctgg

SEQ ID NO: 1301311 - DNA, 15 bp, Homo sapiens
tcagcctggccagac

SEQ ID NO: 1301312 - DNA, 16 bp, Homo sapiens
tcagcctggccagaca

SEQ ID NO: 1301313 - DNA, 19 bp, Homo sapiens
tcagcctggccagacacag

SEQ ID NO: 1301314 - DNA, 14 bp, Homo sapiens
tcagccttgccaga

SEQ ID NO: 1301315 - DNA, 19 bp, Homo sapiens
taaattcctctttgctttg

SEQ ID NO: 1301316 - DNA, 17 bp, Homo sapiens
taaccatcactggttgc

SEQ ID NO: 1301317 - DNA, 17 bp, Homo sapiens
taactagaatttattca

SEQ ID NO: 1301318 - DNA, 16 bp, Homo sapiens
taactagatggtgctg

SEQ ID NO: 1301319 - DNA, 18 bp, Homo sapiens
taactagatggtgctgag

SEQ ID NO: 1301320 - DNA, 13 bp, Homo sapiens
taacttctgcctg

SEQ ID NO: 1301321 - DNA, 23 bp, Homo sapiens
taacttcttatggaattgatttg

SEQ ID NO: 1301322 - DNA, 12 bp, Homo sapiens
taagaaaagatt

SEQ ID NO: 1301323 - DNA, 19 bp, Homo sapiens
taagaaaagattttaatca

SEQ ID NO: 1301324 - DNA, 14 bp, Homo sapiens
taagaacctggaac

SEQ ID NO: 1301325 - DNA, 18 bp, Homo sapiens
taagaattcaaactgggg

SEQ ID NO: 1301326 - DNA, 19 bp, Homo sapiens
taagacatgatttccttga

SEQ ID NO: 1301327 - DNA, 20 bp, Homo sapiens
taagacatgatttccttgaa

SEQ ID NO: 1301328 - DNA, 21 bp, Homo sapiens
taagacatgatttccttgaat

SEQ ID NO: 1301329 - DNA, 11 bp, Homo sapiens
taagacctggc

SEQ ID NO: 1301330 - DNA, 11 bp, Homo sapiens
taagctgtttc

SEQ ID NO: 1301331 - DNA, 21 bp, Homo sapiens
taaggctgcaaggtttaggct

SEQ ID NO: 1301332 - DNA, 18 bp, Homo sapiens
taaggtgatatatttaaa

SEQ ID NO: 1301333 - DNA, 16 bp, Homo sapiens
taagtggaggcacttt

SEQ ID NO: 1301334 - DNA, 20 bp, Homo sapiens
taagtgtatttttcaataaa

SEQ ID NO: 1301335 - DNA, 14 bp, Homo sapiens
taatatgaaaactt

SEQ ID NO: 1301336 - DNA, 22 bp, Homo sapiens
taatatggccacagtagtcttg

SEQ ID NO: 1301337 - DNA, 18 bp, Homo sapiens
taatccaggcagatccag

SEQ ID NO: 1301338 - DNA, 22 bp, Homo sapiens
taatccaggcagatccaggact

SEQ ID NO: 1301339 - DNA, 13 bp, Homo sapiens
taatcttattagg

SEQ ID NO: 1301340 - DNA, 21 bp, Homo sapiens
taatcttattagggagaaaat

SEQ ID NO: 1301341 - DNA, 14 bp, Homo sapiens
taatcttgctctgc

SEQ ID NO: 1301342 - DNA, 15 bp, Homo sapiens
taatcttgctctgct

SEQ ID NO: 1301343 - DNA, 13 bp, Homo sapiens
taatgctccttgt

SEQ ID NO: 1301344 - DNA, 19 bp, Homo sapiens
taatgtctctgtgagactc

SEQ ID NO: 1301345 - DNA, 19 bp, Homo sapiens
taattcctcaacgtattgt

SEQ ID NO: 1301346 - DNA, 12 bp, Homo sapiens
taattgctttga

SEQ ID NO: 1301347 - DNA, 19 bp, Homo sapiens
taatttattaattgctttg

SEQ ID NO: 1301348 - DNA, 15 bp, Homo sapiens
taatttcaaaatgct

SEQ ID NO: 1301349 - DNA, 16 bp, Homo sapiens
taatttcaaaatgctt

SEQ ID NO: 1301350 - DNA, 12 bp, Homo sapiens
taatttgcatta

SEQ ID NO: 1301351 - DNA, 16 bp, Homo sapiens
taatttgcattaaatt

SEQ ID NO: 1301352 - DNA, 17 bp, Homo sapiens
taatttgcattaaattc

SEQ ID NO: 1301353 - DNA, 16 bp, Homo sapiens
taatttttttcaatat

SEQ ID NO: 1301354 - DNA, 22 bp, Homo sapiens
taatttttttcaatatttatta

SEQ ID NO: 1301355 - DNA, 12 bp, Homo sapiens
tacaaaacttcc

SEQ ID NO: 1301356 - DNA, 18 bp, Homo sapiens
tacaaacaaaatttctat

SEQ ID NO: 1301357 - DNA, 16 bp, Homo sapiens
tacaaatcaagtattt

SEQ ID NO: 1301358 - DNA, 15 bp, Homo sapiens
tacaaattagaaaat

SEQ ID NO: 1301359 - DNA, 21 bp, Homo sapiens
tacaatgtgaactttattaaa

SEQ ID NO: 1301360 - DNA, 22 bp, Homo sapiens
tacagatgaatgtatttatttg

SEQ ID NO: 1301361 - DNA, 19 bp, Homo sapiens
tacagctttgatccctgac

SEQ ID NO: 1301362 - DNA, 23 bp, Homo sapiens
tacatagcatgacatttctttgt

SEQ ID NO: 1301363 - DNA, 12 bp, Homo sapiens
tacatatcttta

SEQ ID NO: 1301364 - DNA, 22 bp, Homo sapiens
tacatatctttattaatcacta

SEQ ID NO: 1301365 - DNA, 14 bp, Homo sapiens
taccatttatacaa

SEQ ID NO: 1301366 - DNA, 21 bp, Homo sapiens
taccatttatacaaattagaa

SEQ ID NO: 1301367 - DNA, 16 bp, Homo sapiens
taccccctccttcaga

SEQ ID NO: 1301368 - DNA, 18 bp, Homo sapiens
taccccctccttcagaca

SEQ ID NO: 1301369 - DNA, 22 bp, Homo sapiens
taccctcttcatggatggggga

SEQ ID NO: 1301370 - DNA, 22 bp, Homo sapiens
tacctcaacccccatttctatt

SEQ ID NO: 1301371 - DNA, 17 bp, Homo sapiens
tacctctcttatagaat

SEQ ID NO: 1301372 - DNA, 15 bp, Homo sapiens
tacctctgatacctc

SEQ ID NO: 1301373 - DNA, 15 bp, Homo sapiens
tacgctttgattcat

SEQ ID NO: 1301374 - DNA, 14 bp, Homo sapiens
tactaccttgaaaa

SEQ ID NO: 1301375 - DNA, 16 bp, Homo sapiens
tactaggtaacttcat

SEQ ID NO: 1301376 - DNA, 17 bp, Homo sapiens
tactgagcttctctgtg

SEQ ID NO: 1301377 - DNA, 21 bp, Homo sapiens
tactgtgtgtgtgaatgaaca

SEQ ID NO: 1301378 - DNA, 15 bp, Homo sapiens
tactgttaaaggaaa

SEQ ID NO: 1301379 - DNA, 16 bp, Homo sapiens
tactgttaaaggaaaa

SEQ ID NO: 1301380 - DNA, 14 bp, Homo sapiens
tacttgaagggcca

SEQ ID NO: 1301381 - DNA, 18 bp, Homo sapiens
tacttgaagggccagagc

SEQ ID NO: 1301382 - DNA, 15 bp, Homo sapiens
tagaatccaaacttg

SEQ ID NO: 1301383 - DNA, 14 bp, Homo sapiens
tagaattgcattga

SEQ ID NO: 1301384 - DNA, 15 bp, Homo sapiens
tagaattgcattgac

SEQ ID NO: 1301385 - DNA, 20 bp, Homo sapiens
tagaatttattcaattcctc

SEQ ID NO: 1301386 - DNA, 13 bp, Homo sapiens
tagagggaggggc

SEQ ID NO: 1301387 - DNA, 14 bp, Homo sapiens
tagagggaggggcc

SEQ ID NO: 1301388 - DNA, 17 bp, Homo sapiens
tagatagttagaacctg

SEQ ID NO: 1301389 - DNA, 14 bp, Homo sapiens
tagatggctcctct

SEQ ID NO: 1301390 - DNA, 17 bp, Homo sapiens
tagattatggagctttt

SEQ ID NO: 1301391 - DNA, 13 bp, Homo sapiens
tagcagacaggcc

SEQ ID NO: 1301392 - DNA, 14 bp, Homo sapiens
tagcagattttaat

SEQ ID NO: 1301393 - DNA, 20 bp, Homo sapiens
tagcagcagcctttaatgca

SEQ ID NO: 1301394 - DNA, 21 bp, Homo sapiens
tagccacatttggaatacttt

SEQ ID NO: 1301395 - DNA, 15 bp, Homo sapiens
tagccccctggcctc

SEQ ID NO: 1301396 - DNA, 14 bp, Homo sapiens
tagcctggggtggg

SEQ ID NO: 1301397 - DNA, 18 bp, Homo sapiens
tagctaaacggattccaa

SEQ ID NO: 1301398 - DNA, 20 bp, Homo sapiens
tagctaaacggattccaaag

SEQ ID NO: 1301399 - DNA, 14 bp, Homo sapiens
tagctcccctccaa

SEQ ID NO: 1301400 - DNA, 16 bp, Homo sapiens
tagctgcaaaggacag

SEQ ID NO: 1301401 - DNA, 17 bp, Homo sapiens
tagctgcaaaggacaga

SEQ ID NO: 1301402 - DNA, 15 bp, Homo sapiens
tagctgggattacag

SEQ ID NO: 1301403 - DNA, 18 bp, Homo sapiens
tagctgggggtgggccag

SEQ ID NO: 1301404 - DNA, 20 bp, Homo sapiens
taggacataaattagaggtc

SEQ ID NO: 1301405 - DNA, 19 bp, Homo sapiens
taggactcaaagtttcaga

SEQ ID NO: 1301406 - DNA, 13 bp, Homo sapiens
gtatattgtgttt

SEQ ID NO: 1301407 - DNA, 20 bp, Homo sapiens
gtatcactgtctttcctaga

SEQ ID NO: 1301408 - DNA, 17 bp, Homo sapiens
gtatcatgccctgtgca

SEQ ID NO: 1301409 - DNA, 18 bp, Homo sapiens
gtatggagagaaaacaga

SEQ ID NO: 1301410 - DNA, 16 bp, Homo sapiens
gtatttacgctttgat

SEQ ID NO: 1301411 - DNA, 22 bp, Homo sapiens
gtcaaatggtaggcatttccta

SEQ ID NO: 1301412 - DNA, 13 bp, Homo sapiens
gtcaagctcctcc

SEQ ID NO: 1301413 - DNA, 15 bp, Homo sapiens
gtcaagctcctcctc

SEQ ID NO: 1301414 - DNA, 20 bp, Homo sapiens
gtcaagctcctcctccctgc

SEQ ID NO: 1301415 - DNA, 13 bp, Homo sapiens
gtcacacactgat

SEQ ID NO: 1301416 - DNA, 22 bp, Homo sapiens
gtcactcattgctgagcctctg

SEQ ID NO: 1301417 - DNA, 23 bp, Homo sapiens
gtcactcattgctgagcctctgc

SEQ ID NO: 1301418 - DNA, 24 bp, Homo sapiens
gtcactcattgctgagcctctgct

SEQ ID NO: 1301419 - DNA, 13 bp, Homo sapiens
gtcaggcagggtg

SEQ ID NO: 1301420 - DNA, 21 bp, Homo sapiens
gtcatactatctactctcctc

SEQ ID NO: 1301421 - DNA, 18 bp, Homo sapiens
gtcatgccctcctctccc

SEQ ID NO: 1301422 - DNA, 12 bp, Homo sapiens
gtccaatgtggc

SEQ ID NO: 1301423 - DNA, 17 bp, Homo sapiens
gtccagctgagcgccag

SEQ ID NO: 1301424 - DNA, 21 bp, Homo sapiens
gtcccagattggctcacactg

SEQ ID NO: 1301425 - DNA, 11 bp, Homo sapiens
catccagggcc

SEQ ID NO: 1301426 - DNA, 21 bp, Homo sapiens
aaaacaggtcttcatcgaatc

SEQ ID NO: 1301427 - DNA, 21 bp, Homo sapiens
aaaactacaaatcaagtattt

SEQ ID NO: 1301428 - DNA, 14 bp, Homo sapiens
aaaagattttaatc

SEQ ID NO: 1301429 - DNA, 15 bp, Homo sapiens
aaaagattttaatca

SEQ ID NO: 1301430 - DNA, 23 bp, Homo sapiens
aaaatagttaagacatgatttcc

SEQ ID NO: 1301431 - DNA, 13 bp, Homo sapiens
aaaatatttataa

SEQ ID NO: 1301432 - DNA, 21 bp, Homo sapiens
aaaatatttataaaacttctc

SEQ ID NO: 1301433 - DNA, 13 bp, Homo sapiens
aaaatgcttttta

SEQ ID NO: 1301434 - DNA, 14 bp, Homo sapiens
aaaattcaattgta

SEQ ID NO: 1301435 - DNA, 17 bp, Homo sapiens
aaaattggttggagaat

SEQ ID NO: 1301436 - DNA, 12 bp, Homo sapiens
aaacagaagcct

SEQ ID NO: 1301437 - DNA, 11 bp, Homo sapiens
aaacaggcagt

SEQ ID NO: 1301438 - DNA, 20 bp, Homo sapiens
aaacatctattctctccaaa

SEQ ID NO: 1301439 - DNA, 12 bp, Homo sapiens
aaaccagggagc

SEQ ID NO: 1301440 - DNA, 18 bp, Homo sapiens
aaacctgggattcaggaa

SEQ ID NO: 1301441 - DNA, 18 bp, Homo sapiens
aaactggggcctccagaa

SEQ ID NO: 1301442 - DNA, 16 bp, Homo sapiens
aaactggtattttatc

SEQ ID NO: 1301443 - DNA, 14 bp, Homo sapiens
aaactttgctaaat

SEQ ID NO: 1301444 - DNA, 19 bp, Homo sapiens
aaagaaatgtctattaagg

SEQ ID NO: 1301445 - DNA, 21 bp, Homo sapiens
aaagatctgttttgaaggcaa

SEQ ID NO: 1301446 - DNA, 15 bp, Homo sapiens
aaagcagccacgagg

SEQ ID NO: 1301447 - DNA, 12 bp, Homo sapiens
aaagcatttata

SEQ ID NO: 1301448 - DNA, 23 bp, Homo sapiens
aaagctgtggccagcttgttatt

SEQ ID NO: 1301449 - DNA, 16 bp, Homo sapiens
aaaggagtcaaaacta

SEQ ID NO: 1301450 - DNA, 18 bp, Homo sapiens
aaaggatctttgtggcca

SEQ ID NO: 1301451 - DNA, 19 bp, Homo sapiens
aaaggatctttgtggccaa

SEQ ID NO: 1301452 - DNA, 13 bp, Homo sapiens
aaaggatgtgatt

SEQ ID NO: 1301453 - DNA, 14 bp, Homo sapiens
aaaggtgatatcca

SEQ ID NO: 1301454 - DNA, 19 bp, Homo sapiens
aaagtattctgtactctta

SEQ ID NO: 1301455 - DNA, 22 bp, Homo sapiens
aaagtcctttttttccatcttt

SEQ ID NO: 1301456 - DNA, 22 bp, Homo sapiens
aaagtgtgctttatgctgaaac

SEQ ID NO: 1301457 - DNA, 12 bp, Homo sapiens
aaagttactagg

SEQ ID NO: 1301458 - DNA, 21 bp, Homo sapiens
aaagttactaggtaacttcat

SEQ ID NO: 1301459 - DNA, 13 bp, Homo sapiens
aaataaaaagaaa

SEQ ID NO: 1301460 - DNA, 14 bp, Homo sapiens
aaataaaaataaat

SEQ ID NO: 1301461 - DNA, 17 bp, Homo sapiens
aaataagaatagaaata

SEQ ID NO: 1301462 - DNA, 12 bp, Homo sapiens
aaataatgtctc

SEQ ID NO: 1301463 - DNA, 17 bp, Homo sapiens
aaatagttaagacatga

SEQ ID NO: 1301464 - DNA, 16 bp, Homo sapiens
aaatatggaacttaca

SEQ ID NO: 1301465 - DNA, 18 bp, Homo sapiens
aaatctgacccagtgccc

SEQ ID NO: 1301466 - DNA, 13 bp, Homo sapiens
aaatcttgaaatt

SEQ ID NO: 1301467 - DNA, 21 bp, Homo sapiens
aaatgcatgattttgtaaccc

SEQ ID NO: 1301468 - DNA, 19 bp, Homo sapiens
aaatggacataggactcaa

SEQ ID NO: 1301469 - DNA, 16 bp, Homo sapiens
aaatgggacttaactc

SEQ ID NO: 1301470 - DNA, 19 bp, Homo sapiens
aaatggtaggcatttccta

SEQ ID NO: 1301471 - DNA, 14 bp, Homo sapiens
aaatgtatcttatt

SEQ ID NO: 1301472 - DNA, 16 bp, Homo sapiens
aaatgtctattaaggt

SEQ ID NO: 1301473 - DNA, 15 bp, Homo sapiens
aaatgttatttaaca

SEQ ID NO: 1301474 - DNA, 15 bp, Homo sapiens
aaattaagaaggcaa

SEQ ID NO: 1301475 - DNA, 12 bp, Homo sapiens
aaattagaaaat

SEQ ID NO: 1301476 - DNA, 19 bp, Homo sapiens
aaattcaattgtaaattga

SEQ ID NO: 1301477 - DNA, 20 bp, Homo sapiens
aaattcaattgtaaattgaa

SEQ ID NO: 1301478 - DNA, 18 bp, Homo sapiens
aaattcacaaacttttat

SEQ ID NO: 1301479 - DNA, 14 bp, Homo sapiens
aaattcctctttgc

SEQ ID NO: 1301480 - DNA, 20 bp, Homo sapiens
aaattgacacaagtggacct

SEQ ID NO: 1301481 - DNA, 15 bp, Homo sapiens
aacaaagcagccacg

SEQ ID NO: 1301482 - DNA, 13 bp, Homo sapiens
aacaaagttacta

SEQ ID NO: 1301483 - DNA, 21 bp, Homo sapiens
acatccaaaatagttaagaca

SEQ ID NO: 1301484 - DNA, 16 bp, Homo sapiens
acatccaaagcagaca

SEQ ID NO: 1301485 - DNA, 18 bp, Homo sapiens
acatccaaagcagacagc

SEQ ID NO: 1301486 - DNA, 21 bp, Homo sapiens
acatctaagcctgaaggggcg

SEQ ID NO: 1301487 - DNA, 19 bp, Homo sapiens
acatctattttggattgta

SEQ ID NO: 1301488 - DNA, 12 bp, Homo sapiens
acatctctgctt

SEQ ID NO: 1301489 - DNA, 16 bp, Homo sapiens
acatgaggggacattt

SEQ ID NO: 1301490 - DNA, 17 bp, Homo sapiens
acatgaggggacatttt

SEQ ID NO: 1301491 - DNA, 14 bp, Homo sapiens
acatgattccttcc

SEQ ID NO: 1301492 - DNA, 21 bp, Homo sapiens
acatgatttccttgaatgtgg

SEQ ID NO: 1301493 - DNA, 13 bp, Homo sapiens
acattcacctgcc

SEQ ID NO: 1301494 - DNA, 20 bp, Homo sapiens
acattcacctgccccaactc

SEQ ID NO: 1301495 - DNA, 21 bp, Homo sapiens
acattggcacctaatccaggc

SEQ ID NO: 1301496 - DNA, 20 bp, Homo sapiens
acattgttcaattagaatag

SEQ ID NO: 1301497 - DNA, 18 bp, Homo sapiens
acatttggaatacttttt

SEQ ID NO: 1301498 - DNA, 13 bp, Homo sapiens
acattttaattca

SEQ ID NO: 1301499 - DNA, 20 bp, Homo sapiens
accacatctaagcctgaagg

SEQ ID NO: 1301500 - DNA, 16 bp, Homo sapiens
accagctcaggacaga

SEQ ID NO: 1301501 - DNA, 20 bp, Homo sapiens
accagggagcccctttgatg

SEQ ID NO: 1301502 - DNA, 15 bp, Homo sapiens
accagtccccccacc

SEQ ID NO: 1301503 - DNA, 20 bp, Homo sapiens
accatagtaccatttataca

SEQ ID NO: 1301504 - DNA, 21 bp, Homo sapiens
accattcagtgattactgtca

SEQ ID NO: 1301505 - DNA, 23 bp, Homo sapiens
accatttatacaaattagaaaat

SEQ ID NO: 1301506 - DNA, 14 bp, Homo sapiens
acccaatccaaatg

SEQ ID NO: 1301507 - DNA, 23 bp, Homo sapiens
acccaggagatggaagttgcagt

SEQ ID NO: 1301508 - DNA, 17 bp, Homo sapiens
acccaggagtgtggcca

SEQ ID NO: 1301509 - DNA, 23 bp, Homo sapiens
acccatatccttaccctccttgg

SEQ ID NO: 1301510 - DNA, 13 bp, Homo sapiens
accccccagcact

SEQ ID NO: 1301511 - DNA, 14 bp, Homo sapiens
accccccagcactg

SEQ ID NO: 1301512 - DNA, 15 bp, Homo sapiens
accccctccttcaga

SEQ ID NO: 1301513 - DNA, 16 bp, Homo sapiens
accccctccttcagac

SEQ ID NO: 1301514 - DNA, 17 bp, Homo sapiens
accccctccttcagaca

SEQ ID NO: 1301515 - DNA, 14 bp, Homo sapiens
acccctccctttct

SEQ ID NO: 1301516 - DNA, 19 bp, Homo sapiens
acccctccctttctcccct

SEQ ID NO: 1301517 - DNA, 15 bp, Homo sapiens
acccctgggggctct

SEQ ID NO: 1301518 - DNA, 16 bp, Homo sapiens
acccctggttctcatc

SEQ ID NO: 1301519 - DNA, 21 bp, Homo sapiens
acccgagtcattcgttctgtg

SEQ ID NO: 1301520 - DNA, 17 bp, Homo sapiens
accctcattctactgaa

SEQ ID NO: 1301521 - DNA, 23 bp, Homo sapiens
accctgatttaggagaagccagg

SEQ ID NO: 1301522 - DNA, 13 bp, Homo sapiens
accctggagccca

SEQ ID NO: 1301523 - DNA, 19 bp, Homo sapiens
acccttctcctcttgtaaa

SEQ ID NO: 1301524 - DNA, 21 bp, Homo sapiens
acccttctcctcttgtaaata

SEQ ID NO: 1301525 - DNA, 21 bp, Homo sapiens
acctagcagcaccgttctgtg

SEQ ID NO: 1301526 - DNA, 23 bp, Homo sapiens
acctagcagcaccgttctgtgca

SEQ ID NO: 1301527 - DNA, 19 bp, Homo sapiens
acctcaacccccatttcta

SEQ ID NO: 1301528 - DNA, 21 bp, Homo sapiens
acctcaacccccatttctatt

SEQ ID NO: 1301529 - DNA, 11 bp, Homo sapiens
acctcagcctg

SEQ ID NO: 1301530 - DNA, 14 bp, Homo sapiens
acctcagcctggcc

SEQ ID NO: 1301531 - DNA, 19 bp, Homo sapiens
acctcagcctggccagaca

SEQ ID NO: 1301532 - DNA, 20 bp, Homo sapiens
acctcagcctggccagacac

SEQ ID NO: 1301533 - DNA, 14 bp, Homo sapiens
acctccctgcctcc

SEQ ID NO: 1301534 - DNA, 22 bp, Homo sapiens
acctctccctgaccctgtatat

SEQ ID NO: 1301535 - DNA, 23 bp, Homo sapiens
acctctccctgaccctgtatata

SEQ ID NO: 1301536 - DNA, 13 bp, Homo sapiens
acctctgatacct

SEQ ID NO: 1301537 - DNA, 17 bp, Homo sapiens
acctgccccaactctcc

SEQ ID NO: 1301538 - DNA, 16 bp, Homo sapiens
acctggctgccatact

SEQ ID NO: 1301539 - DNA, 20 bp, Homo sapiens
acctgtaatcccagctactt

SEQ ID NO: 1301540 - DNA, 21 bp, Homo sapiens
acctgtataagtggaggcact

SEQ ID NO: 1301541 - DNA, 23 bp, Homo sapiens
acctgtataagtggaggcacttt

SEQ ID NO: 1301542 - DNA, 17 bp, Homo sapiens
acctgttagcagacagg

SEQ ID NO: 1301543 - DNA, 16 bp, Homo sapiens
acctgtttttaagctg

SEQ ID NO: 1301544 - DNA, 14 bp, Homo sapiens
accttaggccttcc

SEQ ID NO: 1301545 - DNA, 15 bp, Homo sapiens
accttaggccttcct

SEQ ID NO: 1301546 - DNA, 16 bp, Homo sapiens
accttaggccttcctc

SEQ ID NO: 1301547 - DNA, 18 bp, Homo sapiens
accttaggccttcctctc

SEQ ID NO: 1301548 - DNA, 21 bp, Homo sapiens
accttaggccttcctctctcc

SEQ ID NO: 1301549 - DNA, 14 bp, Homo sapiens
accttattgtacct

SEQ ID NO: 1301550 - DNA, 17 bp, Homo sapiens
accttattgtacctctc

SEQ ID NO: 1301551 - DNA, 18 bp, Homo sapiens
accttattgtacctctct

SEQ ID NO: 1301552 - DNA, 14 bp, Homo sapiens
accttcccaaacgc

SEQ ID NO: 1301553 - DNA, 22 bp, Homo sapiens
accttcccaaacgcctcccctg

SEQ ID NO: 1301554 - DNA, 15 bp, Homo sapiens
accttttatgtagta

SEQ ID NO: 1301555 - DNA, 16 bp, Homo sapiens
accttttattgacaca

SEQ ID NO: 1301556 - DNA, 15 bp, Homo sapiens
acgcacctgcctcag

SEQ ID NO: 1301557 - DNA, 16 bp, Homo sapiens
acgcccccccccaccc

SEQ ID NO: 1301558 - DNA, 20 bp, Homo sapiens
acgcctgtaatcccagcact

SEQ ID NO: 1301559 - DNA, 13 bp, Homo sapiens
acgctttgattca

SEQ ID NO: 1301560 - DNA, 13 bp, Homo sapiens
acggccacatcaa

SEQ ID NO: 1301561 - DNA, 15 bp, Homo sapiens
acggggctcttctca

SEQ ID NO: 1301562 - DNA, 18 bp, Homo sapiens
acggggctcttctcattt

SEQ ID NO: 1301563 - DNA, 20 bp, Homo sapiens
acgtagctgcaaaggacaga

SEQ ID NO: 1301564 - DNA, 12 bp, Homo sapiens
actaaactcatt

SEQ ID NO: 1301565 - DNA, 16 bp, Homo sapiens
actaagaattcaaact

SEQ ID NO: 1301566 - DNA, 12 bp, Homo sapiens
actaaggggccc

SEQ ID NO: 1301567 - DNA, 22 bp, Homo sapiens
actaaggggcccggccagccat

SEQ ID NO: 1301568 - DNA, 23 bp, Homo sapiens
actaattccacaccttttattga

SEQ ID NO: 1301569 - DNA, 11 bp, Homo sapiens
actacaaatca

SEQ ID NO: 1301570 - DNA, 15 bp, Homo sapiens
actagaatttattca

SEQ ID NO: 1301571 - DNA, 15 bp, Homo sapiens
actagatggtgctga

SEQ ID NO: 1301572 - DNA, 22 bp, Homo sapiens
actcaaagtttcagagaccatt

SEQ ID NO: 1301573 - DNA, 23 bp, Homo sapiens
actcaaatggggccagatccagc

SEQ ID NO: 1301574 - DNA, 11 bp, Homo sapiens
actcagatcca

SEQ ID NO: 1301575 - DNA, 19 bp, Homo sapiens
actcagatccagggacaga

SEQ ID NO: 1301576 - DNA, 20 bp, Homo sapiens
actcagggcagcgccaggct

SEQ ID NO: 1301577 - DNA, 21 bp, Homo sapiens
actcattgctgagcctctgct

SEQ ID NO: 1301578 - DNA, 21 bp, Homo sapiens
actcatttataaagctaaaat

SEQ ID NO: 1301579 - DNA, 18 bp, Homo sapiens
actccaacagaagaactg

SEQ ID NO: 1301580 - DNA, 16 bp, Homo sapiens
actcccattcctgaag

SEQ ID NO: 1301581 - DNA, 14 bp, Homo sapiens
actccccgaagtct

SEQ ID NO: 1301582 - DNA, 23 bp, Homo sapiens
actccttccagtgtccttagaac

SEQ ID NO: 1301583 - DNA, 21 bp, Homo sapiens
actctagatgaagttttacat

SEQ ID NO: 1301584 - DNA, 20 bp, Homo sapiens
actctagctgggggtgggcc

SEQ ID NO: 1301585 - DNA, 10 bp, Homo sapiens
actctccccc

SEQ ID NO: 1301586 - DNA, 14 bp, Homo sapiens
actctcccccaccc

SEQ ID NO: 1301587 - DNA, 14 bp, Homo sapiens
actctggcaaagct

SEQ ID NO: 1301588 - DNA, 19 bp, Homo sapiens
actcttaggaagagaaacc

SEQ ID NO: 1301589 - DNA, 20 bp, Homo sapiens
actcttttgctttattccag

SEQ ID NO: 1301590 - DNA, 21 bp, Homo sapiens
actcttttgctttattccaga

SEQ ID NO: 1301591 - DNA, 14 bp, Homo sapiens
actgaccagaacta

SEQ ID NO: 1301592 - DNA, 17 bp, Homo sapiens
actgagcttctctgtga

SEQ ID NO: 1301593 - DNA, 14 bp, Homo sapiens
actgaggcctgagc

SEQ ID NO: 1301594 - DNA, 16 bp, Homo sapiens
actgcatgctgctgga

SEQ ID NO: 1301595 - DNA, 17 bp, Homo sapiens
actgcatgctgctggac

SEQ ID NO: 1301596 - DNA, 13 bp, Homo sapiens
actgctactgtaa

SEQ ID NO: 1301597 - DNA, 22 bp, Homo sapiens
actggcaaaaggatctttgtgg

SEQ ID NO: 1301598 - DNA, 17 bp, Homo sapiens
actggggattgggtggg

SEQ ID NO: 1301599 - DNA, 19 bp, Homo sapiens
aggagctgctatagcctgg

SEQ ID NO: 1301600 - DNA, 20 bp, Homo sapiens
aggagctggggatccctccc

SEQ ID NO: 1301601 - DNA, 21 bp, Homo sapiens
aggagctggggatccctcccc

SEQ ID NO: 1301602 - DNA, 14 bp, Homo sapiens
aggaggcaggacct

SEQ ID NO: 1301603 - DNA, 15 bp, Homo sapiens
aggatagatgctggc

SEQ ID NO: 1301604 - DNA, 18 bp, Homo sapiens
aggatagatgctggccca

SEQ ID NO: 1301605 - DNA, 13 bp, Homo sapiens
aggatctttgtgg

SEQ ID NO: 1301606 - DNA, 16 bp, Homo sapiens
aggatctttgtggcca

SEQ ID NO: 1301607 - DNA, 18 bp, Homo sapiens
aggatctttgtggccaag

SEQ ID NO: 1301608 - DNA, 20 bp, Homo sapiens
aggatgtgattgtggaatgg

SEQ ID NO: 1301609 - DNA, 17 bp, Homo sapiens
aggcaaaattgcaaatc

SEQ ID NO: 1301610 - DNA, 20 bp, Homo sapiens
aggcaaaattgcaaatcttg

SEQ ID NO: 1301611 - DNA, 16 bp, Homo sapiens
aggcaacatccaaaat

SEQ ID NO: 1301612 - DNA, 12 bp, Homo sapiens
aggcaagagaat

SEQ ID NO: 1301613 - DNA, 16 bp, Homo sapiens
aggcagatccaggact

SEQ ID NO: 1301614 - DNA, 21 bp, Homo sapiens
aggccatctgggctcctccag

SEQ ID NO: 1301615 - DNA, 17 bp, Homo sapiens
aggcccagttcaccctg

SEQ ID NO: 1301616 - DNA, 14 bp, Homo sapiens
aggccccagcctcc

SEQ ID NO: 1301617 - DNA, 13 bp, Homo sapiens
aggcctcagccag

SEQ ID NO: 1301618 - DNA, 20 bp, Homo sapiens
aggcctgagatttcatctgc

SEQ ID NO: 1301619 - DNA, 14 bp, Homo sapiens
aggcctgagcgctc

SEQ ID NO: 1301620 - DNA, 18 bp, Homo sapiens
aggcctgagcgctcctgc

SEQ ID NO: 1301621 - DNA, 22 bp, Homo sapiens
aggcctgagcgctcctgccgca

SEQ ID NO: 1301622 - DNA, 21 bp, Homo sapiens
aggctaaacatccaatatttt

SEQ ID NO: 1301623 - DNA, 16 bp, Homo sapiens
aggctcaggtccctgg

SEQ ID NO: 1301624 - DNA, 12 bp, Homo sapiens
aggctcatttta

SEQ ID NO: 1301625 - DNA, 16 bp, Homo sapiens
aggctggtggcccagg

SEQ ID NO: 1301626 - DNA, 22 bp, Homo sapiens
aggctggttcggatttggggtg

SEQ ID NO: 1301627 - DNA, 19 bp, Homo sapiens
aggctttggatttgacatt

SEQ ID NO: 1301628 - DNA, 17 bp, Homo sapiens
agggaaaatgcagcagg

SEQ ID NO: 1301629 - DNA, 19 bp, Homo sapiens
agggacaagtggactcagg

SEQ ID NO: 1301630 - DNA, 17 bp, Homo sapiens
agggacagaggccccag

SEQ ID NO: 1301631 - DNA, 20 bp, Homo sapiens
agggacagaggccccagcct

SEQ ID NO: 1301632 - DNA, 14 bp, Homo sapiens
agggactgaagcca

SEQ ID NO: 1301633 - DNA, 16 bp, Homo sapiens
agggaggcaagccctg

SEQ ID NO: 1301634 - DNA, 12 bp, Homo sapiens
agggaggggcct

SEQ ID NO: 1301635 - DNA, 15 bp, Homo sapiens
agggaggggcctagg

SEQ ID NO: 1301636 - DNA, 19 bp, Homo sapiens
agggaggggcctaggcctc

SEQ ID NO: 1301637 - DNA, 21 bp, Homo sapiens
agggagttatctaaaagaaat

SEQ ID NO: 1301638 - DNA, 22 bp, Homo sapiens
agggatctggtcctacccatcc

SEQ ID NO: 1301639 - DNA, 15 bp, Homo sapiens
agggatgccctggag

SEQ ID NO: 1301640 - DNA, 19 bp, Homo sapiens
agggatgccctggaggtgg

SEQ ID NO: 1301641 - DNA, 21 bp, Homo sapiens
agggatgccctggaggtggct

SEQ ID NO: 1301642 - DNA, 12 bp, Homo sapiens
agggccagagcc

SEQ ID NO: 1301643 - DNA, 13 bp, Homo sapiens
agggccagagcca

SEQ ID NO: 1301644 - DNA, 14 bp, Homo sapiens
agggcccagagccc

SEQ ID NO: 1301645 - DNA, 15 bp, Homo sapiens
agggcccagagccca

SEQ ID NO: 1301646 - DNA, 14 bp, Homo sapiens
agggctggactgag

SEQ ID NO: 1301647 - DNA, 17 bp, Homo sapiens
agggctggactgaggcc

SEQ ID NO: 1301648 - DNA, 18 bp, Homo sapiens
agggctggactgaggcct

SEQ ID NO: 1301649 - DNA, 20 bp, Homo sapiens
agggctggactgaggcctga

SEQ ID NO: 1301650 - DNA, 17 bp, Homo sapiens
aggggagcccactgtcc

SEQ ID NO: 1301651 - DNA, 15 bp, Homo sapiens
aggggcccggccagc

SEQ ID NO: 1301652 - DNA, 15 bp, Homo sapiens
aggggccgctgccac

SEQ ID NO: 1301653 - DNA, 22 bp, Homo sapiens
aggggccgctgccacccacctc

SEQ ID NO: 1301654 - DNA, 21 bp, Homo sapiens
aggggtggctgcctcatttag

SEQ ID NO: 1301655 - DNA, 12 bp, Homo sapiens
agggtgtgtgct

SEQ ID NO: 1301656 - DNA, 18 bp, Homo sapiens
agggttattgcatttgga

SEQ ID NO: 1301657 - DNA, 15 bp, Homo sapiens
aggtcaggagttcct

SEQ ID NO: 1301658 - DNA, 22 bp, Homo sapiens
aggtcatactatctactctcct

SEQ ID NO: 1301659 - DNA, 14 bp, Homo sapiens
aggtcctctgtcag

SEQ ID NO: 1301660 - DNA, 23 bp, Homo sapiens
aggtcctctgtcagtcacagcca

SEQ ID NO: 1301661 - DNA, 20 bp, Homo sapiens
aggtcttcatcgaatctact

SEQ ID NO: 1301662 - DNA, 16 bp, Homo sapiens
aggtgatatatttaaa

SEQ ID NO: 1301663 - DNA, 18 bp, Homo sapiens
aggtgatatccattcttt

SEQ ID NO: 1301664 - DNA, 19 bp, Homo sapiens
aggtgatatccattctttc

SEQ ID NO: 1301665 - DNA, 22 bp, Homo sapiens
aggtgatatccattctttctga

SEQ ID NO: 1301666 - DNA, 16 bp, Homo sapiens
aggtgctgacggccag

SEQ ID NO: 1301667 - DNA, 12 bp, Homo sapiens
aggtggccatgc

SEQ ID NO: 1301668 - DNA, 18 bp, Homo sapiens
aggtggccatgcctcagc

SEQ ID NO: 1301669 - DNA, 15 bp, Homo sapiens
aggtggctgagcccc

SEQ ID NO: 1301670 - DNA, 15 bp, Homo sapiens
aggtgttgtcccttc

SEQ ID NO: 1301671 - DNA, 20 bp, Homo sapiens
aggtttaggctggtggccca

SEQ ID NO: 1301672 - DNA, 13 bp, Homo sapiens
aggtttttattag

SEQ ID NO: 1301673 - DNA, 21 bp, Homo sapiens
agtaccatagtaccatttata

SEQ ID NO: 1301674 - DNA, 17 bp, Homo sapiens
agtactttggaggcccc

SEQ ID NO: 1301675 - DNA, 15 bp, Homo sapiens
agtagaattgcattg

SEQ ID NO: 1301676 - DNA, 22 bp, Homo sapiens
agtatcactgtctttcctagat

SEQ ID NO: 1301677 - DNA, 20 bp, Homo sapiens
agtcaaattaataatcttat

SEQ ID NO: 1301678 - DNA, 22 bp, Homo sapiens
agtcaaattaataatcttatta

SEQ ID NO: 1301679 - DNA, 22 bp, Homo sapiens
agtcaagctcctcctccctgca

SEQ ID NO: 1301680 - DNA, 17 bp, Homo sapiens
agtcaatatttttagat

SEQ ID NO: 1301681 - DNA, 13 bp, Homo sapiens
agtcacagccacc

SEQ ID NO: 1301682 - DNA, 17 bp, Homo sapiens
agtcattcgttctgtgg

SEQ ID NO: 1301683 - DNA, 11 bp, Homo sapiens
agtccaagctg

SEQ ID NO: 1301684 - DNA, 14 bp, Homo sapiens
agtccaagctggga

SEQ ID NO: 1301685 - DNA, 16 bp, Homo sapiens
agtccaagctgggaga

SEQ ID NO: 1301686 - DNA, 20 bp, Homo sapiens
agtccgtgctgacagctgct

SEQ ID NO: 1301687 - DNA, 16 bp, Homo sapiens
agtcctttttttccat

SEQ ID NO: 1301688 - DNA, 19 bp, Homo sapiens
agtctcactttgtcgccca

SEQ ID NO: 1301689 - DNA, 14 bp, Homo sapiens
agtctccaccagga

SEQ ID NO: 1301690 - DNA, 15 bp, Homo sapiens
agtctccaccaggaa

SEQ ID NO: 1301691 - DNA, 16 bp, Homo sapiens
agtgaagactggaagc

SEQ ID NO: 1301692 - DNA, 23 bp, Homo sapiens
agtgagcggtgctgtcctcaggt

SEQ ID NO: 1301693 - DNA, 20 bp, Homo sapiens
agtgcaataaatctgaccca

SEQ ID NO: 1301694 - DNA, 21 bp, Homo sapiens
agtgcaataaatctgacccag

SEQ ID NO: 1301695 - DNA, 18 bp, Homo sapiens
agtgcagccgtttgagaa

SEQ ID NO: 1301696 - DNA, 18 bp, Homo sapiens
agtgcccccactgaccag

SEQ ID NO: 1301697 - DNA, 13 bp, Homo sapiens
agtggactcaggg

SEQ ID NO: 1301698 - DNA, 14 bp, Homo sapiens
agtggaggcacttt

SEQ ID NO: 1301699 - DNA, 20 bp, Homo sapiens
agtggtggtaaccctggtgg

SEQ ID NO: 1301700 - DNA, 21 bp, Homo sapiens
agtgtatttttcaataaagca

SEQ ID NO: 1301701 - DNA, 12 bp, Homo sapiens
agtgtgctttat

SEQ ID NO: 1301702 - DNA, 18 bp, Homo sapiens
agtgtgctttatgctgaa

SEQ ID NO: 1301703 - DNA, 20 bp, Homo sapiens
agtgttttaagataaattat

SEQ ID NO: 1301704 - DNA, 19 bp, Homo sapiens
agttaagacatgatttcct

SEQ ID NO: 1301705 - DNA, 16 bp, Homo sapiens
agttaagacctggcag

SEQ ID NO: 1301706 - DNA, 17 bp, Homo sapiens
agttaagacctggcagc

SEQ ID NO: 1301707 - DNA, 18 bp, Homo sapiens
agttactaggtaacttca

SEQ ID NO: 1301708 - DNA, 19 bp, Homo sapiens
agttactaggtaacttcat

SEQ ID NO: 1301709 - DNA, 16 bp, Homo sapiens
agttatctaaaagaaa

SEQ ID NO: 1301710 - DNA, 17 bp, Homo sapiens
agttatctaaaagaaat

SEQ ID NO: 1301711 - DNA, 16 bp, Homo sapiens
agttctttgggccaga

SEQ ID NO: 1301712 - DNA, 21 bp, Homo sapiens
agttgatctggaacccagact

SEQ ID NO: 1301713 - DNA, 15 bp, Homo sapiens
agtttaaaaaaattg

SEQ ID NO: 1301714 - DNA, 18 bp, Homo sapiens
agtttaaaacagaagcct

SEQ ID NO: 1301715 - DNA, 18 bp, Homo sapiens
agttttaactagaattta

SEQ ID NO: 1301716 - DNA, 22 bp, Homo sapiens
ataaaaataaatttggttctaa

SEQ ID NO: 1301717 - DNA, 12 bp, Homo sapiens
ataaaacaggta

SEQ ID NO: 1301718 - DNA, 18 bp, Homo sapiens
ataaagcatttataaatt

SEQ ID NO: 1301719 - DNA, 20 bp, Homo sapiens
ataaagccctgggatcactg

SEQ ID NO: 1301720 - DNA, 14 bp, Homo sapiens
ataaaggatgtgat

SEQ ID NO: 1301721 - DNA, 21 bp, Homo sapiens
ataaaggatgtgattgtggaa

SEQ ID NO: 1301722 - DNA, 15 bp, Homo sapiens
ataaatctgacccag

SEQ ID NO: 1301723 - DNA, 18 bp, Homo sapiens
ataaatgtatcttattca

SEQ ID NO: 1301724 - DNA, 13 bp, Homo sapiens
ataaattcctctt

SEQ ID NO: 1301725 - DNA, 20 bp, Homo sapiens
ataaatttggttctaataga

SEQ ID NO: 1301726 - DNA, 20 bp, Homo sapiens
ataactagatggtgctgaga

SEQ ID NO: 1301727 - DNA, 21 bp, Homo sapiens
ataactagatggtgctgagaa

SEQ ID NO: 1301728 - DNA, 19 bp, Homo sapiens
ataaggccataaaacaggt

SEQ ID NO: 1301729 - DNA, 19 bp, Homo sapiens
ataagtggaggcactttag

SEQ ID NO: 1301730 - DNA, 21 bp, Homo sapiens
ataatttttttcaatatttat

SEQ ID NO: 1301731 - DNA, 22 bp, Homo sapiens
ataatttttttcaatatttatt

SEQ ID NO: 1301732 - DNA, 18 bp, Homo sapiens
atacaaattagaaaatgt

SEQ ID NO: 1301733 - DNA, 23 bp, Homo sapiens
atacatacaccagcattcctttt

SEQ ID NO: 1301734 - DNA, 13 bp, Homo sapiens
atacatatcttta

SEQ ID NO: 1301735 - DNA, 14 bp, Homo sapiens
atacatatctttat

SEQ ID NO: 1301736 - DNA, 17 bp, Homo sapiens
atactaccttgaaaata

SEQ ID NO: 1301737 - DNA, 23 bp, Homo sapiens
atactctagatgaagttttacat

SEQ ID NO: 1301738 - DNA, 22 bp, Homo sapiens
atactcttaggaagagaaacca

SEQ ID NO: 1301739 - DNA, 14 bp, Homo sapiens
atactctttctgta

SEQ ID NO: 1301740 - DNA, 16 bp, Homo sapiens
atactgcaagaaaatg

SEQ ID NO: 1301741 - DNA, 20 bp, Homo sapiens
atactgctactgtaatttta

SEQ ID NO: 1301742 - DNA, 22 bp, Homo sapiens
atactgctactgtaattttata

SEQ ID NO: 1301743 - DNA, 19 bp, Homo sapiens
atacttgaagggccagagc

SEQ ID NO: 1301744 - DNA, 21 bp, Homo sapiens
atacttgaagggccagagcca

SEQ ID NO: 1301745 - DNA, 22 bp, Homo sapiens
atagacactccccgaagtcttt

SEQ ID NO: 1301746 - DNA, 15 bp, Homo sapiens
atagatgctggccca

SEQ ID NO: 1301747 - DNA, 23 bp, Homo sapiens
atagatgctggcccagggcccag

SEQ ID NO: 1301748 - DNA, 19 bp, Homo sapiens
atagtaccatttatacaaa

SEQ ID NO: 1301749 - DNA, 20 bp, Homo sapiens
atatacttttttttctttaa

SEQ ID NO: 1301750 - DNA, 16 bp, Homo sapiens
atatagcccagccagg

SEQ ID NO: 1301751 - DNA, 14 bp, Homo sapiens
atatgtacatgaga

SEQ ID NO: 1301752 - DNA, 17 bp, Homo sapiens
atatgttgaatactttt

SEQ ID NO: 1301753 - DNA, 17 bp, Homo sapiens
atattgtgtttgtgtat

SEQ ID NO: 1301754 - DNA, 14 bp, Homo sapiens
atatttataaaact

SEQ ID NO: 1301755 - DNA, 12 bp, Homo sapiens
atcaaaatgctt

SEQ ID NO: 1301756 - DNA, 13 bp, Homo sapiens
atcaaaatgcttt

SEQ ID NO: 1301757 - DNA, 16 bp, Homo sapiens
atcaagtatttgggaa

SEQ ID NO: 1301758 - DNA, 16 bp, Homo sapiens
atcactgtctttccta

SEQ ID NO: 1301759 - DNA, 21 bp, Homo sapiens
atcactgtctttcctagatgg

SEQ ID NO: 1301760 - DNA, 22 bp, Homo sapiens
atcagaactcaaatggggccag

SEQ ID NO: 1301761 - DNA, 23 bp, Homo sapiens
atcagaactcaaatggggccaga

SEQ ID NO: 1301762 - DNA, 24 bp, Homo sapiens
atccaatattttctttaatgcttt

SEQ ID NO: 1301763 - DNA, 15 bp, Homo sapiens
atccaggcagatcca

SEQ ID NO: 1301764 - DNA, 22 bp, Homo sapiens
atccaggcagatccaggactat

SEQ ID NO: 1301765 - DNA, 16 bp, Homo sapiens
atccagggacagaggc

SEQ ID NO: 1301766 - DNA, 18 bp, Homo sapiens
atccatattgagtcaaat

SEQ ID NO: 1301767 - DNA, 16 bp, Homo sapiens
atccattctttctgat

SEQ ID NO: 1301768 - DNA, 23 bp, Homo sapiens
atcccaactgtctttttttccct

SEQ ID NO: 1301769 - DNA, 22 bp, Homo sapiens
atcccagcactttgggaggctg

SEQ ID NO: 1301770 - DNA, 19 bp, Homo sapiens
atcccccccacctctccct

SEQ ID NO: 1301771 - DNA, 22 bp, Homo sapiens
atccctttattaccccctcctt

SEQ ID NO: 1301772 - DNA, 18 bp, Homo sapiens
atcctgaaatagaggcta

SEQ ID NO: 1301773 - DNA, 19 bp, Homo sapiens
atctaaaagaaatgtctat

SEQ ID NO: 1301774 - DNA, 16 bp, Homo sapiens
atctatacatatcttt

SEQ ID NO: 1301775 - DNA, 20 bp, Homo sapiens
atctcagatcagtgtaccat

SEQ ID NO: 1301776 - DNA, 21 bp, Homo sapiens
atctcatgcccctggctggga

SEQ ID NO: 1301777 - DNA, 18 bp, Homo sapiens
atctcccacctagcagca

SEQ ID NO: 1301778 - DNA, 20 bp, Homo sapiens
atctcccacctagcagcacc

SEQ ID NO: 1301779 - DNA, 18 bp, Homo sapiens
atctcttagcattttaat

SEQ ID NO: 1301780 - DNA, 18 bp, Homo sapiens
atctcttagctcccctcc

SEQ ID NO: 1301781 - DNA, 20 bp, Homo sapiens
atctgacatgattccttcct

SEQ ID NO: 1301782 - DNA, 12 bp, Homo sapiens
atctgacccagt

SEQ ID NO: 1301783 - DNA, 14 bp, Homo sapiens
atctgctctccttc

SEQ ID NO: 1301784 - DNA, 15 bp, Homo sapiens
atctgctctccttcc

SEQ ID NO: 1301785 - DNA, 16 bp, Homo sapiens
atctgctctccttcct

SEQ ID NO: 1301786 - DNA, 20 bp, Homo sapiens
atctgctctccttcctggag

SEQ ID NO: 1301787 - DNA, 14 bp, Homo sapiens
atctgctggagttt

SEQ ID NO: 1301788 - DNA, 11 bp, Homo sapiens
atctggaacct

SEQ ID NO: 1301789 - DNA, 16 bp, Homo sapiens
atctggaacctcagcc

SEQ ID NO: 1301790 - DNA, 18 bp, Homo sapiens
atctggaacctcagcctg

SEQ ID NO: 1301791 - DNA, 22 bp, Homo sapiens
atctggaacctcagcctggcca

SEQ ID NO: 1301792 - DNA, 17 bp, Homo sapiens
atctggtcctacccatc

SEQ ID NO: 1301793 - DNA, 17 bp, Homo sapiens
atctgtcctcagccttg

SEQ ID NO: 1301794 - DNA, 21 bp, Homo sapiens
atctgtcctcagccttgccag

SEQ ID NO: 1301795 - DNA, 16 bp, Homo sapiens
atctgtgcactgccca

SEQ ID NO: 1301796 - DNA, 18 bp, Homo sapiens
atcttatcatggtctcag

SEQ ID NO: 1301797 - DNA, 13 bp, Homo sapiens
atcttattcacat

SEQ ID NO: 1301798 - DNA, 14 bp, Homo sapiens
atctttgattctcc

SEQ ID NO: 1301799 - DNA, 18 bp, Homo sapiens
atctttgattctccttca

SEQ ID NO: 1301800 - DNA, 19 bp, Homo sapiens
atctttgattctccttcag

SEQ ID NO: 1301801 - DNA, 13 bp, Homo sapiens
atctttgtggcca

SEQ ID NO: 1301802 - DNA, 22 bp, Homo sapiens
atcttttacaactgcctcgaaa

SEQ ID NO: 1301803 - DNA, 14 bp, Homo sapiens
atcttttcttgcct

SEQ ID NO: 1301804 - DNA, 12 bp, Homo sapiens
atgaaaacttat

SEQ ID NO: 1301805 - DNA, 23 bp, Homo sapiens
atgagaatctacccccagatcca

SEQ ID NO: 1301806 - DNA, 12 bp, Homo sapiens
atgatgaatgag

SEQ ID NO: 1301807 - DNA, 15 bp, Homo sapiens
atgatgaatgagaat

SEQ ID NO: 1301808 - DNA, 16 bp, Homo sapiens
atgattaattcacctt

SEQ ID NO: 1301809 - DNA, 13 bp, Homo sapiens
atgattccttcct

SEQ ID NO: 1301810 - DNA, 23 bp, Homo sapiens
atgattctatttatatgtacatg

SEQ ID NO: 1301811 - DNA, 16 bp, Homo sapiens
atgatttccttgaatg

SEQ ID NO: 1301812 - DNA, 18 bp, Homo sapiens
atgatttccttgaatgtg

SEQ ID NO: 1301813 - DNA, 20 bp, Homo sapiens
atgatttccttgaatgtggc

SEQ ID NO: 1301814 - DNA, 18 bp, Homo sapiens
atgcactgtgaaggaccc

SEQ ID NO: 1301815 - DNA, 19 bp, Homo sapiens
atgcactgtgaaggaccct

SEQ ID NO: 1301816 - DNA, 20 bp, Homo sapiens
atgcagcagggatgccctgg

SEQ ID NO: 1301817 - DNA, 14 bp, Homo sapiens
atgcatctagatta

SEQ ID NO: 1301818 - DNA, 20 bp, Homo sapiens
atgcatggtgccccaggacc

SEQ ID NO: 1301819 - DNA, 22 bp, Homo sapiens
atgcatggtgccccaggaccag

SEQ ID NO: 1301820 - DNA, 14 bp, Homo sapiens
atgccctggaggtg

SEQ ID NO: 1301821 - DNA, 23 bp, Homo sapiens
atgccctgtgcaacctcttggcc

SEQ ID NO: 1301822 - DNA, 24 bp, Homo sapiens
atgcctcagccctgaccctgtgga

SEQ ID NO: 1301823 - DNA, 18 bp, Homo sapiens
atgcggtagccagcacac

SEQ ID NO: 1301824 - DNA, 16 bp, Homo sapiens
atgctctagtgccttc

SEQ ID NO: 1301825 - DNA, 20 bp, Homo sapiens
atgctgacattcacctgccc

SEQ ID NO: 1301826 - DNA, 18 bp, Homo sapiens
atgctgcaggacttgaga

SEQ ID NO: 1301827 - DNA, 12 bp, Homo sapiens
atgctgcccctc

SEQ ID NO: 1301828 - DNA, 19 bp, Homo sapiens
atgctggcccagggcccag

SEQ ID NO: 1301829 - DNA, 21 bp, Homo sapiens
atgctggcccagggcccagag

SEQ ID NO: 1301830 - DNA, 23 bp, Homo sapiens
atgctggcccagggcccagagcc

SEQ ID NO: 1301831 - DNA, 16 bp, Homo sapiens
cactcattgctgagcc

SEQ ID NO: 1301832 - DNA, 19 bp, Homo sapiens
cactcattgctgagcctct

SEQ ID NO: 1301833 - DNA, 23 bp, Homo sapiens
cactcattgctgagcctctgctc

SEQ ID NO: 1301834 - DNA, 18 bp, Homo sapiens
cactctcccccaccccct

SEQ ID NO: 1301835 - DNA, 19 bp, Homo sapiens
cactgatgctgcccctcat

SEQ ID NO: 1301836 - DNA, 15 bp, Homo sapiens
cactggatgcagaaa

SEQ ID NO: 1301837 - DNA, 14 bp, Homo sapiens
cactggggcctaca

SEQ ID NO: 1301838 - DNA, 20 bp, Homo sapiens
cactggttgcacttatgatt

SEQ ID NO: 1301839 - DNA, 15 bp, Homo sapiens
cactgtgaaggaccc

SEQ ID NO: 1301840 - DNA, 14 bp, Homo sapiens
cactgtgaccccca

SEQ ID NO: 1301841 - DNA, 15 bp, Homo sapiens
cactgtgacccccag

SEQ ID NO: 1301842 - DNA, 23 bp, Homo sapiens
cactgtgacccccagctccggcc

SEQ ID NO: 1301843 - DNA, 18 bp, Homo sapiens
cacttctgggtggggcag

SEQ ID NO: 1301844 - DNA, 17 bp, Homo sapiens
cactttagggctgtaaa

SEQ ID NO: 1301845 - DNA, 23 bp, Homo sapiens
cagaaaatgttgagaatcccaaa

SEQ ID NO: 1301846 - DNA, 17 bp, Homo sapiens
cagaactaaactcattt

SEQ ID NO: 1301847 - DNA, 14 bp, Homo sapiens
cagaagggggtggt

SEQ ID NO: 1301848 - DNA, 22 bp, Homo sapiens
cagaatagccacatttggaata

SEQ ID NO: 1301849 - DNA, 13 bp, Homo sapiens
cagacacccagga

SEQ ID NO: 1301850 - DNA, 15 bp, Homo sapiens
cagacaccctcaacc

SEQ ID NO: 1301851 - DNA, 18 bp, Homo sapiens
cagacatgccacaaggac

SEQ ID NO: 1301852 - DNA, 22 bp, Homo sapiens
cagacatgttttccgtgaaaac

SEQ ID NO: 1301853 - DNA, 14 bp, Homo sapiens
cagacattggcacc

SEQ ID NO: 1301854 - DNA, 15 bp, Homo sapiens
cagacctaatgctcc

SEQ ID NO: 1301855 - DNA, 16 bp, Homo sapiens
cagacctaatgctcct

SEQ ID NO: 1301856 - DNA, 17 bp, Homo sapiens
cagacctaatgctcctt

SEQ ID NO: 1301857 - DNA, 18 bp, Homo sapiens
cagacctaatgctccttg

SEQ ID NO: 1301858 - DNA, 14 bp, Homo sapiens
cagacctgatcctg

SEQ ID NO: 1301859 - DNA, 17 bp, Homo sapiens
cagacctgatcctggag

SEQ ID NO: 1301860 - DNA, 20 bp, Homo sapiens
cagactcacaacctgaacct

SEQ ID NO: 1301861 - DNA, 17 bp, Homo sapiens
cagactcccattcctga

SEQ ID NO: 1301862 - DNA, 19 bp, Homo sapiens
cagagaaaggggagcccac

SEQ ID NO: 1301863 - DNA, 16 bp, Homo sapiens
cagagacatacttgaa

SEQ ID NO: 1301864 - DNA, 20 bp, Homo sapiens
cagagacatacttgaagggc

SEQ ID NO: 1301865 - DNA, 21 bp, Homo sapiens
cagagacatacttgaagggcc

SEQ ID NO: 1301866 - DNA, 20 bp, Homo sapiens
cagagagcctggtgctgctg

SEQ ID NO: 1301867 - DNA, 23 bp, Homo sapiens
cagagatccaaaagaagccccca

SEQ ID NO: 1301868 - DNA, 14 bp, Homo sapiens
cagagcccagctcc

SEQ ID NO: 1301869 - DNA, 19 bp, Homo sapiens
cagaggaggggccgctgcc

SEQ ID NO: 1301870 - DNA, 20 bp, Homo sapiens
cagaggaggggccgctgcca

SEQ ID NO: 1301871 - DNA, 14 bp, Homo sapiens
cagaggccccagcc

SEQ ID NO: 1301872 - DNA, 18 bp, Homo sapiens
cagatccagcctggggtc

SEQ ID NO: 1301873 - DNA, 15 bp, Homo sapiens
cagatccagggacag

SEQ ID NO: 1301874 - DNA, 15 bp, Homo sapiens
cagatccagggactg

SEQ ID NO: 1301875 - DNA, 22 bp, Homo sapiens
cagatctgacatgattccttcc

SEQ ID NO: 1301876 - DNA, 22 bp, Homo sapiens
cagatctggaacctcagcctgg

SEQ ID NO: 1301877 - DNA, 15 bp, Homo sapiens
cagatgtttccagac

SEQ ID NO: 1301878 - DNA, 16 bp, Homo sapiens
cagatgtttccagact

SEQ ID NO: 1301879 - DNA, 23 bp, Homo sapiens
cagattttaattttgaataaata

SEQ ID NO: 1301880 - DNA, 17 bp, Homo sapiens
cagattttgctgtatat

SEQ ID NO: 1301881 - DNA, 13 bp, Homo sapiens
cagcaaccccagg

SEQ ID NO: 1301882 - DNA, 13 bp, Homo sapiens
cagcacaaggcca

SEQ ID NO: 1301883 - DNA, 13 bp, Homo sapiens
cagcacagccaac

SEQ ID NO: 1301884 - DNA, 18 bp, Homo sapiens
cagcaccgttctgtgcac

SEQ ID NO: 1301885 - DNA, 15 bp, Homo sapiens
cagcagggatgccct

SEQ ID NO: 1301886 - DNA, 22 bp, Homo sapiens
cagcagggatgccctggaggtg

SEQ ID NO: 1301887 - DNA, 13 bp, Homo sapiens
cagccatcaaaat

SEQ ID NO: 1301888 - DNA, 17 bp, Homo sapiens
cagccatgtctgcattt

SEQ ID NO: 1301889 - DNA, 11 bp, Homo sapiens
cagcccagaga

SEQ ID NO: 1301890 - DNA, 12 bp, Homo sapiens
cagcccagagac

SEQ ID NO: 1301891 - DNA, 13 bp, Homo sapiens
cagcccagagaca

SEQ ID NO: 1301892 - DNA, 21 bp, Homo sapiens
cagcccctggccccaggacct

SEQ ID NO: 1301893 - DNA, 17 bp, Homo sapiens
cagccccttgagaaacc

SEQ ID NO: 1301894 - DNA, 15 bp, Homo sapiens
cagccctcacccctg

SEQ ID NO: 1301895 - DNA, 16 bp, Homo sapiens
cagccctgaccctgtg

SEQ ID NO: 1301896 - DNA, 19 bp, Homo sapiens
cagcctcccatccagggcc

SEQ ID NO: 1301897 - DNA, 14 bp, Homo sapiens
cagcctccctgaag

SEQ ID NO: 1301898 - DNA, 18 bp, Homo sapiens
cagcctccctgaagcctt

SEQ ID NO: 1301899 - DNA, 21 bp, Homo sapiens
cagcctgagcaactcttgatt

SEQ ID NO: 1301900 - DNA, 20 bp, Homo sapiens
cagcctggtcaacatggtga

SEQ ID NO: 1301901 - DNA, 22 bp, Homo sapiens
cagcgccaggctgaccacagca

SEQ ID NO: 1301902 - DNA, 12 bp, Homo sapiens
cagctaagaaaa

SEQ ID NO: 1301903 - DNA, 14 bp, Homo sapiens
cagctaagaacctg

SEQ ID NO: 1301904 - DNA, 16 bp, Homo sapiens
cagctcaggacagatg

SEQ ID NO: 1301905 - DNA, 13 bp, Homo sapiens
cagctcaggatct

SEQ ID NO: 1301906 - DNA, 14 bp, Homo sapiens
cagctccaacctgc

SEQ ID NO: 1301907 - DNA, 23 bp, Homo sapiens
cagctccaacctgcaaagatctg

SEQ ID NO: 1301908 - DNA, 15 bp, Homo sapiens
cagctccaccctggc

SEQ ID NO: 1301909 - DNA, 21 bp, Homo sapiens
cagctctggacagccccaccc

SEQ ID NO: 1301910 - DNA, 23 bp, Homo sapiens
cagctctggacagccccaccctg

SEQ ID NO: 1301911 - DNA, 22 bp, Homo sapiens
cagctctgggccattctccaca

SEQ ID NO: 1301912 - DNA, 18 bp, Homo sapiens
cagctctttcctccttcc

SEQ ID NO: 1301913 - DNA, 21 bp, Homo sapiens
cagctctttcctccttccatg

SEQ ID NO: 1301914 - DNA, 16 bp, Homo sapiens
cagctgaattatctat

SEQ ID NO: 1301915 - DNA, 14 bp, Homo sapiens
cagctgagcgccag

SEQ ID NO: 1301916 - DNA, 20 bp, Homo sapiens
cagctgatgagttacagcct

SEQ ID NO: 1301917 - DNA, 12 bp, Homo sapiens
cagctgcactga

SEQ ID NO: 1301918 - DNA, 12 bp, Homo sapiens
cagctgctccta

SEQ ID NO: 1301919 - DNA, 18 bp, Homo sapiens
cagctgctcctagaggga

SEQ ID NO: 1301920 - DNA, 19 bp, Homo sapiens
cagctgctcctagagggag

SEQ ID NO: 1301921 - DNA, 15 bp, Homo sapiens
cagcttctcctgtgt

SEQ ID NO: 1301922 - DNA, 17 bp, Homo sapiens
cagcttgttatttataa

SEQ ID NO: 1301923 - DNA, 17 bp, Homo sapiens
cagctttgatccctgac

SEQ ID NO: 1301924 - DNA, 20 bp, Homo sapiens
cagctttgatccctgacatc

SEQ ID NO: 1301925 - DNA, 17 bp, Homo sapiens
caggaatgtgtggcctg

SEQ ID NO: 1301926 - DNA, 15 bp, Homo sapiens
caggacacagtcaga

SEQ ID NO: 1301927 - DNA, 13 bp, Homo sapiens
caggacagatgcc

SEQ ID NO: 1301928 - DNA, 18 bp, Homo sapiens
caggacatgcggtagcca

SEQ ID NO: 1301929 - DNA, 20 bp, Homo sapiens
caggacatgcggtagccagc

SEQ ID NO: 1301930 - DNA, 21 bp, Homo sapiens
caggacatgcggtagccagca

SEQ ID NO: 1301931 - DNA, 12 bp, Homo sapiens
caggaccagctc

SEQ ID NO: 1301932 - DNA, 15 bp, Homo sapiens
caggaccctgaaggg

SEQ ID NO: 1301933 - DNA, 18 bp, Homo sapiens
caggaccctgaaggggcc

SEQ ID NO: 1301934 - DNA, 15 bp, Homo sapiens
caggactgggccact

SEQ ID NO: 1301935 - DNA, 15 bp, Homo sapiens
caggcagggtgcagt

SEQ ID NO: 1301936 - DNA, 17 bp, Homo sapiens
caggcagttggccagag

SEQ ID NO: 1301937 - DNA, 18 bp, Homo sapiens
caggccccaggcagggcc

SEQ ID NO: 1301938 - DNA, 21 bp, Homo sapiens
caggccccgtgaggcaatggg

SEQ ID NO: 1301939 - DNA, 23 bp, Homo sapiens
caggccctccctgttccccagag

SEQ ID NO: 1301940 - DNA, 14 bp, Homo sapiens
caggccgccctgcg

SEQ ID NO: 1301941 - DNA, 14 bp, Homo sapiens
caggcctgagattt

SEQ ID NO: 1301942 - DNA, 16 bp, Homo sapiens
caggcctgagatttca

SEQ ID NO: 1301943 - DNA, 19 bp, Homo sapiens
caggcctgagatttcatct

SEQ ID NO: 1301944 - DNA, 17 bp, Homo sapiens
caggctgaccacagcac

SEQ ID NO: 1301945 - DNA, 22 bp, Homo sapiens
caggctgaccacagcacagcca

SEQ ID NO: 1301946 - DNA, 19 bp, Homo sapiens
cagggacagaggccccagc

SEQ ID NO: 1301947 - DNA, 21 bp, Homo sapiens
cagggacagaggccccagcct

SEQ ID NO: 1301948 - DNA, 13 bp, Homo sapiens
cagggagaagctc

SEQ ID NO: 1301949 - DNA, 19 bp, Homo sapiens
cagggagacccgtccattt

SEQ ID NO: 1301950 - DNA, 22 bp, Homo sapiens
cagggagcctttggttctggcc

SEQ ID NO: 1301951 - DNA, 13 bp, Homo sapiens
cagggatgccctg

SEQ ID NO: 1301952 - DNA, 16 bp, Homo sapiens
cagggatgccctggag

SEQ ID NO: 1301953 - DNA, 13 bp, Homo sapiens
cagggccaaccct

SEQ ID NO: 1301954 - DNA, 12 bp, Homo sapiens
cagggcccagag

SEQ ID NO: 1301955 - DNA, 13 bp, Homo sapiens
cagggcccagagc

SEQ ID NO: 1301956 - DNA, 14 bp, Homo sapiens
cagggcccagagcc

SEQ ID NO: 1301957 - DNA, 16 bp, Homo sapiens
cagggcccagagccca

SEQ ID NO: 1301958 - DNA, 18 bp, Homo sapiens
cagggcccagagcccagc

SEQ ID NO: 1301959 - DNA, 19 bp, Homo sapiens
cagggcccagagcccagct

SEQ ID NO: 1301960 - DNA, 16 bp, Homo sapiens
cagggcccccatctca

SEQ ID NO: 1301961 - DNA, 17 bp, Homo sapiens
cagggctggactgaggc

SEQ ID NO: 1301962 - DNA, 20 bp, Homo sapiens
cagggctggactgaggcctg

SEQ ID NO: 1301963 - DNA, 21 bp, Homo sapiens
cagggctggactgaggcctga

SEQ ID NO: 1301964 - DNA, 23 bp, Homo sapiens
cagggctggactgaggcctgagc

SEQ ID NO: 1301965 - DNA, 18 bp, Homo sapiens
caggggggtgaggagctg

SEQ ID NO: 1301966 - DNA, 19 bp, Homo sapiens
caggggggtgaggagctgg

SEQ ID NO: 1301967 - DNA, 22 bp, Homo sapiens
caggggtggctgcctcatttag

SEQ ID NO: 1301968 - DNA, 20 bp, Homo sapiens
caggtcttcatcgaatctac

SEQ ID NO: 1301969 - DNA, 13 bp, Homo sapiens
caggtggccatgc

SEQ ID NO: 1301970 - DNA, 15 bp, Homo sapiens
caggttcccaagctc

SEQ ID NO: 1301971 - DNA, 14 bp, Homo sapiens
cagtataaacaaag

SEQ ID NO: 1301972 - DNA, 13 bp, Homo sapiens
cagtatcatgccc

SEQ ID NO: 1301973 - DNA, 20 bp, Homo sapiens
cagtatcatgccctgtgcaa

SEQ ID NO: 1301974 - DNA, 14 bp, Homo sapiens
cagtcacagccacc

SEQ ID NO: 1301975 - DNA, 21 bp, Homo sapiens
cagtcattggctgtctcctag

SEQ ID NO: 1301976 - DNA, 16 bp, Homo sapiens
cagtctccaccaggaa

SEQ ID NO: 1301977 - DNA, 17 bp, Homo sapiens
cagtctccaccaggaac

SEQ ID NO: 1301978 - DNA, 21 bp, Homo sapiens
cagtgagggagggctgtcatc

SEQ ID NO: 1301979 - DNA, 20 bp, Homo sapiens
cagttctttgggccagacat

SEQ ID NO: 1301980 - DNA, 17 bp, Homo sapiens
cagttggccagagagcc

SEQ ID NO: 1301981 - DNA, 17 bp, Homo sapiens
cagttgggtgagaacaa

SEQ ID NO: 1301982 - DNA, 16 bp, Homo sapiens
cagtttaaaaaaattg

SEQ ID NO: 1301983 - DNA, 14 bp, Homo sapiens
cataatggggtcct

SEQ ID NO: 1301984 - DNA, 14 bp, Homo sapiens
catacaccagcatt

SEQ ID NO: 1301985 - DNA, 18 bp, Homo sapiens
catacaccagcattcctt

SEQ ID NO: 1301986 - DNA, 18 bp, Homo sapiens
catactatctactctcct

SEQ ID NO: 1301987 - DNA, 13 bp, Homo sapiens
catacttgaaggg

SEQ ID NO: 1301988 - DNA, 18 bp, Homo sapiens
catacttgaagggccaga

SEQ ID NO: 1301989 - DNA, 18 bp, Homo sapiens
catagcagattttaattt

SEQ ID NO: 1301990 - DNA, 17 bp, Homo sapiens
catagcatgacatttct

SEQ ID NO: 1301991 - DNA, 18 bp, Homo sapiens
catagcatgacatttctt

SEQ ID NO: 1301992 - DNA, 23 bp, Homo sapiens
cataggactcaaagtttcagaga

SEQ ID NO: 1301993 - DNA, 17 bp, Homo sapiens
cataggaggcttctgtt

SEQ ID NO: 1301994 - DNA, 22 bp, Homo sapiens
catagtaacttcttatggaatt

SEQ ID NO: 1301995 - DNA, 24 bp, Homo sapiens
catagtaacttcttatggaattga

SEQ ID NO: 1301996 - DNA, 22 bp, Homo sapiens
catagtaccatttatacaaatt

SEQ ID NO: 1301997 - DNA, 18 bp, Homo sapiens
catatgttgaatactttt

SEQ ID NO: 1301998 - DNA, 19 bp, Homo sapiens
catatgttgaatacttttt

SEQ ID NO: 1301999 - DNA, 21 bp, Homo sapiens
catattgctgagagaaatatg

SEQ ID NO: 1302000 - DNA, 23 bp, Homo sapiens
catattgctgagagaaatatgga

SEQ ID NO: 1302001 - DNA, 13 bp, Homo sapiens
catcaaaatgctt

SEQ ID NO: 1302002 - DNA, 15 bp, Homo sapiens
catcaaaatgctttt

SEQ ID NO: 1302003 - DNA, 23 bp, Homo sapiens
catccaaaatagttaagacatga

SEQ ID NO: 1302004 - DNA, 17 bp, Homo sapiens
catccaaagcagacagc

SEQ ID NO: 1302005 - DNA, 23 bp, Homo sapiens
catccagtctcccaacttgtatt

SEQ ID NO: 1302006 - DNA, 15 bp, Homo sapiens
catcccacaagtggt

SEQ ID NO: 1302007 - DNA, 13 bp, Homo sapiens
catcctccagcag

SEQ ID NO: 1302008 - DNA, 14 bp, Homo sapiens
catctattttggat

SEQ ID NO: 1302009 - DNA, 22 bp, Homo sapiens
catctcatgcccctggctggga

SEQ ID NO: 1302010 - DNA, 21 bp, Homo sapiens
catctcccacctagcagcacc

SEQ ID NO: 1302011 - DNA, 16 bp, Homo sapiens
catctctaacagctca

SEQ ID NO: 1302012 - DNA, 18 bp, Homo sapiens
catctctaacagctcagg

SEQ ID NO: 1302013 - DNA, 21 bp, Homo sapiens
catctctaacagctcaggatc

SEQ ID NO: 1302014 - DNA, 22 bp, Homo sapiens
catctctaacagctcaggatct

SEQ ID NO: 1302015 - DNA, 23 bp, Homo sapiens
catctctaacagctcaggatctc

SEQ ID NO: 1302016 - DNA, 15 bp, Homo sapiens
catctctctgcccaa

SEQ ID NO: 1302017 - DNA, 12 bp, Homo sapiens
catctctgcttg

SEQ ID NO: 1302018 - DNA, 23 bp, Homo sapiens
catctcttagctcccctccaacc

SEQ ID NO: 1302019 - DNA, 14 bp, Homo sapiens
catctgaccagcag

SEQ ID NO: 1302020 - DNA, 20 bp, Homo sapiens
catctgccgtgcctggatcc

SEQ ID NO: 1302021 - DNA, 14 bp, Homo sapiens
catctgctctcctt

SEQ ID NO: 1302022 - DNA, 16 bp, Homo sapiens
catctgctctccttcc

SEQ ID NO: 1302023 - DNA, 21 bp, Homo sapiens
catctggaatctggagaccag

SEQ ID NO: 1302024 - DNA, 18 bp, Homo sapiens
catctgtgcactgcccat

SEQ ID NO: 1302025 - DNA, 14 bp, Homo sapiens
catcttttcttgcc

SEQ ID NO: 1302026 - DNA, 16 bp, Homo sapiens
catcttttcttgcctc

SEQ ID NO: 1302027 - DNA, 15 bp, Homo sapiens
catgatggcaacaga

SEQ ID NO: 1302028 - DNA, 19 bp, Homo sapiens
catgatggcaacagatctg

SEQ ID NO: 1302029 - DNA, 20 bp, Homo sapiens
catgatggcaacagatctgg

SEQ ID NO: 1302030 - DNA, 13 bp, Homo sapiens
catgcactgtgaa

SEQ ID NO: 1302031 - DNA, 13 bp, Homo sapiens
catgccctcctct

SEQ ID NO: 1302032 - DNA, 15 bp, Homo sapiens
catgccctcctctcc

SEQ ID NO: 1302033 - DNA, 20 bp, Homo sapiens
catgccctcctctcccattg

SEQ ID NO: 1302034 - DNA, 23 bp, Homo sapiens
catgccctgtgcaacctcttggc

SEQ ID NO: 1302035 - DNA, 16 bp, Homo sapiens
catgcggtagccagca

SEQ ID NO: 1302036 - DNA, 21 bp, Homo sapiens
catgcggtagccagcacacag

SEQ ID NO: 1302037 - DNA, 15 bp, Homo sapiens
catggacaggctggc

SEQ ID NO: 1302038 - DNA, 16 bp, Homo sapiens
catggacaggctggct

SEQ ID NO: 1302039 - DNA, 14 bp, Homo sapiens
catggagccagctc

SEQ ID NO: 1302040 - DNA, 17 bp, Homo sapiens
catggagccagctccct

SEQ ID NO: 1302041 - DNA, 19 bp, Homo sapiens
catggatgggggaactcag

SEQ ID NO: 1302042 - DNA, 14 bp, Homo sapiens
catggtcacacact

SEQ ID NO: 1302043 - DNA, 17 bp, Homo sapiens
catggtgccccaggacc

SEQ ID NO: 1302044 - DNA, 18 bp, Homo sapiens
catggtgccccaggacca

SEQ ID NO: 1302045 - DNA, 20 bp, Homo sapiens
catgtagccccctggcctct

SEQ ID NO: 1302046 - DNA, 23 bp, Homo sapiens
catgtctgcatttcggtggctag

SEQ ID NO: 1302047 - DNA, 13 bp, Homo sapiens
cattaaattcaca

SEQ ID NO: 1302048 - DNA, 17 bp, Homo sapiens
cattagggggaactcta

SEQ ID NO: 1302049 - DNA, 12 bp, Homo sapiens
cattcaacaaga

SEQ ID NO: 1302050 - DNA, 16 bp, Homo sapiens
cattcctgaagaacca

SEQ ID NO: 1302051 - DNA, 15 bp, Homo sapiens
cattctccacagcaa

SEQ ID NO: 1302052 - DNA, 17 bp, Homo sapiens
cattcttgaaagctgtg

SEQ ID NO: 1302053 - DNA, 17 bp, Homo sapiens
cattctttctgataact

SEQ ID NO: 1302054 - DNA, 16 bp, Homo sapiens
cattcttttgtaattt

SEQ ID NO: 1302055 - DNA, 19 bp, Homo sapiens
cattcttttgtaatttaaa

SEQ ID NO: 1302056 - DNA, 15 bp, Homo sapiens
cattgaacacaaact

SEQ ID NO: 1302057 - DNA, 16 bp, Homo sapiens
cattgaacacaaactg

SEQ ID NO: 1302058 - DNA, 21 bp, Homo sapiens
cattgaccgcgactaatttca

SEQ ID NO: 1302059 - DNA, 23 bp, Homo sapiens
cattgcgtttgaccttttatgta

SEQ ID NO: 1302060 - DNA, 18 bp, Homo sapiens
cattgctgagcctctgct

SEQ ID NO: 1302061 - DNA, 21 bp, Homo sapiens
cattgctgagcctctgctccc

SEQ ID NO: 1302062 - DNA, 20 bp, Homo sapiens
cattggcacctaatccaggc

SEQ ID NO: 1302063 - DNA, 21 bp, Homo sapiens
cattgtccctctgccccatcc

SEQ ID NO: 1302064 - DNA, 21 bp, Homo sapiens
cccgagtcattcgttctgtgg

SEQ ID NO: 1302065 - DNA, 19 bp, Homo sapiens
cccgcagtgtgcactaagg

SEQ ID NO: 1302066 - DNA, 22 bp, Homo sapiens
cccgcagtgtgcactaaggggc

SEQ ID NO: 1302067 - DNA, 21 bp, Homo sapiens
cccggggtgcccacaggccgc

SEQ ID NO: 1302068 - DNA, 23 bp, Homo sapiens
ccctactattcagtggcgagaaa

SEQ ID NO: 1302069 - DNA, 16 bp, Homo sapiens
ccctcaacctcttctg

SEQ ID NO: 1302070 - DNA, 17 bp, Homo sapiens
ccctcaagaggaagtga

SEQ ID NO: 1302071 - DNA, 21 bp, Homo sapiens
ccctcaccttggcaccagaca

SEQ ID NO: 1302072 - DNA, 17 bp, Homo sapiens
ccctcatctctctgccc

SEQ ID NO: 1302073 - DNA, 17 bp, Homo sapiens
ccctccccgcccttttt

SEQ ID NO: 1302074 - DNA, 13 bp, Homo sapiens
ccctccctttctc

SEQ ID NO: 1302075 - DNA, 14 bp, Homo sapiens
ccctccctttctcc

SEQ ID NO: 1302076 - DNA, 12 bp, Homo sapiens
ccctccttcaga

SEQ ID NO: 1302077 - DNA, 18 bp, Homo sapiens
ccctctgccccatcctcc

SEQ ID NO: 1302078 - DNA, 12 bp, Homo sapiens
ccctgaccctgt

SEQ ID NO: 1302079 - DNA, 15 bp, Homo sapiens
ccctgaccctgtgga

SEQ ID NO: 1302080 - DNA, 17 bp, Homo sapiens
ccctgacctccctctaa

SEQ ID NO: 1302081 - DNA, 23 bp, Homo sapiens
ccctgatttaggagaagccagga

SEQ ID NO: 1302082 - DNA, 13 bp, Homo sapiens
ccctgcccccagg

SEQ ID NO: 1302083 - DNA, 14 bp, Homo sapiens
ccctgcccccagga

SEQ ID NO: 1302084 - DNA, 20 bp, Homo sapiens
ccctgcccccaggactgggc

SEQ ID NO: 1302085 - DNA, 23 bp, Homo sapiens
ccctgcccccaggactgggccac

SEQ ID NO: 1302086 - DNA, 13 bp, Homo sapiens
ccctggaggtggc

SEQ ID NO: 1302087 - DNA, 13 bp, Homo sapiens
ccctggccccagg

SEQ ID NO: 1302088 - DNA, 14 bp, Homo sapiens
ccctggccccagga

SEQ ID NO: 1302089 - DNA, 20 bp, Homo sapiens
ccctggccgagtccaagctg

SEQ ID NO: 1302090 - DNA, 13 bp, Homo sapiens
ccctggcctctgt

SEQ ID NO: 1302091 - DNA, 18 bp, Homo sapiens
ccctggcctctgtgcctt

SEQ ID NO: 1302092 - DNA, 15 bp, Homo sapiens
ccctgtatatagccc

SEQ ID NO: 1302093 - DNA, 18 bp, Homo sapiens
ccctgtatatagcccagc

SEQ ID NO: 1302094 - DNA, 18 bp, Homo sapiens
cccttctcctcttgtaaa

SEQ ID NO: 1302095 - DNA, 20 bp, Homo sapiens
cccttctcctcttgtaaata

SEQ ID NO: 1302096 - DNA, 22 bp, Homo sapiens
ccctttctcccctgcccccagg

SEQ ID NO: 1302097 - DNA, 13 bp, Homo sapiens
ccgaagtcttttg

SEQ ID NO: 1302098 - DNA, 20 bp, Homo sapiens
ccgagtcattcgttctgtgg

SEQ ID NO: 1302099 - DNA, 15 bp, Homo sapiens
ccgagtccaagctgg

SEQ ID NO: 1302100 - DNA, 14 bp, Homo sapiens
ccgctgccacccac

SEQ ID NO: 1302101 - DNA, 20 bp, Homo sapiens
ccgctgccacccacctccct

SEQ ID NO: 1302102 - DNA, 23 bp, Homo sapiens
ccgctgccacccacctccctgcc

SEQ ID NO: 1302103 - DNA, 24 bp, Homo sapiens
ccgctgccacccacctccctgcct

SEQ ID NO: 1302104 - DNA, 15 bp, Homo sapiens
ccggccagccatgtc

SEQ ID NO: 1302105 - DNA, 18 bp, Homo sapiens
ccggctaatttttgtaat

SEQ ID NO: 1302106 - DNA, 17 bp, Homo sapiens
ccgtgaaaacggagctg

SEQ ID NO: 1302107 - DNA, 18 bp, Homo sapiens
ccgtgaaaacggagctga

SEQ ID NO: 1302108 - DNA, 18 bp, Homo sapiens
ccgtgctgacagctgctc

SEQ ID NO: 1302109 - DNA, 21 bp, Homo sapiens
ccgtgctgacagctgctccta

SEQ ID NO: 1302110 - DNA, 14 bp, Homo sapiens
cctaatccaggcag

SEQ ID NO: 1302111 - DNA, 19 bp, Homo sapiens
cctaatccaggcagatcca

SEQ ID NO: 1302112 - DNA, 21 bp, Homo sapiens
cctaatccaggcagatccagg

SEQ ID NO: 1302113 - DNA, 19 bp, Homo sapiens
cctaatgctccttgttcct

SEQ ID NO: 1302114 - DNA, 19 bp, Homo sapiens
cctacccatccccgcagtg

SEQ ID NO: 1302115 - DNA, 15 bp, Homo sapiens
cctagagggaggggc

SEQ ID NO: 1302116 - DNA, 18 bp, Homo sapiens
cctagagggaggggccta

SEQ ID NO: 1302117 - DNA, 22 bp, Homo sapiens
cctagagtagagtggagggagg

SEQ ID NO: 1302118 - DNA, 23 bp, Homo sapiens
cctagatggcagtcactgaattc

SEQ ID NO: 1302119 - DNA, 12 bp, Homo sapiens
cctagcagcacc

SEQ ID NO: 1302120 - DNA, 14 bp, Homo sapiens
cctaggcctcagcc

SEQ ID NO: 1302121 - DNA, 20 bp, Homo sapiens
cctaggcctcagccagagaa

SEQ ID NO: 1302122 - DNA, 16 bp, Homo sapiens
cctatcacctatttcc

SEQ ID NO: 1302123 - DNA, 12 bp, Homo sapiens
cctcaacctctt

SEQ ID NO: 1302124 - DNA, 17 bp, Homo sapiens
cctcaacctcttctggc

SEQ ID NO: 1302125 - DNA, 20 bp, Homo sapiens
cctcaacctcttctggctca

SEQ ID NO: 1302126 - DNA, 16 bp, Homo sapiens
cctcaagaaataaaag

SEQ ID NO: 1302127 - DNA, 15 bp, Homo sapiens
cctcacaggccccag

SEQ ID NO: 1302128 - DNA, 22 bp, Homo sapiens
cctcacccctggttctcatctt

SEQ ID NO: 1302129 - DNA, 21 bp, Homo sapiens
cctcaccttggcaccagacac

SEQ ID NO: 1302130 - DNA, 11 bp, Homo sapiens
cctcagccaga

SEQ ID NO: 1302131 - DNA, 15 bp, Homo sapiens
cctcagccagagaag

SEQ ID NO: 1302132 - DNA, 17 bp, Homo sapiens
cctcagccagagaagct

SEQ ID NO: 1302133 - DNA, 15 bp, Homo sapiens
cctcagccctgaccc

SEQ ID NO: 1302134 - DNA, 22 bp, Homo sapiens
cctcagcctcccaagtagctgg

SEQ ID NO: 1302135 - DNA, 13 bp, Homo sapiens
cctcagcctggcc

SEQ ID NO: 1302136 - DNA, 14 bp, Homo sapiens
cctcagcctggcca

SEQ ID NO: 1302137 - DNA, 16 bp, Homo sapiens
cctcagcctggccaga

SEQ ID NO: 1302138 - DNA, 18 bp, Homo sapiens
cctcagcctggccagaca

SEQ ID NO: 1302139 - DNA, 21 bp, Homo sapiens
cctcagcctggccagacacag

SEQ ID NO: 1302140 - DNA, 18 bp, Homo sapiens
cctcagccttgccagaga

SEQ ID NO: 1302141 - DNA, 12 bp, Homo sapiens
cctcaggtggcc

SEQ ID NO: 1302142 - DNA, 14 bp, Homo sapiens
cctccactctcccc

SEQ ID NO: 1302143 - DNA, 15 bp, Homo sapiens
cctccagctctttcc

SEQ ID NO: 1302144 - DNA, 17 bp, Homo sapiens
cctccagggtgtgtgct

SEQ ID NO: 1302145 - DNA, 19 bp, Homo sapiens
cctcccccccatgcactgt

SEQ ID NO: 1302146 - DNA, 14 bp, Homo sapiens
cctccctgcatctg

SEQ ID NO: 1302147 - DNA, 19 bp, Homo sapiens
cctccctgttccccagaga

SEQ ID NO: 1302148 - DNA, 12 bp, Homo sapiens
cctccctttctc

SEQ ID NO: 1302149 - DNA, 14 bp, Homo sapiens
cctcctccctgcat

SEQ ID NO: 1302150 - DNA, 16 bp, Homo sapiens
cctcctccctgcatct

SEQ ID NO: 1302151 - DNA, 17 bp, Homo sapiens
cctcctccctgcatctg

SEQ ID NO: 1302152 - DNA, 15 bp, Homo sapiens
cctccttcagacacc

SEQ ID NO: 1302153 - DNA, 17 bp, Homo sapiens
cctctatttatgtttgc

SEQ ID NO: 1302154 - DNA, 15 bp, Homo sapiens
cctctcagtactttg

SEQ ID NO: 1302155 - DNA, 14 bp, Homo sapiens
cctctccccagccc

SEQ ID NO: 1302156 - DNA, 18 bp, Homo sapiens
cctctccccagcccagag

SEQ ID NO: 1302157 - DNA, 15 bp, Homo sapiens
cctctccctgaccct

SEQ ID NO: 1302158 - DNA, 15 bp, Homo sapiens
cctctccttcctgtg

SEQ ID NO: 1302159 - DNA, 14 bp, Homo sapiens
cctctgctccccag

SEQ ID NO: 1302160 - DNA, 16 bp, Homo sapiens
cctctgtcagtcacag

SEQ ID NO: 1302161 - DNA, 19 bp, Homo sapiens
cctctgtcagtcacagcca

SEQ ID NO: 1302162 - DNA, 14 bp, Homo sapiens
cctctgtgccttct

SEQ ID NO: 1302163 - DNA, 18 bp, Homo sapiens
cctcttcatggatggggg

SEQ ID NO: 1302164 - DNA, 13 bp, Homo sapiens
cctcttggcctga

SEQ ID NO: 1302165 - DNA, 18 bp, Homo sapiens
cctcttgtaaataaagcc

SEQ ID NO: 1302166 - DNA, 20 bp, Homo sapiens
cctcttgtaaataaagccct

SEQ ID NO: 1302167 - DNA, 14 bp, Homo sapiens
cctctttgctttgc

SEQ ID NO: 1302168 - DNA, 15 bp, Homo sapiens
cctctttgctttgct

SEQ ID NO: 1302169 - DNA, 17 bp, Homo sapiens
cctctttgctttgcttt

SEQ ID NO: 1302170 - DNA, 15 bp, Homo sapiens
cctgaaacaacttgg

SEQ ID NO: 1302171 - DNA, 19 bp, Homo sapiens
cctgaccctgtatatagcc

SEQ ID NO: 1302172 - DNA, 18 bp, Homo sapiens
cctgacctgtgagcccag

SEQ ID NO: 1302173 - DNA, 20 bp, Homo sapiens
cctgacctgtgagcccagct

SEQ ID NO: 1302174 - DNA, 22 bp, Homo sapiens
cctgacctgtgagcccagctgg

SEQ ID NO: 1302175 - DNA, 18 bp, Homo sapiens
cctgagatttcatctgct

SEQ ID NO: 1302176 - DNA, 14 bp, Homo sapiens
cctgagcaactctt

SEQ ID NO: 1302177 - DNA, 23 bp, Homo sapiens
cctgagcgctcctgccgcagagc

SEQ ID NO: 1302178 - DNA, 18 bp, Homo sapiens
cctgatcagaccacggct

SEQ ID NO: 1302179 - DNA, 19 bp, Homo sapiens
cctgatcagaccacggctc

SEQ ID NO: 1302180 - DNA, 15 bp, Homo sapiens
cctgatcctggaggc

SEQ ID NO: 1302181 - DNA, 19 bp, Homo sapiens
cctgatcctggaggcccag

SEQ ID NO: 1302182 - DNA, 13 bp, Homo sapiens
cctgatgctgaca

SEQ ID NO: 1302183 - DNA, 23 bp, Homo sapiens
cctgatgctgacattcacctgcc

SEQ ID NO: 1302184 - DNA, 19 bp, Homo sapiens
cctgcatctgaccagcagc

SEQ ID NO: 1302185 - DNA, 14 bp, Homo sapiens
cctgccagctgcac

SEQ ID NO: 1302186 - DNA, 16 bp, Homo sapiens
cctgccagctgcactg

SEQ ID NO: 1302187 - DNA, 18 bp, Homo sapiens
cctgccagctgcactgat

SEQ ID NO: 1302188 - DNA, 20 bp, Homo sapiens
cctgccccaatccctttatt

SEQ ID NO: 1302189 - DNA, 12 bp, Homo sapiens
cctgcccccagg

SEQ ID NO: 1302190 - DNA, 14 bp, Homo sapiens
cctgcccccaggac

SEQ ID NO: 1302191 - DNA, 18 bp, Homo sapiens
cctgcccccaggactggg

SEQ ID NO: 1302192 - DNA, 13 bp, Homo sapiens
cctgccgcagagc

SEQ ID NO: 1302193 - DNA, 14 bp, Homo sapiens
cctgccgcagagct

SEQ ID NO: 1302194 - DNA, 17 bp, Homo sapiens
cctgcctccagggctgg

SEQ ID NO: 1302195 - DNA, 12 bp, Homo sapiens
cctgctccagac

SEQ ID NO: 1302196 - DNA, 15 bp, Homo sapiens
cctgctccagacctg

SEQ ID NO: 1302197 - DNA, 22 bp, Homo sapiens
cctgctccagacctgatcctgg

SEQ ID NO: 1302198 - DNA, 16 bp, Homo sapiens
cctggaacttggggag

SEQ ID NO: 1302199 - DNA, 14 bp, Homo sapiens
cctggagcccagag

SEQ ID NO: 1302200 - DNA, 13 bp, Homo sapiens
cctggaggcccag

SEQ ID NO: 1302201 - DNA, 21 bp, Homo sapiens
cctggaggtggctgagcccct

SEQ ID NO: 1302202 - DNA, 12 bp, Homo sapiens
cctggcagctct

SEQ ID NO: 1302203 - DNA, 13 bp, Homo sapiens
cctggcagctctg

SEQ ID NO: 1302204 - DNA, 14 bp, Homo sapiens
cctggcagctctgg

SEQ ID NO: 1302205 - DNA, 19 bp, Homo sapiens
cctggcagctctggacagc

SEQ ID NO: 1302206 - DNA, 16 bp, Homo sapiens
cctggccagacacagg

SEQ ID NO: 1302207 - DNA, 19 bp, Homo sapiens
cctggccagacacaggccc

SEQ ID NO: 1302208 - DNA, 19 bp, Homo sapiens
cctggccatcccacaagtg

SEQ ID NO: 1302209 - DNA, 12 bp, Homo sapiens
cctggccccagg

SEQ ID NO: 1302210 - DNA, 24 bp, Homo sapiens
cctggctgggacgtggctcagcca

SEQ ID NO: 1302211 - DNA, 12 bp, Homo sapiens
cctgggggctct

SEQ ID NO: 1302212 - DNA, 14 bp, Homo sapiens
cctgggggctctca

SEQ ID NO: 1302213 - DNA, 16 bp, Homo sapiens
cctgggggctctcatg

SEQ ID NO: 1302214 - DNA, 14 bp, Homo sapiens
cctggggtctggag

SEQ ID NO: 1302215 - DNA, 23 bp, Homo sapiens
cctggtgggccaacaaagaacac

SEQ ID NO: 1302216 - DNA, 13 bp, Homo sapiens
cctggttctcatc

SEQ ID NO: 1302217 - DNA, 14 bp, Homo sapiens
cctggttctcatct

SEQ ID NO: 1302218 - DNA, 16 bp, Homo sapiens
cctggttctcatcttt

SEQ ID NO: 1302219 - DNA, 22 bp, Homo sapiens
cctgtataagtggaggcacttt

SEQ ID NO: 1302220 - DNA, 16 bp, Homo sapiens
cctgtatatagcccag

SEQ ID NO: 1302221 - DNA, 23 bp, Homo sapiens
cctgtatatagcccagccaggcc

SEQ ID NO: 1302222 - DNA, 13 bp, Homo sapiens
cctgtccagctcc

SEQ ID NO: 1302223 - DNA, 14 bp, Homo sapiens
cctgtccagctcca

SEQ ID NO: 1302224 - DNA, 15 bp, Homo sapiens
cctgtccagctccaa

SEQ ID NO: 1302225 - DNA, 19 bp, Homo sapiens
cctgtccagctccaacctg

SEQ ID NO: 1302226 - DNA, 22 bp, Homo sapiens
cctgtcctccaacaccaagcac

SEQ ID NO: 1302227 - DNA, 15 bp, Homo sapiens
cctgtgagcccagct

SEQ ID NO: 1302228 - DNA, 17 bp, Homo sapiens
cctgtgagcccagctgg

SEQ ID NO: 1302229 - DNA, 18 bp, Homo sapiens
cctgtgtgattgacagct

SEQ ID NO: 1302230 - DNA, 19 bp, Homo sapiens
cctgtgtgattgacagctt

SEQ ID NO: 1302231 - DNA, 21 bp, Homo sapiens
cctgtgtgtccaaaactgcct

SEQ ID NO: 1302232 - DNA, 15 bp, Homo sapiens
cctgttagcagacag

SEQ ID NO: 1302233 - DNA, 13 bp, Homo sapiens
cctgttccccaga

SEQ ID NO: 1302234 - DNA, 14 bp, Homo sapiens
cctgttctgaactg

SEQ ID NO: 1302235 - DNA, 17 bp, Homo sapiens
cctgttgacacaggtct

SEQ ID NO: 1302236 - DNA, 19 bp, Homo sapiens
cctgttgacacaggtcttt

SEQ ID NO: 1302237 - DNA, 18 bp, Homo sapiens
cctgtttttaagctgttt

SEQ ID NO: 1302238 - DNA, 19 bp, Homo sapiens
cctgtttttaagctgtttc

SEQ ID NO: 1302239 - DNA, 15 bp, Homo sapiens
ccttaggccttcctc

SEQ ID NO: 1302240 - DNA, 23 bp, Homo sapiens
ccttaggccttcctctctccaga

SEQ ID NO: 1302241 - DNA, 12 bp, Homo sapiens
ccttcacaaagc

SEQ ID NO: 1302242 - DNA, 23 bp, Homo sapiens
ccttccctcaccttggcaccaga

SEQ ID NO: 1302243 - DNA, 15 bp, Homo sapiens
ccttcctctctccag

SEQ ID NO: 1302244 - DNA, 20 bp, Homo sapiens
ccttctagggttattgcatt

SEQ ID NO: 1302245 - DNA, 14 bp, Homo sapiens
ccttctctcatctc

SEQ ID NO: 1302246 - DNA, 16 bp, Homo sapiens
ccttctctcatctctt

SEQ ID NO: 1302247 - DNA, 12 bp, Homo sapiens
ccttctgctcag

SEQ ID NO: 1302248 - DNA, 17 bp, Homo sapiens
ccttctgctcagctctg

SEQ ID NO: 1302249 - DNA, 17 bp, Homo sapiens
ccttgaagaacctctca

SEQ ID NO: 1302250 - DNA, 18 bp, Homo sapiens
ccttgaagaacctctcac

SEQ ID NO: 1302251 - DNA, 14 bp, Homo sapiens
ccttgagaaacctt

SEQ ID NO: 1302252 - DNA, 15 bp, Homo sapiens
ccttggcaccagaca

SEQ ID NO: 1302253 - DNA, 22 bp, Homo sapiens
ccttggcaccagacacccagga

SEQ ID NO: 1302254 - DNA, 15 bp, Homo sapiens
ccttggctcagacat

SEQ ID NO: 1302255 - DNA, 21 bp, Homo sapiens
ccttgttcctagagtagagtg

SEQ ID NO: 1302256 - DNA, 13 bp, Homo sapiens
cctttaatgcatc

SEQ ID NO: 1302257 - DNA, 18 bp, Homo sapiens
cctttctcccctgccccc

SEQ ID NO: 1302258 - DNA, 20 bp, Homo sapiens
cctttggttctggccagaat

SEQ ID NO: 1302259 - DNA, 18 bp, Homo sapiens
cctttttttccatcttta

SEQ ID NO: 1302260 - DNA, 13 bp, Homo sapiens
cgagtccaagctg

SEQ ID NO: 1302261 - DNA, 15 bp, Homo sapiens
cgatatactctagat

SEQ ID NO: 1302262 - DNA, 15 bp, Homo sapiens
cgcacctgcctcagg

SEQ ID NO: 1302263 - DNA, 23 bp, Homo sapiens
cgcagtgtgcactaaggggcccg

SEQ ID NO: 1302264 - DNA, 19 bp, Homo sapiens
cgcatggtcacacactgat

SEQ ID NO: 1302265 - DNA, 19 bp, Homo sapiens
cgccaaataatgtctctgt

SEQ ID NO: 1302266 - DNA, 21 bp, Homo sapiens
cgccaggatggaacacggcca

SEQ ID NO: 1302267 - DNA, 16 bp, Homo sapiens
cgccaggctgaccaca

SEQ ID NO: 1302268 - DNA, 17 bp, Homo sapiens
cgccaggctgaccacag

SEQ ID NO: 1302269 - DNA, 20 bp, Homo sapiens
cgccaggctgaccacagcac

SEQ ID NO: 1302270 - DNA, 15 bp, Homo sapiens
cgcgactaatttcaa

SEQ ID NO: 1302271 - DNA, 16 bp, Homo sapiens
cgctgccacccacctc

SEQ ID NO: 1302272 - DNA, 20 bp, Homo sapiens
cgctgccacccacctccctg

SEQ ID NO: 1302273 - DNA, 22 bp, Homo sapiens
cgctttctagctgttgagctgt

SEQ ID NO: 1302274 - DNA, 15 bp, Homo sapiens
cggcctgtcctccaa

SEQ ID NO: 1302275 - DNA, 20 bp, Homo sapiens
cggctcggaggaagccccca

SEQ ID NO: 1302276 - DNA, 12 bp, Homo sapiens
cgggctgtgccc

SEQ ID NO: 1302277 - DNA, 23 bp, Homo sapiens
cggggctcttctcatttcacccc

SEQ ID NO: 1302278 - DNA, 21 bp, Homo sapiens
cgggtgaacaaagcagccacg

SEQ ID NO: 1302279 - DNA, 16 bp, Homo sapiens
cggtgctgtcctcagg

SEQ ID NO: 1302280 - DNA, 21 bp, Homo sapiens
cggtgctgtcctcaggtggcc

SEQ ID NO: 1302281 - DNA, 20 bp, Homo sapiens
cggtggctagtcaagctcct

SEQ ID NO: 1302282 - DNA, 20 bp, Homo sapiens
cggtggctcacgcctgtaat

SEQ ID NO: 1302283 - DNA, 18 bp, Homo sapiens
cggtgtggtgcagtgtga

SEQ ID NO: 1302284 - DNA, 16 bp, Homo sapiens
cgtagctgcaaaggac

SEQ ID NO: 1302285 - DNA, 15 bp, Homo sapiens
cgtgctgacagctgc

SEQ ID NO: 1302286 - DNA, 16 bp, Homo sapiens
cgtgctgacagctgct

SEQ ID NO: 1302287 - DNA, 17 bp, Homo sapiens
cgtgctgacagctgctc

SEQ ID NO: 1302288 - DNA, 12 bp, Homo sapiens
cgttctgtgcac

SEQ ID NO: 1302289 - DNA, 21 bp, Homo sapiens
cgtttgagaagaaaacatcta

SEQ ID NO: 1302290 - DNA, 13 bp, Homo sapiens
cgttttgaagcta

SEQ ID NO: 1302291 - DNA, 20 bp, Homo sapiens
cgttttgaagctactgtgtg

SEQ ID NO: 1302292 - DNA, 19 bp, Homo sapiens
ctaaaagtgggcttgattc

SEQ ID NO: 1302293 - DNA, 19 bp, Homo sapiens
ctaaacaatgctgatttgg

SEQ ID NO: 1302294 - DNA, 14 bp, Homo sapiens
ctaaactcatttat

SEQ ID NO: 1302295 - DNA, 19 bp, Homo sapiens
ctaaaggtgttgtcccttc

SEQ ID NO: 1302296 - DNA, 20 bp, Homo sapiens
ctaaaggtgttgtcccttct

SEQ ID NO: 1302297 - DNA, 21 bp, Homo sapiens
ctaagaaaagattttaatcaa

SEQ ID NO: 1302298 - DNA, 14 bp, Homo sapiens
gtctgtgttttaat

SEQ ID NO: 1302299 - DNA, 23 bp, Homo sapiens
gtcttctaaacttccccatcttc

SEQ ID NO: 1302300 - DNA, 18 bp, Homo sapiens
gtcttgatgaccaaagtc

SEQ ID NO: 1302301 - DNA, 15 bp, Homo sapiens
gtcttttgttcgcat

SEQ ID NO: 1302302 - DNA, 18 bp, Homo sapiens
gtgaacaaagcagccacg

SEQ ID NO: 1302303 - DNA, 16 bp, Homo sapiens
gtgaacgatttagaaa

SEQ ID NO: 1302304 - DNA, 12 bp, Homo sapiens
gtgaaggaccct

SEQ ID NO: 1302305 - DNA, 13 bp, Homo sapiens
gtgaaggaccctt

SEQ ID NO: 1302306 - DNA, 15 bp, Homo sapiens
gtgacccccagctcc

SEQ ID NO: 1302307 - DNA, 16 bp, Homo sapiens
gtgacccccagctccg

SEQ ID NO: 1302308 - DNA, 17 bp, Homo sapiens
gtgacccccagctccgg

SEQ ID NO: 1302309 - DNA, 13 bp, Homo sapiens
gtgatatatttaa

SEQ ID NO: 1302310 - DNA, 17 bp, Homo sapiens
gtgattgacagctttgc

SEQ ID NO: 1302311 - DNA, 23 bp, Homo sapiens
gtgattgacagctttgctgctga

SEQ ID NO: 1302312 - DNA, 19 bp, Homo sapiens
gtgattgtggaatggagat

SEQ ID NO: 1302313 - DNA, 23 bp, Homo sapiens
gtgattgtggaatggagattcag

SEQ ID NO: 1302314 - DNA, 23 bp, Homo sapiens
gtgcaacctcttggcctgatcag

SEQ ID NO: 1302315 - DNA, 19 bp, Homo sapiens
gtgcaataaatctgaccca

SEQ ID NO: 1302316 - DNA, 21 bp, Homo sapiens
gtgcaataaatctgacccagt

SEQ ID NO: 1302317 - DNA, 21 bp, Homo sapiens
gtgcaatgtctgagtgaacct

SEQ ID NO: 1302318 - DNA, 19 bp, Homo sapiens
gtgcccccactgaccagaa

SEQ ID NO: 1302319 - DNA, 15 bp, Homo sapiens
gtgctgacagctgct

SEQ ID NO: 1302320 - DNA, 14 bp, Homo sapiens
gtggactcagggca

SEQ ID NO: 1302321 - DNA, 22 bp, Homo sapiens
gtggagaagccacaggcctgag

SEQ ID NO: 1302322 - DNA, 15 bp, Homo sapiens
gtggccaaggagctg

SEQ ID NO: 1302323 - DNA, 18 bp, Homo sapiens
gtggctagtcaagctcct

SEQ ID NO: 1302324 - DNA, 23 bp, Homo sapiens
gtgtatttttcaataaagcattt

SEQ ID NO: 1302325 - DNA, 16 bp, Homo sapiens
gtgtccttagaacatt

SEQ ID NO: 1302326 - DNA, 13 bp, Homo sapiens
gtgtctccaaccc

SEQ ID NO: 1302327 - DNA, 18 bp, Homo sapiens
gtgtctccaaccccccag

SEQ ID NO: 1302328 - DNA, 19 bp, Homo sapiens
gtgtctccaaccccccagc

SEQ ID NO: 1302329 - DNA, 21 bp, Homo sapiens
gtgtgattgacagctttgctg

SEQ ID NO: 1302330 - DNA, 22 bp, Homo sapiens
gtgtggagaagccacaggcctg

SEQ ID NO: 1302331 - DNA, 23 bp, Homo sapiens
gtgtggagaagccacaggcctga

SEQ ID NO: 1302332 - DNA, 19 bp, Homo sapiens
gtgtggtgcagtgtgaaaa

SEQ ID NO: 1302333 - DNA, 18 bp, Homo sapiens
gtgtgtccaaaactgcct

SEQ ID NO: 1302334 - DNA, 13 bp, Homo sapiens
gtgtgtgtgaatg

SEQ ID NO: 1302335 - DNA, 15 bp, Homo sapiens
gtgttactgtaattc

SEQ ID NO: 1302336 - DNA, 18 bp, Homo sapiens
gtgttgccacaggacaca

SEQ ID NO: 1302337 - DNA, 19 bp, Homo sapiens
gttaagacatgatttcctt

SEQ ID NO: 1302338 - DNA, 17 bp, Homo sapiens
gttcccatgtagccccc

SEQ ID NO: 1302339 - DNA, 18 bp, Homo sapiens
gttcccatgtagccccct

SEQ ID NO: 1302340 - DNA, 22 bp, Homo sapiens
gttcccctcctccactctcccc

SEQ ID NO: 1302341 - DNA, 15 bp, Homo sapiens
gttcctagagtagag

SEQ ID NO: 1302342 - DNA, 23 bp, Homo sapiens
gttcctggcagtttaaaaaaatt

SEQ ID NO: 1302343 - DNA, 16 bp, Homo sapiens
gttctcatctttcttg

SEQ ID NO: 1302344 - DNA, 23 bp, Homo sapiens
gttctgcctgccagctgcactga

SEQ ID NO: 1302345 - DNA, 16 bp, Homo sapiens
gttgagaatcccaaat

SEQ ID NO: 1302346 - DNA, 19 bp, Homo sapiens
gttgagaatcccaaatttg

SEQ ID NO: 1302347 - DNA, 14 bp, Homo sapiens
gttgatcagatctg

SEQ ID NO: 1302348 - DNA, 16 bp, Homo sapiens
gttgatctggaaccca

SEQ ID NO: 1302349 - DNA, 19 bp, Homo sapiens
gttgatctggaacccagac

SEQ ID NO: 1302350 - DNA, 15 bp, Homo sapiens
gttgcagtgagctga

SEQ ID NO: 1302351 - DNA, 21 bp, Homo sapiens
gttgctgttttcctcccttct

SEQ ID NO: 1302352 - DNA, 23 bp, Homo sapiens
gttgctgttttcctcccttctgc

SEQ ID NO: 1302353 - DNA, 17 bp, Homo sapiens
gtttagcagcagccttt

SEQ ID NO: 1302354 - DNA, 22 bp, Homo sapiens
gtttcctgaaacaacttggaaa

SEQ ID NO: 1302355 - DNA, 18 bp, Homo sapiens
gtttgactagatgatgga

SEQ ID NO: 1302356 - DNA, 19 bp, Homo sapiens
gtttgactagatgatggat

SEQ ID NO: 1302357 - DNA, 20 bp, Homo sapiens
gtttgagaagaaaacatcta

SEQ ID NO: 1302358 - DNA, 22 bp, Homo sapiens
gtttgtgtatttacgctttgat

SEQ ID NO: 1302359 - DNA, 18 bp, Homo sapiens
gttttcaagtcaaattaa

SEQ ID NO: 1302360 - DNA, 15 bp, Homo sapiens
gttttcctcccttct

SEQ ID NO: 1302361 - DNA, 15 bp, Homo sapiens
gttttgttcccctcc

SEQ ID NO: 1302362 - DNA, 15 bp, Homo sapiens
gtttttaagctgttt

SEQ ID NO: 1302363 - DNA, 14 bp, Homo sapiens
taaaaactttgcta

SEQ ID NO: 1302364 - DNA, 20 bp, Homo sapiens
taaaaagcttccatgattct

SEQ ID NO: 1302365 - DNA, 18 bp, Homo sapiens
taaaactggctttggctt

SEQ ID NO: 1302366 - DNA, 20 bp, Homo sapiens
taaaacttctcaagatactg

SEQ ID NO: 1302367 - DNA, 21 bp, Homo sapiens
taaacaatgctgatttggtga

SEQ ID NO: 1302368 - DNA, 14 bp, Homo sapiens
taaactcatttata

SEQ ID NO: 1302369 - DNA, 15 bp, Homo sapiens
taaactctgttgcaa

SEQ ID NO: 1302370 - DNA, 15 bp, Homo sapiens
taaagacagaggcag

SEQ ID NO: 1302371 - DNA, 13 bp, Homo sapiens
taaagcatttata

SEQ ID NO: 1302372 - DNA, 14 bp, Homo sapiens
taaagtttgcttag

SEQ ID NO: 1302373 - DNA, 17 bp, Homo sapiens
taaatctgacccagtgc

SEQ ID NO: 1302374 - DNA, 20 bp, Homo sapiens
taaatctgctggagtttcat

SEQ ID NO: 1302375 - DNA, 16 bp, Homo sapiens
taaattcacaaacttt

SEQ ID NO: 1302376 - DNA, 18 bp, Homo sapiens
taaattcacaaactttta

SEQ ID NO: 1302377 - DNA, 20 bp, Homo sapiens
taaattcctctttgctttgc

SEQ ID NO: 1302378 - DNA, 22 bp, Homo sapiens
taaattgaatcagtataaacaa

SEQ ID NO: 1302379 - DNA, 15 bp, Homo sapiens
taaattttgtgtctc

SEQ ID NO: 1302380 - DNA, 15 bp, Homo sapiens
taacagctgaattat

SEQ ID NO: 1302381 - DNA, 23 bp, Homo sapiens
taacatgaggggacattttggtg

SEQ ID NO: 1302382 - DNA, 19 bp, Homo sapiens
taactagatggtgctgaga

SEQ ID NO: 1302383 - DNA, 20 bp, Homo sapiens
taactagatggtgctgagaa

SEQ ID NO: 1302384 - DNA, 18 bp, Homo sapiens
taacttcttatggaattg

SEQ ID NO: 1302385 - DNA, 13 bp, Homo sapiens
taagaaggcaaaa

SEQ ID NO: 1302386 - DNA, 18 bp, Homo sapiens
taagaaggcaaaaatgta

SEQ ID NO: 1302387 - DNA, 22 bp, Homo sapiens
taagaattcaaactggggcctc

SEQ ID NO: 1302388 - DNA, 17 bp, Homo sapiens
taagacatgatttcctt

SEQ ID NO: 1302389 - DNA, 17 bp, Homo sapiens
taagacctggcagctct

SEQ ID NO: 1302390 - DNA, 18 bp, Homo sapiens
taagacctggcagctctg

SEQ ID NO: 1302391 - DNA, 13 bp, Homo sapiens
taagcagaggagg

SEQ ID NO: 1302392 - DNA, 20 bp, Homo sapiens
taataatcttattagggaga

SEQ ID NO: 1302393 - DNA, 23 bp, Homo sapiens
taataatcttattagggagaaaa

SEQ ID NO: 1302394 - DNA, 14 bp, Homo sapiens
taatactaccttga

SEQ ID NO: 1302395 - DNA, 15 bp, Homo sapiens
taatactaccttgaa

SEQ ID NO: 1302396 - DNA, 14 bp, Homo sapiens
taatcaagttgaat

SEQ ID NO: 1302397 - DNA, 18 bp, Homo sapiens
taatggggtcctggccat

SEQ ID NO: 1302398 - DNA, 23 bp, Homo sapiens
taatttatcttgtctctgggctt

SEQ ID NO: 1302399 - DNA, 17 bp, Homo sapiens
taatttattaattgctt

SEQ ID NO: 1302400 - DNA, 20 bp, Homo sapiens
taatttgcattaaattcaca

SEQ ID NO: 1302401 - DNA, 14 bp, Homo sapiens
taatttttgtaatt

SEQ ID NO: 1302402 - DNA, 17 bp, Homo sapiens
tacaaatactcttagga

SEQ ID NO: 1302403 - DNA, 19 bp, Homo sapiens
tacaaatactcttaggaag

SEQ ID NO: 1302404 - DNA, 23 bp, Homo sapiens
tacaaatactcttaggaagagaa

SEQ ID NO: 1302405 - DNA, 24 bp, Homo sapiens
tacaagatgaaggagaggcaacat

SEQ ID NO: 1302406 - DNA, 16 bp, Homo sapiens
tacaatgtgaacttta

SEQ ID NO: 1302407 - DNA, 18 bp, Homo sapiens
tacagatgaatgtattta

SEQ ID NO: 1302408 - DNA, 20 bp, Homo sapiens
tacatacaccagcattcctt

SEQ ID NO: 1302409 - DNA, 18 bp, Homo sapiens
tacatctattttggattg

SEQ ID NO: 1302410 - DNA, 19 bp, Homo sapiens
tacatctattttggattgt

SEQ ID NO: 1302411 - DNA, 20 bp, Homo sapiens
tacatctattttggattgta

SEQ ID NO: 1302412 - DNA, 17 bp, Homo sapiens
tacatgagaacaaacag

SEQ ID NO: 1302413 - DNA, 18 bp, Homo sapiens
tcaacccccatttctatt

SEQ ID NO: 1302414 - DNA, 19 bp, Homo sapiens
tcaactgccaaaatgctct

SEQ ID NO: 1302415 - DNA, 19 bp, Homo sapiens
tcaagatactgctactgta

SEQ ID NO: 1302416 - DNA, 16 bp, Homo sapiens
tcaatatttttagata

SEQ ID NO: 1302417 - DNA, 18 bp, Homo sapiens
tcaattgtaaattgaatc

SEQ ID NO: 1302418 - DNA, 16 bp, Homo sapiens
tcacaaagcccaaggg

SEQ ID NO: 1302419 - DNA, 14 bp, Homo sapiens
tcacaacctgaacc

SEQ ID NO: 1302420 - DNA, 19 bp, Homo sapiens
tcacaacctgaacctagga

SEQ ID NO: 1302421 - DNA, 12 bp, Homo sapiens
tcacactgagaa

SEQ ID NO: 1302422 - DNA, 21 bp, Homo sapiens
tcacccctggttctcatcttt

SEQ ID NO: 1302423 - DNA, 22 bp, Homo sapiens
tcacccctggttctcatctttc

SEQ ID NO: 1302424 - DNA, 22 bp, Homo sapiens
tcacctgtttttaagctgtttc

SEQ ID NO: 1302425 - DNA, 13 bp, Homo sapiens
tcactcattgctg

SEQ ID NO: 1302426 - DNA, 12 bp, Homo sapiens
tcactgtctttc

SEQ ID NO: 1302427 - DNA, 17 bp, Homo sapiens
tcagacaccctcaacct

SEQ ID NO: 1302428 - DNA, 20 bp, Homo sapiens
tcagacatgttttccgtgaa

SEQ ID NO: 1302429 - DNA, 14 bp, Homo sapiens
tcagaccacggctc

SEQ ID NO: 1302430 - DNA, 22 bp, Homo sapiens
tcagactcccattcctgaagaa

SEQ ID NO: 1302431 - DNA, 15 bp, Homo sapiens
tcagagaccattgca

SEQ ID NO: 1302432 - DNA, 23 bp, Homo sapiens
tcagatcagtgtaccatttgcct

SEQ ID NO: 1302433 - DNA, 16 bp, Homo sapiens
tcagatccagggacag

SEQ ID NO: 1302434 - DNA, 14 bp, Homo sapiens
tcagccagcacttg

SEQ ID NO: 1302435 - DNA, 19 bp, Homo sapiens
tcagctctgggccattctc

SEQ ID NO: 1302436 - DNA, 14 bp, Homo sapiens
tcaggacagatgcc

SEQ ID NO: 1302437 - DNA, 17 bp, Homo sapiens
tcaggaggcaggacctt

SEQ ID NO: 1302438 - DNA, 19 bp, Homo sapiens
tcagggcagcgccaggctg

SEQ ID NO: 1302439 - DNA, 19 bp, Homo sapiens
tcagtgtaccatttgcctc

SEQ ID NO: 1302440 - DNA, 13 bp, Homo sapiens
tcagttttaacta

SEQ ID NO: 1302441 - DNA, 12 bp, Homo sapiens
tcagttttcatt

SEQ ID NO: 1302442 - DNA, 20 bp, Homo sapiens
tcatactatctactctcctc

SEQ ID NO: 1302443 - DNA, 18 bp, Homo sapiens
tcatagcagattttaatt

SEQ ID NO: 1302444 - DNA, 18 bp, Homo sapiens
tcatagtaacttcttatg

SEQ ID NO: 1302445 - DNA, 22 bp, Homo sapiens
tcatctcccacctagcagcacc

SEQ ID NO: 1302446 - DNA, 14 bp, Homo sapiens
tcatctctctgccc

SEQ ID NO: 1302447 - DNA, 20 bp, Homo sapiens
tcatctcttagctcccctcc

SEQ ID NO: 1302448 - DNA, 15 bp, Homo sapiens
tcatctgctctcctt

SEQ ID NO: 1302449 - DNA, 13 bp, Homo sapiens
tcatgccctcctc

SEQ ID NO: 1302450 - DNA, 14 bp, Homo sapiens
tcatgccctcctct

SEQ ID NO: 1302451 - DNA, 15 bp, Homo sapiens
tcatgccctgtgcaa

SEQ ID NO: 1302452 - DNA, 16 bp, Homo sapiens
tcatgtacaagatgaa

SEQ ID NO: 1302453 - DNA, 18 bp, Homo sapiens
tcatgtacaagatgaagg

SEQ ID NO: 1302454 - DNA, 15 bp, Homo sapiens
tcattcgttctgtgg

SEQ ID NO: 1302455 - DNA, 17 bp, Homo sapiens
tcattcttgaaagctgt

SEQ ID NO: 1302456 - DNA, 18 bp, Homo sapiens
tcattcttgaaagctgtg

SEQ ID NO: 1302457 - DNA, 16 bp, Homo sapiens
tcattgctgagcctct

SEQ ID NO: 1302458 - DNA, 17 bp, Homo sapiens
tcattgctgagcctctg

SEQ ID NO: 1302459 - DNA, 22 bp, Homo sapiens
tcattgctgagcctctgctccc

SEQ ID NO: 1302460 - DNA, 22 bp, Homo sapiens
tcatttataaagctaaaataac

SEQ ID NO: 1302461 - DNA, 14 bp, Homo sapiens
tcatttcacccctc

SEQ ID NO: 1302462 - DNA, 13 bp, Homo sapiens
tccaaaactgcct

SEQ ID NO: 1302463 - DNA, 18 bp, Homo sapiens
tccaaaagaagcccccag

SEQ ID NO: 1302464 - DNA, 19 bp, Homo sapiens
tccaaccccccagcactga

SEQ ID NO: 1302465 - DNA, 23 bp, Homo sapiens
tccaaccccccagcactgaggaa

SEQ ID NO: 1302466 - DNA, 21 bp, Homo sapiens
tccaacctgcaaagatctgtc

SEQ ID NO: 1302467 - DNA, 12 bp, Homo sapiens
tccaagctggga

SEQ ID NO: 1302468 - DNA, 19 bp, Homo sapiens
tccacagcaaccccaggct

SEQ ID NO: 1302469 - DNA, 19 bp, Homo sapiens
tccaccaggaacctcttca

SEQ ID NO: 1302470 - DNA, 21 bp, Homo sapiens
tccaccaggaacctcttcaga

SEQ ID NO: 1302471 - DNA, 22 bp, Homo sapiens
tccaccctggccgagtccaagc

SEQ ID NO: 1302472 - DNA, 15 bp, Homo sapiens
tccagaatgctgtac

SEQ ID NO: 1302473 - DNA, 19 bp, Homo sapiens
tccagacctgatcctggag

SEQ ID NO: 1302474 - DNA, 22 bp, Homo sapiens
tccagacctgatcctggaggcc

SEQ ID NO: 1302475 - DNA, 15 bp, Homo sapiens
tccagatgcagggca

SEQ ID NO: 1302476 - DNA, 19 bp, Homo sapiens
tccagatgtttccagactt

SEQ ID NO: 1302477 - DNA, 16 bp, Homo sapiens
tccagctccaacctgc

SEQ ID NO: 1302478 - DNA, 18 bp, Homo sapiens
tccagctccaacctgcaa

SEQ ID NO: 1302479 - DNA, 15 bp, Homo sapiens
tccagctctttcctc

SEQ ID NO: 1302480 - DNA, 14 bp, Homo sapiens
tccaggcagatcca

SEQ ID NO: 1302481 - DNA, 17 bp, Homo sapiens
tccaggcagatccagga

SEQ ID NO: 1302482 - DNA, 19 bp, Homo sapiens
tccaggcagatccaggact

SEQ ID NO: 1302483 - DNA, 14 bp, Homo sapiens
tccagggacagagg

SEQ ID NO: 1302484 - DNA, 19 bp, Homo sapiens
tccagggctggactgaggc

SEQ ID NO: 1302485 - DNA, 21 bp, Homo sapiens
tccagggctggactgaggcct

SEQ ID NO: 1302486 - DNA, 17 bp, Homo sapiens
tccagggtgtgtgctcg

SEQ ID NO: 1302487 - DNA, 20 bp, Homo sapiens
tccagttttttgttatatag

SEQ ID NO: 1302488 - DNA, 13 bp, Homo sapiens
tccatctttacaa

SEQ ID NO: 1302489 - DNA, 19 bp, Homo sapiens
tccattctttctgataact

SEQ ID NO: 1302490 - DNA, 15 bp, Homo sapiens
tcccaaacgcctccc

SEQ ID NO: 1302491 - DNA, 22 bp, Homo sapiens
tcccaaatttgattgatttgaa

SEQ ID NO: 1302492 - DNA, 21 bp, Homo sapiens
tcccaagtagctgggattaca

SEQ ID NO: 1302493 - DNA, 17 bp, Homo sapiens
tcccaatttcagactcc

SEQ ID NO: 1302494 - DNA, 23 bp, Homo sapiens
tcccaatttcagactcccattcc

SEQ ID NO: 1302495 - DNA, 14 bp, Homo sapiens
tcccacaagtggtg

SEQ ID NO: 1302496 - DNA, 18 bp, Homo sapiens
tcccagattggctcacac

SEQ ID NO: 1302497 - DNA, 19 bp, Homo sapiens
tcccagattggctcacact

SEQ ID NO: 1302498 - DNA, 20 bp, Homo sapiens
tcccagattggctcacactg

SEQ ID NO: 1302499 - DNA, 23 bp, Homo sapiens
tcccagattggctcacactgaga

SEQ ID NO: 1302500 - DNA, 16 bp, Homo sapiens
tcccagcactttggga

SEQ ID NO: 1302501 - DNA, 18 bp, Homo sapiens
tcccagcactttgggagg

SEQ ID NO: 1302502 - DNA, 18 bp, Homo sapiens
tcccagctacttgggagg

SEQ ID NO: 1302503 - DNA, 19 bp, Homo sapiens
tcccagctacttgggaggc

SEQ ID NO: 1302504 - DNA, 12 bp, Homo sapiens
tcccaggaccct

SEQ ID NO: 1302505 - DNA, 13 bp, Homo sapiens
tcccaggaccctg

SEQ ID NO: 1302506 - DNA, 21 bp, Homo sapiens
tcccatgtagccccctggcct

SEQ ID NO: 1302507 - DNA, 22 bp, Homo sapiens
tcccatgtagccccctggcctc

SEQ ID NO: 1302508 - DNA, 16 bp, Homo sapiens
tcccattgtccctctg

SEQ ID NO: 1302509 - DNA, 18 bp, Homo sapiens
tcccattgtccctctgcc

SEQ ID NO: 1302510 - DNA, 21 bp, Homo sapiens
tccccaataattgcagaacta

SEQ ID NO: 1302511 - DNA, 10 bp, Homo sapiens
tccccagaga

SEQ ID NO: 1302512 - DNA, 22 bp, Homo sapiens
tccccagagaaaggggagccca

SEQ ID NO: 1302513 - DNA, 23 bp, Homo sapiens
tccccagagaaaggggagcccac

SEQ ID NO: 1302514 - DNA, 14 bp, Homo sapiens
tccccatcttctaa

SEQ ID NO: 1302515 - DNA, 15 bp, Homo sapiens
tcccccttcacaaag

SEQ ID NO: 1302516 - DNA, 21 bp, Homo sapiens
tccccgcagtgtgcactaagg

SEQ ID NO: 1302517 - DNA, 18 bp, Homo sapiens
tccccgcttctgcctgca

SEQ ID NO: 1302518 - DNA, 14 bp, Homo sapiens
tcccctaacctcat

SEQ ID NO: 1302519 - DNA, 12 bp, Homo sapiens
tcccctcctcca

SEQ ID NO: 1302520 - DNA, 15 bp, Homo sapiens
tcccctctccttcct

SEQ ID NO: 1302521 - DNA, 19 bp, Homo sapiens
tcccctgcccccaggactg

SEQ ID NO: 1302522 - DNA, 15 bp, Homo sapiens
tccctcaccttggca

SEQ ID NO: 1302523 - DNA, 14 bp, Homo sapiens
tccctcccccccat

SEQ ID NO: 1302524 - DNA, 13 bp, Homo sapiens
tccctctatttat

SEQ ID NO: 1302525 - DNA, 21 bp, Homo sapiens
tccctgcatctgaccagcagc

SEQ ID NO: 1302526 - DNA, 20 bp, Homo sapiens
tccctggggctagggggagc

SEQ ID NO: 1302527 - DNA, 15 bp, Homo sapiens
tcccttctgctactg

SEQ ID NO: 1302528 - DNA, 13 bp, Homo sapiens
tccgtgctgacag

SEQ ID NO: 1302529 - DNA, 12 bp, Homo sapiens
tgcaaagatctg

SEQ ID NO: 1302530 - DNA, 23 bp, Homo sapiens
tgcaaggtttaggctggtggccc

SEQ ID NO: 1302531 - DNA, 23 bp, Homo sapiens
tgcaataaatctgacccagtgcc

SEQ ID NO: 1302532 - DNA, 19 bp, Homo sapiens
tgcaatgtctgagtgaacc

SEQ ID NO: 1302533 - DNA, 22 bp, Homo sapiens
tgcaatgtctgagtgaacctgt

SEQ ID NO: 1302534 - DNA, 14 bp, Homo sapiens
tgcacatctctgct

SEQ ID NO: 1302535 - DNA, 15 bp, Homo sapiens
tgcacatctctgctt

SEQ ID NO: 1302536 - DNA, 18 bp, Homo sapiens
tgcacccacccaggagtg

SEQ ID NO: 1302537 - DNA, 17 bp, Homo sapiens
tgcactaaggggcccgg

SEQ ID NO: 1302538 - DNA, 22 bp, Homo sapiens
tgcactaaggggcccggccagc

SEQ ID NO: 1302539 - DNA, 16 bp, Homo sapiens
tgcactgatgctgccc

SEQ ID NO: 1302540 - DNA, 17 bp, Homo sapiens
tgcactgatgctgcccc

SEQ ID NO: 1302541 - DNA, 21 bp, Homo sapiens
tgcactgatgctgcccctcat

SEQ ID NO: 1302542 - DNA, 20 bp, Homo sapiens
tgcacttatgatttcatgtg

SEQ ID NO: 1302543 - DNA, 21 bp, Homo sapiens
tgcacttgtgattatttatta

SEQ ID NO: 1302544 - DNA, 16 bp, Homo sapiens
tgcagcagggatgccc

SEQ ID NO: 1302545 - DNA, 19 bp, Homo sapiens
tgcagcagggatgccctgg

SEQ ID NO: 1302546 - DNA, 22 bp, Homo sapiens
tgcagcagggatgccctggagg

SEQ ID NO: 1302547 - DNA, 19 bp, Homo sapiens
tgcagtttgagacaggaga

SEQ ID NO: 1302548 - DNA, 13 bp, Homo sapiens
tgcatatgttgaa

SEQ ID NO: 1302549 - DNA, 15 bp, Homo sapiens
tgcatatgttgaata

SEQ ID NO: 1302550 - DNA, 17 bp, Homo sapiens
tgcatatgttgaatact

SEQ ID NO: 1302551 - DNA, 17 bp, Homo sapiens
tgcatctgaccagcagc

SEQ ID NO: 1302552 - DNA, 18 bp, Homo sapiens
tgcatctgaccagcagcg

SEQ ID NO: 1302553 - DNA, 14 bp, Homo sapiens
tgcatgattttgta

SEQ ID NO: 1302554 - DNA, 20 bp, Homo sapiens
tgcatggtgccccaggacca

SEQ ID NO: 1302555 - DNA, 19 bp, Homo sapiens
tgcattaaattcacaaact

SEQ ID NO: 1302556 - DNA, 15 bp, Homo sapiens
tgcattgaacacaaa

SEQ ID NO: 1302557 - DNA, 18 bp, Homo sapiens
tgccaaaatgctctagtg

SEQ ID NO: 1302558 - DNA, 21 bp, Homo sapiens
tgccaatattaaatctgctgg

SEQ ID NO: 1302559 - DNA, 15 bp, Homo sapiens
tgccacaaggacttc

SEQ ID NO: 1302560 - DNA, 22 bp, Homo sapiens
tgccacacaaggatagatgctg

SEQ ID NO: 1302561 - DNA, 13 bp, Homo sapiens
tgccacccacctc

SEQ ID NO: 1302562 - DNA, 17 bp, Homo sapiens
tgccacccacctccctg

SEQ ID NO: 1302563 - DNA, 19 bp, Homo sapiens
tgccacccacctccctgcc

SEQ ID NO: 1302564 - DNA, 17 bp, Homo sapiens
tgccagggcaatgatga

SEQ ID NO: 1302565 - DNA, 22 bp, Homo sapiens
tgcccaacccttccctcacctt

SEQ ID NO: 1302566 - DNA, 14 bp, Homo sapiens
tgcccacaggccgc

SEQ ID NO: 1302567 - DNA, 13 bp, Homo sapiens
tgccccaggacca

SEQ ID NO: 1302568 - DNA, 20 bp, Homo sapiens
tgccccaggaccagctcagg

SEQ ID NO: 1302569 - DNA, 17 bp, Homo sapiens
tgccccatcctccagca

SEQ ID NO: 1302570 - DNA, 18 bp, Homo sapiens
tgccccatcctccagcag

SEQ ID NO: 1302571 - DNA, 18 bp, Homo sapiens
tgccccattcttttgtaa

SEQ ID NO: 1302572 - DNA, 11 bp, Homo sapiens
tgcccccagga

SEQ ID NO: 1302573 - DNA, 12 bp, Homo sapiens
tgcccccaggac

SEQ ID NO: 1302574 - DNA, 13 bp, Homo sapiens
tgcccccaggact

SEQ ID NO: 1302575 - DNA, 13 bp, Homo sapiens
tgcccctggctgg

SEQ ID NO: 1302576 - DNA, 20 bp, Homo sapiens
tgcccggctaatttttgtaa

SEQ ID NO: 1302577 - DNA, 19 bp, Homo sapiens
tgccctccagctctttcct

SEQ ID NO: 1302578 - DNA, 21 bp, Homo sapiens
tgccctccagctctttcctcc

SEQ ID NO: 1302579 - DNA, 16 bp, Homo sapiens
tgccctggaggtggct

SEQ ID NO: 1302580 - DNA, 16 bp, Homo sapiens
tgcctcagccctgacc

SEQ ID NO: 1302581 - DNA, 19 bp, Homo sapiens
tgcctcagccctgaccctg

SEQ ID NO: 1302582 - DNA, 22 bp, Homo sapiens
tgcctcatttagagaggaaaag

SEQ ID NO: 1302583 - DNA, 19 bp, Homo sapiens
tgcctccaggaaccacacc

SEQ ID NO: 1302584 - DNA, 14 bp, Homo sapiens
tgcctccagggctg

SEQ ID NO: 1302585 - DNA, 19 bp, Homo sapiens
tgcctccagggctggactg

SEQ ID NO: 1302586 - DNA, 18 bp, Homo sapiens
tgcctcccctctccttcc

SEQ ID NO: 1302587 - DNA, 17 bp, Homo sapiens
tgcctcgaaacacagaa

SEQ ID NO: 1302588 - DNA, 20 bp, Homo sapiens
tgcctcggcctcccaaagtg

SEQ ID NO: 1302589 - DNA, 14 bp, Homo sapiens
tgcctctgtcccct

SEQ ID NO: 1302590 - DNA, 20 bp, Homo sapiens
tgcctctgtccccttctctc

SEQ ID NO: 1302591 - DNA, 21 bp, Homo sapiens
tgcctctgtccccttctctca

SEQ ID NO: 1302592 - DNA, 16 bp, Homo sapiens
tgccttcttttgatta

SEQ ID NO: 1302593 - DNA, 13 bp, Homo sapiens
tgccttggctcag

SEQ ID NO: 1302594 - DNA, 19 bp, Homo sapiens
tgccttggctcagacatgt

SEQ ID NO: 1302595 - DNA, 22 bp, Homo sapiens
tgcgggtgaacaaagcagccac

SEQ ID NO: 1302596 - DNA, 16 bp, Homo sapiens
tgcggtagccagcaca

SEQ ID NO: 1302597 - DNA, 17 bp, Homo sapiens
tgcggtagccagcacac

SEQ ID NO: 1302598 - DNA, 15 bp, Homo sapiens
tgctcagcttctcct

SEQ ID NO: 1302599 - DNA, 14 bp, Homo sapiens
tgctccagacctga

SEQ ID NO: 1302600 - DNA, 14 bp, Homo sapiens
tgctcctagaggga

SEQ ID NO: 1302601 - DNA, 15 bp, Homo sapiens
tgctccttgttccta

SEQ ID NO: 1302602 - DNA, 23 bp, Homo sapiens
tgctccttgttcctagagtagag

SEQ ID NO: 1302603 - DNA, 16 bp, Homo sapiens
tgctcgccccagcagg

SEQ ID NO: 1302604 - DNA, 13 bp, Homo sapiens
tgctcgccctgcg

SEQ ID NO: 1302605 - DNA, 14 bp, Homo sapiens
tgctcgccctgcgg

SEQ ID NO: 1302606 - DNA, 16 bp, Homo sapiens
tgctctgcttgacaac

SEQ ID NO: 1302607 - DNA, 17 bp, Homo sapiens
tgctgacagctgctcct

SEQ ID NO: 1302608 - DNA, 18 bp, Homo sapiens
tgctgacagctgctccta

SEQ ID NO: 1302609 - DNA, 15 bp, Homo sapiens
tgctgacggccaggg

SEQ ID NO: 1302610 - DNA, 17 bp, Homo sapiens
tgctgacggccagggag

SEQ ID NO: 1302611 - DNA, 14 bp, Homo sapiens
tgctgagaagcttt

SEQ ID NO: 1302612 - DNA, 17 bp, Homo sapiens
tgctgagaagcttttga

SEQ ID NO: 1302613 - DNA, 16 bp, Homo sapiens
tgctgagcctctgctc

SEQ ID NO: 1302614 - DNA, 21 bp, Homo sapiens
tgctgcaggacttgagaagac

SEQ ID NO: 1302615 - DNA, 23 bp, Homo sapiens
tgctgctggacagtatcactgtc

SEQ ID NO: 1302616 - DNA, 14 bp, Homo sapiens
tgctggcccagggc

SEQ ID NO: 1302617 - DNA, 19 bp, Homo sapiens
tgctggcccagggcccaga

SEQ ID NO: 1302618 - DNA, 21 bp, Homo sapiens
tgctggcccagggcccagagc

SEQ ID NO: 1302619 - DNA, 17 bp, Homo sapiens
tgctgtacatctatttt

SEQ ID NO: 1302620 - DNA, 21 bp, Homo sapiens
tgctgtcctcaggtggccatg

SEQ ID NO: 1302621 - DNA, 22 bp, Homo sapiens
tgctgttctcttgggaactgaa

SEQ ID NO: 1302622 - DNA, 17 bp, Homo sapiens
tgctgttttcctccctt

SEQ ID NO: 1302623 - DNA, 22 bp, Homo sapiens
tgctgttttcctcccttctgct

SEQ ID NO: 1302624 - DNA, 19 bp, Homo sapiens
tgcttagaatccaaacttg

SEQ ID NO: 1302625 - DNA, 15 bp, Homo sapiens
tgcttgacaacatct

SEQ ID NO: 1302626 - DNA, 23 bp, Homo sapiens
tgcttgagtcaggtttgagtaga

SEQ ID NO: 1302627 - DNA, 13 bp, Homo sapiens
tgctttatgctga

SEQ ID NO: 1302628 - DNA, 15 bp, Homo sapiens
tgctttattccagaa

SEQ ID NO: 1302629 - DNA, 14 bp, Homo sapiens
tgctttctgctcag

SEQ ID NO: 1302630 - DNA, 14 bp, Homo sapiens
tgctttgctttctg

SEQ ID NO: 1302631 - DNA, 15 bp, Homo sapiens
tgctttgggaagccg

SEQ ID NO: 1302632 - DNA, 23 bp, Homo sapiens
tggaaagataactaggaaatcca

SEQ ID NO: 1302633 - DNA, 16 bp, Homo sapiens
tggaacccagactcag

SEQ ID NO: 1302634 - DNA, 19 bp, Homo sapiens
tggaacctcagcctggcca

SEQ ID NO: 1302635 - DNA, 18 bp, Homo sapiens
tggaagctaatttgcatt

SEQ ID NO: 1302636 - DNA, 12 bp, Homo sapiens
tggaatactttt

SEQ ID NO: 1302637 - DNA, 17 bp, Homo sapiens
tggaattgatttgcatt

SEQ ID NO: 1302638 - DNA, 15 bp, Homo sapiens
tggaccttaggcctt

SEQ ID NO: 1302639 - DNA, 21 bp, Homo sapiens
tggaccttaggccttcctctc

SEQ ID NO: 1302640 - DNA, 11 bp, Homo sapiens
tggactgaggc

SEQ ID NO: 1302641 - DNA, 14 bp, Homo sapiens
tggactgaggcctg

SEQ ID NO: 1302642 - DNA, 18 bp, Homo sapiens
tggagaagccacaggcct

SEQ ID NO: 1302643 - DNA, 19 bp, Homo sapiens
tggagaagccacaggcctg

SEQ ID NO: 1302644 - DNA, 20 bp, Homo sapiens
tggagaagccacaggcctga

SEQ ID NO: 1302645 - DNA, 22 bp, Homo sapiens
tggagaagccacaggcctgaga

SEQ ID NO: 1302646 - DNA, 15 bp, Homo sapiens
tggagcccagaggag

SEQ ID NO: 1302647 - DNA, 13 bp, Homo sapiens
tggaggcacttta

SEQ ID NO: 1302648 - DNA, 14 bp, Homo sapiens
tggaggcactttag

SEQ ID NO: 1302649 - DNA, 12 bp, Homo sapiens
tggaggcccagt

SEQ ID NO: 1302650 - DNA, 21 bp, Homo sapiens
tggagtttcatgtacaagatg

SEQ ID NO: 1302651 - DNA, 20 bp, Homo sapiens
tggatgccaatattaaatct

SEQ ID NO: 1302652 - DNA, 22 bp, Homo sapiens
tggatgggggaactcagatcca

SEQ ID NO: 1302653 - DNA, 19 bp, Homo sapiens
tggatttttgactctggca

SEQ ID NO: 1302654 - DNA, 16 bp, Homo sapiens
tggcaaagcttttaga

SEQ ID NO: 1302655 - DNA, 17 bp, Homo sapiens
tggcaaagcttttagaa

SEQ ID NO: 1302656 - DNA, 13 bp, Homo sapiens
tggcaacagatct

SEQ ID NO: 1302657 - DNA, 18 bp, Homo sapiens
tggcaacagatctggaac

SEQ ID NO: 1302658 - DNA, 23 bp, Homo sapiens
tggcaccagacacccaggactta

SEQ ID NO: 1302659 - DNA, 18 bp, Homo sapiens
tggcactggatgcagaaa

SEQ ID NO: 1302660 - DNA, 20 bp, Homo sapiens
tggcagcctcccatccaggg

SEQ ID NO: 1302661 - DNA, 23 bp, Homo sapiens
tggcaggggtggctgcctcattt

SEQ ID NO: 1302662 - DNA, 15 bp, Homo sapiens
tggccaaggagctgc

SEQ ID NO: 1302663 - DNA, 17 bp, Homo sapiens
tggccaaggagctgcta

SEQ ID NO: 1302664 - DNA, 19 bp, Homo sapiens
tggccactaagcagaggag

SEQ ID NO: 1302665 - DNA, 13 bp, Homo sapiens
tggccagacacag

SEQ ID NO: 1302666 - DNA, 18 bp, Homo sapiens
tggccagacacaggccct

SEQ ID NO: 1302667 - DNA, 23 bp, Homo sapiens
tggccagagagcctggtgctgct

SEQ ID NO: 1302668 - DNA, 15 bp, Homo sapiens
tggccatgcctcagc

SEQ ID NO: 1302669 - DNA, 18 bp, Homo sapiens
tggccatgcctcagccct

SEQ ID NO: 1302670 - DNA, 17 bp, Homo sapiens
tggcccagggcccagag

SEQ ID NO: 1302671 - DNA, 18 bp, Homo sapiens
tggcccagggcccagagc

SEQ ID NO: 1302672 - DNA, 20 bp, Homo sapiens
tggcccagggcccagagccc

SEQ ID NO: 1302673 - DNA, 21 bp, Homo sapiens
tggcccagggcccagagccca

SEQ ID NO: 1302674 - DNA, 23 bp, Homo sapiens
tggcccagggcccagagcccagc

SEQ ID NO: 1302675 - DNA, 15 bp, Homo sapiens
tggccgagtccaagc

SEQ ID NO: 1302676 - DNA, 18 bp, Homo sapiens
tggctagtcaagctcctc

SEQ ID NO: 1302677 - DNA, 21 bp, Homo sapiens
tggctagtcaagctcctcctc

SEQ ID NO: 1302678 - DNA, 13 bp, Homo sapiens
tggctcacactga

SEQ ID NO: 1302679 - DNA, 16 bp, Homo sapiens
tggctcagccagcact

SEQ ID NO: 1302680 - DNA, 23 bp, Homo sapiens
tggctccagatgcagggcagtca

SEQ ID NO: 1302681 - DNA, 12 bp, Homo sapiens
tggctcctctca

SEQ ID NO: 1302682 - DNA, 13 bp, Homo sapiens
tggctgagcccct

SEQ ID NO: 1302683 - DNA, 17 bp, Homo sapiens
tggctgagcccctgtct

SEQ ID NO: 1302684 - DNA, 20 bp, Homo sapiens
tggctgcatcccccccacct

SEQ ID NO: 1302685 - DNA, 17 bp, Homo sapiens
tggctgcctcatttaga

SEQ ID NO: 1302686 - DNA, 23 bp, Homo sapiens
tggctgggacgtggctcagccag

SEQ ID NO: 1302687 - DNA, 15 bp, Homo sapiens
tggcttgagaaatat

SEQ ID NO: 1302688 - DNA, 16 bp, Homo sapiens
tgggaaagtattctgt

SEQ ID NO: 1302689 - DNA, 21 bp, Homo sapiens
tgggacgtggctcagccagca

SEQ ID NO: 1302690 - DNA, 14 bp, Homo sapiens
tgggacttaactcc

SEQ ID NO: 1302691 - DNA, 16 bp, Homo sapiens
tgggagctgaggccac

SEQ ID NO: 1302692 - DNA, 20 bp, Homo sapiens
tgggagctgaggccacactc

SEQ ID NO: 1302693 - DNA, 22 bp, Homo sapiens
tgggagggaggctcaggtccct

SEQ ID NO: 1302694 - DNA, 19 bp, Homo sapiens
tgggaggttgatcagatct

SEQ ID NO: 1302695 - DNA, 14 bp, Homo sapiens
tgggcaaacaggca

SEQ ID NO: 1302696 - DNA, 16 bp, Homo sapiens
tgggcaaacaggcagt

SEQ ID NO: 1302697 - DNA, 23 bp, Homo sapiens
tgggccaacaaagaacactaact

SEQ ID NO: 1302698 - DNA, 22 bp, Homo sapiens
tgggccacttctgggtggggca

SEQ ID NO: 1302699 - DNA, 18 bp, Homo sapiens
tgggcctgctccagacct

SEQ ID NO: 1302700 - DNA, 19 bp, Homo sapiens
tgggcctgctccagacctg

SEQ ID NO: 1302701 - DNA, 13 bp, Homo sapiens
tgggctcctccag

SEQ ID NO: 1302702 - DNA, 23 bp, Homo sapiens
tgggctcctccagggtgtgtgct

SEQ ID NO: 1302703 - DNA, 16 bp, Homo sapiens
tggggagccaacagaa

SEQ ID NO: 1302704 - DNA, 20 bp, Homo sapiens
tggggagttaagacctggca

SEQ ID NO: 1302705 - DNA, 14 bp, Homo sapiens
tggggccagatcca

SEQ ID NO: 1302706 - DNA, 18 bp, Homo sapiens
tggggccagatccagcct

SEQ ID NO: 1302707 - DNA, 19 bp, Homo sapiens
tggggccagatccagcctg

SEQ ID NO: 1302708 - DNA, 21 bp, Homo sapiens
tggggccagatccagcctggg

SEQ ID NO: 1302709 - DNA, 18 bp, Homo sapiens
tggggcctacagctttga

SEQ ID NO: 1302710 - DNA, 14 bp, Homo sapiens
tggggcctccagaa

SEQ ID NO: 1302711 - DNA, 16 bp, Homo sapiens
tggggtcctggccatc

SEQ ID NO: 1302712 - DNA, 16 bp, Homo sapiens
tgggtacttcttgaag

SEQ ID NO: 1302713 - DNA, 19 bp, Homo sapiens
tgggtacttcttgaaggtg

SEQ ID NO: 1302714 - DNA, 13 bp, Homo sapiens
tgggtcaggcagg

SEQ ID NO: 1302715 - DNA, 13 bp, Homo sapiens
tgggtgagaacaa

SEQ ID NO: 1302716 - DNA, 14 bp, Homo sapiens
tgggttctgcctgc

SEQ ID NO: 1302717 - DNA, 16 bp, Homo sapiens
tgggttctgcctgcca

SEQ ID NO: 1302718 - DNA, 19 bp, Homo sapiens
tgggttctgcctgccagct

SEQ ID NO: 1302719 - DNA, 21 bp, Homo sapiens
tgggttctgcctgccagctgc

SEQ ID NO: 1302720 - DNA, 16 bp, Homo sapiens
tggtaggcatttccta

SEQ ID NO: 1302721 - DNA, 16 bp, Homo sapiens
tggtgccccaggacca

SEQ ID NO: 1302722 - DNA, 18 bp, Homo sapiens
tggtgccccaggaccagc

SEQ ID NO: 1302723 - DNA, 19 bp, Homo sapiens
tggtgccccaggaccagct

SEQ ID NO: 1302724 - DNA, 21 bp, Homo sapiens
tggtgccccaggaccagctca

SEQ ID NO: 1302725 - DNA, 20 bp, Homo sapiens
tggtgggccaacaaagaaca

SEQ ID NO: 1302726 - DNA, 16 bp, Homo sapiens
tggtggtaaccctggt

SEQ ID NO: 1302727 - DNA, 17 bp, Homo sapiens
tggtggtaaccctggtg

SEQ ID NO: 1302728 - DNA, 14 bp, Homo sapiens
tggtggttgctgtt

SEQ ID NO: 1302729 - DNA, 15 bp, Homo sapiens
tggttctaatagaac

SEQ ID NO: 1302730 - DNA, 13 bp, Homo sapiens
tggttctcatctt

SEQ ID NO: 1302731 - DNA, 20 bp, Homo sapiens
tggttgcacttatgatttca

SEQ ID NO: 1302732 - DNA, 16 bp, Homo sapiens
tggttggagaatttag

SEQ ID NO: 1302733 - DNA, 18 bp, Homo sapiens
tggtttaacttctgcctg

SEQ ID NO: 1302734 - DNA, 17 bp, Homo sapiens
tggttttgttcccctcc

SEQ ID NO: 1302735 - DNA, 19 bp, Homo sapiens
tgtaagaactacaaacaaa

SEQ ID NO: 1302736 - DNA, 16 bp, Homo sapiens
tgtaattttatatgaa

SEQ ID NO: 1302737 - DNA, 19 bp, Homo sapiens
tgtacatctattttggatt

SEQ ID NO: 1302738 - DNA, 14 bp, Homo sapiens
tgtaccatttgcct

SEQ ID NO: 1302739 - DNA, 16 bp, Homo sapiens
tgtagccccctggcct

SEQ ID NO: 1302740 - DNA, 17 bp, Homo sapiens
tgtagccccctggcctc

SEQ ID NO: 1302741 - DNA, 22 bp, Homo sapiens
tgtaggagctgccttggctcag

SEQ ID NO: 1302742 - DNA, 18 bp, Homo sapiens
tgtagtaattgacatgtg

SEQ ID NO: 1302743 - DNA, 19 bp, Homo sapiens
tgtagtaattgacatgtgc

SEQ ID NO: 1302744 - DNA, 20 bp, Homo sapiens
tgtagtccgtgctgacagct

SEQ ID NO: 1302745 - DNA, 14 bp, Homo sapiens
tgtatagttcacgt

SEQ ID NO: 1302746 - DNA, 23 bp, Homo sapiens
tgtatatttgtgatagcactttc

SEQ ID NO: 1302747 - DNA, 17 bp, Homo sapiens
tgtatggagagaaaaca

SEQ ID NO: 1302748 - DNA, 21 bp, Homo sapiens
tgtatttacgctttgattcat

SEQ ID NO: 1302749 - DNA, 18 bp, Homo sapiens
tgtcaaggctgcttagaa

SEQ ID NO: 1302750 - DNA, 21 bp, Homo sapiens
tgtcactcattgctgagcctc

SEQ ID NO: 1302751 - DNA, 16 bp, Homo sapiens
tgtcagtcacagccac

SEQ ID NO: 1302752 - DNA, 14 bp, Homo sapiens
tgtccccttctctc

SEQ ID NO: 1302753 - DNA, 20 bp, Homo sapiens
tgtccccttctctcatctct

SEQ ID NO: 1302754 - DNA, 14 bp, Homo sapiens
tgtccctctgcccc

SEQ ID NO: 1302755 - DNA, 15 bp, Homo sapiens
tgtccctctgcccca

SEQ ID NO: 1302756 - DNA, 17 bp, Homo sapiens
tgtcctcagccttgcca

SEQ ID NO: 1302757 - DNA, 20 bp, Homo sapiens
tgtcctcagccttgccagag

SEQ ID NO: 1302758 - DNA, 22 bp, Homo sapiens
tgtcctcagccttgccagagat

SEQ ID NO: 1302759 - DNA, 14 bp, Homo sapiens
tgtcctcaggtggc

SEQ ID NO: 1302760 - DNA, 19 bp, Homo sapiens
tgtcctcaggtggccatgc

SEQ ID NO: 1302761 - DNA, 17 bp, Homo sapiens
tttatacaaattagaaa

SEQ ID NO: 1302762 - DNA, 19 bp, Homo sapiens
tttatacaaattagaaaat

SEQ ID NO: 1302763 - DNA, 17 bp, Homo sapiens
tttatatgaagataagt

SEQ ID NO: 1302764 - DNA, 13 bp, Homo sapiens
tttatatgtacat

SEQ ID NO: 1302765 - DNA, 14 bp, Homo sapiens
tttatatgtacatg

SEQ ID NO: 1302766 - DNA, 18 bp, Homo sapiens
tttatctttgattctcct

SEQ ID NO: 1302767 - DNA, 21 bp, Homo sapiens
tttattaaatacaaaacttcc

SEQ ID NO: 1302768 - DNA, 17 bp, Homo sapiens
tttattaccccctcctt

SEQ ID NO: 1302769 - DNA, 20 bp, Homo sapiens
tttattacctctgatacctc

SEQ ID NO: 1302770 - DNA, 18 bp, Homo sapiens
tttattccagaatgctgt

SEQ ID NO: 1302771 - DNA, 23 bp, Homo sapiens
tttattccagaatgctgtacatc

SEQ ID NO: 1302772 - DNA, 13 bp, Homo sapiens
tttattgacacag

SEQ ID NO: 1302773 - DNA, 20 bp, Homo sapiens
tttatttacagatgaatgta

SEQ ID NO: 1302774 - DNA, 16 bp, Homo sapiens
tttatttctgcatatg

SEQ ID NO: 1302775 - DNA, 16 bp, Homo sapiens
tttcaactgccaaaat

SEQ ID NO: 1302776 - DNA, 18 bp, Homo sapiens
tttcaagtcaaattaata

SEQ ID NO: 1302777 - DNA, 15 bp, Homo sapiens
tttcacccctccctt

SEQ ID NO: 1302778 - DNA, 17 bp, Homo sapiens
tttcacccctccctttc

SEQ ID NO: 1302779 - DNA, 18 bp, Homo sapiens
tttcacccctccctttct

SEQ ID NO: 1302780 - DNA, 22 bp, Homo sapiens
tttcacccctccctttctcccc

SEQ ID NO: 1302781 - DNA, 16 bp, Homo sapiens
tttcagagaccattgc

SEQ ID NO: 1302782 - DNA, 12 bp, Homo sapiens
tttcatgtacaa

SEQ ID NO: 1302783 - DNA, 23 bp, Homo sapiens
tttcatgtgcggggatcatctgc

SEQ ID NO: 1302784 - DNA, 20 bp, Homo sapiens
tttcatttttttccaggctg

SEQ ID NO: 1302785 - DNA, 20 bp, Homo sapiens
tttccagtctccaccaggaa

SEQ ID NO: 1302786 - DNA, 17 bp, Homo sapiens
tttcctcccttctgcta

SEQ ID NO: 1302787 - DNA, 14 bp, Homo sapiens
tttcctccttccat

SEQ ID NO: 1302788 - DNA, 13 bp, Homo sapiens
tttccttaatcca

SEQ ID NO: 1302789 - DNA, 21 bp, Homo sapiens
tttctacaatgtgaactttat

SEQ ID NO: 1302790 - DNA, 22 bp, Homo sapiens
tttctacaatgtgaactttatt

SEQ ID NO: 1302791 - DNA, 17 bp, Homo sapiens
tttctcccctgccccca

SEQ ID NO: 1302792 - DNA, 13 bp, Homo sapiens
tttctgcatatgt

SEQ ID NO: 1302793 - DNA, 17 bp, Homo sapiens
tttctgcatatgttgaa

SEQ ID NO: 1302794 - DNA, 12 bp, Homo sapiens
tttcttgcctct

SEQ ID NO: 1302795 - DNA, 18 bp, Homo sapiens
tttctttaatgcttttat

SEQ ID NO: 1302796 - DNA, 16 bp, Homo sapiens
tttgaagctactgtgt

SEQ ID NO: 1302797 - DNA, 18 bp, Homo sapiens
tttgaagctactgtgtgt

SEQ ID NO: 1302798 - DNA, 12 bp, Homo sapiens
tttgaaggcaaa

SEQ ID NO: 1302799 - DNA, 13 bp, Homo sapiens
tttgaaggcaaaa

SEQ ID NO: 1302800 - DNA, 18 bp, Homo sapiens
tttgagaagaaaacatct

SEQ ID NO: 1302801 - DNA, 14 bp, Homo sapiens
tttgattctccttc

SEQ ID NO: 1302802 - DNA, 18 bp, Homo sapiens
tttgcattaaattcacaa

SEQ ID NO: 1302803 - DNA, 21 bp, Homo sapiens
tttgcattaaattcacaaact

SEQ ID NO: 1302804 - DNA, 16 bp, Homo sapiens
tttgcttagaaaagaa

SEQ ID NO: 1302805 - DNA, 18 bp, Homo sapiens
tttgctttgctttctgct

SEQ ID NO: 1302806 - DNA, 15 bp, Homo sapiens
tttggaatacttttt

SEQ ID NO: 1302807 - DNA, 20 bp, Homo sapiens
tttggattggggtccctcta

SEQ ID NO: 1302808 - DNA, 12 bp, Homo sapiens
tttggttctgtg

SEQ ID NO: 1302809 - DNA, 19 bp, Homo sapiens
tttggttttgttcccctcc

SEQ ID NO: 1302810 - DNA, 21 bp, Homo sapiens
tttggttttgttcccctcctc

SEQ ID NO: 1302811 - DNA, 20 bp, Homo sapiens
tttgtggccaaggagctgct

SEQ ID NO: 1302812 - DNA, 21 bp, Homo sapiens
tttgtggccaaggagctgcta

SEQ ID NO: 1302813 - DNA, 22 bp, Homo sapiens
tttgtggccaaggagctgctat

SEQ ID NO: 1302814 - DNA, 20 bp, Homo sapiens
tttgttcgcatggtcacaca

SEQ ID NO: 1302815 - DNA, 12 bp, Homo sapiens
ttttaagctgtt

SEQ ID NO: 1302816 - DNA, 22 bp, Homo sapiens
ttttatatgaagataagtgtat

SEQ ID NO: 1302817 - DNA, 23 bp, Homo sapiens
ttttcaactgccaaaatgctcta

SEQ ID NO: 1302818 - DNA, 14 bp, Homo sapiens
ttttcaatatttat

SEQ ID NO: 1302819 - DNA, 13 bp, Homo sapiens
ttttccaggctgg

SEQ ID NO: 1302820 - DNA, 16 bp, Homo sapiens
ttttctttaatgcttt

SEQ ID NO: 1302821 - DNA, 15 bp, Homo sapiens
ttttgaataaaaact

SEQ ID NO: 1302822 - DNA, 12 bp, Homo sapiens
ttttgctgtata

SEQ ID NO: 1302823 - DNA, 18 bp, Homo sapiens
ttttgttatcagtcaata

SEQ ID NO: 1302824 - DNA, 15 bp, Homo sapiens
ttttgttcccctcct

SEQ ID NO: 1302825 - DNA, 15 bp, Homo sapiens
tttttccttaatcca

SEQ ID NO: 1302826 - DNA, 13 bp, Homo sapiens
ttttttccatctt

SEQ ID NO: 1302827 - DNA, 22 bp, Homo sapiens
ttttttccatctttacaaaact

SEQ ID NO: 1302828 - DNA, 12 bp, Homo sapiens
tttttttcttta

SEQ ID NO: 1302829 - DNA, 14 bp, Homo sapiens
ggctagggggagcc

SEQ ID NO: 1302830 - DNA, 22 bp, Homo sapiens
ggctagtcaagctcctcctccc

SEQ ID NO: 1302831 - DNA, 23 bp, Homo sapiens
ggctagtcaagctcctcctccct

SEQ ID NO: 1302832 - DNA, 17 bp, Homo sapiens
ggctcacactgagaatg

SEQ ID NO: 1302833 - DNA, 18 bp, Homo sapiens
ggctcacactgagaatgt

SEQ ID NO: 1302834 - DNA, 15 bp, Homo sapiens
ggctcagccagcact

SEQ ID NO: 1302835 - DNA, 17 bp, Homo sapiens
ggctccagatgcagggc

SEQ ID NO: 1302836 - DNA, 12 bp, Homo sapiens
ggctcctctcag

SEQ ID NO: 1302837 - DNA, 12 bp, Homo sapiens
ggctcttctcat

SEQ ID NO: 1302838 - DNA, 20 bp, Homo sapiens
ggctcttctcatttcacccc

SEQ ID NO: 1302839 - DNA, 15 bp, Homo sapiens
ggctgaccacagcac

SEQ ID NO: 1302840 - DNA, 16 bp, Homo sapiens
ggctgaccacagcaca

SEQ ID NO: 1302841 - DNA, 17 bp, Homo sapiens
ggctgaggctggcacag

SEQ ID NO: 1302842 - DNA, 13 bp, Homo sapiens
ggctggactgagg

SEQ ID NO: 1302843 - DNA, 16 bp, Homo sapiens
ggctggactgaggcct

SEQ ID NO: 1302844 - DNA, 17 bp, Homo sapiens
ggctggactgaggcctg

SEQ ID NO: 1302845 - DNA, 24 bp, Homo sapiens
ggctggctccagatgcagggcagt

SEQ ID NO: 1302846 - DNA, 14 bp, Homo sapiens
ggctggtggcccag

SEQ ID NO: 1302847 - DNA, 17 bp, Homo sapiens
gggacagaggccccagc

SEQ ID NO: 1302848 - DNA, 20 bp, Homo sapiens
gggacagaggccccagcctc

SEQ ID NO: 1302849 - DNA, 14 bp, Homo sapiens
gggacgtggctcag

SEQ ID NO: 1302850 - DNA, 18 bp, Homo sapiens
gggacgtggctcagccag

SEQ ID NO: 1302851 - DNA, 18 bp, Homo sapiens
gggactgaagccaaagtt

SEQ ID NO: 1302852 - DNA, 15 bp, Homo sapiens
gggagaaaattcaat

SEQ ID NO: 1302853 - DNA, 10 bp, Homo sapiens
gggagcccac

SEQ ID NO: 1302854 - DNA, 20 bp, Homo sapiens
gggagcccactgtcctgggc

SEQ ID NO: 1302855 - DNA, 15 bp, Homo sapiens
gggaggctcaggtcc

SEQ ID NO: 1302856 - DNA, 14 bp, Homo sapiens
gggaggggcctagg

SEQ ID NO: 1302857 - DNA, 16 bp, Homo sapiens
gggagttaagacctgg

SEQ ID NO: 1302858 - DNA, 23 bp, Homo sapiens
gggagttaagacctggcagctct

SEQ ID NO: 1302859 - DNA, 19 bp, Homo sapiens
gggatctggtcctacccat

SEQ ID NO: 1302860 - DNA, 16 bp, Homo sapiens
gggatgccctggaggt

SEQ ID NO: 1302861 - DNA, 12 bp, Homo sapiens
gggcagggagcg

SEQ ID NO: 1302862 - DNA, 11 bp, Homo sapiens
gggccagagcc

SEQ ID NO: 1302863 - DNA, 14 bp, Homo sapiens
gggccagatccagc

SEQ ID NO: 1302864 - DNA, 16 bp, Homo sapiens
gggccagatccagcct

SEQ ID NO: 1302865 - DNA, 17 bp, Homo sapiens
gggccagatccagcctg

SEQ ID NO: 1302866 - DNA, 23 bp, Homo sapiens
gggccatgatggcaacagatctg

SEQ ID NO: 1302867 - DNA, 16 bp, Homo sapiens
gggccattctccacag

SEQ ID NO: 1302868 - DNA, 19 bp, Homo sapiens
gggcccagagcccagctcc

SEQ ID NO: 1302869 - DNA, 20 bp, Homo sapiens
gggcccagagcccagctcca

SEQ ID NO: 1302870 - DNA, 13 bp, Homo sapiens
gggcctgctccag

SEQ ID NO: 1302871 - DNA, 14 bp, Homo sapiens
gggcctgctccaga

SEQ ID NO: 1302872 - DNA, 16 bp, Homo sapiens
gggctgtcatctgtgc

SEQ ID NO: 1302873 - DNA, 11 bp, Homo sapiens
ggggagcccac

SEQ ID NO: 1302874 - DNA, 21 bp, Homo sapiens
ggggatccctcccccccatgc

SEQ ID NO: 1302875 - DNA, 17 bp, Homo sapiens
ggggccagatccagcct

SEQ ID NO: 1302876 - DNA, 23 bp, Homo sapiens
ggggcctaggcctcagccagaga

SEQ ID NO: 1302877 - DNA, 14 bp, Homo sapiens
ggggctcttctcat

SEQ ID NO: 1302878 - DNA, 22 bp, Homo sapiens
ggggcttagggtcggaacccaa

SEQ ID NO: 1302879 - DNA, 22 bp, Homo sapiens
gggggagccccttctgctcagc

SEQ ID NO: 1302880 - DNA, 21 bp, Homo sapiens
ggggtctggagttgatctgga

SEQ ID NO: 1302881 - DNA, 16 bp, Homo sapiens
ggggtgcccacaggcc

SEQ ID NO: 1302882 - DNA, 13 bp, Homo sapiens
ggggtgggccagg

SEQ ID NO: 1302883 - DNA, 14 bp, Homo sapiens
ggggtgggccaggc

SEQ ID NO: 1302884 - DNA, 16 bp, Homo sapiens
ggggtggggtcatgcc

SEQ ID NO: 1302885 - DNA, 13 bp, Homo sapiens
gggtcctggccat

SEQ ID NO: 1302886 - DNA, 20 bp, Homo sapiens
gggtgaacaaagcagccacg

SEQ ID NO: 1302887 - DNA, 23 bp, Homo sapiens
gggtgcagtatcatgccctgtgc

SEQ ID NO: 1302888 - DNA, 22 bp, Homo sapiens
gggtggcctaagagttgagctc

SEQ ID NO: 1302889 - DNA, 17 bp, Homo sapiens
gggtggggtcatgccct

SEQ ID NO: 1302890 - DNA, 21 bp, Homo sapiens
gggtggggtcatgccctcctc

SEQ ID NO: 1302891 - DNA, 20 bp, Homo sapiens
ggtaatcttgctctgcttga

SEQ ID NO: 1302892 - DNA, 15 bp, Homo sapiens
ggtacttcttgaagg

SEQ ID NO: 1302893 - DNA, 21 bp, Homo sapiens
ggtagccagcacacagggcag

SEQ ID NO: 1302894 - DNA, 21 bp, Homo sapiens
ggtcaggagttcctaaccagc

SEQ ID NO: 1302895 - DNA, 13 bp, Homo sapiens
ggtcaggcagggt

SEQ ID NO: 1302896 - DNA, 17 bp, Homo sapiens
ggtcctacccatccccg

SEQ ID NO: 1302897 - DNA, 21 bp, Homo sapiens
ggtcctctgtcagtcacagcc

SEQ ID NO: 1302898 - DNA, 23 bp, Homo sapiens
ggtcctctgtcagtcacagccac

SEQ ID NO: 1302899 - DNA, 13 bp, Homo sapiens
ggtcctggccatc

SEQ ID NO: 1302900 - DNA, 21 bp, Homo sapiens
ggtcctggccatcccacaagt

SEQ ID NO: 1302901 - DNA, 19 bp, Homo sapiens
ggtgaacaaagcagccacg

SEQ ID NO: 1302902 - DNA, 14 bp, Homo sapiens
ggtgcccacaggcc

SEQ ID NO: 1302903 - DNA, 14 bp, Homo sapiens
ggtgccccaggacc

SEQ ID NO: 1302904 - DNA, 15 bp, Homo sapiens
ggtgccccaggacca

SEQ ID NO: 1302905 - DNA, 17 bp, Homo sapiens
ggtgccccaggaccagc

SEQ ID NO: 1302906 - DNA, 22 bp, Homo sapiens
ggtgccccaggaccagctcagg

SEQ ID NO: 1302907 - DNA, 16 bp, Homo sapiens
ggtgctgacggccagg

SEQ ID NO: 1302908 - DNA, 17 bp, Homo sapiens
ggtgctgacggccaggg

SEQ ID NO: 1302909 - DNA, 21 bp, Homo sapiens
ggtgctgacttcatctcccac

SEQ ID NO: 1302910 - DNA, 13 bp, Homo sapiens
ggtgctgagaagc

SEQ ID NO: 1302911 - DNA, 20 bp, Homo sapiens
ggtggctagtcaagctcctc

SEQ ID NO: 1302912 - DNA, 15 bp, Homo sapiens
ggtggggtcatgccc

SEQ ID NO: 1302913 - DNA, 23 bp, Homo sapiens
ggtggttgctgttttcctccctt

SEQ ID NO: 1302914 - DNA, 16 bp, Homo sapiens
ggtgtgcacatctctg

SEQ ID NO: 1302915 - DNA, 23 bp, Homo sapiens
ggtgtgcacatctctgcttgagt

SEQ ID NO: 1302916 - DNA, 16 bp, Homo sapiens
ggttcccaagctcaga

SEQ ID NO: 1302917 - DNA, 20 bp, Homo sapiens
ggttgctgttttcctccctt

SEQ ID NO: 1302918 - DNA, 19 bp, Homo sapiens
ggttttgttcccctcctcc

SEQ ID NO: 1302919 - DNA, 13 bp, Homo sapiens
gtaaataaaaaga

SEQ ID NO: 1302920 - DNA, 14 bp, Homo sapiens
gtaaataaagccct

SEQ ID NO: 1302921 - DNA, 23 bp, Homo sapiens
gtaacccagattttgctgtatat

SEQ ID NO: 1302922 - DNA, 18 bp, Homo sapiens
gtaacttcttatggaatt

SEQ ID NO: 1302923 - DNA, 18 bp, Homo sapiens
gtaattttatatgaagat

SEQ ID NO: 1302924 - DNA, 18 bp, Homo sapiens
gtacatctattttggatt

SEQ ID NO: 1302925 - DNA, 23 bp, Homo sapiens
gtagccccctggcctctgtgcct

SEQ ID NO: 1302926 - DNA, 17 bp, Homo sapiens
gtagctgcaaaggacag

SEQ ID NO: 1302927 - DNA, 22 bp, Homo sapiens
gtaggagctgccttggctcaga

SEQ ID NO: 1302928 - DNA, 14 bp, Homo sapiens
gctggctccagatg

SEQ ID NO: 1302929 - DNA, 17 bp, Homo sapiens
gctgggacgtggctcag

SEQ ID NO: 1302930 - DNA, 21 bp, Homo sapiens
gctgggacgtggctcagccag

SEQ ID NO: 1302931 - DNA, 18 bp, Homo sapiens
gctgggggtgggccaggc

SEQ ID NO: 1302932 - DNA, 13 bp, Homo sapiens
gctgggtcaggca

SEQ ID NO: 1302933 - DNA, 15 bp, Homo sapiens
gctgggtcaggcagg

SEQ ID NO: 1302934 - DNA, 16 bp, Homo sapiens
gctgggtcaggcaggg

SEQ ID NO: 1302935 - DNA, 13 bp, Homo sapiens
gctggtggcccag

SEQ ID NO: 1302936 - DNA, 15 bp, Homo sapiens
gctggtggcccagga

SEQ ID NO: 1302937 - DNA, 21 bp, Homo sapiens
gctggttcggatttggggtgg

SEQ ID NO: 1302938 - DNA, 16 bp, Homo sapiens
gctgtacatctatttt

SEQ ID NO: 1302939 - DNA, 20 bp, Homo sapiens
gctgtacatctattttggat

SEQ ID NO: 1302940 - DNA, 22 bp, Homo sapiens
gctgtacatctattttggattg

SEQ ID NO: 1302941 - DNA, 15 bp, Homo sapiens
gctgtcatctgtgca

SEQ ID NO: 1302942 - DNA, 16 bp, Homo sapiens
gctgtcatctgtgcac

SEQ ID NO: 1302943 - DNA, 22 bp, Homo sapiens
gctgtcatctgtgcactgccca

SEQ ID NO: 1302944 - DNA, 19 bp, Homo sapiens
gctgtcctcaggtggccat

SEQ ID NO: 1302945 - DNA, 15 bp, Homo sapiens
gctgttttcctccct

SEQ ID NO: 1302946 - DNA, 22 bp, Homo sapiens
gctgttttcctcccttctgcta

SEQ ID NO: 1302947 - DNA, 12 bp, Homo sapiens
gcttctgcctgc

SEQ ID NO: 1302948 - DNA, 17 bp, Homo sapiens
gctttattccagaatgc

SEQ ID NO: 1302949 - DNA, 12 bp, Homo sapiens
gctttgctgctg

SEQ ID NO: 1302950 - DNA, 18 bp, Homo sapiens
gctttgctgctgaaggct

SEQ ID NO: 1302951 - DNA, 17 bp, Homo sapiens
gctttttatttctgcat

SEQ ID NO: 1302952 - DNA, 14 bp, Homo sapiens
ggaacccagactca

SEQ ID NO: 1302953 - DNA, 15 bp, Homo sapiens
ggaacccagactcag

SEQ ID NO: 1302954 - DNA, 13 bp, Homo sapiens
ggaacctcagcct

SEQ ID NO: 1302955 - DNA, 19 bp, Homo sapiens
ggaacctcagcctggccag

SEQ ID NO: 1302956 - DNA, 20 bp, Homo sapiens
ggaacctcagcctggccaga

SEQ ID NO: 1302957 - DNA, 18 bp, Homo sapiens
ggaacctgacgtagctgc

SEQ ID NO: 1302958 - DNA, 20 bp, Homo sapiens
ggaactcagatccagggaca

SEQ ID NO: 1302959 - DNA, 15 bp, Homo sapiens
ggaactgcatgctgc

SEQ ID NO: 1302960 - DNA, 22 bp, Homo sapiens
ggaagcccccaccgtgggcagg

SEQ ID NO: 1302961 - DNA, 16 bp, Homo sapiens
ggaagtccaatgtggc

SEQ ID NO: 1302962 - DNA, 17 bp, Homo sapiens
ggaagtccaatgtggca

SEQ ID NO: 1302963 - DNA, 17 bp, Homo sapiens
ggaatactttttgttat

SEQ ID NO: 1302964 - DNA, 15 bp, Homo sapiens
ggaatgtgtggcctg

SEQ ID NO: 1302965 - DNA, 15 bp, Homo sapiens
ggaatttcccaggac

SEQ ID NO: 1302966 - DNA, 16 bp, Homo sapiens
ggaatttcccaggacc

SEQ ID NO: 1302967 - DNA, 16 bp, Homo sapiens
ggacacttaatactac

SEQ ID NO: 1302968 - DNA, 19 bp, Homo sapiens
ggacagatccagggactga

SEQ ID NO: 1302969 - DNA, 14 bp, Homo sapiens
ggacagccccaccc

SEQ ID NO: 1302970 - DNA, 17 bp, Homo sapiens
ggaccatcatcctactg

SEQ ID NO: 1302971 - DNA, 22 bp, Homo sapiens
ggacccatgagttggggtctgg

SEQ ID NO: 1302972 - DNA, 18 bp, Homo sapiens
ggaccttaggccttcctc

SEQ ID NO: 1302973 - DNA, 19 bp, Homo sapiens
ggaccttcgggctgtgccc

SEQ ID NO: 1302974 - DNA, 19 bp, Homo sapiens
ggacgtggctcagccagca

SEQ ID NO: 1302975 - DNA, 20 bp, Homo sapiens
ggactatatttgggcctgct

SEQ ID NO: 1302976 - DNA, 23 bp, Homo sapiens
ggactgggccacttctgggtggg

SEQ ID NO: 1302977 - DNA, 18 bp, Homo sapiens
ggacttcctgtccagctc

SEQ ID NO: 1302978 - DNA, 19 bp, Homo sapiens
ggagaagccacaggcctga

SEQ ID NO: 1302979 - DNA, 12 bp, Homo sapiens
ggagaagccagg

SEQ ID NO: 1302980 - DNA, 13 bp, Homo sapiens
ggagaagccagga

SEQ ID NO: 1302981 - DNA, 17 bp, Homo sapiens
ggagcccactgtcctgg

SEQ ID NO: 1302982 - DNA, 18 bp, Homo sapiens
ggagcccactgtcctggg

SEQ ID NO: 1302983 - DNA, 21 bp, Homo sapiens
ggagccccttctgctcagctc

SEQ ID NO: 1302984 - DNA, 21 bp, Homo sapiens
ggagcttttttccttaatcca

SEQ ID NO: 1302985 - DNA, 14 bp, Homo sapiens
ggaggcaagccctg

SEQ ID NO: 1302986 - DNA, 22 bp, Homo sapiens
ggaggcactttagggctgtaaa

SEQ ID NO: 1302987 - DNA, 13 bp, Homo sapiens
ggaggcccagttc

SEQ ID NO: 1302988 - DNA, 15 bp, Homo sapiens
ggaggctcaggtccc

SEQ ID NO: 1302989 - DNA, 15 bp, Homo sapiens
ggaggggcctaggcc

SEQ ID NO: 1302990 - DNA, 21 bp, Homo sapiens
ggaggggcctaggcctcagcc

SEQ ID NO: 1302991 - DNA, 18 bp, Homo sapiens
ggagttaagacctggcag

SEQ ID NO: 1302992 - DNA, 12 bp, Homo sapiens
ggagttatctaa

SEQ ID NO: 1302993 - DNA, 22 bp, Homo sapiens
ggagttgatctggaacccagac

SEQ ID NO: 1302994 - DNA, 14 bp, Homo sapiens
ggatagatgctggc

SEQ ID NO: 1302995 - DNA, 18 bp, Homo sapiens
ggatagatgctggcccag

SEQ ID NO: 1302996 - DNA, 17 bp, Homo sapiens
ggatccctcccccccat

SEQ ID NO: 1302997 - DNA, 18 bp, Homo sapiens
ggatctggggctctggga

SEQ ID NO: 1302998 - DNA, 17 bp, Homo sapiens
ggatctggtcctaccca

SEQ ID NO: 1302999 - DNA, 15 bp, Homo sapiens
ggatgccctggaggt

SEQ ID NO: 1303000 - DNA, 15 bp, Homo sapiens
ggatgggggaactca

SEQ ID NO: 1303001 - DNA, 17 bp, Homo sapiens
ggatgggggaactcaga

SEQ ID NO: 1303002 - DNA, 16 bp, Homo sapiens
ggattggggtccctct

SEQ ID NO: 1303003 - DNA, 17 bp, Homo sapiens
ggattggggtccctcta

SEQ ID NO: 1303004 - DNA, 13 bp, Homo sapiens
ggcaaaattgcaa

SEQ ID NO: 1303005 - DNA, 19 bp, Homo sapiens
ggcaacagatctggaacct

SEQ ID NO: 1303006 - DNA, 21 bp, Homo sapiens
ggcaatgggagctgaggccac

SEQ ID NO: 1303007 - DNA, 16 bp, Homo sapiens
ggcaccagacacccag

SEQ ID NO: 1303008 - DNA, 20 bp, Homo sapiens
ggcaccagacacccaggact

SEQ ID NO: 1303009 - DNA, 15 bp, Homo sapiens
ggcacctaatccagg

SEQ ID NO: 1303010 - DNA, 16 bp, Homo sapiens
ggcagatccaggacta

SEQ ID NO: 1303011 - DNA, 18 bp, Homo sapiens
ggcagcagaagggggtgg

SEQ ID NO: 1303012 - DNA, 14 bp, Homo sapiens
ggcagcctcccatc

SEQ ID NO: 1303013 - DNA, 22 bp, Homo sapiens
ggcagcctcccatccagggccc

SEQ ID NO: 1303014 - DNA, 20 bp, Homo sapiens
ggcagtcattggctgtctcc

SEQ ID NO: 1303015 - DNA, 16 bp, Homo sapiens
ggcagtgagggagggc

SEQ ID NO: 1303016 - DNA, 14 bp, Homo sapiens
ggccaaggagctgc

SEQ ID NO: 1303017 - DNA, 15 bp, Homo sapiens
ggccaaggagctgct

SEQ ID NO: 1303018 - DNA, 18 bp, Homo sapiens
ggccagagagcctggtgc

SEQ ID NO: 1303019 - DNA, 11 bp, Homo sapiens
ggccagagcca

SEQ ID NO: 1303020 - DNA, 14 bp, Homo sapiens
ggccagccatgtct

SEQ ID NO: 1303021 - DNA, 17 bp, Homo sapiens
ggccagggagaagctcc

SEQ ID NO: 1303022 - DNA, 18 bp, Homo sapiens
ggccatgatggcaacaga

SEQ ID NO: 1303023 - DNA, 22 bp, Homo sapiens
ggccatgatggcaacagatctg

SEQ ID NO: 1303024 - DNA, 20 bp, Homo sapiens
ggccattctccacagcaacc

SEQ ID NO: 1303025 - DNA, 14 bp, Homo sapiens
ggcccagagcccag

SEQ ID NO: 1303026 - DNA, 15 bp, Homo sapiens
ggcccagagcccagc

SEQ ID NO: 1303027 - DNA, 18 bp, Homo sapiens
ggcccagagcccagctcc

SEQ ID NO: 1303028 - DNA, 14 bp, Homo sapiens
ggcccagggcccag

SEQ ID NO: 1303029 - DNA, 17 bp, Homo sapiens
ggcccagggcccagagc

SEQ ID NO: 1303030 - DNA, 21 bp, Homo sapiens
ggcccagggcccagagcccag

SEQ ID NO: 1303031 - DNA, 20 bp, Homo sapiens
ggccctccctgttccccaga

SEQ ID NO: 1303032 - DNA, 23 bp, Homo sapiens
ggccctccctgttccccagagaa

SEQ ID NO: 1303033 - DNA, 16 bp, Homo sapiens
ggccgagtccaagctg

SEQ ID NO: 1303034 - DNA, 12 bp, Homo sapiens
ggccgctgccac

SEQ ID NO: 1303035 - DNA, 15 bp, Homo sapiens
ggccggccagcccct

SEQ ID NO: 1303036 - DNA, 20 bp, Homo sapiens
ggcctacagctttgatccct

SEQ ID NO: 1303037 - DNA, 23 bp, Homo sapiens
tgcattttggagagtttcctgaa

SEQ ID NO: 1303038 - DNA, 17 bp, Homo sapiens
tgccaaaatgctctagt

SEQ ID NO: 1303039 - DNA, 14 bp, Homo sapiens
tgccacaggacaca

SEQ ID NO: 1303040 - DNA, 20 bp, Homo sapiens
tgccacccacctccctgcct

SEQ ID NO: 1303041 - DNA, 14 bp, Homo sapiens
tgccagagatccaa

SEQ ID NO: 1303042 - DNA, 15 bp, Homo sapiens
tgccagctgcactga

SEQ ID NO: 1303043 - DNA, 22 bp, Homo sapiens
tgccagggcaatgatgaatgag

SEQ ID NO: 1303044 - DNA, 21 bp, Homo sapiens
tgcccacaggccgccctgcgg

SEQ ID NO: 1303045 - DNA, 24 bp, Homo sapiens
tgcccatggacaggctggctccag

SEQ ID NO: 1303046 - DNA, 14 bp, Homo sapiens
tgccccaggaccag

SEQ ID NO: 1303047 - DNA, 19 bp, Homo sapiens
tgccccatcctccagcagg

SEQ ID NO: 1303048 - DNA, 17 bp, Homo sapiens
tgcccccactgaccaga

SEQ ID NO: 1303049 - DNA, 14 bp, Homo sapiens
tgcccccaggactg

SEQ ID NO: 1303050 - DNA, 15 bp, Homo sapiens
tgcccccaggactgg

SEQ ID NO: 1303051 - DNA, 19 bp, Homo sapiens
tgcccccaggactgggcca

SEQ ID NO: 1303052 - DNA, 13 bp, Homo sapiens
tgccgcagagctg

SEQ ID NO: 1303053 - DNA, 14 bp, Homo sapiens
tgccgcagagctgg

SEQ ID NO: 1303054 - DNA, 15 bp, Homo sapiens
tgcctcagccctgac

SEQ ID NO: 1303055 - DNA, 12 bp, Homo sapiens
tgcctccagggc

SEQ ID NO: 1303056 - DNA, 18 bp, Homo sapiens
tgcctccagggctggact

SEQ ID NO: 1303057 - DNA, 16 bp, Homo sapiens
tgcctgccagctgcac

SEQ ID NO: 1303058 - DNA, 19 bp, Homo sapiens
tgcctgccagctgcactga

SEQ ID NO: 1303059 - DNA, 17 bp, Homo sapiens
tgcgccaccgcccagag

SEQ ID NO: 1303060 - DNA, 18 bp, Homo sapiens
tgcgggtgaacaaagcag

SEQ ID NO: 1303061 - DNA, 15 bp, Homo sapiens
tgcggtagccagcac

SEQ ID NO: 1303062 - DNA, 18 bp, Homo sapiens
tgcggtagccagcacaca

SEQ ID NO: 1303063 - DNA, 18 bp, Homo sapiens
tgctcagctctgggccat

SEQ ID NO: 1303064 - DNA, 20 bp, Homo sapiens
tgctcagctctgggccattc

SEQ ID NO: 1303065 - DNA, 12 bp, Homo sapiens
tgctccagacct

SEQ ID NO: 1303066 - DNA, 20 bp, Homo sapiens
tgctcctagagggaggggcc

SEQ ID NO: 1303067 - DNA, 24 bp, Homo sapiens
tgctcctagagggaggggcctagg

SEQ ID NO: 1303068 - DNA, 14 bp, Homo sapiens
tgctccttgttcct

SEQ ID NO: 1303069 - DNA, 14 bp, Homo sapiens
tgctcgccccagca

SEQ ID NO: 1303070 - DNA, 14 bp, Homo sapiens
tgctctagtgcctt

SEQ ID NO: 1303071 - DNA, 12 bp, Homo sapiens
tgctctccttcc

SEQ ID NO: 1303072 - DNA, 15 bp, Homo sapiens
tgctgacagctgctc

SEQ ID NO: 1303073 - DNA, 18 bp, Homo sapiens
tgctgacattcacctgcc

SEQ ID NO: 1303074 - DNA, 14 bp, Homo sapiens
tgctgagcctctgc

SEQ ID NO: 1303075 - DNA, 17 bp, Homo sapiens
tgctgagcctctgctcc

SEQ ID NO: 1303076 - DNA, 18 bp, Homo sapiens
tgctgatttggtgaccaa

SEQ ID NO: 1303077 - DNA, 16 bp, Homo sapiens
tgctggacagtatcac

SEQ ID NO: 1303078 - DNA, 20 bp, Homo sapiens
tgctggagtttcatgtacaa

SEQ ID NO: 1303079 - DNA, 17 bp, Homo sapiens
tgctggcccagggccca

SEQ ID NO: 1303080 - DNA, 20 bp, Homo sapiens
tgctggcccagggcccagag

SEQ ID NO: 1303081 - DNA, 22 bp, Homo sapiens
tgctggcccagggcccagagcc

SEQ ID NO: 1303082 - DNA, 23 bp, Homo sapiens
tgctggcccagggcccagagccc

SEQ ID NO: 1303083 - DNA, 21 bp, Homo sapiens
tgctgtatatttgtgatagca

SEQ ID NO: 1303084 - DNA, 12 bp, Homo sapiens
tgctgtcctcag

SEQ ID NO: 1303085 - DNA, 14 bp, Homo sapiens
tgctgtcctcaggt

SEQ ID NO: 1303086 - DNA, 15 bp, Homo sapiens
tgctgttttcctccc

SEQ ID NO: 1303087 - DNA, 21 bp, Homo sapiens
tgctgttttcctcccttctgc

SEQ ID NO: 1303088 - DNA, 16 bp, Homo sapiens
tgcttgacaacatctg

SEQ ID NO: 1303089 - DNA, 20 bp, Homo sapiens
tgcttgagtcaggtttgagt

SEQ ID NO: 1303090 - DNA, 20 bp, Homo sapiens
tgctttctgctcagcttctc

SEQ ID NO: 1303091 - DNA, 18 bp, Homo sapiens
tgctttttatttctgcat

SEQ ID NO: 1303092 - DNA, 19 bp, Homo sapiens
tgctttttatttctgcata

SEQ ID NO: 1303093 - DNA, 15 bp, Homo sapiens
tggaacacggccaca

SEQ ID NO: 1303094 - DNA, 17 bp, Homo sapiens
tggaacacggccacatc

SEQ ID NO: 1303095 - DNA, 17 bp, Homo sapiens
tggaacctcagcctggc

SEQ ID NO: 1303096 - DNA, 23 bp, Homo sapiens
tggaacctcagcctggccagaca

SEQ ID NO: 1303097 - DNA, 18 bp, Homo sapiens
tggaatctggagaccagg

SEQ ID NO: 1303098 - DNA, 12 bp, Homo sapiens
tggaattgattt

SEQ ID NO: 1303099 - DNA, 16 bp, Homo sapiens
tggaattgatttgcat

SEQ ID NO: 1303100 - DNA, 19 bp, Homo sapiens
tggaattgatttgcattga

SEQ ID NO: 1303101 - DNA, 20 bp, Homo sapiens
tggaattgatttgcattgaa

SEQ ID NO: 1303102 - DNA, 23 bp, Homo sapiens
tggaattgatttgcattgaacac

SEQ ID NO: 1303103 - DNA, 23 bp, Homo sapiens
tggacacttaatactaccttgaa

SEQ ID NO: 1303104 - DNA, 12 bp, Homo sapiens
tggacagcccca

SEQ ID NO: 1303105 - DNA, 16 bp, Homo sapiens
tggaccttaggccttc

SEQ ID NO: 1303106 - DNA, 17 bp, Homo sapiens
tggaccttaggccttcc

SEQ ID NO: 1303107 - DNA, 14 bp, Homo sapiens
tggactcagggcag

SEQ ID NO: 1303108 - DNA, 15 bp, Homo sapiens
tggactcagggcagc

SEQ ID NO: 1303109 - DNA, 18 bp, Homo sapiens
tggactcagggcagcgcc

SEQ ID NO: 1303110 - DNA, 16 bp, Homo sapiens
tggactgaggcctgag

SEQ ID NO: 1303111 - DNA, 15 bp, Homo sapiens
tggacttgtcctcag

SEQ ID NO: 1303112 - DNA, 23 bp, Homo sapiens
tggagaagccacaggcctgagat

SEQ ID NO: 1303113 - DNA, 18 bp, Homo sapiens
tggagaggccctctggag

SEQ ID NO: 1303114 - DNA, 16 bp, Homo sapiens
tggagagtttcctgaa

SEQ ID NO: 1303115 - DNA, 17 bp, Homo sapiens
tggagagtttcctgaaa

SEQ ID NO: 1303116 - DNA, 13 bp, Homo sapiens
tggagccagctcc

SEQ ID NO: 1303117 - DNA, 14 bp, Homo sapiens
tggagcttttttcc

SEQ ID NO: 1303118 - DNA, 15 bp, Homo sapiens
tggaggcccagttca

SEQ ID NO: 1303119 - DNA, 22 bp, Homo sapiens
tggagggacaagtggactcagg

SEQ ID NO: 1303120 - DNA, 18 bp, Homo sapiens
tggatacatacaccagca

SEQ ID NO: 1303121 - DNA, 18 bp, Homo sapiens
tggcaaagcttttagaaa

SEQ ID NO: 1303122 - DNA, 20 bp, Homo sapiens
tggcaacagatctggaacct

SEQ ID NO: 1303123 - DNA, 22 bp, Homo sapiens
tggcaacagatctggaacctca

SEQ ID NO: 1303124 - DNA, 16 bp, Homo sapiens
tggcaaggaaaaacag

SEQ ID NO: 1303125 - DNA, 16 bp, Homo sapiens
tggcaccagacaccca

SEQ ID NO: 1303126 - DNA, 21 bp, Homo sapiens
tggcaccagacacccaggact

SEQ ID NO: 1303127 - DNA, 20 bp, Homo sapiens
tggcacctaatccaggcaga

SEQ ID NO: 1303128 - DNA, 15 bp, Homo sapiens
tggcactggatgcag

SEQ ID NO: 1303129 - DNA, 19 bp, Homo sapiens
tggcagcctcccatccagg

SEQ ID NO: 1303130 - DNA, 21 bp, Homo sapiens
tggcaggggtggctgcctcat

SEQ ID NO: 1303131 - DNA, 19 bp, Homo sapiens
tggccaaggagctgctata

SEQ ID NO: 1303132 - DNA, 17 bp, Homo sapiens
tggccacagtagtcttg

SEQ ID NO: 1303133 - DNA, 13 bp, Homo sapiens
tggccatcccaca

SEQ ID NO: 1303134 - DNA, 14 bp, Homo sapiens
tggccatgcctcag

SEQ ID NO: 1303135 - DNA, 20 bp, Homo sapiens
tggccatgcctcagccctga

SEQ ID NO: 1303136 - DNA, 14 bp, Homo sapiens
tggcccagggccca

SEQ ID NO: 1303137 - DNA, 16 bp, Homo sapiens
tggcccagggcccaga

SEQ ID NO: 1303138 - DNA, 12 bp, Homo sapiens
tggccccaggac

SEQ ID NO: 1303139 - DNA, 22 bp, Homo sapiens
tggcctgatcagaccacggctc

SEQ ID NO: 1303140 - DNA, 17 bp, Homo sapiens
tggctagtcaagctcct

SEQ ID NO: 1303141 - DNA, 22 bp, Homo sapiens
tggctagtcaagctcctcctcc

SEQ ID NO: 1303142 - DNA, 12 bp, Homo sapiens
tggctcacactg

SEQ ID NO: 1303143 - DNA, 15 bp, Homo sapiens
tggctcacactgaga

SEQ ID NO: 1303144 - DNA, 16 bp, Homo sapiens
tggctcacactgagaa

SEQ ID NO: 1303145 - DNA, 18 bp, Homo sapiens
tggctcagacatgttttc

SEQ ID NO: 1303146 - DNA, 12 bp, Homo sapiens
tggctcagccag

SEQ ID NO: 1303147 - DNA, 20 bp, Homo sapiens
tggctccagatgcagggcag

SEQ ID NO: 1303148 - DNA, 14 bp, Homo sapiens
tggctcctctcagt

SEQ ID NO: 1303149 - DNA, 17 bp, Homo sapiens
tggctttggcttcttgg

SEQ ID NO: 1303150 - DNA, 17 bp, Homo sapiens
tgggagggaggctcagg

SEQ ID NO: 1303151 - DNA, 17 bp, Homo sapiens
tgggattcaggaatgtg

SEQ ID NO: 1303152 - DNA, 13 bp, Homo sapiens
tgggccagacatg

SEQ ID NO: 1303153 - DNA, 18 bp, Homo sapiens
tgggccagacatgccaca

SEQ ID NO: 1303154 - DNA, 20 bp, Homo sapiens
tgggccattctccacagcaa

SEQ ID NO: 1303155 - DNA, 15 bp, Homo sapiens
tgggctcctccaggg

SEQ ID NO: 1303156 - DNA, 19 bp, Homo sapiens
tgaagccaattcagacagg

SEQ ID NO: 1303157 - DNA, 22 bp, Homo sapiens
tgaagctactgtgtgtgtgaat

SEQ ID NO: 1303158 - DNA, 22 bp, Homo sapiens
tgaaggagaggcaacatccaaa

SEQ ID NO: 1303159 - DNA, 14 bp, Homo sapiens
tgaaggcaaaattg

SEQ ID NO: 1303160 - DNA, 18 bp, Homo sapiens
tgaagggccagagccagg

SEQ ID NO: 1303161 - DNA, 15 bp, Homo sapiens
tgaaggtgctgacgg

SEQ ID NO: 1303162 - DNA, 15 bp, Homo sapiens
tgaagttttacattg

SEQ ID NO: 1303163 - DNA, 21 bp, Homo sapiens
tgaataaaaactttgctaaat

SEQ ID NO: 1303164 - DNA, 21 bp, Homo sapiens
tgaatcagtataaacaaagtt

SEQ ID NO: 1303165 - DNA, 22 bp, Homo sapiens
tgaatcagtataaacaaagtta

SEQ ID NO: 1303166 - DNA, 14 bp, Homo sapiens
tgaatgagaatcta

SEQ ID NO: 1303167 - DNA, 11 bp, Homo sapiens
tgaatgtattt

SEQ ID NO: 1303168 - DNA, 15 bp, Homo sapiens
tgaatgtatttattt

SEQ ID NO: 1303169 - DNA, 16 bp, Homo sapiens
tgacacaagtggacct

SEQ ID NO: 1303170 - DNA, 17 bp, Homo sapiens
tgacacaagtggacctt

SEQ ID NO: 1303171 - DNA, 16 bp, Homo sapiens
tgacacaggtctttcc

SEQ ID NO: 1303172 - DNA, 18 bp, Homo sapiens
tgacacaggtctttccta

SEQ ID NO: 1303173 - DNA, 21 bp, Homo sapiens
tgacagagcaagactctgtct

SEQ ID NO: 1303174 - DNA, 18 bp, Homo sapiens
tgacagctgctcctagag

SEQ ID NO: 1303175 - DNA, 13 bp, Homo sapiens
tgacagctttgct

SEQ ID NO: 1303176 - DNA, 20 bp, Homo sapiens
tgacagctttgctgctgaag

SEQ ID NO: 1303177 - DNA, 14 bp, Homo sapiens
tgacatctggaatc

SEQ ID NO: 1303178 - DNA, 16 bp, Homo sapiens
tgacatgattccttcc

SEQ ID NO: 1303179 - DNA, 15 bp, Homo sapiens
tgacattgcgtttga

SEQ ID NO: 1303180 - DNA, 16 bp, Homo sapiens
tgaccaaagtcctttt

SEQ ID NO: 1303181 - DNA, 17 bp, Homo sapiens
tgaccacagcacagcca

SEQ ID NO: 1303182 - DNA, 19 bp, Homo sapiens
tgaccacagcacagccaac

SEQ ID NO: 1303183 - DNA, 21 bp, Homo sapiens
tgaccacgctttctagctgtt

SEQ ID NO: 1303184 - DNA, 11 bp, Homo sapiens
tgaccagcagc

SEQ ID NO: 1303185 - DNA, 21 bp, Homo sapiens
tgacccagccccttgagaaac

SEQ ID NO: 1303186 - DNA, 23 bp, Homo sapiens
tgacccagtgcccccactgacca

SEQ ID NO: 1303187 - DNA, 14 bp, Homo sapiens
tgacccccagctcc

SEQ ID NO: 1303188 - DNA, 19 bp, Homo sapiens
tgaccgcgactaatttcaa

SEQ ID NO: 1303189 - DNA, 17 bp, Homo sapiens
tgactctggcaaagctt

SEQ ID NO: 1303190 - DNA, 23 bp, Homo sapiens
tgagaagaaaacatctattctct

SEQ ID NO: 1303191 - DNA, 15 bp, Homo sapiens
tgagaatgtaagaac

SEQ ID NO: 1303192 - DNA, 17 bp, Homo sapiens
tgagacacggagcccag

SEQ ID NO: 1303193 - DNA, 22 bp, Homo sapiens
tgagagaaatatggaacttaca

SEQ ID NO: 1303194 - DNA, 21 bp, Homo sapiens
tgagcacaactttaagaggac

SEQ ID NO: 1303195 - DNA, 17 bp, Homo sapiens
tgagcccctgtctagag

SEQ ID NO: 1303196 - DNA, 21 bp, Homo sapiens
tgagcccctgtctagagaggg

SEQ ID NO: 1303197 - DNA, 17 bp, Homo sapiens
tgagcctctgctcccca

SEQ ID NO: 1303198 - DNA, 14 bp, Homo sapiens
tgagcgctcctgcc

SEQ ID NO: 1303199 - DNA, 18 bp, Homo sapiens
tgagcgctcctgccgcag

SEQ ID NO: 1303200 - DNA, 22 bp, Homo sapiens
tgagcgctcctgccgcagagct

SEQ ID NO: 1303201 - DNA, 16 bp, Homo sapiens
tgagctattgctgttc

SEQ ID NO: 1303202 - DNA, 16 bp, Homo sapiens
tgagctctcggaactg

SEQ ID NO: 1303203 - DNA, 13 bp, Homo sapiens
tgaggagctgggg

SEQ ID NO: 1303204 - DNA, 14 bp, Homo sapiens
tgaggcaagagaat

SEQ ID NO: 1303205 - DNA, 12 bp, Homo sapiens
tgaggccacact

SEQ ID NO: 1303206 - DNA, 20 bp, Homo sapiens
tgaggccacactcagcacaa

SEQ ID NO: 1303207 - DNA, 11 bp, Homo sapiens
tgaggctggca

SEQ ID NO: 1303208 - DNA, 15 bp, Homo sapiens
tgaggctggcacagg

SEQ ID NO: 1303209 - DNA, 17 bp, Homo sapiens
tgaggctggcacaggac

SEQ ID NO: 1303210 - DNA, 20 bp, Homo sapiens
tgagtcaggtttgagtagag

SEQ ID NO: 1303211 - DNA, 16 bp, Homo sapiens
tgagttacagcctgtt

SEQ ID NO: 1303212 - DNA, 22 bp, Homo sapiens
tgataactagatggtgctgaga

SEQ ID NO: 1303213 - DNA, 23 bp, Homo sapiens
tgataactagatggtgctgagaa

SEQ ID NO: 1303214 - DNA, 19 bp, Homo sapiens
tgatagacacatatgaggg

SEQ ID NO: 1303215 - DNA, 21 bp, Homo sapiens
tgatagcactttctacaatgt

SEQ ID NO: 1303216 - DNA, 14 bp, Homo sapiens
tgatatatttaaaa

SEQ ID NO: 1303217 - DNA, 19 bp, Homo sapiens
tgatatatttaaaaatatt

SEQ ID NO: 1303218 - DNA, 21 bp, Homo sapiens
tgatatcatgcccctgtactc

SEQ ID NO: 1303219 - DNA, 19 bp, Homo sapiens
tgatatccattctttctga

SEQ ID NO: 1303220 - DNA, 21 bp, Homo sapiens
tgatatccattctttctgata

SEQ ID NO: 1303221 - DNA, 17 bp, Homo sapiens
tgatcaacatcttttct

SEQ ID NO: 1303222 - DNA, 18 bp, Homo sapiens
tgatcaacatcttttctt

SEQ ID NO: 1303223 - DNA, 17 bp, Homo sapiens
tgatcagatctgacatg

SEQ ID NO: 1303224 - DNA, 23 bp, Homo sapiens
tgatcagatctgacatgattcct

SEQ ID NO: 1303225 - DNA, 18 bp, Homo sapiens
tgatggcaacagatctgg

SEQ ID NO: 1303226 - DNA, 22 bp, Homo sapiens
tgatgtgaagccaattcagaca

SEQ ID NO: 1303227 - DNA, 12 bp, Homo sapiens
tgattccttcct

SEQ ID NO: 1303228 - DNA, 18 bp, Homo sapiens
tgattccttcctgttctg

SEQ ID NO: 1303229 - DNA, 20 bp, Homo sapiens
tgattccttcctgttctgaa

SEQ ID NO: 1303230 - DNA, 22 bp, Homo sapiens
tgattctatttatatgtacatg

SEQ ID NO: 1303231 - DNA, 18 bp, Homo sapiens
tgattctccttcagccct

SEQ ID NO: 1303232 - DNA, 16 bp, Homo sapiens
tgattctgcagtaaat

SEQ ID NO: 1303233 - DNA, 17 bp, Homo sapiens
tgattgacagctttgct

SEQ ID NO: 1303234 - DNA, 19 bp, Homo sapiens
tgattgacagctttgctgc

SEQ ID NO: 1303235 - DNA, 12 bp, Homo sapiens
tgattgatttga

SEQ ID NO: 1303236 - DNA, 14 bp, Homo sapiens
tgattgatttgaag

SEQ ID NO: 1303237 - DNA, 22 bp, Homo sapiens
tgatttaggagaagccaggaat

SEQ ID NO: 1303238 - DNA, 14 bp, Homo sapiens
tgatttccttgaat

SEQ ID NO: 1303239 - DNA, 23 bp, Homo sapiens
tgatttccttgaatgtggcttga

SEQ ID NO: 1303240 - DNA, 13 bp, Homo sapiens
tgatttgcattga

SEQ ID NO: 1303241 - DNA, 18 bp, Homo sapiens
tgatttgcattgaacaca

SEQ ID NO: 1303242 - DNA, 19 bp, Homo sapiens
tgatttggtgaccaactgt

SEQ ID NO: 1303243 - DNA, 13 bp, Homo sapiens
tgattttttgcat

SEQ ID NO: 1303244 - DNA, 23 bp, Homo sapiens
tgcaaagatctgtcctcagcctt

SEQ ID NO: 1303245 - DNA, 16 bp, Homo sapiens
tgcaagggactgtgtg

SEQ ID NO: 1303246 - DNA, 21 bp, Homo sapiens
tgcaagggactgtgtgttgcc

SEQ ID NO: 1303247 - DNA, 23 bp, Homo sapiens
tgcactaaggggcccggccagcc

SEQ ID NO: 1303248 - DNA, 21 bp, Homo sapiens
tgcactgcccatggacaggct

SEQ ID NO: 1303249 - DNA, 15 bp, Homo sapiens
tgcactgtgaaggac

SEQ ID NO: 1303250 - DNA, 18 bp, Homo sapiens
tgcacttatgatttcatg

SEQ ID NO: 1303251 - DNA, 14 bp, Homo sapiens
tgcagaactaaact

SEQ ID NO: 1303252 - DNA, 14 bp, Homo sapiens
tgcagcagggatgc

SEQ ID NO: 1303253 - DNA, 18 bp, Homo sapiens
tgcagcagggatgccctg

SEQ ID NO: 1303254 - DNA, 13 bp, Homo sapiens
tgcaggacttgag

SEQ ID NO: 1303255 - DNA, 15 bp, Homo sapiens
tgcaggacttgagaa

SEQ ID NO: 1303256 - DNA, 13 bp, Homo sapiens
tgcagtaaatctt

SEQ ID NO: 1303257 - DNA, 15 bp, Homo sapiens
tgcagtaaatctttt

SEQ ID NO: 1303258 - DNA, 21 bp, Homo sapiens
tgcagtaaatcttttacaact

SEQ ID NO: 1303259 - DNA, 19 bp, Homo sapiens
tgcatatgttgaatacttt

SEQ ID NO: 1303260 - DNA, 15 bp, Homo sapiens
tgcatcccccccacc

SEQ ID NO: 1303261 - DNA, 17 bp, Homo sapiens
tgcatcccccccacctc

SEQ ID NO: 1303262 - DNA, 18 bp, Homo sapiens
tgcatctagattatggag

SEQ ID NO: 1303263 - DNA, 21 bp, Homo sapiens
tgcatctgaccagcagcgcct

SEQ ID NO: 1303264 - DNA, 22 bp, Homo sapiens
tgcatctgaccagcagcgcctt

SEQ ID NO: 1303265 - DNA, 17 bp, Homo sapiens
tgcatggtgccccagga

SEQ ID NO: 1303266 - DNA, 19 bp, Homo sapiens
tgcatggtgccccaggacc

SEQ ID NO: 1303267 - DNA, 22 bp, Homo sapiens
tgcatggtgccccaggaccagc

SEQ ID NO: 1303268 - DNA, 15 bp, Homo sapiens
tgcattaaattcaca

SEQ ID NO: 1303269 - DNA, 17 bp, Homo sapiens
tgcattaaattcacaaa

SEQ ID NO: 1303270 - DNA, 21 bp, Homo sapiens
tgcattaaattcacaaacttt

SEQ ID NO: 1303271 - DNA, 14 bp, Homo sapiens
tgcattgaacacaa

SEQ ID NO: 1303272 - DNA, 21 bp, Homo sapiens
tgcattgaacacaaactgtaa

SEQ ID NO: 1303273 - DNA, 22 bp, Homo sapiens
tgcattgaacacaaactgtaaa

SEQ ID NO: 1303274 - DNA, 16 bp, Homo sapiens
tctagccaaatggttt

SEQ ID NO: 1303275 - DNA, 21 bp, Homo sapiens
tctagctgggggtgggccagg

SEQ ID NO: 1303276 - DNA, 18 bp, Homo sapiens
tctagctgttgagctgtt

SEQ ID NO: 1303277 - DNA, 18 bp, Homo sapiens
tctagggttattgcattt

SEQ ID NO: 1303278 - DNA, 18 bp, Homo sapiens
tctagtgccttctaaagg

SEQ ID NO: 1303279 - DNA, 14 bp, Homo sapiens
tctataaggccata

SEQ ID NO: 1303280 - DNA, 16 bp, Homo sapiens
tctataaggccataaa

SEQ ID NO: 1303281 - DNA, 15 bp, Homo sapiens
tctatacatatcttt

SEQ ID NO: 1303282 - DNA, 18 bp, Homo sapiens
tctatacatatctttatt

SEQ ID NO: 1303283 - DNA, 15 bp, Homo sapiens
tctatttatgtttgc

SEQ ID NO: 1303284 - DNA, 17 bp, Homo sapiens
tctcagtactttggagg

SEQ ID NO: 1303285 - DNA, 22 bp, Homo sapiens
tctcatctttcttgatcaacat

SEQ ID NO: 1303286 - DNA, 17 bp, Homo sapiens
tctcatgttttcaactg

SEQ ID NO: 1303287 - DNA, 19 bp, Homo sapiens
tctcatttcacccctccct

SEQ ID NO: 1303288 - DNA, 22 bp, Homo sapiens
tctcatttcacccctccctttc

SEQ ID NO: 1303289 - DNA, 18 bp, Homo sapiens
tctccaaccccccagcac

SEQ ID NO: 1303290 - DNA, 20 bp, Homo sapiens
tctccaaccccccagcactg

SEQ ID NO: 1303291 - DNA, 22 bp, Homo sapiens
tctccaaccccccagcactgag

SEQ ID NO: 1303292 - DNA, 19 bp, Homo sapiens
tctccacagcaaccccagg

SEQ ID NO: 1303293 - DNA, 16 bp, Homo sapiens
tctccaccaggaacct

SEQ ID NO: 1303294 - DNA, 17 bp, Homo sapiens
tctccactcagttgcaa

SEQ ID NO: 1303295 - DNA, 19 bp, Homo sapiens
tctcccattgtccctctgc

SEQ ID NO: 1303296 - DNA, 15 bp, Homo sapiens
tctccccagcccaga

SEQ ID NO: 1303297 - DNA, 19 bp, Homo sapiens
tctccccagcccagagaca

SEQ ID NO: 1303298 - DNA, 20 bp, Homo sapiens
tctcccccaccccctccccg

SEQ ID NO: 1303299 - DNA, 15 bp, Homo sapiens
tctcccctgccccca

SEQ ID NO: 1303300 - DNA, 16 bp, Homo sapiens
tctcccctgcccccag

SEQ ID NO: 1303301 - DNA, 15 bp, Homo sapiens
tctccctgaccctgt

SEQ ID NO: 1303302 - DNA, 19 bp, Homo sapiens
tctccttcagccctcaccc

SEQ ID NO: 1303303 - DNA, 16 bp, Homo sapiens
tctccttcctgtgtgt

SEQ ID NO: 1303304 - DNA, 13 bp, Homo sapiens
tctctccagatgt

SEQ ID NO: 1303305 - DNA, 16 bp, Homo sapiens
tctctccagatgtttc

SEQ ID NO: 1303306 - DNA, 12 bp, Homo sapiens
tctctctgccca

SEQ ID NO: 1303307 - DNA, 16 bp, Homo sapiens
tctctctgcccaaccc

SEQ ID NO: 1303308 - DNA, 21 bp, Homo sapiens
tctctgggcttggggcttcct

SEQ ID NO: 1303309 - DNA, 23 bp, Homo sapiens
tctctgtgaacgatttagaaaga

SEQ ID NO: 1303310 - DNA, 22 bp, Homo sapiens
tctctgtgagactcgagaactt

SEQ ID NO: 1303311 - DNA, 17 bp, Homo sapiens
tctcttagctcccctcc

SEQ ID NO: 1303312 - DNA, 18 bp, Homo sapiens
tctcttagctcccctcca

SEQ ID NO: 1303313 - DNA, 19 bp, Homo sapiens
tctcttagctcccctccaa

SEQ ID NO: 1303314 - DNA, 18 bp, Homo sapiens
tctcttatagaatattta

SEQ ID NO: 1303315 - DNA, 19 bp, Homo sapiens
tctgacatgattccttcct

SEQ ID NO: 1303316 - DNA, 17 bp, Homo sapiens
tctgaccagcagcgcct

SEQ ID NO: 1303317 - DNA, 11 bp, Homo sapiens
tctgacccagt

SEQ ID NO: 1303318 - DNA, 13 bp, Homo sapiens
tctgacccagtgc

SEQ ID NO: 1303319 - DNA, 15 bp, Homo sapiens
tctgacccagtgccc

SEQ ID NO: 1303320 - DNA, 19 bp, Homo sapiens
tctgacccagtgcccccac

SEQ ID NO: 1303321 - DNA, 22 bp, Homo sapiens
tctgacccagtgcccccactga

SEQ ID NO: 1303322 - DNA, 13 bp, Homo sapiens
tctgagtgaacct

SEQ ID NO: 1303323 - DNA, 18 bp, Homo sapiens
tctgagtgaacctgtata

SEQ ID NO: 1303324 - DNA, 14 bp, Homo sapiens
tctgcaaaaatatt

SEQ ID NO: 1303325 - DNA, 20 bp, Homo sapiens
tctgcaaaaatatttataaa

SEQ ID NO: 1303326 - DNA, 15 bp, Homo sapiens
tctgcatatgttgaa

SEQ ID NO: 1303327 - DNA, 19 bp, Homo sapiens
tctgcatttcggtggctag

SEQ ID NO: 1303328 - DNA, 15 bp, Homo sapiens
tctgccccatcctcc

SEQ ID NO: 1303329 - DNA, 22 bp, Homo sapiens
tctgcctgccagctgcactgat

SEQ ID NO: 1303330 - DNA, 16 bp, Homo sapiens
tctgctcagctctggg

SEQ ID NO: 1303331 - DNA, 14 bp, Homo sapiens
tctgctcagcttct

SEQ ID NO: 1303332 - DNA, 16 bp, Homo sapiens
tctgctccccagggga

SEQ ID NO: 1303333 - DNA, 14 bp, Homo sapiens
tctgctctccttcc

SEQ ID NO: 1303334 - DNA, 19 bp, Homo sapiens
tctgcttgacaacatctga

SEQ ID NO: 1303335 - DNA, 15 bp, Homo sapiens
tctggaacccagact

SEQ ID NO: 1303336 - DNA, 22 bp, Homo sapiens
tctggaacccagactcagacat

SEQ ID NO: 1303337 - DNA, 20 bp, Homo sapiens
tctggaacctcagcctggcc

SEQ ID NO: 1303338 - DNA, 20 bp, Homo sapiens
tctggacagccccaccctgg

SEQ ID NO: 1303339 - DNA, 21 bp, Homo sapiens
tctggagaccagggagccttt

SEQ ID NO: 1303340 - DNA, 15 bp, Homo sapiens
tctggagtggccact

SEQ ID NO: 1303341 - DNA, 19 bp, Homo sapiens
tctgggcttggggcttcct

SEQ ID NO: 1303342 - DNA, 15 bp, Homo sapiens
tctggggctctggga

SEQ ID NO: 1303343 - DNA, 16 bp, Homo sapiens
tctggggctctgggat

SEQ ID NO: 1303344 - DNA, 17 bp, Homo sapiens
tctgtaattgtgtgtga

SEQ ID NO: 1303345 - DNA, 15 bp, Homo sapiens
tctgtatatactttt

SEQ ID NO: 1303346 - DNA, 13 bp, Homo sapiens
tctgtcagtcaca

SEQ ID NO: 1303347 - DNA, 19 bp, Homo sapiens
tctgtcagtcacagccacc

SEQ ID NO: 1303348 - DNA, 22 bp, Homo sapiens
tctgtccccttctctcatctct

SEQ ID NO: 1303349 - DNA, 13 bp, Homo sapiens
tctgtcctcagcc

SEQ ID NO: 1303350 - DNA, 13 bp, Homo sapiens
ttggagaatttag

SEQ ID NO: 1303351 - DNA, 18 bp, Homo sapiens
ttggagaatttaggtttt

SEQ ID NO: 1303352 - DNA, 18 bp, Homo sapiens
ttggagagtttcctgaaa

SEQ ID NO: 1303353 - DNA, 20 bp, Homo sapiens
ttggcaccagacacccagga

SEQ ID NO: 1303354 - DNA, 16 bp, Homo sapiens
ttggctcacactgaga

SEQ ID NO: 1303355 - DNA, 17 bp, Homo sapiens
ttgggcctgctccagac

SEQ ID NO: 1303356 - DNA, 17 bp, Homo sapiens
ttggggagttaagacct

SEQ ID NO: 1303357 - DNA, 19 bp, Homo sapiens
ttggggagttaagacctgg

SEQ ID NO: 1303358 - DNA, 14 bp, Homo sapiens
ttggttcattaatt

SEQ ID NO: 1303359 - DNA, 19 bp, Homo sapiens
ttggttctaatagaactca

SEQ ID NO: 1303360 - DNA, 14 bp, Homo sapiens
ttggttttgttccc

SEQ ID NO: 1303361 - DNA, 16 bp, Homo sapiens
ttgtaacccagatttt

SEQ ID NO: 1303362 - DNA, 13 bp, Homo sapiens
ttgtattaaactc

SEQ ID NO: 1303363 - DNA, 15 bp, Homo sapiens
ttgtattaaactctt

SEQ ID NO: 1303364 - DNA, 17 bp, Homo sapiens
ttgtccctctgccccat

SEQ ID NO: 1303365 - DNA, 22 bp, Homo sapiens
ttgtgtatttacgctttgattc

SEQ ID NO: 1303366 - DNA, 14 bp, Homo sapiens
ttgttatttataac

SEQ ID NO: 1303367 - DNA, 13 bp, Homo sapiens
ttgttcaattaga

SEQ ID NO: 1303368 - DNA, 15 bp, Homo sapiens
ttgttcccctcctcc

SEQ ID NO: 1303369 - DNA, 18 bp, Homo sapiens
ttgttgagctattgctgt

SEQ ID NO: 1303370 - DNA, 13 bp, Homo sapiens
ttgtttgtcttta

SEQ ID NO: 1303371 - DNA, 14 bp, Homo sapiens
tttaaaaatatttt

SEQ ID NO: 1303372 - DNA, 13 bp, Homo sapiens
tttaacttctgcc

SEQ ID NO: 1303373 - DNA, 11 bp, Homo sapiens
tttaagctgtt

SEQ ID NO: 1303374 - DNA, 16 bp, Homo sapiens
tttacattgttgagct

SEQ ID NO: 1303375 - DNA, 18 bp, Homo sapiens
tttacgctttgattcata

SEQ ID NO: 1303376 - DNA, 17 bp, Homo sapiens
tttactgagcttctctg

SEQ ID NO: 1303377 - DNA, 21 bp, Homo sapiens
tttactgagcttctctgtgaa

SEQ ID NO: 1303378 - DNA, 13 bp, Homo sapiens
tttatacaaatta

SEQ ID NO: 1303379 - DNA, 18 bp, Homo sapiens
tttatactctttctgtat

SEQ ID NO: 1303380 - DNA, 19 bp, Homo sapiens
tttatctttgattctcctt

SEQ ID NO: 1303381 - DNA, 19 bp, Homo sapiens
tttatgtagtaattgacat

SEQ ID NO: 1303382 - DNA, 23 bp, Homo sapiens
tttatgtttgcacttgtgattat

SEQ ID NO: 1303383 - DNA, 23 bp, Homo sapiens
tttattaccccctccttcagaca

SEQ ID NO: 1303384 - DNA, 14 bp, Homo sapiens
tttattacctctga

SEQ ID NO: 1303385 - DNA, 16 bp, Homo sapiens
tttattatttatttat

SEQ ID NO: 1303386 - DNA, 17 bp, Homo sapiens
tttattcaattcctctg

SEQ ID NO: 1303387 - DNA, 15 bp, Homo sapiens
tttattgacacagaa

SEQ ID NO: 1303388 - DNA, 15 bp, Homo sapiens
tttcaaaatgctttt

SEQ ID NO: 1303389 - DNA, 20 bp, Homo sapiens
tttcaagtcaaattaataat

SEQ ID NO: 1303390 - DNA, 13 bp, Homo sapiens
tttcacccctccc

SEQ ID NO: 1303391 - DNA, 20 bp, Homo sapiens
tttcacccctccctttctcc

SEQ ID NO: 1303392 - DNA, 17 bp, Homo sapiens
tttcagagaccattgca

SEQ ID NO: 1303393 - DNA, 11 bp, Homo sapiens
tttcatctgct

SEQ ID NO: 1303394 - DNA, 17 bp, Homo sapiens
tttcatctgctctcctt

SEQ ID NO: 1303395 - DNA, 18 bp, Homo sapiens
tttcatctgctctccttc

SEQ ID NO: 1303396 - DNA, 22 bp, Homo sapiens
tttcatctgctctccttcctgg

SEQ ID NO: 1303397 - DNA, 18 bp, Homo sapiens
tttccagacttccttgag

SEQ ID NO: 1303398 - DNA, 15 bp, Homo sapiens
tttccagtctccacc

SEQ ID NO: 1303399 - DNA, 12 bp, Homo sapiens
tttccatcttta

SEQ ID NO: 1303400 - DNA, 11 bp, Homo sapiens
tttcccaggac

SEQ ID NO: 1303401 - DNA, 19 bp, Homo sapiens
gcccaggctggagtgcagt

SEQ ID NO: 1303402 - DNA, 16 bp, Homo sapiens
gcccaggctggtttcg

SEQ ID NO: 1303403 - DNA, 18 bp, Homo sapiens
gcccagggcccagagccc

SEQ ID NO: 1303404 - DNA, 19 bp, Homo sapiens
gccccaatccctttattac

SEQ ID NO: 1303405 - DNA, 15 bp, Homo sapiens
gccccaggaaaggcc

SEQ ID NO: 1303406 - DNA, 11 bp, Homo sapiens
gccccaggacc

SEQ ID NO: 1303407 - DNA, 12 bp, Homo sapiens
gccccaggacca

SEQ ID NO: 1303408 - DNA, 19 bp, Homo sapiens
gccccaggaccagctcagg

SEQ ID NO: 1303409 - DNA, 22 bp, Homo sapiens
gccccaggaccagctcaggaca

SEQ ID NO: 1303410 - DNA, 23 bp, Homo sapiens
gccccaggaccagctcaggacag

SEQ ID NO: 1303411 - DNA, 24 bp, Homo sapiens
gccccaggaccagctcaggacaga

SEQ ID NO: 1303412 - DNA, 22 bp, Homo sapiens
gccccaggacctggctgccata

SEQ ID NO: 1303413 - DNA, 21 bp, Homo sapiens
gccccaggcagggccaaccct

SEQ ID NO: 1303414 - DNA, 17 bp, Homo sapiens
gccccatcctccagcag

SEQ ID NO: 1303415 - DNA, 20 bp, Homo sapiens
gcccccaccgtgggcaggga

SEQ ID NO: 1303416 - DNA, 12 bp, Homo sapiens
gcccccactgac

SEQ ID NO: 1303417 - DNA, 23 bp, Homo sapiens
gcccccagctaagaacctggaac

SEQ ID NO: 1303418 - DNA, 15 bp, Homo sapiens
gcccccaggactggg

SEQ ID NO: 1303419 - DNA, 16 bp, Homo sapiens
gcccccccccacccct

SEQ ID NO: 1303420 - DNA, 17 bp, Homo sapiens
gcccccccccacccctg

SEQ ID NO: 1303421 - DNA, 14 bp, Homo sapiens
gccccctggcctct

SEQ ID NO: 1303422 - DNA, 16 bp, Homo sapiens
gccccctggcctctgt

SEQ ID NO: 1303423 - DNA, 12 bp, Homo sapiens
gcccctggctgg

SEQ ID NO: 1303424 - DNA, 18 bp, Homo sapiens
gcccctgtctagagaggg

SEQ ID NO: 1303425 - DNA, 17 bp, Homo sapiens
gccccttctgctcagct

SEQ ID NO: 1303426 - DNA, 17 bp, Homo sapiens
gccctccagctctttcc

SEQ ID NO: 1303427 - DNA, 22 bp, Homo sapiens
gccctccctgttccccagagaa

SEQ ID NO: 1303428 - DNA, 17 bp, Homo sapiens
gccctcctctcccattg

SEQ ID NO: 1303429 - DNA, 18 bp, Homo sapiens
gccctctggagtggccac

SEQ ID NO: 1303430 - DNA, 22 bp, Homo sapiens
gccctctggagtggccactaag

SEQ ID NO: 1303431 - DNA, 13 bp, Homo sapiens
gccctggaggtgg

SEQ ID NO: 1303432 - DNA, 18 bp, Homo sapiens
gccctggaggtggctgag

SEQ ID NO: 1303433 - DNA, 21 bp, Homo sapiens
gccctgtgcaacctcttggcc

SEQ ID NO: 1303434 - DNA, 21 bp, Homo sapiens
gccctgttgacacaggtcttt

SEQ ID NO: 1303435 - DNA, 14 bp, Homo sapiens
gccgctgccaccca

SEQ ID NO: 1303436 - DNA, 20 bp, Homo sapiens
gccgtgctcgccccagcagg

SEQ ID NO: 1303437 - DNA, 23 bp, Homo sapiens
gccgtttgagaagaaaacatcta

SEQ ID NO: 1303438 - DNA, 22 bp, Homo sapiens
gcctacagctttgatccctgac

SEQ ID NO: 1303439 - DNA, 13 bp, Homo sapiens
gcctaggcctcag

SEQ ID NO: 1303440 - DNA, 16 bp, Homo sapiens
gcctcagccagagaag

SEQ ID NO: 1303441 - DNA, 19 bp, Homo sapiens
gcctccaggaaccacacca

SEQ ID NO: 1303442 - DNA, 13 bp, Homo sapiens
gcctccagggctg

SEQ ID NO: 1303443 - DNA, 17 bp, Homo sapiens
gcctccagggctggact

SEQ ID NO: 1303444 - DNA, 15 bp, Homo sapiens
gcctcccatccaggg

SEQ ID NO: 1303445 - DNA, 18 bp, Homo sapiens
gcctcccctctccttcct

SEQ ID NO: 1303446 - DNA, 17 bp, Homo sapiens
gcctcggcctcccaaag

SEQ ID NO: 1303447 - DNA, 19 bp, Homo sapiens
gcctctgtccccttctctc

SEQ ID NO: 1303448 - DNA, 15 bp, Homo sapiens
gcctgccagctgcac

SEQ ID NO: 1303449 - DNA, 18 bp, Homo sapiens
gcctgccagctgcactga

SEQ ID NO: 1303450 - DNA, 17 bp, Homo sapiens
gcctgctccagacctga

SEQ ID NO: 1303451 - DNA, 14 bp, Homo sapiens
gcctggccagacac

SEQ ID NO: 1303452 - DNA, 20 bp, Homo sapiens
gcctggccagacacaggccc

SEQ ID NO: 1303453 - DNA, 17 bp, Homo sapiens
gcctggggctggcctcc

SEQ ID NO: 1303454 - DNA, 13 bp, Homo sapiens
gcctggtgctgct

SEQ ID NO: 1303455 - DNA, 18 bp, Homo sapiens
gccttcctctctccagat

SEQ ID NO: 1303456 - DNA, 12 bp, Homo sapiens
gccttgccagag

SEQ ID NO: 1303457 - DNA, 12 bp, Homo sapiens
gccttggctcag

SEQ ID NO: 1303458 - DNA, 14 bp, Homo sapiens
gccttggctcagac

SEQ ID NO: 1303459 - DNA, 22 bp, Homo sapiens
gcgccaggatggaacacggcca

SEQ ID NO: 1303460 - DNA, 15 bp, Homo sapiens
gcgcctttcccaact

SEQ ID NO: 1303461 - DNA, 20 bp, Homo sapiens
gcgctcctgccgcagagctg

SEQ ID NO: 1303462 - DNA, 13 bp, Homo sapiens
gcggccggccagc

SEQ ID NO: 1303463 - DNA, 21 bp, Homo sapiens
gcggtagccagcacacagggc

SEQ ID NO: 1303464 - DNA, 22 bp, Homo sapiens
gctaaattactcaggaagaaca

SEQ ID NO: 1303465 - DNA, 23 bp, Homo sapiens
gctaagaacctggaacttgggga

SEQ ID NO: 1303466 - DNA, 22 bp, Homo sapiens
gctactgtaattttatatgaag

SEQ ID NO: 1303467 - DNA, 17 bp, Homo sapiens
gctatagcctggggtgg

SEQ ID NO: 1303468 - DNA, 18 bp, Homo sapiens
gctcaagcgattctcctg

SEQ ID NO: 1303469 - DNA, 13 bp, Homo sapiens
gctcacactgaga

SEQ ID NO: 1303470 - DNA, 12 bp, Homo sapiens
gctcagccagca

SEQ ID NO: 1303471 - DNA, 13 bp, Homo sapiens
gctcagccagcac

SEQ ID NO: 1303472 - DNA, 17 bp, Homo sapiens
gctcagctctgggccat

SEQ ID NO: 1303473 - DNA, 13 bp, Homo sapiens
gctcagcttctcc

SEQ ID NO: 1303474 - DNA, 16 bp, Homo sapiens
gctcagcttctcctgt

SEQ ID NO: 1303475 - DNA, 16 bp, Homo sapiens
gctccaccctggccga

SEQ ID NO: 1303476 - DNA, 13 bp, Homo sapiens
gctccagacctga

SEQ ID NO: 1303477 - DNA, 22 bp, Homo sapiens
gctccagacctgatcctggagg

SEQ ID NO: 1303478 - DNA, 22 bp, Homo sapiens
gctccagatgcagggcagtcat

SEQ ID NO: 1303479 - DNA, 15 bp, Homo sapiens
gctcctagagggagg

SEQ ID NO: 1303480 - DNA, 15 bp, Homo sapiens
gctcctcctccctgc

SEQ ID NO: 1303481 - DNA, 18 bp, Homo sapiens
gctcctcctccctgcatc

SEQ ID NO: 1303482 - DNA, 18 bp, Homo sapiens
gctcctctccccagccca

SEQ ID NO: 1303483 - DNA, 14 bp, Homo sapiens
gctccttgttccta

SEQ ID NO: 1303484 - DNA, 15 bp, Homo sapiens
gctctatgtttacaa

SEQ ID NO: 1303485 - DNA, 16 bp, Homo sapiens
gctctatgtttacaaa

SEQ ID NO: 1303486 - DNA, 19 bp, Homo sapiens
gctctcggaactgcatgct

SEQ ID NO: 1303487 - DNA, 19 bp, Homo sapiens
gctctggacagccccaccc

SEQ ID NO: 1303488 - DNA, 16 bp, Homo sapiens
gctcttctcatttcac

SEQ ID NO: 1303489 - DNA, 20 bp, Homo sapiens
gctcttctcatttcacccct

SEQ ID NO: 1303490 - DNA, 22 bp, Homo sapiens
gctcttctcatttcacccctcc

SEQ ID NO: 1303491 - DNA, 13 bp, Homo sapiens
gctgacagctgct

SEQ ID NO: 1303492 - DNA, 15 bp, Homo sapiens
gctgacagctgctcc

SEQ ID NO: 1303493 - DNA, 17 bp, Homo sapiens
gctgacattcacctgcc

SEQ ID NO: 1303494 - DNA, 13 bp, Homo sapiens
gctgaccacagca

SEQ ID NO: 1303495 - DNA, 16 bp, Homo sapiens
gctgaccacagcacag

SEQ ID NO: 1303496 - DNA, 24 bp, Homo sapiens
gctgacttcatctcccacctagca

SEQ ID NO: 1303497 - DNA, 18 bp, Homo sapiens
gctgagaagcttttgaat

SEQ ID NO: 1303498 - DNA, 20 bp, Homo sapiens
gctgagcctctgctccccag

SEQ ID NO: 1303499 - DNA, 21 bp, Homo sapiens
gctgaggccacactcagcaca

SEQ ID NO: 1303500 - DNA, 15 bp, Homo sapiens
gctgaggctggcaca

SEQ ID NO: 1303501 - DNA, 18 bp, Homo sapiens
gctgaggctggcacagga

SEQ ID NO: 1303502 - DNA, 17 bp, Homo sapiens
gctgatttggtgaccaa

SEQ ID NO: 1303503 - DNA, 23 bp, Homo sapiens
gctgccacccacctccctgcctc

SEQ ID NO: 1303504 - DNA, 22 bp, Homo sapiens
gctgcccctcatctctctgccc

SEQ ID NO: 1303505 - DNA, 14 bp, Homo sapiens
gctgcctcatttag

SEQ ID NO: 1303506 - DNA, 21 bp, Homo sapiens
gctgcctcatttagagaggaa

SEQ ID NO: 1303507 - DNA, 19 bp, Homo sapiens
gctgccttggctcagacat

SEQ ID NO: 1303508 - DNA, 15 bp, Homo sapiens
gctgctatagcctgg

SEQ ID NO: 1303509 - DNA, 19 bp, Homo sapiens
gctgctcctagagggaggg

SEQ ID NO: 1303510 - DNA, 21 bp, Homo sapiens
gctgctcctagagggaggggc

SEQ ID NO: 1303511 - DNA, 15 bp, Homo sapiens
gctgctgaaggctca

SEQ ID NO: 1303512 - DNA, 12 bp, Homo sapiens
gctgctgctgct

SEQ ID NO: 1303513 - DNA, 20 bp, Homo sapiens
gctgcttagaatccaaactt

SEQ ID NO: 1303514 - DNA, 13 bp, Homo sapiens
gctggactgaggc

SEQ ID NO: 1303515 - DNA, 14 bp, Homo sapiens
gctggactgaggcc

SEQ ID NO: 1303516 - DNA, 18 bp, Homo sapiens
gctggactgaggcctgag

SEQ ID NO: 1303517 - DNA, 15 bp, Homo sapiens
gctggagtgcagtgg

SEQ ID NO: 1303518 - DNA, 19 bp, Homo sapiens
gctggcccagggcccagag

SEQ ID NO: 1303519 - DNA, 21 bp, Homo sapiens
gctggcctcccaaatgagcca

SEQ ID NO: 1303520 - DNA, 18 bp, Homo sapiens
gattaatatgaaaactta

SEQ ID NO: 1303521 - DNA, 15 bp, Homo sapiens
gattcagttttcatt

SEQ ID NO: 1303522 - DNA, 18 bp, Homo sapiens
gattccaaagagtagaat

SEQ ID NO: 1303523 - DNA, 12 bp, Homo sapiens
gattctccttca

SEQ ID NO: 1303524 - DNA, 18 bp, Homo sapiens
gattctccttcagccctc

SEQ ID NO: 1303525 - DNA, 17 bp, Homo sapiens
gattgacagctttgctg

SEQ ID NO: 1303526 - DNA, 17 bp, Homo sapiens
gattgatttgaagaaca

SEQ ID NO: 1303527 - DNA, 17 bp, Homo sapiens
gattggctcacactgag

SEQ ID NO: 1303528 - DNA, 20 bp, Homo sapiens
gatttcatctgctctccttc

SEQ ID NO: 1303529 - DNA, 22 bp, Homo sapiens
gatttcatctgctctccttcct

SEQ ID NO: 1303530 - DNA, 13 bp, Homo sapiens
gatttccttgaat

SEQ ID NO: 1303531 - DNA, 17 bp, Homo sapiens
gatttccttgaatgtgg

SEQ ID NO: 1303532 - DNA, 19 bp, Homo sapiens
gatttgaagaacatgtgag

SEQ ID NO: 1303533 - DNA, 13 bp, Homo sapiens
gatttgacattgc

SEQ ID NO: 1303534 - DNA, 17 bp, Homo sapiens
gatttgcattgaacaca

SEQ ID NO: 1303535 - DNA, 15 bp, Homo sapiens
gattttaattttgaa

SEQ ID NO: 1303536 - DNA, 18 bp, Homo sapiens
gattttgctgtatatttg

SEQ ID NO: 1303537 - DNA, 19 bp, Homo sapiens
gattttggttttgttcccc

SEQ ID NO: 1303538 - DNA, 13 bp, Homo sapiens
gattttgtaaccc

SEQ ID NO: 1303539 - DNA, 16 bp, Homo sapiens
gattttgtaacccaga

SEQ ID NO: 1303540 - DNA, 21 bp, Homo sapiens
gcaaaaggatctttgtggcca

SEQ ID NO: 1303541 - DNA, 20 bp, Homo sapiens
gcaaagatctgtcctcagcc

SEQ ID NO: 1303542 - DNA, 14 bp, Homo sapiens
gcaacagatctgga

SEQ ID NO: 1303543 - DNA, 17 bp, Homo sapiens
gcaacagatctggaacc

SEQ ID NO: 1303544 - DNA, 14 bp, Homo sapiens
gcaaccactaagaa

SEQ ID NO: 1303545 - DNA, 16 bp, Homo sapiens
gcaacctcttggcctg

SEQ ID NO: 1303546 - DNA, 23 bp, Homo sapiens
gcaagccctgttgacacaggtct

SEQ ID NO: 1303547 - DNA, 22 bp, Homo sapiens
gcaaggtttaggctggtggccc

SEQ ID NO: 1303548 - DNA, 16 bp, Homo sapiens
gcaataaatctgaccc

SEQ ID NO: 1303549 - DNA, 13 bp, Homo sapiens
gcacacagggcag

SEQ ID NO: 1303550 - DNA, 14 bp, Homo sapiens
gcacaggacatgcg

SEQ ID NO: 1303551 - DNA, 14 bp, Homo sapiens
gcaccagacaccca

SEQ ID NO: 1303552 - DNA, 16 bp, Homo sapiens
gcaccagacacccagg

SEQ ID NO: 1303553 - DNA, 18 bp, Homo sapiens
gcaccagacacccaggac

SEQ ID NO: 1303554 - DNA, 15 bp, Homo sapiens
gcacctaatccaggc

SEQ ID NO: 1303555 - DNA, 17 bp, Homo sapiens
gcacctaatccaggcag

SEQ ID NO: 1303556 - DNA, 18 bp, Homo sapiens
gcacctaatccaggcaga

SEQ ID NO: 1303557 - DNA, 15 bp, Homo sapiens
gcacctgcctcagga

SEQ ID NO: 1303558 - DNA, 16 bp, Homo sapiens
gcacctgcctcaggac

SEQ ID NO: 1303559 - DNA, 23 bp, Homo sapiens
gcactaaggggcccggccagcca

SEQ ID NO: 1303560 - DNA, 12 bp, Homo sapiens
gcactacattca

SEQ ID NO: 1303561 - DNA, 18 bp, Homo sapiens
gcactgatgctgcccctc

SEQ ID NO: 1303562 - DNA, 11 bp, Homo sapiens
gcactgtgaag

SEQ ID NO: 1303563 - DNA, 18 bp, Homo sapiens
gcactgtgaaggaccctt

SEQ ID NO: 1303564 - DNA, 23 bp, Homo sapiens
gcacttgtgattatttattattt

SEQ ID NO: 1303565 - DNA, 20 bp, Homo sapiens
gcactttagggctgtaaaat

SEQ ID NO: 1303566 - DNA, 22 bp, Homo sapiens
gcactttctacaatgtgaactt

SEQ ID NO: 1303567 - DNA, 19 bp, Homo sapiens
gcagaactaaactcattta

SEQ ID NO: 1303568 - DNA, 14 bp, Homo sapiens
gcagaggaggggcc

SEQ ID NO: 1303569 - DNA, 14 bp, Homo sapiens
gcagatccaggact

SEQ ID NO: 1303570 - DNA, 19 bp, Homo sapiens
gcagcaccgttctgtgcac

SEQ ID NO: 1303571 - DNA, 20 bp, Homo sapiens
gcagcctcccatccagggcc

SEQ ID NO: 1303572 - DNA, 21 bp, Homo sapiens
gcagcctcccatccagggccc

SEQ ID NO: 1303573 - DNA, 10 bp, Homo sapiens
gcagcctggg

SEQ ID NO: 1303574 - DNA, 17 bp, Homo sapiens
gcagcctggggctggcc

SEQ ID NO: 1303575 - DNA, 13 bp, Homo sapiens
gcagcgccaggct

SEQ ID NO: 1303576 - DNA, 21 bp, Homo sapiens
gcaggaccttcgggctgtgcc

SEQ ID NO: 1303577 - DNA, 21 bp, Homo sapiens
gcagggatgccctggaggtgg

SEQ ID NO: 1303578 - DNA, 23 bp, Homo sapiens
gcagggatgccctggaggtggct

SEQ ID NO: 1303579 - DNA, 13 bp, Homo sapiens
gcagtcactgaat

SEQ ID NO: 1303580 - DNA, 18 bp, Homo sapiens
gcagtggtgtggagaagc

SEQ ID NO: 1303581 - DNA, 12 bp, Homo sapiens
gcagtgtgaaaa

SEQ ID NO: 1303582 - DNA, 22 bp, Homo sapiens
gcagttggccagagagcctggt

SEQ ID NO: 1303583 - DNA, 17 bp, Homo sapiens
gcagttttcaagtcaaa

SEQ ID NO: 1303584 - DNA, 15 bp, Homo sapiens
gcatgattttgtaac

SEQ ID NO: 1303585 - DNA, 18 bp, Homo sapiens
gcatggtcacacactgat

SEQ ID NO: 1303586 - DNA, 17 bp, Homo sapiens
gcatggtgccccaggac

SEQ ID NO: 1303587 - DNA, 19 bp, Homo sapiens
gcatggtgccccaggacca

SEQ ID NO: 1303588 - DNA, 21 bp, Homo sapiens
gcatggtgccccaggaccagc

SEQ ID NO: 1303589 - DNA, 23 bp, Homo sapiens
gcatggtgccccaggaccagctc

SEQ ID NO: 1303590 - DNA, 22 bp, Homo sapiens
gcattaaattcacaaactttta

SEQ ID NO: 1303591 - DNA, 18 bp, Homo sapiens
gcattgaacacaaactgt

SEQ ID NO: 1303592 - DNA, 19 bp, Homo sapiens
gcattgaacacaaactgta

SEQ ID NO: 1303593 - DNA, 21 bp, Homo sapiens
gcattgaacacaaactgtaaa

SEQ ID NO: 1303594 - DNA, 22 bp, Homo sapiens
gcattgaccgcgactaatttca

SEQ ID NO: 1303595 - DNA, 23 bp, Homo sapiens
gcattgaccgcgactaatttcaa

SEQ ID NO: 1303596 - DNA, 21 bp, Homo sapiens
gcatttcctatcacctatttc

SEQ ID NO: 1303597 - DNA, 22 bp, Homo sapiens
gcatttggattggggtccctct

SEQ ID NO: 1303598 - DNA, 16 bp, Homo sapiens
gccaaataatgtctct

SEQ ID NO: 1303599 - DNA, 23 bp, Homo sapiens
gccaacacgcacctgcctcagga

SEQ ID NO: 1303600 - DNA, 22 bp, Homo sapiens
gccaacccttctcctcttgtaa

SEQ ID NO: 1303601 - DNA, 21 bp, Homo sapiens
gccaagaaacgtcttctaaac

SEQ ID NO: 1303602 - DNA, 12 bp, Homo sapiens
gccaaggagctg

SEQ ID NO: 1303603 - DNA, 15 bp, Homo sapiens
gccaaggagctgcta

SEQ ID NO: 1303604 - DNA, 16 bp, Homo sapiens
gccaaggagctgctat

SEQ ID NO: 1303605 - DNA, 20 bp, Homo sapiens
gccaaggagctgctatagcc

SEQ ID NO: 1303606 - DNA, 21 bp, Homo sapiens
gccaaggagctgctatagcct

SEQ ID NO: 1303607 - DNA, 15 bp, Homo sapiens
gccaattcagacagg

SEQ ID NO: 1303608 - DNA, 17 bp, Homo sapiens
gccaattcagacaggca

SEQ ID NO: 1303609 - DNA, 14 bp, Homo sapiens
gccacaaggacttc

SEQ ID NO: 1303610 - DNA, 21 bp, Homo sapiens
gccacaaggacttcctgtcca

SEQ ID NO: 1303611 - DNA, 18 bp, Homo sapiens
gccacaggacacagtcag

SEQ ID NO: 1303612 - DNA, 13 bp, Homo sapiens
gccacaggcctga

SEQ ID NO: 1303613 - DNA, 15 bp, Homo sapiens
gccacaggcctgaga

SEQ ID NO: 1303614 - DNA, 17 bp, Homo sapiens
gccacccacctccctgc

SEQ ID NO: 1303615 - DNA, 16 bp, Homo sapiens
gccactaagcagagga

SEQ ID NO: 1303616 - DNA, 17 bp, Homo sapiens
gccactaagcagaggag

SEQ ID NO: 1303617 - DNA, 23 bp, Homo sapiens
gccactaagcagaggaggggccg

SEQ ID NO: 1303618 - DNA, 12 bp, Homo sapiens
gccagagccagg

SEQ ID NO: 1303619 - DNA, 12 bp, Homo sapiens
gccagcacacag

SEQ ID NO: 1303620 - DNA, 15 bp, Homo sapiens
gccagcacacagggc

SEQ ID NO: 1303621 - DNA, 14 bp, Homo sapiens
gccagcacttgtcc

SEQ ID NO: 1303622 - DNA, 14 bp, Homo sapiens
gccagcccctggcc

SEQ ID NO: 1303623 - DNA, 20 bp, Homo sapiens
gccaggctgaccacagcaca

SEQ ID NO: 1303624 - DNA, 14 bp, Homo sapiens
gccagggagaagct

SEQ ID NO: 1303625 - DNA, 15 bp, Homo sapiens
gccagggagaagctc

SEQ ID NO: 1303626 - DNA, 20 bp, Homo sapiens
gccagggagaagctcctctc

SEQ ID NO: 1303627 - DNA, 22 bp, Homo sapiens
gccataaaacaggtaatataaa

SEQ ID NO: 1303628 - DNA, 14 bp, Homo sapiens
gccatcaaaatgct

SEQ ID NO: 1303629 - DNA, 17 bp, Homo sapiens
gccattctccacagcaa

SEQ ID NO: 1303630 - DNA, 16 bp, Homo sapiens
gcccaacccttccctc

SEQ ID NO: 1303631 - DNA, 15 bp, Homo sapiens
gcccaagggatctgg

SEQ ID NO: 1303632 - DNA, 18 bp, Homo sapiens
gcccaatattataatttt

SEQ ID NO: 1303633 - DNA, 18 bp, Homo sapiens
gcccactgtcctgggcct

SEQ ID NO: 1303634 - DNA, 24 bp, Homo sapiens
gcccactgtcctgggcctgcagaa

SEQ ID NO: 1303635 - DNA, 14 bp, Homo sapiens
gcccagagcccagc

SEQ ID NO: 1303636 - DNA, 18 bp, Homo sapiens
gcccagagcccagctcca

SEQ ID NO: 1303637 - DNA, 12 bp, Homo sapiens
gcccagccctcc

SEQ ID NO: 1303638 - DNA, 17 bp, Homo sapiens
gacccagtgcccccact

SEQ ID NO: 1303639 - DNA, 13 bp, Homo sapiens
gacccccagctcc

SEQ ID NO: 1303640 - DNA, 11 bp, Homo sapiens
gaccctgtata

SEQ ID NO: 1303641 - DNA, 15 bp, Homo sapiens
gacctgatcctggag

SEQ ID NO: 1303642 - DNA, 18 bp, Homo sapiens
gacctgatcctggaggcc

SEQ ID NO: 1303643 - DNA, 18 bp, Homo sapiens
gacctggcactggatgca

SEQ ID NO: 1303644 - DNA, 23 bp, Homo sapiens
gacctgtgagcccagctgggtca

SEQ ID NO: 1303645 - DNA, 18 bp, Homo sapiens
gacctgttagcagacagg

SEQ ID NO: 1303646 - DNA, 16 bp, Homo sapiens
gaccttaggccttcct

SEQ ID NO: 1303647 - DNA, 18 bp, Homo sapiens
gaccttcgggctgtgccc

SEQ ID NO: 1303648 - DNA, 12 bp, Homo sapiens
gacgtagctgca

SEQ ID NO: 1303649 - DNA, 14 bp, Homo sapiens
gactagatgatgga

SEQ ID NO: 1303650 - DNA, 21 bp, Homo sapiens
gactagatgatggatgccaat

SEQ ID NO: 1303651 - DNA, 19 bp, Homo sapiens
gactatatttgggcctgct

SEQ ID NO: 1303652 - DNA, 16 bp, Homo sapiens
gactcagggcagcgcc

SEQ ID NO: 1303653 - DNA, 17 bp, Homo sapiens
gactcagggcagcgcca

SEQ ID NO: 1303654 - DNA, 16 bp, Homo sapiens
gactcgagaactttca

SEQ ID NO: 1303655 - DNA, 16 bp, Homo sapiens
gactctggcaaagctt

SEQ ID NO: 1303656 - DNA, 21 bp, Homo sapiens
gactgaggcctgagcgctcct

SEQ ID NO: 1303657 - DNA, 21 bp, Homo sapiens
gactggaagctaatttgcatt

SEQ ID NO: 1303658 - DNA, 21 bp, Homo sapiens
gactgtgtgttgccacaggac

SEQ ID NO: 1303659 - DNA, 22 bp, Homo sapiens
gactgtgtgttgccacaggaca

SEQ ID NO: 1303660 - DNA, 24 bp, Homo sapiens
gacttcatctcccacctagcagca

SEQ ID NO: 1303661 - DNA, 21 bp, Homo sapiens
gacttcctgtccagctccaac

SEQ ID NO: 1303662 - DNA, 15 bp, Homo sapiens
gacttccttgagaca

SEQ ID NO: 1303663 - DNA, 18 bp, Homo sapiens
gagaaaggggagcccact

SEQ ID NO: 1303664 - DNA, 20 bp, Homo sapiens
gagaaatatggacacttaat

SEQ ID NO: 1303665 - DNA, 17 bp, Homo sapiens
gagaacaaacagatcga

SEQ ID NO: 1303666 - DNA, 13 bp, Homo sapiens
gagaagccacagg

SEQ ID NO: 1303667 - DNA, 20 bp, Homo sapiens
gagaagccacaggcctgaga

SEQ ID NO: 1303668 - DNA, 23 bp, Homo sapiens
gagaagccaggaatttcccagga

SEQ ID NO: 1303669 - DNA, 19 bp, Homo sapiens
gagaagctcctctccccag

SEQ ID NO: 1303670 - DNA, 14 bp, Homo sapiens
gagaattgggggct

SEQ ID NO: 1303671 - DNA, 20 bp, Homo sapiens
gagaccggggtatcctgggg

SEQ ID NO: 1303672 - DNA, 17 bp, Homo sapiens
gagactcgagaactttc

SEQ ID NO: 1303673 - DNA, 22 bp, Homo sapiens
gagagaaaacagacctaatgct

SEQ ID NO: 1303674 - DNA, 13 bp, Homo sapiens
gagagcctggtgc

SEQ ID NO: 1303675 - DNA, 23 bp, Homo sapiens
gagaggccctctggagtggccac

SEQ ID NO: 1303676 - DNA, 21 bp, Homo sapiens
gagatccaaaagaagccccca

SEQ ID NO: 1303677 - DNA, 17 bp, Homo sapiens
gagattcagttttcatt

SEQ ID NO: 1303678 - DNA, 13 bp, Homo sapiens
gagatttcatctg

SEQ ID NO: 1303679 - DNA, 20 bp, Homo sapiens
gagcaagggttccctcaaga

SEQ ID NO: 1303680 - DNA, 11 bp, Homo sapiens
gagcccactgt

SEQ ID NO: 1303681 - DNA, 14 bp, Homo sapiens
gagcccagaggagg

SEQ ID NO: 1303682 - DNA, 22 bp, Homo sapiens
gagcccagctgggtcaggcagg

SEQ ID NO: 1303683 - DNA, 21 bp, Homo sapiens
gagcgctcctgccgcagagct

SEQ ID NO: 1303684 - DNA, 19 bp, Homo sapiens
gagcggtgctgtcctcagg

SEQ ID NO: 1303685 - DNA, 17 bp, Homo sapiens
gagctgaggccacactc

SEQ ID NO: 1303686 - DNA, 15 bp, Homo sapiens
gagctgccttggctc

SEQ ID NO: 1303687 - DNA, 22 bp, Homo sapiens
gagctgccttggctcagacatg

SEQ ID NO: 1303688 - DNA, 10 bp, Homo sapiens
gagcttctct

SEQ ID NO: 1303689 - DNA, 16 bp, Homo sapiens
gagcttctctgtgaac

SEQ ID NO: 1303690 - DNA, 22 bp, Homo sapiens
gaggaaaagtaaccatcactgg

SEQ ID NO: 1303691 - DNA, 18 bp, Homo sapiens
gaggaggggccgctgcca

SEQ ID NO: 1303692 - DNA, 13 bp, Homo sapiens
gaggcaagagaat

SEQ ID NO: 1303693 - DNA, 23 bp, Homo sapiens
gaggccccagcctccctgaagcc

SEQ ID NO: 1303694 - DNA, 17 bp, Homo sapiens
gaggccctctggagtgg

SEQ ID NO: 1303695 - DNA, 19 bp, Homo sapiens
gaggccctctggagtggcc

SEQ ID NO: 1303696 - DNA, 20 bp, Homo sapiens
gaggcctgcctccagggctg

SEQ ID NO: 1303697 - DNA, 16 bp, Homo sapiens
gaggctgaggctggca

SEQ ID NO: 1303698 - DNA, 19 bp, Homo sapiens
gaggctgaggctggcacag

SEQ ID NO: 1303699 - DNA, 20 bp, Homo sapiens
gaggctgaggctggcacagg

SEQ ID NO: 1303700 - DNA, 16 bp, Homo sapiens
gaggctttggatttga

SEQ ID NO: 1303701 - DNA, 17 bp, Homo sapiens
gagggaggcaagccctg

SEQ ID NO: 1303702 - DNA, 19 bp, Homo sapiens
gaggggcctaggcctcagc

SEQ ID NO: 1303703 - DNA, 14 bp, Homo sapiens
gagtagaattgcat

SEQ ID NO: 1303704 - DNA, 19 bp, Homo sapiens
gagtcaaatggtaggcatt

SEQ ID NO: 1303705 - DNA, 11 bp, Homo sapiens
gagtggccact

SEQ ID NO: 1303706 - DNA, 12 bp, Homo sapiens
gagttaagacct

SEQ ID NO: 1303707 - DNA, 17 bp, Homo sapiens
gagttaagacctggcag

SEQ ID NO: 1303708 - DNA, 17 bp, Homo sapiens
gagttgatctggaaccc

SEQ ID NO: 1303709 - DNA, 20 bp, Homo sapiens
gagttgatctggaacccaga

SEQ ID NO: 1303710 - DNA, 17 bp, Homo sapiens
gataactagatggtgct

SEQ ID NO: 1303711 - DNA, 23 bp, Homo sapiens
gatactgctactgtaattttata

SEQ ID NO: 1303712 - DNA, 21 bp, Homo sapiens
gatagacacatatgaggggga

SEQ ID NO: 1303713 - DNA, 12 bp, Homo sapiens
gatagatgctgg

SEQ ID NO: 1303714 - DNA, 16 bp, Homo sapiens
gatagatgctggccca

SEQ ID NO: 1303715 - DNA, 18 bp, Homo sapiens
gatagatgctggcccagg

SEQ ID NO: 1303716 - DNA, 20 bp, Homo sapiens
gatagatgctggcccagggc

SEQ ID NO: 1303717 - DNA, 16 bp, Homo sapiens
gatatccattctttct

SEQ ID NO: 1303718 - DNA, 19 bp, Homo sapiens
gatatccattctttctgat

SEQ ID NO: 1303719 - DNA, 17 bp, Homo sapiens
gatcaacatcttttctt

SEQ ID NO: 1303720 - DNA, 14 bp, Homo sapiens
gatcagatctgaca

SEQ ID NO: 1303721 - DNA, 16 bp, Homo sapiens
gatccaaaagaagccc

SEQ ID NO: 1303722 - DNA, 20 bp, Homo sapiens
gatccaaaagaagcccccag

SEQ ID NO: 1303723 - DNA, 13 bp, Homo sapiens
gatccagcctggg

SEQ ID NO: 1303724 - DNA, 13 bp, Homo sapiens
gatccagggacag

SEQ ID NO: 1303725 - DNA, 14 bp, Homo sapiens
gatccagggacaga

SEQ ID NO: 1303726 - DNA, 16 bp, Homo sapiens
gatccagggactgaag

SEQ ID NO: 1303727 - DNA, 19 bp, Homo sapiens
gatccctcccccccatgca

SEQ ID NO: 1303728 - DNA, 21 bp, Homo sapiens
gatccctcccccccatgcact

SEQ ID NO: 1303729 - DNA, 21 bp, Homo sapiens
gatctgacatgattccttcct

SEQ ID NO: 1303730 - DNA, 22 bp, Homo sapiens
gatctgacatgattccttcctg

SEQ ID NO: 1303731 - DNA, 16 bp, Homo sapiens
gatctggaacccagac

SEQ ID NO: 1303732 - DNA, 17 bp, Homo sapiens
gatctggaacccagact

SEQ ID NO: 1303733 - DNA, 18 bp, Homo sapiens
gatctggaacccagactc

SEQ ID NO: 1303734 - DNA, 17 bp, Homo sapiens
gatctgtcctcagcctt

SEQ ID NO: 1303735 - DNA, 18 bp, Homo sapiens
gatctgtcctcagccttg

SEQ ID NO: 1303736 - DNA, 13 bp, Homo sapiens
gatctgttttgaa

SEQ ID NO: 1303737 - DNA, 17 bp, Homo sapiens
gatctgttttgaaggca

SEQ ID NO: 1303738 - DNA, 14 bp, Homo sapiens
gatctttgtggcca

SEQ ID NO: 1303739 - DNA, 15 bp, Homo sapiens
gatctttgtggccaa

SEQ ID NO: 1303740 - DNA, 16 bp, Homo sapiens
gatgaagttttacatt

SEQ ID NO: 1303741 - DNA, 17 bp, Homo sapiens
gatgaagttttacattg

SEQ ID NO: 1303742 - DNA, 14 bp, Homo sapiens
gatgaatgtattta

SEQ ID NO: 1303743 - DNA, 18 bp, Homo sapiens
gatgatacatccaaagca

SEQ ID NO: 1303744 - DNA, 15 bp, Homo sapiens
gatgccacacaagga

SEQ ID NO: 1303745 - DNA, 19 bp, Homo sapiens
gatgccctggaggtggctg

SEQ ID NO: 1303746 - DNA, 20 bp, Homo sapiens
gatgctgacattcacctgcc

SEQ ID NO: 1303747 - DNA, 12 bp, Homo sapiens
gatgctggccca

SEQ ID NO: 1303748 - DNA, 15 bp, Homo sapiens
gatgctggcccaggg

SEQ ID NO: 1303749 - DNA, 17 bp, Homo sapiens
gatgctggcccagggcc

SEQ ID NO: 1303750 - DNA, 18 bp, Homo sapiens
gatggccggagaggaccg

SEQ ID NO: 1303751 - DNA, 12 bp, Homo sapiens
gatggctcctct

SEQ ID NO: 1303752 - DNA, 13 bp, Homo sapiens
gatggctcctctc

SEQ ID NO: 1303753 - DNA, 20 bp, Homo sapiens
gatgggggaactcagatcca

SEQ ID NO: 1303754 - DNA, 16 bp, Homo sapiens
gatggtgctgagaagc

SEQ ID NO: 1303755 - DNA, 18 bp, Homo sapiens
gatgtgattgtggaatgg

SEQ ID NO: 1303756 - DNA, 12 bp, Homo sapiens
gatgtttccaga

SEQ ID NO: 1303757 - DNA, 21 bp, Homo sapiens
cttgatgaccaaagtcctttt

SEQ ID NO: 1303758 - DNA, 13 bp, Homo sapiens
cttgattctgcag

SEQ ID NO: 1303759 - DNA, 11 bp, Homo sapiens
cttgccagaga

SEQ ID NO: 1303760 - DNA, 21 bp, Homo sapiens
cttggcaccagacacccagga

SEQ ID NO: 1303761 - DNA, 12 bp, Homo sapiens
cttggctcagac

SEQ ID NO: 1303762 - DNA, 21 bp, Homo sapiens
cttggggagttaagacctggc

SEQ ID NO: 1303763 - DNA, 13 bp, Homo sapiens
cttgtattaaact

SEQ ID NO: 1303764 - DNA, 23 bp, Homo sapiens
cttgtattaaactcttcacaaaa

SEQ ID NO: 1303765 - DNA, 12 bp, Homo sapiens
cttgtccagctg

SEQ ID NO: 1303766 - DNA, 13 bp, Homo sapiens
cttgtccagctga

SEQ ID NO: 1303767 - DNA, 13 bp, Homo sapiens
ctttaatgcatct

SEQ ID NO: 1303768 - DNA, 15 bp, Homo sapiens
ctttattaatcacta

SEQ ID NO: 1303769 - DNA, 20 bp, Homo sapiens
ctttattaatcactattgtt

SEQ ID NO: 1303770 - DNA, 14 bp, Homo sapiens
ctttattaccccct

SEQ ID NO: 1303771 - DNA, 23 bp, Homo sapiens
ctttattccagaatgctgtacat

SEQ ID NO: 1303772 - DNA, 15 bp, Homo sapiens
ctttcatttttttcc

SEQ ID NO: 1303773 - DNA, 16 bp, Homo sapiens
ctttcatttttttcca

SEQ ID NO: 1303774 - DNA, 22 bp, Homo sapiens
ctttcatttttttccaggctgg

SEQ ID NO: 1303775 - DNA, 17 bp, Homo sapiens
ctttcctaaggctgcaa

SEQ ID NO: 1303776 - DNA, 21 bp, Homo sapiens
ctttcctagatggcagtcact

SEQ ID NO: 1303777 - DNA, 18 bp, Homo sapiens
ctttctacaatgtgaact

SEQ ID NO: 1303778 - DNA, 22 bp, Homo sapiens
ctttctcccctgcccccaggac

SEQ ID NO: 1303779 - DNA, 24 bp, Homo sapiens
ctttctcccctgcccccaggactg

SEQ ID NO: 1303780 - DNA, 20 bp, Homo sapiens
ctttgattctccttcagccc

SEQ ID NO: 1303781 - DNA, 22 bp, Homo sapiens
ctttgattctccttcagccctc

SEQ ID NO: 1303782 - DNA, 19 bp, Homo sapiens
ctttgctgctgaaggctca

SEQ ID NO: 1303783 - DNA, 13 bp, Homo sapiens
ctttgctttctgc

SEQ ID NO: 1303784 - DNA, 21 bp, Homo sapiens
ctttgctttctgctcagcttc

SEQ ID NO: 1303785 - DNA, 12 bp, Homo sapiens
ctttgtggccaa

SEQ ID NO: 1303786 - DNA, 16 bp, Homo sapiens
ctttgtggccaaggag

SEQ ID NO: 1303787 - DNA, 18 bp, Homo sapiens
ctttgtggccaaggagct

SEQ ID NO: 1303788 - DNA, 22 bp, Homo sapiens
ctttgtggccaaggagctgcta

SEQ ID NO: 1303789 - DNA, 20 bp, Homo sapiens
cttttatactctttctgtat

SEQ ID NO: 1303790 - DNA, 15 bp, Homo sapiens
cttttatgtagtaat

SEQ ID NO: 1303791 - DNA, 21 bp, Homo sapiens
cttttgaacgcccccccccac

SEQ ID NO: 1303792 - DNA, 21 bp, Homo sapiens
cttttgaataaaaactttgct

SEQ ID NO: 1303793 - DNA, 11 bp, Homo sapiens
gaaaaacaggt

SEQ ID NO: 1303794 - DNA, 18 bp, Homo sapiens
gaaaataagaatagaaat

SEQ ID NO: 1303795 - DNA, 22 bp, Homo sapiens
gaaaatgcagcagggatgccct

SEQ ID NO: 1303796 - DNA, 15 bp, Homo sapiens
gaaaatgttatttaa

SEQ ID NO: 1303797 - DNA, 16 bp, Homo sapiens
gaaaatgttatttaac

SEQ ID NO: 1303798 - DNA, 16 bp, Homo sapiens
gaaataaaaggaagcc

SEQ ID NO: 1303799 - DNA, 20 bp, Homo sapiens
gaaataaaggatgtgattgt

SEQ ID NO: 1303800 - DNA, 21 bp, Homo sapiens
gaaattgacacaagtggacct

SEQ ID NO: 1303801 - DNA, 14 bp, Homo sapiens
gaacaaagcagcca

SEQ ID NO: 1303802 - DNA, 14 bp, Homo sapiens
gaacacggccacat

SEQ ID NO: 1303803 - DNA, 17 bp, Homo sapiens
gaacatccaaccttccc

SEQ ID NO: 1303804 - DNA, 17 bp, Homo sapiens
gaacccagactcagaca

SEQ ID NO: 1303805 - DNA, 19 bp, Homo sapiens
gaacccagactcagacatt

SEQ ID NO: 1303806 - DNA, 19 bp, Homo sapiens
gaacgcccccccccacccc

SEQ ID NO: 1303807 - DNA, 20 bp, Homo sapiens
gaactcaaatggggccagat

SEQ ID NO: 1303808 - DNA, 22 bp, Homo sapiens
gaactcaaatggggccagatcc

SEQ ID NO: 1303809 - DNA, 14 bp, Homo sapiens
gaactcagatccag

SEQ ID NO: 1303810 - DNA, 15 bp, Homo sapiens
gaactcagatccagg

SEQ ID NO: 1303811 - DNA, 19 bp, Homo sapiens
gaactcagatccagggaca

SEQ ID NO: 1303812 - DNA, 12 bp, Homo sapiens
gaactgaactca

SEQ ID NO: 1303813 - DNA, 20 bp, Homo sapiens
gaactgtgtttcaagttcaa

SEQ ID NO: 1303814 - DNA, 17 bp, Homo sapiens
gaacttacattgttcaa

SEQ ID NO: 1303815 - DNA, 23 bp, Homo sapiens
gaacttccaggtgttactgtaat

SEQ ID NO: 1303816 - DNA, 13 bp, Homo sapiens
gaagaacggggct

SEQ ID NO: 1303817 - DNA, 20 bp, Homo sapiens
gaagaacggggctcttctca

SEQ ID NO: 1303818 - DNA, 22 bp, Homo sapiens
gaagaacggggctcttctcatt

SEQ ID NO: 1303819 - DNA, 19 bp, Homo sapiens
gaagacctcacctagaaat

SEQ ID NO: 1303820 - DNA, 15 bp, Homo sapiens
gaagactggaagcta

SEQ ID NO: 1303821 - DNA, 12 bp, Homo sapiens
gaagagaaacca

SEQ ID NO: 1303822 - DNA, 21 bp, Homo sapiens
gaagataagtgtatttttcaa

SEQ ID NO: 1303823 - DNA, 19 bp, Homo sapiens
gaagccaggaatttcccag

SEQ ID NO: 1303824 - DNA, 23 bp, Homo sapiens
gaagccaggaatttcccaggacc

SEQ ID NO: 1303825 - DNA, 24 bp, Homo sapiens
gaagccaggaatttcccaggaccc

SEQ ID NO: 1303826 - DNA, 14 bp, Homo sapiens
gaagcccccagcta

SEQ ID NO: 1303827 - DNA, 20 bp, Homo sapiens
gaagccgtgctcgccccagc

SEQ ID NO: 1303828 - DNA, 22 bp, Homo sapiens
gaagctcctctccccagcccag

SEQ ID NO: 1303829 - DNA, 16 bp, Homo sapiens
gaagggccagagccag

SEQ ID NO: 1303830 - DNA, 19 bp, Homo sapiens
gaagggggtggtgtctcca

SEQ ID NO: 1303831 - DNA, 14 bp, Homo sapiens
gaagtccaatgtgg

SEQ ID NO: 1303832 - DNA, 17 bp, Homo sapiens
gaagttgcagtgagctg

SEQ ID NO: 1303833 - DNA, 18 bp, Homo sapiens
gaatactgttaaaggaaa

SEQ ID NO: 1303834 - DNA, 20 bp, Homo sapiens
gaatactttttacaattaaa

SEQ ID NO: 1303835 - DNA, 19 bp, Homo sapiens
gaatatttattacctctga

SEQ ID NO: 1303836 - DNA, 21 bp, Homo sapiens
gaatcagtataaacaaagtta

SEQ ID NO: 1303837 - DNA, 17 bp, Homo sapiens
gaatcccaaatttgatt

SEQ ID NO: 1303838 - DNA, 12 bp, Homo sapiens
gaatctggagac

SEQ ID NO: 1303839 - DNA, 20 bp, Homo sapiens
gaatgaacactcttttgctt

SEQ ID NO: 1303840 - DNA, 13 bp, Homo sapiens
gaatgctgtacat

SEQ ID NO: 1303841 - DNA, 15 bp, Homo sapiens
gaatgctgtacatct

SEQ ID NO: 1303842 - DNA, 20 bp, Homo sapiens
gaatgctgtacatctatttt

SEQ ID NO: 1303843 - DNA, 18 bp, Homo sapiens
gaatgtggcttgagaaat

SEQ ID NO: 1303844 - DNA, 20 bp, Homo sapiens
gaatgttacattgtttgtct

SEQ ID NO: 1303845 - DNA, 23 bp, Homo sapiens
gaattcaaactggggcctccaga

SEQ ID NO: 1303846 - DNA, 12 bp, Homo sapiens
gaattgatttgc

SEQ ID NO: 1303847 - DNA, 17 bp, Homo sapiens
gaatttattcaattcct

SEQ ID NO: 1303848 - DNA, 23 bp, Homo sapiens
gaatttattcaattcctctggga

SEQ ID NO: 1303849 - DNA, 17 bp, Homo sapiens
gaatttcccaggaccct

SEQ ID NO: 1303850 - DNA, 20 bp, Homo sapiens
gacaagtggactcagggcag

SEQ ID NO: 1303851 - DNA, 19 bp, Homo sapiens
gacacagaaaatgttgaga

SEQ ID NO: 1303852 - DNA, 16 bp, Homo sapiens
gacacaggtctttcct

SEQ ID NO: 1303853 - DNA, 17 bp, Homo sapiens
gacacaggtctttccta

SEQ ID NO: 1303854 - DNA, 15 bp, Homo sapiens
gacacatatgagggg

SEQ ID NO: 1303855 - DNA, 13 bp, Homo sapiens
gacacccaggact

SEQ ID NO: 1303856 - DNA, 13 bp, Homo sapiens
gacagaggcccca

SEQ ID NO: 1303857 - DNA, 19 bp, Homo sapiens
gacagaggccccagcctcc

SEQ ID NO: 1303858 - DNA, 14 bp, Homo sapiens
gacagctgctccta

SEQ ID NO: 1303859 - DNA, 18 bp, Homo sapiens
gacaggagacctggcact

SEQ ID NO: 1303860 - DNA, 16 bp, Homo sapiens
gacaggcaaataaaag

SEQ ID NO: 1303861 - DNA, 12 bp, Homo sapiens
gacaggctggct

SEQ ID NO: 1303862 - DNA, 14 bp, Homo sapiens
gacaggctggctcc

SEQ ID NO: 1303863 - DNA, 21 bp, Homo sapiens
gacaggctggctccagatgca

SEQ ID NO: 1303864 - DNA, 17 bp, Homo sapiens
gacatgatttccttgaa

SEQ ID NO: 1303865 - DNA, 20 bp, Homo sapiens
gacatgatttccttgaatgt

SEQ ID NO: 1303866 - DNA, 22 bp, Homo sapiens
gacatgatttccttgaatgtgg

SEQ ID NO: 1303867 - DNA, 17 bp, Homo sapiens
gacatgcggtagccagc

SEQ ID NO: 1303868 - DNA, 15 bp, Homo sapiens
gacattcacctgccc

SEQ ID NO: 1303869 - DNA, 15 bp, Homo sapiens
gaccacagcacagcc

SEQ ID NO: 1303870 - DNA, 13 bp, Homo sapiens
gaccacggctcga

SEQ ID NO: 1303871 - DNA, 16 bp, Homo sapiens
gaccagcagcgccttt

SEQ ID NO: 1303872 - DNA, 12 bp, Homo sapiens
gaccagctcagg

SEQ ID NO: 1303873 - DNA, 22 bp, Homo sapiens
gaccagctcaggacagatgcca

SEQ ID NO: 1303874 - DNA, 19 bp, Homo sapiens
gacccaatgtaggagctgc

SEQ ID NO: 1303875 - DNA, 16 bp, Homo sapiens
ctggaacctcagcctg

SEQ ID NO: 1303876 - DNA, 18 bp, Homo sapiens
ctggaacctcagcctggc

SEQ ID NO: 1303877 - DNA, 22 bp, Homo sapiens
ctggaacctcagcctggccaga

SEQ ID NO: 1303878 - DNA, 19 bp, Homo sapiens
ctggaagctaatttgcatt

SEQ ID NO: 1303879 - DNA, 16 bp, Homo sapiens
ctggaagtccaatgtg

SEQ ID NO: 1303880 - DNA, 18 bp, Homo sapiens
ctggaatctggagaccag

SEQ ID NO: 1303881 - DNA, 13 bp, Homo sapiens
ctggacagcccca

SEQ ID NO: 1303882 - DNA, 15 bp, Homo sapiens
ctggacagccccacc

SEQ ID NO: 1303883 - DNA, 16 bp, Homo sapiens
ctggacagccccaccc

SEQ ID NO: 1303884 - DNA, 17 bp, Homo sapiens
ctggagaccagggagcc

SEQ ID NO: 1303885 - DNA, 21 bp, Homo sapiens
ctggaggcccagttcaccctg

SEQ ID NO: 1303886 - DNA, 20 bp, Homo sapiens
ctggagttgatctggaaccc

SEQ ID NO: 1303887 - DNA, 19 bp, Homo sapiens
ctggcaaaaggatctttgt

SEQ ID NO: 1303888 - DNA, 23 bp, Homo sapiens
ctggcaaaaggatctttgtggcc

SEQ ID NO: 1303889 - DNA, 20 bp, Homo sapiens
ctggcactgactgggcatag

SEQ ID NO: 1303890 - DNA, 15 bp, Homo sapiens
ctggcagcctcccat

SEQ ID NO: 1303891 - DNA, 21 bp, Homo sapiens
ctggcagctctggacagcccc

SEQ ID NO: 1303892 - DNA, 13 bp, Homo sapiens
ctggcccagggcc

SEQ ID NO: 1303893 - DNA, 14 bp, Homo sapiens
ctggcccagggccc

SEQ ID NO: 1303894 - DNA, 18 bp, Homo sapiens
ctggcccagggcccagag

SEQ ID NO: 1303895 - DNA, 23 bp, Homo sapiens
ctggcccagggcccagagcccag

SEQ ID NO: 1303896 - DNA, 20 bp, Homo sapiens
ctggccccaggacctggctg

SEQ ID NO: 1303897 - DNA, 21 bp, Homo sapiens
ctggccccaggacctggctgc

SEQ ID NO: 1303898 - DNA, 17 bp, Homo sapiens
ctggccgagtccaagct

SEQ ID NO: 1303899 - DNA, 18 bp, Homo sapiens
ctggccgagtccaagctg

SEQ ID NO: 1303900 - DNA, 11 bp, Homo sapiens
ctggcctctgt

SEQ ID NO: 1303901 - DNA, 15 bp, Homo sapiens
ctggcctctgtgcct

SEQ ID NO: 1303902 - DNA, 16 bp, Homo sapiens
ctggcctctgtgcctt

SEQ ID NO: 1303903 - DNA, 19 bp, Homo sapiens
ctggctgggacgtggctca

SEQ ID NO: 1303904 - DNA, 17 bp, Homo sapiens
ctgggacgtggctcagc

SEQ ID NO: 1303905 - DNA, 21 bp, Homo sapiens
ctgggacgtggctcagccagc

SEQ ID NO: 1303906 - DNA, 17 bp, Homo sapiens
ctgggctcctccagggt

SEQ ID NO: 1303907 - DNA, 12 bp, Homo sapiens
ctggggcctcca

SEQ ID NO: 1303908 - DNA, 17 bp, Homo sapiens
ctggggcctccagaact

SEQ ID NO: 1303909 - DNA, 14 bp, Homo sapiens
ctggggctctggga

SEQ ID NO: 1303910 - DNA, 13 bp, Homo sapiens
ctggggggcagtg

SEQ ID NO: 1303911 - DNA, 14 bp, Homo sapiens
ctgggggtgggcca

SEQ ID NO: 1303912 - DNA, 14 bp, Homo sapiens
ctggggtggggtca

SEQ ID NO: 1303913 - DNA, 17 bp, Homo sapiens
ctgggtacttcttgaag

SEQ ID NO: 1303914 - DNA, 22 bp, Homo sapiens
ctggtcctacccatccccgcag

SEQ ID NO: 1303915 - DNA, 13 bp, Homo sapiens
ctggtggcccagg

SEQ ID NO: 1303916 - DNA, 21 bp, Homo sapiens
ctggttcggatttggggtgga

SEQ ID NO: 1303917 - DNA, 16 bp, Homo sapiens
ctggttctcatctttc

SEQ ID NO: 1303918 - DNA, 13 bp, Homo sapiens
ctgtaatcccagc

SEQ ID NO: 1303919 - DNA, 14 bp, Homo sapiens
ctgtacatctattt

SEQ ID NO: 1303920 - DNA, 13 bp, Homo sapiens
ctgtatatacttt

SEQ ID NO: 1303921 - DNA, 16 bp, Homo sapiens
ctgtatatagcccagc

SEQ ID NO: 1303922 - DNA, 14 bp, Homo sapiens
ctgtcagtcacagc

SEQ ID NO: 1303923 - DNA, 21 bp, Homo sapiens
ctgtcatctgtgcactgccca

SEQ ID NO: 1303924 - DNA, 12 bp, Homo sapiens
ctgtccagctcc

SEQ ID NO: 1303925 - DNA, 18 bp, Homo sapiens
ctgtccagctccaacctg

SEQ ID NO: 1303926 - DNA, 16 bp, Homo sapiens
ctgtccccttctctca

SEQ ID NO: 1303927 - DNA, 19 bp, Homo sapiens
ctgtccccttctctcatct

SEQ ID NO: 1303928 - DNA, 21 bp, Homo sapiens
ctgtccccttctctcatctct

SEQ ID NO: 1303929 - DNA, 22 bp, Homo sapiens
ctgtccccttctctcatctctt

SEQ ID NO: 1303930 - DNA, 20 bp, Homo sapiens
ctgtcctcagccttgccaga

SEQ ID NO: 1303931 - DNA, 14 bp, Homo sapiens
ctgtcctgggcctg

SEQ ID NO: 1303932 - DNA, 18 bp, Homo sapiens
ctgtcctgggcctgcaga

SEQ ID NO: 1303933 - DNA, 14 bp, Homo sapiens
ctgtctagagaggg

SEQ ID NO: 1303934 - DNA, 11 bp, Homo sapiens
ctgtctttcct

SEQ ID NO: 1303935 - DNA, 22 bp, Homo sapiens
ctgtgaacgatttagaaagaag

SEQ ID NO: 1303936 - DNA, 21 bp, Homo sapiens
ctgtgacccccagctccggcc

SEQ ID NO: 1303937 - DNA, 15 bp, Homo sapiens
ctgtgagcccagctg

SEQ ID NO: 1303938 - DNA, 20 bp, Homo sapiens
ctgtgcacaaaacccagacc

SEQ ID NO: 1303939 - DNA, 19 bp, Homo sapiens
ctgtgccttcttttgatta

SEQ ID NO: 1303940 - DNA, 23 bp, Homo sapiens
ctgtggccagcttgttatttata

SEQ ID NO: 1303941 - DNA, 23 bp, Homo sapiens
ctgtgtgattgacagctttgctg

SEQ ID NO: 1303942 - DNA, 15 bp, Homo sapiens
ctgtgtgtccaaaac

SEQ ID NO: 1303943 - DNA, 21 bp, Homo sapiens
ctgtgtgtccaaaactgcctc

SEQ ID NO: 1303944 - DNA, 17 bp, Homo sapiens
ctgtgtgtgtgaatgaa

SEQ ID NO: 1303945 - DNA, 13 bp, Homo sapiens
ctgtgtgttgcca

SEQ ID NO: 1303946 - DNA, 21 bp, Homo sapiens
ctgtgtgttgccacaggacac

SEQ ID NO: 1303947 - DNA, 20 bp, Homo sapiens
ctgttcccatgtagccccct

SEQ ID NO: 1303948 - DNA, 13 bp, Homo sapiens
ctgttccccagag

SEQ ID NO: 1303949 - DNA, 15 bp, Homo sapiens
ctgttccccagagaa

SEQ ID NO: 1303950 - DNA, 21 bp, Homo sapiens
ctgttctcttgggaactgaac

SEQ ID NO: 1303951 - DNA, 15 bp, Homo sapiens
ctgttgagctgtttt

SEQ ID NO: 1303952 - DNA, 21 bp, Homo sapiens
ctgttttcctcccttctgcta

SEQ ID NO: 1303953 - DNA, 17 bp, Homo sapiens
ctgttttgaaggcaaaa

SEQ ID NO: 1303954 - DNA, 20 bp, Homo sapiens
cttacattgttcaattagaa

SEQ ID NO: 1303955 - DNA, 15 bp, Homo sapiens
cttagaacattttaa

SEQ ID NO: 1303956 - DNA, 16 bp, Homo sapiens
cttagaatccaaactt

SEQ ID NO: 1303957 - DNA, 22 bp, Homo sapiens
cttagagacagttgggtgagaa

SEQ ID NO: 1303958 - DNA, 16 bp, Homo sapiens
cttagatggattctcc

SEQ ID NO: 1303959 - DNA, 22 bp, Homo sapiens
cttaggaagagaaaccagggag

SEQ ID NO: 1303960 - DNA, 23 bp, Homo sapiens
cttaggccttcctctctccagat

SEQ ID NO: 1303961 - DNA, 13 bp, Homo sapiens
cttatagaatatt

SEQ ID NO: 1303962 - DNA, 14 bp, Homo sapiens
cttatcatggtctc

SEQ ID NO: 1303963 - DNA, 15 bp, Homo sapiens
cttatcatggtctca

SEQ ID NO: 1303964 - DNA, 20 bp, Homo sapiens
cttatggaattgatttgcat

SEQ ID NO: 1303965 - DNA, 13 bp, Homo sapiens
cttattgtacctc

SEQ ID NO: 1303966 - DNA, 18 bp, Homo sapiens
cttattgtacctctctta

SEQ ID NO: 1303967 - DNA, 20 bp, Homo sapiens
cttcagaaagtgtgctttat

SEQ ID NO: 1303968 - DNA, 13 bp, Homo sapiens
cttcatctcccac

SEQ ID NO: 1303969 - DNA, 21 bp, Homo sapiens
cttcattcttgaaagctgtgg

SEQ ID NO: 1303970 - DNA, 19 bp, Homo sapiens
cttccagtgtccttagaac

SEQ ID NO: 1303971 - DNA, 17 bp, Homo sapiens
cttccatgattctattt

SEQ ID NO: 1303972 - DNA, 22 bp, Homo sapiens
cttcctggagcccagaggaggg

SEQ ID NO: 1303973 - DNA, 16 bp, Homo sapiens
cttcctgtccagctcc

SEQ ID NO: 1303974 - DNA, 20 bp, Homo sapiens
cttccttgagacacggagcc

SEQ ID NO: 1303975 - DNA, 14 bp, Homo sapiens
cttcgggctgtgcc

SEQ ID NO: 1303976 - DNA, 19 bp, Homo sapiens
cttctaaacccaatccaaa

SEQ ID NO: 1303977 - DNA, 19 bp, Homo sapiens
cttctaaacttccccatct

SEQ ID NO: 1303978 - DNA, 23 bp, Homo sapiens
cttctaaaggtgttgtcccttct

SEQ ID NO: 1303979 - DNA, 18 bp, Homo sapiens
cttctcatttcacccctc

SEQ ID NO: 1303980 - DNA, 22 bp, Homo sapiens
cttctcatttcacccctccctt

SEQ ID NO: 1303981 - DNA, 20 bp, Homo sapiens
cttctgctactggcaaaagg

SEQ ID NO: 1303982 - DNA, 16 bp, Homo sapiens
cttctgctcagctctg

SEQ ID NO: 1303983 - DNA, 16 bp, Homo sapiens
cttgaaaataagaata

SEQ ID NO: 1303984 - DNA, 22 bp, Homo sapiens
cttgaaaataagaatagaaata

SEQ ID NO: 1303985 - DNA, 15 bp, Homo sapiens
cttgaagggccagag

SEQ ID NO: 1303986 - DNA, 18 bp, Homo sapiens
cttgaagggccagagcca

SEQ ID NO: 1303987 - DNA, 20 bp, Homo sapiens
cttgaagggccagagccagg

SEQ ID NO: 1303988 - DNA, 22 bp, Homo sapiens
cttgaatgtggcttgagaaata

SEQ ID NO: 1303989 - DNA, 14 bp, Homo sapiens
cttgacaacatctg

SEQ ID NO: 1303990 - DNA, 11 bp, Homo sapiens
cttgagaaacc

SEQ ID NO: 1303991 - DNA, 17 bp, Homo sapiens
cttgagacacggagccc

SEQ ID NO: 1303992 - DNA, 23 bp, Homo sapiens
cttgatcaacatcttttcttgcc

SEQ ID NO: 1303993 - DNA, 15 bp, Homo sapiens
ctctccccagcccag

SEQ ID NO: 1303994 - DNA, 20 bp, Homo sapiens
ctctccctgaccctgtatat

SEQ ID NO: 1303995 - DNA, 14 bp, Homo sapiens
ctctcctcatctct

SEQ ID NO: 1303996 - DNA, 23 bp, Homo sapiens
ctctcctcatctctaacagctca

SEQ ID NO: 1303997 - DNA, 12 bp, Homo sapiens
ctctcggaactg

SEQ ID NO: 1303998 - DNA, 16 bp, Homo sapiens
ctctcggaactgcatg

SEQ ID NO: 1303999 - DNA, 14 bp, Homo sapiens
ctctctccagatgt

SEQ ID NO: 1304000 - DNA, 19 bp, Homo sapiens
ctctcttatagaatattta

SEQ ID NO: 1304001 - DNA, 23 bp, Homo sapiens
ctctcttatagaatatttattac

SEQ ID NO: 1304002 - DNA, 14 bp, Homo sapiens
ctctgcccaaccct

SEQ ID NO: 1304003 - DNA, 15 bp, Homo sapiens
ctctgccccatcctc

SEQ ID NO: 1304004 - DNA, 13 bp, Homo sapiens
ctctgctccccag

SEQ ID NO: 1304005 - DNA, 15 bp, Homo sapiens
ctctggacagcccca

SEQ ID NO: 1304006 - DNA, 15 bp, Homo sapiens
ctctggagtggccac

SEQ ID NO: 1304007 - DNA, 20 bp, Homo sapiens
ctctggagtggccactaagc

SEQ ID NO: 1304008 - DNA, 14 bp, Homo sapiens
ctctgtcagtcaca

SEQ ID NO: 1304009 - DNA, 19 bp, Homo sapiens
ctctgtcagtcacagccac

SEQ ID NO: 1304010 - DNA, 15 bp, Homo sapiens
ctctgtccccttctc

SEQ ID NO: 1304011 - DNA, 18 bp, Homo sapiens
ctctgtccccttctctca

SEQ ID NO: 1304012 - DNA, 21 bp, Homo sapiens
ctctgtccccttctctcatct

SEQ ID NO: 1304013 - DNA, 14 bp, Homo sapiens
ctcttagatggatt

SEQ ID NO: 1304014 - DNA, 22 bp, Homo sapiens
ctcttatagaatatttattacc

SEQ ID NO: 1304015 - DNA, 21 bp, Homo sapiens
ctcttcagaaagtgtgcttta

SEQ ID NO: 1304016 - DNA, 19 bp, Homo sapiens
ctcttctcatttcacccct

SEQ ID NO: 1304017 - DNA, 16 bp, Homo sapiens
ctcttggcctgatcag

SEQ ID NO: 1304018 - DNA, 12 bp, Homo sapiens
ctcttgtaaata

SEQ ID NO: 1304019 - DNA, 18 bp, Homo sapiens
ctcttgtaaataaagccc

SEQ ID NO: 1304020 - DNA, 15 bp, Homo sapiens
ctcttgtattaaact

SEQ ID NO: 1304021 - DNA, 13 bp, Homo sapiens
ctctttctgtata

SEQ ID NO: 1304022 - DNA, 14 bp, Homo sapiens
ctctttgctttgct

SEQ ID NO: 1304023 - DNA, 20 bp, Homo sapiens
ctctttgctttgctttctgc

SEQ ID NO: 1304024 - DNA, 16 bp, Homo sapiens
ctgaaacaacttggaa

SEQ ID NO: 1304025 - DNA, 20 bp, Homo sapiens
ctgaaacaacttggaaagat

SEQ ID NO: 1304026 - DNA, 13 bp, Homo sapiens
ctgaactcacttt

SEQ ID NO: 1304027 - DNA, 15 bp, Homo sapiens
ctgaagaaccagtcc

SEQ ID NO: 1304028 - DNA, 23 bp, Homo sapiens
ctgaattatctatacatatcttt

SEQ ID NO: 1304029 - DNA, 13 bp, Homo sapiens
ctgacagctgctc

SEQ ID NO: 1304030 - DNA, 22 bp, Homo sapiens
ctgacagctgctcctagaggga

SEQ ID NO: 1304031 - DNA, 16 bp, Homo sapiens
ctgacatgattccttc

SEQ ID NO: 1304032 - DNA, 14 bp, Homo sapiens
ctgaccacagcaca

SEQ ID NO: 1304033 - DNA, 22 bp, Homo sapiens
ctgaccacgctttctagctgtt

SEQ ID NO: 1304034 - DNA, 14 bp, Homo sapiens
ctgaccagcagcgc

SEQ ID NO: 1304035 - DNA, 12 bp, Homo sapiens
ctgaccctgtat

SEQ ID NO: 1304036 - DNA, 13 bp, Homo sapiens
ctgaccctgtata

SEQ ID NO: 1304037 - DNA, 15 bp, Homo sapiens
ctgaccctgtatata

SEQ ID NO: 1304038 - DNA, 19 bp, Homo sapiens
ctgaccctgtatatagccc

SEQ ID NO: 1304039 - DNA, 13 bp, Homo sapiens
ctgaccctgtgga

SEQ ID NO: 1304040 - DNA, 20 bp, Homo sapiens
ctgacctgtgagcccagctg

SEQ ID NO: 1304041 - DNA, 15 bp, Homo sapiens
ctgacggccagggag

SEQ ID NO: 1304042 - DNA, 18 bp, Homo sapiens
ctgacgtagctgcaaagg

SEQ ID NO: 1304043 - DNA, 19 bp, Homo sapiens
ctgagaatgtaagaactac

SEQ ID NO: 1304044 - DNA, 12 bp, Homo sapiens
ctgagagaaata

SEQ ID NO: 1304045 - DNA, 15 bp, Homo sapiens
ctgagatttcatctg

SEQ ID NO: 1304046 - DNA, 20 bp, Homo sapiens
ctgagatttcatctgctctc

SEQ ID NO: 1304047 - DNA, 21 bp, Homo sapiens
ctgagatttcatctgctctcc

SEQ ID NO: 1304048 - DNA, 20 bp, Homo sapiens
ctgagcaactcttgattatc

SEQ ID NO: 1304049 - DNA, 13 bp, Homo sapiens
ctgagcccctgtc

SEQ ID NO: 1304050 - DNA, 15 bp, Homo sapiens
ctgagcccctgtcta

SEQ ID NO: 1304051 - DNA, 16 bp, Homo sapiens
ctgagcccctgtctag

SEQ ID NO: 1304052 - DNA, 22 bp, Homo sapiens
ctgagcccctgtctagagaggg

SEQ ID NO: 1304053 - DNA, 23 bp, Homo sapiens
ctgagcccctgtctagagaggga

SEQ ID NO: 1304054 - DNA, 14 bp, Homo sapiens
ctgagcctctgctc

SEQ ID NO: 1304055 - DNA, 15 bp, Homo sapiens
ctgagcctctgctcc

SEQ ID NO: 1304056 - DNA, 15 bp, Homo sapiens
ctgagcttctctgtg

SEQ ID NO: 1304057 - DNA, 12 bp, Homo sapiens
ctgaggcaagag

SEQ ID NO: 1304058 - DNA, 13 bp, Homo sapiens
ctgaggctggcac

SEQ ID NO: 1304059 - DNA, 18 bp, Homo sapiens
ctgaggctttggatttga

SEQ ID NO: 1304060 - DNA, 17 bp, Homo sapiens
ctgagtgaacctgtata

SEQ ID NO: 1304061 - DNA, 19 bp, Homo sapiens
ctgagtgcagccgtttgag

SEQ ID NO: 1304062 - DNA, 17 bp, Homo sapiens
ctgatcctggaggccca

SEQ ID NO: 1304063 - DNA, 14 bp, Homo sapiens
ctgcaaaggacaga

SEQ ID NO: 1304064 - DNA, 16 bp, Homo sapiens
ctgcaaaggacagatc

SEQ ID NO: 1304065 - DNA, 19 bp, Homo sapiens
ctgcaggacttgagaagac

SEQ ID NO: 1304066 - DNA, 19 bp, Homo sapiens
ctgcagtttgagacaggag

SEQ ID NO: 1304067 - DNA, 21 bp, Homo sapiens
ctgcatatgttgaatactttt

SEQ ID NO: 1304068 - DNA, 16 bp, Homo sapiens
ctgcatctgaccagca

SEQ ID NO: 1304069 - DNA, 17 bp, Homo sapiens
ctgcatctgaccagcag

SEQ ID NO: 1304070 - DNA, 18 bp, Homo sapiens
ctgcatctgaccagcagc

SEQ ID NO: 1304071 - DNA, 17 bp, Homo sapiens
ctgcatttcggtggcta

SEQ ID NO: 1304072 - DNA, 14 bp, Homo sapiens
ctgccacccacctc

SEQ ID NO: 1304073 - DNA, 15 bp, Homo sapiens
ctgccacccacctcc

SEQ ID NO: 1304074 - DNA, 17 bp, Homo sapiens
ctgccacccacctccct

SEQ ID NO: 1304075 - DNA, 22 bp, Homo sapiens
ctgccacccacctccctgcctc

SEQ ID NO: 1304076 - DNA, 11 bp, Homo sapiens
ctgccagctgc

SEQ ID NO: 1304077 - DNA, 13 bp, Homo sapiens
ctgccagctgcac

SEQ ID NO: 1304078 - DNA, 17 bp, Homo sapiens
ctgcccaacccttccct

SEQ ID NO: 1304079 - DNA, 20 bp, Homo sapiens
ctgcccaacccttccctcac

SEQ ID NO: 1304080 - DNA, 20 bp, Homo sapiens
ctgcccatggacaggctggc

SEQ ID NO: 1304081 - DNA, 18 bp, Homo sapiens
ctgccccatcctccagca

SEQ ID NO: 1304082 - DNA, 17 bp, Homo sapiens
ctgcccccaggactggg

SEQ ID NO: 1304083 - DNA, 22 bp, Homo sapiens
ctgccctccagctctttcctcc

SEQ ID NO: 1304084 - DNA, 14 bp, Homo sapiens
ctgccgcagagctg

SEQ ID NO: 1304085 - DNA, 12 bp, Homo sapiens
ctgcctcaggac

SEQ ID NO: 1304086 - DNA, 14 bp, Homo sapiens
ctgcctcaggactg

SEQ ID NO: 1304087 - DNA, 13 bp, Homo sapiens
ctgcctccaggaa

SEQ ID NO: 1304088 - DNA, 18 bp, Homo sapiens
ctgcctccagggctggac

SEQ ID NO: 1304089 - DNA, 20 bp, Homo sapiens
ctgcctccagggctggactg

SEQ ID NO: 1304090 - DNA, 18 bp, Homo sapiens
ctgcctcgaaacacagaa

SEQ ID NO: 1304091 - DNA, 15 bp, Homo sapiens
ctgcctgccagctgc

SEQ ID NO: 1304092 - DNA, 14 bp, Homo sapiens
ctgccttggctcag

SEQ ID NO: 1304093 - DNA, 15 bp, Homo sapiens
ctgccttggctcaga

SEQ ID NO: 1304094 - DNA, 17 bp, Homo sapiens
ctgccttggctcagaca

SEQ ID NO: 1304095 - DNA, 14 bp, Homo sapiens
ctgctatagcctgg

SEQ ID NO: 1304096 - DNA, 14 bp, Homo sapiens
ctgctcagctctgg

SEQ ID NO: 1304097 - DNA, 22 bp, Homo sapiens
ctgctcagctctgggccattct

SEQ ID NO: 1304098 - DNA, 16 bp, Homo sapiens
ctgctccccaggggag

SEQ ID NO: 1304099 - DNA, 14 bp, Homo sapiens
ctgctcctagaggg

SEQ ID NO: 1304100 - DNA, 15 bp, Homo sapiens
ctgctcctagaggga

SEQ ID NO: 1304101 - DNA, 21 bp, Homo sapiens
ctgctcctagagggaggggcc

SEQ ID NO: 1304102 - DNA, 13 bp, Homo sapiens
ctgctctccttcc

SEQ ID NO: 1304103 - DNA, 15 bp, Homo sapiens
ctgctctccttcctg

SEQ ID NO: 1304104 - DNA, 14 bp, Homo sapiens
ctgctgctgctgtg

SEQ ID NO: 1304105 - DNA, 15 bp, Homo sapiens
ctgctggacagtatc

SEQ ID NO: 1304106 - DNA, 20 bp, Homo sapiens
ctgctggacagtatcactgt

SEQ ID NO: 1304107 - DNA, 21 bp, Homo sapiens
ctgctggagtttcatgtacaa

SEQ ID NO: 1304108 - DNA, 20 bp, Homo sapiens
ctgcttagaatccaaacttg

SEQ ID NO: 1304109 - DNA, 20 bp, Homo sapiens
ctgctttgggaagccgtgct

SEQ ID NO: 1304110 - DNA, 16 bp, Homo sapiens
ctggaacccagactca

SEQ ID NO: 1304111 - DNA, 19 bp, Homo sapiens
ctggaacccagactcagac

SEQ ID NO: 1304112 - DNA, 22 bp, Homo sapiens
ctggaacccagactcagacatt

SEQ ID NO: 1304113 - DNA, 20 bp, Homo sapiens
ctactgtgtgtgtgaatgaa

SEQ ID NO: 1304114 - DNA, 20 bp, Homo sapiens
ctagaaattgacacaagtgg

SEQ ID NO: 1304115 - DNA, 21 bp, Homo sapiens
ctagagagggaggcaagccct

SEQ ID NO: 1304116 - DNA, 16 bp, Homo sapiens
ctagagggaggggcct

SEQ ID NO: 1304117 - DNA, 16 bp, Homo sapiens
ctagatggcagtcact

SEQ ID NO: 1304118 - DNA, 15 bp, Homo sapiens
ctagatggctcctct

SEQ ID NO: 1304119 - DNA, 13 bp, Homo sapiens
ctagatggtgctg

SEQ ID NO: 1304120 - DNA, 15 bp, Homo sapiens
ctagatggtgctgag

SEQ ID NO: 1304121 - DNA, 20 bp, Homo sapiens
ctagcagcaccgttctgtgc

SEQ ID NO: 1304122 - DNA, 19 bp, Homo sapiens
ctagctctatgtttacaaa

SEQ ID NO: 1304123 - DNA, 20 bp, Homo sapiens
ctagctgggggtgggccagg

SEQ ID NO: 1304124 - DNA, 13 bp, Homo sapiens
ctaggcctcagcc

SEQ ID NO: 1304125 - DNA, 15 bp, Homo sapiens
ctaggcctcagccag

SEQ ID NO: 1304126 - DNA, 16 bp, Homo sapiens
ctaggcctcagccaga

SEQ ID NO: 1304127 - DNA, 23 bp, Homo sapiens
ctagggggagccccttctgctca

SEQ ID NO: 1304128 - DNA, 15 bp, Homo sapiens
ctagtcaagctcctc

SEQ ID NO: 1304129 - DNA, 22 bp, Homo sapiens
ctatatttgggcctgctccaga

SEQ ID NO: 1304130 - DNA, 21 bp, Homo sapiens
ctatgcatggtgccccaggac

SEQ ID NO: 1304131 - DNA, 19 bp, Homo sapiens
ctattaaggtgatatattt

SEQ ID NO: 1304132 - DNA, 23 bp, Homo sapiens
ctattaaggtgatatatttaaaa

SEQ ID NO: 1304133 - DNA, 21 bp, Homo sapiens
ctattctctccaaaaatgcac

SEQ ID NO: 1304134 - DNA, 14 bp, Homo sapiens
ctatttatttactg

SEQ ID NO: 1304135 - DNA, 15 bp, Homo sapiens
ctcaaatggggccag

SEQ ID NO: 1304136 - DNA, 19 bp, Homo sapiens
ctcaaatggggccagatcc

SEQ ID NO: 1304137 - DNA, 20 bp, Homo sapiens
ctcaaatggggccagatcca

SEQ ID NO: 1304138 - DNA, 22 bp, Homo sapiens
ctcaacccccatttctatttat

SEQ ID NO: 1304139 - DNA, 15 bp, Homo sapiens
ctcaacgtattgttt

SEQ ID NO: 1304140 - DNA, 21 bp, Homo sapiens
ctcaagaaataaaaggaagcc

SEQ ID NO: 1304141 - DNA, 20 bp, Homo sapiens
ctcacactgagaatgtaaga

SEQ ID NO: 1304142 - DNA, 17 bp, Homo sapiens
ctcaccttggcaccaga

SEQ ID NO: 1304143 - DNA, 17 bp, Homo sapiens
ctcagaggcgcactgtg

SEQ ID NO: 1304144 - DNA, 18 bp, Homo sapiens
ctcagaggcgcactgtga

SEQ ID NO: 1304145 - DNA, 20 bp, Homo sapiens
ctcagcagctggtaatcttg

SEQ ID NO: 1304146 - DNA, 11 bp, Homo sapiens
ctcagccagca

SEQ ID NO: 1304147 - DNA, 13 bp, Homo sapiens
ctcagccagcact

SEQ ID NO: 1304148 - DNA, 14 bp, Homo sapiens
ctcagccctgaccc

SEQ ID NO: 1304149 - DNA, 13 bp, Homo sapiens
ctcagcctggcca

SEQ ID NO: 1304150 - DNA, 23 bp, Homo sapiens
ctcagctctgggccattctccac

SEQ ID NO: 1304151 - DNA, 16 bp, Homo sapiens
ctcagcttctcctgtg

SEQ ID NO: 1304152 - DNA, 13 bp, Homo sapiens
ctcaggaagaaca

SEQ ID NO: 1304153 - DNA, 14 bp, Homo sapiens
ctcaggaagaacac

SEQ ID NO: 1304154 - DNA, 16 bp, Homo sapiens
ctcaggacagatgcca

SEQ ID NO: 1304155 - DNA, 18 bp, Homo sapiens
ctcaggacagatgccaca

SEQ ID NO: 1304156 - DNA, 16 bp, Homo sapiens
ctcaggaggcaggacc

SEQ ID NO: 1304157 - DNA, 18 bp, Homo sapiens
ctcaggaggcaggacctt

SEQ ID NO: 1304158 - DNA, 13 bp, Homo sapiens
ctcaggatctctt

SEQ ID NO: 1304159 - DNA, 10 bp, Homo sapiens
ctcagggcag

SEQ ID NO: 1304160 - DNA, 19 bp, Homo sapiens
ctcaggtggccatgcctca

SEQ ID NO: 1304161 - DNA, 12 bp, Homo sapiens
ctcagtactttg

SEQ ID NO: 1304162 - DNA, 21 bp, Homo sapiens
ctcagtactttggaggcccct

SEQ ID NO: 1304163 - DNA, 17 bp, Homo sapiens
ctcataaaaagcaaaac

SEQ ID NO: 1304164 - DNA, 20 bp, Homo sapiens
ctcatctctaacagctcagg

SEQ ID NO: 1304165 - DNA, 22 bp, Homo sapiens
ctcatctcttagctcccctcca

SEQ ID NO: 1304166 - DNA, 14 bp, Homo sapiens
ctcatgcccctggc

SEQ ID NO: 1304167 - DNA, 16 bp, Homo sapiens
ctcattgctgagcctc

SEQ ID NO: 1304168 - DNA, 18 bp, Homo sapiens
ctcattgctgagcctctg

SEQ ID NO: 1304169 - DNA, 20 bp, Homo sapiens
ctcattgctgagcctctgct

SEQ ID NO: 1304170 - DNA, 22 bp, Homo sapiens
ctcatttcacccctccctttct

SEQ ID NO: 1304171 - DNA, 15 bp, Homo sapiens
ctccaacaccaagca

SEQ ID NO: 1304172 - DNA, 23 bp, Homo sapiens
ctccaacaccaagcacagcagcc

SEQ ID NO: 1304173 - DNA, 18 bp, Homo sapiens
ctccaaccccccagcact

SEQ ID NO: 1304174 - DNA, 23 bp, Homo sapiens
ctccaaccccccagcactgagga

SEQ ID NO: 1304175 - DNA, 20 bp, Homo sapiens
ctccaaggggaatcagaact

SEQ ID NO: 1304176 - DNA, 16 bp, Homo sapiens
ctccacagcaacccca

SEQ ID NO: 1304177 - DNA, 15 bp, Homo sapiens
ctccaccaggaacct

SEQ ID NO: 1304178 - DNA, 15 bp, Homo sapiens
ctccactctccccca

SEQ ID NO: 1304179 - DNA, 17 bp, Homo sapiens
ctccagatgtttccaga

SEQ ID NO: 1304180 - DNA, 19 bp, Homo sapiens
ctccagatgtttccagact

SEQ ID NO: 1304181 - DNA, 13 bp, Homo sapiens
ctccagggctgga

SEQ ID NO: 1304182 - DNA, 18 bp, Homo sapiens
ctccagggctggactgag

SEQ ID NO: 1304183 - DNA, 22 bp, Homo sapiens
ctcccaaagtgctgggattaca

SEQ ID NO: 1304184 - DNA, 15 bp, Homo sapiens
ctcccaaatgagcca

SEQ ID NO: 1304185 - DNA, 21 bp, Homo sapiens
ctcccaatttcagactcccat

SEQ ID NO: 1304186 - DNA, 17 bp, Homo sapiens
ctcccattcctgaagaa

SEQ ID NO: 1304187 - DNA, 17 bp, Homo sapiens
ctcccattgtccctctg

SEQ ID NO: 1304188 - DNA, 19 bp, Homo sapiens
ctcccattgtccctctgcc

SEQ ID NO: 1304189 - DNA, 13 bp, Homo sapiens
ctccccagcccag

SEQ ID NO: 1304190 - DNA, 16 bp, Homo sapiens
ctccccagcccagaga

SEQ ID NO: 1304191 - DNA, 21 bp, Homo sapiens
ctcccccccatgcactgtgaa

SEQ ID NO: 1304192 - DNA, 16 bp, Homo sapiens
ctcccctgcccccagg

SEQ ID NO: 1304193 - DNA, 22 bp, Homo sapiens
ctcccctgcccccaggactggg

SEQ ID NO: 1304194 - DNA, 14 bp, Homo sapiens
ctccctctatttat

SEQ ID NO: 1304195 - DNA, 18 bp, Homo sapiens
ctccctgaagcctttgca

SEQ ID NO: 1304196 - DNA, 23 bp, Homo sapiens
ctccctgaccctgtatatagccc

SEQ ID NO: 1304197 - DNA, 15 bp, Homo sapiens
ctccctgcctccagg

SEQ ID NO: 1304198 - DNA, 16 bp, Homo sapiens
ctccctgcctccagga

SEQ ID NO: 1304199 - DNA, 16 bp, Homo sapiens
ctccctgttccccaga

SEQ ID NO: 1304200 - DNA, 18 bp, Homo sapiens
ctccctgttccccagaga

SEQ ID NO: 1304201 - DNA, 19 bp, Homo sapiens
ctccctgttccccagagaa

SEQ ID NO: 1304202 - DNA, 15 bp, Homo sapiens
ctccctttctcccct

SEQ ID NO: 1304203 - DNA, 19 bp, Homo sapiens
ctcctagagggaggggcct

SEQ ID NO: 1304204 - DNA, 17 bp, Homo sapiens
ctcctccactctccccc

SEQ ID NO: 1304205 - DNA, 16 bp, Homo sapiens
ctcctccctgcatctg

SEQ ID NO: 1304206 - DNA, 15 bp, Homo sapiens
ctcctcctccctgca

SEQ ID NO: 1304207 - DNA, 14 bp, Homo sapiens
ctcctctccccagc

SEQ ID NO: 1304208 - DNA, 15 bp, Homo sapiens
ctcctctccccagcc

SEQ ID NO: 1304209 - DNA, 17 bp, Homo sapiens
ctcctctccccagccca

SEQ ID NO: 1304210 - DNA, 18 bp, Homo sapiens
ctcctctccccagcccag

SEQ ID NO: 1304211 - DNA, 19 bp, Homo sapiens
ctcctctccccagcccaga

SEQ ID NO: 1304212 - DNA, 23 bp, Homo sapiens
ctcctctccccagcccagagaca

SEQ ID NO: 1304213 - DNA, 20 bp, Homo sapiens
ctcctcttgtaaataaagcc

SEQ ID NO: 1304214 - DNA, 21 bp, Homo sapiens
ctcctcttgtaaataaagccc

SEQ ID NO: 1304215 - DNA, 16 bp, Homo sapiens
ctcctgaggctttgga

SEQ ID NO: 1304216 - DNA, 14 bp, Homo sapiens
ctcctgccgcagag

SEQ ID NO: 1304217 - DNA, 14 bp, Homo sapiens
ctccttcagacacc

SEQ ID NO: 1304218 - DNA, 13 bp, Homo sapiens
ctccttcagccct

SEQ ID NO: 1304219 - DNA, 14 bp, Homo sapiens
ctccttcagccctc

SEQ ID NO: 1304220 - DNA, 20 bp, Homo sapiens
ctccttcagccctcacccct

SEQ ID NO: 1304221 - DNA, 13 bp, Homo sapiens
ctccttcctgtgt

SEQ ID NO: 1304222 - DNA, 15 bp, Homo sapiens
ctcgaaacacagaaa

SEQ ID NO: 1304223 - DNA, 14 bp, Homo sapiens
ctcgccccagcagg

SEQ ID NO: 1304224 - DNA, 17 bp, Homo sapiens
ctcggaggaagccccca

SEQ ID NO: 1304225 - DNA, 17 bp, Homo sapiens
ctcggagggattcccct

SEQ ID NO: 1304226 - DNA, 18 bp, Homo sapiens
ctctaaatgggaaagtat

SEQ ID NO: 1304227 - DNA, 18 bp, Homo sapiens
ctctaacagctcaggatc

SEQ ID NO: 1304228 - DNA, 23 bp, Homo sapiens
ctctagctgggggtgggccaggc

SEQ ID NO: 1304229 - DNA, 17 bp, Homo sapiens
ctctatttatgtttgca

SEQ ID NO: 1304230 - DNA, 15 bp, Homo sapiens
ctctccaaaaatgca

SEQ ID NO: 1304231 - DNA, 19 bp, Homo sapiens
ctctcccattgtccctctg

SEQ ID NO: 1304232 - DNA, 11 bp, Homo sapiens
aaaaaattggt

SEQ ID NO: 1304233 - DNA, 21 bp, Homo sapiens
aaaaataaatttggttctaat

SEQ ID NO: 1304234 - DNA, 22 bp, Homo sapiens
aaaacaactatggatcagaata

SEQ ID NO: 1304235 - DNA, 13 bp, Homo sapiens
aaaacatctattc

SEQ ID NO: 1304236 - DNA, 12 bp, Homo sapiens
aaaagagggggg

SEQ ID NO: 1304237 - DNA, 18 bp, Homo sapiens
aaaaggaagccaaagagt

SEQ ID NO: 1304238 - DNA, 19 bp, Homo sapiens
aaaataaccggatatatac

SEQ ID NO: 1304239 - DNA, 23 bp, Homo sapiens
aaaatgatgtgtacccaaacgtg

SEQ ID NO: 1304240 - DNA, 22 bp, Homo sapiens
aaaatgctttttatttctgcat

SEQ ID NO: 1304241 - DNA, 16 bp, Homo sapiens
aaaattggttggagaa

SEQ ID NO: 1304242 - DNA, 21 bp, Homo sapiens
aaacaaaaattaggtattttg

SEQ ID NO: 1304243 - DNA, 21 bp, Homo sapiens
aaacaggcagttggccagaga

SEQ ID NO: 1304244 - DNA, 17 bp, Homo sapiens
aaacatccaatattttc

SEQ ID NO: 1304245 - DNA, 15 bp, Homo sapiens
aaacccaatccaaat

SEQ ID NO: 1304246 - DNA, 24 bp, Homo sapiens
aaactcatttataaagctaaaata

SEQ ID NO: 1304247 - DNA, 20 bp, Homo sapiens
aaactctgttgcaagtgcaa

SEQ ID NO: 1304248 - DNA, 13 bp, Homo sapiens
aaactggctttgg

SEQ ID NO: 1304249 - DNA, 14 bp, Homo sapiens
aaactggctttggc

SEQ ID NO: 1304250 - DNA, 22 bp, Homo sapiens
aaactggtattttatctttgat

SEQ ID NO: 1304251 - DNA, 20 bp, Homo sapiens
aaagaagcccaatattataa

SEQ ID NO: 1304252 - DNA, 13 bp, Homo sapiens
aaagagtagaatt

SEQ ID NO: 1304253 - DNA, 19 bp, Homo sapiens
aaagatctgtcctcagcct

SEQ ID NO: 1304254 - DNA, 20 bp, Homo sapiens
aaagatctgtcctcagcctt

SEQ ID NO: 1304255 - DNA, 21 bp, Homo sapiens
aaagatctgtcctcagccttg

SEQ ID NO: 1304256 - DNA, 18 bp, Homo sapiens
aaagattttaatcaagtt

SEQ ID NO: 1304257 - DNA, 18 bp, Homo sapiens
aaagcccaagggatctgg

SEQ ID NO: 1304258 - DNA, 12 bp, Homo sapiens
aaaggaagccaa

SEQ ID NO: 1304259 - DNA, 14 bp, Homo sapiens
aaaggaagccaaag

SEQ ID NO: 1304260 - DNA, 19 bp, Homo sapiens
aaagtgtgctttatgctga

SEQ ID NO: 1304261 - DNA, 23 bp, Homo sapiens
aaagtgtgctttatgctgaaaca

SEQ ID NO: 1304262 - DNA, 15 bp, Homo sapiens
aaagtttgcttagaa

SEQ ID NO: 1304263 - DNA, 17 bp, Homo sapiens
aaataaaaggaagccaa

SEQ ID NO: 1304264 - DNA, 14 bp, Homo sapiens
aaataagaatagaa

SEQ ID NO: 1304265 - DNA, 13 bp, Homo sapiens
aaataatgtctct

SEQ ID NO: 1304266 - DNA, 20 bp, Homo sapiens
aaatatggacacttaatact

SEQ ID NO: 1304267 - DNA, 23 bp, Homo sapiens
aaatcggatctggggctctggga

SEQ ID NO: 1304268 - DNA, 20 bp, Homo sapiens
aaatctgctggagtttcatg

SEQ ID NO: 1304269 - DNA, 22 bp, Homo sapiens
aaatctgctggagtttcatgta

SEQ ID NO: 1304270 - DNA, 11 bp, Homo sapiens
aaatcttttac

SEQ ID NO: 1304271 - DNA, 20 bp, Homo sapiens
aaatgcatgattttgtaacc

SEQ ID NO: 1304272 - DNA, 18 bp, Homo sapiens
aaatgctttttatttctg

SEQ ID NO: 1304273 - DNA, 17 bp, Homo sapiens
actcagatccagggaca

SEQ ID NO: 1304274 - DNA, 24 bp, Homo sapiens
agaggccctctggagtggccacta

SEQ ID NO: 1304275 - DNA, 13 bp, Homo sapiens
aataagaatagaa

SEQ ID NO: 1304276 - DNA, 19 bp, Homo sapiens
aataatcttattagggaga

SEQ ID NO: 1304277 - DNA, 12 bp, Homo sapiens
aataatgtctct

SEQ ID NO: 1304278 - DNA, 13 bp, Homo sapiens
aataatgtctctg

SEQ ID NO: 1304279 - DNA, 21 bp, Homo sapiens
aataattgcagaactaaactc

SEQ ID NO: 1304280 - DNA, 12 bp, Homo sapiens
aatacaaaactt

SEQ ID NO: 1304281 - DNA, 20 bp, Homo sapiens
aatagtctagatggctcctc

SEQ ID NO: 1304282 - DNA, 22 bp, Homo sapiens
aatagttaagacatgatttcct

SEQ ID NO: 1304283 - DNA, 16 bp, Homo sapiens
aatatttataaaactt

SEQ ID NO: 1304284 - DNA, 17 bp, Homo sapiens
aatatttattacctctg

SEQ ID NO: 1304285 - DNA, 20 bp, Homo sapiens
aatatttattattttcacct

SEQ ID NO: 1304286 - DNA, 13 bp, Homo sapiens
acatctaagcctg

SEQ ID NO: 1304287 - DNA, 14 bp, Homo sapiens
acatctattctctc

SEQ ID NO: 1304288 - DNA, 23 bp, Homo sapiens
acatctattttggattgtatatt

SEQ ID NO: 1304289 - DNA, 15 bp, Homo sapiens
acatctctgcttgag

SEQ ID NO: 1304290 - DNA, 24 bp, Homo sapiens
acatcttttcttgcctctgtcccc

SEQ ID NO: 1304291 - DNA, 15 bp, Homo sapiens
acatgagaacaaaca

SEQ ID NO: 1304292 - DNA, 15 bp, Homo sapiens
acatgattccttcct

SEQ ID NO: 1304293 - DNA, 13 bp, Homo sapiens
acatgatttcctt

SEQ ID NO: 1304294 - DNA, 23 bp, Homo sapiens
acatgatttccttgaatgtggct

SEQ ID NO: 1304295 - DNA, 22 bp, Homo sapiens
acatgcggtagccagcacacag

SEQ ID NO: 1304296 - DNA, 23 bp, Homo sapiens
acatgcggtagccagcacacagg

SEQ ID NO: 1304297 - DNA, 22 bp, Homo sapiens
acatgtgccagggcaatgatga

SEQ ID NO: 1304298 - DNA, 15 bp, Homo sapiens
acattgcgtttgacc

SEQ ID NO: 1304299 - DNA, 23 bp, Homo sapiens
acattgcgtttgaccttttatgt

SEQ ID NO: 1304300 - DNA, 16 bp, Homo sapiens
acattgttcaattaga

SEQ ID NO: 1304301 - DNA, 14 bp, Homo sapiens
acattgttgagcta

SEQ ID NO: 1304302 - DNA, 17 bp, Homo sapiens
acattttggtgagaaat

SEQ ID NO: 1304303 - DNA, 14 bp, Homo sapiens
accaagcacagcag

SEQ ID NO: 1304304 - DNA, 16 bp, Homo sapiens
accaagcacagcagcc

SEQ ID NO: 1304305 - DNA, 17 bp, Homo sapiens
accaagcacagcagcct

SEQ ID NO: 1304306 - DNA, 15 bp, Homo sapiens
accagcattcctttt

SEQ ID NO: 1304307 - DNA, 21 bp, Homo sapiens
accatagtaccatttatacaa

SEQ ID NO: 1304308 - DNA, 13 bp, Homo sapiens
accatttatacaa

SEQ ID NO: 1304309 - DNA, 21 bp, Homo sapiens
accatttatacaaattagaaa

SEQ ID NO: 1304310 - DNA, 19 bp, Homo sapiens
acccaactagctctatgtt

SEQ ID NO: 1304311 - DNA, 13 bp, Homo sapiens
acccacctccctg

SEQ ID NO: 1304312 - DNA, 14 bp, Homo sapiens
acccacctccctgc

SEQ ID NO: 1304313 - DNA, 18 bp, Homo sapiens
acccacctccctgcctcc

SEQ ID NO: 1304314 - DNA, 22 bp, Homo sapiens
acccagacctgttagcagacag

SEQ ID NO: 1304315 - DNA, 17 bp, Homo sapiens
acccagccccttgagaa

SEQ ID NO: 1304316 - DNA, 21 bp, Homo sapiens
acccagccccttgagaaacct

SEQ ID NO: 1304317 - DNA, 20 bp, Homo sapiens
acccatgagttggggtctgg

SEQ ID NO: 1304318 - DNA, 20 bp, Homo sapiens
accccaggctgaagcaggtt

SEQ ID NO: 1304319 - DNA, 12 bp, Homo sapiens
accccctccttc

SEQ ID NO: 1304320 - DNA, 21 bp, Homo sapiens
accccggggtgcccacaggcc

SEQ ID NO: 1304321 - DNA, 13 bp, Homo sapiens
acccctccctttc

SEQ ID NO: 1304322 - DNA, 18 bp, Homo sapiens
acccctccctttctcccc

SEQ ID NO: 1304323 - DNA, 17 bp, Homo sapiens
acccctgggggctctca

SEQ ID NO: 1304324 - DNA, 15 bp, Homo sapiens
acccctggttctcat

SEQ ID NO: 1304325 - DNA, 21 bp, Homo sapiens
accctcaacctcttctggctc

SEQ ID NO: 1304326 - DNA, 21 bp, Homo sapiens
accctggccgagtccaagctg

SEQ ID NO: 1304327 - DNA, 18 bp, Homo sapiens
accctggtggttgctgtt

SEQ ID NO: 1304328 - DNA, 15 bp, Homo sapiens
accctgtatatagcc

SEQ ID NO: 1304329 - DNA, 17 bp, Homo sapiens
acccttctcctcttgta

SEQ ID NO: 1304330 - DNA, 23 bp, Homo sapiens
acccttctcctcttgtaaataaa

SEQ ID NO: 1304331 - DNA, 16 bp, Homo sapiens
accgcgactaatttca

SEQ ID NO: 1304332 - DNA, 16 bp, Homo sapiens
accgtgggcagggagc

SEQ ID NO: 1304333 - DNA, 14 bp, Homo sapiens
accgttctgtgcac

SEQ ID NO: 1304334 - DNA, 20 bp, Homo sapiens
acctaatccaggcagatcca

SEQ ID NO: 1304335 - DNA, 21 bp, Homo sapiens
acctaatccaggcagatccag

SEQ ID NO: 1304336 - DNA, 22 bp, Homo sapiens
acctaatccaggcagatccagg

SEQ ID NO: 1304337 - DNA, 12 bp, Homo sapiens
acctatttccat

SEQ ID NO: 1304338 - DNA, 14 bp, Homo sapiens
acctcacctagaaa

SEQ ID NO: 1304339 - DNA, 15 bp, Homo sapiens
acctcagcctggcca

SEQ ID NO: 1304340 - DNA, 17 bp, Homo sapiens
acctcagcctggccaga

SEQ ID NO: 1304341 - DNA, 21 bp, Homo sapiens
acctcagcctggccagacaca

SEQ ID NO: 1304342 - DNA, 22 bp, Homo sapiens
acctctcttatagaatatttat

SEQ ID NO: 1304343 - DNA, 16 bp, Homo sapiens
acctcttctggctcaa

SEQ ID NO: 1304344 - DNA, 21 bp, Homo sapiens
acctgcctcggcctcccaaag

SEQ ID NO: 1304345 - DNA, 23 bp, Homo sapiens
acctgcctcggcctcccaaagtg

SEQ ID NO: 1304346 - DNA, 17 bp, Homo sapiens
acctggcagctctggac

SEQ ID NO: 1304347 - DNA, 18 bp, Homo sapiens
acctgggattcaggaatg

SEQ ID NO: 1304348 - DNA, 15 bp, Homo sapiens
acctgtaatcccagc

SEQ ID NO: 1304349 - DNA, 19 bp, Homo sapiens
acctgtaatcccagctact

SEQ ID NO: 1304350 - DNA, 17 bp, Homo sapiens
acctgtgagcccagctg

SEQ ID NO: 1304351 - DNA, 19 bp, Homo sapiens
acctgtttttaagctgttt

SEQ ID NO: 1304352 - DNA, 20 bp, Homo sapiens
accttattgtacctctctta

SEQ ID NO: 1304353 - DNA, 19 bp, Homo sapiens
accttcccaaacgcctccc

SEQ ID NO: 1304354 - DNA, 15 bp, Homo sapiens
accttcgggctgtgc

SEQ ID NO: 1304355 - DNA, 17 bp, Homo sapiens
accttcgggctgtgccc

SEQ ID NO: 1304356 - DNA, 18 bp, Homo sapiens
accttcgggctgtgcccg

SEQ ID NO: 1304357 - DNA, 20 bp, Homo sapiens
accttgaaaataagaataga

SEQ ID NO: 1304358 - DNA, 14 bp, Homo sapiens
accttggcaccaga

SEQ ID NO: 1304359 - DNA, 16 bp, Homo sapiens
accttggcaccagaca

SEQ ID NO: 1304360 - DNA, 22 bp, Homo sapiens
accttggcaccagacacccagg

SEQ ID NO: 1304361 - DNA, 20 bp, Homo sapiens
accttttattgacacagaaa

SEQ ID NO: 1304362 - DNA, 19 bp, Homo sapiens
accttttgggaatgtttta

SEQ ID NO: 1304363 - DNA, 18 bp, Homo sapiens
acgatttagaaagaagcc

SEQ ID NO: 1304364 - DNA, 14 bp, Homo sapiens
acgcacctgcctca

SEQ ID NO: 1304365 - DNA, 14 bp, Homo sapiens
acgcccccccccac

SEQ ID NO: 1304366 - DNA, 23 bp, Homo sapiens
acgcccccccccacccctggggg

SEQ ID NO: 1304367 - DNA, 17 bp, Homo sapiens
acgctttctagctgttg

SEQ ID NO: 1304368 - DNA, 16 bp, Homo sapiens
acgctttgattcatag

SEQ ID NO: 1304369 - DNA, 15 bp, Homo sapiens
acggagcccagccct

SEQ ID NO: 1304370 - DNA, 18 bp, Homo sapiens
acggccacatcaaagagg

SEQ ID NO: 1304371 - DNA, 18 bp, Homo sapiens
acggccagggagaagctc

SEQ ID NO: 1304372 - DNA, 18 bp, Homo sapiens
acggctcgatttctccag

SEQ ID NO: 1304373 - DNA, 16 bp, Homo sapiens
acgtagctgcaaagga

SEQ ID NO: 1304374 - DNA, 14 bp, Homo sapiens
acgtggctcagcca

SEQ ID NO: 1304375 - DNA, 19 bp, Homo sapiens
acgtggctcagccagcact

SEQ ID NO: 1304376 - DNA, 21 bp, Homo sapiens
actaaggggcccggccagcca

SEQ ID NO: 1304377 - DNA, 13 bp, Homo sapiens
actaattccacac

SEQ ID NO: 1304378 - DNA, 15 bp, Homo sapiens
actaattccacacct

SEQ ID NO: 1304379 - DNA, 19 bp, Homo sapiens
actaatttcaaaatgcttt

SEQ ID NO: 1304380 - DNA, 20 bp, Homo sapiens
actaatttcaaaatgctttt

SEQ ID NO: 1304381 - DNA, 18 bp, Homo sapiens
actacaaacaaaatttct

SEQ ID NO: 1304382 - DNA, 20 bp, Homo sapiens
actacaaacaaaatttctat

SEQ ID NO: 1304383 - DNA, 20 bp, Homo sapiens
actacatgagaacaaacaga

SEQ ID NO: 1304384 - DNA, 17 bp, Homo sapiens
actaccttgaaaataag

SEQ ID NO: 1304385 - DNA, 18 bp, Homo sapiens
actaggaaatccattcac

SEQ ID NO: 1304386 - DNA, 14 bp, Homo sapiens
actaggtaacttca

SEQ ID NO: 1304387 - DNA, 18 bp, Homo sapiens
actaggtaacttcatatt

SEQ ID NO: 1304388 - DNA, 22 bp, Homo sapiens
actatatttgggcctgctccag

SEQ ID NO: 1304389 - DNA, 19 bp, Homo sapiens
actatctactctcctcatc

SEQ ID NO: 1304390 - DNA, 20 bp, Homo sapiens
actatgcatggtgccccagg

SEQ ID NO: 1304391 - DNA, 22 bp, Homo sapiens
actatgcatggtgccccaggac

SEQ ID NO: 1304392 - DNA, 23 bp, Homo sapiens
actatgcatggtgccccaggacc

SEQ ID NO: 1304393 - DNA, 15 bp, Homo sapiens
actatggtatttgag

SEQ ID NO: 1304394 - DNA, 20 bp, Homo sapiens
actcaaagtttcagagacca

SEQ ID NO: 1304395 - DNA, 22 bp, Homo sapiens
actcactggggcctacagcttt

SEQ ID NO: 1304396 - DNA, 12 bp, Homo sapiens
actcagatccag

SEQ ID NO: 1304397 - DNA, 14 bp, Homo sapiens
actcagatccaggg

SEQ ID NO: 1304398 - DNA, 17 bp, Homo sapiens
gccagatccagcctggg

SEQ ID NO: 1304399 - DNA, 17 bp, Homo sapiens
gccagcacacagggcag

SEQ ID NO: 1304400 - DNA, 20 bp, Homo sapiens
gccagcacttgtccagctga

SEQ ID NO: 1304401 - DNA, 13 bp, Homo sapiens
gccagccatgtct

SEQ ID NO: 1304402 - DNA, 20 bp, Homo sapiens
gccagcccctggccccagga

SEQ ID NO: 1304403 - DNA, 14 bp, Homo sapiens
gccaggccccaggc

SEQ ID NO: 1304404 - DNA, 15 bp, Homo sapiens
gccaggctgaccaca

SEQ ID NO: 1304405 - DNA, 16 bp, Homo sapiens
gccaggctgaccacag

SEQ ID NO: 1304406 - DNA, 18 bp, Homo sapiens
gccaggctgaccacagca

SEQ ID NO: 1304407 - DNA, 20 bp, Homo sapiens
gccagggcaatgatgaatga

SEQ ID NO: 1304408 - DNA, 19 bp, Homo sapiens
gccaggggggtgaggagct

SEQ ID NO: 1304409 - DNA, 20 bp, Homo sapiens
gccaggggggtgaggagctg

SEQ ID NO: 1304410 - DNA, 18 bp, Homo sapiens
gccatcaaaatgcttttt

SEQ ID NO: 1304411 - DNA, 19 bp, Homo sapiens
gccatcaaaatgcttttta

SEQ ID NO: 1304412 - DNA, 21 bp, Homo sapiens
gccatctgggctcctccaggg

SEQ ID NO: 1304413 - DNA, 23 bp, Homo sapiens
gccatgagatgatacatccaaag

SEQ ID NO: 1304414 - DNA, 21 bp, Homo sapiens
gccatgatggcaacagatctg

SEQ ID NO: 1304415 - DNA, 18 bp, Homo sapiens
gcccaagggatctggtcc

SEQ ID NO: 1304416 - DNA, 15 bp, Homo sapiens
gcccactgtcctggg

SEQ ID NO: 1304417 - DNA, 17 bp, Homo sapiens
gcccactgtcctgggcc

SEQ ID NO: 1304418 - DNA, 21 bp, Homo sapiens
gcccactgtcctgggcctgca

SEQ ID NO: 1304419 - DNA, 10 bp, Homo sapiens
gcccagagac

SEQ ID NO: 1304420 - DNA, 20 bp, Homo sapiens
gcccagagacatacttgaag

SEQ ID NO: 1304421 - DNA, 13 bp, Homo sapiens
gcccagagcccag

SEQ ID NO: 1304422 - DNA, 17 bp, Homo sapiens
gcccagagcccagctcc

SEQ ID NO: 1304423 - DNA, 17 bp, Homo sapiens
gcccagccaggccccag

SEQ ID NO: 1304424 - DNA, 14 bp, Homo sapiens
gcccagctgggtca

SEQ ID NO: 1304425 - DNA, 18 bp, Homo sapiens
gcccagctgggtcaggca

SEQ ID NO: 1304426 - DNA, 18 bp, Homo sapiens
gcccaggaccatcatcct

SEQ ID NO: 1304427 - DNA, 19 bp, Homo sapiens
gcccagggcccagagccca

SEQ ID NO: 1304428 - DNA, 20 bp, Homo sapiens
gcccagggcccagagcccag

SEQ ID NO: 1304429 - DNA, 21 bp, Homo sapiens
gcccagggcccagagcccagc

SEQ ID NO: 1304430 - DNA, 19 bp, Homo sapiens
gcccatggacaggctggct

SEQ ID NO: 1304431 - DNA, 21 bp, Homo sapiens
gcccatggacaggctggctcc

SEQ ID NO: 1304432 - DNA, 18 bp, Homo sapiens
gccccaatccctttatta

SEQ ID NO: 1304433 - DNA, 16 bp, Homo sapiens
gccccagcctccctga

SEQ ID NO: 1304434 - DNA, 22 bp, Homo sapiens
gccccaggaaaggcccagccac

SEQ ID NO: 1304435 - DNA, 16 bp, Homo sapiens
gccccaggaccagctc

SEQ ID NO: 1304436 - DNA, 20 bp, Homo sapiens
gccccaggacctggctgcca

SEQ ID NO: 1304437 - DNA, 22 bp, Homo sapiens
gccccaggcagggccaaccctt

SEQ ID NO: 1304438 - DNA, 18 bp, Homo sapiens
gccccatcctccagcagg

SEQ ID NO: 1304439 - DNA, 22 bp, Homo sapiens
gccccattcttttgtaatttaa

SEQ ID NO: 1304440 - DNA, 23 bp, Homo sapiens
gccccattcttttgtaatttaaa

SEQ ID NO: 1304441 - DNA, 18 bp, Homo sapiens
gcccccaccgtgggcagg

SEQ ID NO: 1304442 - DNA, 15 bp, Homo sapiens
gcccccagctaagaa

SEQ ID NO: 1304443 - DNA, 21 bp, Homo sapiens
gcccccagctaagaacctgga

SEQ ID NO: 1304444 - DNA, 22 bp, Homo sapiens
gcccccagctaagaacctggaa

SEQ ID NO: 1304445 - DNA, 17 bp, Homo sapiens
gcccccaggactgggcc

SEQ ID NO: 1304446 - DNA, 13 bp, Homo sapiens
gcccccatctcat

SEQ ID NO: 1304447 - DNA, 13 bp, Homo sapiens
gcccctggcccca

SEQ ID NO: 1304448 - DNA, 14 bp, Homo sapiens
gcccctggccccag

SEQ ID NO: 1304449 - DNA, 14 bp, Homo sapiens
gcccctggctggga

SEQ ID NO: 1304450 - DNA, 16 bp, Homo sapiens
gcccctggctgggacg

SEQ ID NO: 1304451 - DNA, 19 bp, Homo sapiens
gcccctgtctagagaggga

SEQ ID NO: 1304452 - DNA, 15 bp, Homo sapiens
gccccttctgctcag

SEQ ID NO: 1304453 - DNA, 20 bp, Homo sapiens
gccccttctgctcagctctg

SEQ ID NO: 1304454 - DNA, 17 bp, Homo sapiens
ctcccctgacctgtgag

SEQ ID NO: 1304455 - DNA, 18 bp, Homo sapiens
ctcccctgcccccaggac

SEQ ID NO: 1304456 - DNA, 19 bp, Homo sapiens
ctcccctgcccccaggact

SEQ ID NO: 1304457 - DNA, 12 bp, Homo sapiens
ctccctgaccct

SEQ ID NO: 1304458 - DNA, 14 bp, Homo sapiens
ctccctgaccctgt

SEQ ID NO: 1304459 - DNA, 16 bp, Homo sapiens
ctccctgaccctgtat

SEQ ID NO: 1304460 - DNA, 23 bp, Homo sapiens
ctccctgcatctgaccagcagcg

SEQ ID NO: 1304461 - DNA, 14 bp, Homo sapiens
ctccctgcctccag

SEQ ID NO: 1304462 - DNA, 14 bp, Homo sapiens
ctcccttctgctac

SEQ ID NO: 1304463 - DNA, 16 bp, Homo sapiens
ctcccttctgctactg

SEQ ID NO: 1304464 - DNA, 23 bp, Homo sapiens
ctccctttctcccctgcccccag

SEQ ID NO: 1304465 - DNA, 23 bp, Homo sapiens
ctcctagagggaggggcctaggc

SEQ ID NO: 1304466 - DNA, 14 bp, Homo sapiens
ctcctcatctctaa

SEQ ID NO: 1304467 - DNA, 16 bp, Homo sapiens
ctcctccactctcccc

SEQ ID NO: 1304468 - DNA, 13 bp, Homo sapiens
ctcctccagggtg

SEQ ID NO: 1304469 - DNA, 23 bp, Homo sapiens
ctcctccctgcatctgaccagca

SEQ ID NO: 1304470 - DNA, 14 bp, Homo sapiens
ctcctcctccctgc

SEQ ID NO: 1304471 - DNA, 21 bp, Homo sapiens
ctcctctccccagcccagaga

SEQ ID NO: 1304472 - DNA, 12 bp, Homo sapiens
ctcctcttgtaa

SEQ ID NO: 1304473 - DNA, 17 bp, Homo sapiens
ctcctgccgcagagctg

SEQ ID NO: 1304474 - DNA, 13 bp, Homo sapiens
ctccttgttccta

SEQ ID NO: 1304475 - DNA, 19 bp, Homo sapiens
ctcgaaacacagaaacctt

SEQ ID NO: 1304476 - DNA, 20 bp, Homo sapiens
ctcgaaacacagaaaccttt

SEQ ID NO: 1304477 - DNA, 14 bp, Homo sapiens
ctcgatttctccag

SEQ ID NO: 1304478 - DNA, 21 bp, Homo sapiens
ctcggaactgcatgctgctgg

SEQ ID NO: 1304479 - DNA, 22 bp, Homo sapiens
ctcggaactgcatgctgctgga

SEQ ID NO: 1304480 - DNA, 20 bp, Homo sapiens
ctcggcctcccaaagtgctg

SEQ ID NO: 1304481 - DNA, 16 bp, Homo sapiens
ctctaacagctcagga

SEQ ID NO: 1304482 - DNA, 19 bp, Homo sapiens
ctctagccaaatggtttaa

SEQ ID NO: 1304483 - DNA, 20 bp, Homo sapiens
ctctagctgggggtgggcca

SEQ ID NO: 1304484 - DNA, 17 bp, Homo sapiens
ctctcatctcttagctc

SEQ ID NO: 1304485 - DNA, 18 bp, Homo sapiens
ctctcccattgtccctct

SEQ ID NO: 1304486 - DNA, 19 bp, Homo sapiens
ctctccccagcccagagac

SEQ ID NO: 1304487 - DNA, 17 bp, Homo sapiens
ctctcccctgacctgtg

SEQ ID NO: 1304488 - DNA, 13 bp, Homo sapiens
ctctccctgaccc

SEQ ID NO: 1304489 - DNA, 12 bp, Homo sapiens
ctctcctcatct

SEQ ID NO: 1304490 - DNA, 16 bp, Homo sapiens
ctctccttcctggagc

SEQ ID NO: 1304491 - DNA, 14 bp, Homo sapiens
ctctccttcctgtg

SEQ ID NO: 1304492 - DNA, 19 bp, Homo sapiens
ctctcggaactgcatgctg

SEQ ID NO: 1304493 - DNA, 21 bp, Homo sapiens
ctctcggaactgcatgctgct

SEQ ID NO: 1304494 - DNA, 17 bp, Homo sapiens
ctctctccagatgtttc

SEQ ID NO: 1304495 - DNA, 20 bp, Homo sapiens
ctctgcccaacccttccctc

SEQ ID NO: 1304496 - DNA, 19 bp, Homo sapiens
ctctgcttgacaacatctg

SEQ ID NO: 1304497 - DNA, 12 bp, Homo sapiens
ctctggagtggc

SEQ ID NO: 1304498 - DNA, 20 bp, Homo sapiens
ctctgggccattctccacag

SEQ ID NO: 1304499 - DNA, 20 bp, Homo sapiens
ctctgtcagtcacagccacc

SEQ ID NO: 1304500 - DNA, 13 bp, Homo sapiens
ctctgtgagactc

SEQ ID NO: 1304501 - DNA, 17 bp, Homo sapiens
ctctgtgagactcgaga

SEQ ID NO: 1304502 - DNA, 16 bp, Homo sapiens
ctctgtgccttctttt

SEQ ID NO: 1304503 - DNA, 17 bp, Homo sapiens
ctcttagctcccctcca

SEQ ID NO: 1304504 - DNA, 19 bp, Homo sapiens
ctcttagctcccctccaac

SEQ ID NO: 1304505 - DNA, 19 bp, Homo sapiens
ctcttaggaagagaaacca

SEQ ID NO: 1304506 - DNA, 16 bp, Homo sapiens
ctcttatagaatattt

SEQ ID NO: 1304507 - DNA, 21 bp, Homo sapiens
ctcttgattatccatattgag

SEQ ID NO: 1304508 - DNA, 14 bp, Homo sapiens
ctctttctgtatat

SEQ ID NO: 1304509 - DNA, 12 bp, Homo sapiens
ctctttgctttg

SEQ ID NO: 1304510 - DNA, 18 bp, Homo sapiens
ctctttgctttgctttct

SEQ ID NO: 1304511 - DNA, 14 bp, Homo sapiens
ctgaagaaccagtc

SEQ ID NO: 1304512 - DNA, 22 bp, Homo sapiens
ctgaagaaccagtccccccacc

SEQ ID NO: 1304513 - DNA, 19 bp, Homo sapiens
ctgaagcaggttcccaagc

SEQ ID NO: 1304514 - DNA, 21 bp, Homo sapiens
ctgaagcaggttcccaagctc

SEQ ID NO: 1304515 - DNA, 15 bp, Homo sapiens
ctgaaggggccatga

SEQ ID NO: 1304516 - DNA, 19 bp, Homo sapiens
ctgaaggggccatgatggc

SEQ ID NO: 1304517 - DNA, 16 bp, Homo sapiens
ctgacagctgctccta

SEQ ID NO: 1304518 - DNA, 19 bp, Homo sapiens
ctgacagctgctcctagag

SEQ ID NO: 1304519 - DNA, 16 bp, Homo sapiens
ctgacatctggaatct

SEQ ID NO: 1304520 - DNA, 23 bp, Homo sapiens
ctgacattcacctgccccaactc

SEQ ID NO: 1304521 - DNA, 15 bp, Homo sapiens
ctgaccacagcacag

SEQ ID NO: 1304522 - DNA, 21 bp, Homo sapiens
ctgaccagcagcgcctttccc

SEQ ID NO: 1304523 - DNA, 22 bp, Homo sapiens
ctgaccagcagcgcctttccca

SEQ ID NO: 1304524 - DNA, 20 bp, Homo sapiens
ctgacccagtgcccccactg

SEQ ID NO: 1304525 - DNA, 21 bp, Homo sapiens
ctgacccagtgcccccactga

SEQ ID NO: 1304526 - DNA, 18 bp, Homo sapiens
ctgacctgtgagcccagc

SEQ ID NO: 1304527 - DNA, 21 bp, Homo sapiens
ctgacggccagggagaagctc

SEQ ID NO: 1304528 - DNA, 23 bp, Homo sapiens
ctgacttcatctcccacctagca

SEQ ID NO: 1304529 - DNA, 17 bp, Homo sapiens
ctgagaatgtaagaact

SEQ ID NO: 1304530 - DNA, 18 bp, Homo sapiens
ctgagatttcatctgctc

SEQ ID NO: 1304531 - DNA, 22 bp, Homo sapiens
ctgagatttcatctgctctcct

SEQ ID NO: 1304532 - DNA, 12 bp, Homo sapiens
ctgagcccctgt

SEQ ID NO: 1304533 - DNA, 18 bp, Homo sapiens
ctgagcctctgctcccca

SEQ ID NO: 1304534 - DNA, 14 bp, Homo sapiens
ctgagcgctcctgc

SEQ ID NO: 1304535 - DNA, 20 bp, Homo sapiens
ctgaggccacactcagcaca

SEQ ID NO: 1304536 - DNA, 17 bp, Homo sapiens
ctgaggcctgagcgctc

SEQ ID NO: 1304537 - DNA, 22 bp, Homo sapiens
ctgaggcctgagcgctcctgcc

SEQ ID NO: 1304538 - DNA, 17 bp, Homo sapiens
ctgaggctggcacagga

SEQ ID NO: 1304539 - DNA, 18 bp, Homo sapiens
ctgaggctggcacaggac

SEQ ID NO: 1304540 - DNA, 20 bp, Homo sapiens
ctgaggctggcacaggacat

SEQ ID NO: 1304541 - DNA, 15 bp, Homo sapiens
ctgagtgaacctgta

SEQ ID NO: 1304542 - DNA, 18 bp, Homo sapiens
ctgataactagatggtgc

SEQ ID NO: 1304543 - DNA, 19 bp, Homo sapiens
ctgataactagatggtgct

SEQ ID NO: 1304544 - DNA, 20 bp, Homo sapiens
ctgataactagatggtgctg

SEQ ID NO: 1304545 - DNA, 12 bp, Homo sapiens
ctgatcctggag

SEQ ID NO: 1304546 - DNA, 17 bp, Homo sapiens
ctgcaaaaatatttata

SEQ ID NO: 1304547 - DNA, 22 bp, Homo sapiens
ctgcaaagatctgtcctcagcc

SEQ ID NO: 1304548 - DNA, 18 bp, Homo sapiens
ctgcaaggtttaggctgg

SEQ ID NO: 1304549 - DNA, 18 bp, Homo sapiens
ctgcactgatgctgcccc

SEQ ID NO: 1304550 - DNA, 19 bp, Homo sapiens
ctgcactgatgctgcccct

SEQ ID NO: 1304551 - DNA, 14 bp, Homo sapiens
ctgcagtaaatctt

SEQ ID NO: 1304552 - DNA, 14 bp, Homo sapiens
ctgcatatgttgaa

SEQ ID NO: 1304553 - DNA, 18 bp, Homo sapiens
ctgcatttcggtggctag

SEQ ID NO: 1304554 - DNA, 22 bp, Homo sapiens
ctgccaaaatgctctagtgcct

SEQ ID NO: 1304555 - DNA, 18 bp, Homo sapiens
ctgccacccacctccctg

SEQ ID NO: 1304556 - DNA, 23 bp, Homo sapiens
ctgccacccacctccctgcctcc

SEQ ID NO: 1304557 - DNA, 16 bp, Homo sapiens
ctgcccatggacaggc

SEQ ID NO: 1304558 - DNA, 12 bp, Homo sapiens
ctgccccaactc

SEQ ID NO: 1304559 - DNA, 13 bp, Homo sapiens
ctgccccaactct

SEQ ID NO: 1304560 - DNA, 13 bp, Homo sapiens
ctgccccatcctc

SEQ ID NO: 1304561 - DNA, 17 bp, Homo sapiens
ctgccccatcctccagc

SEQ ID NO: 1304562 - DNA, 21 bp, Homo sapiens
ctgccccatcctccagcaggg

SEQ ID NO: 1304563 - DNA, 22 bp, Homo sapiens
ctgccccatcctccagcaggga

SEQ ID NO: 1304564 - DNA, 14 bp, Homo sapiens
ctgcccccaggact

SEQ ID NO: 1304565 - DNA, 18 bp, Homo sapiens
ctgcccccaggactgggc

SEQ ID NO: 1304566 - DNA, 13 bp, Homo sapiens
ctgccgcagagct

SEQ ID NO: 1304567 - DNA, 11 bp, Homo sapiens
ctgcctcagga

SEQ ID NO: 1304568 - DNA, 12 bp, Homo sapiens
ctgcctcattta

SEQ ID NO: 1304569 - DNA, 19 bp, Homo sapiens
ctgcctccagggctggact

SEQ ID NO: 1304570 - DNA, 15 bp, Homo sapiens
gaggctgaggctggc

SEQ ID NO: 1304571 - DNA, 20 bp, Homo sapiens
gaggctttggatttgacatt

SEQ ID NO: 1304572 - DNA, 12 bp, Homo sapiens
gagggaggggcc

SEQ ID NO: 1304573 - DNA, 21 bp, Homo sapiens
gagggcagcagaagggggtgg

SEQ ID NO: 1304574 - DNA, 22 bp, Homo sapiens
gagggcagcagaagggggtggt

SEQ ID NO: 1304575 - DNA, 20 bp, Homo sapiens
gaggtgtatggagagaaaac

SEQ ID NO: 1304576 - DNA, 12 bp, Homo sapiens
gagtccaagctg

SEQ ID NO: 1304577 - DNA, 23 bp, Homo sapiens
gagtgcagccgtttgagaagaaa

SEQ ID NO: 1304578 - DNA, 13 bp, Homo sapiens
gagttaagacctg

SEQ ID NO: 1304579 - DNA, 18 bp, Homo sapiens
gagttatctaaaagaaat

SEQ ID NO: 1304580 - DNA, 19 bp, Homo sapiens
gagttgatctggaacccag

SEQ ID NO: 1304581 - DNA, 21 bp, Homo sapiens
gagttgatctggaacccagac

SEQ ID NO: 1304582 - DNA, 13 bp, Homo sapiens
gataaattataag

SEQ ID NO: 1304583 - DNA, 16 bp, Homo sapiens
gataagtgtatttttc

SEQ ID NO: 1304584 - DNA, 21 bp, Homo sapiens
gatacatccaaagcagacagc

SEQ ID NO: 1304585 - DNA, 20 bp, Homo sapiens
gatagacacatatgaggggg

SEQ ID NO: 1304586 - DNA, 20 bp, Homo sapiens
gatagcactttctacaatgt

SEQ ID NO: 1304587 - DNA, 15 bp, Homo sapiens
gatatatttaaaaat

SEQ ID NO: 1304588 - DNA, 19 bp, Homo sapiens
gatatatttaaaaatattt

SEQ ID NO: 1304589 - DNA, 15 bp, Homo sapiens
gatatccattctttc

SEQ ID NO: 1304590 - DNA, 20 bp, Homo sapiens
gatcaacatcttttcttgcc

SEQ ID NO: 1304591 - DNA, 18 bp, Homo sapiens
gatcaaccagctaagaaa

SEQ ID NO: 1304592 - DNA, 19 bp, Homo sapiens
gatccaaaagaagccccca

SEQ ID NO: 1304593 - DNA, 22 bp, Homo sapiens
gatccaaaagaagcccccagct

SEQ ID NO: 1304594 - DNA, 21 bp, Homo sapiens
gatccagcctggggtctggag

SEQ ID NO: 1304595 - DNA, 12 bp, Homo sapiens
gatccaggacta

SEQ ID NO: 1304596 - DNA, 22 bp, Homo sapiens
gatccagggacagaggccccag

SEQ ID NO: 1304597 - DNA, 12 bp, Homo sapiens
gatcctggaggc

SEQ ID NO: 1304598 - DNA, 12 bp, Homo sapiens
gatctggaaccc

SEQ ID NO: 1304599 - DNA, 20 bp, Homo sapiens
gatctggaacctcagcctgg

SEQ ID NO: 1304600 - DNA, 21 bp, Homo sapiens
gatctggaacctcagcctggc

SEQ ID NO: 1304601 - DNA, 23 bp, Homo sapiens
gatctggaacctcagcctggcca

SEQ ID NO: 1304602 - DNA, 14 bp, Homo sapiens
gatctgtcctcagc

SEQ ID NO: 1304603 - DNA, 14 bp, Homo sapiens
gatgcagggcagtc

SEQ ID NO: 1304604 - DNA, 13 bp, Homo sapiens
gatgctggcccag

SEQ ID NO: 1304605 - DNA, 14 bp, Homo sapiens
gatgctggcccagg

SEQ ID NO: 1304606 - DNA, 19 bp, Homo sapiens
gatgctggcccagggccca

SEQ ID NO: 1304607 - DNA, 21 bp, Homo sapiens
gatgctggcccagggcccaga

SEQ ID NO: 1304608 - DNA, 22 bp, Homo sapiens
gatgctggcccagggcccagag

SEQ ID NO: 1304609 - DNA, 17 bp, Homo sapiens
gatggaacacggccaca

SEQ ID NO: 1304610 - DNA, 12 bp, Homo sapiens
gatggacagact

SEQ ID NO: 1304611 - DNA, 16 bp, Homo sapiens
gatgggggaactcaga

SEQ ID NO: 1304612 - DNA, 22 bp, Homo sapiens
gatgggggaactcagatccagg

SEQ ID NO: 1304613 - DNA, 14 bp, Homo sapiens
gatggtgctgagaa

SEQ ID NO: 1304614 - DNA, 12 bp, Homo sapiens
gatgtgaagcca

SEQ ID NO: 1304615 - DNA, 19 bp, Homo sapiens
gattccaaagagtagaatt

SEQ ID NO: 1304616 - DNA, 13 bp, Homo sapiens
gattccttcctgt

SEQ ID NO: 1304617 - DNA, 15 bp, Homo sapiens
gattctatttatatg

SEQ ID NO: 1304618 - DNA, 11 bp, Homo sapiens
gattctccttc

SEQ ID NO: 1304619 - DNA, 17 bp, Homo sapiens
gattctccttcagccct

SEQ ID NO: 1304620 - DNA, 21 bp, Homo sapiens
gattctgcagtaaatctttta

SEQ ID NO: 1304621 - DNA, 19 bp, Homo sapiens
gattgacagctttgctgct

SEQ ID NO: 1304622 - DNA, 20 bp, Homo sapiens
gattgggtgggcaggaaaag

SEQ ID NO: 1304623 - DNA, 12 bp, Homo sapiens
gatttcatctgc

SEQ ID NO: 1304624 - DNA, 15 bp, Homo sapiens
gatttcatctgctct

SEQ ID NO: 1304625 - DNA, 17 bp, Homo sapiens
gatttcatctgctctcc

SEQ ID NO: 1304626 - DNA, 21 bp, Homo sapiens
gatttcatctgctctccttcc

SEQ ID NO: 1304627 - DNA, 22 bp, Homo sapiens
gatttccagtctccaccaggaa

SEQ ID NO: 1304628 - DNA, 20 bp, Homo sapiens
gatttgaagaacatgtgaga

SEQ ID NO: 1304629 - DNA, 13 bp, Homo sapiens
gatttggggtgga

SEQ ID NO: 1304630 - DNA, 22 bp, Homo sapiens
gattttggttttgttcccctcc

SEQ ID NO: 1304631 - DNA, 19 bp, Homo sapiens
gattttttgcattcctgac

SEQ ID NO: 1304632 - DNA, 14 bp, Homo sapiens
gcaaaaatatttat

SEQ ID NO: 1304633 - DNA, 17 bp, Homo sapiens
gcaaaattgcaaatctt

SEQ ID NO: 1304634 - DNA, 21 bp, Homo sapiens
gcaaagatctgtcctcagcct

SEQ ID NO: 1304635 - DNA, 12 bp, Homo sapiens
gcaaatcttgaa

SEQ ID NO: 1304636 - DNA, 22 bp, Homo sapiens
gcaacaagaccaccacttcgaa

SEQ ID NO: 1304637 - DNA, 12 bp, Homo sapiens
gcaacagatctg

SEQ ID NO: 1304638 - DNA, 13 bp, Homo sapiens
gcaacagatctgg

SEQ ID NO: 1304639 - DNA, 18 bp, Homo sapiens
gcaacagatctggaacct

SEQ ID NO: 1304640 - DNA, 22 bp, Homo sapiens
gcaacagatctggaacctcagc

SEQ ID NO: 1304641 - DNA, 13 bp, Homo sapiens
gcaacatccaaaa

SEQ ID NO: 1304642 - DNA, 17 bp, Homo sapiens
gcaacatccaaaatagt

SEQ ID NO: 1304643 - DNA, 19 bp, Homo sapiens
gcaaccccaggctgaagca

SEQ ID NO: 1304644 - DNA, 15 bp, Homo sapiens
gcaagccctgttgac

SEQ ID NO: 1304645 - DNA, 16 bp, Homo sapiens
gcaaggaaaaacaggt

SEQ ID NO: 1304646 - DNA, 12 bp, Homo sapiens
gcaagggactgt

SEQ ID NO: 1304647 - DNA, 16 bp, Homo sapiens
gcaagggttccctcaa

SEQ ID NO: 1304648 - DNA, 18 bp, Homo sapiens
gcaagggttccctcaaga

SEQ ID NO: 1304649 - DNA, 18 bp, Homo sapiens
gcaaggtccggcccatcc

SEQ ID NO: 1304650 - DNA, 20 bp, Homo sapiens
gcaaggtttaggctggtggc

SEQ ID NO: 1304651 - DNA, 24 bp, Homo sapiens
gcaaggtttaggctggtggcccag

SEQ ID NO: 1304652 - DNA, 16 bp, Homo sapiens
gcaatgatgaatgaga

SEQ ID NO: 1304653 - DNA, 19 bp, Homo sapiens
gcaatgggagctgaggcca

SEQ ID NO: 1304654 - DNA, 19 bp, Homo sapiens
gcaatgtctgagtgaacct

SEQ ID NO: 1304655 - DNA, 13 bp, Homo sapiens
gcacaaaacccag

SEQ ID NO: 1304656 - DNA, 23 bp, Homo sapiens
gcacaaaacccagacctgttagc

SEQ ID NO: 1304657 - DNA, 22 bp, Homo sapiens
gcacagcagcctggggctggcc

SEQ ID NO: 1304658 - DNA, 22 bp, Homo sapiens
gcacagccaacacgcacctgcc

SEQ ID NO: 1304659 - DNA, 15 bp, Homo sapiens
gcaccagacacccag

SEQ ID NO: 1304660 - DNA, 17 bp, Homo sapiens
gcaccagacacccagga

SEQ ID NO: 1304661 - DNA, 20 bp, Homo sapiens
gcaccagacacccaggactt

SEQ ID NO: 1304662 - DNA, 13 bp, Homo sapiens
gcacctgcctcag

SEQ ID NO: 1304663 - DNA, 21 bp, Homo sapiens
gcacctgtaatcccagctact

SEQ ID NO: 1304664 - DNA, 14 bp, Homo sapiens
gcactaaggggccc

SEQ ID NO: 1304665 - DNA, 13 bp, Homo sapiens
gcactgatgctgc

SEQ ID NO: 1304666 - DNA, 19 bp, Homo sapiens
gcactgatgctgcccctca

SEQ ID NO: 1304667 - DNA, 21 bp, Homo sapiens
gcactgcccatggacaggctg

SEQ ID NO: 1304668 - DNA, 14 bp, Homo sapiens
gcactgtgaaggac

SEQ ID NO: 1304669 - DNA, 16 bp, Homo sapiens
gcactgtgaaggaccc

SEQ ID NO: 1304670 - DNA, 16 bp, Homo sapiens
gcacttgtccagctga

SEQ ID NO: 1304671 - DNA, 20 bp, Homo sapiens
gcacttgtgattatttatta

SEQ ID NO: 1304672 - DNA, 21 bp, Homo sapiens
gcacttgtgattatttattat

SEQ ID NO: 1304673 - DNA, 21 bp, Homo sapiens
gcactttctacaatgtgaact

SEQ ID NO: 1304674 - DNA, 21 bp, Homo sapiens
gcagaactaaactcatttata

SEQ ID NO: 1304675 - DNA, 14 bp, Homo sapiens
gcagaagggggtgg

SEQ ID NO: 1304676 - DNA, 15 bp, Homo sapiens
gcagaagggggtggt

SEQ ID NO: 1304677 - DNA, 22 bp, Homo sapiens
gcagaagggggtggtgtctcca

SEQ ID NO: 1304678 - DNA, 15 bp, Homo sapiens
gcagacagctccacc

SEQ ID NO: 1304679 - DNA, 15 bp, Homo sapiens
gcagatccaggacta

SEQ ID NO: 1304680 - DNA, 13 bp, Homo sapiens
gcagcagaagggg

SEQ ID NO: 1304681 - DNA, 17 bp, Homo sapiens
gcagcagggatgccctg

SEQ ID NO: 1304682 - DNA, 20 bp, Homo sapiens
gcagcagggatgccctggag

SEQ ID NO: 1304683 - DNA, 18 bp, Homo sapiens
gcagccgtttgagaagaa

SEQ ID NO: 1304684 - DNA, 14 bp, Homo sapiens
gcagcgccaggctg

SEQ ID NO: 1304685 - DNA, 20 bp, Homo sapiens
gcagctctggacagccccac

SEQ ID NO: 1304686 - DNA, 22 bp, Homo sapiens
gtcccagattggctcacactga

SEQ ID NO: 1304687 - DNA, 11 bp, Homo sapiens
gtccccccacc

SEQ ID NO: 1304688 - DNA, 12 bp, Homo sapiens
gtccccccaccc

SEQ ID NO: 1304689 - DNA, 13 bp, Homo sapiens
gtccccccaccct

SEQ ID NO: 1304690 - DNA, 11 bp, Homo sapiens
gtccccttctc

SEQ ID NO: 1304691 - DNA, 12 bp, Homo sapiens
gtccccttctct

SEQ ID NO: 1304692 - DNA, 19 bp, Homo sapiens
gtccccttctctcatctct

SEQ ID NO: 1304693 - DNA, 13 bp, Homo sapiens
gtcctaaaacacc

SEQ ID NO: 1304694 - DNA, 16 bp, Homo sapiens
gtcctacccatccccg

SEQ ID NO: 1304695 - DNA, 12 bp, Homo sapiens
gtcctcagcctt

SEQ ID NO: 1304696 - DNA, 21 bp, Homo sapiens
gtcctcagccttgccagagat

SEQ ID NO: 1304697 - DNA, 16 bp, Homo sapiens
gtcctcaggtggccat

SEQ ID NO: 1304698 - DNA, 17 bp, Homo sapiens
gtcctcaggtggccatg

SEQ ID NO: 1304699 - DNA, 21 bp, Homo sapiens
gtcctcccaatttcagactcc

SEQ ID NO: 1304700 - DNA, 15 bp, Homo sapiens
gtcctggccatccca

SEQ ID NO: 1304701 - DNA, 18 bp, Homo sapiens
gtcctggccatcccacaa

SEQ ID NO: 1304702 - DNA, 17 bp, Homo sapiens
gtcctgggcctgcagaa

SEQ ID NO: 1304703 - DNA, 17 bp, Homo sapiens
gtccttagaacatttta

SEQ ID NO: 1304704 - DNA, 20 bp, Homo sapiens
gtcgcccaggctggagtgca

SEQ ID NO: 1304705 - DNA, 13 bp, Homo sapiens
gtctagagaggga

SEQ ID NO: 1304706 - DNA, 15 bp, Homo sapiens
gtctagatggctcct

SEQ ID NO: 1304707 - DNA, 17 bp, Homo sapiens
gtctagatggctcctct

SEQ ID NO: 1304708 - DNA, 18 bp, Homo sapiens
gtctagatggctcctctc

SEQ ID NO: 1304709 - DNA, 20 bp, Homo sapiens
gtctagatggctcctctcag

SEQ ID NO: 1304710 - DNA, 22 bp, Homo sapiens
gtctccaaccccccagcactga

SEQ ID NO: 1304711 - DNA, 16 bp, Homo sapiens
gtctccaccaggaacc

SEQ ID NO: 1304712 - DNA, 19 bp, Homo sapiens
gtctccaccaggaacctct

SEQ ID NO: 1304713 - DNA, 20 bp, Homo sapiens
gtctgcatttcggtggctag

SEQ ID NO: 1304714 - DNA, 21 bp, Homo sapiens
gtctggagttgatctggaacc

SEQ ID NO: 1304715 - DNA, 12 bp, Homo sapiens
gtctggcagcct

SEQ ID NO: 1304716 - DNA, 14 bp, Homo sapiens
gtctttaactgtca

SEQ ID NO: 1304717 - DNA, 17 bp, Homo sapiens
gtgaacaaagcagccac

SEQ ID NO: 1304718 - DNA, 14 bp, Homo sapiens
gtgaacctgtataa

SEQ ID NO: 1304719 - DNA, 20 bp, Homo sapiens
gtgaagccaattcagacagg

SEQ ID NO: 1304720 - DNA, 15 bp, Homo sapiens
gtgatctcagatcag

SEQ ID NO: 1304721 - DNA, 22 bp, Homo sapiens
gtgcaacaaggtcctctgtcag

SEQ ID NO: 1304722 - DNA, 23 bp, Homo sapiens
gtgcaataaatctgacccagtgc

SEQ ID NO: 1304723 - DNA, 21 bp, Homo sapiens
gtgcactgcccatggacaggc

SEQ ID NO: 1304724 - DNA, 22 bp, Homo sapiens
gtgcagtatcatgccctgtgca

SEQ ID NO: 1304725 - DNA, 21 bp, Homo sapiens
gtgcccacaggccgccctgcg

SEQ ID NO: 1304726 - DNA, 19 bp, Homo sapiens
gtgccccaggaccagctca

SEQ ID NO: 1304727 - DNA, 18 bp, Homo sapiens
gtgcccccactgaccaga

SEQ ID NO: 1304728 - DNA, 16 bp, Homo sapiens
gtgctcgccccagcag

SEQ ID NO: 1304729 - DNA, 13 bp, Homo sapiens
gtgctgagaagct

SEQ ID NO: 1304730 - DNA, 14 bp, Homo sapiens
gtgctgctgctgct

SEQ ID NO: 1304731 - DNA, 15 bp, Homo sapiens
gtgctgctgctgctg

SEQ ID NO: 1304732 - DNA, 14 bp, Homo sapiens
gtgctttatgctga

SEQ ID NO: 1304733 - DNA, 18 bp, Homo sapiens
gtggaccttaggccttcc

SEQ ID NO: 1304734 - DNA, 21 bp, Homo sapiens
gtggaccttaggccttcctct

SEQ ID NO: 1304735 - DNA, 17 bp, Homo sapiens
gtggagaagccacaggc

SEQ ID NO: 1304736 - DNA, 20 bp, Homo sapiens
gtggagaagccacaggcctg

SEQ ID NO: 1304737 - DNA, 23 bp, Homo sapiens
gtggagggacaagtggactcagg

SEQ ID NO: 1304738 - DNA, 17 bp, Homo sapiens
gtggccaaggagctgct

SEQ ID NO: 1304739 - DNA, 19 bp, Homo sapiens
gtggccaaggagctgctat

SEQ ID NO: 1304740 - DNA, 20 bp, Homo sapiens
gtggcgactctatagactct

SEQ ID NO: 1304741 - DNA, 19 bp, Homo sapiens
gtggctagtcaagctcctc

SEQ ID NO: 1304742 - DNA, 17 bp, Homo sapiens
gtggctgagcccctgtc

SEQ ID NO: 1304743 - DNA, 17 bp, Homo sapiens
gtgggcaaacaggcagt

SEQ ID NO: 1304744 - DNA, 13 bp, Homo sapiens
gtgggcaggaaaa

SEQ ID NO: 1304745 - DNA, 17 bp, Homo sapiens
gtgtgcactaaggggcc

SEQ ID NO: 1304746 - DNA, 18 bp, Homo sapiens
gtgtgctttatgctgaaa

SEQ ID NO: 1304747 - DNA, 14 bp, Homo sapiens
gtgtggtgcagtgt

SEQ ID NO: 1304748 - DNA, 18 bp, Homo sapiens
gtgtggtgcagtgtgaaa

SEQ ID NO: 1304749 - DNA, 19 bp, Homo sapiens
gtgtgtccaaaactgcctc

SEQ ID NO: 1304750 - DNA, 15 bp, Homo sapiens
gtgtgttgccacagg

SEQ ID NO: 1304751 - DNA, 19 bp, Homo sapiens
gtgttactgtaattcctca

SEQ ID NO: 1304752 - DNA, 14 bp, Homo sapiens
gtgttgtcccttct

SEQ ID NO: 1304753 - DNA, 16 bp, Homo sapiens
gttactaggtaacttc

SEQ ID NO: 1304754 - DNA, 20 bp, Homo sapiens
gttactaggtaacttcatat

SEQ ID NO: 1304755 - DNA, 13 bp, Homo sapiens
gttagcagacagg

SEQ ID NO: 1304756 - DNA, 15 bp, Homo sapiens
gttatctaaaagaaa

SEQ ID NO: 1304757 - DNA, 16 bp, Homo sapiens
gttatctaaaagaaat

SEQ ID NO: 1304758 - DNA, 22 bp, Homo sapiens
gttatgcaagggactgtgtgtt

SEQ ID NO: 1304759 - DNA, 23 bp, Homo sapiens
gttatttaacagctgaattatct

SEQ ID NO: 1304760 - DNA, 13 bp, Homo sapiens
gttcaattagaat

SEQ ID NO: 1304761 - DNA, 19 bp, Homo sapiens
gttcccaagctcagaggcg

SEQ ID NO: 1304762 - DNA, 13 bp, Homo sapiens
gttccccagagaa

SEQ ID NO: 1304763 - DNA, 18 bp, Homo sapiens
gttcggatttggggtgga

SEQ ID NO: 1304764 - DNA, 16 bp, Homo sapiens
gttcgggtgtgcaatg

SEQ ID NO: 1304765 - DNA, 11 bp, Homo sapiens
gttctcatctt

SEQ ID NO: 1304766 - DNA, 16 bp, Homo sapiens
gttctgcaaaaatatt

SEQ ID NO: 1304767 - DNA, 22 bp, Homo sapiens
gttctgcaaaaatatttataaa

SEQ ID NO: 1304768 - DNA, 17 bp, Homo sapiens
gttctgcctgccagctg

SEQ ID NO: 1304769 - DNA, 15 bp, Homo sapiens
gttctttgggccaga

SEQ ID NO: 1304770 - DNA, 16 bp, Homo sapiens
gttctttgggccagac

SEQ ID NO: 1304771 - DNA, 22 bp, Homo sapiens
gttctttgggccagacatgcca

SEQ ID NO: 1304772 - DNA, 13 bp, Homo sapiens
gttgaatactttt

SEQ ID NO: 1304773 - DNA, 15 bp, Homo sapiens
gttgacacaggtctt

SEQ ID NO: 1304774 - DNA, 13 bp, Homo sapiens
gttgagctgtttt

SEQ ID NO: 1304775 - DNA, 17 bp, Homo sapiens
gttgatctggaacccag

SEQ ID NO: 1304776 - DNA, 13 bp, Homo sapiens
gttgccacaggac

SEQ ID NO: 1304777 - DNA, 15 bp, Homo sapiens
gttgccacaggacac

SEQ ID NO: 1304778 - DNA, 18 bp, Homo sapiens
gttgctgttttcctccct

SEQ ID NO: 1304779 - DNA, 19 bp, Homo sapiens
gttgctgttttcctccctt

SEQ ID NO: 1304780 - DNA, 16 bp, Homo sapiens
gtttgactagatgatg

SEQ ID NO: 1304781 - DNA, 15 bp, Homo sapiens
taggagaagccagga

SEQ ID NO: 1304782 - DNA, 16 bp, Homo sapiens
taggagaagccaggaa

SEQ ID NO: 1304783 - DNA, 21 bp, Homo sapiens
taggagggagttatctaaaag

SEQ ID NO: 1304784 - DNA, 21 bp, Homo sapiens
taggccttcctctctccagat

SEQ ID NO: 1304785 - DNA, 18 bp, Homo sapiens
taggctggtggcccagga

SEQ ID NO: 1304786 - DNA, 14 bp, Homo sapiens
tagggctgtaaaat

SEQ ID NO: 1304787 - DNA, 14 bp, Homo sapiens
tagtaattgacatg

SEQ ID NO: 1304788 - DNA, 18 bp, Homo sapiens
tagtaccatttatacaaa

SEQ ID NO: 1304789 - DNA, 20 bp, Homo sapiens
tagtaccatttatacaaatt

SEQ ID NO: 1304790 - DNA, 13 bp, Homo sapiens
tagtcaagctcct

SEQ ID NO: 1304791 - DNA, 14 bp, Homo sapiens
tataaattcctctt

SEQ ID NO: 1304792 - DNA, 20 bp, Homo sapiens
tataaattcctctttgcttt

SEQ ID NO: 1304793 - DNA, 19 bp, Homo sapiens
tataagtggaggcacttta

SEQ ID NO: 1304794 - DNA, 22 bp, Homo sapiens
tatacatagcatgacatttctt

SEQ ID NO: 1304795 - DNA, 18 bp, Homo sapiens
tatacatatctttattaa

SEQ ID NO: 1304796 - DNA, 18 bp, Homo sapiens
tatactctagatgaagtt

SEQ ID NO: 1304797 - DNA, 17 bp, Homo sapiens
tatactctttctgtata

SEQ ID NO: 1304798 - DNA, 21 bp, Homo sapiens
tatagaatatttattacctct

SEQ ID NO: 1304799 - DNA, 22 bp, Homo sapiens
tatatttgggcctgctccagac

SEQ ID NO: 1304800 - DNA, 23 bp, Homo sapiens
tatatttgtgatagcactttcta

SEQ ID NO: 1304801 - DNA, 18 bp, Homo sapiens
tatcatgcccctgtactc

SEQ ID NO: 1304802 - DNA, 14 bp, Homo sapiens
tatcatgccctgtg

SEQ ID NO: 1304803 - DNA, 14 bp, Homo sapiens
tatctaaaagaaat

SEQ ID NO: 1304804 - DNA, 18 bp, Homo sapiens
tatctatacatatcttta

SEQ ID NO: 1304805 - DNA, 17 bp, Homo sapiens
tatcttgtctctgggct

SEQ ID NO: 1304806 - DNA, 19 bp, Homo sapiens
tatctttgattctccttca

SEQ ID NO: 1304807 - DNA, 20 bp, Homo sapiens
tatgcatggtgccccaggac

SEQ ID NO: 1304808 - DNA, 23 bp, Homo sapiens
tatgcatggtgccccaggaccag

SEQ ID NO: 1304809 - DNA, 21 bp, Homo sapiens
tgtcctcagccttgccagaga

SEQ ID NO: 1304810 - DNA, 23 bp, Homo sapiens
tgtcctccaacaccaagcacagc

SEQ ID NO: 1304811 - DNA, 14 bp, Homo sapiens
tgtcctgggcctgc

SEQ ID NO: 1304812 - DNA, 17 bp, Homo sapiens
tgtcctgggcctgcaga

SEQ ID NO: 1304813 - DNA, 16 bp, Homo sapiens
tgtctaaacaatgctg

SEQ ID NO: 1304814 - DNA, 20 bp, Homo sapiens
tgtctaaacaatgctgattt

SEQ ID NO: 1304815 - DNA, 23 bp, Homo sapiens
tgtctctgggcttggggcttcct

SEQ ID NO: 1304816 - DNA, 14 bp, Homo sapiens
tgtctgagtgaacc

SEQ ID NO: 1304817 - DNA, 17 bp, Homo sapiens
tgtctgagtgaacctgt

SEQ ID NO: 1304818 - DNA, 20 bp, Homo sapiens
tgtctgagtgaacctgtata

SEQ ID NO: 1304819 - DNA, 21 bp, Homo sapiens
tgtctgagtgaacctgtataa

SEQ ID NO: 1304820 - DNA, 15 bp, Homo sapiens
tgtcttcatagcaga

SEQ ID NO: 1304821 - DNA, 14 bp, Homo sapiens
acaaaatctgttta

SEQ ID NO: 1304822 - DNA, 13 bp, Homo sapiens
acaaagcccaagg

SEQ ID NO: 1304823 - DNA, 21 bp, Homo sapiens
acaaagttactaggtaacttc

SEQ ID NO: 1304824 - DNA, 15 bp, Homo sapiens
acaaatactcttagg

SEQ ID NO: 1304825 - DNA, 13 bp, Homo sapiens
acaacctgaacct

SEQ ID NO: 1304826 - DNA, 14 bp, Homo sapiens
acaacctgaaccta

SEQ ID NO: 1304827 - DNA, 19 bp, Homo sapiens
acaagaccaccacttcgaa

SEQ ID NO: 1304828 - DNA, 21 bp, Homo sapiens
acaagagcactacattcattt

SEQ ID NO: 1304829 - DNA, 21 bp, Homo sapiens
acaaggatagatgctggccca

SEQ ID NO: 1304830 - DNA, 23 bp, Homo sapiens
acaaggtcctctgtcagtcacag

SEQ ID NO: 1304831 - DNA, 18 bp, Homo sapiens
acaagtggactcagggca

SEQ ID NO: 1304832 - DNA, 13 bp, Homo sapiens
acacactgatgct

SEQ ID NO: 1304833 - DNA, 15 bp, Homo sapiens
acacactgatgctta

SEQ ID NO: 1304834 - DNA, 19 bp, Homo sapiens
acacagaaaatgttgagaa

SEQ ID NO: 1304835 - DNA, 19 bp, Homo sapiens
acacagaaacctttttaaa

SEQ ID NO: 1304836 - DNA, 15 bp, Homo sapiens
acacataccctcttc

SEQ ID NO: 1304837 - DNA, 13 bp, Homo sapiens
acacatatgaggg

SEQ ID NO: 1304838 - DNA, 16 bp, Homo sapiens
acaccaagcacagcag

SEQ ID NO: 1304839 - DNA, 19 bp, Homo sapiens
acaccaagcacagcagcct

SEQ ID NO: 1304840 - DNA, 14 bp, Homo sapiens
acaccagcattcct

SEQ ID NO: 1304841 - DNA, 22 bp, Homo sapiens
acacggagcccagccctcccca

SEQ ID NO: 1304842 - DNA, 14 bp, Homo sapiens
acacggccacatca

SEQ ID NO: 1304843 - DNA, 22 bp, Homo sapiens
acactatggtatttgagtgttt

SEQ ID NO: 1304844 - DNA, 13 bp, Homo sapiens
acactcagcacaa

SEQ ID NO: 1304845 - DNA, 16 bp, Homo sapiens
acactcagcacaaggc

SEQ ID NO: 1304846 - DNA, 15 bp, Homo sapiens
acactccccgaagtc

SEQ ID NO: 1304847 - DNA, 19 bp, Homo sapiens
acactgagaatgtaagaac

SEQ ID NO: 1304848 - DNA, 22 bp, Homo sapiens
acactgagaatgtaagaactac

SEQ ID NO: 1304849 - DNA, 16 bp, Homo sapiens
acagaggccccagcct

SEQ ID NO: 1304850 - DNA, 23 bp, Homo sapiens
acagatcgaaccgttttgaagct

SEQ ID NO: 1304851 - DNA, 22 bp, Homo sapiens
acagatctggaacctcagcctg

SEQ ID NO: 1304852 - DNA, 14 bp, Homo sapiens
acagatgaatgtat

SEQ ID NO: 1304853 - DNA, 18 bp, Homo sapiens
acagatgccacacaagga

SEQ ID NO: 1304854 - DNA, 20 bp, Homo sapiens
acagccaacacgcacctgcc

SEQ ID NO: 1304855 - DNA, 10 bp, Homo sapiens
acagctgctc

SEQ ID NO: 1304856 - DNA, 20 bp, Homo sapiens
acagctgctcctagagggag

SEQ ID NO: 1304857 - DNA, 21 bp, Homo sapiens
acagctgctcctagagggagg

SEQ ID NO: 1304858 - DNA, 12 bp, Homo sapiens
acagctttgctg

SEQ ID NO: 1304859 - DNA, 15 bp, Homo sapiens
acaggacacagtcag

SEQ ID NO: 1304860 - DNA, 22 bp, Homo sapiens
acaggacatgcggtagccagca

SEQ ID NO: 1304861 - DNA, 22 bp, Homo sapiens
acaggccctccctgttccccag

SEQ ID NO: 1304862 - DNA, 23 bp, Homo sapiens
acagtatcactgtctttcctaga

SEQ ID NO: 1304863 - DNA, 13 bp, Homo sapiens
acataaattagag

SEQ ID NO: 1304864 - DNA, 17 bp, Homo sapiens
acataatggggtcctgg

SEQ ID NO: 1304865 - DNA, 13 bp, Homo sapiens
acatacaccagca

SEQ ID NO: 1304866 - DNA, 14 bp, Homo sapiens
acatacaccagcat

SEQ ID NO: 1304867 - DNA, 23 bp, Homo sapiens
acatacttgaagggccagagcca

SEQ ID NO: 1304868 - DNA, 16 bp, Homo sapiens
acatagcatgacattt

SEQ ID NO: 1304869 - DNA, 18 bp, Homo sapiens
acatagcatgacatttct

SEQ ID NO: 1304870 - DNA, 19 bp, Homo sapiens
acatagcatgacatttctt

SEQ ID NO: 1304871 - DNA, 16 bp, Homo sapiens
acataggactcaaagt

SEQ ID NO: 1304872 - DNA, 19 bp, Homo sapiens
acatatctttattaatcac

SEQ ID NO: 1304873 - DNA, 19 bp, Homo sapiens
acatccaaagcagacagct

SEQ ID NO: 1304874 - DNA, 18 bp, Homo sapiens
acatctattttggattgt

SEQ ID NO: 1304875 - DNA, 16 bp, Homo sapiens
acatgatttccttgaa

SEQ ID NO: 1304876 - DNA, 17 bp, Homo sapiens
acatgatttccttgaat

SEQ ID NO: 1304877 - DNA, 14 bp, Homo sapiens
acatgccacaagga

SEQ ID NO: 1304878 - DNA, 18 bp, Homo sapiens
acatgcggtagccagcac

SEQ ID NO: 1304879 - DNA, 14 bp, Homo sapiens
acattcacctgccc

SEQ ID NO: 1304880 - DNA, 12 bp, Homo sapiens
acatttggaata

SEQ ID NO: 1304881 - DNA, 15 bp, Homo sapiens
acatttggaatactt

SEQ ID NO: 1304882 - DNA, 16 bp, Homo sapiens
accacatctaagcctg

SEQ ID NO: 1304883 - DNA, 13 bp, Homo sapiens
accacttcattct

SEQ ID NO: 1304884 - DNA, 17 bp, Homo sapiens
accacttcattcttgaa

SEQ ID NO: 1304885 - DNA, 13 bp, Homo sapiens
accacttcgaaac

SEQ ID NO: 1304886 - DNA, 16 bp, Homo sapiens
accagacacccaggac

SEQ ID NO: 1304887 - DNA, 17 bp, Homo sapiens
accagacacccaggact

SEQ ID NO: 1304888 - DNA, 17 bp, Homo sapiens
accagcagcgcctttcc

SEQ ID NO: 1304889 - DNA, 18 bp, Homo sapiens
accagcagcgcctttccc

SEQ ID NO: 1304890 - DNA, 22 bp, Homo sapiens
accagctaagaaaagattttaa

SEQ ID NO: 1304891 - DNA, 13 bp, Homo sapiens
accagctcaggac

SEQ ID NO: 1304892 - DNA, 17 bp, Homo sapiens
accagtccccccaccct

SEQ ID NO: 1304893 - DNA, 23 bp, Homo sapiens
accatagtaccatttatacaaat

SEQ ID NO: 1304894 - DNA, 12 bp, Homo sapiens
accatcatccta

SEQ ID NO: 1304895 - DNA, 15 bp, Homo sapiens
acccaagcttagaac

SEQ ID NO: 1304896 - DNA, 15 bp, Homo sapiens
acccacctccctgcc

SEQ ID NO: 1304897 - DNA, 16 bp, Homo sapiens
acccacctccctgcct

SEQ ID NO: 1304898 - DNA, 19 bp, Homo sapiens
acccagattttgctgtata

SEQ ID NO: 1304899 - DNA, 20 bp, Homo sapiens
acccagattttgctgtatat

SEQ ID NO: 1304900 - DNA, 16 bp, Homo sapiens
acccagccccttgaga

SEQ ID NO: 1304901 - DNA, 23 bp, Homo sapiens
acccaggacttatttaaactctg

SEQ ID NO: 1304902 - DNA, 18 bp, Homo sapiens
acccagtgcccccactga

SEQ ID NO: 1304903 - DNA, 22 bp, Homo sapiens
acccagtgcccccactgaccag

SEQ ID NO: 1304904 - DNA, 17 bp, Homo sapiens
acccatccccgcagtgt

SEQ ID NO: 1304905 - DNA, 21 bp, Homo sapiens
acccatgagttggggtctggc

SEQ ID NO: 1304906 - DNA, 17 bp, Homo sapiens
acccccatttctattta

SEQ ID NO: 1304907 - DNA, 15 bp, Homo sapiens
accccctccccgccc

SEQ ID NO: 1304908 - DNA, 11 bp, Homo sapiens
accccctcctt

SEQ ID NO: 1304909 - DNA, 19 bp, Homo sapiens
accccctccttcagacacc

SEQ ID NO: 1304910 - DNA, 16 bp, Homo sapiens
acccctccctttctcc

SEQ ID NO: 1304911 - DNA, 16 bp, Homo sapiens
acccctgggggctctc

SEQ ID NO: 1304912 - DNA, 20 bp, Homo sapiens
acccctggttctcatctttc

SEQ ID NO: 1304913 - DNA, 13 bp, Homo sapiens
accctcttcatgg

SEQ ID NO: 1304914 - DNA, 17 bp, Homo sapiens
accctgaaggggccatg

SEQ ID NO: 1304915 - DNA, 18 bp, Homo sapiens
accctgaaggggccatga

SEQ ID NO: 1304916 - DNA, 22 bp, Homo sapiens
accctgatttaggagaagccag

SEQ ID NO: 1304917 - DNA, 18 bp, Homo sapiens
accctggccgagtccaag

SEQ ID NO: 1304918 - DNA, 22 bp, Homo sapiens
accctggccgagtccaagctgg

SEQ ID NO: 1304919 - DNA, 17 bp, Homo sapiens
accctggtggttgctgt

SEQ ID NO: 1304920 - DNA, 18 bp, Homo sapiens
accctgtatatagcccag

SEQ ID NO: 1304921 - DNA, 20 bp, Homo sapiens
accctgtatatagcccagcc

SEQ ID NO: 1304922 - DNA, 14 bp, Homo sapiens
accggtggggctgg

SEQ ID NO: 1304923 - DNA, 18 bp, Homo sapiens
accgtgggcagggagcgg

SEQ ID NO: 1304924 - DNA, 14 bp, Homo sapiens
acctagcagcaccg

SEQ ID NO: 1304925 - DNA, 15 bp, Homo sapiens
acctcacctagaaat

SEQ ID NO: 1304926 - DNA, 13 bp, Homo sapiens
acctcagcctggc

SEQ ID NO: 1304927 - DNA, 15 bp, Homo sapiens
acctcaggtgatcca

SEQ ID NO: 1304928 - DNA, 13 bp, Homo sapiens
acctccctgcctc

SEQ ID NO: 1304929 - DNA, 23 bp, Homo sapiens
acctctcttatagaatatttatt

SEQ ID NO: 1304930 - DNA, 14 bp, Homo sapiens
acctcttctggctc

SEQ ID NO: 1304931 - DNA, 14 bp, Homo sapiens
acctgaacctagga

SEQ ID NO: 1304932 - DNA, 13 bp, Homo sapiens
acctgatcctgga

SEQ ID NO: 1304933 - DNA, 22 bp, Homo sapiens
acctgatcctggaggcccagtt

SEQ ID NO: 1304934 - DNA, 15 bp, Homo sapiens
acctgcaaagatctg

SEQ ID NO: 1304935 - DNA, 16 bp, Homo sapiens
acctgcaaagatctgt

SEQ ID NO: 1304936 - DNA, 22 bp, Homo sapiens
acctgcaaagatctgtcctcag

SEQ ID NO: 1304937 - DNA, 13 bp, Homo sapiens
acctgcctcagga

SEQ ID NO: 1304938 - DNA, 22 bp, Homo sapiens
acctggggggcagtggtgtgga

SEQ ID NO: 1304939 - DNA, 18 bp, Homo sapiens
acctgtttttaagctgtt

SEQ ID NO: 1304940 - DNA, 20 bp, Homo sapiens
acctgtttttaagctgtttc

SEQ ID NO: 1304941 - DNA, 17 bp, Homo sapiens
accttaggccttcctct

SEQ ID NO: 1304942 - DNA, 20 bp, Homo sapiens
accttaggccttcctctctc

SEQ ID NO: 1304943 - DNA, 14 bp, Homo sapiens
accttcgggctgtg

SEQ ID NO: 1304944 - DNA, 17 bp, Homo sapiens
accttggcaccagacac

SEQ ID NO: 1304945 - DNA, 18 bp, Homo sapiens
accttggcaccagacacc

SEQ ID NO: 1304946 - DNA, 20 bp, Homo sapiens
accttttatgtagtaattga

SEQ ID NO: 1304947 - DNA, 16 bp, Homo sapiens
accttttgggaatgtt

SEQ ID NO: 1304948 - DNA, 17 bp, Homo sapiens
acgcacctgcctcagga

SEQ ID NO: 1304949 - DNA, 12 bp, Homo sapiens
acgctttgattc

SEQ ID NO: 1304950 - DNA, 12 bp, Homo sapiens
acggattccaaa

SEQ ID NO: 1304951 - DNA, 12 bp, Homo sapiens
acgtcttctaaa

SEQ ID NO: 1304952 - DNA, 19 bp, Homo sapiens
acgtgggcaaacaggcagt

SEQ ID NO: 1304953 - DNA, 14 bp, Homo sapiens
actaaactcattta

SEQ ID NO: 1304954 - DNA, 15 bp, Homo sapiens
actaactatgcatgg

SEQ ID NO: 1304955 - DNA, 23 bp, Homo sapiens
actaactatgcatggtgccccag

SEQ ID NO: 1304956 - DNA, 18 bp, Homo sapiens
actaagaattcaaactgg

SEQ ID NO: 1304957 - DNA, 13 bp, Homo sapiens
actaagcagagga

SEQ ID NO: 1304958 - DNA, 14 bp, Homo sapiens
actaagcagaggag

SEQ ID NO: 1304959 - DNA, 22 bp, Homo sapiens
actaagcagaggaggggccgct

SEQ ID NO: 1304960 - DNA, 14 bp, Homo sapiens
actaatttcaaaat

SEQ ID NO: 1304961 - DNA, 21 bp, Homo sapiens
actacaaacaaaatttctatt

SEQ ID NO: 1304962 - DNA, 22 bp, Homo sapiens
actacaaacaaaatttctatta

SEQ ID NO: 1304963 - DNA, 13 bp, Homo sapiens
actacaaatcaag

SEQ ID NO: 1304964 - DNA, 13 bp, Homo sapiens
actacattcattt

SEQ ID NO: 1304965 - DNA, 13 bp, Homo sapiens
actagatgatgga

SEQ ID NO: 1304966 - DNA, 16 bp, Homo sapiens
actagatggtgctgag

SEQ ID NO: 1304967 - DNA, 16 bp, Homo sapiens
actaggtaacttcata

SEQ ID NO: 1304968 - DNA, 15 bp, Homo sapiens
actatctactctcct

SEQ ID NO: 1304969 - DNA, 16 bp, Homo sapiens
actatctactctcctc

SEQ ID NO: 1304970 - DNA, 17 bp, Homo sapiens
actatctactctcctca

SEQ ID NO: 1304971 - DNA, 21 bp, Homo sapiens
actatgcatggtgccccagga

SEQ ID NO: 1304972 - DNA, 16 bp, Homo sapiens
actatggtatttgagt

SEQ ID NO: 1304973 - DNA, 19 bp, Homo sapiens
actcaaagtttcagagacc

SEQ ID NO: 1304974 - DNA, 17 bp, Homo sapiens
actcaaatggggccaga

SEQ ID NO: 1304975 - DNA, 21 bp, Homo sapiens
actcaaatggggccagatcca

SEQ ID NO: 1304976 - DNA, 21 bp, Homo sapiens
actcacaacctgaacctagga

SEQ ID NO: 1304977 - DNA, 18 bp, Homo sapiens
actcagacattggcacct

SEQ ID NO: 1304978 - DNA, 17 bp, Homo sapiens
actcagggcagcgccag

SEQ ID NO: 1304979 - DNA, 15 bp, Homo sapiens
actcattgctgagcc

SEQ ID NO: 1304980 - DNA, 20 bp, Homo sapiens
actcattgctgagcctctgc

SEQ ID NO: 1304981 - DNA, 19 bp, Homo sapiens
actccaacagaagaactgt

SEQ ID NO: 1304982 - DNA, 20 bp, Homo sapiens
actcccattcctgaagaacc

SEQ ID NO: 1304983 - DNA, 18 bp, Homo sapiens
actctatagactctagga

SEQ ID NO: 1304984 - DNA, 20 bp, Homo sapiens
actctcccccaccccctccc

SEQ ID NO: 1304985 - DNA, 16 bp, Homo sapiens
actctggcaaagcttt

SEQ ID NO: 1304986 - DNA, 16 bp, Homo sapiens
actcttgattatccat

SEQ ID NO: 1304987 - DNA, 14 bp, Homo sapiens
actctttctgtata

SEQ ID NO: 1304988 - DNA, 12 bp, Homo sapiens
actcttttgctt

SEQ ID NO: 1304989 - DNA, 18 bp, Homo sapiens
actgaactcactttcctc

SEQ ID NO: 1304990 - DNA, 19 bp, Homo sapiens
actgagaatgtaagaacta

SEQ ID NO: 1304991 - DNA, 20 bp, Homo sapiens
actgagaatgtaagaactac

SEQ ID NO: 1304992 - DNA, 18 bp, Homo sapiens
actgagcttctctgtgaa

SEQ ID NO: 1304993 - DNA, 12 bp, Homo sapiens
actgatgctgcc

SEQ ID NO: 1304994 - DNA, 14 bp, Homo sapiens
actgatgctgcccc

SEQ ID NO: 1304995 - DNA, 16 bp, Homo sapiens
actgcccatggacagg

SEQ ID NO: 1304996 - DNA, 21 bp, Homo sapiens
actgcccatggacaggctggc

SEQ ID NO: 1304997 - DNA, 23 bp, Homo sapiens
actgctacaaatactcttaggaa

SEQ ID NO: 1304998 - DNA, 22 bp, Homo sapiens
actgctactgtaattttatatg

SEQ ID NO: 1304999 - DNA, 20 bp, Homo sapiens
actggaagctaatttgcatt

SEQ ID NO: 1305000 - DNA, 17 bp, Homo sapiens
actggatgcagaaacag

SEQ ID NO: 1305001 - DNA, 21 bp, Homo sapiens
actggggcctacagctttgat

SEQ ID NO: 1305002 - DNA, 16 bp, Homo sapiens
actggggcctccagaa

SEQ ID NO: 1305003 - DNA, 18 bp, Homo sapiens
actgtaaataaaaagaaa

SEQ ID NO: 1305004 - DNA, 23 bp, Homo sapiens
actgtcaaaaagtttggttctgt

SEQ ID NO: 1305005 - DNA, 20 bp, Homo sapiens
actgtcaaggctgcttagaa

SEQ ID NO: 1305006 - DNA, 22 bp, Homo sapiens
actgtcaaggctgcttagaatc

SEQ ID NO: 1305007 - DNA, 14 bp, Homo sapiens
actgtcactcattg

SEQ ID NO: 1305008 - DNA, 14 bp, Homo sapiens
actgtcctgggcct

SEQ ID NO: 1305009 - DNA, 17 bp, Homo sapiens
actgtcctgggcctgca

SEQ ID NO: 1305010 - DNA, 19 bp, Homo sapiens
actgtcctgggcctgcaga

SEQ ID NO: 1305011 - DNA, 22 bp, Homo sapiens
actgtggggtgtgcacatctct

SEQ ID NO: 1305012 - DNA, 15 bp, Homo sapiens
actgtgtgtgtgaat

SEQ ID NO: 1305013 - DNA, 20 bp, Homo sapiens
actgtgtgttgccacaggac

SEQ ID NO: 1305014 - DNA, 18 bp, Homo sapiens
actgtgtttcaagttcaa

SEQ ID NO: 1305015 - DNA, 17 bp, Homo sapiens
acttaatactaccttga

SEQ ID NO: 1305016 - DNA, 23 bp, Homo sapiens
acttatgacctcttcctttagga

SEQ ID NO: 1305017 - DNA, 16 bp, Homo sapiens
acttatgatttcatgt

SEQ ID NO: 1305018 - DNA, 14 bp, Homo sapiens
acttcattcttgaa

SEQ ID NO: 1305019 - DNA, 21 bp, Homo sapiens
acttccaggtgttactgtaat

SEQ ID NO: 1305020 - DNA, 16 bp, Homo sapiens
acttctgggtggggca

SEQ ID NO: 1305021 - DNA, 17 bp, Homo sapiens
acttctgggtggggcag

SEQ ID NO: 1305022 - DNA, 23 bp, Homo sapiens
acttcttatggaattgatttgca

SEQ ID NO: 1305023 - DNA, 18 bp, Homo sapiens
acttgaagggccagagcc

SEQ ID NO: 1305024 - DNA, 20 bp, Homo sapiens
acttgaagggccagagccag

SEQ ID NO: 1305025 - DNA, 20 bp, Homo sapiens
acttgtgattatttattatt

SEQ ID NO: 1305026 - DNA, 15 bp, Homo sapiens
actttattaaataca

SEQ ID NO: 1305027 - DNA, 20 bp, Homo sapiens
actttattaaatacaaaact

SEQ ID NO: 1305028 - DNA, 17 bp, Homo sapiens
actttctacaatgtgaa

SEQ ID NO: 1305029 - DNA, 20 bp, Homo sapiens
actttgtcgcccaggctgga

SEQ ID NO: 1305030 - DNA, 13 bp, Homo sapiens
agaaaatgttatt

SEQ ID NO: 1305031 - DNA, 16 bp, Homo sapiens
agaaaatgttgagaat

SEQ ID NO: 1305032 - DNA, 17 bp, Homo sapiens
agaaaatgttgagaatc

SEQ ID NO: 1305033 - DNA, 13 bp, Homo sapiens
agaaaattcaatt

SEQ ID NO: 1305034 - DNA, 18 bp, Homo sapiens
agaaaattcaattgtaaa

SEQ ID NO: 1305035 - DNA, 15 bp, Homo sapiens
agaaacgtcttctaa

SEQ ID NO: 1305036 - DNA, 21 bp, Homo sapiens
agaaacgtcttctaaacttcc

SEQ ID NO: 1305037 - DNA, 15 bp, Homo sapiens
agaaagtgtgcttta

SEQ ID NO: 1305038 - DNA, 22 bp, Homo sapiens
agaaagtgtgctttatgctgaa

SEQ ID NO: 1305039 - DNA, 13 bp, Homo sapiens
agaacatgtgaga

SEQ ID NO: 1305040 - DNA, 12 bp, Homo sapiens
agaactaaactc

SEQ ID NO: 1305041 - DNA, 16 bp, Homo sapiens
agaactaaactcattt

SEQ ID NO: 1305042 - DNA, 23 bp, Homo sapiens
agaactacaaacaaaatttctat

SEQ ID NO: 1305043 - DNA, 20 bp, Homo sapiens
agaactcaaatggggccaga

SEQ ID NO: 1305044 - DNA, 20 bp, Homo sapiens
agaactgtgtttcaagttca

SEQ ID NO: 1305045 - DNA, 18 bp, Homo sapiens
agaactttcatttttttc

SEQ ID NO: 1305046 - DNA, 20 bp, Homo sapiens
agaagaactgtgtttcaagt

SEQ ID NO: 1305047 - DNA, 13 bp, Homo sapiens
agaagccaggaat

SEQ ID NO: 1305048 - DNA, 18 bp, Homo sapiens
agaagcccaatattataa

SEQ ID NO: 1305049 - DNA, 21 bp, Homo sapiens
agaagcccaatattataattt

SEQ ID NO: 1305050 - DNA, 17 bp, Homo sapiens
agaagcccccagctaag

SEQ ID NO: 1305051 - DNA, 24 bp, Homo sapiens
agaagcccccagctaagaacctgg

SEQ ID NO: 1305052 - DNA, 18 bp, Homo sapiens
agaagctcctctccccag

SEQ ID NO: 1305053 - DNA, 23 bp, Homo sapiens
agaagctcctctccccagcccag

SEQ ID NO: 1305054 - DNA, 22 bp, Homo sapiens
agaagcttttgaataaaaactt

SEQ ID NO: 1305055 - DNA, 19 bp, Homo sapiens
agaatagccacatttggaa

SEQ ID NO: 1305056 - DNA, 11 bp, Homo sapiens
agaatatttat

SEQ ID NO: 1305057 - DNA, 17 bp, Homo sapiens
agaatcccaaatttgat

SEQ ID NO: 1305058 - DNA, 18 bp, Homo sapiens
agaatcccaaatttgatt

SEQ ID NO: 1305059 - DNA, 13 bp, Homo sapiens
agaatgctgtaca

SEQ ID NO: 1305060 - DNA, 20 bp, Homo sapiens
agaatgctgtacatctattt

SEQ ID NO: 1305061 - DNA, 16 bp, Homo sapiens
agaatgtaagaactac

SEQ ID NO: 1305062 - DNA, 21 bp, Homo sapiens
agaatttattcaattcctctg

SEQ ID NO: 1305063 - DNA, 14 bp, Homo sapiens
agacacatatgagg

SEQ ID NO: 1305064 - DNA, 16 bp, Homo sapiens
agacacatatgagggg

SEQ ID NO: 1305065 - DNA, 15 bp, Homo sapiens
agacacccaggactt

SEQ ID NO: 1305066 - DNA, 21 bp, Homo sapiens
agacaccctcaacctcttctg

SEQ ID NO: 1305067 - DNA, 21 bp, Homo sapiens
agacacggagcccagccctcc

SEQ ID NO: 1305068 - DNA, 23 bp, Homo sapiens
agacactccccgaagtcttttgt

SEQ ID NO: 1305069 - DNA, 14 bp, Homo sapiens
agacatacttgaag

SEQ ID NO: 1305070 - DNA, 22 bp, Homo sapiens
agacatgatttccttgaatgtg

SEQ ID NO: 1305071 - DNA, 16 bp, Homo sapiens
agaccaccacttcgaa

SEQ ID NO: 1305072 - DNA, 19 bp, Homo sapiens
agacctgatcctggaggcc

SEQ ID NO: 1305073 - DNA, 20 bp, Homo sapiens
agactcacaacctgaaccta

SEQ ID NO: 1305074 - DNA, 19 bp, Homo sapiens
agactcccattcctgaaga

SEQ ID NO: 1305075 - DNA, 23 bp, Homo sapiens
agactcccattcctgaagaacca

SEQ ID NO: 1305076 - DNA, 18 bp, Homo sapiens
agactcgagaactttcat

SEQ ID NO: 1305077 - DNA, 19 bp, Homo sapiens
agactggaagctaatttgc

SEQ ID NO: 1305078 - DNA, 19 bp, Homo sapiens
agagaaaggggagcccact

SEQ ID NO: 1305079 - DNA, 17 bp, Homo sapiens
agagacatacttgaagg

SEQ ID NO: 1305080 - DNA, 23 bp, Homo sapiens
agagacatacttgaagggccaga

SEQ ID NO: 1305081 - DNA, 18 bp, Homo sapiens
agagagggaggcaagccc

SEQ ID NO: 1305082 - DNA, 12 bp, Homo sapiens
agagcccagctc

SEQ ID NO: 1305083 - DNA, 16 bp, Homo sapiens
agagcctggtgctgct

SEQ ID NO: 1305084 - DNA, 18 bp, Homo sapiens
agagcctggtgctgctgc

SEQ ID NO: 1305085 - DNA, 15 bp, Homo sapiens
agaggaccggcggct

SEQ ID NO: 1305086 - DNA, 12 bp, Homo sapiens
agaggccccagc

SEQ ID NO: 1305087 - DNA, 13 bp, Homo sapiens
agaggccccagcc

SEQ ID NO: 1305088 - DNA, 14 bp, Homo sapiens
agaggccccagcct

SEQ ID NO: 1305089 - DNA, 16 bp, Homo sapiens
agaggccccagcctcc

SEQ ID NO: 1305090 - DNA, 23 bp, Homo sapiens
agaggccccagcctccctgaagc

SEQ ID NO: 1305091 - DNA, 19 bp, Homo sapiens
agaggctaaattactcagg

SEQ ID NO: 1305092 - DNA, 21 bp, Homo sapiens
agaggctaaattactcaggaa

SEQ ID NO: 1305093 - DNA, 21 bp, Homo sapiens
agaggctgaggctggcacagg

SEQ ID NO: 1305094 - DNA, 16 bp, Homo sapiens
agagggaggcaagccc

SEQ ID NO: 1305095 - DNA, 16 bp, Homo sapiens
agagggaggggcctag

SEQ ID NO: 1305096 - DNA, 18 bp, Homo sapiens
agagggaggggcctaggc

SEQ ID NO: 1305097 - DNA, 13 bp, Homo sapiens
agataactaggaa

SEQ ID NO: 1305098 - DNA, 15 bp, Homo sapiens
agatcagtgtaccat

SEQ ID NO: 1305099 - DNA, 18 bp, Homo sapiens
agatcagtgtaccatttg

SEQ ID NO: 1305100 - DNA, 13 bp, Homo sapiens
agatccagcctgg

SEQ ID NO: 1305101 - DNA, 14 bp, Homo sapiens
agatccagcctggg

SEQ ID NO: 1305102 - DNA, 22 bp, Homo sapiens
agatccagggacagaggcccca

SEQ ID NO: 1305103 - DNA, 21 bp, Homo sapiens
agatctgacatgattccttcc

SEQ ID NO: 1305104 - DNA, 23 bp, Homo sapiens
agatctgacatgattccttcctg

SEQ ID NO: 1305105 - DNA, 19 bp, Homo sapiens
agatctggaacctcagcct

SEQ ID NO: 1305106 - DNA, 14 bp, Homo sapiens
agatctgtcctcag

SEQ ID NO: 1305107 - DNA, 19 bp, Homo sapiens
agatctgtcctcagccttg

SEQ ID NO: 1305108 - DNA, 13 bp, Homo sapiens
agatgcagggcag

SEQ ID NO: 1305109 - DNA, 23 bp, Homo sapiens
agatgctggcccagggcccagag

SEQ ID NO: 1305110 - DNA, 14 bp, Homo sapiens
agatggctcctctc

SEQ ID NO: 1305111 - DNA, 20 bp, Homo sapiens
agattatggagcttttttcc

SEQ ID NO: 1305112 - DNA, 14 bp, Homo sapiens
agattggctcacac

SEQ ID NO: 1305113 - DNA, 19 bp, Homo sapiens
agattggctcacactgaga

SEQ ID NO: 1305114 - DNA, 19 bp, Homo sapiens
agatttcatctgctctcct

SEQ ID NO: 1305115 - DNA, 23 bp, Homo sapiens
agatttccagtctccaccaggaa

SEQ ID NO: 1305116 - DNA, 19 bp, Homo sapiens
agattttaatcaagttgaa

SEQ ID NO: 1305117 - DNA, 17 bp, Homo sapiens
agattttaattttgaat

SEQ ID NO: 1305118 - DNA, 12 bp, Homo sapiens
agcaaaacaaaa

SEQ ID NO: 1305119 - DNA, 16 bp, Homo sapiens
agcaaccccaggctga

SEQ ID NO: 1305120 - DNA, 16 bp, Homo sapiens
agcaactcttgattat

SEQ ID NO: 1305121 - DNA, 14 bp, Homo sapiens
agcacacagggcag

SEQ ID NO: 1305122 - DNA, 16 bp, Homo sapiens
agcaccgttctgtgca

SEQ ID NO: 1305123 - DNA, 18 bp, Homo sapiens
agcaccgttctgtgcaca

SEQ ID NO: 1305124 - DNA, 10 bp, Homo sapiens
agcactgagg

SEQ ID NO: 1305125 - DNA, 11 bp, Homo sapiens
agcactgagga

SEQ ID NO: 1305126 - DNA, 21 bp, Homo sapiens
agcactgaggaagaacggggc

SEQ ID NO: 1305127 - DNA, 15 bp, Homo sapiens
agcacttatttaatg

SEQ ID NO: 1305128 - DNA, 22 bp, Homo sapiens
agcactttctacaatgtgaact

SEQ ID NO: 1305129 - DNA, 12 bp, Homo sapiens
agcagacaggcc

SEQ ID NO: 1305130 - DNA, 12 bp, Homo sapiens
agcagaggaggg

SEQ ID NO: 1305131 - DNA, 19 bp, Homo sapiens
agcagcctgagcaactctt

SEQ ID NO: 1305132 - DNA, 16 bp, Homo sapiens
agcagcctttaatgca

SEQ ID NO: 1305133 - DNA, 18 bp, Homo sapiens
agcagcctttaatgcatc

SEQ ID NO: 1305134 - DNA, 14 bp, Homo sapiens
agcagcgcctttcc

SEQ ID NO: 1305135 - DNA, 16 bp, Homo sapiens
agcaggttcccaagct

SEQ ID NO: 1305136 - DNA, 18 bp, Homo sapiens
agcagttttcaagtcaaa

SEQ ID NO: 1305137 - DNA, 14 bp, Homo sapiens
agcattccttttga

SEQ ID NO: 1305138 - DNA, 15 bp, Homo sapiens
agccaaatggtttaa

SEQ ID NO: 1305139 - DNA, 18 bp, Homo sapiens
agccaacagaagcttcca

SEQ ID NO: 1305140 - DNA, 18 bp, Homo sapiens
agccaattcagacaggca

SEQ ID NO: 1305141 - DNA, 14 bp, Homo sapiens
agccacaggcctga

SEQ ID NO: 1305142 - DNA, 16 bp, Homo sapiens
agccacaggcctgaga

SEQ ID NO: 1305143 - DNA, 23 bp, Homo sapiens
agccacatttggaatactttttg

SEQ ID NO: 1305144 - DNA, 20 bp, Homo sapiens
agccaccgaagccgcctgtg

SEQ ID NO: 1305145 - DNA, 13 bp, Homo sapiens
agccagcacacag

SEQ ID NO: 1305146 - DNA, 17 bp, Homo sapiens
agccagcacacagggca

SEQ ID NO: 1305147 - DNA, 19 bp, Homo sapiens
agccagcacacagggcagt

SEQ ID NO: 1305148 - DNA, 17 bp, Homo sapiens
agccagctccctctatt

SEQ ID NO: 1305149 - DNA, 17 bp, Homo sapiens
agccaggaatttcccag

SEQ ID NO: 1305150 - DNA, 20 bp, Homo sapiens
agccaggaatttcccaggac

SEQ ID NO: 1305151 - DNA, 15 bp, Homo sapiens
agccatcaaaatgct

SEQ ID NO: 1305152 - DNA, 16 bp, Homo sapiens
agcccaagggatctgg

SEQ ID NO: 1305153 - DNA, 22 bp, Homo sapiens
agcccaagggatctggtcctac

SEQ ID NO: 1305154 - DNA, 14 bp, Homo sapiens
agcccactgtcctg

SEQ ID NO: 1305155 - DNA, 18 bp, Homo sapiens
agcccactgtcctgggcc

SEQ ID NO: 1305156 - DNA, 21 bp, Homo sapiens
agcccagagacatacttgaag

SEQ ID NO: 1305157 - DNA, 12 bp, Homo sapiens
agcccagaggag

SEQ ID NO: 1305158 - DNA, 16 bp, Homo sapiens
agcccagaggagggca

SEQ ID NO: 1305159 - DNA, 20 bp, Homo sapiens
agcccccagctaagaacctg

SEQ ID NO: 1305160 - DNA, 14 bp, Homo sapiens
agccccctggcctc

SEQ ID NO: 1305161 - DNA, 19 bp, Homo sapiens
agccccctggcctctgtgc

SEQ ID NO: 1305162 - DNA, 23 bp, Homo sapiens
agcccctgtctagagagggaggc

SEQ ID NO: 1305163 - DNA, 15 bp, Homo sapiens
agccccttctgctca

SEQ ID NO: 1305164 - DNA, 22 bp, Homo sapiens
agccctcacccctggttctcat

SEQ ID NO: 1305165 - DNA, 23 bp, Homo sapiens
agccctcacccctggttctcatc

SEQ ID NO: 1305166 - DNA, 15 bp, Homo sapiens
agccctgaccctgtg

SEQ ID NO: 1305167 - DNA, 21 bp, Homo sapiens
agccctgttgacacaggtctt

SEQ ID NO: 1305168 - DNA, 23 bp, Homo sapiens
agccctgttgacacaggtctttc

SEQ ID NO: 1305169 - DNA, 13 bp, Homo sapiens
agcctctgctccc

SEQ ID NO: 1305170 - DNA, 15 bp, Homo sapiens
agcctctgctcccca

SEQ ID NO: 1305171 - DNA, 21 bp, Homo sapiens
agcctgagcaactcttgatta

SEQ ID NO: 1305172 - DNA, 19 bp, Homo sapiens
agcctgagtcacctgcaga

SEQ ID NO: 1305173 - DNA, 15 bp, Homo sapiens
agcctggccagacac

SEQ ID NO: 1305174 - DNA, 18 bp, Homo sapiens
agcctggccagacacagg

SEQ ID NO: 1305175 - DNA, 19 bp, Homo sapiens
agcctggggtggggtcatg

SEQ ID NO: 1305176 - DNA, 23 bp, Homo sapiens
agcctggggtggggtcatgccct

SEQ ID NO: 1305177 - DNA, 14 bp, Homo sapiens
agcctggtgctgct

SEQ ID NO: 1305178 - DNA, 15 bp, Homo sapiens
agcctggtgctgctg

SEQ ID NO: 1305179 - DNA, 16 bp, Homo sapiens
agcctggtgctgctgc

SEQ ID NO: 1305180 - DNA, 18 bp, Homo sapiens
agcctttggttctggcca

SEQ ID NO: 1305181 - DNA, 22 bp, Homo sapiens
agcggtgctgtcctcaggtggc

SEQ ID NO: 1305182 - DNA, 13 bp, Homo sapiens
agctaagaacctg

SEQ ID NO: 1305183 - DNA, 22 bp, Homo sapiens
agctaatttgcattaaattcac

SEQ ID NO: 1305184 - DNA, 23 bp, Homo sapiens
agctactgtgtgtgtgaatgaac

SEQ ID NO: 1305185 - DNA, 23 bp, Homo sapiens
agctataaattcctctttgcttt

SEQ ID NO: 1305186 - DNA, 19 bp, Homo sapiens
agctcagaggcgcactgtg

SEQ ID NO: 1305187 - DNA, 13 bp, Homo sapiens
agctcaggacaga

SEQ ID NO: 1305188 - DNA, 18 bp, Homo sapiens
agctccaacctgcaaaga

SEQ ID NO: 1305189 - DNA, 17 bp, Homo sapiens
agctccaccctggccga

SEQ ID NO: 1305190 - DNA, 20 bp, Homo sapiens
agctccccgcttctgcctgc

SEQ ID NO: 1305191 - DNA, 17 bp, Homo sapiens
agctcctcctccctgca

SEQ ID NO: 1305192 - DNA, 21 bp, Homo sapiens
agctcctcctccctgcatctg

SEQ ID NO: 1305193 - DNA, 19 bp, Homo sapiens
agctcctctccccagccca

SEQ ID NO: 1305194 - DNA, 17 bp, Homo sapiens
agctctcggaactgcat

SEQ ID NO: 1305195 - DNA, 18 bp, Homo sapiens
agctctcggaactgcatg

SEQ ID NO: 1305196 - DNA, 23 bp, Homo sapiens
agctctcggaactgcatgctgct

SEQ ID NO: 1305197 - DNA, 12 bp, Homo sapiens
agctctttcctc

SEQ ID NO: 1305198 - DNA, 16 bp, Homo sapiens
agctgacccagcccct

SEQ ID NO: 1305199 - DNA, 17 bp, Homo sapiens
agctgagcgccaggatg

SEQ ID NO: 1305200 - DNA, 13 bp, Homo sapiens
agctgcaaaggac

SEQ ID NO: 1305201 - DNA, 15 bp, Homo sapiens
agctgcaaaggacag

SEQ ID NO: 1305202 - DNA, 16 bp, Homo sapiens
agctgcaaaggacaga

SEQ ID NO: 1305203 - DNA, 19 bp, Homo sapiens
agctgcactgatgctgccc

SEQ ID NO: 1305204 - DNA, 19 bp, Homo sapiens
agctgccttggctcagaca

SEQ ID NO: 1305205 - DNA, 19 bp, Homo sapiens
agctgctcctagagggagg

SEQ ID NO: 1305206 - DNA, 20 bp, Homo sapiens
agctgctcctagagggaggg

SEQ ID NO: 1305207 - DNA, 22 bp, Homo sapiens
agctgctcctagagggaggggc

SEQ ID NO: 1305208 - DNA, 22 bp, Homo sapiens
agctggccgcgccaaataatgt

SEQ ID NO: 1305209 - DNA, 22 bp, Homo sapiens
agctggggatccctccccccca

SEQ ID NO: 1305210 - DNA, 14 bp, Homo sapiens
agctgggtcaggca

SEQ ID NO: 1305211 - DNA, 20 bp, Homo sapiens
agctggtaatcttgctctgc

SEQ ID NO: 1305212 - DNA, 12 bp, Homo sapiens
agcttctcctgt

SEQ ID NO: 1305213 - DNA, 13 bp, Homo sapiens
agcttctctgtga

SEQ ID NO: 1305214 - DNA, 21 bp, Homo sapiens
agcttttttccttaatccagc

SEQ ID NO: 1305215 - DNA, 14 bp, Homo sapiens
aggaaaaacaggtc

SEQ ID NO: 1305216 - DNA, 15 bp, Homo sapiens
aggaagccaaagagt

SEQ ID NO: 1305217 - DNA, 18 bp, Homo sapiens
aggaatttcccaggaccc

SEQ ID NO: 1305218 - DNA, 20 bp, Homo sapiens
aggaatttcccaggaccctg

SEQ ID NO: 1305219 - DNA, 13 bp, Homo sapiens
aggacataatggg

SEQ ID NO: 1305220 - DNA, 15 bp, Homo sapiens
aggacataatggggt

SEQ ID NO: 1305221 - DNA, 22 bp, Homo sapiens
aggacatgcggtagccagcaca

SEQ ID NO: 1305222 - DNA, 16 bp, Homo sapiens
aggacctggctgccat

SEQ ID NO: 1305223 - DNA, 18 bp, Homo sapiens
aggaccttcgggctgtgc

SEQ ID NO: 1305224 - DNA, 20 bp, Homo sapiens
aggacgaacatccaaccttc

SEQ ID NO: 1305225 - DNA, 12 bp, Homo sapiens
aggactgggcca

SEQ ID NO: 1305226 - DNA, 11 bp, Homo sapiens
aggagaagcca

SEQ ID NO: 1305227 - DNA, 14 bp, Homo sapiens
aggagaagccagga

SEQ ID NO: 1305228 - DNA, 15 bp, Homo sapiens
aggagaagccaggaa

SEQ ID NO: 1305229 - DNA, 12 bp, Homo sapiens
aggagctgggga

SEQ ID NO: 1305230 - DNA, 13 bp, Homo sapiens
aggaggggccgct

SEQ ID NO: 1305231 - DNA, 14 bp, Homo sapiens
aggatagatgctgg

SEQ ID NO: 1305232 - DNA, 20 bp, Homo sapiens
aggatagatgctggcccagg

SEQ ID NO: 1305233 - DNA, 22 bp, Homo sapiens
aggatagatgctggcccagggc

SEQ ID NO: 1305234 - DNA, 19 bp, Homo sapiens
aggatggaacacggccaca

SEQ ID NO: 1305235 - DNA, 19 bp, Homo sapiens
aggcaaaattgcaaatctt

SEQ ID NO: 1305236 - DNA, 20 bp, Homo sapiens
aggcacctcacaggccccag

SEQ ID NO: 1305237 - DNA, 22 bp, Homo sapiens
aggcactttagggctgtaaaat

SEQ ID NO: 1305238 - DNA, 11 bp, Homo sapiens
aggcagatcca

SEQ ID NO: 1305239 - DNA, 17 bp, Homo sapiens
aggcagatccaggacta

SEQ ID NO: 1305240 - DNA, 14 bp, Homo sapiens
aggcagggtgcagt

SEQ ID NO: 1305241 - DNA, 12 bp, Homo sapiens
aggcatttccta

SEQ ID NO: 1305242 - DNA, 21 bp, Homo sapiens
aggccaagaaacgtcttctaa

SEQ ID NO: 1305243 - DNA, 17 bp, Homo sapiens
aggccacactcagcaca

SEQ ID NO: 1305244 - DNA, 13 bp, Homo sapiens
aggccccagcctc

SEQ ID NO: 1305245 - DNA, 21 bp, Homo sapiens
aggcccctatgtagtccgtgc

SEQ ID NO: 1305246 - DNA, 22 bp, Homo sapiens
aggccctccctgttccccagag

SEQ ID NO: 1305247 - DNA, 13 bp, Homo sapiens
aggccctctggag

SEQ ID NO: 1305248 - DNA, 22 bp, Homo sapiens
aggccctctggagtggccacta

SEQ ID NO: 1305249 - DNA, 22 bp, Homo sapiens
aggcctgagatttcatctgctc

SEQ ID NO: 1305250 - DNA, 19 bp, Homo sapiens
aggcctgagcgctcctgcc

SEQ ID NO: 1305251 - DNA, 17 bp, Homo sapiens
aggcctgcctccagggc

SEQ ID NO: 1305252 - DNA, 19 bp, Homo sapiens
aggcctgcctccagggctg

SEQ ID NO: 1305253 - DNA, 21 bp, Homo sapiens
aggcgcactgtgacccccagc

SEQ ID NO: 1305254 - DNA, 13 bp, Homo sapiens
aggctaaacatcc

SEQ ID NO: 1305255 - DNA, 19 bp, Homo sapiens
aggctaaattactcaggaa

SEQ ID NO: 1305256 - DNA, 13 bp, Homo sapiens
aggctgaccacag

SEQ ID NO: 1305257 - DNA, 17 bp, Homo sapiens
aggctgaccacagcaca

SEQ ID NO: 1305258 - DNA, 18 bp, Homo sapiens
aggctgaccacagcacag

SEQ ID NO: 1305259 - DNA, 14 bp, Homo sapiens
aggctgaggctggc

SEQ ID NO: 1305260 - DNA, 16 bp, Homo sapiens
aggctgaggctggcac

SEQ ID NO: 1305261 - DNA, 17 bp, Homo sapiens
aggctgaggctggcaca

SEQ ID NO: 1305262 - DNA, 14 bp, Homo sapiens
aggctgcttagaat

SEQ ID NO: 1305263 - DNA, 22 bp, Homo sapiens
aggctgcttagaatccaaactt

SEQ ID NO: 1305264 - DNA, 18 bp, Homo sapiens
aggctggcacaggacatg

SEQ ID NO: 1305265 - DNA, 19 bp, Homo sapiens
aggctggctccagatgcag

SEQ ID NO: 1305266 - DNA, 20 bp, Homo sapiens
aggctgttcccatgtagccc

SEQ ID NO: 1305267 - DNA, 16 bp, Homo sapiens
agggacagaggcccca

SEQ ID NO: 1305268 - DNA, 21 bp, Homo sapiens
agggacagaggccccagcctc

SEQ ID NO: 1305269 - DNA, 22 bp, Homo sapiens
agggacagaggccccagcctcc

SEQ ID NO: 1305270 - DNA, 19 bp, Homo sapiens
agggagacccgtccatttg

SEQ ID NO: 1305271 - DNA, 18 bp, Homo sapiens
agggagcctttggttctg

SEQ ID NO: 1305272 - DNA, 22 bp, Homo sapiens
agggagcggccggccagcccct

SEQ ID NO: 1305273 - DNA, 13 bp, Homo sapiens
agggaggcaagcc

SEQ ID NO: 1305274 - DNA, 14 bp, Homo sapiens
agggaggcaagccc

SEQ ID NO: 1305275 - DNA, 20 bp, Homo sapiens
agggaggggcctaggcctca

SEQ ID NO: 1305276 - DNA, 22 bp, Homo sapiens
agggatcaaccagctaagaaaa

SEQ ID NO: 1305277 - DNA, 20 bp, Homo sapiens
agggatgccctggaggtggc

SEQ ID NO: 1305278 - DNA, 17 bp, Homo sapiens
agggcagcgccaggctg

SEQ ID NO: 1305279 - DNA, 17 bp, Homo sapiens
agggccaacccttctcc

SEQ ID NO: 1305280 - DNA, 21 bp, Homo sapiens
agggccaacccttctcctctt

SEQ ID NO: 1305281 - DNA, 16 bp, Homo sapiens
agggccagagccaggg

SEQ ID NO: 1305282 - DNA, 17 bp, Homo sapiens
agggcccagagcccagc

SEQ ID NO: 1305283 - DNA, 18 bp, Homo sapiens
agggcccagagcccagct

SEQ ID NO: 1305284 - DNA, 21 bp, Homo sapiens
agggcccagagcccagctcca

SEQ ID NO: 1305285 - DNA, 15 bp, Homo sapiens
agggctggactgagg

SEQ ID NO: 1305286 - DNA, 16 bp, Homo sapiens
agggctggactgaggc

SEQ ID NO: 1305287 - DNA, 15 bp, Homo sapiens
aggggaatcagaact

SEQ ID NO: 1305288 - DNA, 16 bp, Homo sapiens
aggggaatcagaactc

SEQ ID NO: 1305289 - DNA, 24 bp, Homo sapiens
aggggagcccactgtcctgggcct

SEQ ID NO: 1305290 - DNA, 21 bp, Homo sapiens
aggggcccggccagccatgtc

SEQ ID NO: 1305291 - DNA, 23 bp, Homo sapiens
aggggcccggccagccatgtctg

SEQ ID NO: 1305292 - DNA, 16 bp, Homo sapiens
aggggcctaggcctca

SEQ ID NO: 1305293 - DNA, 21 bp, Homo sapiens
agggggagccccttctgctca

SEQ ID NO: 1305294 - DNA, 20 bp, Homo sapiens
agggtgcagtatcatgccct

SEQ ID NO: 1305295 - DNA, 18 bp, Homo sapiens
aggtaatataaaaagctt

SEQ ID NO: 1305296 - DNA, 16 bp, Homo sapiens
aggtaatttcttgtgc

SEQ ID NO: 1305297 - DNA, 11 bp, Homo sapiens
aggtctttcct

SEQ ID NO: 1305298 - DNA, 22 bp, Homo sapiens
aggtgcaacaaggtcctctgtc

SEQ ID NO: 1305299 - DNA, 14 bp, Homo sapiens
aggtggctgagccc

SEQ ID NO: 1305300 - DNA, 19 bp, Homo sapiens
aggtggctgagcccctgtc

SEQ ID NO: 1305301 - DNA, 20 bp, Homo sapiens
aggtgtatggagagaaaaca

SEQ ID NO: 1305302 - DNA, 16 bp, Homo sapiens
aggtgttactgtaatt

SEQ ID NO: 1305303 - DNA, 18 bp, Homo sapiens
aggtttaggctggtggcc

SEQ ID NO: 1305304 - DNA, 20 bp, Homo sapiens
aggtttttattagtaccata

SEQ ID NO: 1305305 - DNA, 15 bp, Homo sapiens
agtaaatcttttaca

SEQ ID NO: 1305306 - DNA, 17 bp, Homo sapiens
agtaacatgaggggaca

SEQ ID NO: 1305307 - DNA, 17 bp, Homo sapiens
agtaacttcttatggaa

SEQ ID NO: 1305308 - DNA, 19 bp, Homo sapiens
agtaacttcttatggaatt

SEQ ID NO: 1305309 - DNA, 20 bp, Homo sapiens
agtaattgacatgtgccagg

SEQ ID NO: 1305310 - DNA, 23 bp, Homo sapiens
agtaccatagtaccatttataca

SEQ ID NO: 1305311 - DNA, 16 bp, Homo sapiens
agtataaacaaagtta

SEQ ID NO: 1305312 - DNA, 13 bp, Homo sapiens
agtatcactgtct

SEQ ID NO: 1305313 - DNA, 17 bp, Homo sapiens
agtatcactgtctttcc

SEQ ID NO: 1305314 - DNA, 19 bp, Homo sapiens
agtatcatgccctgtgcaa

SEQ ID NO: 1305315 - DNA, 17 bp, Homo sapiens
agtatttgggaagtgaa

SEQ ID NO: 1305316 - DNA, 21 bp, Homo sapiens
agtatttgggaagtgaagact

SEQ ID NO: 1305317 - DNA, 17 bp, Homo sapiens
agtcaaaactacaaatc

SEQ ID NO: 1305318 - DNA, 14 bp, Homo sapiens
agtcaaattaataa

SEQ ID NO: 1305319 - DNA, 15 bp, Homo sapiens
agtcaaattaataat

SEQ ID NO: 1305320 - DNA, 18 bp, Homo sapiens
agtcaaattaataatctt

SEQ ID NO: 1305321 - DNA, 13 bp, Homo sapiens
agtcaagctcctc

SEQ ID NO: 1305322 - DNA, 14 bp, Homo sapiens
agtcaagctcctcc

SEQ ID NO: 1305323 - DNA, 15 bp, Homo sapiens
agtcaagctcctcct

SEQ ID NO: 1305324 - DNA, 17 bp, Homo sapiens
agtcaagctcctcctcc

SEQ ID NO: 1305325 - DNA, 21 bp, Homo sapiens
agtcctttttttccatcttta

SEQ ID NO: 1305326 - DNA, 17 bp, Homo sapiens
agtctcttgtattaaac

SEQ ID NO: 1305327 - DNA, 22 bp, Homo sapiens
agtcttttgttcgcatggtcac

SEQ ID NO: 1305328 - DNA, 22 bp, Homo sapiens
agtgagcggtgctgtcctcagg

SEQ ID NO: 1305329 - DNA, 14 bp, Homo sapiens
agtgattactgtca

SEQ ID NO: 1305330 - DNA, 19 bp, Homo sapiens
agtgccccattcttttgta

SEQ ID NO: 1305331 - DNA, 14 bp, Homo sapiens
agtgcccccactga

SEQ ID NO: 1305332 - DNA, 16 bp, Homo sapiens
agtgcccccactgacc

SEQ ID NO: 1305333 - DNA, 16 bp, Homo sapiens
agtgccttctaaaggt

SEQ ID NO: 1305334 - DNA, 17 bp, Homo sapiens
agtggaccttaggcctt

SEQ ID NO: 1305335 - DNA, 19 bp, Homo sapiens
agtggaccttaggccttcc

SEQ ID NO: 1305336 - DNA, 17 bp, Homo sapiens
agtggaggcactttagg

SEQ ID NO: 1305337 - DNA, 22 bp, Homo sapiens
agtggccactaagcagaggagg

SEQ ID NO: 1305338 - DNA, 18 bp, Homo sapiens
agtggtggtaaccctggt

SEQ ID NO: 1305339 - DNA, 15 bp, Homo sapiens
agtggtgtgatctca

SEQ ID NO: 1305340 - DNA, 16 bp, Homo sapiens
agtgtaccatttgcct

SEQ ID NO: 1305341 - DNA, 17 bp, Homo sapiens
agtgttctgcaaaaata

SEQ ID NO: 1305342 - DNA, 22 bp, Homo sapiens
agttacagcctgttagtaacat

SEQ ID NO: 1305343 - DNA, 22 bp, Homo sapiens
agttactaggtaacttcatatt

SEQ ID NO: 1305344 - DNA, 15 bp, Homo sapiens
agttctttgggccag

SEQ ID NO: 1305345 - DNA, 18 bp, Homo sapiens
agttctttgggccagaca

SEQ ID NO: 1305346 - DNA, 23 bp, Homo sapiens
agttgaattgaggggattaatat

SEQ ID NO: 1305347 - DNA, 13 bp, Homo sapiens
agttgatctggaa

SEQ ID NO: 1305348 - DNA, 18 bp, Homo sapiens
agttgatctggaacccag

SEQ ID NO: 1305349 - DNA, 20 bp, Homo sapiens
agttgatctggaacccagac

SEQ ID NO: 1305350 - DNA, 16 bp, Homo sapiens
agttggccagagagcc

SEQ ID NO: 1305351 - DNA, 12 bp, Homo sapiens
agtttaaaaaaa

SEQ ID NO: 1305352 - DNA, 14 bp, Homo sapiens
agtttaaaaaaatt

SEQ ID NO: 1305353 - DNA, 14 bp, Homo sapiens
agtttgcttagaaa

SEQ ID NO: 1305354 - DNA, 22 bp, Homo sapiens
agttttcaagtcaaattaataa

SEQ ID NO: 1305355 - DNA, 13 bp, Homo sapiens
ataaaaagcaaaa

SEQ ID NO: 1305356 - DNA, 13 bp, Homo sapiens
ataaaaataaatt

SEQ ID NO: 1305357 - DNA, 15 bp, Homo sapiens
ataaaaggaagccaa

SEQ ID NO: 1305358 - DNA, 14 bp, Homo sapiens
ataaagccctggga

SEQ ID NO: 1305359 - DNA, 13 bp, Homo sapiens
ataaaggatgtga

SEQ ID NO: 1305360 - DNA, 22 bp, Homo sapiens
ataaaggatgtgattgtggaat

SEQ ID NO: 1305361 - DNA, 12 bp, Homo sapiens
ataaagtttgct

SEQ ID NO: 1305362 - DNA, 16 bp, Homo sapiens
ataaatctgacccagt

SEQ ID NO: 1305363 - DNA, 19 bp, Homo sapiens
ataaatctgacccagtgcc

SEQ ID NO: 1305364 - DNA, 15 bp, Homo sapiens
ataaatgtatcttat

SEQ ID NO: 1305365 - DNA, 20 bp, Homo sapiens
ataaattcctctttgctttg

SEQ ID NO: 1305366 - DNA, 21 bp, Homo sapiens
ataaattcctctttgctttgc

SEQ ID NO: 1305367 - DNA, 19 bp, Homo sapiens
ataactagatggtgctgag

SEQ ID NO: 1305368 - DNA, 23 bp, Homo sapiens
ataatcttattagggagaaaatt

SEQ ID NO: 1305369 - DNA, 15 bp, Homo sapiens
ataatgtctctgtga

SEQ ID NO: 1305370 - DNA, 14 bp, Homo sapiens
atacaaattagaaa

SEQ ID NO: 1305371 - DNA, 17 bp, Homo sapiens
atacaccagcattcctt

SEQ ID NO: 1305372 - DNA, 15 bp, Homo sapiens
atacatacaccagca

SEQ ID NO: 1305373 - DNA, 16 bp, Homo sapiens
atacatatctttatta

SEQ ID NO: 1305374 - DNA, 15 bp, Homo sapiens
atactaccttgaaaa

SEQ ID NO: 1305375 - DNA, 23 bp, Homo sapiens
atactctttctgtatatactttt

SEQ ID NO: 1305376 - DNA, 16 bp, Homo sapiens
atacttgaagggccag

SEQ ID NO: 1305377 - DNA, 17 bp, Homo sapiens
atacttgaagggccaga

SEQ ID NO: 1305378 - DNA, 23 bp, Homo sapiens
atacttgaagggccagagccagg

SEQ ID NO: 1305379 - DNA, 13 bp, Homo sapiens
atactttttacaa

SEQ ID NO: 1305380 - DNA, 12 bp, Homo sapiens
atagaatattta

SEQ ID NO: 1305381 - DNA, 19 bp, Homo sapiens
atagaggctaaattactca

SEQ ID NO: 1305382 - DNA, 11 bp, Homo sapiens
atagcactttc

SEQ ID NO: 1305383 - DNA, 14 bp, Homo sapiens
atagcagattttaa

SEQ ID NO: 1305384 - DNA, 19 bp, Homo sapiens
atagcatgacatttctttg

SEQ ID NO: 1305385 - DNA, 13 bp, Homo sapiens
atagccacatttg

SEQ ID NO: 1305386 - DNA, 16 bp, Homo sapiens
atagccacatttggaa

SEQ ID NO: 1305387 - DNA, 23 bp, Homo sapiens
atagccacatttggaatactttt

SEQ ID NO: 1305388 - DNA, 23 bp, Homo sapiens
atagctccccgcttctgcctgca

SEQ ID NO: 1305389 - DNA, 19 bp, Homo sapiens
atagtaacttcttatggaa

SEQ ID NO: 1305390 - DNA, 21 bp, Homo sapiens
atagtaacttcttatggaatt

SEQ ID NO: 1305391 - DNA, 14 bp, Homo sapiens
atagtaccatttat

SEQ ID NO: 1305392 - DNA, 21 bp, Homo sapiens
atagtaccatttatacaaatt

SEQ ID NO: 1305393 - DNA, 22 bp, Homo sapiens
atatactctagatgaagtttta

SEQ ID NO: 1305394 - DNA, 11 bp, Homo sapiens
atatacttttt

SEQ ID NO: 1305395 - DNA, 12 bp, Homo sapiens
atatatttaaaa

SEQ ID NO: 1305396 - DNA, 18 bp, Homo sapiens
atatccattctttctgat

SEQ ID NO: 1305397 - DNA, 13 bp, Homo sapiens
atatctttattaa

SEQ ID NO: 1305398 - DNA, 19 bp, Homo sapiens
atatggaacttacattgtt

SEQ ID NO: 1305399 - DNA, 15 bp, Homo sapiens
atatggacacttaat

SEQ ID NO: 1305400 - DNA, 23 bp, Homo sapiens
atatggccacagtagtcttgatg

SEQ ID NO: 1305401 - DNA, 15 bp, Homo sapiens
atatgttgaatactt

SEQ ID NO: 1305402 - DNA, 13 bp, Homo sapiens
atattaaatctgc

SEQ ID NO: 1305403 - DNA, 17 bp, Homo sapiens
atattgagtcaaatggt

SEQ ID NO: 1305404 - DNA, 22 bp, Homo sapiens
atattgctgagagaaatatgga

SEQ ID NO: 1305405 - DNA, 20 bp, Homo sapiens
atatttgtgatagcactttc

SEQ ID NO: 1305406 - DNA, 21 bp, Homo sapiens
atatttgtgatagcactttct

SEQ ID NO: 1305407 - DNA, 22 bp, Homo sapiens
atcaaaatgctttttatttctg

SEQ ID NO: 1305408 - DNA, 15 bp, Homo sapiens
atcaagttgaattga

SEQ ID NO: 1305409 - DNA, 22 bp, Homo sapiens
atcacctatttccattcaacaa

SEQ ID NO: 1305410 - DNA, 12 bp, Homo sapiens
atcactgtcttt

SEQ ID NO: 1305411 - DNA, 14 bp, Homo sapiens
atcactgtctttcc

SEQ ID NO: 1305412 - DNA, 18 bp, Homo sapiens
atcactgtctttcctaga

SEQ ID NO: 1305413 - DNA, 22 bp, Homo sapiens
atcagaatagccacatttggaa

SEQ ID NO: 1305414 - DNA, 18 bp, Homo sapiens
atcagtataaacaaagtt

SEQ ID NO: 1305415 - DNA, 13 bp, Homo sapiens
atcagtcaatatt

SEQ ID NO: 1305416 - DNA, 13 bp, Homo sapiens
atcatctgccgtg

SEQ ID NO: 1305417 - DNA, 19 bp, Homo sapiens
atcattagggggaactcta

SEQ ID NO: 1305418 - DNA, 19 bp, Homo sapiens
atccaatattttctttaat

SEQ ID NO: 1305419 - DNA, 12 bp, Homo sapiens
atccagcctggg

SEQ ID NO: 1305420 - DNA, 14 bp, Homo sapiens
atccaggcagatcc

SEQ ID NO: 1305421 - DNA, 12 bp, Homo sapiens
atccagggacag

SEQ ID NO: 1305422 - DNA, 14 bp, Homo sapiens
atccagggacagag

SEQ ID NO: 1305423 - DNA, 20 bp, Homo sapiens
atccatattgagtcaaatgg

SEQ ID NO: 1305424 - DNA, 13 bp, Homo sapiens
atccattctttct

SEQ ID NO: 1305425 - DNA, 22 bp, Homo sapiens
atcccagctacttgggaggctg

SEQ ID NO: 1305426 - DNA, 12 bp, Homo sapiens
atccccaataat

SEQ ID NO: 1305427 - DNA, 21 bp, Homo sapiens
atccccaataattgcagaact

SEQ ID NO: 1305428 - DNA, 22 bp, Homo sapiens
atccccgcagtgtgcactaagg

SEQ ID NO: 1305429 - DNA, 22 bp, Homo sapiens
atccctcccccccatgcactgt

SEQ ID NO: 1305430 - DNA, 22 bp, Homo sapiens
atccggcaacatcaacccgagt

SEQ ID NO: 1305431 - DNA, 15 bp, Homo sapiens
atcctccagcaggga

SEQ ID NO: 1305432 - DNA, 21 bp, Homo sapiens
atcctgaaatagaggctaaat

SEQ ID NO: 1305433 - DNA, 16 bp, Homo sapiens
atcctggaggcccagt

SEQ ID NO: 1305434 - DNA, 17 bp, Homo sapiens
atcctggaggcccagtt

SEQ ID NO: 1305435 - DNA, 15 bp, Homo sapiens
atctactaattccac

SEQ ID NO: 1305436 - DNA, 19 bp, Homo sapiens
atctagattatggagcttt

SEQ ID NO: 1305437 - DNA, 16 bp, Homo sapiens
atctcttagctcccct

SEQ ID NO: 1305438 - DNA, 18 bp, Homo sapiens
atctgacatgattccttc

SEQ ID NO: 1305439 - DNA, 18 bp, Homo sapiens
atctgacccagtgccccc

SEQ ID NO: 1305440 - DNA, 20 bp, Homo sapiens
atctgacccagtgcccccac

SEQ ID NO: 1305441 - DNA, 13 bp, Homo sapiens
atctgctctcctt

SEQ ID NO: 1305442 - DNA, 21 bp, Homo sapiens
atctgctctccttcctggagc

SEQ ID NO: 1305443 - DNA, 14 bp, Homo sapiens
atctggaacccaga

SEQ ID NO: 1305444 - DNA, 15 bp, Homo sapiens
atctggaacccagac

SEQ ID NO: 1305445 - DNA, 16 bp, Homo sapiens
atctggaacccagact

SEQ ID NO: 1305446 - DNA, 19 bp, Homo sapiens
atctggaacccagactcag

SEQ ID NO: 1305447 - DNA, 19 bp, Homo sapiens
atctggaacctcagcctgg

SEQ ID NO: 1305448 - DNA, 21 bp, Homo sapiens
atctggaacctcagcctggcc

SEQ ID NO: 1305449 - DNA, 20 bp, Homo sapiens
atctggagaccagggagcct

SEQ ID NO: 1305450 - DNA, 21 bp, Homo sapiens
atctggagaccagggagcctt

SEQ ID NO: 1305451 - DNA, 22 bp, Homo sapiens
atctggagaccagggagccttt

SEQ ID NO: 1305452 - DNA, 18 bp, Homo sapiens
atctggtcctacccatcc

SEQ ID NO: 1305453 - DNA, 16 bp, Homo sapiens
atctgtcctcagcctt

SEQ ID NO: 1305454 - DNA, 18 bp, Homo sapiens
atctgtcctcagccttgc

SEQ ID NO: 1305455 - DNA, 19 bp, Homo sapiens
atctgttttgaaggcaaaa

SEQ ID NO: 1305456 - DNA, 21 bp, Homo sapiens
atcttattagggagaaaattc

SEQ ID NO: 1305457 - DNA, 21 bp, Homo sapiens
atcttctaaacccaatccaaa

SEQ ID NO: 1305458 - DNA, 22 bp, Homo sapiens
atcttgaaattaagaaggcaaa

SEQ ID NO: 1305459 - DNA, 15 bp, Homo sapiens
atcttgctctgcttg

SEQ ID NO: 1305460 - DNA, 13 bp, Homo sapiens
atctttattaatc

SEQ ID NO: 1305461 - DNA, 18 bp, Homo sapiens
atctttcttgatcaacat

SEQ ID NO: 1305462 - DNA, 17 bp, Homo sapiens
atctttgattctccttc

SEQ ID NO: 1305463 - DNA, 20 bp, Homo sapiens
atctttgattctccttcagc

SEQ ID NO: 1305464 - DNA, 16 bp, Homo sapiens
atctttgtggccaagg

SEQ ID NO: 1305465 - DNA, 23 bp, Homo sapiens
atctttgtggccaaggagctgct

SEQ ID NO: 1305466 - DNA, 23 bp, Homo sapiens
atcttttcttgcctctgtcccct

SEQ ID NO: 1305467 - DNA, 14 bp, Homo sapiens
atgaagttttacat

SEQ ID NO: 1305468 - DNA, 17 bp, Homo sapiens
atgaatgtatttatttg

SEQ ID NO: 1305469 - DNA, 21 bp, Homo sapiens
atgacatttctttgtgctttg

SEQ ID NO: 1305470 - DNA, 13 bp, Homo sapiens
atgagaacaaaca

SEQ ID NO: 1305471 - DNA, 13 bp, Homo sapiens
atgatttccttga

SEQ ID NO: 1305472 - DNA, 19 bp, Homo sapiens
atgatttccttgaatgtgg

SEQ ID NO: 1305473 - DNA, 21 bp, Homo sapiens
atgatttccttgaatgtggct

SEQ ID NO: 1305474 - DNA, 13 bp, Homo sapiens
atgcaagggactg

SEQ ID NO: 1305475 - DNA, 19 bp, Homo sapiens
atgcagcagggatgccctg

SEQ ID NO: 1305476 - DNA, 17 bp, Homo sapiens
atgcatggtgccccagg

SEQ ID NO: 1305477 - DNA, 21 bp, Homo sapiens
atgcatggtgccccaggacca

SEQ ID NO: 1305478 - DNA, 19 bp, Homo sapiens
atgccacaaggacttcctg

SEQ ID NO: 1305479 - DNA, 16 bp, Homo sapiens
atgcccctggctggga

SEQ ID NO: 1305480 - DNA, 16 bp, Homo sapiens
atgccctggaggtggc

SEQ ID NO: 1305481 - DNA, 20 bp, Homo sapiens
atgcctcagccctgaccctg

SEQ ID NO: 1305482 - DNA, 15 bp, Homo sapiens
atgcggtagccagca

SEQ ID NO: 1305483 - DNA, 20 bp, Homo sapiens
atgcggtagccagcacacag

SEQ ID NO: 1305484 - DNA, 18 bp, Homo sapiens
atgctccttgttcctaga

SEQ ID NO: 1305485 - DNA, 17 bp, Homo sapiens
atgctctagtgccttct

SEQ ID NO: 1305486 - DNA, 19 bp, Homo sapiens
atgctgacattcacctgcc

SEQ ID NO: 1305487 - DNA, 13 bp, Homo sapiens
atgctgctggaca

SEQ ID NO: 1305488 - DNA, 13 bp, Homo sapiens
atgctggcccagg

SEQ ID NO: 1305489 - DNA, 16 bp, Homo sapiens
atgctggcccagggcc

SEQ ID NO: 1305490 - DNA, 22 bp, Homo sapiens
atgctggcccagggcccagagc

SEQ ID NO: 1305491 - DNA, 22 bp, Homo sapiens
atgctgtacatctattttggat

SEQ ID NO: 1305492 - DNA, 19 bp, Homo sapiens
atgctttttatttctgcat

SEQ ID NO: 1305493 - DNA, 15 bp, Homo sapiens
atggaattgatttgc

SEQ ID NO: 1305494 - DNA, 18 bp, Homo sapiens
atggagagaaaacagacc

SEQ ID NO: 1305495 - DNA, 13 bp, Homo sapiens
atggatgccaata

SEQ ID NO: 1305496 - DNA, 19 bp, Homo sapiens
atggatgggggaactcaga

SEQ ID NO: 1305497 - DNA, 24 bp, Homo sapiens
atggcaacagatctggaacctcag

SEQ ID NO: 1305498 - DNA, 22 bp, Homo sapiens
atggccacagtagtcttgatga

SEQ ID NO: 1305499 - DNA, 12 bp, Homo sapiens
atggctcctctc

SEQ ID NO: 1305500 - DNA, 16 bp, Homo sapiens
atggggtcctggccat

SEQ ID NO: 1305501 - DNA, 17 bp, Homo sapiens
atggtaggcatttccta

SEQ ID NO: 1305502 - DNA, 15 bp, Homo sapiens
atggtcacacactga

SEQ ID NO: 1305503 - DNA, 24 bp, Homo sapiens
atggtgaaaccccgtctctactaa

SEQ ID NO: 1305504 - DNA, 16 bp, Homo sapiens
atggtggcgcgcacct

SEQ ID NO: 1305505 - DNA, 18 bp, Homo sapiens
atgtagccccctggcctc

SEQ ID NO: 1305506 - DNA, 16 bp, Homo sapiens
atgtagtaattgacat

SEQ ID NO: 1305507 - DNA, 17 bp, Homo sapiens
atgtagtaattgacatg

SEQ ID NO: 1305508 - DNA, 21 bp, Homo sapiens
atgtctctgtgagactcgaga

SEQ ID NO: 1305509 - DNA, 16 bp, Homo sapiens
atgtgagaggtttgac

SEQ ID NO: 1305510 - DNA, 17 bp, Homo sapiens
atgtgagaggtttgact

SEQ ID NO: 1305511 - DNA, 17 bp, Homo sapiens
atgtgattgtggaatgg

SEQ ID NO: 1305512 - DNA, 22 bp, Homo sapiens
atgtgattgtggaatggagatt

SEQ ID NO: 1305513 - DNA, 16 bp, Homo sapiens
atgttgagaatcccaa

SEQ ID NO: 1305514 - DNA, 15 bp, Homo sapiens
atgtttccagacttc

SEQ ID NO: 1305515 - DNA, 13 bp, Homo sapiens
attaaagacagag

SEQ ID NO: 1305516 - DNA, 17 bp, Homo sapiens
attaaatacaaaacttc

SEQ ID NO: 1305517 - DNA, 19 bp, Homo sapiens
attaaatacaaaacttcca

SEQ ID NO: 1305518 - DNA, 13 bp, Homo sapiens
attaaattcacaa

SEQ ID NO: 1305519 - DNA, 18 bp, Homo sapiens
attaaattcacaaacttt

SEQ ID NO: 1305520 - DNA, 22 bp, Homo sapiens
attaagaaggcaaaaatgtaaa

SEQ ID NO: 1305521 - DNA, 16 bp, Homo sapiens
attaataatcttatta

SEQ ID NO: 1305522 - DNA, 14 bp, Homo sapiens
attaattctataag

SEQ ID NO: 1305523 - DNA, 13 bp, Homo sapiens
attaattgctttg

SEQ ID NO: 1305524 - DNA, 14 bp, Homo sapiens
attaattgctttga

SEQ ID NO: 1305525 - DNA, 13 bp, Homo sapiens
attaccccctcct

SEQ ID NO: 1305526 - DNA, 18 bp, Homo sapiens
attagaaaatgttattta

SEQ ID NO: 1305527 - DNA, 22 bp, Homo sapiens
attagaaaatgttatttaacag

SEQ ID NO: 1305528 - DNA, 17 bp, Homo sapiens
attatccatattgagtc

SEQ ID NO: 1305529 - DNA, 20 bp, Homo sapiens
attatctatacatatcttta

SEQ ID NO: 1305530 - DNA, 20 bp, Homo sapiens
attatgttttttaaaatatt

SEQ ID NO: 1305531 - DNA, 19 bp, Homo sapiens
attcaaactggggcctcca

SEQ ID NO: 1305532 - DNA, 14 bp, Homo sapiens
attcaattcctctg

SEQ ID NO: 1305533 - DNA, 16 bp, Homo sapiens
attcaattcctctggg

SEQ ID NO: 1305534 - DNA, 17 bp, Homo sapiens
attcaattcctctggga

SEQ ID NO: 1305535 - DNA, 18 bp, Homo sapiens
attcaattcctctgggaa

SEQ ID NO: 1305536 - DNA, 13 bp, Homo sapiens
attcacaaacttt

SEQ ID NO: 1305537 - DNA, 22 bp, Homo sapiens
attcacaaacttttatactctt

SEQ ID NO: 1305538 - DNA, 19 bp, Homo sapiens
attcagtggcgagaaataa

SEQ ID NO: 1305539 - DNA, 13 bp, Homo sapiens
attcagttttcat

SEQ ID NO: 1305540 - DNA, 14 bp, Homo sapiens
attcagttttcatt

SEQ ID NO: 1305541 - DNA, 20 bp, Homo sapiens
attccaaagagtagaattgc

SEQ ID NO: 1305542 - DNA, 13 bp, Homo sapiens
attcctctgggaa

SEQ ID NO: 1305543 - DNA, 14 bp, Homo sapiens
attcctctttgctt

SEQ ID NO: 1305544 - DNA, 15 bp, Homo sapiens
attcctctttgcttt

SEQ ID NO: 1305545 - DNA, 16 bp, Homo sapiens
attcctgaagaaccag

SEQ ID NO: 1305546 - DNA, 13 bp, Homo sapiens
attcgttctgtgg

SEQ ID NO: 1305547 - DNA, 15 bp, Homo sapiens
attctataaggccat

SEQ ID NO: 1305548 - DNA, 13 bp, Homo sapiens
attctccacagca

SEQ ID NO: 1305549 - DNA, 14 bp, Homo sapiens
attctccacagcaa

SEQ ID NO: 1305550 - DNA, 16 bp, Homo sapiens
attctccacagcaacc

SEQ ID NO: 1305551 - DNA, 17 bp, Homo sapiens
attctccttcagccctc

SEQ ID NO: 1305552 - DNA, 19 bp, Homo sapiens
attctctccaaaaatgcac

SEQ ID NO: 1305553 - DNA, 20 bp, Homo sapiens
attctgcagtaaatctttta

SEQ ID NO: 1305554 - DNA, 21 bp, Homo sapiens
attctgcagtaaatcttttac

SEQ ID NO: 1305555 - DNA, 16 bp, Homo sapiens
attcttgaaagctgtg

SEQ ID NO: 1305556 - DNA, 15 bp, Homo sapiens
attctttctgataac

SEQ ID NO: 1305557 - DNA, 18 bp, Homo sapiens
attgaacacaaactgtaa

SEQ ID NO: 1305558 - DNA, 15 bp, Homo sapiens
attgacagctttgct

SEQ ID NO: 1305559 - DNA, 23 bp, Homo sapiens
attgaccgcgactaatttcaaaa

SEQ ID NO: 1305560 - DNA, 12 bp, Homo sapiens
attgatttgcat

SEQ ID NO: 1305561 - DNA, 13 bp, Homo sapiens
attgatttgcatt

SEQ ID NO: 1305562 - DNA, 19 bp, Homo sapiens
attgcaaatcttgaaatta

SEQ ID NO: 1305563 - DNA, 20 bp, Homo sapiens
attgcagaactaaactcatt

SEQ ID NO: 1305564 - DNA, 21 bp, Homo sapiens
attgctgagagaaatatggaa

SEQ ID NO: 1305565 - DNA, 12 bp, Homo sapiens
attgctttgagc

SEQ ID NO: 1305566 - DNA, 16 bp, Homo sapiens
attggctcacactgag

SEQ ID NO: 1305567 - DNA, 21 bp, Homo sapiens
attggctcacactgagaatgt

SEQ ID NO: 1305568 - DNA, 13 bp, Homo sapiens
attgtgtttgtgt

SEQ ID NO: 1305569 - DNA, 16 bp, Homo sapiens
attgtttgtctttaac

SEQ ID NO: 1305570 - DNA, 21 bp, Homo sapiens
attgtttgtctttaactgtca

SEQ ID NO: 1305571 - DNA, 14 bp, Homo sapiens
atttaaaaatattt

SEQ ID NO: 1305572 - DNA, 22 bp, Homo sapiens
atttaacagctgaattatctat

SEQ ID NO: 1305573 - DNA, 13 bp, Homo sapiens
atttactgagctt

SEQ ID NO: 1305574 - DNA, 20 bp, Homo sapiens
atttactgagcttctctgtg

SEQ ID NO: 1305575 - DNA, 22 bp, Homo sapiens
atttagaaagaagcccaatatt

SEQ ID NO: 1305576 - DNA, 21 bp, Homo sapiens
atttagctaaacggattccaa

SEQ ID NO: 1305577 - DNA, 22 bp, Homo sapiens
atttagctaaacggattccaaa

SEQ ID NO: 1305578 - DNA, 23 bp, Homo sapiens
atttagctaaacggattccaaag

SEQ ID NO: 1305579 - DNA, 17 bp, Homo sapiens
atttaggtttttattag

SEQ ID NO: 1305580 - DNA, 21 bp, Homo sapiens
atttataaagctaaaataacc

SEQ ID NO: 1305581 - DNA, 18 bp, Homo sapiens
atttatacaaattagaaa

SEQ ID NO: 1305582 - DNA, 19 bp, Homo sapiens
atttatcttgtctctgggc

SEQ ID NO: 1305583 - DNA, 15 bp, Homo sapiens
atttattaattgctt

SEQ ID NO: 1305584 - DNA, 17 bp, Homo sapiens
atttattaattgctttg

SEQ ID NO: 1305585 - DNA, 13 bp, Homo sapiens
atttattatttat

SEQ ID NO: 1305586 - DNA, 19 bp, Homo sapiens
atttattatttatttatta

SEQ ID NO: 1305587 - DNA, 19 bp, Homo sapiens
atttattcaattcctctgg

SEQ ID NO: 1305588 - DNA, 24 bp, Homo sapiens
atttatttactgagcttctctgtg

SEQ ID NO: 1305589 - DNA, 13 bp, Homo sapiens
atttatttattat

SEQ ID NO: 1305590 - DNA, 14 bp, Homo sapiens
atttatttattatt

SEQ ID NO: 1305591 - DNA, 21 bp, Homo sapiens
atttcaaaatgctttttatta

SEQ ID NO: 1305592 - DNA, 20 bp, Homo sapiens
atttcacccctccctttctc

SEQ ID NO: 1305593 - DNA, 23 bp, Homo sapiens
atttcagactcccattcctgaag

SEQ ID NO: 1305594 - DNA, 14 bp, Homo sapiens
atttcatctgctct

SEQ ID NO: 1305595 - DNA, 17 bp, Homo sapiens
atttcatctgctctcct

SEQ ID NO: 1305596 - DNA, 18 bp, Homo sapiens
atttcatctgctctcctt

SEQ ID NO: 1305597 - DNA, 20 bp, Homo sapiens
atttcatctgctctccttcc

SEQ ID NO: 1305598 - DNA, 21 bp, Homo sapiens
atttcatctgctctccttcct

SEQ ID NO: 1305599 - DNA, 13 bp, Homo sapiens
atttctatttatt

SEQ ID NO: 1305600 - DNA, 13 bp, Homo sapiens
atttcttgtgcct

SEQ ID NO: 1305601 - DNA, 16 bp, Homo sapiens
atttgaagaacatgtg

SEQ ID NO: 1305602 - DNA, 16 bp, Homo sapiens
atttgattgatttgaa

SEQ ID NO: 1305603 - DNA, 18 bp, Homo sapiens
atttgcattaaattcaca

SEQ ID NO: 1305604 - DNA, 22 bp, Homo sapiens
atttgcattgaacacaaactgt

SEQ ID NO: 1305605 - DNA, 18 bp, Homo sapiens
atttgggaagtgaagact

SEQ ID NO: 1305606 - DNA, 19 bp, Homo sapiens
atttgggcctgctccagac

SEQ ID NO: 1305607 - DNA, 23 bp, Homo sapiens
atttgggcctgctccagacctga

SEQ ID NO: 1305608 - DNA, 15 bp, Homo sapiens
atttgtgatagcact

SEQ ID NO: 1305609 - DNA, 13 bp, Homo sapiens
attttatctttga

SEQ ID NO: 1305610 - DNA, 12 bp, Homo sapiens
attttctttaat

SEQ ID NO: 1305611 - DNA, 12 bp, Homo sapiens
attttgctgtat

SEQ ID NO: 1305612 - DNA, 14 bp, Homo sapiens
attttgctgtatat

SEQ ID NO: 1305613 - DNA, 16 bp, Homo sapiens
attttggttttgttcc

SEQ ID NO: 1305614 - DNA, 18 bp, Homo sapiens
atttttttaaaatgttaa

SEQ ID NO: 1305615 - DNA, 14 bp, Homo sapiens
caaaaatatttata

SEQ ID NO: 1305616 - DNA, 15 bp, Homo sapiens
caaaaattagccggg

SEQ ID NO: 1305617 - DNA, 22 bp, Homo sapiens
caaaactgcctcaggaggcagg

SEQ ID NO: 1305618 - DNA, 14 bp, Homo sapiens
caaacaaaatttct

SEQ ID NO: 1305619 - DNA, 17 bp, Homo sapiens
caaacgcctcccctgcc

SEQ ID NO: 1305620 - DNA, 16 bp, Homo sapiens
caaactggggcctcca

SEQ ID NO: 1305621 - DNA, 22 bp, Homo sapiens
caaagaggctgaggctggcaca

SEQ ID NO: 1305622 - DNA, 13 bp, Homo sapiens
caaagcagccacg

SEQ ID NO: 1305623 - DNA, 14 bp, Homo sapiens
caaagcccaaggga

SEQ ID NO: 1305624 - DNA, 13 bp, Homo sapiens
caaataatgtctc

SEQ ID NO: 1305625 - DNA, 16 bp, Homo sapiens
caaataatgtctctgt

SEQ ID NO: 1305626 - DNA, 18 bp, Homo sapiens
caaatggcgtctggaagt

SEQ ID NO: 1305627 - DNA, 21 bp, Homo sapiens
caaatggcgtctggaagtcca

SEQ ID NO: 1305628 - DNA, 14 bp, Homo sapiens
caaatggggccaga

SEQ ID NO: 1305629 - DNA, 23 bp, Homo sapiens
caaatggggccagatccagcctg

SEQ ID NO: 1305630 - DNA, 20 bp, Homo sapiens
caaatggtaggcatttccta

SEQ ID NO: 1305631 - DNA, 23 bp, Homo sapiens
caaatggtttaacttctgcctgt

SEQ ID NO: 1305632 - DNA, 16 bp, Homo sapiens
caaattaataatctta

SEQ ID NO: 1305633 - DNA, 17 bp, Homo sapiens
caaattaataatcttat

SEQ ID NO: 1305634 - DNA, 11 bp, Homo sapiens
caaattagaaa

SEQ ID NO: 1305635 - DNA, 12 bp, Homo sapiens
caaattagaaaa

SEQ ID NO: 1305636 - DNA, 19 bp, Homo sapiens
caaattagaaaatgttatt

SEQ ID NO: 1305637 - DNA, 22 bp, Homo sapiens
caaattagaaaatgttatttaa

SEQ ID NO: 1305638 - DNA, 15 bp, Homo sapiens
caacaccaagcacag

SEQ ID NO: 1305639 - DNA, 22 bp, Homo sapiens
caacaccaagcacagcagcctg

SEQ ID NO: 1305640 - DNA, 17 bp, Homo sapiens
caacagatctggaacct

SEQ ID NO: 1305641 - DNA, 15 bp, Homo sapiens
caaccagctaagaaa

SEQ ID NO: 1305642 - DNA, 17 bp, Homo sapiens
caaccagctaagaaaag

SEQ ID NO: 1305643 - DNA, 19 bp, Homo sapiens
caaccccccagcactgagg

SEQ ID NO: 1305644 - DNA, 20 bp, Homo sapiens
caaccccccagcactgagga

SEQ ID NO: 1305645 - DNA, 17 bp, Homo sapiens
caacccttccctcacct

SEQ ID NO: 1305646 - DNA, 18 bp, Homo sapiens
caacccttccctcacctt

SEQ ID NO: 1305647 - DNA, 23 bp, Homo sapiens
caacccttctcctcttgtaaata

SEQ ID NO: 1305648 - DNA, 13 bp, Homo sapiens
caacctaaatttg

SEQ ID NO: 1305649 - DNA, 16 bp, Homo sapiens
caactatggatcagaa

SEQ ID NO: 1305650 - DNA, 13 bp, Homo sapiens
caactctagctgg

SEQ ID NO: 1305651 - DNA, 24 bp, Homo sapiens
caactctcccctgacctgtgagcc

SEQ ID NO: 1305652 - DNA, 14 bp, Homo sapiens
caagcacagcagcc

SEQ ID NO: 1305653 - DNA, 23 bp, Homo sapiens
caagctcctcctccctgcatctg

SEQ ID NO: 1305654 - DNA, 15 bp, Homo sapiens
caaggaaaaacaggt

SEQ ID NO: 1305655 - DNA, 21 bp, Homo sapiens
caaggacttcctgtccagctc

SEQ ID NO: 1305656 - DNA, 22 bp, Homo sapiens
caaggacttcctgtccagctcc

SEQ ID NO: 1305657 - DNA, 11 bp, Homo sapiens
caaggagctgc

SEQ ID NO: 1305658 - DNA, 15 bp, Homo sapiens
caaggatagatgctg

SEQ ID NO: 1305659 - DNA, 20 bp, Homo sapiens
caaggatagatgctggccca

SEQ ID NO: 1305660 - DNA, 22 bp, Homo sapiens
caaggtaatttcttgtgcctct

SEQ ID NO: 1305661 - DNA, 22 bp, Homo sapiens
caaggtcctctgtcagtcacag

SEQ ID NO: 1305662 - DNA, 21 bp, Homo sapiens
caaggtttaggctggtggccc

SEQ ID NO: 1305663 - DNA, 22 bp, Homo sapiens
caagtatttgggaagtgaagac

SEQ ID NO: 1305664 - DNA, 22 bp, Homo sapiens
caagtggaccttaggccttcct

SEQ ID NO: 1305665 - DNA, 19 bp, Homo sapiens
caagtggtggtaaccctgg

SEQ ID NO: 1305666 - DNA, 16 bp, Homo sapiens
caataaagcatttata

SEQ ID NO: 1305667 - DNA, 18 bp, Homo sapiens
caataaatctgacccagt

SEQ ID NO: 1305668 - DNA, 20 bp, Homo sapiens
caataaatctgacccagtgc

SEQ ID NO: 1305669 - DNA, 16 bp, Homo sapiens
caataattgcagaact

SEQ ID NO: 1305670 - DNA, 19 bp, Homo sapiens
caatattttctttaatgct

SEQ ID NO: 1305671 - DNA, 14 bp, Homo sapiens
caatgatgaatgag

SEQ ID NO: 1305672 - DNA, 19 bp, Homo sapiens
caatgggagctgaggccac

SEQ ID NO: 1305673 - DNA, 20 bp, Homo sapiens
caatgtctgagtgaacctgt

SEQ ID NO: 1305674 - DNA, 15 bp, Homo sapiens
caatgtgaactttat

SEQ ID NO: 1305675 - DNA, 21 bp, Homo sapiens
caatgtgaactttattaaata

SEQ ID NO: 1305676 - DNA, 15 bp, Homo sapiens
caattcctctgggaa

SEQ ID NO: 1305677 - DNA, 14 bp, Homo sapiens
caatttcagactcc

SEQ ID NO: 1305678 - DNA, 13 bp, Homo sapiens
cacaaactgtaaa

SEQ ID NO: 1305679 - DNA, 14 bp, Homo sapiens
cacaacctgaacct

SEQ ID NO: 1305680 - DNA, 12 bp, Homo sapiens
cacaaggacttc

SEQ ID NO: 1305681 - DNA, 14 bp, Homo sapiens
cacaaggacttcct

SEQ ID NO: 1305682 - DNA, 21 bp, Homo sapiens
cacaaggatagatgctggccc

SEQ ID NO: 1305683 - DNA, 12 bp, Homo sapiens
cacacagggcag

SEQ ID NO: 1305684 - DNA, 16 bp, Homo sapiens
cacaccacatctaagc

SEQ ID NO: 1305685 - DNA, 14 bp, Homo sapiens
cacactgatgctta

SEQ ID NO: 1305686 - DNA, 15 bp, Homo sapiens
cacagcacagccaac

SEQ ID NO: 1305687 - DNA, 13 bp, Homo sapiens
cacagccacccct

SEQ ID NO: 1305688 - DNA, 17 bp, Homo sapiens
cacaggacacagtcaga

SEQ ID NO: 1305689 - DNA, 20 bp, Homo sapiens
cacaggacatgcggtagcca

SEQ ID NO: 1305690 - DNA, 22 bp, Homo sapiens
cacaggacatgcggtagccagc

SEQ ID NO: 1305691 - DNA, 15 bp, Homo sapiens
cacaggcctgagatt

SEQ ID NO: 1305692 - DNA, 23 bp, Homo sapiens
cacaggcctgagatttcatctgc

SEQ ID NO: 1305693 - DNA, 14 bp, Homo sapiens
cacaggtctttcct

SEQ ID NO: 1305694 - DNA, 16 bp, Homo sapiens
cacagtagtcttgatg

SEQ ID NO: 1305695 - DNA, 20 bp, Homo sapiens
cacagttctttgggccagac

SEQ ID NO: 1305696 - DNA, 19 bp, Homo sapiens
cacataccctcttcatgga

SEQ ID NO: 1305697 - DNA, 17 bp, Homo sapiens
cacatctaagcctgaag

SEQ ID NO: 1305698 - DNA, 12 bp, Homo sapiens
cacatcttccct

SEQ ID NO: 1305699 - DNA, 19 bp, Homo sapiens
cacatttggaatacttttt

SEQ ID NO: 1305700 - DNA, 15 bp, Homo sapiens
caccaagcacagcag

SEQ ID NO: 1305701 - DNA, 17 bp, Homo sapiens
caccaagcacagcagcc

SEQ ID NO: 1305702 - DNA, 19 bp, Homo sapiens
caccaagcacagcagcctg

SEQ ID NO: 1305703 - DNA, 13 bp, Homo sapiens
cacccacctccct

SEQ ID NO: 1305704 - DNA, 15 bp, Homo sapiens
cacccacctccctgc

SEQ ID NO: 1305705 - DNA, 18 bp, Homo sapiens
cacccacctccctgcctc

SEQ ID NO: 1305706 - DNA, 21 bp, Homo sapiens
cacccacctccctgcctccag

SEQ ID NO: 1305707 - DNA, 15 bp, Homo sapiens
cacccctccctttct

SEQ ID NO: 1305708 - DNA, 18 bp, Homo sapiens
cacccctccctttctccc

SEQ ID NO: 1305709 - DNA, 16 bp, Homo sapiens
caccctctaaatggga

SEQ ID NO: 1305710 - DNA, 13 bp, Homo sapiens
cacctccctgcct

SEQ ID NO: 1305711 - DNA, 14 bp, Homo sapiens
cacctccctgcctc

SEQ ID NO: 1305712 - DNA, 21 bp, Homo sapiens
cacctgtaatcccagctactt

SEQ ID NO: 1305713 - DNA, 20 bp, Homo sapiens
cacctgtttttaagctgttt

SEQ ID NO: 1305714 - DNA, 22 bp, Homo sapiens
caccttgaagaacctctcactt

SEQ ID NO: 1305715 - DNA, 12 bp, Homo sapiens
cacgcacctgcc

SEQ ID NO: 1305716 - DNA, 13 bp, Homo sapiens
cactaagcagagg

SEQ ID NO: 1305717 - DNA, 14 bp, Homo sapiens
cactaagcagagga

SEQ ID NO: 1305718 - DNA, 18 bp, Homo sapiens
cactaagcagaggagggg

SEQ ID NO: 1305719 - DNA, 12 bp, Homo sapiens
cactaaggggcc

SEQ ID NO: 1305720 - DNA, 12 bp, Homo sapiens
cactcagcacaa

SEQ ID NO: 1305721 - DNA, 13 bp, Homo sapiens
cactcagcacaag

SEQ ID NO: 1305722 - DNA, 22 bp, Homo sapiens
cactcagcacaaggccatctgg

SEQ ID NO: 1305723 - DNA, 21 bp, Homo sapiens
cactcattgctgagcctctgc

SEQ ID NO: 1305724 - DNA, 18 bp, Homo sapiens
cactccccgaagtctttt

SEQ ID NO: 1305725 - DNA, 19 bp, Homo sapiens
cactccccgaagtcttttg

SEQ ID NO: 1305726 - DNA, 16 bp, Homo sapiens
cactctcccccacccc

SEQ ID NO: 1305727 - DNA, 23 bp, Homo sapiens
cactcttttgctttattccagaa

SEQ ID NO: 1305728 - DNA, 13 bp, Homo sapiens
cactgaccagaac

SEQ ID NO: 1305729 - DNA, 21 bp, Homo sapiens
cactgagaatgtaagaactac

SEQ ID NO: 1305730 - DNA, 13 bp, Homo sapiens
cactgaggaagaa

SEQ ID NO: 1305731 - DNA, 18 bp, Homo sapiens
cactgcccatggacaggc

SEQ ID NO: 1305732 - DNA, 16 bp, Homo sapiens
cactggggcctacagc

SEQ ID NO: 1305733 - DNA, 15 bp, Homo sapiens
cactggttgcactta

SEQ ID NO: 1305734 - DNA, 18 bp, Homo sapiens
cactgtcctgggcctgca

SEQ ID NO: 1305735 - DNA, 14 bp, Homo sapiens
cactgtgaaggacc

SEQ ID NO: 1305736 - DNA, 18 bp, Homo sapiens
cacttgaggtcaggagtt

SEQ ID NO: 1305737 - DNA, 15 bp, Homo sapiens
cacttgtccagctga

SEQ ID NO: 1305738 - DNA, 23 bp, Homo sapiens
cacttgtccagctgagcgccagg

SEQ ID NO: 1305739 - DNA, 18 bp, Homo sapiens
cactttagggctgtaaaa

SEQ ID NO: 1305740 - DNA, 19 bp, Homo sapiens
cactttctacaatgtgaac

SEQ ID NO: 1305741 - DNA, 20 bp, Homo sapiens
cactttgtcgcccaggctgg

SEQ ID NO: 1305742 - DNA, 14 bp, Homo sapiens
cagaaaatgttgag

SEQ ID NO: 1305743 - DNA, 18 bp, Homo sapiens
cagaaaatgttgagaatc

SEQ ID NO: 1305744 - DNA, 22 bp, Homo sapiens
cagaaagtgtgctttatgctga

SEQ ID NO: 1305745 - DNA, 19 bp, Homo sapiens
cagaactaaactcatttat

SEQ ID NO: 1305746 - DNA, 20 bp, Homo sapiens
cagaactcaaatggggccag

SEQ ID NO: 1305747 - DNA, 18 bp, Homo sapiens
cagaactcactggggcct

SEQ ID NO: 1305748 - DNA, 18 bp, Homo sapiens
cagaagcctgatgctgac

SEQ ID NO: 1305749 - DNA, 20 bp, Homo sapiens
cagaagggggtggtgtctcc

SEQ ID NO: 1305750 - DNA, 11 bp, Homo sapiens
cagaatgctgt

SEQ ID NO: 1305751 - DNA, 16 bp, Homo sapiens
cagaatgctgtacatc

SEQ ID NO: 1305752 - DNA, 17 bp, Homo sapiens
cagaatgctgtacatct

SEQ ID NO: 1305753 - DNA, 18 bp, Homo sapiens
cagaatgctgtacatcta

SEQ ID NO: 1305754 - DNA, 21 bp, Homo sapiens
cagaatgctgtacatctattt

SEQ ID NO: 1305755 - DNA, 19 bp, Homo sapiens
cagaatttgggttctgcct

SEQ ID NO: 1305756 - DNA, 14 bp, Homo sapiens
cagacacccaggac

SEQ ID NO: 1305757 - DNA, 15 bp, Homo sapiens
cagacacccaggact

SEQ ID NO: 1305758 - DNA, 13 bp, Homo sapiens
cagacctgatcct

SEQ ID NO: 1305759 - DNA, 20 bp, Homo sapiens
cagacctgttagcagacagg

SEQ ID NO: 1305760 - DNA, 14 bp, Homo sapiens
cagactcccattcc

SEQ ID NO: 1305761 - DNA, 24 bp, Homo sapiens
cagacttccttgagacacggagcc

SEQ ID NO: 1305762 - DNA, 21 bp, Homo sapiens
cagagaagctataaattcctc

SEQ ID NO: 1305763 - DNA, 15 bp, Homo sapiens
cagagacatacttga

SEQ ID NO: 1305764 - DNA, 23 bp, Homo sapiens
cagagacatacttgaagggccag

SEQ ID NO: 1305765 - DNA, 20 bp, Homo sapiens
cagagcaagactctgtctca

SEQ ID NO: 1305766 - DNA, 14 bp, Homo sapiens
cagaggagggcagc

SEQ ID NO: 1305767 - DNA, 18 bp, Homo sapiens
cagaggagggcagcagaa

SEQ ID NO: 1305768 - DNA, 22 bp, Homo sapiens
cagaggagggcagcagaagggg

SEQ ID NO: 1305769 - DNA, 13 bp, Homo sapiens
cagaggccccagc

SEQ ID NO: 1305770 - DNA, 18 bp, Homo sapiens
cagaggcgcactgtgacc

SEQ ID NO: 1305771 - DNA, 14 bp, Homo sapiens
cagatccagcctgg

SEQ ID NO: 1305772 - DNA, 12 bp, Homo sapiens
cagatccaggac

SEQ ID NO: 1305773 - DNA, 13 bp, Homo sapiens
cagatccaggact

SEQ ID NO: 1305774 - DNA, 14 bp, Homo sapiens
cagatccagggaca

SEQ ID NO: 1305775 - DNA, 18 bp, Homo sapiens
cagatctggaacctcagc

SEQ ID NO: 1305776 - DNA, 23 bp, Homo sapiens
cagatctggaacctcagcctggc

SEQ ID NO: 1305777 - DNA, 14 bp, Homo sapiens
cagatgcagggcag

SEQ ID NO: 1305778 - DNA, 14 bp, Homo sapiens
cagatgtttccaga

SEQ ID NO: 1305779 - DNA, 18 bp, Homo sapiens
cagatgtttccagacttc

SEQ ID NO: 1305780 - DNA, 17 bp, Homo sapiens
cagattggctcacactg

SEQ ID NO: 1305781 - DNA, 16 bp, Homo sapiens
cagattttgctgtata

SEQ ID NO: 1305782 - DNA, 16 bp, Homo sapiens
cagcaccgttctgtgc

SEQ ID NO: 1305783 - DNA, 13 bp, Homo sapiens
cagcactgaggaa

SEQ ID NO: 1305784 - DNA, 15 bp, Homo sapiens
cagcactgaggaaga

SEQ ID NO: 1305785 - DNA, 15 bp, Homo sapiens
cagcacttgtccagc

SEQ ID NO: 1305786 - DNA, 19 bp, Homo sapiens
cagcacttgtccagctgag

SEQ ID NO: 1305787 - DNA, 16 bp, Homo sapiens
cagcactttgggaggc

SEQ ID NO: 1305788 - DNA, 21 bp, Homo sapiens
cagcagcctggggctggcctc

SEQ ID NO: 1305789 - DNA, 17 bp, Homo sapiens
cagcagcgcctttccca

SEQ ID NO: 1305790 - DNA, 16 bp, Homo sapiens
cagcagggatgccctg

SEQ ID NO: 1305791 - DNA, 20 bp, Homo sapiens
cagcagttttcaagtcaaat

SEQ ID NO: 1305792 - DNA, 23 bp, Homo sapiens
cagccaacacgcacctgcctcag

SEQ ID NO: 1305793 - DNA, 21 bp, Homo sapiens
cagccaccgaagccgcctgtg

SEQ ID NO: 1305794 - DNA, 15 bp, Homo sapiens
cagccaggccccagg

SEQ ID NO: 1305795 - DNA, 17 bp, Homo sapiens
cagccatcaaaatgctt

SEQ ID NO: 1305796 - DNA, 13 bp, Homo sapiens
cagccctcacccc

SEQ ID NO: 1305797 - DNA, 14 bp, Homo sapiens
cagccctcacccct

SEQ ID NO: 1305798 - DNA, 20 bp, Homo sapiens
cagccctccccatggagcca

SEQ ID NO: 1305799 - DNA, 14 bp, Homo sapiens
cagcctcccatcca

SEQ ID NO: 1305800 - DNA, 20 bp, Homo sapiens
cagcctcccatccagggccc

SEQ ID NO: 1305801 - DNA, 23 bp, Homo sapiens
cagcctcccatccagggccccca

SEQ ID NO: 1305802 - DNA, 16 bp, Homo sapiens
cagcctccctgaagcc

SEQ ID NO: 1305803 - DNA, 17 bp, Homo sapiens
cagcctccctgaagcct

SEQ ID NO: 1305804 - DNA, 14 bp, Homo sapiens
cagcctggccagac

SEQ ID NO: 1305805 - DNA, 15 bp, Homo sapiens
cagcctggccagaca

SEQ ID NO: 1305806 - DNA, 18 bp, Homo sapiens
cagcctggccagacacag

SEQ ID NO: 1305807 - DNA, 20 bp, Homo sapiens
cagcctggccagacacaggc

SEQ ID NO: 1305808 - DNA, 17 bp, Homo sapiens
cagcctggggctggcct

SEQ ID NO: 1305809 - DNA, 21 bp, Homo sapiens
cagcctggggctggcctccca

SEQ ID NO: 1305810 - DNA, 14 bp, Homo sapiens
cagccttgccagag

SEQ ID NO: 1305811 - DNA, 18 bp, Homo sapiens
cagctaagaacctggaac

SEQ ID NO: 1305812 - DNA, 19 bp, Homo sapiens
cagctaagaacctggaact

SEQ ID NO: 1305813 - DNA, 19 bp, Homo sapiens
cagctcaggacagatgcca

SEQ ID NO: 1305814 - DNA, 11 bp, Homo sapiens
cagctcaggat

SEQ ID NO: 1305815 - DNA, 16 bp, Homo sapiens
cagctccggcctgtcc

SEQ ID NO: 1305816 - DNA, 17 bp, Homo sapiens
cagctctggacagcccc

SEQ ID NO: 1305817 - DNA, 12 bp, Homo sapiens
cagctctgggcc

SEQ ID NO: 1305818 - DNA, 23 bp, Homo sapiens
cagctctgggccattctccacag

SEQ ID NO: 1305819 - DNA, 13 bp, Homo sapiens
cagctctttcctc

SEQ ID NO: 1305820 - DNA, 19 bp, Homo sapiens
cagctctttcctccttcca

SEQ ID NO: 1305821 - DNA, 22 bp, Homo sapiens
cagctctttcctccttccatgg

SEQ ID NO: 1305822 - DNA, 18 bp, Homo sapiens
cagctgagcgccaggatg

SEQ ID NO: 1305823 - DNA, 18 bp, Homo sapiens
cagctgcactgatgctgc

SEQ ID NO: 1305824 - DNA, 18 bp, Homo sapiens
cagctgggtcaggcaggg

SEQ ID NO: 1305825 - DNA, 14 bp, Homo sapiens
cagctttgctgctg

SEQ ID NO: 1305826 - DNA, 18 bp, Homo sapiens
caggaaaggcccagccac

SEQ ID NO: 1305827 - DNA, 16 bp, Homo sapiens
caggaaccacaccaca

SEQ ID NO: 1305828 - DNA, 19 bp, Homo sapiens
caggaatgtgtggcctgca

SEQ ID NO: 1305829 - DNA, 17 bp, Homo sapiens
caggaatttcccaggac

SEQ ID NO: 1305830 - DNA, 20 bp, Homo sapiens
caggaatttcccaggaccct

SEQ ID NO: 1305831 - DNA, 22 bp, Homo sapiens
caggacatgcggtagccagcac

SEQ ID NO: 1305832 - DNA, 16 bp, Homo sapiens
caggaccagctcagga

SEQ ID NO: 1305833 - DNA, 19 bp, Homo sapiens
caggaccagctcaggacag

SEQ ID NO: 1305834 - DNA, 13 bp, Homo sapiens
caggaccctgaag

SEQ ID NO: 1305835 - DNA, 14 bp, Homo sapiens
caggaccctgaagg

SEQ ID NO: 1305836 - DNA, 17 bp, Homo sapiens
caggaccctgaaggggc

SEQ ID NO: 1305837 - DNA, 14 bp, Homo sapiens
caggacctggctgc

SEQ ID NO: 1305838 - DNA, 16 bp, Homo sapiens
caggacctggctgcca

SEQ ID NO: 1305839 - DNA, 20 bp, Homo sapiens
caggaccttcgggctgtgcc

SEQ ID NO: 1305840 - DNA, 21 bp, Homo sapiens
caggaccttcgggctgtgccc

SEQ ID NO: 1305841 - DNA, 13 bp, Homo sapiens
caggactgggcca

SEQ ID NO: 1305842 - DNA, 20 bp, Homo sapiens
caggagatggaagttgcagt

SEQ ID NO: 1305843 - DNA, 15 bp, Homo sapiens
caggaggcaggacct

SEQ ID NO: 1305844 - DNA, 23 bp, Homo sapiens
caggatctcttagcattttaatt

SEQ ID NO: 1305845 - DNA, 15 bp, Homo sapiens
caggcagatccagga

SEQ ID NO: 1305846 - DNA, 18 bp, Homo sapiens
caggcagatccaggacta

SEQ ID NO: 1305847 - DNA, 15 bp, Homo sapiens
caggccccaggaaag

SEQ ID NO: 1305848 - DNA, 22 bp, Homo sapiens
caggccctccctgttccccaga

SEQ ID NO: 1305849 - DNA, 23 bp, Homo sapiens
caggctaaacatccaatattttc

SEQ ID NO: 1305850 - DNA, 18 bp, Homo sapiens
caggctgaagcaggttcc

SEQ ID NO: 1305851 - DNA, 14 bp, Homo sapiens
caggctgaccacag

SEQ ID NO: 1305852 - DNA, 15 bp, Homo sapiens
caggctgaccacagc

SEQ ID NO: 1305853 - DNA, 18 bp, Homo sapiens
cagggacagaggccccag

SEQ ID NO: 1305854 - DNA, 23 bp, Homo sapiens
cagggacagaggccccagcctcc

SEQ ID NO: 1305855 - DNA, 12 bp, Homo sapiens
cagggagaagct

SEQ ID NO: 1305856 - DNA, 15 bp, Homo sapiens
cagggagcggccggc

SEQ ID NO: 1305857 - DNA, 20 bp, Homo sapiens
cagggatgccctggaggtgg

SEQ ID NO: 1305858 - DNA, 21 bp, Homo sapiens
cagggatgccctggaggtggc

SEQ ID NO: 1305859 - DNA, 22 bp, Homo sapiens
cagggatgccctggaggtggct

SEQ ID NO: 1305860 - DNA, 13 bp, Homo sapiens
cagggcagcgcca

SEQ ID NO: 1305861 - DNA, 16 bp, Homo sapiens
cagggcagcgccaggc

SEQ ID NO: 1305862 - DNA, 17 bp, Homo sapiens
cagggcagcgccaggct

SEQ ID NO: 1305863 - DNA, 22 bp, Homo sapiens
cagggcagcgccaggctgacca

SEQ ID NO: 1305864 - DNA, 18 bp, Homo sapiens
cagggccaacccttctcc

SEQ ID NO: 1305865 - DNA, 21 bp, Homo sapiens
cagggcccccatctcatgccc

SEQ ID NO: 1305866 - DNA, 15 bp, Homo sapiens
caggggggtgaggag

SEQ ID NO: 1305867 - DNA, 13 bp, Homo sapiens
cagggtgtgtgct

SEQ ID NO: 1305868 - DNA, 19 bp, Homo sapiens
cagggtttcaccatgttgc

SEQ ID NO: 1305869 - DNA, 13 bp, Homo sapiens
caggtctttccta

SEQ ID NO: 1305870 - DNA, 20 bp, Homo sapiens
caggtgctgacttcatctcc

SEQ ID NO: 1305871 - DNA, 21 bp, Homo sapiens
caggtgctgacttcatctccc

SEQ ID NO: 1305872 - DNA, 19 bp, Homo sapiens
caggtggccatgcctcagc

SEQ ID NO: 1305873 - DNA, 17 bp, Homo sapiens
caggttcccaagctcag

SEQ ID NO: 1305874 - DNA, 12 bp, Homo sapiens
cagtaaatcttt

SEQ ID NO: 1305875 - DNA, 19 bp, Homo sapiens
cagtactttggaggcccct

SEQ ID NO: 1305876 - DNA, 23 bp, Homo sapiens
cagtagtcttgatgaccaaagtc

SEQ ID NO: 1305877 - DNA, 14 bp, Homo sapiens
cagtatcactgtct

SEQ ID NO: 1305878 - DNA, 17 bp, Homo sapiens
cagtatcatgccctgtg

SEQ ID NO: 1305879 - DNA, 19 bp, Homo sapiens
cagtatcatgccctgtgca

SEQ ID NO: 1305880 - DNA, 17 bp, Homo sapiens
cagtcagatttccagtc

SEQ ID NO: 1305881 - DNA, 23 bp, Homo sapiens
cagtcagatttccagtctccacc

SEQ ID NO: 1305882 - DNA, 17 bp, Homo sapiens
cagtcattggctgtctc

SEQ ID NO: 1305883 - DNA, 14 bp, Homo sapiens
cagtccccccaccc

SEQ ID NO: 1305884 - DNA, 15 bp, Homo sapiens
cagtgcccccactga

SEQ ID NO: 1305885 - DNA, 23 bp, Homo sapiens
cagtgcccccactgaccagaact

SEQ ID NO: 1305886 - DNA, 20 bp, Homo sapiens
cagtgtccttagaacatttt

SEQ ID NO: 1305887 - DNA, 15 bp, Homo sapiens
cagtgtgcactaagg

SEQ ID NO: 1305888 - DNA, 19 bp, Homo sapiens
cagtgtgcactaaggggcc

SEQ ID NO: 1305889 - DNA, 23 bp, Homo sapiens
cagtgtgcactaaggggcccggc

SEQ ID NO: 1305890 - DNA, 13 bp, Homo sapiens
cagttcaccctga

SEQ ID NO: 1305891 - DNA, 15 bp, Homo sapiens
cagtttgagacagga

SEQ ID NO: 1305892 - DNA, 16 bp, Homo sapiens
cagtttgagacaggag

SEQ ID NO: 1305893 - DNA, 23 bp, Homo sapiens
cataaaaagcaaaacaaaaatta

SEQ ID NO: 1305894 - DNA, 20 bp, Homo sapiens
catacttgaagggccagagc

SEQ ID NO: 1305895 - DNA, 22 bp, Homo sapiens
catacttgaagggccagagcca

SEQ ID NO: 1305896 - DNA, 14 bp, Homo sapiens
catactttcctgta

SEQ ID NO: 1305897 - DNA, 17 bp, Homo sapiens
catagcagattttaatt

SEQ ID NO: 1305898 - DNA, 15 bp, Homo sapiens
catagcatgacattt

SEQ ID NO: 1305899 - DNA, 21 bp, Homo sapiens
catagtaacttcttatggaat

SEQ ID NO: 1305900 - DNA, 16 bp, Homo sapiens
catagtaccatttata

SEQ ID NO: 1305901 - DNA, 17 bp, Homo sapiens
catattgctgagagaaa

SEQ ID NO: 1305902 - DNA, 23 bp, Homo sapiens
catcaaagaggctgaggctggca

SEQ ID NO: 1305903 - DNA, 15 bp, Homo sapiens
catccaaagcagaca

SEQ ID NO: 1305904 - DNA, 16 bp, Homo sapiens
catccaaccttcccaa

SEQ ID NO: 1305905 - DNA, 19 bp, Homo sapiens
catccccgcagtgtgcact

SEQ ID NO: 1305906 - DNA, 14 bp, Homo sapiens
catcctccagcagg

SEQ ID NO: 1305907 - DNA, 21 bp, Homo sapiens
catcgaatctactaattccac

SEQ ID NO: 1305908 - DNA, 12 bp, Homo sapiens
catctaagcctg

SEQ ID NO: 1305909 - DNA, 13 bp, Homo sapiens
catctattctctc

SEQ ID NO: 1305910 - DNA, 16 bp, Homo sapiens
catctattttggattg

SEQ ID NO: 1305911 - DNA, 19 bp, Homo sapiens
catctctaacagctcagga

SEQ ID NO: 1305912 - DNA, 20 bp, Homo sapiens
catctctaacagctcaggat

SEQ ID NO: 1305913 - DNA, 16 bp, Homo sapiens
catctctctgcccaac

SEQ ID NO: 1305914 - DNA, 18 bp, Homo sapiens
catctctctgcccaaccc

SEQ ID NO: 1305915 - DNA, 20 bp, Homo sapiens
catctctgcttgagtcaggt

SEQ ID NO: 1305916 - DNA, 18 bp, Homo sapiens
catctcttagctcccctc

SEQ ID NO: 1305917 - DNA, 13 bp, Homo sapiens
catctgctctcct

SEQ ID NO: 1305918 - DNA, 15 bp, Homo sapiens
catctgctctccttc

SEQ ID NO: 1305919 - DNA, 18 bp, Homo sapiens
catctgctctccttcctg

SEQ ID NO: 1305920 - DNA, 16 bp, Homo sapiens
catctgggctcctcca

SEQ ID NO: 1305921 - DNA, 17 bp, Homo sapiens
catctgggctcctccag

SEQ ID NO: 1305922 - DNA, 20 bp, Homo sapiens
catctgggctcctccagggt

SEQ ID NO: 1305923 - DNA, 21 bp, Homo sapiens
catcttctaaacccaatccaa

SEQ ID NO: 1305924 - DNA, 21 bp, Homo sapiens
catgagttggggtctggcagc

SEQ ID NO: 1305925 - DNA, 14 bp, Homo sapiens
catgattccttcct

SEQ ID NO: 1305926 - DNA, 19 bp, Homo sapiens
catgattccttcctgttct

SEQ ID NO: 1305927 - DNA, 14 bp, Homo sapiens
catgatttccttga

SEQ ID NO: 1305928 - DNA, 17 bp, Homo sapiens
catgatttccttgaatg

SEQ ID NO: 1305929 - DNA, 10 bp, Homo sapiens
catgcactgt

SEQ ID NO: 1305930 - DNA, 17 bp, Homo sapiens
catgcactgtgaaggac

SEQ ID NO: 1305931 - DNA, 20 bp, Homo sapiens
catgcactgtgaaggaccct

SEQ ID NO: 1305932 - DNA, 11 bp, Homo sapiens
catgcctcagc

SEQ ID NO: 1305933 - DNA, 18 bp, Homo sapiens
catggacaggctggctcc

SEQ ID NO: 1305934 - DNA, 17 bp, Homo sapiens
catggtcacacactgat

SEQ ID NO: 1305935 - DNA, 14 bp, Homo sapiens
catgtaatcctcaa

SEQ ID NO: 1305936 - DNA, 22 bp, Homo sapiens
catgtgccagggcaatgatgaa

SEQ ID NO: 1305937 - DNA, 24 bp, Homo sapiens
catgtgccagggcaatgatgaatg

SEQ ID NO: 1305938 - DNA, 17 bp, Homo sapiens
cattaaattcacaaact

SEQ ID NO: 1305939 - DNA, 21 bp, Homo sapiens
cattaaattcacaaactttta

SEQ ID NO: 1305940 - DNA, 12 bp, Homo sapiens
cattaattctat

SEQ ID NO: 1305941 - DNA, 23 bp, Homo sapiens
cattcacagttctttgggccaga

SEQ ID NO: 1305942 - DNA, 13 bp, Homo sapiens
cattcacctgccc

SEQ ID NO: 1305943 - DNA, 15 bp, Homo sapiens
cattcacctgcccca

SEQ ID NO: 1305944 - DNA, 21 bp, Homo sapiens
cattcagtgattactgtcaag

SEQ ID NO: 1305945 - DNA, 13 bp, Homo sapiens
cattcctgaagaa

SEQ ID NO: 1305946 - DNA, 14 bp, Homo sapiens
cattcgttctgtgg

SEQ ID NO: 1305947 - DNA, 14 bp, Homo sapiens
cattctccacagca

SEQ ID NO: 1305948 - DNA, 18 bp, Homo sapiens
cattctccacagcaaccc

SEQ ID NO: 1305949 - DNA, 12 bp, Homo sapiens
cattcttttgta

SEQ ID NO: 1305950 - DNA, 14 bp, Homo sapiens
cattcttttgtaat

SEQ ID NO: 1305951 - DNA, 14 bp, Homo sapiens
cattgaacacaaac

SEQ ID NO: 1305952 - DNA, 17 bp, Homo sapiens
cattgaacacaaactgt

SEQ ID NO: 1305953 - DNA, 18 bp, Homo sapiens
cattgaacacaaactgta

SEQ ID NO: 1305954 - DNA, 16 bp, Homo sapiens
cattgctgagcctctg

SEQ ID NO: 1305955 - DNA, 14 bp, Homo sapiens
cattgtccctctgc

SEQ ID NO: 1305956 - DNA, 18 bp, Homo sapiens
cattgttcaattagaata

SEQ ID NO: 1305957 - DNA, 22 bp, Homo sapiens
catttagctaaacggattccaa

SEQ ID NO: 1305958 - DNA, 20 bp, Homo sapiens
catttatacaaattagaaaa

SEQ ID NO: 1305959 - DNA, 15 bp, Homo sapiens
catttcacccctccc

SEQ ID NO: 1305960 - DNA, 20 bp, Homo sapiens
catttcacccctccctttct

SEQ ID NO: 1305961 - DNA, 21 bp, Homo sapiens
catttcacccctccctttctc

SEQ ID NO: 1305962 - DNA, 22 bp, Homo sapiens
catttcacccctccctttctcc

SEQ ID NO: 1305963 - DNA, 23 bp, Homo sapiens
catttcctatcacctatttccat

SEQ ID NO: 1305964 - DNA, 15 bp, Homo sapiens
catttcggtggctag

SEQ ID NO: 1305965 - DNA, 21 bp, Homo sapiens
catttcggtggctagtcaagc

SEQ ID NO: 1305966 - DNA, 17 bp, Homo sapiens
catttggaatacttttt

SEQ ID NO: 1305967 - DNA, 16 bp, Homo sapiens
catttggttcattaat

SEQ ID NO: 1305968 - DNA, 20 bp, Homo sapiens
cattttggagagtttcctga

SEQ ID NO: 1305969 - DNA, 15 bp, Homo sapiens
catttttttccaggc

SEQ ID NO: 1305970 - DNA, 16 bp, Homo sapiens
ccaaacttggattttt

SEQ ID NO: 1305971 - DNA, 22 bp, Homo sapiens
ccaaagagtagaattgcattga

SEQ ID NO: 1305972 - DNA, 16 bp, Homo sapiens
ccaacacgcacctgcc

SEQ ID NO: 1305973 - DNA, 11 bp, Homo sapiens
ccaacccttct

SEQ ID NO: 1305974 - DNA, 14 bp, Homo sapiens
ccaagaaacgtctt

SEQ ID NO: 1305975 - DNA, 13 bp, Homo sapiens
ccaagcctgacca

SEQ ID NO: 1305976 - DNA, 15 bp, Homo sapiens
ccaatgtaggagctg

SEQ ID NO: 1305977 - DNA, 16 bp, Homo sapiens
ccaattcagacaggca

SEQ ID NO: 1305978 - DNA, 17 bp, Homo sapiens
ccacaaggacttcctgt

SEQ ID NO: 1305979 - DNA, 21 bp, Homo sapiens
ccacaaggacttcctgtccag

SEQ ID NO: 1305980 - DNA, 15 bp, Homo sapiens
ccacaagtggtggta

SEQ ID NO: 1305981 - DNA, 22 bp, Homo sapiens
ccacaagtggtggtaaccctgg

SEQ ID NO: 1305982 - DNA, 22 bp, Homo sapiens
ccacacaaggatagatgctggc

SEQ ID NO: 1305983 - DNA, 13 bp, Homo sapiens
ccacaccacatct

SEQ ID NO: 1305984 - DNA, 19 bp, Homo sapiens
ccacagcaaccccaggctg

SEQ ID NO: 1305985 - DNA, 14 bp, Homo sapiens
ccacagcacagcca

SEQ ID NO: 1305986 - DNA, 17 bp, Homo sapiens
ccacaggacacagtcag

SEQ ID NO: 1305987 - DNA, 12 bp, Homo sapiens
ccacaggcctga

SEQ ID NO: 1305988 - DNA, 14 bp, Homo sapiens
ccacaggcctgaga

SEQ ID NO: 1305989 - DNA, 19 bp, Homo sapiens
ccacaggcctgagatttca

SEQ ID NO: 1305990 - DNA, 15 bp, Homo sapiens
ccacatctaagcctg

SEQ ID NO: 1305991 - DNA, 18 bp, Homo sapiens
ccaccaggaacctcttca

SEQ ID NO: 1305992 - DNA, 17 bp, Homo sapiens
ccacccacctccctgcc

SEQ ID NO: 1305993 - DNA, 17 bp, Homo sapiens
ccacccctgggggctct

SEQ ID NO: 1305994 - DNA, 13 bp, Homo sapiens
ccaccgcccagag

SEQ ID NO: 1305995 - DNA, 21 bp, Homo sapiens
ccactaagaattcaaactggg

SEQ ID NO: 1305996 - DNA, 16 bp, Homo sapiens
ccactaagcagaggag

SEQ ID NO: 1305997 - DNA, 20 bp, Homo sapiens
ccactctcccccaccccctc

SEQ ID NO: 1305998 - DNA, 21 bp, Homo sapiens
ccagaatgctgtacatctatt

SEQ ID NO: 1305999 - DNA, 19 bp, Homo sapiens
ccagacacaggccctccct

SEQ ID NO: 1306000 - DNA, 15 bp, Homo sapiens
ccagacctgatcctg

SEQ ID NO: 1306001 - DNA, 16 bp, Homo sapiens
ccagacctgatcctgg

SEQ ID NO: 1306002 - DNA, 21 bp, Homo sapiens
ccagacctgttagcagacagg

SEQ ID NO: 1306003 - DNA, 16 bp, Homo sapiens
ccagagaaaggggagc

SEQ ID NO: 1306004 - DNA, 23 bp, Homo sapiens
ccagagaaaggggagcccactgt

SEQ ID NO: 1306005 - DNA, 22 bp, Homo sapiens
ccagagagcctggtgctgctgc

SEQ ID NO: 1306006 - DNA, 11 bp, Homo sapiens
ccagagccagg

SEQ ID NO: 1306007 - DNA, 12 bp, Homo sapiens
ccagagccaggg

SEQ ID NO: 1306008 - DNA, 12 bp, Homo sapiens
ccagagcccagc

SEQ ID NO: 1306009 - DNA, 14 bp, Homo sapiens
ccagagcccagctc

SEQ ID NO: 1306010 - DNA, 15 bp, Homo sapiens
ccagagcccagctcc

SEQ ID NO: 1306011 - DNA, 17 bp, Homo sapiens
ccagagcccagctccaa

SEQ ID NO: 1306012 - DNA, 14 bp, Homo sapiens
ccagatccagcctg

SEQ ID NO: 1306013 - DNA, 16 bp, Homo sapiens
ccagatccagcctggg

SEQ ID NO: 1306014 - DNA, 14 bp, Homo sapiens
ccagatgcagggca

SEQ ID NO: 1306015 - DNA, 23 bp, Homo sapiens
ccagatgtttccagacttccttg

SEQ ID NO: 1306016 - DNA, 19 bp, Homo sapiens
ccagattggctcacactga

SEQ ID NO: 1306017 - DNA, 20 bp, Homo sapiens
ccagattggctcacactgag

SEQ ID NO: 1306018 - DNA, 16 bp, Homo sapiens
ccagcacacagggcag

SEQ ID NO: 1306019 - DNA, 12 bp, Homo sapiens
ccagcactgagg

SEQ ID NO: 1306020 - DNA, 14 bp, Homo sapiens
ccagcactgaggaa

SEQ ID NO: 1306021 - DNA, 15 bp, Homo sapiens
ccagcagttttcaag

SEQ ID NO: 1306022 - DNA, 22 bp, Homo sapiens
ccagcagttttcaagtcaaatt

SEQ ID NO: 1306023 - DNA, 13 bp, Homo sapiens
ccagcattccttt

SEQ ID NO: 1306024 - DNA, 14 bp, Homo sapiens
ccagcattcctttt

SEQ ID NO: 1306025 - DNA, 17 bp, Homo sapiens
ccagccatgtctgcatt

SEQ ID NO: 1306026 - DNA, 23 bp, Homo sapiens
ccagcccctggccccaggacctg

SEQ ID NO: 1306027 - DNA, 21 bp, Homo sapiens
ccagcctccctgaagcctttg

SEQ ID NO: 1306028 - DNA, 17 bp, Homo sapiens
ccagctaagaacctgga

SEQ ID NO: 1306029 - DNA, 20 bp, Homo sapiens
ccagctccggcctgtcctcc

SEQ ID NO: 1306030 - DNA, 16 bp, Homo sapiens
ccagctctttcctcct

SEQ ID NO: 1306031 - DNA, 14 bp, Homo sapiens
ccagctgcactgat

SEQ ID NO: 1306032 - DNA, 16 bp, Homo sapiens
ccagctgggtcaggca

SEQ ID NO: 1306033 - DNA, 18 bp, Homo sapiens
ccagctgggtcaggcagg

SEQ ID NO: 1306034 - DNA, 15 bp, Homo sapiens
ccaggaccagctcag

SEQ ID NO: 1306035 - DNA, 19 bp, Homo sapiens
ccaggaccctgaaggggcc

SEQ ID NO: 1306036 - DNA, 18 bp, Homo sapiens
ccaggacctggctgccat

SEQ ID NO: 1306037 - DNA, 20 bp, Homo sapiens
ccaggactatatttgggcct

SEQ ID NO: 1306038 - DNA, 14 bp, Homo sapiens
ccaggactgggcca

SEQ ID NO: 1306039 - DNA, 21 bp, Homo sapiens
ccaggagtgtggccacgtggg

SEQ ID NO: 1306040 - DNA, 15 bp, Homo sapiens
ccaggcagatccagg

SEQ ID NO: 1306041 - DNA, 18 bp, Homo sapiens
ccaggctgaccacagcac

SEQ ID NO: 1306042 - DNA, 21 bp, Homo sapiens
ccaggctggtttcgaactcct

SEQ ID NO: 1306043 - DNA, 23 bp, Homo sapiens
ccagggacagaggccccagcctc

SEQ ID NO: 1306044 - DNA, 15 bp, Homo sapiens
ccagggagaagctcc

SEQ ID NO: 1306045 - DNA, 12 bp, Homo sapiens
ccagggagcctt

SEQ ID NO: 1306046 - DNA, 16 bp, Homo sapiens
ccagggctggactgag

SEQ ID NO: 1306047 - DNA, 17 bp, Homo sapiens
ccagggctggactgagg

SEQ ID NO: 1306048 - DNA, 18 bp, Homo sapiens
ccagggctggactgaggc

SEQ ID NO: 1306049 - DNA, 19 bp, Homo sapiens
ccagggctggactgaggcc

SEQ ID NO: 1306050 - DNA, 19 bp, Homo sapiens
ccaggggggtgaggagctg

SEQ ID NO: 1306051 - DNA, 14 bp, Homo sapiens
ccagggtgtgtgct

SEQ ID NO: 1306052 - DNA, 17 bp, Homo sapiens
ccaggtgttactgtaat

SEQ ID NO: 1306053 - DNA, 15 bp, Homo sapiens
ccagtccccccaccc

SEQ ID NO: 1306054 - DNA, 21 bp, Homo sapiens
ccagtctccaccaggaacctc

SEQ ID NO: 1306055 - DNA, 17 bp, Homo sapiens
ccatccccgcagtgtgc

SEQ ID NO: 1306056 - DNA, 13 bp, Homo sapiens
ccatcctccagca

SEQ ID NO: 1306057 - DNA, 14 bp, Homo sapiens
ccatcctccagcag

SEQ ID NO: 1306058 - DNA, 21 bp, Homo sapiens
ccatctcatgcccctggctgg

SEQ ID NO: 1306059 - DNA, 22 bp, Homo sapiens
ccatgagttggggtctggcagc

SEQ ID NO: 1306060 - DNA, 19 bp, Homo sapiens
ccatgatggcaacagatct

SEQ ID NO: 1306061 - DNA, 15 bp, Homo sapiens
ccatgcactgtgaag

SEQ ID NO: 1306062 - DNA, 21 bp, Homo sapiens
ccatgcactgtgaaggaccct

SEQ ID NO: 1306063 - DNA, 12 bp, Homo sapiens
ccatggaacctg

SEQ ID NO: 1306064 - DNA, 17 bp, Homo sapiens
ccatggagccagctccc

SEQ ID NO: 1306065 - DNA, 18 bp, Homo sapiens
ccatggagccagctccct

SEQ ID NO: 1306066 - DNA, 20 bp, Homo sapiens
ccattcagtgattactgtca

SEQ ID NO: 1306067 - DNA, 13 bp, Homo sapiens
ccattcctgaaga

SEQ ID NO: 1306068 - DNA, 16 bp, Homo sapiens
ccattctccacagcaa

SEQ ID NO: 1306069 - DNA, 12 bp, Homo sapiens
ccattctttctg

SEQ ID NO: 1306070 - DNA, 15 bp, Homo sapiens
ccattcttttgtaat

SEQ ID NO: 1306071 - DNA, 22 bp, Homo sapiens
ccattcttttgtaatttaaatg

SEQ ID NO: 1306072 - DNA, 15 bp, Homo sapiens
ccattgtccctctgc

SEQ ID NO: 1306073 - DNA, 19 bp, Homo sapiens
ccattgtccctctgcccca

SEQ ID NO: 1306074 - DNA, 22 bp, Homo sapiens
ccattgtccctctgccccatcc

SEQ ID NO: 1306075 - DNA, 16 bp, Homo sapiens
cccaaatttgattgat

SEQ ID NO: 1306076 - DNA, 19 bp, Homo sapiens
cccaaatttgattgatttg

SEQ ID NO: 1306077 - DNA, 13 bp, Homo sapiens
cccaactgtcttt

SEQ ID NO: 1306078 - DNA, 12 bp, Homo sapiens
cccaagctcaga

SEQ ID NO: 1306079 - DNA, 23 bp, Homo sapiens
cccaagggatctggtcctaccca

SEQ ID NO: 1306080 - DNA, 15 bp, Homo sapiens
cccaatttcagactc

SEQ ID NO: 1306081 - DNA, 22 bp, Homo sapiens
cccacccctgggggctctcatg

SEQ ID NO: 1306082 - DNA, 17 bp, Homo sapiens
cccacctccctgcctcc

SEQ ID NO: 1306083 - DNA, 22 bp, Homo sapiens
cccagagaaaggggagcccact

SEQ ID NO: 1306084 - DNA, 18 bp, Homo sapiens
cccagagacatacttgaa

SEQ ID NO: 1306085 - DNA, 15 bp, Homo sapiens
cccagagcccagctc

SEQ ID NO: 1306086 - DNA, 17 bp, Homo sapiens
cccagagcccagctcca

SEQ ID NO: 1306087 - DNA, 21 bp, Homo sapiens
cccagattggctcacactgag

SEQ ID NO: 1306088 - DNA, 22 bp, Homo sapiens
cccagattggctcacactgaga

SEQ ID NO: 1306089 - DNA, 18 bp, Homo sapiens
cccagattttgctgtata

SEQ ID NO: 1306090 - DNA, 24 bp, Homo sapiens
cccagcactgaggaagaacggggc

SEQ ID NO: 1306091 - DNA, 11 bp, Homo sapiens
cccagcccaga

SEQ ID NO: 1306092 - DNA, 16 bp, Homo sapiens
cccagcctccctgaag

SEQ ID NO: 1306093 - DNA, 17 bp, Homo sapiens
cccagctaagaacctgg

SEQ ID NO: 1306094 - DNA, 17 bp, Homo sapiens
cccagctccggcctgtc

SEQ ID NO: 1306095 - DNA, 16 bp, Homo sapiens
cccaggaaaggcccag

SEQ ID NO: 1306096 - DNA, 11 bp, Homo sapiens
cccaggaccct

SEQ ID NO: 1306097 - DNA, 16 bp, Homo sapiens
cccaggacctggctgc

SEQ ID NO: 1306098 - DNA, 15 bp, Homo sapiens
cccaggcagggccaa

SEQ ID NO: 1306099 - DNA, 17 bp, Homo sapiens
cccagggcccagagccc

SEQ ID NO: 1306100 - DNA, 19 bp, Homo sapiens
cccagggcccagagcccag

SEQ ID NO: 1306101 - DNA, 19 bp, Homo sapiens
cccagtgcccccactgacc

SEQ ID NO: 1306102 - DNA, 22 bp, Homo sapiens
cccagtgcccccactgaccaga

SEQ ID NO: 1306103 - DNA, 13 bp, Homo sapiens
cccatccagggcc

SEQ ID NO: 1306104 - DNA, 14 bp, Homo sapiens
cccatcctccagca

SEQ ID NO: 1306105 - DNA, 12 bp, Homo sapiens
cccatgcactgt

SEQ ID NO: 1306106 - DNA, 20 bp, Homo sapiens
cccatgcactgtgaaggacc

SEQ ID NO: 1306107 - DNA, 22 bp, Homo sapiens
cccatgcactgtgaaggaccct

SEQ ID NO: 1306108 - DNA, 15 bp, Homo sapiens
cccatggacaggctg

SEQ ID NO: 1306109 - DNA, 22 bp, Homo sapiens
cccatggacaggctggctccag

SEQ ID NO: 1306110 - DNA, 18 bp, Homo sapiens
cccattcctgaagaacca

SEQ ID NO: 1306111 - DNA, 16 bp, Homo sapiens
cccatttctatttatt

SEQ ID NO: 1306112 - DNA, 12 bp, Homo sapiens
ccccacccctgg

SEQ ID NO: 1306113 - DNA, 12 bp, Homo sapiens
ccccaccctcat

SEQ ID NO: 1306114 - DNA, 17 bp, Homo sapiens
ccccacctctccctgac

SEQ ID NO: 1306115 - DNA, 18 bp, Homo sapiens
ccccagcaggtgctgact

SEQ ID NO: 1306116 - DNA, 19 bp, Homo sapiens
ccccagctaagaacctgga

SEQ ID NO: 1306117 - DNA, 18 bp, Homo sapiens
ccccaggaccagctcagg

SEQ ID NO: 1306118 - DNA, 16 bp, Homo sapiens
ccccaggactgggcca

SEQ ID NO: 1306119 - DNA, 12 bp, Homo sapiens
ccccatcctcca

SEQ ID NO: 1306120 - DNA, 20 bp, Homo sapiens
ccccatttctatttatttac

SEQ ID NO: 1306121 - DNA, 12 bp, Homo sapiens
cccccaccccct

SEQ ID NO: 1306122 - DNA, 21 bp, Homo sapiens
cccccagctaagaacctggaa

SEQ ID NO: 1306123 - DNA, 15 bp, Homo sapiens
cccccagctccggcc

SEQ ID NO: 1306124 - DNA, 15 bp, Homo sapiens
cccccaggactgggc

SEQ ID NO: 1306125 - DNA, 14 bp, Homo sapiens
cccccatgcactgt

SEQ ID NO: 1306126 - DNA, 14 bp, Homo sapiens
ccccccatgcactg

SEQ ID NO: 1306127 - DNA, 14 bp, Homo sapiens
ccccgtctctacta

SEQ ID NO: 1306128 - DNA, 12 bp, Homo sapiens
cccctccctttc

SEQ ID NO: 1306129 - DNA, 20 bp, Homo sapiens
cccctgacctgtgagcccag

SEQ ID NO: 1306130 - DNA, 14 bp, Homo sapiens
cccctggcctctgt

SEQ ID NO: 1306131 - DNA, 14 bp, Homo sapiens
cccctgtctagaga

SEQ ID NO: 1306132 - DNA, 19 bp, Homo sapiens
ccccttctgctcagctctg

SEQ ID NO: 1306133 - DNA, 20 bp, Homo sapiens
ccccttctgctcagctctgg

SEQ ID NO: 1306134 - DNA, 23 bp, Homo sapiens
cccgagtcattcgttctgtggag

SEQ ID NO: 1306135 - DNA, 13 bp, Homo sapiens
ccctcacccctgg

SEQ ID NO: 1306136 - DNA, 20 bp, Homo sapiens
ccctcacccctggttctcat

SEQ ID NO: 1306137 - DNA, 23 bp, Homo sapiens
ccctcaccttggcaccagacacc

SEQ ID NO: 1306138 - DNA, 14 bp, Homo sapiens
ccctccccatggag

SEQ ID NO: 1306139 - DNA, 15 bp, Homo sapiens
ccctcccccccatgc

SEQ ID NO: 1306140 - DNA, 20 bp, Homo sapiens
ccctcccccccatgcactgt

SEQ ID NO: 1306141 - DNA, 16 bp, Homo sapiens
ccctccctttctcccc

SEQ ID NO: 1306142 - DNA, 12 bp, Homo sapiens
ccctcctccact

SEQ ID NO: 1306143 - DNA, 13 bp, Homo sapiens
ccctcctccactc

SEQ ID NO: 1306144 - DNA, 15 bp, Homo sapiens
ccctctgccccatcc

SEQ ID NO: 1306145 - DNA, 20 bp, Homo sapiens
ccctgacctgtgagcccagc

SEQ ID NO: 1306146 - DNA, 19 bp, Homo sapiens
ccctgcatctgaccagcag

SEQ ID NO: 1306147 - DNA, 21 bp, Homo sapiens
ccctgcatctgaccagcagcg

SEQ ID NO: 1306148 - DNA, 16 bp, Homo sapiens
ccctgcccccaggact

SEQ ID NO: 1306149 - DNA, 17 bp, Homo sapiens
ccctgcccccaggactg

SEQ ID NO: 1306150 - DNA, 22 bp, Homo sapiens
ccctgcccccaggactgggcca

SEQ ID NO: 1306151 - DNA, 22 bp, Homo sapiens
ccctgcgggtgaacaaagcagc

SEQ ID NO: 1306152 - DNA, 15 bp, Homo sapiens
ccctggcctctgtgc

SEQ ID NO: 1306153 - DNA, 19 bp, Homo sapiens
ccctggcctctgtgccttc

SEQ ID NO: 1306154 - DNA, 21 bp, Homo sapiens
ccctggcctctgtgccttctt

SEQ ID NO: 1306155 - DNA, 16 bp, Homo sapiens
ccctggttctcatctt

SEQ ID NO: 1306156 - DNA, 12 bp, Homo sapiens
ccctgtctagag

SEQ ID NO: 1306157 - DNA, 17 bp, Homo sapiens
ccctgtctagagaggga

SEQ ID NO: 1306158 - DNA, 20 bp, Homo sapiens
ccctgtctagagagggaggc

SEQ ID NO: 1306159 - DNA, 16 bp, Homo sapiens
ccctgttccccagaga

SEQ ID NO: 1306160 - DNA, 18 bp, Homo sapiens
cccttcacaaagcccaag

SEQ ID NO: 1306161 - DNA, 17 bp, Homo sapiens
cccttctcctcttgtaa

SEQ ID NO: 1306162 - DNA, 14 bp, Homo sapiens
cccttctgctcagc

SEQ ID NO: 1306163 - DNA, 23 bp, Homo sapiens
cccttctgctcagctctgggcca

SEQ ID NO: 1306164 - DNA, 14 bp, Homo sapiens
cccttgagaaacct

SEQ ID NO: 1306165 - DNA, 22 bp, Homo sapiens
ccgcctggatgcggatggccgg

SEQ ID NO: 1306166 - DNA, 15 bp, Homo sapiens
ccgctgccacccacc

SEQ ID NO: 1306167 - DNA, 15 bp, Homo sapiens
ccgcttctgcctgca

SEQ ID NO: 1306168 - DNA, 16 bp, Homo sapiens
ccgtgctgacagctgc

SEQ ID NO: 1306169 - DNA, 17 bp, Homo sapiens
ccgtgctgacagctgct

SEQ ID NO: 1306170 - DNA, 20 bp, Homo sapiens
ccgtgctgacagctgctcct

SEQ ID NO: 1306171 - DNA, 12 bp, Homo sapiens
cctaaggctgca

SEQ ID NO: 1306172 - DNA, 13 bp, Homo sapiens
cctaatccaggca

SEQ ID NO: 1306173 - DNA, 18 bp, Homo sapiens
cctaatccaggcagatcc

SEQ ID NO: 1306174 - DNA, 17 bp, Homo sapiens
cctacagctttgatccc

SEQ ID NO: 1306175 - DNA, 21 bp, Homo sapiens
cctagcagcaccgttctgtgc

SEQ ID NO: 1306176 - DNA, 18 bp, Homo sapiens
cctaggcctcagccagag

SEQ ID NO: 1306177 - DNA, 16 bp, Homo sapiens
cctatgtagtccgtgc

SEQ ID NO: 1306178 - DNA, 18 bp, Homo sapiens
cctatttccattcaacaa

SEQ ID NO: 1306179 - DNA, 15 bp, Homo sapiens
cctcacccctggttc

SEQ ID NO: 1306180 - DNA, 23 bp, Homo sapiens
cctcacccctggttctcatcttt

SEQ ID NO: 1306181 - DNA, 17 bp, Homo sapiens
cctcagccctgaccctg

SEQ ID NO: 1306182 - DNA, 17 bp, Homo sapiens
cctcagcctggccagac

SEQ ID NO: 1306183 - DNA, 20 bp, Homo sapiens
cctcagcctggccagacaca

SEQ ID NO: 1306184 - DNA, 21 bp, Homo sapiens
cctcagccttgccagagatcc

SEQ ID NO: 1306185 - DNA, 16 bp, Homo sapiens
cctcaggtggccatgc

SEQ ID NO: 1306186 - DNA, 21 bp, Homo sapiens
cctcaggtggccatgcctcag

SEQ ID NO: 1306187 - DNA, 17 bp, Homo sapiens
cctcatctctctgccca

SEQ ID NO: 1306188 - DNA, 19 bp, Homo sapiens
cctcatctctctgcccaac

SEQ ID NO: 1306189 - DNA, 20 bp, Homo sapiens
cctcatctctctgcccaacc

SEQ ID NO: 1306190 - DNA, 17 bp, Homo sapiens
cctccactctcccccac

SEQ ID NO: 1306191 - DNA, 22 bp, Homo sapiens
cctccagaactcactggggcct

SEQ ID NO: 1306192 - DNA, 17 bp, Homo sapiens
cctccagctctttcctc

SEQ ID NO: 1306193 - DNA, 12 bp, Homo sapiens
cctccagggctg

SEQ ID NO: 1306194 - DNA, 13 bp, Homo sapiens
cctccagggctgg

SEQ ID NO: 1306195 - DNA, 20 bp, Homo sapiens
cctccagggctggactgagg

SEQ ID NO: 1306196 - DNA, 16 bp, Homo sapiens
cctccccatggagcca

SEQ ID NO: 1306197 - DNA, 21 bp, Homo sapiens
cctccctgcatctgaccagca

SEQ ID NO: 1306198 - DNA, 22 bp, Homo sapiens
cctccctgcatctgaccagcag

SEQ ID NO: 1306199 - DNA, 18 bp, Homo sapiens
cctccctgttccccagag

SEQ ID NO: 1306200 - DNA, 10 bp, Homo sapiens
cctcccttct

SEQ ID NO: 1306201 - DNA, 17 bp, Homo sapiens
cctcccttctgctactg

SEQ ID NO: 1306202 - DNA, 13 bp, Homo sapiens
cctccctttctcc

SEQ ID NO: 1306203 - DNA, 14 bp, Homo sapiens
cctccctttctccc

SEQ ID NO: 1306204 - DNA, 16 bp, Homo sapiens
cctcctccactctccc

SEQ ID NO: 1306205 - DNA, 13 bp, Homo sapiens
cctcctccctgca

SEQ ID NO: 1306206 - DNA, 13 bp, Homo sapiens
cctccttcagaca

SEQ ID NO: 1306207 - DNA, 20 bp, Homo sapiens
cctcgaaacacagaaacctt

SEQ ID NO: 1306208 - DNA, 19 bp, Homo sapiens
cctctcccattgtccctct

SEQ ID NO: 1306209 - DNA, 16 bp, Homo sapiens
cctctccccagcccag

SEQ ID NO: 1306210 - DNA, 21 bp, Homo sapiens
cctctccccagcccagagaca

SEQ ID NO: 1306211 - DNA, 12 bp, Homo sapiens
cctctccctgac

SEQ ID NO: 1306212 - DNA, 20 bp, Homo sapiens
cctctcttatagaatattta

SEQ ID NO: 1306213 - DNA, 14 bp, Homo sapiens
cctctgatacctca

SEQ ID NO: 1306214 - DNA, 19 bp, Homo sapiens
cctctgccccatcctccag

SEQ ID NO: 1306215 - DNA, 13 bp, Homo sapiens
cctctggagtggc

SEQ ID NO: 1306216 - DNA, 14 bp, Homo sapiens
cctctggagtggcc

SEQ ID NO: 1306217 - DNA, 15 bp, Homo sapiens
cctctggagtggcca

SEQ ID NO: 1306218 - DNA, 15 bp, Homo sapiens
cctctgtcagtcaca

SEQ ID NO: 1306219 - DNA, 14 bp, Homo sapiens
cctctgtccccttc

SEQ ID NO: 1306220 - DNA, 17 bp, Homo sapiens
cctctgtccccttctct

SEQ ID NO: 1306221 - DNA, 18 bp, Homo sapiens
cctctgtccccttctctc

SEQ ID NO: 1306222 - DNA, 19 bp, Homo sapiens
cctctgtccccttctctca

SEQ ID NO: 1306223 - DNA, 13 bp, Homo sapiens
cctctttgctttg

SEQ ID NO: 1306224 - DNA, 13 bp, Homo sapiens
cctgaacctagga

SEQ ID NO: 1306225 - DNA, 16 bp, Homo sapiens
cctgaagaaccagtcc

SEQ ID NO: 1306226 - DNA, 20 bp, Homo sapiens
cctgaaggggccatgatggc

SEQ ID NO: 1306227 - DNA, 14 bp, Homo sapiens
cctgaaggggcgtc

SEQ ID NO: 1306228 - DNA, 20 bp, Homo sapiens
cctgaccacgctttctagct

SEQ ID NO: 1306229 - DNA, 16 bp, Homo sapiens
cctgacctccctctaa

SEQ ID NO: 1306230 - DNA, 17 bp, Homo sapiens
cctgagatttcatctgc

SEQ ID NO: 1306231 - DNA, 22 bp, Homo sapiens
cctgagatttcatctgctctcc

SEQ ID NO: 1306232 - DNA, 18 bp, Homo sapiens
cctgagcaactcttgatt

SEQ ID NO: 1306233 - DNA, 23 bp, Homo sapiens
cctgagcaactcttgattatcca

SEQ ID NO: 1306234 - DNA, 22 bp, Homo sapiens
cctgaggctttggatttgacat

SEQ ID NO: 1306235 - DNA, 21 bp, Homo sapiens
cctgatgctgacattcacctg

SEQ ID NO: 1306236 - DNA, 19 bp, Homo sapiens
cctgatttaggagaagcca

SEQ ID NO: 1306237 - DNA, 21 bp, Homo sapiens
cctgatttaggagaagccagg

SEQ ID NO: 1306238 - DNA, 13 bp, Homo sapiens
cctgccagctgca

SEQ ID NO: 1306239 - DNA, 23 bp, Homo sapiens
cctgccagctgcactgatgctgc

SEQ ID NO: 1306240 - DNA, 21 bp, Homo sapiens
cctgccccaactctcccctga

SEQ ID NO: 1306241 - DNA, 19 bp, Homo sapiens
cctgcccccaggactgggc

SEQ ID NO: 1306242 - DNA, 15 bp, Homo sapiens
cctgccgcagagctg

SEQ ID NO: 1306243 - DNA, 17 bp, Homo sapiens
cctgccgcagagctggc

SEQ ID NO: 1306244 - DNA, 14 bp, Homo sapiens
cctgcctccaggaa

SEQ ID NO: 1306245 - DNA, 23 bp, Homo sapiens
cctgcctccagggctggactgag

SEQ ID NO: 1306246 - DNA, 20 bp, Homo sapiens
cctgcgccaccgcccagaga

SEQ ID NO: 1306247 - DNA, 23 bp, Homo sapiens
cctgcgggtgaacaaagcagcca

SEQ ID NO: 1306248 - DNA, 23 bp, Homo sapiens
cctgcggtagatgggagggaggc

SEQ ID NO: 1306249 - DNA, 13 bp, Homo sapiens
cctggaacttggg

SEQ ID NO: 1306250 - DNA, 17 bp, Homo sapiens
cctggaacttggggagt

SEQ ID NO: 1306251 - DNA, 13 bp, Homo sapiens
cctggagcccaga

SEQ ID NO: 1306252 - DNA, 17 bp, Homo sapiens
cctggagcccagaggag

SEQ ID NO: 1306253 - DNA, 14 bp, Homo sapiens
cctggaggcccagt

SEQ ID NO: 1306254 - DNA, 22 bp, Homo sapiens
cctggaggtggctgagcccctg

SEQ ID NO: 1306255 - DNA, 15 bp, Homo sapiens
cctggcagctctgga

SEQ ID NO: 1306256 - DNA, 17 bp, Homo sapiens
cctggcagctctggaca

SEQ ID NO: 1306257 - DNA, 13 bp, Homo sapiens
cctggccagacac

SEQ ID NO: 1306258 - DNA, 18 bp, Homo sapiens
cctggccagacacaggcc

SEQ ID NO: 1306259 - DNA, 23 bp, Homo sapiens
cctggccagacacaggccctccc

SEQ ID NO: 1306260 - DNA, 17 bp, Homo sapiens
cctggccatcccacaag

SEQ ID NO: 1306261 - DNA, 13 bp, Homo sapiens
cctggccccagga

SEQ ID NO: 1306262 - DNA, 16 bp, Homo sapiens
cctggggctggcctcc

SEQ ID NO: 1306263 - DNA, 15 bp, Homo sapiens
cctggggtggggtca

SEQ ID NO: 1306264 - DNA, 12 bp, Homo sapiens
cctggtgctgct

SEQ ID NO: 1306265 - DNA, 23 bp, Homo sapiens
cctgtaatcccagcactttggga

SEQ ID NO: 1306266 - DNA, 18 bp, Homo sapiens
cctgtataagtggaggca

SEQ ID NO: 1306267 - DNA, 13 bp, Homo sapiens
cctgtatatagcc

SEQ ID NO: 1306268 - DNA, 14 bp, Homo sapiens
cctgtctagagagg

SEQ ID NO: 1306269 - DNA, 14 bp, Homo sapiens
cctgtgtgattgac

SEQ ID NO: 1306270 - DNA, 22 bp, Homo sapiens
cctgtgtgattgacagctttgc

SEQ ID NO: 1306271 - DNA, 20 bp, Homo sapiens
cctgtgtgtccaaaactgcc

SEQ ID NO: 1306272 - DNA, 16 bp, Homo sapiens
cctgttccccagagaa

SEQ ID NO: 1306273 - DNA, 13 bp, Homo sapiens
cctgttctgaact

SEQ ID NO: 1306274 - DNA, 17 bp, Homo sapiens
ccttaccctccttggga

SEQ ID NO: 1306275 - DNA, 18 bp, Homo sapiens
ccttcacaaagcccaagg

SEQ ID NO: 1306276 - DNA, 10 bp, Homo sapiens
ccttcagaca

SEQ ID NO: 1306277 - DNA, 24 bp, Homo sapiens
ccttccctcaccttggcaccagac

SEQ ID NO: 1306278 - DNA, 13 bp, Homo sapiens
ccttctaaaggtg

SEQ ID NO: 1306279 - DNA, 17 bp, Homo sapiens
ccttctcctcttgtaaa

SEQ ID NO: 1306280 - DNA, 21 bp, Homo sapiens
ccttgaaaataagaatagaaa

SEQ ID NO: 1306281 - DNA, 19 bp, Homo sapiens
ccttgagaaaccttattgt

SEQ ID NO: 1306282 - DNA, 12 bp, Homo sapiens
ccttgccagaga

SEQ ID NO: 1306283 - DNA, 23 bp, Homo sapiens
ccttggcaccagacacccaggac

SEQ ID NO: 1306284 - DNA, 12 bp, Homo sapiens
ccttggctcaga

SEQ ID NO: 1306285 - DNA, 23 bp, Homo sapiens
cctttattaccccctccttcaga

SEQ ID NO: 1306286 - DNA, 15 bp, Homo sapiens
cctttctcccctgcc

SEQ ID NO: 1306287 - DNA, 19 bp, Homo sapiens
cctttctcccctgccccca

SEQ ID NO: 1306288 - DNA, 14 bp, Homo sapiens
cctttggttctggc

SEQ ID NO: 1306289 - DNA, 23 bp, Homo sapiens
ccttttgaacgcccccccccacc

SEQ ID NO: 1306290 - DNA, 14 bp, Homo sapiens
cgcacctgcctcag

SEQ ID NO: 1306291 - DNA, 16 bp, Homo sapiens
cgcacctgcctcagga

SEQ ID NO: 1306292 - DNA, 14 bp, Homo sapiens
cgcagagctggccg

SEQ ID NO: 1306293 - DNA, 17 bp, Homo sapiens
cgcagtgtgcactaagg

SEQ ID NO: 1306294 - DNA, 17 bp, Homo sapiens
cgccaaataatgtctct

SEQ ID NO: 1306295 - DNA, 23 bp, Homo sapiens
cgccaggctgaccacagcacagc

SEQ ID NO: 1306296 - DNA, 22 bp, Homo sapiens
cgcccagagacccaagctgcct

SEQ ID NO: 1306297 - DNA, 16 bp, Homo sapiens
cgcctcccctgcccca

SEQ ID NO: 1306298 - DNA, 19 bp, Homo sapiens
cgcgccaaataatgtctct

SEQ ID NO: 1306299 - DNA, 23 bp, Homo sapiens
cgcgccaaataatgtctctgtga

SEQ ID NO: 1306300 - DNA, 18 bp, Homo sapiens
cgctcctgccgcagagct

SEQ ID NO: 1306301 - DNA, 19 bp, Homo sapiens
cgctcctgccgcagagctg

SEQ ID NO: 1306302 - DNA, 16 bp, Homo sapiens
cggaactgcatgctgc

SEQ ID NO: 1306303 - DNA, 24 bp, Homo sapiens
cggattccaaagagtagaattgca

SEQ ID NO: 1306304 - DNA, 23 bp, Homo sapiens
cggccggccagcccctggcccca

SEQ ID NO: 1306305 - DNA, 12 bp, Homo sapiens
cggcctgtcctc

SEQ ID NO: 1306306 - DNA, 16 bp, Homo sapiens
cggctcggaggaagcc

SEQ ID NO: 1306307 - DNA, 16 bp, Homo sapiens
cggggtgcccacaggc

SEQ ID NO: 1306308 - DNA, 22 bp, Homo sapiens
cggtagccagcacacagggcag

SEQ ID NO: 1306309 - DNA, 17 bp, Homo sapiens
cggtgctgtcctcaggt

SEQ ID NO: 1306310 - DNA, 22 bp, Homo sapiens
cggtggctagtcaagctcctcc

SEQ ID NO: 1306311 - DNA, 14 bp, Homo sapiens
cgtctgttccccct

SEQ ID NO: 1306312 - DNA, 15 bp, Homo sapiens
cgtgaaaacggagct

SEQ ID NO: 1306313 - DNA, 17 bp, Homo sapiens
cgtgaaaacggagctga

SEQ ID NO: 1306314 - DNA, 18 bp, Homo sapiens
cgtgaaaacggagctgaa

SEQ ID NO: 1306315 - DNA, 19 bp, Homo sapiens
cgtgctcgccccagcaggt

SEQ ID NO: 1306316 - DNA, 16 bp, Homo sapiens
cgtttgagaagaaaac

SEQ ID NO: 1306317 - DNA, 23 bp, Homo sapiens
ctaaaagtgggcttgattctgca

SEQ ID NO: 1306318 - DNA, 15 bp, Homo sapiens
ctaaacggattccaa

SEQ ID NO: 1306319 - DNA, 14 bp, Homo sapiens
ctaagaaaagattt

SEQ ID NO: 1306320 - DNA, 15 bp, Homo sapiens
ctaagaaaagatttt

SEQ ID NO: 1306321 - DNA, 17 bp, Homo sapiens
ctaagaattcaaactgg

SEQ ID NO: 1306322 - DNA, 17 bp, Homo sapiens
ctaagcctgaaggggcg

SEQ ID NO: 1306323 - DNA, 20 bp, Homo sapiens
ctaagcctgaaggggcgtct

SEQ ID NO: 1306324 - DNA, 18 bp, Homo sapiens
ctaaggggcccggccagc

SEQ ID NO: 1306325 - DNA, 18 bp, Homo sapiens
ctaatccaggcagatcca

SEQ ID NO: 1306326 - DNA, 23 bp, Homo sapiens
ctaatccaggcagatccaggact

SEQ ID NO: 1306327 - DNA, 18 bp, Homo sapiens
ctaatgctccttgttcct

SEQ ID NO: 1306328 - DNA, 21 bp, Homo sapiens
ctaatttatcttgtctctggg

SEQ ID NO: 1306329 - DNA, 17 bp, Homo sapiens
ctaatttcaaaatgctt

SEQ ID NO: 1306330 - DNA, 19 bp, Homo sapiens
ctaatttcaaaatgctttt

SEQ ID NO: 1306331 - DNA, 22 bp, Homo sapiens
ctaatttcaaaatgctttttat

SEQ ID NO: 1306332 - DNA, 12 bp, Homo sapiens
ctaatttgcatt

SEQ ID NO: 1306333 - DNA, 14 bp, Homo sapiens
ctaatttgcattaa

SEQ ID NO: 1306334 - DNA, 10 bp, Homo sapiens
ctacaaatca

SEQ ID NO: 1306335 - DNA, 13 bp, Homo sapiens
ctacaatgtgaac

SEQ ID NO: 1306336 - DNA, 19 bp, Homo sapiens
ctacaatgtgaactttatt

SEQ ID NO: 1306337 - DNA, 13 bp, Homo sapiens
ctacatgagaaca

SEQ ID NO: 1306338 - DNA, 12 bp, Homo sapiens
ctacattcattt

SEQ ID NO: 1306339 - DNA, 19 bp, Homo sapiens
ctaccttgaaaataagaat

SEQ ID NO: 1306340 - DNA, 12 bp, Homo sapiens
ctagaatttatt

SEQ ID NO: 1306341 - DNA, 13 bp, Homo sapiens
ctagaatttattc

SEQ ID NO: 1306342 - DNA, 12 bp, Homo sapiens
ctagagagggag

SEQ ID NO: 1306343 - DNA, 13 bp, Homo sapiens
ctagagagggagg

SEQ ID NO: 1306344 - DNA, 22 bp, Homo sapiens
ctagagagggaggcaagccctg

SEQ ID NO: 1306345 - DNA, 23 bp, Homo sapiens
ctagagagggaggcaagccctgt

SEQ ID NO: 1306346 - DNA, 15 bp, Homo sapiens
ctagagggaggggcc

SEQ ID NO: 1306347 - DNA, 17 bp, Homo sapiens
ctagatgaagttttaca

SEQ ID NO: 1306348 - DNA, 16 bp, Homo sapiens
ctagatggctcctctc

SEQ ID NO: 1306349 - DNA, 18 bp, Homo sapiens
ctagatggctcctctcag

SEQ ID NO: 1306350 - DNA, 12 bp, Homo sapiens
ctagctgggggt

SEQ ID NO: 1306351 - DNA, 12 bp, Homo sapiens
ctaggccgggcg

SEQ ID NO: 1306352 - DNA, 19 bp, Homo sapiens
ctaggcctcagccagagaa

SEQ ID NO: 1306353 - DNA, 19 bp, Homo sapiens
ctagtcaagctcctcctcc

SEQ ID NO: 1306354 - DNA, 17 bp, Homo sapiens
ctataaattcctctttg

SEQ ID NO: 1306355 - DNA, 22 bp, Homo sapiens
ctataaattcctctttgctttg

SEQ ID NO: 1306356 - DNA, 20 bp, Homo sapiens
ctatacatatctttattaat

SEQ ID NO: 1306357 - DNA, 22 bp, Homo sapiens
ctatacatatctttattaatca

SEQ ID NO: 1306358 - DNA, 13 bp, Homo sapiens
ctatagcctgggg

SEQ ID NO: 1306359 - DNA, 18 bp, Homo sapiens
ctatagcctggggtgggg

SEQ ID NO: 1306360 - DNA, 21 bp, Homo sapiens
ctatagcctggggtggggtca

SEQ ID NO: 1306361 - DNA, 12 bp, Homo sapiens
ctatatttgggc

SEQ ID NO: 1306362 - DNA, 17 bp, Homo sapiens
ctatcacctatttccat

SEQ ID NO: 1306363 - DNA, 16 bp, Homo sapiens
ctatctactctcctca

SEQ ID NO: 1306364 - DNA, 20 bp, Homo sapiens
ctatgcatggtgccccagga

SEQ ID NO: 1306365 - DNA, 22 bp, Homo sapiens
ctatgcatggtgccccaggacc

SEQ ID NO: 1306366 - DNA, 20 bp, Homo sapiens
ctatgtagtccgtgctgaca

SEQ ID NO: 1306367 - DNA, 20 bp, Homo sapiens
ctatgtttacaaatggacat

SEQ ID NO: 1306368 - DNA, 18 bp, Homo sapiens
ctatttatttactgagct

SEQ ID NO: 1306369 - DNA, 16 bp, Homo sapiens
ctcaaatggggccaga

SEQ ID NO: 1306370 - DNA, 17 bp, Homo sapiens
ctcaaatggggccagat

SEQ ID NO: 1306371 - DNA, 21 bp, Homo sapiens
ctcaaatggggccagatccag

SEQ ID NO: 1306372 - DNA, 19 bp, Homo sapiens
ctcaacccccatttctatt

SEQ ID NO: 1306373 - DNA, 13 bp, Homo sapiens
ctcaacctcttct

SEQ ID NO: 1306374 - DNA, 21 bp, Homo sapiens
ctcaacctcttctggctcaaa

SEQ ID NO: 1306375 - DNA, 23 bp, Homo sapiens
ctcaagaaataaaaggaagccaa

SEQ ID NO: 1306376 - DNA, 20 bp, Homo sapiens
ctcacaacctgaacctagga

SEQ ID NO: 1306377 - DNA, 14 bp, Homo sapiens
ctcacactgagaat

SEQ ID NO: 1306378 - DNA, 19 bp, Homo sapiens
ctcacccctggttctcatc

SEQ ID NO: 1306379 - DNA, 16 bp, Homo sapiens
ctcactggggcctaca

SEQ ID NO: 1306380 - DNA, 14 bp, Homo sapiens
ctcacttcaccctg

SEQ ID NO: 1306381 - DNA, 20 bp, Homo sapiens
ctcactttcctcctgaggct

SEQ ID NO: 1306382 - DNA, 20 bp, Homo sapiens
ctcagacatgttttccgtga

SEQ ID NO: 1306383 - DNA, 13 bp, Homo sapiens
ctcagacattggc

SEQ ID NO: 1306384 - DNA, 17 bp, Homo sapiens
ctcagatcagtgtacca

SEQ ID NO: 1306385 - DNA, 21 bp, Homo sapiens
ctcagatcagtgtaccatttg

SEQ ID NO: 1306386 - DNA, 10 bp, Homo sapiens
ctcagatcca

SEQ ID NO: 1306387 - DNA, 13 bp, Homo sapiens
ctcagatccaggg

SEQ ID NO: 1306388 - DNA, 16 bp, Homo sapiens
ctcagatccagggaca

SEQ ID NO: 1306389 - DNA, 14 bp, Homo sapiens
ctcagcacaaggcc

SEQ ID NO: 1306390 - DNA, 20 bp, Homo sapiens
ctcagcacaaggccatctgg

SEQ ID NO: 1306391 - DNA, 15 bp, Homo sapiens
ctcagccctgaccct

SEQ ID NO: 1306392 - DNA, 14 bp, Homo sapiens
ctcagcctggccag

SEQ ID NO: 1306393 - DNA, 17 bp, Homo sapiens
ctcagcctggccagaca

SEQ ID NO: 1306394 - DNA, 16 bp, Homo sapiens
ctcagccttgccagag

SEQ ID NO: 1306395 - DNA, 20 bp, Homo sapiens
ctcagccttgccagagatcc

SEQ ID NO: 1306396 - DNA, 21 bp, Homo sapiens
ctcagccttgccagagatcca

SEQ ID NO: 1306397 - DNA, 12 bp, Homo sapiens
ctcaggacagat

SEQ ID NO: 1306398 - DNA, 14 bp, Homo sapiens
ctcaggacagatgc

SEQ ID NO: 1306399 - DNA, 19 bp, Homo sapiens
ctcaggacagatgccacac

SEQ ID NO: 1306400 - DNA, 14 bp, Homo sapiens
ctcaggactgcgac

SEQ ID NO: 1306401 - DNA, 20 bp, Homo sapiens
ctcaggccaagaaacgtctt

SEQ ID NO: 1306402 - DNA, 18 bp, Homo sapiens
ctcagtactttggaggcc

SEQ ID NO: 1306403 - DNA, 20 bp, Homo sapiens
ctcagtactttggaggcccc

SEQ ID NO: 1306404 - DNA, 14 bp, Homo sapiens
ctcataaaaagcaa

SEQ ID NO: 1306405 - DNA, 24 bp, Homo sapiens
ctcatctctaacagctcaggatct

SEQ ID NO: 1306406 - DNA, 17 bp, Homo sapiens
ctcatctctctgcccaa

SEQ ID NO: 1306407 - DNA, 17 bp, Homo sapiens
ctcatgcccctggctgg

SEQ ID NO: 1306408 - DNA, 18 bp, Homo sapiens
ctcatgttttcaactgcc

SEQ ID NO: 1306409 - DNA, 20 bp, Homo sapiens
ctcatgttttcaactgccaa

SEQ ID NO: 1306410 - DNA, 15 bp, Homo sapiens
ctcattgctgagcct

SEQ ID NO: 1306411 - DNA, 19 bp, Homo sapiens
ctcattgctgagcctctgc

SEQ ID NO: 1306412 - DNA, 23 bp, Homo sapiens
ctcatttcacccctccctttctc

SEQ ID NO: 1306413 - DNA, 21 bp, Homo sapiens
ctccaacctgcaaagatctgt

SEQ ID NO: 1306414 - DNA, 18 bp, Homo sapiens
ctccaacctggggggcag

SEQ ID NO: 1306415 - DNA, 13 bp, Homo sapiens
ctccaccaggaac

SEQ ID NO: 1306416 - DNA, 14 bp, Homo sapiens
ctccagacctgatc

SEQ ID NO: 1306417 - DNA, 23 bp, Homo sapiens
ctccagacctgatcctggaggcc

SEQ ID NO: 1306418 - DNA, 18 bp, Homo sapiens
ctccagatgcagggcagt

SEQ ID NO: 1306419 - DNA, 21 bp, Homo sapiens
ctccagatgcagggcagtcat

SEQ ID NO: 1306420 - DNA, 15 bp, Homo sapiens
ctccagctctttcct

SEQ ID NO: 1306421 - DNA, 12 bp, Homo sapiens
ctccagggctgg

SEQ ID NO: 1306422 - DNA, 21 bp, Homo sapiens
ctccagggctggactgaggcc

SEQ ID NO: 1306423 - DNA, 19 bp, Homo sapiens
ctcccaatttcagactccc

SEQ ID NO: 1306424 - DNA, 22 bp, Homo sapiens
ctcccatccagggcccccatct

SEQ ID NO: 1306425 - DNA, 16 bp, Homo sapiens
ctcccattcctgaaga

SEQ ID NO: 1306426 - DNA, 12 bp, Homo sapiens
ctccccatggag

SEQ ID NO: 1306427 - DNA, 20 bp, Homo sapiens
ctcccccccatgcactgtga

SEQ ID NO: 1306428 - DNA, 13 bp, Homo sapiens
ctcccctgccccc

SEQ ID NO: 1306429 - DNA, 17 bp, Homo sapiens
ctcccctgcccccagga

SEQ ID NO: 1306430 - DNA, 20 bp, Homo sapiens
ctcccctgcccccaggactg

SEQ ID NO: 1306431 - DNA, 21 bp, Homo sapiens
ctcccctgcccccaggactgg

SEQ ID NO: 1306432 - DNA, 23 bp, Homo sapiens
ctcccctgcccccaggactgggc

SEQ ID NO: 1306433 - DNA, 17 bp, Homo sapiens
ctccctgaccctgtata

SEQ ID NO: 1306434 - DNA, 20 bp, Homo sapiens
ctccctgcatctgaccagca

SEQ ID NO: 1306435 - DNA, 22 bp, Homo sapiens
ctccctgcatctgaccagcagc

SEQ ID NO: 1306436 - DNA, 15 bp, Homo sapiens
ctcccttctgctact

SEQ ID NO: 1306437 - DNA, 12 bp, Homo sapiens
ctccctttctcc

SEQ ID NO: 1306438 - DNA, 13 bp, Homo sapiens
ctcctccctgcat

SEQ ID NO: 1306439 - DNA, 14 bp, Homo sapiens
ctcctccctgcatc

SEQ ID NO: 1306440 - DNA, 15 bp, Homo sapiens
ctcctccctgcatct

SEQ ID NO: 1306441 - DNA, 18 bp, Homo sapiens
ctcctccctgcatctgac

SEQ ID NO: 1306442 - DNA, 13 bp, Homo sapiens
ctcctcctccctg

SEQ ID NO: 1306443 - DNA, 20 bp, Homo sapiens
ctcctctccccagcccagag

SEQ ID NO: 1306444 - DNA, 22 bp, Homo sapiens
ctcctctccccagcccagagac

SEQ ID NO: 1306445 - DNA, 13 bp, Homo sapiens
ctcctcttgtaaa

SEQ ID NO: 1306446 - DNA, 13 bp, Homo sapiens
ctccttcagacac

SEQ ID NO: 1306447 - DNA, 15 bp, Homo sapiens
ctccttcagccctca

SEQ ID NO: 1306448 - DNA, 17 bp, Homo sapiens
ctccttcagccctcacc

SEQ ID NO: 1306449 - DNA, 14 bp, Homo sapiens
ctccttccagtgtc

SEQ ID NO: 1306450 - DNA, 20 bp, Homo sapiens
ctccttcctggagcccagag

SEQ ID NO: 1306451 - DNA, 15 bp, Homo sapiens
ctccttcctgtgtgt

SEQ ID NO: 1306452 - DNA, 12 bp, Homo sapiens
ctccttgttcct

SEQ ID NO: 1306453 - DNA, 15 bp, Homo sapiens
ctccttgttcctaga

SEQ ID NO: 1306454 - DNA, 14 bp, Homo sapiens
ctcgaaacacagaa

SEQ ID NO: 1306455 - DNA, 20 bp, Homo sapiens
ctcgccctgcggtagatggg

SEQ ID NO: 1306456 - DNA, 13 bp, Homo sapiens
ctcggaggaagcc

SEQ ID NO: 1306457 - DNA, 22 bp, Homo sapiens
ctctaacagctcaggatctctt

SEQ ID NO: 1306458 - DNA, 15 bp, Homo sapiens
ctctatgtttacaaa

SEQ ID NO: 1306459 - DNA, 20 bp, Homo sapiens
ctctatgtttacaaatggac

SEQ ID NO: 1306460 - DNA, 16 bp, Homo sapiens
ctctatttatgtttgc

SEQ ID NO: 1306461 - DNA, 19 bp, Homo sapiens
ctctcagtactttggaggc

SEQ ID NO: 1306462 - DNA, 20 bp, Homo sapiens
ctctcatgttttcaactgcc

SEQ ID NO: 1306463 - DNA, 16 bp, Homo sapiens
ctctcccattgtccct

SEQ ID NO: 1306464 - DNA, 21 bp, Homo sapiens
ctctcccattgtccctctgcc

SEQ ID NO: 1306465 - DNA, 13 bp, Homo sapiens
ctctccccagccc

SEQ ID NO: 1306466 - DNA, 16 bp, Homo sapiens
ctctccccagcccaga

SEQ ID NO: 1306467 - DNA, 17 bp, Homo sapiens
ctctccccagcccagag

SEQ ID NO: 1306468 - DNA, 18 bp, Homo sapiens
ctctccccagcccagaga

SEQ ID NO: 1306469 - DNA, 15 bp, Homo sapiens
ctctcccctgacctg

SEQ ID NO: 1306470 - DNA, 23 bp, Homo sapiens
ctctcggaactgcatgctgctgg

SEQ ID NO: 1306471 - DNA, 12 bp, Homo sapiens
ctctctccagat

SEQ ID NO: 1306472 - DNA, 21 bp, Homo sapiens
ctctcttatagaatatttatt

SEQ ID NO: 1306473 - DNA, 17 bp, Homo sapiens
ctctgccccatcctcca

SEQ ID NO: 1306474 - DNA, 21 bp, Homo sapiens
ctctgccccatcctccagcag

SEQ ID NO: 1306475 - DNA, 22 bp, Homo sapiens
ctctgccccatcctccagcagg

SEQ ID NO: 1306476 - DNA, 17 bp, Homo sapiens
ctctgcttgagtcaggt

SEQ ID NO: 1306477 - DNA, 18 bp, Homo sapiens
ctctgcttgagtcaggtt

SEQ ID NO: 1306478 - DNA, 18 bp, Homo sapiens
ctctggacagccccaccc

SEQ ID NO: 1306479 - DNA, 16 bp, Homo sapiens
ctctggagtggccact

SEQ ID NO: 1306480 - DNA, 16 bp, Homo sapiens
ctctgtcagtcacagc

SEQ ID NO: 1306481 - DNA, 17 bp, Homo sapiens
ctctgtcagtcacagcc

SEQ ID NO: 1306482 - DNA, 14 bp, Homo sapiens
ctctgtccccttct

SEQ ID NO: 1306483 - DNA, 17 bp, Homo sapiens
ctctgtccccttctctc

SEQ ID NO: 1306484 - DNA, 15 bp, Homo sapiens
ctctgtgccttcttt

SEQ ID NO: 1306485 - DNA, 20 bp, Homo sapiens
ctctgttgcaagtgcaataa

SEQ ID NO: 1306486 - DNA, 21 bp, Homo sapiens
ctcttagcattttaattagat

SEQ ID NO: 1306487 - DNA, 15 bp, Homo sapiens
ctcttagctcccctc

SEQ ID NO: 1306488 - DNA, 20 bp, Homo sapiens
ctcttatagaatatttatta

SEQ ID NO: 1306489 - DNA, 11 bp, Homo sapiens
ctcttctcatt

SEQ ID NO: 1306490 - DNA, 12 bp, Homo sapiens
ctcttctcattt

SEQ ID NO: 1306491 - DNA, 11 bp, Homo sapiens
ctcttctggct

SEQ ID NO: 1306492 - DNA, 14 bp, Homo sapiens
ctcttctggctcaa

SEQ ID NO: 1306493 - DNA, 14 bp, Homo sapiens
ctcttgtaaataaa

SEQ ID NO: 1306494 - DNA, 17 bp, Homo sapiens
ctcttgtaaataaagcc

SEQ ID NO: 1306495 - DNA, 19 bp, Homo sapiens
ctcttgtaaataaagccct

SEQ ID NO: 1306496 - DNA, 20 bp, Homo sapiens
ctcttgtaaataaagccctg

SEQ ID NO: 1306497 - DNA, 23 bp, Homo sapiens
ctcttgtaaataaagccctggga

SEQ ID NO: 1306498 - DNA, 16 bp, Homo sapiens
ctctttcctccttcca

SEQ ID NO: 1306499 - DNA, 11 bp, Homo sapiens
ctctttctgta

SEQ ID NO: 1306500 - DNA, 13 bp, Homo sapiens
ctctttgctttgc

SEQ ID NO: 1306501 - DNA, 15 bp, Homo sapiens
ctctttgctttgctt

SEQ ID NO: 1306502 - DNA, 19 bp, Homo sapiens
ctgaacaataggctgttcc

SEQ ID NO: 1306503 - DNA, 23 bp, Homo sapiens
ctgaagcctttgcattttggaga

SEQ ID NO: 1306504 - DNA, 23 bp, Homo sapiens
ctgaaggggccatgatggcaaca

SEQ ID NO: 1306505 - DNA, 12 bp, Homo sapiens
ctgacagctgct

SEQ ID NO: 1306506 - DNA, 15 bp, Homo sapiens
ctgacatgattcctt

SEQ ID NO: 1306507 - DNA, 16 bp, Homo sapiens
ctgacattcacctgcc

SEQ ID NO: 1306508 - DNA, 13 bp, Homo sapiens
ctgaccagcagcg

SEQ ID NO: 1306509 - DNA, 16 bp, Homo sapiens
ctgaccagcagcgcct

SEQ ID NO: 1306510 - DNA, 20 bp, Homo sapiens
ctgaccagcagcgcctttcc

SEQ ID NO: 1306511 - DNA, 21 bp, Homo sapiens
ctgacccagccccttgagaaa

SEQ ID NO: 1306512 - DNA, 23 bp, Homo sapiens
ctgacccagtgcccccactgacc

SEQ ID NO: 1306513 - DNA, 18 bp, Homo sapiens
ctgaccctgtatatagcc

SEQ ID NO: 1306514 - DNA, 20 bp, Homo sapiens
ctgaccctgtatatagccca

SEQ ID NO: 1306515 - DNA, 22 bp, Homo sapiens
ctgaccctgtatatagcccagc

SEQ ID NO: 1306516 - DNA, 18 bp, Homo sapiens
ctgacctccctctaattt

SEQ ID NO: 1306517 - DNA, 20 bp, Homo sapiens
ctgacctccctctaatttat

SEQ ID NO: 1306518 - DNA, 17 bp, Homo sapiens
ctgacctgtgagcccag

SEQ ID NO: 1306519 - DNA, 21 bp, Homo sapiens
ctgacctgtgagcccagctgg

SEQ ID NO: 1306520 - DNA, 19 bp, Homo sapiens
ctgacggccagggagaagc

SEQ ID NO: 1306521 - DNA, 20 bp, Homo sapiens
ctgacggccagggagaagct

SEQ ID NO: 1306522 - DNA, 22 bp, Homo sapiens
ctgacgtagctgcaaaggacag

SEQ ID NO: 1306523 - DNA, 23 bp, Homo sapiens
ctgacgtagctgcaaaggacaga

SEQ ID NO: 1306524 - DNA, 14 bp, Homo sapiens
ctgagatttcatct

SEQ ID NO: 1306525 - DNA, 12 bp, Homo sapiens
ctgagcctctgc

SEQ ID NO: 1306526 - DNA, 16 bp, Homo sapiens
ctgagcctctgctccc

SEQ ID NO: 1306527 - DNA, 15 bp, Homo sapiens
ctgaggaagaacggg

SEQ ID NO: 1306528 - DNA, 16 bp, Homo sapiens
ctgaggcaagagaatt

SEQ ID NO: 1306529 - DNA, 12 bp, Homo sapiens
ctgaggccacac

SEQ ID NO: 1306530 - DNA, 14 bp, Homo sapiens
ctgaggccacactc

SEQ ID NO: 1306531 - DNA, 11 bp, Homo sapiens
ctgaggctggc

SEQ ID NO: 1306532 - DNA, 19 bp, Homo sapiens
ctgaggctggcacaggaca

SEQ ID NO: 1306533 - DNA, 14 bp, Homo sapiens
ctgaggctttggat

SEQ ID NO: 1306534 - DNA, 17 bp, Homo sapiens
ctgaggctttggatttg

SEQ ID NO: 1306535 - DNA, 21 bp, Homo sapiens
ctgaggctttggatttgacat

SEQ ID NO: 1306536 - DNA, 13 bp, Homo sapiens
ctgagtgaacctg

SEQ ID NO: 1306537 - DNA, 18 bp, Homo sapiens
ctgagtgaacctgtataa

SEQ ID NO: 1306538 - DNA, 21 bp, Homo sapiens
ctgataactagatggtgctga

SEQ ID NO: 1306539 - DNA, 24 bp, Homo sapiens
ctgataactagatggtgctgagaa

SEQ ID NO: 1306540 - DNA, 12 bp, Homo sapiens
ctgatacctcaa

SEQ ID NO: 1306541 - DNA, 17 bp, Homo sapiens
ctgatcagaccacggct

SEQ ID NO: 1306542 - DNA, 19 bp, Homo sapiens
ctgatcctggaggcccagt

SEQ ID NO: 1306543 - DNA, 21 bp, Homo sapiens
ctgatcctggaggcccagttc

SEQ ID NO: 1306544 - DNA, 12 bp, Homo sapiens
ctgatgctgaca

SEQ ID NO: 1306545 - DNA, 14 bp, Homo sapiens
ctgatgctgcccct

SEQ ID NO: 1306546 - DNA, 21 bp, Homo sapiens
ctgattaagttgtctaaacaa

SEQ ID NO: 1306547 - DNA, 16 bp, Homo sapiens
ctgatttaggagaagc

SEQ ID NO: 1306548 - DNA, 17 bp, Homo sapiens
ctgatttaggagaagcc

SEQ ID NO: 1306549 - DNA, 18 bp, Homo sapiens
ctgatttaggagaagcca

SEQ ID NO: 1306550 - DNA, 20 bp, Homo sapiens
ctgatttaggagaagccagg

SEQ ID NO: 1306551 - DNA, 21 bp, Homo sapiens
ctgatttaggagaagccagga

SEQ ID NO: 1306552 - DNA, 22 bp, Homo sapiens
ctgatttaggagaagccaggaa

SEQ ID NO: 1306553 - DNA, 15 bp, Homo sapiens
ctgcaaaaatattta

SEQ ID NO: 1306554 - DNA, 20 bp, Homo sapiens
ctgcaaaaatatttataaaa

SEQ ID NO: 1306555 - DNA, 21 bp, Homo sapiens
ctgcaagaaaatgatgtgtac

SEQ ID NO: 1306556 - DNA, 20 bp, Homo sapiens
ctgcaaggtttaggctggtg

SEQ ID NO: 1306557 - DNA, 22 bp, Homo sapiens
ctgcaaggtttaggctggtggc

SEQ ID NO: 1306558 - DNA, 23 bp, Homo sapiens
ctgcaaggtttaggctggtggcc

SEQ ID NO: 1306559 - DNA, 22 bp, Homo sapiens
ctgcagaatttgggttctgcct

SEQ ID NO: 1306560 - DNA, 23 bp, Homo sapiens
ctgcaggacttgagaagacctca

SEQ ID NO: 1306561 - DNA, 17 bp, Homo sapiens
ctgcagtaaatctttta

SEQ ID NO: 1306562 - DNA, 19 bp, Homo sapiens
ctgcatctgaccagcagcg

SEQ ID NO: 1306563 - DNA, 20 bp, Homo sapiens
ctgcatctgaccagcagcgc

SEQ ID NO: 1306564 - DNA, 22 bp, Homo sapiens
ctgcatctgaccagcagcgcct

SEQ ID NO: 1306565 - DNA, 12 bp, Homo sapiens
ctgcatgctgct

SEQ ID NO: 1306566 - DNA, 15 bp, Homo sapiens
ctgcatgctgctgga

SEQ ID NO: 1306567 - DNA, 22 bp, Homo sapiens
ctgcatgctgctggacagtatc

SEQ ID NO: 1306568 - DNA, 15 bp, Homo sapiens
ctgccaaaatgctct

SEQ ID NO: 1306569 - DNA, 16 bp, Homo sapiens
ctgccaaaatgctcta

SEQ ID NO: 1306570 - DNA, 19 bp, Homo sapiens
ctgccacccacctccctgc

SEQ ID NO: 1306571 - DNA, 12 bp, Homo sapiens
ctgccagctgca

SEQ ID NO: 1306572 - DNA, 16 bp, Homo sapiens
ctgccagctgcactga

SEQ ID NO: 1306573 - DNA, 17 bp, Homo sapiens
ctgccagctgcactgat

SEQ ID NO: 1306574 - DNA, 18 bp, Homo sapiens
ctgcccatggacaggctg

SEQ ID NO: 1306575 - DNA, 13 bp, Homo sapiens
ctgcccccaggac

SEQ ID NO: 1306576 - DNA, 15 bp, Homo sapiens
ctgcccccaggactg

SEQ ID NO: 1306577 - DNA, 16 bp, Homo sapiens
ctgcccccaggactgg

SEQ ID NO: 1306578 - DNA, 15 bp, Homo sapiens
ctgccgcagagctgg

SEQ ID NO: 1306579 - DNA, 18 bp, Homo sapiens
ctgccgcagagctggccg

SEQ ID NO: 1306580 - DNA, 10 bp, Homo sapiens
ctgcctcagg

SEQ ID NO: 1306581 - DNA, 13 bp, Homo sapiens
ctgcctcatttag

SEQ ID NO: 1306582 - DNA, 22 bp, Homo sapiens
ctgcctccagggctggactgag

SEQ ID NO: 1306583 - DNA, 23 bp, Homo sapiens
ctgcctccagggctggactgagg

SEQ ID NO: 1306584 - DNA, 20 bp, Homo sapiens
ctgcctgccagctgcactga

SEQ ID NO: 1306585 - DNA, 18 bp, Homo sapiens
ctgccttggctcagacat

SEQ ID NO: 1306586 - DNA, 23 bp, Homo sapiens
ctgctacaaatactcttaggaag

SEQ ID NO: 1306587 - DNA, 14 bp, Homo sapiens
ctgctccagacctg

SEQ ID NO: 1306588 - DNA, 21 bp, Homo sapiens
ctgctccagacctgatcctgg

SEQ ID NO: 1306589 - DNA, 17 bp, Homo sapiens
ctgctcctagagggagg

SEQ ID NO: 1306590 - DNA, 22 bp, Homo sapiens
ctgctcctagagggaggggcct

SEQ ID NO: 1306591 - DNA, 12 bp, Homo sapiens
ctgctctccttc

SEQ ID NO: 1306592 - DNA, 16 bp, Homo sapiens
ctgctgaaggctcatt

SEQ ID NO: 1306593 - DNA, 13 bp, Homo sapiens
ctggaacccagac

SEQ ID NO: 1306594 - DNA, 18 bp, Homo sapiens
ctggaacccagactcaga

SEQ ID NO: 1306595 - DNA, 19 bp, Homo sapiens
ctggaagtccaatgtggca

SEQ ID NO: 1306596 - DNA, 17 bp, Homo sapiens
ctggaatctggagacca

SEQ ID NO: 1306597 - DNA, 19 bp, Homo sapiens
ctggacagtatcactgtct

SEQ ID NO: 1306598 - DNA, 13 bp, Homo sapiens
ctggactgaggcc

SEQ ID NO: 1306599 - DNA, 15 bp, Homo sapiens
ctggactgaggcctg

SEQ ID NO: 1306600 - DNA, 18 bp, Homo sapiens
ctggagaccagggagcct

SEQ ID NO: 1306601 - DNA, 21 bp, Homo sapiens
ctggagcccagaggagggcag

SEQ ID NO: 1306602 - DNA, 20 bp, Homo sapiens
ctggaggtggctgagcccct

SEQ ID NO: 1306603 - DNA, 14 bp, Homo sapiens
ctggagtggccact

SEQ ID NO: 1306604 - DNA, 23 bp, Homo sapiens
ctggagtggccactaagcagagg

SEQ ID NO: 1306605 - DNA, 24 bp, Homo sapiens
ctggagtggccactaagcagagga

SEQ ID NO: 1306606 - DNA, 18 bp, Homo sapiens
ctggagttgatctggaac

SEQ ID NO: 1306607 - DNA, 22 bp, Homo sapiens
ctggagttgatctggaacccag

SEQ ID NO: 1306608 - DNA, 13 bp, Homo sapiens
ctggagtttcatg

SEQ ID NO: 1306609 - DNA, 21 bp, Homo sapiens
ctggcaaaaggatctttgtgg

SEQ ID NO: 1306610 - DNA, 21 bp, Homo sapiens
ctggcactggatgcagaaaca

SEQ ID NO: 1306611 - DNA, 12 bp, Homo sapiens
ctggcagcctcc

SEQ ID NO: 1306612 - DNA, 14 bp, Homo sapiens
ctggcagcctccca

SEQ ID NO: 1306613 - DNA, 23 bp, Homo sapiens
ctggcagcctcccatccagggcc

SEQ ID NO: 1306614 - DNA, 17 bp, Homo sapiens
ctggcagctctggacag

SEQ ID NO: 1306615 - DNA, 18 bp, Homo sapiens
ctggcagctctggacagc

SEQ ID NO: 1306616 - DNA, 20 bp, Homo sapiens
ctggcagctctggacagccc

SEQ ID NO: 1306617 - DNA, 15 bp, Homo sapiens
ctggcagtttaaaaa

SEQ ID NO: 1306618 - DNA, 13 bp, Homo sapiens
ctggccagaatgc

SEQ ID NO: 1306619 - DNA, 17 bp, Homo sapiens
ctggccagacacaggcc

SEQ ID NO: 1306620 - DNA, 21 bp, Homo sapiens
ctggccagacacaggccctcc

SEQ ID NO: 1306621 - DNA, 17 bp, Homo sapiens
ctggcccagggcccaga

SEQ ID NO: 1306622 - DNA, 19 bp, Homo sapiens
ctggcccagggcccagagc

SEQ ID NO: 1306623 - DNA, 16 bp, Homo sapiens
ctggccgagtccaagc

SEQ ID NO: 1306624 - DNA, 23 bp, Homo sapiens
ctggccgagtccaagctgggaga

SEQ ID NO: 1306625 - DNA, 14 bp, Homo sapiens
ctggcctcccaaat

SEQ ID NO: 1306626 - DNA, 16 bp, Homo sapiens
ctggcctcccaaatga

SEQ ID NO: 1306627 - DNA, 14 bp, Homo sapiens
ctggctccagatgc

SEQ ID NO: 1306628 - DNA, 20 bp, Homo sapiens
ctggctccagatgcagggca

SEQ ID NO: 1306629 - DNA, 21 bp, Homo sapiens
ctggctgggacgtggctcagc

SEQ ID NO: 1306630 - DNA, 23 bp, Homo sapiens
ctggctgggacgtggctcagcca

SEQ ID NO: 1306631 - DNA, 14 bp, Homo sapiens
ctggctttggcttc

SEQ ID NO: 1306632 - DNA, 18 bp, Homo sapiens
ctgggacgtggctcagcc

SEQ ID NO: 1306633 - DNA, 15 bp, Homo sapiens
ctgggagattcaagg

SEQ ID NO: 1306634 - DNA, 19 bp, Homo sapiens
ctgggagattcaagggacc

SEQ ID NO: 1306635 - DNA, 13 bp, Homo sapiens
ctgggcctgcaga

SEQ ID NO: 1306636 - DNA, 14 bp, Homo sapiens
ctgggctcctccag

SEQ ID NO: 1306637 - DNA, 11 bp, Homo sapiens
ctggggcctcc

SEQ ID NO: 1306638 - DNA, 20 bp, Homo sapiens
ctgggggacccaatgtagga

SEQ ID NO: 1306639 - DNA, 16 bp, Homo sapiens
ctgggggtgggccagg

SEQ ID NO: 1306640 - DNA, 13 bp, Homo sapiens
ctggggtggggtc

SEQ ID NO: 1306641 - DNA, 20 bp, Homo sapiens
ctgggtacttcttgaaggtg

SEQ ID NO: 1306642 - DNA, 22 bp, Homo sapiens
ctgggtgacagagcaagactct

SEQ ID NO: 1306643 - DNA, 23 bp, Homo sapiens
ctgggtgacagagcaagactctg

SEQ ID NO: 1306644 - DNA, 13 bp, Homo sapiens
ctggtcctaccca

SEQ ID NO: 1306645 - DNA, 17 bp, Homo sapiens
ctggtcctacccatccc

SEQ ID NO: 1306646 - DNA, 12 bp, Homo sapiens
ctggtggcccag

SEQ ID NO: 1306647 - DNA, 12 bp, Homo sapiens
ctggttctcatc

SEQ ID NO: 1306648 - DNA, 14 bp, Homo sapiens
ctggttctcatctt

SEQ ID NO: 1306649 - DNA, 22 bp, Homo sapiens
ctgtaaaatgcatgattttgta

SEQ ID NO: 1306650 - DNA, 13 bp, Homo sapiens
ctgtaattttata

SEQ ID NO: 1306651 - DNA, 15 bp, Homo sapiens
ctgtactcttagatg

SEQ ID NO: 1306652 - DNA, 15 bp, Homo sapiens
ctgtatatacttttt

SEQ ID NO: 1306653 - DNA, 23 bp, Homo sapiens
ctgtatatttgtgatagcacttt

SEQ ID NO: 1306654 - DNA, 20 bp, Homo sapiens
ctgtcaaggctgcttagaat

SEQ ID NO: 1306655 - DNA, 22 bp, Homo sapiens
ctgtcactcattgctgagcctc

SEQ ID NO: 1306656 - DNA, 23 bp, Homo sapiens
ctgtcactcattgctgagcctct

SEQ ID NO: 1306657 - DNA, 13 bp, Homo sapiens
ctgtcagtcacag

SEQ ID NO: 1306658 - DNA, 17 bp, Homo sapiens
ctgtcagtcacagccac

SEQ ID NO: 1306659 - DNA, 13 bp, Homo sapiens
ctgtccagctcca

SEQ ID NO: 1306660 - DNA, 14 bp, Homo sapiens
ctgtccagctccaa

SEQ ID NO: 1306661 - DNA, 13 bp, Homo sapiens
ctgtcctcagcct

SEQ ID NO: 1306662 - DNA, 14 bp, Homo sapiens
ctgtcctcagcctt

SEQ ID NO: 1306663 - DNA, 21 bp, Homo sapiens
ctgtcctcagccttgccagag

SEQ ID NO: 1306664 - DNA, 12 bp, Homo sapiens
ctgtcctcaggt

SEQ ID NO: 1306665 - DNA, 17 bp, Homo sapiens
ctgtcctcaggtggcca

SEQ ID NO: 1306666 - DNA, 23 bp, Homo sapiens
ctgtcctccaacaccaagcacag

SEQ ID NO: 1306667 - DNA, 13 bp, Homo sapiens
ctgtctagagagg

SEQ ID NO: 1306668 - DNA, 16 bp, Homo sapiens
ctgtctagagagggag

SEQ ID NO: 1306669 - DNA, 20 bp, Homo sapiens
ctgtctttcctagatggcag

SEQ ID NO: 1306670 - DNA, 18 bp, Homo sapiens
ctgtgaacgatttagaaa

SEQ ID NO: 1306671 - DNA, 17 bp, Homo sapiens
ctgtgacccccagctcc

SEQ ID NO: 1306672 - DNA, 18 bp, Homo sapiens
ctgtgacccccagctccg

SEQ ID NO: 1306673 - DNA, 14 bp, Homo sapiens
ctgtgagcccagct

SEQ ID NO: 1306674 - DNA, 21 bp, Homo sapiens
ctgtgcaacctcttggcctga

SEQ ID NO: 1306675 - DNA, 23 bp, Homo sapiens
ctgtggggtgtgcacatctctgc

SEQ ID NO: 1306676 - DNA, 16 bp, Homo sapiens
ctgtgtctgtgtttta

SEQ ID NO: 1306677 - DNA, 21 bp, Homo sapiens
ctgtgtgattgacagctttgc

SEQ ID NO: 1306678 - DNA, 12 bp, Homo sapiens
ctgtgtgtgtga

SEQ ID NO: 1306679 - DNA, 21 bp, Homo sapiens
ctgtgtgtgtgaatgaacact

SEQ ID NO: 1306680 - DNA, 15 bp, Homo sapiens
ctgttcccccttcac

SEQ ID NO: 1306681 - DNA, 17 bp, Homo sapiens
ctgttgacacaggtctt

SEQ ID NO: 1306682 - DNA, 20 bp, Homo sapiens
ctgtttagcagcagccttta

SEQ ID NO: 1306683 - DNA, 16 bp, Homo sapiens
ctgttttcctcccttc

SEQ ID NO: 1306684 - DNA, 15 bp, Homo sapiens
ctgtttttaagctgt

SEQ ID NO: 1306685 - DNA, 23 bp, Homo sapiens
ctgtttttaagctgtttccatag

SEQ ID NO: 1306686 - DNA, 17 bp, Homo sapiens
cttaactccttccagtg

SEQ ID NO: 1306687 - DNA, 16 bp, Homo sapiens
cttaatactaccttga

SEQ ID NO: 1306688 - DNA, 12 bp, Homo sapiens
cttagaacattt

SEQ ID NO: 1306689 - DNA, 19 bp, Homo sapiens
cttagaacattttaattca

SEQ ID NO: 1306690 - DNA, 12 bp, Homo sapiens
cttagaatccaa

SEQ ID NO: 1306691 - DNA, 20 bp, Homo sapiens
cttagatgttccagtaatct

SEQ ID NO: 1306692 - DNA, 13 bp, Homo sapiens
cttaggccttcct

SEQ ID NO: 1306693 - DNA, 17 bp, Homo sapiens
cttaggccttcctctct

SEQ ID NO: 1306694 - DNA, 14 bp, Homo sapiens
cttatagaatattt

SEQ ID NO: 1306695 - DNA, 15 bp, Homo sapiens
cttatagaatattta

SEQ ID NO: 1306696 - DNA, 20 bp, Homo sapiens
cttatagaatatttattacc

SEQ ID NO: 1306697 - DNA, 14 bp, Homo sapiens
cttatggaattgat

SEQ ID NO: 1306698 - DNA, 17 bp, Homo sapiens
cttattagggagaaaat

SEQ ID NO: 1306699 - DNA, 14 bp, Homo sapiens
cttcacaaagccca

SEQ ID NO: 1306700 - DNA, 15 bp, Homo sapiens
cttcaccctggagcc

SEQ ID NO: 1306701 - DNA, 15 bp, Homo sapiens
cttcatattgctgag

SEQ ID NO: 1306702 - DNA, 19 bp, Homo sapiens
cttcatctcccacctagca

SEQ ID NO: 1306703 - DNA, 23 bp, Homo sapiens
cttcatggatgggggaactcaga

SEQ ID NO: 1306704 - DNA, 18 bp, Homo sapiens
cttccagtgtccttagaa

SEQ ID NO: 1306705 - DNA, 14 bp, Homo sapiens
cttccatgattcta

SEQ ID NO: 1306706 - DNA, 18 bp, Homo sapiens
cttccttgagacacggag

SEQ ID NO: 1306707 - DNA, 23 bp, Homo sapiens
cttccttgagacacggagcccag

SEQ ID NO: 1306708 - DNA, 16 bp, Homo sapiens
cttcgggctgtgcccg

SEQ ID NO: 1306709 - DNA, 18 bp, Homo sapiens
cttctaaacttccccatc

SEQ ID NO: 1306710 - DNA, 22 bp, Homo sapiens
cttctaaacttccccatcttct

SEQ ID NO: 1306711 - DNA, 15 bp, Homo sapiens
cttctaaaggtgttg

SEQ ID NO: 1306712 - DNA, 19 bp, Homo sapiens
cttctagggttattgcatt

SEQ ID NO: 1306713 - DNA, 17 bp, Homo sapiens
cttctcatttcacccct

SEQ ID NO: 1306714 - DNA, 21 bp, Homo sapiens
cttctcatttcacccctccct

SEQ ID NO: 1306715 - DNA, 14 bp, Homo sapiens
cttctcctcttgta

SEQ ID NO: 1306716 - DNA, 17 bp, Homo sapiens
cttctcctcttgtaaat

SEQ ID NO: 1306717 - DNA, 18 bp, Homo sapiens
cttctcctcttgtaaata

SEQ ID NO: 1306718 - DNA, 11 bp, Homo sapiens
cttctgctact

SEQ ID NO: 1306719 - DNA, 14 bp, Homo sapiens
cttctgctcagctc

SEQ ID NO: 1306720 - DNA, 22 bp, Homo sapiens
cttcttatggaattgatttgca

SEQ ID NO: 1306721 - DNA, 13 bp, Homo sapiens
cttgaaagctgtg

SEQ ID NO: 1306722 - DNA, 13 bp, Homo sapiens
cttgaagggccag

SEQ ID NO: 1306723 - DNA, 22 bp, Homo sapiens
cttgaaggtgctgacggccagg

SEQ ID NO: 1306724 - DNA, 12 bp, Homo sapiens
cttgagaaacct

SEQ ID NO: 1306725 - DNA, 13 bp, Homo sapiens
cttgagaaacctt

SEQ ID NO: 1306726 - DNA, 22 bp, Homo sapiens
cttgagaaatatggacacttaa

SEQ ID NO: 1306727 - DNA, 23 bp, Homo sapiens
cttgagaagacctcacctagaaa

SEQ ID NO: 1306728 - DNA, 22 bp, Homo sapiens
cttgagacacggagcccagccc

SEQ ID NO: 1306729 - DNA, 20 bp, Homo sapiens
cttgattctgcagtaaatct

SEQ ID NO: 1306730 - DNA, 22 bp, Homo sapiens
cttgattctgcagtaaatcttt

SEQ ID NO: 1306731 - DNA, 12 bp, Homo sapiens
cttgccagagat

SEQ ID NO: 1306732 - DNA, 16 bp, Homo sapiens
cttggcaccagacacc

SEQ ID NO: 1306733 - DNA, 14 bp, Homo sapiens
cttggctcagacat

SEQ ID NO: 1306734 - DNA, 16 bp, Homo sapiens
cttggctcagacatgt

SEQ ID NO: 1306735 - DNA, 19 bp, Homo sapiens
cttggggagttaagacctg

SEQ ID NO: 1306736 - DNA, 20 bp, Homo sapiens
cttggggagttaagacctgg

SEQ ID NO: 1306737 - DNA, 22 bp, Homo sapiens
cttggggagttaagacctggca

SEQ ID NO: 1306738 - DNA, 15 bp, Homo sapiens
cttgtgattatttat

SEQ ID NO: 1306739 - DNA, 23 bp, Homo sapiens
ctttaatgcatctagattatgga

SEQ ID NO: 1306740 - DNA, 21 bp, Homo sapiens
ctttaggagggagttatctaa

SEQ ID NO: 1306741 - DNA, 16 bp, Homo sapiens
ctttcctaaggctgca

SEQ ID NO: 1306742 - DNA, 20 bp, Homo sapiens
ctttcctaaggctgcaaggt

SEQ ID NO: 1306743 - DNA, 20 bp, Homo sapiens
ctttcctagatggcagtcac

SEQ ID NO: 1306744 - DNA, 13 bp, Homo sapiens
ctttcctccttcc

SEQ ID NO: 1306745 - DNA, 14 bp, Homo sapiens
ctttctagctgttg

SEQ ID NO: 1306746 - DNA, 18 bp, Homo sapiens
ctttctcccctgccccca

SEQ ID NO: 1306747 - DNA, 23 bp, Homo sapiens
ctttctcccctgcccccaggact

SEQ ID NO: 1306748 - DNA, 21 bp, Homo sapiens
ctttctgataactagatggtg

SEQ ID NO: 1306749 - DNA, 23 bp, Homo sapiens
ctttctgataactagatggtgct

SEQ ID NO: 1306750 - DNA, 13 bp, Homo sapiens
ctttctgctcagc

SEQ ID NO: 1306751 - DNA, 16 bp, Homo sapiens
ctttctgctcagcttc

SEQ ID NO: 1306752 - DNA, 17 bp, Homo sapiens
ctttctgctcagcttct

SEQ ID NO: 1306753 - DNA, 19 bp, Homo sapiens
ctttctgtatatacttttt

SEQ ID NO: 1306754 - DNA, 20 bp, Homo sapiens
ctttctgtatatactttttt

SEQ ID NO: 1306755 - DNA, 12 bp, Homo sapiens
ctttgattcata

SEQ ID NO: 1306756 - DNA, 19 bp, Homo sapiens
ctttgattctccttcagcc

SEQ ID NO: 1306757 - DNA, 14 bp, Homo sapiens
ctttgctttctgct

SEQ ID NO: 1306758 - DNA, 15 bp, Homo sapiens
ctttgctttctgctc

SEQ ID NO: 1306759 - DNA, 11 bp, Homo sapiens
ctttgctttgc

SEQ ID NO: 1306760 - DNA, 15 bp, Homo sapiens
ctttggatttgacat

SEQ ID NO: 1306761 - DNA, 16 bp, Homo sapiens
ctttggatttgacatt

SEQ ID NO: 1306762 - DNA, 17 bp, Homo sapiens
ctttggatttgacattg

SEQ ID NO: 1306763 - DNA, 13 bp, Homo sapiens
ctttgggccagac

SEQ ID NO: 1306764 - DNA, 14 bp, Homo sapiens
ctttgtggccaagg

SEQ ID NO: 1306765 - DNA, 12 bp, Homo sapiens
cttttatactct

SEQ ID NO: 1306766 - DNA, 17 bp, Homo sapiens
cttttatactctttctg

SEQ ID NO: 1306767 - DNA, 18 bp, Homo sapiens
cttttatgtagtaattga

SEQ ID NO: 1306768 - DNA, 18 bp, Homo sapiens
cttttattgacacagaaa

SEQ ID NO: 1306769 - DNA, 14 bp, Homo sapiens
cttttgctttattc

SEQ ID NO: 1306770 - DNA, 13 bp, Homo sapiens
ctttttatttctg

SEQ ID NO: 1306771 - DNA, 19 bp, Homo sapiens
ctttttttccatctttaca

SEQ ID NO: 1306772 - DNA, 15 bp, Homo sapiens
cttttttttctttaa

SEQ ID NO: 1306773 - DNA, 14 bp, Homo sapiens
gaaaatgcagcagg

SEQ ID NO: 1306774 - DNA, 21 bp, Homo sapiens
gaaaatgttgagaatcccaaa

SEQ ID NO: 1306775 - DNA, 16 bp, Homo sapiens
gaaacctgggattcag

SEQ ID NO: 1306776 - DNA, 14 bp, Homo sapiens
gaaagataactagg

SEQ ID NO: 1306777 - DNA, 17 bp, Homo sapiens
gaaataaaaggaagcca

SEQ ID NO: 1306778 - DNA, 17 bp, Homo sapiens
gaaatgggacttaactc

SEQ ID NO: 1306779 - DNA, 17 bp, Homo sapiens
gaaattaagaaggcaaa

SEQ ID NO: 1306780 - DNA, 15 bp, Homo sapiens
gaacaaagcagccac

SEQ ID NO: 1306781 - DNA, 17 bp, Homo sapiens
gaacacaaactgtaaat

SEQ ID NO: 1306782 - DNA, 18 bp, Homo sapiens
gaacactcttttgcttta

SEQ ID NO: 1306783 - DNA, 18 bp, Homo sapiens
gaacatccaaccttccca

SEQ ID NO: 1306784 - DNA, 19 bp, Homo sapiens
gaacatgtgagaggtttga

SEQ ID NO: 1306785 - DNA, 19 bp, Homo sapiens
gaaccagtccccccaccct

SEQ ID NO: 1306786 - DNA, 13 bp, Homo sapiens
gaacccagactca

SEQ ID NO: 1306787 - DNA, 17 bp, Homo sapiens
gaaccgttttgaagcta

SEQ ID NO: 1306788 - DNA, 14 bp, Homo sapiens
gaacctcagcctgg

SEQ ID NO: 1306789 - DNA, 17 bp, Homo sapiens
gaacctgacgtagctgc

SEQ ID NO: 1306790 - DNA, 16 bp, Homo sapiens
gaacctggaacttggg

SEQ ID NO: 1306791 - DNA, 18 bp, Homo sapiens
gaacgatttagaaagaag

SEQ ID NO: 1306792 - DNA, 20 bp, Homo sapiens
gaacgcccccccccacccct

SEQ ID NO: 1306793 - DNA, 22 bp, Homo sapiens
gaacggggctcttctcatttca

SEQ ID NO: 1306794 - DNA, 17 bp, Homo sapiens
gaactaaactcatttat

SEQ ID NO: 1306795 - DNA, 23 bp, Homo sapiens
gaactacaaacaaaatttctatt

SEQ ID NO: 1306796 - DNA, 16 bp, Homo sapiens
gaactcaaatggggcc

SEQ ID NO: 1306797 - DNA, 19 bp, Homo sapiens
gaactcaaatggggccaga

SEQ ID NO: 1306798 - DNA, 14 bp, Homo sapiens
gaactcactggggc

SEQ ID NO: 1306799 - DNA, 16 bp, Homo sapiens
gaactcactggggcct

SEQ ID NO: 1306800 - DNA, 14 bp, Homo sapiens
gaagaaaacatcta

SEQ ID NO: 1306801 - DNA, 18 bp, Homo sapiens
gaagaacaccctctaaat

SEQ ID NO: 1306802 - DNA, 19 bp, Homo sapiens
gaagaaccagtccccccac

SEQ ID NO: 1306803 - DNA, 20 bp, Homo sapiens
gaagccaattcagacaggca

SEQ ID NO: 1306804 - DNA, 17 bp, Homo sapiens
gaagccacaggcctgag

SEQ ID NO: 1306805 - DNA, 15 bp, Homo sapiens
gaagctaatttgcat

SEQ ID NO: 1306806 - DNA, 22 bp, Homo sapiens
gaagctactgtgtgtgtgaatg

SEQ ID NO: 1306807 - DNA, 17 bp, Homo sapiens
gaagctcctctccccag

SEQ ID NO: 1306808 - DNA, 21 bp, Homo sapiens
gaagctcctctccccagccca

SEQ ID NO: 1306809 - DNA, 23 bp, Homo sapiens
gaagctcctctccccagcccaga

SEQ ID NO: 1306810 - DNA, 21 bp, Homo sapiens
gaaggggcgtctgttccccct

SEQ ID NO: 1306811 - DNA, 20 bp, Homo sapiens
gaagtgctggcaaccactaa

SEQ ID NO: 1306812 - DNA, 13 bp, Homo sapiens
gaagttttacatt

SEQ ID NO: 1306813 - DNA, 20 bp, Homo sapiens
gaatactgttaaaggaaaaa

SEQ ID NO: 1306814 - DNA, 15 bp, Homo sapiens
gaatagccacatttg

SEQ ID NO: 1306815 - DNA, 23 bp, Homo sapiens
gaatagtctagatggctcctctc

SEQ ID NO: 1306816 - DNA, 18 bp, Homo sapiens
gaatatttattacctctg

SEQ ID NO: 1306817 - DNA, 19 bp, Homo sapiens
gaatcccaaatttgattga

SEQ ID NO: 1306818 - DNA, 15 bp, Homo sapiens
gaatctactaattcc

SEQ ID NO: 1306819 - DNA, 14 bp, Homo sapiens
gaatgctgtacatc

SEQ ID NO: 1306820 - DNA, 23 bp, Homo sapiens
gaatgggaggttgatcagatctg

SEQ ID NO: 1306821 - DNA, 13 bp, Homo sapiens
gaatgtatttatt

SEQ ID NO: 1306822 - DNA, 16 bp, Homo sapiens
gaatgttttaaattct

SEQ ID NO: 1306823 - DNA, 21 bp, Homo sapiens
gaattcaaactggggcctcca

SEQ ID NO: 1306824 - DNA, 14 bp, Homo sapiens
gaattgatttgcat

SEQ ID NO: 1306825 - DNA, 13 bp, Homo sapiens
gaattgcattgac

SEQ ID NO: 1306826 - DNA, 14 bp, Homo sapiens
gaatttcccaggac

SEQ ID NO: 1306827 - DNA, 11 bp, Homo sapiens
gacaacatctg

SEQ ID NO: 1306828 - DNA, 22 bp, Homo sapiens
gacacaagtggaccttaggcct

SEQ ID NO: 1306829 - DNA, 16 bp, Homo sapiens
gacacagaaaatgttg

SEQ ID NO: 1306830 - DNA, 21 bp, Homo sapiens
gacacagaaaatgttgagaat

SEQ ID NO: 1306831 - DNA, 13 bp, Homo sapiens
gacacaggccctc

SEQ ID NO: 1306832 - DNA, 15 bp, Homo sapiens
gacacggagcccagc

SEQ ID NO: 1306833 - DNA, 14 bp, Homo sapiens
gacagccccaccct

SEQ ID NO: 1306834 - DNA, 18 bp, Homo sapiens
gacagctccaccctggcc

SEQ ID NO: 1306835 - DNA, 11 bp, Homo sapiens
gacagctgctc

SEQ ID NO: 1306836 - DNA, 17 bp, Homo sapiens
gacagggtttcaccatg

SEQ ID NO: 1306837 - DNA, 18 bp, Homo sapiens
gacagttgggtgagaaca

SEQ ID NO: 1306838 - DNA, 15 bp, Homo sapiens
gacatacttgaaggg

SEQ ID NO: 1306839 - DNA, 22 bp, Homo sapiens
gacatacttgaagggccagagc

SEQ ID NO: 1306840 - DNA, 20 bp, Homo sapiens
gacatctggaatctggagac

SEQ ID NO: 1306841 - DNA, 14 bp, Homo sapiens
gacatgattccttc

SEQ ID NO: 1306842 - DNA, 19 bp, Homo sapiens
gacatgatttccttgaatg

SEQ ID NO: 1306843 - DNA, 24 bp, Homo sapiens
gacatgatttccttgaatgtggct

SEQ ID NO: 1306844 - DNA, 19 bp, Homo sapiens
gacatgcggtagccagcac

SEQ ID NO: 1306845 - DNA, 23 bp, Homo sapiens
gacatgcggtagccagcacacag

SEQ ID NO: 1306846 - DNA, 17 bp, Homo sapiens
gacatgttttccgtgaa

SEQ ID NO: 1306847 - DNA, 16 bp, Homo sapiens
gacattcacctgcccc

SEQ ID NO: 1306848 - DNA, 18 bp, Homo sapiens
gacattcacctgccccaa

SEQ ID NO: 1306849 - DNA, 23 bp, Homo sapiens
gacattggcacctaatccaggca

SEQ ID NO: 1306850 - DNA, 14 bp, Homo sapiens
gaccaactgtcact

SEQ ID NO: 1306851 - DNA, 12 bp, Homo sapiens
gaccacagcaca

SEQ ID NO: 1306852 - DNA, 14 bp, Homo sapiens
gaccacgctttcta

SEQ ID NO: 1306853 - DNA, 21 bp, Homo sapiens
gaccacgctttctagctgttg

SEQ ID NO: 1306854 - DNA, 13 bp, Homo sapiens
gaccagcagcgcc

SEQ ID NO: 1306855 - DNA, 20 bp, Homo sapiens
gaccagcagcgcctttccca

SEQ ID NO: 1306856 - DNA, 23 bp, Homo sapiens
gaccagcagcgcctttcccaact

SEQ ID NO: 1306857 - DNA, 14 bp, Homo sapiens
gaccagggagcctt

SEQ ID NO: 1306858 - DNA, 18 bp, Homo sapiens
gacccaatgtaggagctg

SEQ ID NO: 1306859 - DNA, 23 bp, Homo sapiens
gacccatgagttggggtctggca

SEQ ID NO: 1306860 - DNA, 17 bp, Homo sapiens
gacccccagctccggcc

SEQ ID NO: 1306861 - DNA, 19 bp, Homo sapiens
gaccctgtatatagcccag

SEQ ID NO: 1306862 - DNA, 14 bp, Homo sapiens
gaccctgtggaagc

SEQ ID NO: 1306863 - DNA, 14 bp, Homo sapiens
gacctaatgctcct

SEQ ID NO: 1306864 - DNA, 21 bp, Homo sapiens
gacctgatcctggaggcccag

SEQ ID NO: 1306865 - DNA, 10 bp, Homo sapiens
gacctggcag

SEQ ID NO: 1306866 - DNA, 16 bp, Homo sapiens
gacctggcagctctgg

SEQ ID NO: 1306867 - DNA, 17 bp, Homo sapiens
gacctgttagcagacag

SEQ ID NO: 1306868 - DNA, 21 bp, Homo sapiens
gaccttaggccttcctctctc

SEQ ID NO: 1306869 - DNA, 21 bp, Homo sapiens
gacgaacatccaaccttccca

SEQ ID NO: 1306870 - DNA, 20 bp, Homo sapiens
gacgtactccaacagaagaa

SEQ ID NO: 1306871 - DNA, 14 bp, Homo sapiens
gacgtggctcagcc

SEQ ID NO: 1306872 - DNA, 16 bp, Homo sapiens
gacgtggctcagccag

SEQ ID NO: 1306873 - DNA, 12 bp, Homo sapiens
gactaatttcaa

SEQ ID NO: 1306874 - DNA, 22 bp, Homo sapiens
gactaatttcaaaatgcttttt

SEQ ID NO: 1306875 - DNA, 21 bp, Homo sapiens
gactatatttgggcctgctcc

SEQ ID NO: 1306876 - DNA, 18 bp, Homo sapiens
gactcaaagtttcagaga

SEQ ID NO: 1306877 - DNA, 19 bp, Homo sapiens
gactcacaacctgaaccta

SEQ ID NO: 1306878 - DNA, 18 bp, Homo sapiens
gactcagacattggcacc

SEQ ID NO: 1306879 - DNA, 18 bp, Homo sapiens
gactcagggcagcgccag

SEQ ID NO: 1306880 - DNA, 14 bp, Homo sapiens
gactgaggcctgag

SEQ ID NO: 1306881 - DNA, 23 bp, Homo sapiens
gactgaggcctgagcgctcctgc

SEQ ID NO: 1306882 - DNA, 20 bp, Homo sapiens
gactggaagctaatttgcat

SEQ ID NO: 1306883 - DNA, 20 bp, Homo sapiens
gacttcctgtccagctccaa

SEQ ID NO: 1306884 - DNA, 22 bp, Homo sapiens
gacttcctgtccagctccaacc

SEQ ID NO: 1306885 - DNA, 16 bp, Homo sapiens
gacttccttgagacac

SEQ ID NO: 1306886 - DNA, 13 bp, Homo sapiens
gagaaatgggact

SEQ ID NO: 1306887 - DNA, 16 bp, Homo sapiens
gagaactttcattttt

SEQ ID NO: 1306888 - DNA, 18 bp, Homo sapiens
gagaagccacaggcctga

SEQ ID NO: 1306889 - DNA, 12 bp, Homo sapiens
gagaagccagga

SEQ ID NO: 1306890 - DNA, 22 bp, Homo sapiens
gagaagcttttgaataaaaact

SEQ ID NO: 1306891 - DNA, 16 bp, Homo sapiens
gagaatgtaagaacta

SEQ ID NO: 1306892 - DNA, 18 bp, Homo sapiens
gagaattgcttgaaccca

SEQ ID NO: 1306893 - DNA, 16 bp, Homo sapiens
gagacacggagcccag

SEQ ID NO: 1306894 - DNA, 23 bp, Homo sapiens
gagacagttgggtgagaacaacc

SEQ ID NO: 1306895 - DNA, 20 bp, Homo sapiens
gagacatacttgaagggcca

SEQ ID NO: 1306896 - DNA, 19 bp, Homo sapiens
gagacctggcactggatgc

SEQ ID NO: 1306897 - DNA, 14 bp, Homo sapiens
gagactcgagaact

SEQ ID NO: 1306898 - DNA, 15 bp, Homo sapiens
gagactcgagaactt

SEQ ID NO: 1306899 - DNA, 20 bp, Homo sapiens
gagactcgagaactttcatt

SEQ ID NO: 1306900 - DNA, 17 bp, Homo sapiens
gagagcctggtgctgct

SEQ ID NO: 1306901 - DNA, 19 bp, Homo sapiens
gagagcctggtgctgctgc

SEQ ID NO: 1306902 - DNA, 16 bp, Homo sapiens
gagaggccctctggag

SEQ ID NO: 1306903 - DNA, 18 bp, Homo sapiens
gagagggaggcaagccct

SEQ ID NO: 1306904 - DNA, 19 bp, Homo sapiens
gagagggaggcaagccctg

SEQ ID NO: 1306905 - DNA, 22 bp, Homo sapiens
gagatccaaaagaagcccccag

SEQ ID NO: 1306906 - DNA, 20 bp, Homo sapiens
gagatggaagttgcagtgag

SEQ ID NO: 1306907 - DNA, 12 bp, Homo sapiens
gagcaagactct

SEQ ID NO: 1306908 - DNA, 14 bp, Homo sapiens
gagcaagactctgt

SEQ ID NO: 1306909 - DNA, 20 bp, Homo sapiens
gagccaacagaagcttccat

SEQ ID NO: 1306910 - DNA, 13 bp, Homo sapiens
gagccagctccct

SEQ ID NO: 1306911 - DNA, 19 bp, Homo sapiens
gagcccactgtcctgggcc

SEQ ID NO: 1306912 - DNA, 24 bp, Homo sapiens
gagcccactgtcctgggcctgcag

SEQ ID NO: 1306913 - DNA, 15 bp, Homo sapiens
gagcccagccctccc

SEQ ID NO: 1306914 - DNA, 18 bp, Homo sapiens
gagcccagccctccccat

SEQ ID NO: 1306915 - DNA, 13 bp, Homo sapiens
gagcccagctcca

SEQ ID NO: 1306916 - DNA, 20 bp, Homo sapiens
gagcccctgtctagagaggg

SEQ ID NO: 1306917 - DNA, 20 bp, Homo sapiens
gagccccttctgctcagctc

SEQ ID NO: 1306918 - DNA, 22 bp, Homo sapiens
gagccccttctgctcagctctg

SEQ ID NO: 1306919 - DNA, 17 bp, Homo sapiens
gagcctctgctccccag

SEQ ID NO: 1306920 - DNA, 22 bp, Homo sapiens
gagcgctcctgccgcagagctg

SEQ ID NO: 1306921 - DNA, 18 bp, Homo sapiens
gagctgccttggctcaga

SEQ ID NO: 1306922 - DNA, 20 bp, Homo sapiens
gagctgctatagcctggggt

SEQ ID NO: 1306923 - DNA, 23 bp, Homo sapiens
gagctggccgcgccaaataatgt

SEQ ID NO: 1306924 - DNA, 19 bp, Homo sapiens
gaggaagaacggggctctt

SEQ ID NO: 1306925 - DNA, 16 bp, Homo sapiens
gaggaggggccgctgc

SEQ ID NO: 1306926 - DNA, 22 bp, Homo sapiens
gaggcaatgggagctgaggcca

SEQ ID NO: 1306927 - DNA, 18 bp, Homo sapiens
gaggcccagttcaccctg

SEQ ID NO: 1306928 - DNA, 22 bp, Homo sapiens
gaggccccagcctccctgaagc

SEQ ID NO: 1306929 - DNA, 22 bp, Homo sapiens
gaggcccctatgtagtccgtgc

SEQ ID NO: 1306930 - DNA, 24 bp, Homo sapiens
gaggcccctatgtagtccgtgctg

SEQ ID NO: 1306931 - DNA, 19 bp, Homo sapiens
gaggcctgcctccagggct

SEQ ID NO: 1306932 - DNA, 22 bp, Homo sapiens
gaggcctgcctccagggctgga

SEQ ID NO: 1306933 - DNA, 23 bp, Homo sapiens
gaggctaaattactcaggaagaa

SEQ ID NO: 1306934 - DNA, 16 bp, Homo sapiens
gaggctgaggcaagag

SEQ ID NO: 1306935 - DNA, 13 bp, Homo sapiens
gaggctggcacag

SEQ ID NO: 1306936 - DNA, 14 bp, Homo sapiens
gaggctttggattt

SEQ ID NO: 1306937 - DNA, 17 bp, Homo sapiens
gaggggcctaggcctca

SEQ ID NO: 1306938 - DNA, 22 bp, Homo sapiens
gaggggcctaggcctcagccag

SEQ ID NO: 1306939 - DNA, 23 bp, Homo sapiens
gaggggcctaggcctcagccaga

SEQ ID NO: 1306940 - DNA, 20 bp, Homo sapiens
gaggtggctgagcccctgtc

SEQ ID NO: 1306941 - DNA, 20 bp, Homo sapiens
gaggttgatcagatctgaca

SEQ ID NO: 1306942 - DNA, 19 bp, Homo sapiens
gagtcaaaactacaaatca

SEQ ID NO: 1306943 - DNA, 18 bp, Homo sapiens
gagtcattcgttctgtgg

SEQ ID NO: 1306944 - DNA, 16 bp, Homo sapiens
gagtgcagccgtttga

SEQ ID NO: 1306945 - DNA, 23 bp, Homo sapiens
gagtgccccattcttttgtaatt

SEQ ID NO: 1306946 - DNA, 14 bp, Homo sapiens
gagttaagacctgg

SEQ ID NO: 1306947 - DNA, 16 bp, Homo sapiens
gagttatctaaaagaa

SEQ ID NO: 1306948 - DNA, 15 bp, Homo sapiens
gagtttcatgtacaa

SEQ ID NO: 1306949 - DNA, 12 bp, Homo sapiens
gataaattataa

SEQ ID NO: 1306950 - DNA, 19 bp, Homo sapiens
gataactagatggtgctga

SEQ ID NO: 1306951 - DNA, 20 bp, Homo sapiens
gataactagatggtgctgag

SEQ ID NO: 1306952 - DNA, 17 bp, Homo sapiens
gatacatccaaagcaga

SEQ ID NO: 1306953 - DNA, 20 bp, Homo sapiens
gatacatccaaagcagacag

SEQ ID NO: 1306954 - DNA, 23 bp, Homo sapiens
gatacatccaaagcagacagctc

SEQ ID NO: 1306955 - DNA, 17 bp, Homo sapiens
gatagatgctggcccag

SEQ ID NO: 1306956 - DNA, 12 bp, Homo sapiens
gatagcactttc

SEQ ID NO: 1306957 - DNA, 14 bp, Homo sapiens
gatagcactttcta

SEQ ID NO: 1306958 - DNA, 16 bp, Homo sapiens
gatcaacatcttttct

SEQ ID NO: 1306959 - DNA, 20 bp, Homo sapiens
gatcagtgtaccatttgcct

SEQ ID NO: 1306960 - DNA, 15 bp, Homo sapiens
gatccagggacagag

SEQ ID NO: 1306961 - DNA, 18 bp, Homo sapiens
gatccagggacagaggcc

SEQ ID NO: 1306962 - DNA, 15 bp, Homo sapiens
gatcctggaggccca

SEQ ID NO: 1306963 - DNA, 16 bp, Homo sapiens
gatcctggaggcccag

SEQ ID NO: 1306964 - DNA, 17 bp, Homo sapiens
gatcctggaggcccagt

SEQ ID NO: 1306965 - DNA, 19 bp, Homo sapiens
gatctgacatgattccttc

SEQ ID NO: 1306966 - DNA, 18 bp, Homo sapiens
gatctggaacctcagcct

SEQ ID NO: 1306967 - DNA, 17 bp, Homo sapiens
gatctggggctctggga

SEQ ID NO: 1306968 - DNA, 18 bp, Homo sapiens
gatctggggctctgggat

SEQ ID NO: 1306969 - DNA, 15 bp, Homo sapiens
gatctgtcctcagcc

SEQ ID NO: 1306970 - DNA, 18 bp, Homo sapiens
gatctgttttgaaggcaa

SEQ ID NO: 1306971 - DNA, 20 bp, Homo sapiens
gatctgttttgaaggcaaaa

SEQ ID NO: 1306972 - DNA, 22 bp, Homo sapiens
gatgaagttttacattgttgag

SEQ ID NO: 1306973 - DNA, 13 bp, Homo sapiens
gatgaatgagaat

SEQ ID NO: 1306974 - DNA, 12 bp, Homo sapiens
gatgccctggag

SEQ ID NO: 1306975 - DNA, 18 bp, Homo sapiens
gatgccctggaggtggct

SEQ ID NO: 1306976 - DNA, 16 bp, Homo sapiens
gatgctggcccagggc

SEQ ID NO: 1306977 - DNA, 23 bp, Homo sapiens
gatgctggcccagggcccagagc

SEQ ID NO: 1306978 - DNA, 21 bp, Homo sapiens
gatggaagttgcagtgagctg

SEQ ID NO: 1306979 - DNA, 23 bp, Homo sapiens
gatggatgccaatattaaatctg

SEQ ID NO: 1306980 - DNA, 17 bp, Homo sapiens
gatggattctccactca

SEQ ID NO: 1306981 - DNA, 16 bp, Homo sapiens
gatggcaacagatctg

SEQ ID NO: 1306982 - DNA, 14 bp, Homo sapiens
gatggctcctctca

SEQ ID NO: 1306983 - DNA, 12 bp, Homo sapiens
gatggtgctgag

SEQ ID NO: 1306984 - DNA, 13 bp, Homo sapiens
gatgtgaagccaa

SEQ ID NO: 1306985 - DNA, 23 bp, Homo sapiens
gatgtgaagccaattcagacagg

SEQ ID NO: 1306986 - DNA, 13 bp, Homo sapiens
gatgtttccagac

SEQ ID NO: 1306987 - DNA, 14 bp, Homo sapiens
gattaatatgaaaa

SEQ ID NO: 1306988 - DNA, 14 bp, Homo sapiens
gattatggagcttt

SEQ ID NO: 1306989 - DNA, 13 bp, Homo sapiens
gattcaggaatgt

SEQ ID NO: 1306990 - DNA, 22 bp, Homo sapiens
gattcagttttcatttggttca

SEQ ID NO: 1306991 - DNA, 16 bp, Homo sapiens
gattcatagtaacttc

SEQ ID NO: 1306992 - DNA, 21 bp, Homo sapiens
gattcccctaacctcattccc

SEQ ID NO: 1306993 - DNA, 20 bp, Homo sapiens
gattctatttatatgtacat

SEQ ID NO: 1306994 - DNA, 13 bp, Homo sapiens
gattctccttcag

SEQ ID NO: 1306995 - DNA, 15 bp, Homo sapiens
gattctgcagtaaat

SEQ ID NO: 1306996 - DNA, 15 bp, Homo sapiens
gattgatttgaagaa

SEQ ID NO: 1306997 - DNA, 18 bp, Homo sapiens
gattggctcacactgaga

SEQ ID NO: 1306998 - DNA, 20 bp, Homo sapiens
gatttaggagaagccaggaa

SEQ ID NO: 1306999 - DNA, 22 bp, Homo sapiens
gatttcctgctttgggaagccg

SEQ ID NO: 1307000 - DNA, 21 bp, Homo sapiens
gatttgcattgaacacaaact

SEQ ID NO: 1307001 - DNA, 17 bp, Homo sapiens
gattttaatcaagttga

SEQ ID NO: 1307002 - DNA, 18 bp, Homo sapiens
gattttaatcaagttgaa

SEQ ID NO: 1307003 - DNA, 23 bp, Homo sapiens
gcaaaaatatttataaaacttct

SEQ ID NO: 1307004 - DNA, 13 bp, Homo sapiens
gcaaaattgcaaa

SEQ ID NO: 1307005 - DNA, 19 bp, Homo sapiens
gcaaagatctgtcctcagc

SEQ ID NO: 1307006 - DNA, 16 bp, Homo sapiens
gcaacagatctggaac

SEQ ID NO: 1307007 - DNA, 20 bp, Homo sapiens
gcaacagatctggaacctca

SEQ ID NO: 1307008 - DNA, 19 bp, Homo sapiens
gcaagagaattgcttgaac

SEQ ID NO: 1307009 - DNA, 21 bp, Homo sapiens
gcaaggtttaggctggtggcc

SEQ ID NO: 1307010 - DNA, 17 bp, Homo sapiens
gcaatgatgaatgagaa

SEQ ID NO: 1307011 - DNA, 20 bp, Homo sapiens
gcaatgggagctgaggccac

SEQ ID NO: 1307012 - DNA, 19 bp, Homo sapiens
gcacaactttaagaggaca

SEQ ID NO: 1307013 - DNA, 15 bp, Homo sapiens
gcacacccaggtttg

SEQ ID NO: 1307014 - DNA, 22 bp, Homo sapiens
gcacaggacatgcggtagccag

SEQ ID NO: 1307015 - DNA, 13 bp, Homo sapiens
gcacatctctgct

SEQ ID NO: 1307016 - DNA, 16 bp, Homo sapiens
gcacatctctgcttga

SEQ ID NO: 1307017 - DNA, 14 bp, Homo sapiens
gcaccgttctgtgc

SEQ ID NO: 1307018 - DNA, 15 bp, Homo sapiens
gcaccgttctgtgca

SEQ ID NO: 1307019 - DNA, 16 bp, Homo sapiens
gcacctaatccaggca

SEQ ID NO: 1307020 - DNA, 22 bp, Homo sapiens
gcacctaatccaggcagatcca

SEQ ID NO: 1307021 - DNA, 23 bp, Homo sapiens
gcacctaatccaggcagatccag

SEQ ID NO: 1307022 - DNA, 14 bp, Homo sapiens
gcacctgcctcagg

SEQ ID NO: 1307023 - DNA, 16 bp, Homo sapiens
gcactacattcattta

SEQ ID NO: 1307024 - DNA, 13 bp, Homo sapiens
gcactgaggaaga

SEQ ID NO: 1307025 - DNA, 22 bp, Homo sapiens
gcactgatgctgcccctcatct

SEQ ID NO: 1307026 - DNA, 17 bp, Homo sapiens
gcacttgtgattattta

SEQ ID NO: 1307027 - DNA, 12 bp, Homo sapiens
gcagaggagggg

SEQ ID NO: 1307028 - DNA, 12 bp, Homo sapiens
gcagcagaaggg

SEQ ID NO: 1307029 - DNA, 15 bp, Homo sapiens
gcagcagaagggggt

SEQ ID NO: 1307030 - DNA, 15 bp, Homo sapiens
gcagcagggatgccc

SEQ ID NO: 1307031 - DNA, 18 bp, Homo sapiens
gcagcctcccatccaggg

SEQ ID NO: 1307032 - DNA, 23 bp, Homo sapiens
gcagcctgcgccaccgcccagag

SEQ ID NO: 1307033 - DNA, 13 bp, Homo sapiens
gcagcgcctttcc

SEQ ID NO: 1307034 - DNA, 15 bp, Homo sapiens
gcagcgcctttccca

SEQ ID NO: 1307035 - DNA, 20 bp, Homo sapiens
gcaggaccttcgggctgtgc

SEQ ID NO: 1307036 - DNA, 13 bp, Homo sapiens
gcagggatgccct

SEQ ID NO: 1307037 - DNA, 13 bp, Homo sapiens
gcagggcagtcat

SEQ ID NO: 1307038 - DNA, 19 bp, Homo sapiens
gcagggccaacccttctcc

SEQ ID NO: 1307039 - DNA, 22 bp, Homo sapiens
gcaggggtggctgcctcattta

SEQ ID NO: 1307040 - DNA, 15 bp, Homo sapiens
gcaggttcccaagct

SEQ ID NO: 1307041 - DNA, 19 bp, Homo sapiens
gcaggttcccaagctcaga

SEQ ID NO: 1307042 - DNA, 14 bp, Homo sapiens
gcagttggccagag

SEQ ID NO: 1307043 - DNA, 12 bp, Homo sapiens
gcatatgttgaa

SEQ ID NO: 1307044 - DNA, 17 bp, Homo sapiens
gcatatgttgaatactt

SEQ ID NO: 1307045 - DNA, 18 bp, Homo sapiens
gcatatgttgaatacttt

SEQ ID NO: 1307046 - DNA, 15 bp, Homo sapiens
gcatctgaccagcag

SEQ ID NO: 1307047 - DNA, 17 bp, Homo sapiens
gcatctgaccagcagcg

SEQ ID NO: 1307048 - DNA, 18 bp, Homo sapiens
gcattaaattcacaaact

SEQ ID NO: 1307049 - DNA, 16 bp, Homo sapiens
gcattgaacacaaact

SEQ ID NO: 1307050 - DNA, 23 bp, Homo sapiens
gcattttggagagtttcctgaaa

SEQ ID NO: 1307051 - DNA, 20 bp, Homo sapiens
gccaacacgcacctgcctca

SEQ ID NO: 1307052 - DNA, 11 bp, Homo sapiens
gccaaggagct

SEQ ID NO: 1307053 - DNA, 13 bp, Homo sapiens
gccaaggagctgc

SEQ ID NO: 1307054 - DNA, 23 bp, Homo sapiens
gccaaggagctgctatagcctgg

SEQ ID NO: 1307055 - DNA, 18 bp, Homo sapiens
gccacaaggacttcctgt

SEQ ID NO: 1307056 - DNA, 16 bp, Homo sapiens
gccacactcagcacaa

SEQ ID NO: 1307057 - DNA, 17 bp, Homo sapiens
gccacactcagcacaag

SEQ ID NO: 1307058 - DNA, 19 bp, Homo sapiens
gccacactcagcacaaggc

SEQ ID NO: 1307059 - DNA, 20 bp, Homo sapiens
gccacaggcctgagatttca

SEQ ID NO: 1307060 - DNA, 15 bp, Homo sapiens
gccacatcaaagagg

SEQ ID NO: 1307061 - DNA, 19 bp, Homo sapiens
gccacatttggaatacttt

SEQ ID NO: 1307062 - DNA, 21 bp, Homo sapiens
gccacccacctccctgcctcc

SEQ ID NO: 1307063 - DNA, 15 bp, Homo sapiens
gccactaagcagagg

SEQ ID NO: 1307064 - DNA, 19 bp, Homo sapiens
gccactaagcagaggaggg

SEQ ID NO: 1307065 - DNA, 20 bp, Homo sapiens
gccacttctgggtggggcag

SEQ ID NO: 1307066 - DNA, 16 bp, Homo sapiens
gccagacacaggccct

SEQ ID NO: 1307067 - DNA, 21 bp, Homo sapiens
gccagagagcctggtgctgct

SEQ ID NO: 1307068 - DNA, 16 bp, Homo sapiens
gccagagatccaaaag

SEQ ID NO: 1307069 - DNA, 21 bp, Homo sapiens
gccagagatccaaaagaagcc

SEQ ID NO: 1307070 - DNA, 22 bp, Homo sapiens
gccagagatccaaaagaagccc

SEQ ID NO: 1307071 - DNA, 11 bp, Homo sapiens
gccagatccag

SEQ ID NO: 1307072 - DNA, 14 bp, Homo sapiens
gccagatccagcct

SEQ ID NO: 1307073 - DNA, 16 bp, Homo sapiens
gccagatccagcctgg

SEQ ID NO: 1307074 - DNA, 12 bp, Homo sapiens
gctccagacctg

SEQ ID NO: 1307075 - DNA, 20 bp, Homo sapiens
gctccagacctgatcctgga

SEQ ID NO: 1307076 - DNA, 17 bp, Homo sapiens
gctccagatgcagggca

SEQ ID NO: 1307077 - DNA, 21 bp, Homo sapiens
gctccagatgcagggcagtca

SEQ ID NO: 1307078 - DNA, 20 bp, Homo sapiens
gctcctcctccctgcatctg

SEQ ID NO: 1307079 - DNA, 12 bp, Homo sapiens
gctcctctcagt

SEQ ID NO: 1307080 - DNA, 19 bp, Homo sapiens
gctcctctccccagcccag

SEQ ID NO: 1307081 - DNA, 18 bp, Homo sapiens
gctcctgccgcagagctg

SEQ ID NO: 1307082 - DNA, 22 bp, Homo sapiens
gctctccttcctggagcccaga

SEQ ID NO: 1307083 - DNA, 16 bp, Homo sapiens
gctctggacagcccca

SEQ ID NO: 1307084 - DNA, 22 bp, Homo sapiens
gctctggacagccccaccctgg

SEQ ID NO: 1307085 - DNA, 14 bp, Homo sapiens
gctctgggccattc

SEQ ID NO: 1307086 - DNA, 23 bp, Homo sapiens
gctcttctcatttcacccctccc

SEQ ID NO: 1307087 - DNA, 17 bp, Homo sapiens
gctctttcctccttcca

SEQ ID NO: 1307088 - DNA, 22 bp, Homo sapiens
gctgacccagccccttgagaaa

SEQ ID NO: 1307089 - DNA, 13 bp, Homo sapiens
gctgacggccagg

SEQ ID NO: 1307090 - DNA, 15 bp, Homo sapiens
gctgacggccaggga

SEQ ID NO: 1307091 - DNA, 22 bp, Homo sapiens
gctgagcccctgtctagagagg

SEQ ID NO: 1307092 - DNA, 13 bp, Homo sapiens
gctgagcctctgc

SEQ ID NO: 1307093 - DNA, 19 bp, Homo sapiens
gctgagcctctgctcccca

SEQ ID NO: 1307094 - DNA, 19 bp, Homo sapiens
gctgaggccacactcagca

SEQ ID NO: 1307095 - DNA, 13 bp, Homo sapiens
gctgcaaaggaca

SEQ ID NO: 1307096 - DNA, 19 bp, Homo sapiens
gctgcaaggtttaggctgg

SEQ ID NO: 1307097 - DNA, 16 bp, Homo sapiens
gctgcagcctgcgcca

SEQ ID NO: 1307098 - DNA, 22 bp, Homo sapiens
gctgcatcccccccacctctcc

SEQ ID NO: 1307099 - DNA, 17 bp, Homo sapiens
gctgccacccacctccc

SEQ ID NO: 1307100 - DNA, 20 bp, Homo sapiens
gctgccacccacctccctgc

SEQ ID NO: 1307101 - DNA, 21 bp, Homo sapiens
gctgcctcccctctccttcct

SEQ ID NO: 1307102 - DNA, 16 bp, Homo sapiens
gctgccttggctcaga

SEQ ID NO: 1307103 - DNA, 16 bp, Homo sapiens
gctgctatagcctggg

SEQ ID NO: 1307104 - DNA, 17 bp, Homo sapiens
gctgctatagcctgggg

SEQ ID NO: 1307105 - DNA, 23 bp, Homo sapiens
gctgctcctagagggaggggcct

SEQ ID NO: 1307106 - DNA, 21 bp, Homo sapiens
gctgctggacagtatcactgt

SEQ ID NO: 1307107 - DNA, 13 bp, Homo sapiens
gctggcccagggc

SEQ ID NO: 1307108 - DNA, 18 bp, Homo sapiens
gctggcccagggcccaga

SEQ ID NO: 1307109 - DNA, 22 bp, Homo sapiens
gctggcctcccaaatgagccat

SEQ ID NO: 1307110 - DNA, 19 bp, Homo sapiens
gctgggacgtggctcagcc

SEQ ID NO: 1307111 - DNA, 20 bp, Homo sapiens
gctgggacgtggctcagcca

SEQ ID NO: 1307112 - DNA, 19 bp, Homo sapiens
gctgggggtgggccaggct

SEQ ID NO: 1307113 - DNA, 14 bp, Homo sapiens
gctgggtcaggcag

SEQ ID NO: 1307114 - DNA, 12 bp, Homo sapiens
gctggttctgta

SEQ ID NO: 1307115 - DNA, 16 bp, Homo sapiens
gctgtaaaatgcatga

SEQ ID NO: 1307116 - DNA, 23 bp, Homo sapiens
gctgtacatctattttggattgt

SEQ ID NO: 1307117 - DNA, 14 bp, Homo sapiens
gctgtcatctgtgc

SEQ ID NO: 1307118 - DNA, 18 bp, Homo sapiens
gctgtcctcaggtggcca

SEQ ID NO: 1307119 - DNA, 22 bp, Homo sapiens
gctgttcccatgtagccccctg

SEQ ID NO: 1307120 - DNA, 16 bp, Homo sapiens
gctgttgagctgtttt

SEQ ID NO: 1307121 - DNA, 13 bp, Homo sapiens
gctgtttccatag

SEQ ID NO: 1307122 - DNA, 19 bp, Homo sapiens
gcttccatgattctattta

SEQ ID NO: 1307123 - DNA, 12 bp, Homo sapiens
gcttccattcca

SEQ ID NO: 1307124 - DNA, 15 bp, Homo sapiens
gcttctcctgtgtga

SEQ ID NO: 1307125 - DNA, 19 bp, Homo sapiens
gcttctctgtgaacgattt

SEQ ID NO: 1307126 - DNA, 15 bp, Homo sapiens
gcttgacaacatctg

SEQ ID NO: 1307127 - DNA, 14 bp, Homo sapiens
gcttgattctgcag

SEQ ID NO: 1307128 - DNA, 16 bp, Homo sapiens
gcttggggcttcctaa

SEQ ID NO: 1307129 - DNA, 15 bp, Homo sapiens
gcttgttatttataa

SEQ ID NO: 1307130 - DNA, 14 bp, Homo sapiens
gctttatgctgaaa

SEQ ID NO: 1307131 - DNA, 18 bp, Homo sapiens
gctttctgctcagcttct

SEQ ID NO: 1307132 - DNA, 14 bp, Homo sapiens
gctttgatccctga

SEQ ID NO: 1307133 - DNA, 12 bp, Homo sapiens
gctttgattcat

SEQ ID NO: 1307134 - DNA, 15 bp, Homo sapiens
gctttgattcatagt

SEQ ID NO: 1307135 - DNA, 19 bp, Homo sapiens
gctttgctgctgaaggctc

SEQ ID NO: 1307136 - DNA, 18 bp, Homo sapiens
gctttgctttctgctcag

SEQ ID NO: 1307137 - DNA, 17 bp, Homo sapiens
gctttggatttgacatt

SEQ ID NO: 1307138 - DNA, 21 bp, Homo sapiens
gctttttatttctgcatatgt

SEQ ID NO: 1307139 - DNA, 20 bp, Homo sapiens
ggaaaatgcagcagggatgc

SEQ ID NO: 1307140 - DNA, 23 bp, Homo sapiens
ggaacctcagcctggccagacac

SEQ ID NO: 1307141 - DNA, 19 bp, Homo sapiens
ggaactcagatccagggac

SEQ ID NO: 1307142 - DNA, 16 bp, Homo sapiens
ggaactgcatgctgct

SEQ ID NO: 1307143 - DNA, 22 bp, Homo sapiens
ggaacttggggagttaagacct

SEQ ID NO: 1307144 - DNA, 23 bp, Homo sapiens
ggaacttggggagttaagacctg

SEQ ID NO: 1307145 - DNA, 21 bp, Homo sapiens
ggaagaacggggctcttctca

SEQ ID NO: 1307146 - DNA, 13 bp, Homo sapiens
ggaagagaaacca

SEQ ID NO: 1307147 - DNA, 14 bp, Homo sapiens
ggaagccaaagagt

SEQ ID NO: 1307148 - DNA, 15 bp, Homo sapiens
ggaagtccaatgtgg

SEQ ID NO: 1307149 - DNA, 20 bp, Homo sapiens
ggaagtgaagactggaagct

SEQ ID NO: 1307150 - DNA, 15 bp, Homo sapiens
ggaattgatttgcat

SEQ ID NO: 1307151 - DNA, 17 bp, Homo sapiens
ggaattgatttgcattg

SEQ ID NO: 1307152 - DNA, 18 bp, Homo sapiens
ggaatttcccaggaccct

SEQ ID NO: 1307153 - DNA, 16 bp, Homo sapiens
ggacagaggccccagc

SEQ ID NO: 1307154 - DNA, 17 bp, Homo sapiens
ggacagaggccccagcc

SEQ ID NO: 1307155 - DNA, 20 bp, Homo sapiens
ggacagaggccccagcctcc

SEQ ID NO: 1307156 - DNA, 17 bp, Homo sapiens
ggacagccccaccctgg

SEQ ID NO: 1307157 - DNA, 23 bp, Homo sapiens
ggacataatggggtcctggccat

SEQ ID NO: 1307158 - DNA, 16 bp, Homo sapiens
ggacatgcggtagcca

SEQ ID NO: 1307159 - DNA, 18 bp, Homo sapiens
ggaccagctcaggacaga

SEQ ID NO: 1307160 - DNA, 22 bp, Homo sapiens
ggaccagctcaggacagatgcc

SEQ ID NO: 1307161 - DNA, 21 bp, Homo sapiens
ggaccttaggccttcctctct

SEQ ID NO: 1307162 - DNA, 20 bp, Homo sapiens
ggaccttcgggctgtgcccg

SEQ ID NO: 1307163 - DNA, 18 bp, Homo sapiens
ggacgtggctcagccagc

SEQ ID NO: 1307164 - DNA, 23 bp, Homo sapiens
ggactatatttgggcctgctcca

SEQ ID NO: 1307165 - DNA, 13 bp, Homo sapiens
ggactgaggcctg

SEQ ID NO: 1307166 - DNA, 23 bp, Homo sapiens
ggacttcctgtccagctccaacc

SEQ ID NO: 1307167 - DNA, 15 bp, Homo sapiens
ggagaagccaggaat

SEQ ID NO: 1307168 - DNA, 20 bp, Homo sapiens
ggagaccggggtatcctggg

SEQ ID NO: 1307169 - DNA, 20 bp, Homo sapiens
ggagccaacagaagcttcca

SEQ ID NO: 1307170 - DNA, 21 bp, Homo sapiens
ggagccagctccctctattta

SEQ ID NO: 1307171 - DNA, 14 bp, Homo sapiens
ggagcccactgtcc

SEQ ID NO: 1307172 - DNA, 23 bp, Homo sapiens
ggagcccactgtcctgggcctgc

SEQ ID NO: 1307173 - DNA, 19 bp, Homo sapiens
ggagccccttctgctcagc

SEQ ID NO: 1307174 - DNA, 20 bp, Homo sapiens
ggagcctttggttctggcca

SEQ ID NO: 1307175 - DNA, 18 bp, Homo sapiens
ggagctgccttggctcag

SEQ ID NO: 1307176 - DNA, 18 bp, Homo sapiens
ggagctgctatagcctgg

SEQ ID NO: 1307177 - DNA, 17 bp, Homo sapiens
ggagctggggatccctc

SEQ ID NO: 1307178 - DNA, 19 bp, Homo sapiens
ggaggcccagttcaccctg

SEQ ID NO: 1307179 - DNA, 15 bp, Homo sapiens
ggagggaggctcagg

SEQ ID NO: 1307180 - DNA, 16 bp, Homo sapiens
ggagggcagcagaagg

SEQ ID NO: 1307181 - DNA, 21 bp, Homo sapiens
ggagttgatctggaacccaga

SEQ ID NO: 1307182 - DNA, 19 bp, Homo sapiens
ggatagatgctggcccagg

SEQ ID NO: 1307183 - DNA, 21 bp, Homo sapiens
ggatagatgctggcccagggc

SEQ ID NO: 1307184 - DNA, 22 bp, Homo sapiens
ggatgccaatattaaatctgct

SEQ ID NO: 1307185 - DNA, 13 bp, Homo sapiens
ggatgccctggag

SEQ ID NO: 1307186 - DNA, 18 bp, Homo sapiens
ggatgccctggaggtggc

SEQ ID NO: 1307187 - DNA, 16 bp, Homo sapiens
ggatgcggatggccgg

SEQ ID NO: 1307188 - DNA, 18 bp, Homo sapiens
ggatgtgattgtggaatg

SEQ ID NO: 1307189 - DNA, 14 bp, Homo sapiens
ggattaatatgaaa

SEQ ID NO: 1307190 - DNA, 16 bp, Homo sapiens
ggattaatatgaaaac

SEQ ID NO: 1307191 - DNA, 21 bp, Homo sapiens
ggattcaggaatgtgtggcct

SEQ ID NO: 1307192 - DNA, 23 bp, Homo sapiens
ggcaaacaggcagttggccagag

SEQ ID NO: 1307193 - DNA, 12 bp, Homo sapiens
ggcaaataaaag

SEQ ID NO: 1307194 - DNA, 13 bp, Homo sapiens
ggcaccagacacc

SEQ ID NO: 1307195 - DNA, 17 bp, Homo sapiens
ggcaccagacacccagg

SEQ ID NO: 1307196 - DNA, 19 bp, Homo sapiens
ggcaccagacacccaggac

SEQ ID NO: 1307197 - DNA, 16 bp, Homo sapiens
ggcacctcacaggccc

SEQ ID NO: 1307198 - DNA, 14 bp, Homo sapiens
ggcagatccaggac

SEQ ID NO: 1307199 - DNA, 21 bp, Homo sapiens
ggcagcctcccatccagggcc

SEQ ID NO: 1307200 - DNA, 11 bp, Homo sapiens
ggcatttccta

SEQ ID NO: 1307201 - DNA, 16 bp, Homo sapiens
ggccaaggagctgcta

SEQ ID NO: 1307202 - DNA, 16 bp, Homo sapiens
ggccacactcagcaca

SEQ ID NO: 1307203 - DNA, 21 bp, Homo sapiens
ggccacactcagcacaaggcc

SEQ ID NO: 1307204 - DNA, 23 bp, Homo sapiens
ggccacgtgggcaaacaggcagt

SEQ ID NO: 1307205 - DNA, 20 bp, Homo sapiens
ggccactaagcagaggaggg

SEQ ID NO: 1307206 - DNA, 21 bp, Homo sapiens
ggccactaagcagaggagggg

SEQ ID NO: 1307207 - DNA, 15 bp, Homo sapiens
ggccacttctgggtg

SEQ ID NO: 1307208 - DNA, 17 bp, Homo sapiens
ggccagacacaggccct

SEQ ID NO: 1307209 - DNA, 15 bp, Homo sapiens
ggccagacatgccac

SEQ ID NO: 1307210 - DNA, 18 bp, Homo sapiens
ggccagacatgccacaag

SEQ ID NO: 1307211 - DNA, 22 bp, Homo sapiens
ggccagagagcctggtgctgct

SEQ ID NO: 1307212 - DNA, 23 bp, Homo sapiens
ggccagagagcctggtgctgctg

SEQ ID NO: 1307213 - DNA, 13 bp, Homo sapiens
ggccagagccagg

SEQ ID NO: 1307214 - DNA, 12 bp, Homo sapiens
ggccagatccag

SEQ ID NO: 1307215 - DNA, 16 bp, Homo sapiens
ggccagatccagcctg

SEQ ID NO: 1307216 - DNA, 15 bp, Homo sapiens
ggccagggagaagct

SEQ ID NO: 1307217 - DNA, 16 bp, Homo sapiens
ggccagggagaagctc

SEQ ID NO: 1307218 - DNA, 18 bp, Homo sapiens
ggccagggagaagctcct

SEQ ID NO: 1307219 - DNA, 16 bp, Homo sapiens
ggcccagagcccagct

SEQ ID NO: 1307220 - DNA, 19 bp, Homo sapiens
ggcccagagcccagctcca

SEQ ID NO: 1307221 - DNA, 22 bp, Homo sapiens
ggcccaggaccatcatcctact

SEQ ID NO: 1307222 - DNA, 16 bp, Homo sapiens
ggcccagggcccagag

SEQ ID NO: 1307223 - DNA, 13 bp, Homo sapiens
ggccccagcctcc

SEQ ID NO: 1307224 - DNA, 14 bp, Homo sapiens
ggcccccatctcat

SEQ ID NO: 1307225 - DNA, 21 bp, Homo sapiens
ggcccccatctcatgcccctg

SEQ ID NO: 1307226 - DNA, 22 bp, Homo sapiens
ggcccctatgtagtccgtgctg

SEQ ID NO: 1307227 - DNA, 20 bp, Homo sapiens
ggcccggccagccatgtctg

SEQ ID NO: 1307228 - DNA, 21 bp, Homo sapiens
ggccctccctgttccccagag

SEQ ID NO: 1307229 - DNA, 14 bp, Homo sapiens
ggccctctggagtg

SEQ ID NO: 1307230 - DNA, 18 bp, Homo sapiens
ggccctctggagtggcca

SEQ ID NO: 1307231 - DNA, 13 bp, Homo sapiens
ggccgagtccaag

SEQ ID NO: 1307232 - DNA, 15 bp, Homo sapiens
ggccgctgccaccca

SEQ ID NO: 1307233 - DNA, 19 bp, Homo sapiens
ggccgctgccacccacctc

SEQ ID NO: 1307234 - DNA, 22 bp, Homo sapiens
ggccgctgccacccacctccct

SEQ ID NO: 1307235 - DNA, 19 bp, Homo sapiens
ggcctaagagttgagctct

SEQ ID NO: 1307236 - DNA, 20 bp, Homo sapiens
ggcctaggcctcagccagag

SEQ ID NO: 1307237 - DNA, 20 bp, Homo sapiens
ggcctcagccagagaagcta

SEQ ID NO: 1307238 - DNA, 22 bp, Homo sapiens
ggcctgagatttcatctgctct

SEQ ID NO: 1307239 - DNA, 18 bp, Homo sapiens
ggcctgagcgctcctgcc

SEQ ID NO: 1307240 - DNA, 14 bp, Homo sapiens
ggcctgctccagac

SEQ ID NO: 1307241 - DNA, 18 bp, Homo sapiens
ggcggctcggaggaagcc

SEQ ID NO: 1307242 - DNA, 16 bp, Homo sapiens
ggcgtctgttccccct

SEQ ID NO: 1307243 - DNA, 17 bp, Homo sapiens
ggctagtcaagctcctc

SEQ ID NO: 1307244 - DNA, 19 bp, Homo sapiens
ggctagtcaagctcctcct

SEQ ID NO: 1307245 - DNA, 19 bp, Homo sapiens
ggctcaagcgattctcctg

SEQ ID NO: 1307246 - DNA, 12 bp, Homo sapiens
ggctcacactga

SEQ ID NO: 1307247 - DNA, 14 bp, Homo sapiens
ggctcacactgaga

SEQ ID NO: 1307248 - DNA, 15 bp, Homo sapiens
ggctcacactgagaa

SEQ ID NO: 1307249 - DNA, 23 bp, Homo sapiens
ggctctcatgttttcaactgcca

SEQ ID NO: 1307250 - DNA, 23 bp, Homo sapiens
ggctctgggatagctgacccagc

SEQ ID NO: 1307251 - DNA, 13 bp, Homo sapiens
ggctcttctcatt

SEQ ID NO: 1307252 - DNA, 13 bp, Homo sapiens
ggctgaccacagc

SEQ ID NO: 1307253 - DNA, 22 bp, Homo sapiens
ggctgaccacagcacagccaac

SEQ ID NO: 1307254 - DNA, 14 bp, Homo sapiens
ggctgaggctggca

SEQ ID NO: 1307255 - DNA, 14 bp, Homo sapiens
ggctggcacaggac

SEQ ID NO: 1307256 - DNA, 18 bp, Homo sapiens
ggctgggacgtggctcag

SEQ ID NO: 1307257 - DNA, 22 bp, Homo sapiens
ggctggttcggatttggggtgg

SEQ ID NO: 1307258 - DNA, 16 bp, Homo sapiens
ggctgtaaaatgcatg

SEQ ID NO: 1307259 - DNA, 13 bp, Homo sapiens
ggctttggcttct

SEQ ID NO: 1307260 - DNA, 22 bp, Homo sapiens
gggacaagtggactcagggcag

SEQ ID NO: 1307261 - DNA, 18 bp, Homo sapiens
gggacagaggccccagcc

SEQ ID NO: 1307262 - DNA, 19 bp, Homo sapiens
gggacagaggccccagcct

SEQ ID NO: 1307263 - DNA, 21 bp, Homo sapiens
gggacccaatgtaggagctgc

SEQ ID NO: 1307264 - DNA, 19 bp, Homo sapiens
gggagcccactgtcctggg

SEQ ID NO: 1307265 - DNA, 19 bp, Homo sapiens
gggagccccttctgctcag

SEQ ID NO: 1307266 - DNA, 21 bp, Homo sapiens
gggagcctttggttctggcca

SEQ ID NO: 1307267 - DNA, 18 bp, Homo sapiens
gggaggttgatcagatct

SEQ ID NO: 1307268 - DNA, 20 bp, Homo sapiens
gggatccctcccccccatgc

SEQ ID NO: 1307269 - DNA, 15 bp, Homo sapiens
gggcaaacaggcagt

SEQ ID NO: 1307270 - DNA, 20 bp, Homo sapiens
gggcagcagaagggggtggt

SEQ ID NO: 1307271 - DNA, 13 bp, Homo sapiens
gggcagcgccagg

SEQ ID NO: 1307272 - DNA, 18 bp, Homo sapiens
gggcagtgggtcccagat

SEQ ID NO: 1307273 - DNA, 20 bp, Homo sapiens
gggcagtggtgtggagaagc

SEQ ID NO: 1307274 - DNA, 22 bp, Homo sapiens
gggccacttctgggtggggcag

SEQ ID NO: 1307275 - DNA, 15 bp, Homo sapiens
gggccagagccaggg

SEQ ID NO: 1307276 - DNA, 22 bp, Homo sapiens
gggccatgatggcaacagatct

SEQ ID NO: 1307277 - DNA, 18 bp, Homo sapiens
gggccattctccacagca

SEQ ID NO: 1307278 - DNA, 11 bp, Homo sapiens
gggcccagagc

SEQ ID NO: 1307279 - DNA, 12 bp, Homo sapiens
gggcccagagcc

SEQ ID NO: 1307280 - DNA, 13 bp, Homo sapiens
gggcccagagccc

SEQ ID NO: 1307281 - DNA, 16 bp, Homo sapiens
gggcccagagcccagc

SEQ ID NO: 1307282 - DNA, 16 bp, Homo sapiens
gggcccggccagccat

SEQ ID NO: 1307283 - DNA, 14 bp, Homo sapiens
gggcctccagaact

SEQ ID NO: 1307284 - DNA, 17 bp, Homo sapiens
gggcctgctccagacct

SEQ ID NO: 1307285 - DNA, 17 bp, Homo sapiens
gggcgtctgttccccct

SEQ ID NO: 1307286 - DNA, 12 bp, Homo sapiens
gggctcttctca

SEQ ID NO: 1307287 - DNA, 14 bp, Homo sapiens
gggctggactgagg

SEQ ID NO: 1307288 - DNA, 14 bp, Homo sapiens
gggctggttctgta

SEQ ID NO: 1307289 - DNA, 18 bp, Homo sapiens
ggggaactcagatccagg

SEQ ID NO: 1307290 - DNA, 21 bp, Homo sapiens
ggggacccaatgtaggagctg

SEQ ID NO: 1307291 - DNA, 17 bp, Homo sapiens
ggggagttaagacctgg

SEQ ID NO: 1307292 - DNA, 21 bp, Homo sapiens
ggggagttaagacctggcagc

SEQ ID NO: 1307293 - DNA, 22 bp, Homo sapiens
ggggatcatctgccgtgcctgg

SEQ ID NO: 1307294 - DNA, 13 bp, Homo sapiens
ggggcccggccag

SEQ ID NO: 1307295 - DNA, 15 bp, Homo sapiens
ggggcccggccagcc

SEQ ID NO: 1307296 - DNA, 14 bp, Homo sapiens
ggggccgctgccac

SEQ ID NO: 1307297 - DNA, 18 bp, Homo sapiens
ggggcgtctgttccccct

SEQ ID NO: 1307298 - DNA, 24 bp, Homo sapiens
ggggctctcatgttttcaactgcc

SEQ ID NO: 1307299 - DNA, 18 bp, Homo sapiens
ggggtcatgccctcctct

SEQ ID NO: 1307300 - DNA, 21 bp, Homo sapiens
ggggtcatgccctcctctccc

SEQ ID NO: 1307301 - DNA, 14 bp, Homo sapiens
ggggtcctggccat

SEQ ID NO: 1307302 - DNA, 17 bp, Homo sapiens
ggggtgggccaggctga

SEQ ID NO: 1307303 - DNA, 16 bp, Homo sapiens
gggtcatgccctcctc

SEQ ID NO: 1307304 - DNA, 21 bp, Homo sapiens
gggtcatgccctcctctccca

SEQ ID NO: 1307305 - DNA, 22 bp, Homo sapiens
gggtctggagttgatctggaac

SEQ ID NO: 1307306 - DNA, 17 bp, Homo sapiens
gggtgagaacaaccaaa

SEQ ID NO: 1307307 - DNA, 15 bp, Homo sapiens
gggtgaggagctggg

SEQ ID NO: 1307308 - DNA, 15 bp, Homo sapiens
gggtgggcaggaaaa

SEQ ID NO: 1307309 - DNA, 14 bp, Homo sapiens
gggtgggccaggct

SEQ ID NO: 1307310 - DNA, 19 bp, Homo sapiens
gggtgggccaggctgatgg

SEQ ID NO: 1307311 - DNA, 17 bp, Homo sapiens
gggtgtgcacatctctg

SEQ ID NO: 1307312 - DNA, 16 bp, Homo sapiens
ggtacttcttgaaggt

SEQ ID NO: 1307313 - DNA, 19 bp, Homo sapiens
ggtcaacatggtgaaaccc

SEQ ID NO: 1307314 - DNA, 14 bp, Homo sapiens
ggtcacacactgat

SEQ ID NO: 1307315 - DNA, 20 bp, Homo sapiens
ggtcctacccatccccgcag

SEQ ID NO: 1307316 - DNA, 12 bp, Homo sapiens
ggtcctggccat

SEQ ID NO: 1307317 - DNA, 18 bp, Homo sapiens
ggtgaacaaagcagccac

SEQ ID NO: 1307318 - DNA, 20 bp, Homo sapiens
ggtgatatccattctttctg

SEQ ID NO: 1307319 - DNA, 16 bp, Homo sapiens
ggtgcagtgtgaaaag

SEQ ID NO: 1307320 - DNA, 16 bp, Homo sapiens
ggtgccccaggaccag

SEQ ID NO: 1307321 - DNA, 10 bp, Homo sapiens
ggtggccatg

SEQ ID NO: 1307322 - DNA, 19 bp, Homo sapiens
ggtggcctaagagttgagc

SEQ ID NO: 1307323 - DNA, 21 bp, Homo sapiens
ggtggcgactctatagactct

SEQ ID NO: 1307324 - DNA, 14 bp, Homo sapiens
ggtgggccaggctg

SEQ ID NO: 1307325 - DNA, 21 bp, Homo sapiens
ggtggtgtctccaacccccca

SEQ ID NO: 1307326 - DNA, 15 bp, Homo sapiens
ggtgtggtgcagtgt

SEQ ID NO: 1307327 - DNA, 17 bp, Homo sapiens
ggtgtggtgcagtgtga

SEQ ID NO: 1307328 - DNA, 20 bp, Homo sapiens
ggttcggatttggggtggat

SEQ ID NO: 1307329 - DNA, 17 bp, Homo sapiens
ggtttaggctggtggcc

SEQ ID NO: 1307330 - DNA, 22 bp, Homo sapiens
ggtttaggctggtggcccagga

SEQ ID NO: 1307331 - DNA, 19 bp, Homo sapiens
ggtttcaccatgttgccca

SEQ ID NO: 1307332 - DNA, 14 bp, Homo sapiens
ggttttgttcccct

SEQ ID NO: 1307333 - DNA, 13 bp, Homo sapiens
gtaaataaagccc

SEQ ID NO: 1307334 - DNA, 19 bp, Homo sapiens
gtaaattgaatcagtataa

SEQ ID NO: 1307335 - DNA, 14 bp, Homo sapiens
gtaaccctggtggt

SEQ ID NO: 1307336 - DNA, 20 bp, Homo sapiens
gtaacttcttatggaattga

SEQ ID NO: 1307337 - DNA, 22 bp, Homo sapiens
gtaatcctcaagaaataaaagg

SEQ ID NO: 1307338 - DNA, 15 bp, Homo sapiens
gtaattgacatgtgc

SEQ ID NO: 1307339 - DNA, 15 bp, Homo sapiens
gtaattttatatgaa

SEQ ID NO: 1307340 - DNA, 11 bp, Homo sapiens
gtacatgagaa

SEQ ID NO: 1307341 - DNA, 19 bp, Homo sapiens
gtaccatttatacaaatta

SEQ ID NO: 1307342 - DNA, 21 bp, Homo sapiens
gtaccatttatacaaattaga

SEQ ID NO: 1307343 - DNA, 15 bp, Homo sapiens
gtagaattgcattga

SEQ ID NO: 1307344 - DNA, 17 bp, Homo sapiens
gtagatgggagggaggc

SEQ ID NO: 1307345 - DNA, 21 bp, Homo sapiens
gtagatgggagggaggctcag

SEQ ID NO: 1307346 - DNA, 15 bp, Homo sapiens
gtagccagcacacag

SEQ ID NO: 1307347 - DNA, 23 bp, Homo sapiens
gtaggagctgccttggctcagac

SEQ ID NO: 1307348 - DNA, 14 bp, Homo sapiens
gtaggcatttccta

SEQ ID NO: 1307349 - DNA, 15 bp, Homo sapiens
gtagtaattgacatg

SEQ ID NO: 1307350 - DNA, 22 bp, Homo sapiens
gtagtccgtgctgacagctgct

SEQ ID NO: 1307351 - DNA, 23 bp, Homo sapiens
gtagtccgtgctgacagctgctc

SEQ ID NO: 1307352 - DNA, 16 bp, Homo sapiens
gtagtcttgatgacca

SEQ ID NO: 1307353 - DNA, 20 bp, Homo sapiens
gtataagtggaggcacttta

SEQ ID NO: 1307354 - DNA, 21 bp, Homo sapiens
gtataagtggaggcactttag

SEQ ID NO: 1307355 - DNA, 20 bp, Homo sapiens
gtatatttgtgatagcactt

SEQ ID NO: 1307356 - DNA, 23 bp, Homo sapiens
gtatatttgtgatagcactttct

SEQ ID NO: 1307357 - DNA, 13 bp, Homo sapiens
gtattaaagacag

SEQ ID NO: 1307358 - DNA, 23 bp, Homo sapiens
gtcaaaaagtttggttctgtgtc

SEQ ID NO: 1307359 - DNA, 18 bp, Homo sapiens
gtcaaggctgcttagaat

SEQ ID NO: 1307360 - DNA, 12 bp, Homo sapiens
gtcacagccacc

SEQ ID NO: 1307361 - DNA, 19 bp, Homo sapiens
gtcactcattgctgagcct

SEQ ID NO: 1307362 - DNA, 20 bp, Homo sapiens
gtcactcattgctgagcctc

SEQ ID NO: 1307363 - DNA, 21 bp, Homo sapiens
gtcactcattgctgagcctct

SEQ ID NO: 1307364 - DNA, 16 bp, Homo sapiens
gtcagtcacagccacc

SEQ ID NO: 1307365 - DNA, 16 bp, Homo sapiens
gtcatgccctcctctc

SEQ ID NO: 1307366 - DNA, 17 bp, Homo sapiens
gtcatgccctcctctcc

SEQ ID NO: 1307367 - DNA, 16 bp, Homo sapiens
gtcattcgttctgtgg

SEQ ID NO: 1307368 - DNA, 15 bp, Homo sapiens
gtccaagctgggaga

SEQ ID NO: 1307369 - DNA, 14 bp, Homo sapiens
gtccagctccaacc

SEQ ID NO: 1307370 - DNA, 22 bp, Homo sapiens
gtccccccaccctcattctact

SEQ ID NO: 1307371 - DNA, 18 bp, Homo sapiens
gtccccttctctcatctc

SEQ ID NO: 1307372 - DNA, 11 bp, Homo sapiens
gtccctctgcc

SEQ ID NO: 1307373 - DNA, 14 bp, Homo sapiens
gtccctctgcccca

SEQ ID NO: 1307374 - DNA, 20 bp, Homo sapiens
gtccgtgctgacagctgctc

SEQ ID NO: 1307375 - DNA, 21 bp, Homo sapiens
gtccgtgctgacagctgctcc

SEQ ID NO: 1307376 - DNA, 23 bp, Homo sapiens
gtcctcaggtggccatgcctcag

SEQ ID NO: 1307377 - DNA, 19 bp, Homo sapiens
gtcctctgtcagtcacagc

SEQ ID NO: 1307378 - DNA, 20 bp, Homo sapiens
gtcctctgtcagtcacagcc

SEQ ID NO: 1307379 - DNA, 16 bp, Homo sapiens
gtcctggccatcccac

SEQ ID NO: 1307380 - DNA, 13 bp, Homo sapiens
gtcctgggcctgc

SEQ ID NO: 1307381 - DNA, 14 bp, Homo sapiens
gtcctgggcctgca

SEQ ID NO: 1307382 - DNA, 14 bp, Homo sapiens
gtctagagagggag

SEQ ID NO: 1307383 - DNA, 16 bp, Homo sapiens
gtctagagagggaggc

SEQ ID NO: 1307384 - DNA, 16 bp, Homo sapiens
gtctccaaccccccag

SEQ ID NO: 1307385 - DNA, 17 bp, Homo sapiens
gtctccaaccccccagc

SEQ ID NO: 1307386 - DNA, 20 bp, Homo sapiens
gtctccaaccccccagcact

SEQ ID NO: 1307387 - DNA, 17 bp, Homo sapiens
gtctccaccaggaacct

SEQ ID NO: 1307388 - DNA, 21 bp, Homo sapiens
gtctgcatttcggtggctagt

SEQ ID NO: 1307389 - DNA, 15 bp, Homo sapiens
gtgaactttattaaa

SEQ ID NO: 1307390 - DNA, 22 bp, Homo sapiens
gtgaagccaattcagacaggca

SEQ ID NO: 1307391 - DNA, 17 bp, Homo sapiens
gtgagactcgagaactt

SEQ ID NO: 1307392 - DNA, 20 bp, Homo sapiens
gtgagactcgagaactttca

SEQ ID NO: 1307393 - DNA, 15 bp, Homo sapiens
gtgagcccagctggg

SEQ ID NO: 1307394 - DNA, 18 bp, Homo sapiens
gtgagcccagctgggtca

SEQ ID NO: 1307395 - DNA, 20 bp, Homo sapiens
gtgagcccagctgggtcagg

SEQ ID NO: 1307396 - DNA, 23 bp, Homo sapiens
gtgaggcaatgggagctgaggcc

SEQ ID NO: 1307397 - DNA, 17 bp, Homo sapiens
gtgagggagggctgtca

SEQ ID NO: 1307398 - DNA, 15 bp, Homo sapiens
gtgcactgcccatgg

SEQ ID NO: 1307399 - DNA, 20 bp, Homo sapiens
gtgcactgcccatggacagg

SEQ ID NO: 1307400 - DNA, 13 bp, Homo sapiens
gtgcccacaggcc

SEQ ID NO: 1307401 - DNA, 12 bp, Homo sapiens
gtgccccaggac

SEQ ID NO: 1307402 - DNA, 21 bp, Homo sapiens
gtgccccaggaccagctcagg

SEQ ID NO: 1307403 - DNA, 14 bp, Homo sapiens
gtgctcgccccagc

SEQ ID NO: 1307404 - DNA, 14 bp, Homo sapiens
gtgctcgccctgcg

SEQ ID NO: 1307405 - DNA, 16 bp, Homo sapiens
gtgctgacagctgctc

SEQ ID NO: 1307406 - DNA, 15 bp, Homo sapiens
gtgctgacggccagg

SEQ ID NO: 1307407 - DNA, 16 bp, Homo sapiens
gtgctgacggccaggg

SEQ ID NO: 1307408 - DNA, 18 bp, Homo sapiens
gtgctgacggccagggag

SEQ ID NO: 1307409 - DNA, 23 bp, Homo sapiens
gtgctgacggccagggagaagct

SEQ ID NO: 1307410 - DNA, 11 bp, Homo sapiens
gtgctgagaag

SEQ ID NO: 1307411 - DNA, 14 bp, Homo sapiens
gtgctgagaagctt

SEQ ID NO: 1307412 - DNA, 15 bp, Homo sapiens
gtgctggcaaccact

SEQ ID NO: 1307413 - DNA, 15 bp, Homo sapiens
gtggactcagggcag

SEQ ID NO: 1307414 - DNA, 16 bp, Homo sapiens
gtggactcagggcagc

SEQ ID NO: 1307415 - DNA, 16 bp, Homo sapiens
gtggccaaggagctgc

SEQ ID NO: 1307416 - DNA, 21 bp, Homo sapiens
gtggctagtcaagctcctcct

SEQ ID NO: 1307417 - DNA, 15 bp, Homo sapiens
gtggctcagccagca

SEQ ID NO: 1307418 - DNA, 16 bp, Homo sapiens
gtggctgcctcattta

SEQ ID NO: 1307419 - DNA, 20 bp, Homo sapiens
gtggctgcctcatttagaga

SEQ ID NO: 1307420 - DNA, 22 bp, Homo sapiens
gtggcttgagaaatatggacac

SEQ ID NO: 1307421 - DNA, 14 bp, Homo sapiens
gtgggcaggaaaag

SEQ ID NO: 1307422 - DNA, 17 bp, Homo sapiens
gtgggccaacaaagaac

SEQ ID NO: 1307423 - DNA, 14 bp, Homo sapiens
gtgggcttgattct

SEQ ID NO: 1307424 - DNA, 19 bp, Homo sapiens
gtggggtcatgccctcctc

SEQ ID NO: 1307425 - DNA, 12 bp, Homo sapiens
gtggtaaccctg

SEQ ID NO: 1307426 - DNA, 19 bp, Homo sapiens
gtggtggtaaccctggtgg

SEQ ID NO: 1307427 - DNA, 20 bp, Homo sapiens
gtggtggtaaccctggtggt

SEQ ID NO: 1307428 - DNA, 22 bp, Homo sapiens
gtggtgtggagaagccacaggc

SEQ ID NO: 1307429 - DNA, 18 bp, Homo sapiens
gtggttgctgttttcctc

SEQ ID NO: 1307430 - DNA, 19 bp, Homo sapiens
gtggttgctgttttcctcc

SEQ ID NO: 1307431 - DNA, 20 bp, Homo sapiens
gtggttgctgttttcctccc

SEQ ID NO: 1307432 - DNA, 17 bp, Homo sapiens
gtgtatttacgctttga

SEQ ID NO: 1307433 - DNA, 21 bp, Homo sapiens
gtgtctccaaccccccagcac

SEQ ID NO: 1307434 - DNA, 13 bp, Homo sapiens
gtgtgaatgaaca

SEQ ID NO: 1307435 - DNA, 19 bp, Homo sapiens
gtgtgcaatgtctgagtga

SEQ ID NO: 1307436 - DNA, 23 bp, Homo sapiens
gtgtgcactaaggggcccggcca

SEQ ID NO: 1307437 - DNA, 13 bp, Homo sapiens
gtgtggtgcagtg

SEQ ID NO: 1307438 - DNA, 17 bp, Homo sapiens
gtgtgtgaatgaacact

SEQ ID NO: 1307439 - DNA, 15 bp, Homo sapiens
gtgttgccacaggac

SEQ ID NO: 1307440 - DNA, 13 bp, Homo sapiens
gttaaaggaaaaa

SEQ ID NO: 1307441 - DNA, 22 bp, Homo sapiens
gttaagacatgatttccttgaa

SEQ ID NO: 1307442 - DNA, 13 bp, Homo sapiens
gttaagacctggc

SEQ ID NO: 1307443 - DNA, 21 bp, Homo sapiens
gttacagcctgttagtaacat

SEQ ID NO: 1307444 - DNA, 23 bp, Homo sapiens
gttagtaacatgaggggacattt

SEQ ID NO: 1307445 - DNA, 22 bp, Homo sapiens
gttcaccttgaagaacctctca

SEQ ID NO: 1307446 - DNA, 21 bp, Homo sapiens
gttcccccttcacaaagccca

SEQ ID NO: 1307447 - DNA, 14 bp, Homo sapiens
gttcctggcagttt

SEQ ID NO: 1307448 - DNA, 13 bp, Homo sapiens
gttctgcctgcca

SEQ ID NO: 1307449 - DNA, 15 bp, Homo sapiens
gttctgcctgccagc

SEQ ID NO: 1307450 - DNA, 19 bp, Homo sapiens
gttctgcctgccagctgca

SEQ ID NO: 1307451 - DNA, 16 bp, Homo sapiens
gttctggccagaatgc

SEQ ID NO: 1307452 - DNA, 11 bp, Homo sapiens
gttctgtgcac

SEQ ID NO: 1307453 - DNA, 17 bp, Homo sapiens
gttctttgggccagaca

SEQ ID NO: 1307454 - DNA, 17 bp, Homo sapiens
gttgaatactttttaca

SEQ ID NO: 1307455 - DNA, 15 bp, Homo sapiens
gttgatctggaaccc

SEQ ID NO: 1307456 - DNA, 22 bp, Homo sapiens
gttgatctggaacccagactca

SEQ ID NO: 1307457 - DNA, 19 bp, Homo sapiens
gttgcacttatgatttcat

SEQ ID NO: 1307458 - DNA, 14 bp, Homo sapiens
gttgccacaggaca

SEQ ID NO: 1307459 - DNA, 16 bp, Homo sapiens
gttgccacaggacaca

SEQ ID NO: 1307460 - DNA, 23 bp, Homo sapiens
gtttagcagcagcctttaatgca

SEQ ID NO: 1307461 - DNA, 18 bp, Homo sapiens
gtttaggctggtggccca

SEQ ID NO: 1307462 - DNA, 21 bp, Homo sapiens
gtttaggctggtggcccagga

SEQ ID NO: 1307463 - DNA, 19 bp, Homo sapiens
gtttccagacttccttgag

SEQ ID NO: 1307464 - DNA, 20 bp, Homo sapiens
gtttccagacttccttgaga

SEQ ID NO: 1307465 - DNA, 18 bp, Homo sapiens
gtttgtctgtcttcatag

SEQ ID NO: 1307466 - DNA, 19 bp, Homo sapiens
gttttaactagaatttatt

SEQ ID NO: 1307467 - DNA, 12 bp, Homo sapiens
gttttacattgt

SEQ ID NO: 1307468 - DNA, 21 bp, Homo sapiens
gttttacattgttgagctatt

SEQ ID NO: 1307469 - DNA, 17 bp, Homo sapiens
gttttcaagtcaaatta

SEQ ID NO: 1307470 - DNA, 16 bp, Homo sapiens
gttttcatttggttca

SEQ ID NO: 1307471 - DNA, 15 bp, Homo sapiens
gttttgaaggcaaaa

SEQ ID NO: 1307472 - DNA, 14 bp, Homo sapiens
taaaacagaagcct

SEQ ID NO: 1307473 - DNA, 14 bp, Homo sapiens
taaaaggaagccaa

SEQ ID NO: 1307474 - DNA, 19 bp, Homo sapiens
taaaaggaagccaaagagt

SEQ ID NO: 1307475 - DNA, 19 bp, Homo sapiens
taaaagtgggcttgattct

SEQ ID NO: 1307476 - DNA, 23 bp, Homo sapiens
taaaagtgggcttgattctgcag

SEQ ID NO: 1307477 - DNA, 16 bp, Homo sapiens
taaaatgcatgatttt

SEQ ID NO: 1307478 - DNA, 14 bp, Homo sapiens
taaaatgttaaaac

SEQ ID NO: 1307479 - DNA, 15 bp, Homo sapiens
taaacaaagttacta

SEQ ID NO: 1307480 - DNA, 18 bp, Homo sapiens
taaacttccccatcttct

SEQ ID NO: 1307481 - DNA, 15 bp, Homo sapiens
taaagctaaaataac

SEQ ID NO: 1307482 - DNA, 22 bp, Homo sapiens
taaataaatgtatcttattcac

SEQ ID NO: 1307483 - DNA, 14 bp, Homo sapiens
taaatcttttacaa

SEQ ID NO: 1307484 - DNA, 11 bp, Homo sapiens
taaatggctgc

SEQ ID NO: 1307485 - DNA, 19 bp, Homo sapiens
taaatgtatcttattcaca

SEQ ID NO: 1307486 - DNA, 12 bp, Homo sapiens
taaattcctctt

SEQ ID NO: 1307487 - DNA, 16 bp, Homo sapiens
taaattcctctttgct

SEQ ID NO: 1307488 - DNA, 17 bp, Homo sapiens
taaattcctctttgctt

SEQ ID NO: 1307489 - DNA, 18 bp, Homo sapiens
taaattcctctttgcttt

SEQ ID NO: 1307490 - DNA, 19 bp, Homo sapiens
taaattgaatcagtataaa

SEQ ID NO: 1307491 - DNA, 12 bp, Homo sapiens
taacagctgaat

SEQ ID NO: 1307492 - DNA, 19 bp, Homo sapiens
taacagctgaattatctat

SEQ ID NO: 1307493 - DNA, 18 bp, Homo sapiens
taacatgaggggacattt

SEQ ID NO: 1307494 - DNA, 19 bp, Homo sapiens
taacatgaggggacatttt

SEQ ID NO: 1307495 - DNA, 20 bp, Homo sapiens
taaccctggtggttgctgtt

SEQ ID NO: 1307496 - DNA, 18 bp, Homo sapiens
taactagaatttattcaa

SEQ ID NO: 1307497 - DNA, 19 bp, Homo sapiens
taacttcttatggaattga

SEQ ID NO: 1307498 - DNA, 14 bp, Homo sapiens
taagaaaagatttt

SEQ ID NO: 1307499 - DNA, 14 bp, Homo sapiens
taagaattcaaact

SEQ ID NO: 1307500 - DNA, 16 bp, Homo sapiens
taagacatgatttcct

SEQ ID NO: 1307501 - DNA, 21 bp, Homo sapiens
taagaggacataatggggtcc

SEQ ID NO: 1307502 - DNA, 15 bp, Homo sapiens
taagcagaggagggg

SEQ ID NO: 1307503 - DNA, 16 bp, Homo sapiens
taagcagaggaggggc

SEQ ID NO: 1307504 - DNA, 20 bp, Homo sapiens
taaggtgatatatttaaaaa

SEQ ID NO: 1307505 - DNA, 19 bp, Homo sapiens
taagtggaggcactttagg

SEQ ID NO: 1307506 - DNA, 13 bp, Homo sapiens
taagtgtattttt

SEQ ID NO: 1307507 - DNA, 21 bp, Homo sapiens
taatataaaaagcttccatga

SEQ ID NO: 1307508 - DNA, 16 bp, Homo sapiens
taatatgaaaacttat

SEQ ID NO: 1307509 - DNA, 17 bp, Homo sapiens
taatccaggcagatcca

SEQ ID NO: 1307510 - DNA, 20 bp, Homo sapiens
taatcttgctctgcttgaca

SEQ ID NO: 1307511 - DNA, 14 bp, Homo sapiens
taatgcttttatat

SEQ ID NO: 1307512 - DNA, 15 bp, Homo sapiens
taatggggtcctggc

SEQ ID NO: 1307513 - DNA, 17 bp, Homo sapiens
taatggggtcctggcca

SEQ ID NO: 1307514 - DNA, 22 bp, Homo sapiens
taatggggtcctggccatccca

SEQ ID NO: 1307515 - DNA, 11 bp, Homo sapiens
taatgtctctg

SEQ ID NO: 1307516 - DNA, 19 bp, Homo sapiens
taattcatcccaactgtct

SEQ ID NO: 1307517 - DNA, 15 bp, Homo sapiens
taattccacaccttt

SEQ ID NO: 1307518 - DNA, 17 bp, Homo sapiens
taattgtttgtctttaa

SEQ ID NO: 1307519 - DNA, 12 bp, Homo sapiens
taatttcaaaat

SEQ ID NO: 1307520 - DNA, 16 bp, Homo sapiens
tacaaacaaaatttct

SEQ ID NO: 1307521 - DNA, 14 bp, Homo sapiens
tacaaattagaaaa

SEQ ID NO: 1307522 - DNA, 14 bp, Homo sapiens
tacaatgtgaactt

SEQ ID NO: 1307523 - DNA, 17 bp, Homo sapiens
tacaatgtgaactttat

SEQ ID NO: 1307524 - DNA, 20 bp, Homo sapiens
tacaatgtgaactttattaa

SEQ ID NO: 1307525 - DNA, 22 bp, Homo sapiens
tacaatgtgaactttattaaat

SEQ ID NO: 1307526 - DNA, 18 bp, Homo sapiens
tacaattaaaaaaaaaga

SEQ ID NO: 1307527 - DNA, 14 bp, Homo sapiens
tacatacaccagca

SEQ ID NO: 1307528 - DNA, 16 bp, Homo sapiens
tacatacaccagcatt

SEQ ID NO: 1307529 - DNA, 19 bp, Homo sapiens
tacatccaaagcagacagc

SEQ ID NO: 1307530 - DNA, 20 bp, Homo sapiens
tacatccaaagcagacagct

SEQ ID NO: 1307531 - DNA, 23 bp, Homo sapiens
tacatccaaagcagacagctcca

SEQ ID NO: 1307532 - DNA, 14 bp, Homo sapiens
tacattgttcaatt

SEQ ID NO: 1307533 - DNA, 13 bp, Homo sapiens
tacattgttgagc

SEQ ID NO: 1307534 - DNA, 23 bp, Homo sapiens
tacattgtttgtctgtcttcata

SEQ ID NO: 1307535 - DNA, 23 bp, Homo sapiens
taccattcagtgattactgtcaa

SEQ ID NO: 1307536 - DNA, 15 bp, Homo sapiens
taccatttatacaaa

SEQ ID NO: 1307537 - DNA, 13 bp, Homo sapiens
taccccctccttc

SEQ ID NO: 1307538 - DNA, 22 bp, Homo sapiens
tacctgttttgtggtcagctgt

SEQ ID NO: 1307539 - DNA, 13 bp, Homo sapiens
tactaggtaactt

SEQ ID NO: 1307540 - DNA, 13 bp, Homo sapiens
tactctttctgta

SEQ ID NO: 1307541 - DNA, 14 bp, Homo sapiens
tactgcaagaaaat

SEQ ID NO: 1307542 - DNA, 15 bp, Homo sapiens
tactgcaagaaaatg

SEQ ID NO: 1307543 - DNA, 18 bp, Homo sapiens
tactggcaaaaggatctt

SEQ ID NO: 1307544 - DNA, 14 bp, Homo sapiens
tactgtaattttat

SEQ ID NO: 1307545 - DNA, 17 bp, Homo sapiens
tactgtgtgtgtgaatg

SEQ ID NO: 1307546 - DNA, 19 bp, Homo sapiens
tactgtgtgtgtgaatgaa

SEQ ID NO: 1307547 - DNA, 22 bp, Homo sapiens
tactgtgtgtgtgaatgaacac

SEQ ID NO: 1307548 - DNA, 23 bp, Homo sapiens
tactgtgtgtgtgaatgaacact

SEQ ID NO: 1307549 - DNA, 14 bp, Homo sapiens
tacttcttgaaggt

SEQ ID NO: 1307550 - DNA, 11 bp, Homo sapiens
tacttgaaggg

SEQ ID NO: 1307551 - DNA, 21 bp, Homo sapiens
tacttgaagggccagagccag

SEQ ID NO: 1307552 - DNA, 20 bp, Homo sapiens
tagaaataaaggatgtgatt

SEQ ID NO: 1307553 - DNA, 19 bp, Homo sapiens
tagaactttaagcaacaag

SEQ ID NO: 1307554 - DNA, 12 bp, Homo sapiens
tagaatatttat

SEQ ID NO: 1307555 - DNA, 23 bp, Homo sapiens
tagaatttattcaattcctctgg

SEQ ID NO: 1307556 - DNA, 21 bp, Homo sapiens
tagacactccccgaagtcttt

SEQ ID NO: 1307557 - DNA, 14 bp, Homo sapiens
tagatgctggccca

SEQ ID NO: 1307558 - DNA, 16 bp, Homo sapiens
tagatgctggcccagg

SEQ ID NO: 1307559 - DNA, 18 bp, Homo sapiens
tagatgctggcccagggc

SEQ ID NO: 1307560 - DNA, 21 bp, Homo sapiens
tagatgctggcccagggccca

SEQ ID NO: 1307561 - DNA, 22 bp, Homo sapiens
tagatgctggcccagggcccag

SEQ ID NO: 1307562 - DNA, 14 bp, Homo sapiens
tagatggtgctgag

SEQ ID NO: 1307563 - DNA, 16 bp, Homo sapiens
tagatggtgctgagaa

SEQ ID NO: 1307564 - DNA, 18 bp, Homo sapiens
tagatgttccagtaatct

SEQ ID NO: 1307565 - DNA, 19 bp, Homo sapiens
tagcagcaccgttctgtgc

SEQ ID NO: 1307566 - DNA, 19 bp, Homo sapiens
tagccagcacacagggcag

SEQ ID NO: 1307567 - DNA, 21 bp, Homo sapiens
tagctccccgcttctgcctgc

SEQ ID NO: 1307568 - DNA, 16 bp, Homo sapiens
tagctgttgagctgtt

SEQ ID NO: 1307569 - DNA, 17 bp, Homo sapiens
tagctgttgagctgttt

SEQ ID NO: 1307570 - DNA, 15 bp, Homo sapiens
taggaagagaaacca

SEQ ID NO: 1307571 - DNA, 19 bp, Homo sapiens
taggaagagaaaccaggga

SEQ ID NO: 1307572 - DNA, 16 bp, Homo sapiens
taggcctcagccagag

SEQ ID NO: 1307573 - DNA, 22 bp, Homo sapiens
taggcctcagccagagaagcta

SEQ ID NO: 1307574 - DNA, 23 bp, Homo sapiens
taggccttcctctctccagatgt

SEQ ID NO: 1307575 - DNA, 15 bp, Homo sapiens
taggctggtggccca

SEQ ID NO: 1307576 - DNA, 19 bp, Homo sapiens
taggctggtggcccaggac

SEQ ID NO: 1307577 - DNA, 23 bp, Homo sapiens
tagggatcaaccagctaagaaaa

SEQ ID NO: 1307578 - DNA, 11 bp, Homo sapiens
taggtattttg

SEQ ID NO: 1307579 - DNA, 18 bp, Homo sapiens
tagtaacttcttatggaa

SEQ ID NO: 1307580 - DNA, 19 bp, Homo sapiens
tagtaccatttatacaaat

SEQ ID NO: 1307581 - DNA, 14 bp, Homo sapiens
tagtcaagctcctc

SEQ ID NO: 1307582 - DNA, 22 bp, Homo sapiens
tagtccgtgctgacagctgctc

SEQ ID NO: 1307583 - DNA, 23 bp, Homo sapiens
tagtccgtgctgacagctgctcc

SEQ ID NO: 1307584 - DNA, 20 bp, Homo sapiens
tagtctagatggctcctctc

SEQ ID NO: 1307585 - DNA, 19 bp, Homo sapiens
tagttaagacatgatttcc

SEQ ID NO: 1307586 - DNA, 21 bp, Homo sapiens
tataaattcctctttgctttg

SEQ ID NO: 1307587 - DNA, 16 bp, Homo sapiens
tatacaaattagaaaa

SEQ ID NO: 1307588 - DNA, 15 bp, Homo sapiens
tatacatatctttat

SEQ ID NO: 1307589 - DNA, 12 bp, Homo sapiens
tatatgtacatg

SEQ ID NO: 1307590 - DNA, 19 bp, Homo sapiens
tatattgtgtttgtgtatt

SEQ ID NO: 1307591 - DNA, 22 bp, Homo sapiens
tatatttgtgatagcactttct

SEQ ID NO: 1307592 - DNA, 20 bp, Homo sapiens
tatcagtcaatatttttaga

SEQ ID NO: 1307593 - DNA, 17 bp, Homo sapiens
tatccatattgagtcaa

SEQ ID NO: 1307594 - DNA, 14 bp, Homo sapiens
tatccattctttct

SEQ ID NO: 1307595 - DNA, 16 bp, Homo sapiens
tatccattctttctga

SEQ ID NO: 1307596 - DNA, 22 bp, Homo sapiens
tatcctgggggacccaatgtag

SEQ ID NO: 1307597 - DNA, 13 bp, Homo sapiens
tatctactctcct

SEQ ID NO: 1307598 - DNA, 14 bp, Homo sapiens
tatctttattaatc

SEQ ID NO: 1307599 - DNA, 15 bp, Homo sapiens
tatctttattaatca

SEQ ID NO: 1307600 - DNA, 18 bp, Homo sapiens
tatctttgattctccttc

SEQ ID NO: 1307601 - DNA, 15 bp, Homo sapiens
tatgaaaacttatga

SEQ ID NO: 1307602 - DNA, 18 bp, Homo sapiens
tatgcatggtgccccagg

SEQ ID NO: 1307603 - DNA, 18 bp, Homo sapiens
tatggaattgatttgcat

SEQ ID NO: 1307604 - DNA, 19 bp, Homo sapiens
tatggaattgatttgcatt

SEQ ID NO: 1307605 - DNA, 15 bp, Homo sapiens
tatgttgaatacttt

SEQ ID NO: 1307606 - DNA, 17 bp, Homo sapiens
tatgttttttaaaatat

SEQ ID NO: 1307607 - DNA, 12 bp, Homo sapiens
tattaaagacag

SEQ ID NO: 1307608 - DNA, 18 bp, Homo sapiens
tattaaatacaaaacttc

SEQ ID NO: 1307609 - DNA, 19 bp, Homo sapiens
tattaaatacaaaacttcc

SEQ ID NO: 1307610 - DNA, 13 bp, Homo sapiens
tattaattgcttt

SEQ ID NO: 1307611 - DNA, 13 bp, Homo sapiens
tattacctctgat

SEQ ID NO: 1307612 - DNA, 16 bp, Homo sapiens
tattagggagaaaatt

SEQ ID NO: 1307613 - DNA, 21 bp, Homo sapiens
tattagggagaaaattcaatt

SEQ ID NO: 1307614 - DNA, 16 bp, Homo sapiens
tattattttcacctgt

SEQ ID NO: 1307615 - DNA, 18 bp, Homo sapiens
tattctctccaaaaatgc

SEQ ID NO: 1307616 - DNA, 13 bp, Homo sapiens
tattgacacagaa

SEQ ID NO: 1307617 - DNA, 16 bp, Homo sapiens
tattgacacagaaaat

SEQ ID NO: 1307618 - DNA, 20 bp, Homo sapiens
tattgacacagaaaatgttg

SEQ ID NO: 1307619 - DNA, 22 bp, Homo sapiens
tattgcatttggattggggtcc

SEQ ID NO: 1307620 - DNA, 23 bp, Homo sapiens
tattgttccagcagttttcaagt

SEQ ID NO: 1307621 - DNA, 15 bp, Homo sapiens
tatttacgctttgat

SEQ ID NO: 1307622 - DNA, 14 bp, Homo sapiens
tatttactgagctt

SEQ ID NO: 1307623 - DNA, 19 bp, Homo sapiens
tatttactgagcttctctg

SEQ ID NO: 1307624 - DNA, 21 bp, Homo sapiens
tatttactgagcttctctgtg

SEQ ID NO: 1307625 - DNA, 23 bp, Homo sapiens
tatttactgagcttctctgtgaa

SEQ ID NO: 1307626 - DNA, 15 bp, Homo sapiens
tatttataaaacttc

SEQ ID NO: 1307627 - DNA, 16 bp, Homo sapiens
tatttatctgattaag

SEQ ID NO: 1307628 - DNA, 13 bp, Homo sapiens
tatttattacctc

SEQ ID NO: 1307629 - DNA, 14 bp, Homo sapiens
tatttattatttat

SEQ ID NO: 1307630 - DNA, 11 bp, Homo sapiens
tatttatttac

SEQ ID NO: 1307631 - DNA, 17 bp, Homo sapiens
tatttctgcatatgttg

SEQ ID NO: 1307632 - DNA, 20 bp, Homo sapiens
tatttttcaataaagcattt

SEQ ID NO: 1307633 - DNA, 16 bp, Homo sapiens
tcaaaactacaaatca

SEQ ID NO: 1307634 - DNA, 21 bp, Homo sapiens
tcaaagaggctgaggctggca

SEQ ID NO: 1307635 - DNA, 19 bp, Homo sapiens
tcaaatggggccagatcca

SEQ ID NO: 1307636 - DNA, 20 bp, Homo sapiens
tcaaatggggccagatccag

SEQ ID NO: 1307637 - DNA, 20 bp, Homo sapiens
tcaaatggtaggcatttcct

SEQ ID NO: 1307638 - DNA, 12 bp, Homo sapiens
tcaaattaataa

SEQ ID NO: 1307639 - DNA, 12 bp, Homo sapiens
tcaacatctttt

SEQ ID NO: 1307640 - DNA, 20 bp, Homo sapiens
tcaactgccaaaatgctcta

SEQ ID NO: 1307641 - DNA, 21 bp, Homo sapiens
tcaagaaataaaaggaagcca

SEQ ID NO: 1307642 - DNA, 15 bp, Homo sapiens
tcaagctcctcctcc

SEQ ID NO: 1307643 - DNA, 17 bp, Homo sapiens
tcaaggctgcttagaat

SEQ ID NO: 1307644 - DNA, 18 bp, Homo sapiens
tcaaggctgcttagaatc

SEQ ID NO: 1307645 - DNA, 15 bp, Homo sapiens
tcaagtcaaattaat

SEQ ID NO: 1307646 - DNA, 12 bp, Homo sapiens
tcaataaagcat

SEQ ID NO: 1307647 - DNA, 15 bp, Homo sapiens
tcaataaagcattta

SEQ ID NO: 1307648 - DNA, 19 bp, Homo sapiens
tcaataaagcatttataaa

SEQ ID NO: 1307649 - DNA, 10 bp, Homo sapiens
tcaatattta

SEQ ID NO: 1307650 - DNA, 12 bp, Homo sapiens
tcaatatttatt

SEQ ID NO: 1307651 - DNA, 12 bp, Homo sapiens
tcacaaagccca

SEQ ID NO: 1307652 - DNA, 16 bp, Homo sapiens
tcacaacctgaaccta

SEQ ID NO: 1307653 - DNA, 19 bp, Homo sapiens
tcacactgagaatgtaaga

SEQ ID NO: 1307654 - DNA, 16 bp, Homo sapiens
tcacagccacccctga

SEQ ID NO: 1307655 - DNA, 19 bp, Homo sapiens
tcacagttctttgggccag

SEQ ID NO: 1307656 - DNA, 20 bp, Homo sapiens
tcacccctccctttctcccc

SEQ ID NO: 1307657 - DNA, 21 bp, Homo sapiens
tcacctgtttttaagctgttt

SEQ ID NO: 1307658 - DNA, 18 bp, Homo sapiens
tcactcattgctgagcct

SEQ ID NO: 1307659 - DNA, 22 bp, Homo sapiens
tcactcattgctgagcctctgc

SEQ ID NO: 1307660 - DNA, 17 bp, Homo sapiens
tcactgtctttcctaga

SEQ ID NO: 1307661 - DNA, 15 bp, Homo sapiens
tcagacaccctcaac

SEQ ID NO: 1307662 - DNA, 19 bp, Homo sapiens
tcagactcccattcctgaa

SEQ ID NO: 1307663 - DNA, 15 bp, Homo sapiens
tcagatttccagtct

SEQ ID NO: 1307664 - DNA, 13 bp, Homo sapiens
tcagcacaaggcc

SEQ ID NO: 1307665 - DNA, 23 bp, Homo sapiens
tcagccagcacttgtccagctga

SEQ ID NO: 1307666 - DNA, 16 bp, Homo sapiens
tcagccctgaccctgt

SEQ ID NO: 1307667 - DNA, 18 bp, Homo sapiens
tcagcctggccagacaca

SEQ ID NO: 1307668 - DNA, 20 bp, Homo sapiens
tcagcctggccagacacagg

SEQ ID NO: 1307669 - DNA, 16 bp, Homo sapiens
tcagccttgccagaga

SEQ ID NO: 1307670 - DNA, 17 bp, Homo sapiens
tcagccttgccagagat

SEQ ID NO: 1307671 - DNA, 15 bp, Homo sapiens
tcaggacagatgcca

SEQ ID NO: 1307672 - DNA, 12 bp, Homo sapiens
tcaggagttcct

SEQ ID NO: 1307673 - DNA, 11 bp, Homo sapiens
tcaggtggcca

SEQ ID NO: 1307674 - DNA, 15 bp, Homo sapiens
tcagtataaacaaag

SEQ ID NO: 1307675 - DNA, 15 bp, Homo sapiens
tcatagtaacttctt

SEQ ID NO: 1307676 - DNA, 16 bp, Homo sapiens
tcatagtaacttctta

SEQ ID NO: 1307677 - DNA, 12 bp, Homo sapiens
tcatctcccacc

SEQ ID NO: 1307678 - DNA, 14 bp, Homo sapiens
tcatctcttagctc

SEQ ID NO: 1307679 - DNA, 14 bp, Homo sapiens
tcatctgctctcct

SEQ ID NO: 1307680 - DNA, 16 bp, Homo sapiens
tcatctgctctccttc

SEQ ID NO: 1307681 - DNA, 17 bp, Homo sapiens
tcatctgctctccttcc

SEQ ID NO: 1307682 - DNA, 18 bp, Homo sapiens
tcatctgctctccttcct

SEQ ID NO: 1307683 - DNA, 22 bp, Homo sapiens
tcatctttcttgatcaacatct

SEQ ID NO: 1307684 - DNA, 16 bp, Homo sapiens
tcatggtctcagtcat

SEQ ID NO: 1307685 - DNA, 13 bp, Homo sapiens
tcattaattctat

SEQ ID NO: 1307686 - DNA, 14 bp, Homo sapiens
tcattaattctata

SEQ ID NO: 1307687 - DNA, 15 bp, Homo sapiens
tcattgctgagcctc

SEQ ID NO: 1307688 - DNA, 18 bp, Homo sapiens
tcatttggttcattaatt

SEQ ID NO: 1307689 - DNA, 21 bp, Homo sapiens
tccaaaagaagcccccagcta

SEQ ID NO: 1307690 - DNA, 20 bp, Homo sapiens
tccaaatggcgtctggaagt

SEQ ID NO: 1307691 - DNA, 17 bp, Homo sapiens
tccaacaccaagcacag

SEQ ID NO: 1307692 - DNA, 21 bp, Homo sapiens
tccaaccccccagcactgagg

SEQ ID NO: 1307693 - DNA, 22 bp, Homo sapiens
tccaaccccccagcactgagga

SEQ ID NO: 1307694 - DNA, 14 bp, Homo sapiens
tccaaccttcccaa

SEQ ID NO: 1307695 - DNA, 22 bp, Homo sapiens
tccaagctgggagattcaaggg

SEQ ID NO: 1307696 - DNA, 18 bp, Homo sapiens
tccaatgtggcaaggaaa

SEQ ID NO: 1307697 - DNA, 17 bp, Homo sapiens
tccacagcaaccccagg

SEQ ID NO: 1307698 - DNA, 20 bp, Homo sapiens
tccacagcaaccccaggctg

SEQ ID NO: 1307699 - DNA, 13 bp, Homo sapiens
tccactctccccc

SEQ ID NO: 1307700 - DNA, 14 bp, Homo sapiens
tccactctccccca

SEQ ID NO: 1307701 - DNA, 13 bp, Homo sapiens
tccagaatgctgt

SEQ ID NO: 1307702 - DNA, 16 bp, Homo sapiens
tccagatgcagggcag

SEQ ID NO: 1307703 - DNA, 14 bp, Homo sapiens
tccagcagttttca

SEQ ID NO: 1307704 - DNA, 12 bp, Homo sapiens
tccagcctgggt

SEQ ID NO: 1307705 - DNA, 12 bp, Homo sapiens
tccagctccaac

SEQ ID NO: 1307706 - DNA, 19 bp, Homo sapiens
tccagctccaacctgcaaa

SEQ ID NO: 1307707 - DNA, 18 bp, Homo sapiens
tccagctctttcctcctt

SEQ ID NO: 1307708 - DNA, 15 bp, Homo sapiens
tccaggcagatccag

SEQ ID NO: 1307709 - DNA, 19 bp, Homo sapiens
tccagggacagaggcccca

SEQ ID NO: 1307710 - DNA, 18 bp, Homo sapiens
tccaggtgttactgtaat

SEQ ID NO: 1307711 - DNA, 15 bp, Homo sapiens
tccagtctccaccag

SEQ ID NO: 1307712 - DNA, 21 bp, Homo sapiens
tcccaaagtgctgggattaca

SEQ ID NO: 1307713 - DNA, 15 bp, Homo sapiens
tcccaactctagctg

SEQ ID NO: 1307714 - DNA, 17 bp, Homo sapiens
tcccaactctagctggg

SEQ ID NO: 1307715 - DNA, 16 bp, Homo sapiens
tcccaagctcagaggc

SEQ ID NO: 1307716 - DNA, 20 bp, Homo sapiens
tcccaagtagctgggattac

SEQ ID NO: 1307717 - DNA, 16 bp, Homo sapiens
tcccacaagtggtggt

SEQ ID NO: 1307718 - DNA, 16 bp, Homo sapiens
tcccacctagcagcac

SEQ ID NO: 1307719 - DNA, 19 bp, Homo sapiens
tcccagcactttgggaggc

SEQ ID NO: 1307720 - DNA, 16 bp, Homo sapiens
tcccagctacttggga

SEQ ID NO: 1307721 - DNA, 19 bp, Homo sapiens
tcccaggaccctgaagggg

SEQ ID NO: 1307722 - DNA, 14 bp, Homo sapiens
tcccatccagggcc

SEQ ID NO: 1307723 - DNA, 13 bp, Homo sapiens
tcccatgtagccc

SEQ ID NO: 1307724 - DNA, 15 bp, Homo sapiens
tcccatgtagccccc

SEQ ID NO: 1307725 - DNA, 21 bp, Homo sapiens
tcccattgtccctctgcccca

SEQ ID NO: 1307726 - DNA, 11 bp, Homo sapiens
tccccagagaa

SEQ ID NO: 1307727 - DNA, 13 bp, Homo sapiens
tccccagcccaga

SEQ ID NO: 1307728 - DNA, 15 bp, Homo sapiens
tccccagcccagaga

SEQ ID NO: 1307729 - DNA, 19 bp, Homo sapiens
tccccatcttctaaaccca

SEQ ID NO: 1307730 - DNA, 15 bp, Homo sapiens
tccccatggagccag

SEQ ID NO: 1307731 - DNA, 19 bp, Homo sapiens
tcccccaccccctccccgc

SEQ ID NO: 1307732 - DNA, 19 bp, Homo sapiens
tccccgcagtgtgcactaa

SEQ ID NO: 1307733 - DNA, 22 bp, Homo sapiens
tccccgcagtgtgcactaaggg

SEQ ID NO: 1307734 - DNA, 13 bp, Homo sapiens
tccccgccctttt

SEQ ID NO: 1307735 - DNA, 22 bp, Homo sapiens
tcccctccaacctggggggcag

SEQ ID NO: 1307736 - DNA, 13 bp, Homo sapiens
tcccctgccccca

SEQ ID NO: 1307737 - DNA, 15 bp, Homo sapiens
tcccctgcccccagg

SEQ ID NO: 1307738 - DNA, 17 bp, Homo sapiens
tcccctgcccccaggac

SEQ ID NO: 1307739 - DNA, 13 bp, Homo sapiens
tccccttctctca

SEQ ID NO: 1307740 - DNA, 18 bp, Homo sapiens
tccccttctctcatctct

SEQ ID NO: 1307741 - DNA, 20 bp, Homo sapiens
tccctcaccttggcaccaga

SEQ ID NO: 1307742 - DNA, 22 bp, Homo sapiens
tccctcaccttggcaccagaca

SEQ ID NO: 1307743 - DNA, 16 bp, Homo sapiens
tccctcccccccatgc

SEQ ID NO: 1307744 - DNA, 14 bp, Homo sapiens
tccctctaatttat

SEQ ID NO: 1307745 - DNA, 17 bp, Homo sapiens
tccctgaccctgtatat

SEQ ID NO: 1307746 - DNA, 16 bp, Homo sapiens
tccctgacctccctct

SEQ ID NO: 1307747 - DNA, 17 bp, Homo sapiens
tccctgacctccctcta

SEQ ID NO: 1307748 - DNA, 18 bp, Homo sapiens
tccctgcatctgaccagc

SEQ ID NO: 1307749 - DNA, 15 bp, Homo sapiens
tccctgttccccaga

SEQ ID NO: 1307750 - DNA, 16 bp, Homo sapiens
tccctgttccccagag

SEQ ID NO: 1307751 - DNA, 14 bp, Homo sapiens
tccctttctcccct

SEQ ID NO: 1307752 - DNA, 21 bp, Homo sapiens
tccgtgctgacagctgctcct

SEQ ID NO: 1307753 - DNA, 17 bp, Homo sapiens
tcctaaaacacctggta

SEQ ID NO: 1307754 - DNA, 14 bp, Homo sapiens
tcctaagcctaaaa

SEQ ID NO: 1307755 - DNA, 17 bp, Homo sapiens
tcctagagggaggggcc

SEQ ID NO: 1307756 - DNA, 22 bp, Homo sapiens
tcctagatggcagtcactgaat

SEQ ID NO: 1307757 - DNA, 11 bp, Homo sapiens
tcctcagcctt

SEQ ID NO: 1307758 - DNA, 18 bp, Homo sapiens
tcctcagccttgccagag

SEQ ID NO: 1307759 - DNA, 16 bp, Homo sapiens
tcctcaggtggccatg

SEQ ID NO: 1307760 - DNA, 18 bp, Homo sapiens
tcctcaggtggccatgcc

SEQ ID NO: 1307761 - DNA, 16 bp, Homo sapiens
tcctccactctccccc

SEQ ID NO: 1307762 - DNA, 19 bp, Homo sapiens
tcctccactctcccccacc

SEQ ID NO: 1307763 - DNA, 20 bp, Homo sapiens
tcctcccaatttcagactcc

SEQ ID NO: 1307764 - DNA, 10 bp, Homo sapiens
tcctcccttc

SEQ ID NO: 1307765 - DNA, 17 bp, Homo sapiens
tcctcccttctgctact

SEQ ID NO: 1307766 - DNA, 14 bp, Homo sapiens
tcctcctccctgca

SEQ ID NO: 1307767 - DNA, 16 bp, Homo sapiens
tcctctccccagccca

SEQ ID NO: 1307768 - DNA, 20 bp, Homo sapiens
tcctctccccagcccagaga

SEQ ID NO: 1307769 - DNA, 14 bp, Homo sapiens
tcctctctccagat

SEQ ID NO: 1307770 - DNA, 14 bp, Homo sapiens
tcctgaagaaccag

SEQ ID NO: 1307771 - DNA, 23 bp, Homo sapiens
tcctgaagaaccagtccccccac

SEQ ID NO: 1307772 - DNA, 16 bp, Homo sapiens
tcctgaggctttggat

SEQ ID NO: 1307773 - DNA, 17 bp, Homo sapiens
tcctgaggctttggatt

SEQ ID NO: 1307774 - DNA, 18 bp, Homo sapiens
tcctggagcccagaggag

SEQ ID NO: 1307775 - DNA, 14 bp, Homo sapiens
tcctggaggcccag

SEQ ID NO: 1307776 - DNA, 16 bp, Homo sapiens
tcctgtccagctccaa

SEQ ID NO: 1307777 - DNA, 17 bp, Homo sapiens
tcctgtccagctccaac

SEQ ID NO: 1307778 - DNA, 19 bp, Homo sapiens
tcctgtgtgattgacagct

SEQ ID NO: 1307779 - DNA, 15 bp, Homo sapiens
tccttagaacatttt

SEQ ID NO: 1307780 - DNA, 19 bp, Homo sapiens
tccttcagccctcacccct

SEQ ID NO: 1307781 - DNA, 21 bp, Homo sapiens
tccttccagtgtccttagaac

SEQ ID NO: 1307782 - DNA, 14 bp, Homo sapiens
tccttcctgttctg

SEQ ID NO: 1307783 - DNA, 16 bp, Homo sapiens
tccttcctgttctgaa

SEQ ID NO: 1307784 - DNA, 19 bp, Homo sapiens
tccttcctgttctgaactg

SEQ ID NO: 1307785 - DNA, 17 bp, Homo sapiens
tccttgagacacggagc

SEQ ID NO: 1307786 - DNA, 18 bp, Homo sapiens
tcgaaccgttttgaagct

SEQ ID NO: 1307787 - DNA, 14 bp, Homo sapiens
tcgagaactttcat

SEQ ID NO: 1307788 - DNA, 20 bp, Homo sapiens
tcgcatggtcacacactgat

SEQ ID NO: 1307789 - DNA, 20 bp, Homo sapiens
tcgccccagcaggtgctgac

SEQ ID NO: 1307790 - DNA, 19 bp, Homo sapiens
tcggaacccaagcttagaa

SEQ ID NO: 1307791 - DNA, 22 bp, Homo sapiens
tcggaactgcatgctgctggac

SEQ ID NO: 1307792 - DNA, 20 bp, Homo sapiens
tcggatctggggctctggga

SEQ ID NO: 1307793 - DNA, 16 bp, Homo sapiens
tcggatttggggtgga

SEQ ID NO: 1307794 - DNA, 12 bp, Homo sapiens
tcgggctgtgcc

SEQ ID NO: 1307795 - DNA, 17 bp, Homo sapiens
tctaaacttccccatct

SEQ ID NO: 1307796 - DNA, 23 bp, Homo sapiens
tctaaatgggaaagtattctgta

SEQ ID NO: 1307797 - DNA, 14 bp, Homo sapiens
tctaatatggccac

SEQ ID NO: 1307798 - DNA, 22 bp, Homo sapiens
tctaatttatcttgtctctggg

SEQ ID NO: 1307799 - DNA, 23 bp, Homo sapiens
tctaatttatcttgtctctgggc

SEQ ID NO: 1307800 - DNA, 17 bp, Homo sapiens
tctacaatgtgaacttt

SEQ ID NO: 1307801 - DNA, 19 bp, Homo sapiens
tctacaatgtgaactttat

SEQ ID NO: 1307802 - DNA, 21 bp, Homo sapiens
tctagatgaagttttacattg

SEQ ID NO: 1307803 - DNA, 13 bp, Homo sapiens
tctatagactcta

SEQ ID NO: 1307804 - DNA, 17 bp, Homo sapiens
tctcatctcttagctcc

SEQ ID NO: 1307805 - DNA, 19 bp, Homo sapiens
tctccaaccccccagcact

SEQ ID NO: 1307806 - DNA, 21 bp, Homo sapiens
tctccaaccccccagcactga

SEQ ID NO: 1307807 - DNA, 18 bp, Homo sapiens
tctccaccaggaacctct

SEQ ID NO: 1307808 - DNA, 19 bp, Homo sapiens
tctccagatgtttccagac

SEQ ID NO: 1307809 - DNA, 14 bp, Homo sapiens
tctccccagcccag

SEQ ID NO: 1307810 - DNA, 17 bp, Homo sapiens
tctccccagcccagaga

SEQ ID NO: 1307811 - DNA, 18 bp, Homo sapiens
tctccccagcccagagac

SEQ ID NO: 1307812 - DNA, 14 bp, Homo sapiens
tctcctcatctcta

SEQ ID NO: 1307813 - DNA, 21 bp, Homo sapiens
tctcctcttgtaaataaagcc

SEQ ID NO: 1307814 - DNA, 13 bp, Homo sapiens
tctccttcctgtg

SEQ ID NO: 1307815 - DNA, 19 bp, Homo sapiens
tctctcatctcttagctcc

SEQ ID NO: 1307816 - DNA, 14 bp, Homo sapiens
tctctctgcccaac

SEQ ID NO: 1307817 - DNA, 18 bp, Homo sapiens
tctctgcttgagtcaggt

SEQ ID NO: 1307818 - DNA, 19 bp, Homo sapiens
tctctgcttgagtcaggtt

SEQ ID NO: 1307819 - DNA, 17 bp, Homo sapiens
tctcttatagaatattt

SEQ ID NO: 1307820 - DNA, 20 bp, Homo sapiens
tctcttatagaatatttatt

SEQ ID NO: 1307821 - DNA, 18 bp, Homo sapiens
tctgacatgattccttcc

SEQ ID NO: 1307822 - DNA, 20 bp, Homo sapiens
tctgagtgaacctgtataag

SEQ ID NO: 1307823 - DNA, 15 bp, Homo sapiens
tctgcagtaaatctt

SEQ ID NO: 1307824 - DNA, 16 bp, Homo sapiens
tctgcagtaaatcttt

SEQ ID NO: 1307825 - DNA, 16 bp, Homo sapiens
tctgcatatgttgaat

SEQ ID NO: 1307826 - DNA, 18 bp, Homo sapiens
tctgccccatcctccagc

SEQ ID NO: 1307827 - DNA, 19 bp, Homo sapiens
tctgccccatcctccagca

SEQ ID NO: 1307828 - DNA, 21 bp, Homo sapiens
tctgccccatcctccagcagg

SEQ ID NO: 1307829 - DNA, 15 bp, Homo sapiens
tctgctcagcttctc

SEQ ID NO: 1307830 - DNA, 15 bp, Homo sapiens
tctgctctccttcct

SEQ ID NO: 1307831 - DNA, 18 bp, Homo sapiens
tctgcttgacaacatctg

SEQ ID NO: 1307832 - DNA, 14 bp, Homo sapiens
tctggaacccagac

SEQ ID NO: 1307833 - DNA, 17 bp, Homo sapiens
tctggaacccagactca

SEQ ID NO: 1307834 - DNA, 18 bp, Homo sapiens
tctggaacccagactcag

SEQ ID NO: 1307835 - DNA, 23 bp, Homo sapiens
tctggaacccagactcagacatt

SEQ ID NO: 1307836 - DNA, 17 bp, Homo sapiens
tctggaacctcagcctg

SEQ ID NO: 1307837 - DNA, 19 bp, Homo sapiens
tctggaatctggagaccag

SEQ ID NO: 1307838 - DNA, 19 bp, Homo sapiens
tctggagaccagggagcct

SEQ ID NO: 1307839 - DNA, 19 bp, Homo sapiens
tctggagtggccactaagc

SEQ ID NO: 1307840 - DNA, 21 bp, Homo sapiens
tctggcagcctcccatccagg

SEQ ID NO: 1307841 - DNA, 14 bp, Homo sapiens
tctggtcctaccca

SEQ ID NO: 1307842 - DNA, 15 bp, Homo sapiens
tctgtccccttctct

SEQ ID NO: 1307843 - DNA, 12 bp, Homo sapiens
tctgtgtctgtg

SEQ ID NO: 1307844 - DNA, 15 bp, Homo sapiens
tctgtgtctgtgttt

SEQ ID NO: 1307845 - DNA, 16 bp, Homo sapiens
tctgttgcaagtgcaa

SEQ ID NO: 1307846 - DNA, 17 bp, Homo sapiens
tcttagctcccctccaa

SEQ ID NO: 1307847 - DNA, 20 bp, Homo sapiens
tcttatagaatatttattac

SEQ ID NO: 1307848 - DNA, 13 bp, Homo sapiens
tcttctaaacttc

SEQ ID NO: 1307849 - DNA, 18 bp, Homo sapiens
tcttctcatttcacccct

SEQ ID NO: 1307850 - DNA, 18 bp, Homo sapiens
tcttctggctcaaaaaga

SEQ ID NO: 1307851 - DNA, 14 bp, Homo sapiens
tcttgattatccat

SEQ ID NO: 1307852 - DNA, 16 bp, Homo sapiens
tcttgcctctgtcccc

SEQ ID NO: 1307853 - DNA, 22 bp, Homo sapiens
tcttgcctctgtccccttctct

SEQ ID NO: 1307854 - DNA, 14 bp, Homo sapiens
tcttgggaactgaa

SEQ ID NO: 1307855 - DNA, 16 bp, Homo sapiens
tcttgtattaaactct

SEQ ID NO: 1307856 - DNA, 14 bp, Homo sapiens
tcttgtctctgggc

SEQ ID NO: 1307857 - DNA, 16 bp, Homo sapiens
tctttaatgcttttat

SEQ ID NO: 1307858 - DNA, 23 bp, Homo sapiens
tctttcctaaggctgcaaggttt

SEQ ID NO: 1307859 - DNA, 14 bp, Homo sapiens
tctttcctccttcc

SEQ ID NO: 1307860 - DNA, 18 bp, Homo sapiens
tctttgctttgctttctg

SEQ ID NO: 1307861 - DNA, 16 bp, Homo sapiens
tctttgggccagacat

SEQ ID NO: 1307862 - DNA, 14 bp, Homo sapiens
tctttgtggccaag

SEQ ID NO: 1307863 - DNA, 22 bp, Homo sapiens
tctttgtggccaaggagctgct

SEQ ID NO: 1307864 - DNA, 15 bp, Homo sapiens
tgaaacaacttggaa

SEQ ID NO: 1307865 - DNA, 19 bp, Homo sapiens
tgaaataaaactggctttg

SEQ ID NO: 1307866 - DNA, 19 bp, Homo sapiens
tgaaattaagaaggcaaaa

SEQ ID NO: 1307867 - DNA, 17 bp, Homo sapiens
tgaacaaagcagccacg

SEQ ID NO: 1307868 - DNA, 19 bp, Homo sapiens
tgaacacaaactgtaaata

SEQ ID NO: 1307869 - DNA, 22 bp, Homo sapiens
tgaacctaggagtgccccattc

SEQ ID NO: 1307870 - DNA, 13 bp, Homo sapiens
tgaagaacatgtg

SEQ ID NO: 1307871 - DNA, 20 bp, Homo sapiens
tgaagaaccagtccccccac

SEQ ID NO: 1307872 - DNA, 23 bp, Homo sapiens
tgaagataagtgtatttttcaat

SEQ ID NO: 1307873 - DNA, 12 bp, Homo sapiens
tgaaggaccctt

SEQ ID NO: 1307874 - DNA, 12 bp, Homo sapiens
tgaagggccaga

SEQ ID NO: 1307875 - DNA, 14 bp, Homo sapiens
tgaagggccagagc

SEQ ID NO: 1307876 - DNA, 15 bp, Homo sapiens
tgaagggccagagcc

SEQ ID NO: 1307877 - DNA, 16 bp, Homo sapiens
tgaagggccagagcca

SEQ ID NO: 1307878 - DNA, 17 bp, Homo sapiens
tgaagggccagagccag

SEQ ID NO: 1307879 - DNA, 20 bp, Homo sapiens
tgaaggtgctgacggccagg

SEQ ID NO: 1307880 - DNA, 14 bp, Homo sapiens
tgaagttttacatt

SEQ ID NO: 1307881 - DNA, 16 bp, Homo sapiens
tgaagttttacattgt

SEQ ID NO: 1307882 - DNA, 17 bp, Homo sapiens
tgaagttttacattgtt

SEQ ID NO: 1307883 - DNA, 20 bp, Homo sapiens
tgaataaaaactttgctaaa

SEQ ID NO: 1307884 - DNA, 20 bp, Homo sapiens
tgaatcagtataaacaaagt

SEQ ID NO: 1307885 - DNA, 11 bp, Homo sapiens
tgaatgaacac

SEQ ID NO: 1307886 - DNA, 23 bp, Homo sapiens
tgaatgtatttatttgggagacc

SEQ ID NO: 1307887 - DNA, 18 bp, Homo sapiens
tgaatgtggcttgagaaa

SEQ ID NO: 1307888 - DNA, 20 bp, Homo sapiens
tgaattgaggggattaatat

SEQ ID NO: 1307889 - DNA, 19 bp, Homo sapiens
tgacacagaaaatgttgag

SEQ ID NO: 1307890 - DNA, 23 bp, Homo sapiens
tgacacagaaaatgttgagaatc

SEQ ID NO: 1307891 - DNA, 13 bp, Homo sapiens
tgacagctgctcc

SEQ ID NO: 1307892 - DNA, 23 bp, Homo sapiens
tgacagctgctcctagagggagg

SEQ ID NO: 1307893 - DNA, 15 bp, Homo sapiens
tgacagctttgctgc

SEQ ID NO: 1307894 - DNA, 16 bp, Homo sapiens
tgacagctttgctgct

SEQ ID NO: 1307895 - DNA, 21 bp, Homo sapiens
tgacagctttgctgctgaagg

SEQ ID NO: 1307896 - DNA, 15 bp, Homo sapiens
tgacatgattccttc

SEQ ID NO: 1307897 - DNA, 12 bp, Homo sapiens
tgacattcacct

SEQ ID NO: 1307898 - DNA, 14 bp, Homo sapiens
tgacatttctttgt

SEQ ID NO: 1307899 - DNA, 14 bp, Homo sapiens
tgaccaaagtcctt

SEQ ID NO: 1307900 - DNA, 15 bp, Homo sapiens
tgaccacagcacagc

SEQ ID NO: 1307901 - DNA, 16 bp, Homo sapiens
tgaccacagcacagcc

SEQ ID NO: 1307902 - DNA, 14 bp, Homo sapiens
tgaccagcagcgcc

SEQ ID NO: 1307903 - DNA, 16 bp, Homo sapiens
tgacccagtgccccca

SEQ ID NO: 1307904 - DNA, 17 bp, Homo sapiens
tgacccagtgcccccac

SEQ ID NO: 1307905 - DNA, 18 bp, Homo sapiens
tgaccctgtatatagccc

SEQ ID NO: 1307906 - DNA, 22 bp, Homo sapiens
tgacctccctctaatttatctt

SEQ ID NO: 1307907 - DNA, 20 bp, Homo sapiens
tgacctgtgagcccagctgg

SEQ ID NO: 1307908 - DNA, 21 bp, Homo sapiens
tgagaaatatggacacttaat

SEQ ID NO: 1307909 - DNA, 14 bp, Homo sapiens
tgagaagaaaacat

SEQ ID NO: 1307910 - DNA, 22 bp, Homo sapiens
tgagaatcccaaatttgattga

SEQ ID NO: 1307911 - DNA, 12 bp, Homo sapiens
tgagactcgaga

SEQ ID NO: 1307912 - DNA, 17 bp, Homo sapiens
tgagactcgagaacttt

SEQ ID NO: 1307913 - DNA, 14 bp, Homo sapiens
tgagaggtttgact

SEQ ID NO: 1307914 - DNA, 18 bp, Homo sapiens
tgagatttcatctgctct

SEQ ID NO: 1307915 - DNA, 19 bp, Homo sapiens
tgagatttcatctgctctc

SEQ ID NO: 1307916 - DNA, 21 bp, Homo sapiens
tgagcccagctgggtcaggca

SEQ ID NO: 1307917 - DNA, 22 bp, Homo sapiens
tgagcccctgtctagagaggga

SEQ ID NO: 1307918 - DNA, 12 bp, Homo sapiens
tgagcctctgct

SEQ ID NO: 1307919 - DNA, 14 bp, Homo sapiens
tgagcctctgctcc

SEQ ID NO: 1307920 - DNA, 16 bp, Homo sapiens
tgagcctctgctcccc

SEQ ID NO: 1307921 - DNA, 18 bp, Homo sapiens
tgagcctctgctccccag

SEQ ID NO: 1307922 - DNA, 12 bp, Homo sapiens
tgagcgccagga

SEQ ID NO: 1307923 - DNA, 21 bp, Homo sapiens
tgagctctcggaactgcatgc

SEQ ID NO: 1307924 - DNA, 17 bp, Homo sapiens
tgaggaagaacggggct

SEQ ID NO: 1307925 - DNA, 13 bp, Homo sapiens
tgaggccacactc

SEQ ID NO: 1307926 - DNA, 17 bp, Homo sapiens
tgagttggggtctggca

SEQ ID NO: 1307927 - DNA, 21 bp, Homo sapiens
tgataactagatggtgctgag

SEQ ID NO: 1307928 - DNA, 21 bp, Homo sapiens
tgatagacacatatgaggggg

SEQ ID NO: 1307929 - DNA, 12 bp, Homo sapiens
tgatagcacttt

SEQ ID NO: 1307930 - DNA, 14 bp, Homo sapiens
tgatagcactttct

SEQ ID NO: 1307931 - DNA, 15 bp, Homo sapiens
tgatcagatctgaca

SEQ ID NO: 1307932 - DNA, 16 bp, Homo sapiens
tgatcagatctgacat

SEQ ID NO: 1307933 - DNA, 16 bp, Homo sapiens
tgatcctggaggccca

SEQ ID NO: 1307934 - DNA, 20 bp, Homo sapiens
tgatcctggaggcccagttc

SEQ ID NO: 1307935 - DNA, 17 bp, Homo sapiens
tgatctggaacccagac

SEQ ID NO: 1307936 - DNA, 15 bp, Homo sapiens
tgatgctgcccctca

SEQ ID NO: 1307937 - DNA, 16 bp, Homo sapiens
tgattcatagtaactt

SEQ ID NO: 1307938 - DNA, 21 bp, Homo sapiens
tgattctatttatatgtacat

SEQ ID NO: 1307939 - DNA, 13 bp, Homo sapiens
tgattctccttca

SEQ ID NO: 1307940 - DNA, 19 bp, Homo sapiens
tgattctccttcagccctc

SEQ ID NO: 1307941 - DNA, 12 bp, Homo sapiens
tgattgacagct

SEQ ID NO: 1307942 - DNA, 19 bp, Homo sapiens
tgattgttcgggtgtgcaa

SEQ ID NO: 1307943 - DNA, 21 bp, Homo sapiens
tgatttaggagaagccaggaa

SEQ ID NO: 1307944 - DNA, 13 bp, Homo sapiens
tgatttccttgaa

SEQ ID NO: 1307945 - DNA, 16 bp, Homo sapiens
tgatttccttgaatgt

SEQ ID NO: 1307946 - DNA, 19 bp, Homo sapiens
tgatttccttgaatgtggc

SEQ ID NO: 1307947 - DNA, 17 bp, Homo sapiens
tgatttgaagaacatgt

SEQ ID NO: 1307948 - DNA, 19 bp, Homo sapiens
tgatttgaagaacatgtga

SEQ ID NO: 1307949 - DNA, 15 bp, Homo sapiens
tgatttgcattgaac

SEQ ID NO: 1307950 - DNA, 20 bp, Homo sapiens
tgatttggtgaccaactgtc

SEQ ID NO: 1307951 - DNA, 13 bp, Homo sapiens
tgcaaaggacaga

SEQ ID NO: 1307952 - DNA, 15 bp, Homo sapiens
tgcaaaggacagatc

SEQ ID NO: 1307953 - DNA, 14 bp, Homo sapiens
tgcaaatcttgaaa

SEQ ID NO: 1307954 - DNA, 18 bp, Homo sapiens
tgcaacctcttggcctga

SEQ ID NO: 1307955 - DNA, 14 bp, Homo sapiens
tgcaacttggactt

SEQ ID NO: 1307956 - DNA, 19 bp, Homo sapiens
tgcaataaatctgacccag

SEQ ID NO: 1307957 - DNA, 17 bp, Homo sapiens
tgcacccacccaggagt

SEQ ID NO: 1307958 - DNA, 15 bp, Homo sapiens
tgcactaaggggccc

SEQ ID NO: 1307959 - DNA, 14 bp, Homo sapiens
tgcactgatgctgc

SEQ ID NO: 1307960 - DNA, 18 bp, Homo sapiens
tgcactgtgaaggaccct

SEQ ID NO: 1307961 - DNA, 14 bp, Homo sapiens
tgcagcctgcgcca

SEQ ID NO: 1307962 - DNA, 14 bp, Homo sapiens
tgcagggcagtcat

SEQ ID NO: 1307963 - DNA, 16 bp, Homo sapiens
tgcagtatcatgccct

SEQ ID NO: 1307964 - DNA, 21 bp, Homo sapiens
tgcagtatcatgccctgtgca

SEQ ID NO: 1307965 - DNA, 17 bp, Homo sapiens
tgcatgctgctggacag

SEQ ID NO: 1307966 - DNA, 21 bp, Homo sapiens
tgcatggtgccccaggaccag

SEQ ID NO: 1307967 - DNA, 13 bp, Homo sapiens
tgcattaaattca

SEQ ID NO: 1307968 - DNA, 14 bp, Homo sapiens
tgcattaaattcac

SEQ ID NO: 1307969 - DNA, 16 bp, Homo sapiens
tgcattaaattcacaa

SEQ ID NO: 1307970 - DNA, 13 bp, Homo sapiens
tgcattgaacaca

SEQ ID NO: 1307971 - DNA, 23 bp, Homo sapiens
tgcattgaacacaaactgtaaat

SEQ ID NO: 1307972 - DNA, 22 bp, Homo sapiens
tgcattgaccgcgactaatttc

SEQ ID NO: 1307973 - DNA, 18 bp, Homo sapiens
tgccaatattaaatctgc

SEQ ID NO: 1307974 - DNA, 18 bp, Homo sapiens
tgccacaggacacagtca

SEQ ID NO: 1307975 - DNA, 20 bp, Homo sapiens
tgccacaggacacagtcaga

SEQ ID NO: 1307976 - DNA, 19 bp, Homo sapiens
tgcccaacccttccctcac

SEQ ID NO: 1307977 - DNA, 18 bp, Homo sapiens
tgccccaggaccagctca

SEQ ID NO: 1307978 - DNA, 20 bp, Homo sapiens
tgccccatcctccagcaggg

SEQ ID NO: 1307979 - DNA, 21 bp, Homo sapiens
tgccccatcctccagcaggga

SEQ ID NO: 1307980 - DNA, 12 bp, Homo sapiens
tgccccattctt

SEQ ID NO: 1307981 - DNA, 17 bp, Homo sapiens
tgcccccaggactgggc

SEQ ID NO: 1307982 - DNA, 18 bp, Homo sapiens
tgcccggggaaaggcaag

SEQ ID NO: 1307983 - DNA, 15 bp, Homo sapiens
tgccctcctctccca

SEQ ID NO: 1307984 - DNA, 21 bp, Homo sapiens
tgccgatatactctagatgaa

SEQ ID NO: 1307985 - DNA, 17 bp, Homo sapiens
tgccgcagagctggccg

SEQ ID NO: 1307986 - DNA, 16 bp, Homo sapiens
tgcctccagggctgga

SEQ ID NO: 1307987 - DNA, 17 bp, Homo sapiens
tgcctcccctctccttc

SEQ ID NO: 1307988 - DNA, 13 bp, Homo sapiens
tgcctcgaaacac

SEQ ID NO: 1307989 - DNA, 21 bp, Homo sapiens
tgcctcgaaacacagaaacct

SEQ ID NO: 1307990 - DNA, 13 bp, Homo sapiens
tgcctctgtcccc

SEQ ID NO: 1307991 - DNA, 15 bp, Homo sapiens
tgcctctgtcccctt

SEQ ID NO: 1307992 - DNA, 16 bp, Homo sapiens
tgcctctgtccccttc

SEQ ID NO: 1307993 - DNA, 15 bp, Homo sapiens
tgcctgccagctgca

SEQ ID NO: 1307994 - DNA, 14 bp, Homo sapiens
tgcctgtggaactg

SEQ ID NO: 1307995 - DNA, 15 bp, Homo sapiens
tgccttctaaaggtg

SEQ ID NO: 1307996 - DNA, 21 bp, Homo sapiens
tgcgggtgaacaaagcagcca

SEQ ID NO: 1307997 - DNA, 17 bp, Homo sapiens
tgctcagctctgggcca

SEQ ID NO: 1307998 - DNA, 20 bp, Homo sapiens
tgctcagcttctcctgtgtg

SEQ ID NO: 1307999 - DNA, 21 bp, Homo sapiens
tgctcagcttctcctgtgtga

SEQ ID NO: 1308000 - DNA, 21 bp, Homo sapiens
tgctccagacctgatcctgga

SEQ ID NO: 1308001 - DNA, 17 bp, Homo sapiens
tgctccttgttcctaga

SEQ ID NO: 1308002 - DNA, 16 bp, Homo sapiens
tgctctagtgccttct

SEQ ID NO: 1308003 - DNA, 17 bp, Homo sapiens
tgctctccttcctggag

SEQ ID NO: 1308004 - DNA, 21 bp, Homo sapiens
tgctctgcttgacaacatctg

SEQ ID NO: 1308005 - DNA, 16 bp, Homo sapiens
tgctgacagctgctcc

SEQ ID NO: 1308006 - DNA, 14 bp, Homo sapiens
tgctgacggccagg

SEQ ID NO: 1308007 - DNA, 20 bp, Homo sapiens
tgctgacggccagggagaag

SEQ ID NO: 1308008 - DNA, 23 bp, Homo sapiens
tgctgagagaaatatggaactta

SEQ ID NO: 1308009 - DNA, 12 bp, Homo sapiens
tgctgagcctct

SEQ ID NO: 1308010 - DNA, 20 bp, Homo sapiens
tgctgagcctctgctcccca

SEQ ID NO: 1308011 - DNA, 12 bp, Homo sapiens
tgctgctgctgc

SEQ ID NO: 1308012 - DNA, 13 bp, Homo sapiens
tgctgctggacag

SEQ ID NO: 1308013 - DNA, 13 bp, Homo sapiens
tgctggcccaggg

SEQ ID NO: 1308014 - DNA, 15 bp, Homo sapiens
tgctgtacatctatt

SEQ ID NO: 1308015 - DNA, 16 bp, Homo sapiens
tgctgtacatctattt

SEQ ID NO: 1308016 - DNA, 18 bp, Homo sapiens
tgctgtcctcaggtggcc

SEQ ID NO: 1308017 - DNA, 14 bp, Homo sapiens
tgctgttttcctcc

SEQ ID NO: 1308018 - DNA, 17 bp, Homo sapiens
tgcttgaacccaggaga

SEQ ID NO: 1308019 - DNA, 13 bp, Homo sapiens
tgctttctgctca

SEQ ID NO: 1308020 - DNA, 15 bp, Homo sapiens
tgctttctgctcagc

SEQ ID NO: 1308021 - DNA, 19 bp, Homo sapiens
tgctttgctttctgctcag

SEQ ID NO: 1308022 - DNA, 15 bp, Homo sapiens
tgctttttatttctg

SEQ ID NO: 1308023 - DNA, 18 bp, Homo sapiens
tggaaagataactaggaa

SEQ ID NO: 1308024 - DNA, 12 bp, Homo sapiens
tggaacccagac

SEQ ID NO: 1308025 - DNA, 15 bp, Homo sapiens
tggaacccagactca

SEQ ID NO: 1308026 - DNA, 17 bp, Homo sapiens
tggaacccagactcaga

SEQ ID NO: 1308027 - DNA, 22 bp, Homo sapiens
tggaacccagactcagacattg

SEQ ID NO: 1308028 - DNA, 15 bp, Homo sapiens
tggaacctcagcctg

SEQ ID NO: 1308029 - DNA, 18 bp, Homo sapiens
tggaacctcagcctggcc

SEQ ID NO: 1308030 - DNA, 16 bp, Homo sapiens
tggaagctaatttgca

SEQ ID NO: 1308031 - DNA, 17 bp, Homo sapiens
tggaagctaatttgcat

SEQ ID NO: 1308032 - DNA, 17 bp, Homo sapiens
tggaagtccaatgtggc

SEQ ID NO: 1308033 - DNA, 13 bp, Homo sapiens
tggaatacttttt

SEQ ID NO: 1308034 - DNA, 15 bp, Homo sapiens
tggaattgatttgca

SEQ ID NO: 1308035 - DNA, 18 bp, Homo sapiens
tggaattgatttgcattg

SEQ ID NO: 1308036 - DNA, 14 bp, Homo sapiens
tggacaggctggct

SEQ ID NO: 1308037 - DNA, 21 bp, Homo sapiens
tggacagtatcactgtctttc

SEQ ID NO: 1308038 - DNA, 23 bp, Homo sapiens
tggacagtatcactgtctttcct

SEQ ID NO: 1308039 - DNA, 20 bp, Homo sapiens
tggactcagggcagcgccag

SEQ ID NO: 1308040 - DNA, 15 bp, Homo sapiens
tggactgaggcctga

SEQ ID NO: 1308041 - DNA, 20 bp, Homo sapiens
tggacttgtcctcagcagct

SEQ ID NO: 1308042 - DNA, 18 bp, Homo sapiens
tggagaccagggagcctt

SEQ ID NO: 1308043 - DNA, 19 bp, Homo sapiens
tggagaccagggagccttt

SEQ ID NO: 1308044 - DNA, 12 bp, Homo sapiens
tggagagaaaac

SEQ ID NO: 1308045 - DNA, 16 bp, Homo sapiens
tggagaggccctctgg

SEQ ID NO: 1308046 - DNA, 15 bp, Homo sapiens
tggagagtttcctga

SEQ ID NO: 1308047 - DNA, 19 bp, Homo sapiens
tggagcccagaggagggca

SEQ ID NO: 1308048 - DNA, 20 bp, Homo sapiens
tggagcccagaggagggcag

SEQ ID NO: 1308049 - DNA, 15 bp, Homo sapiens
tggagttgatctgga

SEQ ID NO: 1308050 - DNA, 19 bp, Homo sapiens
tggagttgatctggaaccc

SEQ ID NO: 1308051 - DNA, 21 bp, Homo sapiens
tggatgccaatattaaatctg

SEQ ID NO: 1308052 - DNA, 13 bp, Homo sapiens
tggatttgacatt

SEQ ID NO: 1308053 - DNA, 22 bp, Homo sapiens
tggattttggttttgttcccct

SEQ ID NO: 1308054 - DNA, 20 bp, Homo sapiens
tggcaaaaggatctttgtgg

SEQ ID NO: 1308055 - DNA, 21 bp, Homo sapiens
tggcaaaaggatctttgtggc

SEQ ID NO: 1308056 - DNA, 15 bp, Homo sapiens
tggcaacagatctgg

SEQ ID NO: 1308057 - DNA, 17 bp, Homo sapiens
tggcaacagatctggaa

SEQ ID NO: 1308058 - DNA, 14 bp, Homo sapiens
tggcacaggacatg

SEQ ID NO: 1308059 - DNA, 17 bp, Homo sapiens
tggcaccagacacccag

SEQ ID NO: 1308060 - DNA, 19 bp, Homo sapiens
tggcactgactgggcatag

SEQ ID NO: 1308061 - DNA, 13 bp, Homo sapiens
tggcactggatgc

SEQ ID NO: 1308062 - DNA, 21 bp, Homo sapiens
tggcagcctcccatccagggc

SEQ ID NO: 1308063 - DNA, 22 bp, Homo sapiens
tggcagctctggacagccccac

SEQ ID NO: 1308064 - DNA, 17 bp, Homo sapiens
tggcagtcactgaattc

SEQ ID NO: 1308065 - DNA, 16 bp, Homo sapiens
tggccaaggagctgct

SEQ ID NO: 1308066 - DNA, 18 bp, Homo sapiens
tggccaaggagctgctat

SEQ ID NO: 1308067 - DNA, 12 bp, Homo sapiens
tggccactaagc

SEQ ID NO: 1308068 - DNA, 13 bp, Homo sapiens
tggccagagagcc

SEQ ID NO: 1308069 - DNA, 17 bp, Homo sapiens
tggccatgcctcagccc

SEQ ID NO: 1308070 - DNA, 19 bp, Homo sapiens
tggccgagtccaagctggg

SEQ ID NO: 1308071 - DNA, 21 bp, Homo sapiens
tggccgcgccaaataatgtct

SEQ ID NO: 1308072 - DNA, 20 bp, Homo sapiens
tggcctcccaaatgagccat

SEQ ID NO: 1308073 - DNA, 15 bp, Homo sapiens
tggctagtcaagctc

SEQ ID NO: 1308074 - DNA, 23 bp, Homo sapiens
tggctagtcaagctcctcctccc

SEQ ID NO: 1308075 - DNA, 14 bp, Homo sapiens
tggctcacactgag

SEQ ID NO: 1308076 - DNA, 21 bp, Homo sapiens
tggctccagatgcagggcagt

SEQ ID NO: 1308077 - DNA, 13 bp, Homo sapiens
tggctcctctcag

SEQ ID NO: 1308078 - DNA, 15 bp, Homo sapiens
tggctgggacgtggc

SEQ ID NO: 1308079 - DNA, 19 bp, Homo sapiens
tggctgggacgtggctcag

SEQ ID NO: 1308080 - DNA, 15 bp, Homo sapiens
tgggacgtggctcag

SEQ ID NO: 1308081 - DNA, 16 bp, Homo sapiens
tgggacgtggctcagc

SEQ ID NO: 1308082 - DNA, 11 bp, Homo sapiens
tgggaggctga

SEQ ID NO: 1308083 - DNA, 16 bp, Homo sapiens
tgggagggaggctcag

SEQ ID NO: 1308084 - DNA, 15 bp, Homo sapiens
tgggcaaacaggcag

SEQ ID NO: 1308085 - DNA, 13 bp, Homo sapiens
tgggcaggaaaag

SEQ ID NO: 1308086 - DNA, 13 bp, Homo sapiens
tgggcagggagcg

SEQ ID NO: 1308087 - DNA, 14 bp, Homo sapiens
tgggcctgctccag

SEQ ID NO: 1308088 - DNA, 16 bp, Homo sapiens
tgggcctgctccagac

SEQ ID NO: 1308089 - DNA, 14 bp, Homo sapiens
tgggcttgattctg

SEQ ID NO: 1308090 - DNA, 16 bp, Homo sapiens
tggggagttaagacct

SEQ ID NO: 1308091 - DNA, 18 bp, Homo sapiens
tggggagttaagacctgg

SEQ ID NO: 1308092 - DNA, 19 bp, Homo sapiens
tggggagttaagacctggc

SEQ ID NO: 1308093 - DNA, 23 bp, Homo sapiens
tggggattgggtgggcaggaaaa

SEQ ID NO: 1308094 - DNA, 13 bp, Homo sapiens
tggggccagatcc

SEQ ID NO: 1308095 - DNA, 16 bp, Homo sapiens
tggggccagatccagc

SEQ ID NO: 1308096 - DNA, 20 bp, Homo sapiens
tggggccagatccagcctgg

SEQ ID NO: 1308097 - DNA, 20 bp, Homo sapiens
tggggcctccagaactcact

SEQ ID NO: 1308098 - DNA, 20 bp, Homo sapiens
tggggctagggggagcccct

SEQ ID NO: 1308099 - DNA, 16 bp, Homo sapiens
tggggctggttctgta

SEQ ID NO: 1308100 - DNA, 18 bp, Homo sapiens
tgggggaactcagatcca

SEQ ID NO: 1308101 - DNA, 20 bp, Homo sapiens
tgggggaactcagatccagg

SEQ ID NO: 1308102 - DNA, 13 bp, Homo sapiens
tggggtcatgccc

SEQ ID NO: 1308103 - DNA, 18 bp, Homo sapiens
tggggtcatgccctcctc

SEQ ID NO: 1308104 - DNA, 15 bp, Homo sapiens
tggggtcctggccat

SEQ ID NO: 1308105 - DNA, 14 bp, Homo sapiens
tggggtctggcagc

SEQ ID NO: 1308106 - DNA, 14 bp, Homo sapiens
tgggtgacagagca

SEQ ID NO: 1308107 - DNA, 18 bp, Homo sapiens
tgggtgggcaggaaaagg

SEQ ID NO: 1308108 - DNA, 14 bp, Homo sapiens
tggtcacacactga

SEQ ID NO: 1308109 - DNA, 12 bp, Homo sapiens
tggtcctaccca

SEQ ID NO: 1308110 - DNA, 15 bp, Homo sapiens
tggtgcagtgtgaaa

SEQ ID NO: 1308111 - DNA, 23 bp, Homo sapiens
tggtgccccaggaccagctcagg

SEQ ID NO: 1308112 - DNA, 19 bp, Homo sapiens
tggtgctgctgctgctgtg

SEQ ID NO: 1308113 - DNA, 11 bp, Homo sapiens
tggtgtctcca

SEQ ID NO: 1308114 - DNA, 16 bp, Homo sapiens
tggttcattaattcta

SEQ ID NO: 1308115 - DNA, 15 bp, Homo sapiens
tggttctcatctttc

SEQ ID NO: 1308116 - DNA, 20 bp, Homo sapiens
tggttttgttcccctcctcc

SEQ ID NO: 1308117 - DNA, 14 bp, Homo sapiens
tgtaaataaagccc

SEQ ID NO: 1308118 - DNA, 18 bp, Homo sapiens
tgtaaataaagccctggg

SEQ ID NO: 1308119 - DNA, 17 bp, Homo sapiens
tgtaaattgaatcagta

SEQ ID NO: 1308120 - DNA, 22 bp, Homo sapiens
tgtaaattgaatcagtataaac

SEQ ID NO: 1308121 - DNA, 18 bp, Homo sapiens
tgtaagaactacaaacaa

SEQ ID NO: 1308122 - DNA, 16 bp, Homo sapiens
tgtaatcccagctact

SEQ ID NO: 1308123 - DNA, 23 bp, Homo sapiens
tgtacatctattttggattgtat

SEQ ID NO: 1308124 - DNA, 16 bp, Homo sapiens
tgtacatgagaaggaa

SEQ ID NO: 1308125 - DNA, 18 bp, Homo sapiens
tgtagccccctggcctct

SEQ ID NO: 1308126 - DNA, 19 bp, Homo sapiens
tgtagccccctggcctctg

SEQ ID NO: 1308127 - DNA, 20 bp, Homo sapiens
tgtagccccctggcctctgt

SEQ ID NO: 1308128 - DNA, 15 bp, Homo sapiens
tgtagtaattgacat

SEQ ID NO: 1308129 - DNA, 21 bp, Homo sapiens
tgtagtcctcataaaaagcaa

SEQ ID NO: 1308130 - DNA, 13 bp, Homo sapiens
tgtatatactttt

SEQ ID NO: 1308131 - DNA, 20 bp, Homo sapiens
tgtatattgtgtttgtgtat

SEQ ID NO: 1308132 - DNA, 20 bp, Homo sapiens
tgtatttacgctttgattca

SEQ ID NO: 1308133 - DNA, 23 bp, Homo sapiens
tgtatttacgctttgattcatag

SEQ ID NO: 1308134 - DNA, 19 bp, Homo sapiens
tgtatttttcaataaagca

SEQ ID NO: 1308135 - DNA, 23 bp, Homo sapiens
tgtcactcattgctgagcctctg

SEQ ID NO: 1308136 - DNA, 15 bp, Homo sapiens
tgtcagtcacagcca

SEQ ID NO: 1308137 - DNA, 18 bp, Homo sapiens
tgtcagtcacagccaccc

SEQ ID NO: 1308138 - DNA, 15 bp, Homo sapiens
tgtccaaaactgcct

SEQ ID NO: 1308139 - DNA, 12 bp, Homo sapiens
tgtccagctcca

SEQ ID NO: 1308140 - DNA, 20 bp, Homo sapiens
tgtccagctccaacctgcaa

SEQ ID NO: 1308141 - DNA, 23 bp, Homo sapiens
tgtccagctccaacctgcaaaga

SEQ ID NO: 1308142 - DNA, 21 bp, Homo sapiens
tgtccagctgagcgccaggat

SEQ ID NO: 1308143 - DNA, 22 bp, Homo sapiens
tgtccccttctctcatctctta

SEQ ID NO: 1308144 - DNA, 16 bp, Homo sapiens
tgtccctctgccccat

SEQ ID NO: 1308145 - DNA, 13 bp, Homo sapiens
tgtcctcagcctt

SEQ ID NO: 1308146 - DNA, 21 bp, Homo sapiens
tgtctaaacaatgctgatttg

SEQ ID NO: 1308147 - DNA, 22 bp, Homo sapiens
tgtctaaacaatgctgatttgg

SEQ ID NO: 1308148 - DNA, 11 bp, Homo sapiens
tgtctccaacc

SEQ ID NO: 1308149 - DNA, 19 bp, Homo sapiens
tgtctccaaccccccagca

SEQ ID NO: 1308150 - DNA, 23 bp, Homo sapiens
tgtctccaaccccccagcactga

SEQ ID NO: 1308151 - DNA, 21 bp, Homo sapiens
tgtctgcatttcggtggctag

SEQ ID NO: 1308152 - DNA, 21 bp, Homo sapiens
tgtgaaataaaactggctttg

SEQ ID NO: 1308153 - DNA, 21 bp, Homo sapiens
tgtgaacgatttagaaagaag

SEQ ID NO: 1308154 - DNA, 18 bp, Homo sapiens
tgtgaactttattaaata

SEQ ID NO: 1308155 - DNA, 13 bp, Homo sapiens
tgtgaaggaccct

SEQ ID NO: 1308156 - DNA, 19 bp, Homo sapiens
tgtgagactcgagaacttt

SEQ ID NO: 1308157 - DNA, 17 bp, Homo sapiens
tgtgatagcactttcta

SEQ ID NO: 1308158 - DNA, 22 bp, Homo sapiens
tgtgattgacagctttgctgct

SEQ ID NO: 1308159 - DNA, 17 bp, Homo sapiens
tgtgattgtggaatgga

SEQ ID NO: 1308160 - DNA, 23 bp, Homo sapiens
tgtgcactaaggggcccggccag

SEQ ID NO: 1308161 - DNA, 18 bp, Homo sapiens
tgtgccagggcaatgatg

SEQ ID NO: 1308162 - DNA, 16 bp, Homo sapiens
tgtgccttcttttgat

SEQ ID NO: 1308163 - DNA, 17 bp, Homo sapiens
tgtgctttatgctgaaa

SEQ ID NO: 1308164 - DNA, 15 bp, Homo sapiens
tgtgtatttacgctt

SEQ ID NO: 1308165 - DNA, 12 bp, Homo sapiens
tgtgtgaatgaa

SEQ ID NO: 1308166 - DNA, 19 bp, Homo sapiens
tgtgtgattgacagctttg

SEQ ID NO: 1308167 - DNA, 21 bp, Homo sapiens
tgtgtgattgacagctttgct

SEQ ID NO: 1308168 - DNA, 23 bp, Homo sapiens
tgtgttgccacaggacacagtca

SEQ ID NO: 1308169 - DNA, 21 bp, Homo sapiens
tgttatcagtcaatattttta

SEQ ID NO: 1308170 - DNA, 18 bp, Homo sapiens
tgttccagtaatctaata

SEQ ID NO: 1308171 - DNA, 17 bp, Homo sapiens
tgttcccctcctccact

SEQ ID NO: 1308172 - DNA, 22 bp, Homo sapiens
tgttcgcatggtcacacactga

SEQ ID NO: 1308173 - DNA, 23 bp, Homo sapiens
tgttcgcatggtcacacactgat

SEQ ID NO: 1308174 - DNA, 15 bp, Homo sapiens
tgttctgaactgtgg

SEQ ID NO: 1308175 - DNA, 23 bp, Homo sapiens
tgttgagaatcccaaatttgatt

SEQ ID NO: 1308176 - DNA, 17 bp, Homo sapiens
tgtttgtctgtcttcat

SEQ ID NO: 1308177 - DNA, 23 bp, Homo sapiens
tgttttcctcccttctgctactg

SEQ ID NO: 1308178 - DNA, 14 bp, Homo sapiens
tgtttttaagctgt

SEQ ID NO: 1308179 - DNA, 22 bp, Homo sapiens
ttaaactctgttgcaagtgcaa

SEQ ID NO: 1308180 - DNA, 13 bp, Homo sapiens
ttaaactggtatt

SEQ ID NO: 1308181 - DNA, 22 bp, Homo sapiens
ttaaactggtattttatctttg

SEQ ID NO: 1308182 - DNA, 12 bp, Homo sapiens
ttaaagacagag

SEQ ID NO: 1308183 - DNA, 14 bp, Homo sapiens
ttaaattttgtgtc

SEQ ID NO: 1308184 - DNA, 21 bp, Homo sapiens
ttaactagaatttattcaatt

SEQ ID NO: 1308185 - DNA, 14 bp, Homo sapiens
ttaagaaggcaaaa

SEQ ID NO: 1308186 - DNA, 18 bp, Homo sapiens
ttaagaaggcaaaaatgt

SEQ ID NO: 1308187 - DNA, 18 bp, Homo sapiens
ttaagacatgatttcctt

SEQ ID NO: 1308188 - DNA, 14 bp, Homo sapiens
ttaagctgtttcca

SEQ ID NO: 1308189 - DNA, 17 bp, Homo sapiens
ttaatactaccttgaaa

SEQ ID NO: 1308190 - DNA, 14 bp, Homo sapiens
ttaatatgaaaact

SEQ ID NO: 1308191 - DNA, 14 bp, Homo sapiens
ttaatcaagttgaa

SEQ ID NO: 1308192 - DNA, 20 bp, Homo sapiens
ttacaaaactacatgagaac

SEQ ID NO: 1308193 - DNA, 17 bp, Homo sapiens
ttacattgtttgtctgt

SEQ ID NO: 1308194 - DNA, 16 bp, Homo sapiens
ttacgctttgattcat

SEQ ID NO: 1308195 - DNA, 14 bp, Homo sapiens
ttactaggtaactt

SEQ ID NO: 1308196 - DNA, 14 bp, Homo sapiens
ttactcaggaagaa

SEQ ID NO: 1308197 - DNA, 13 bp, Homo sapiens
ttactgagcttct

SEQ ID NO: 1308198 - DNA, 16 bp, Homo sapiens
ttactgagcttctctg

SEQ ID NO: 1308199 - DNA, 19 bp, Homo sapiens
ttactgagcttctctgtga

SEQ ID NO: 1308200 - DNA, 12 bp, Homo sapiens
ttagaacatttt

SEQ ID NO: 1308201 - DNA, 18 bp, Homo sapiens
ttagaatccaaacttgga

SEQ ID NO: 1308202 - DNA, 13 bp, Homo sapiens
ttagctcccctcc

SEQ ID NO: 1308203 - DNA, 18 bp, Homo sapiens
ttagctcccctccaacct

SEQ ID NO: 1308204 - DNA, 15 bp, Homo sapiens
ttaggaagagaaacc

SEQ ID NO: 1308205 - DNA, 12 bp, Homo sapiens
ttaggagaagcc

SEQ ID NO: 1308206 - DNA, 19 bp, Homo sapiens
ttaggagggagttatctaa

SEQ ID NO: 1308207 - DNA, 17 bp, Homo sapiens
ttaggctggtggcccag

SEQ ID NO: 1308208 - DNA, 13 bp, Homo sapiens
ttagggagaaaat

SEQ ID NO: 1308209 - DNA, 13 bp, Homo sapiens
ttataaaacttct

SEQ ID NO: 1308210 - DNA, 15 bp, Homo sapiens
ttatagaatatttat

SEQ ID NO: 1308211 - DNA, 16 bp, Homo sapiens
ttatatgaagataagt

SEQ ID NO: 1308212 - DNA, 19 bp, Homo sapiens
ttatatgtacatgagaagg

SEQ ID NO: 1308213 - DNA, 17 bp, Homo sapiens
ttatctatacatatctt

SEQ ID NO: 1308214 - DNA, 17 bp, Homo sapiens
ttatcttgtctctgggc

SEQ ID NO: 1308215 - DNA, 14 bp, Homo sapiens
ttatggaattgatt

SEQ ID NO: 1308216 - DNA, 19 bp, Homo sapiens
ttatggaattgatttgcat

SEQ ID NO: 1308217 - DNA, 23 bp, Homo sapiens
ttatggaattgatttgcattgaa

SEQ ID NO: 1308218 - DNA, 19 bp, Homo sapiens
ttatgtagtaattgacatg

SEQ ID NO: 1308219 - DNA, 14 bp, Homo sapiens
ttattaattgcttt

SEQ ID NO: 1308220 - DNA, 19 bp, Homo sapiens
ttattaccccctccttcag

SEQ ID NO: 1308221 - DNA, 22 bp, Homo sapiens
ttattaccccctccttcagaca

SEQ ID NO: 1308222 - DNA, 12 bp, Homo sapiens
ttattacctctg

SEQ ID NO: 1308223 - DNA, 17 bp, Homo sapiens
ttattagggagaaaatt

SEQ ID NO: 1308224 - DNA, 19 bp, Homo sapiens
ttattcaattcctctggga

SEQ ID NO: 1308225 - DNA, 17 bp, Homo sapiens
ttattccagaatgctgt

SEQ ID NO: 1308226 - DNA, 20 bp, Homo sapiens
ttattccagaatgctgtaca

SEQ ID NO: 1308227 - DNA, 19 bp, Homo sapiens
ttattgacacagaaaatgt

SEQ ID NO: 1308228 - DNA, 23 bp, Homo sapiens
ttatttaacagctgaattatcta

SEQ ID NO: 1308229 - DNA, 15 bp, Homo sapiens
ttatttacagatgaa

SEQ ID NO: 1308230 - DNA, 17 bp, Homo sapiens
ttatttactgagcttct

SEQ ID NO: 1308231 - DNA, 21 bp, Homo sapiens
ttatttactgagcttctctgt

SEQ ID NO: 1308232 - DNA, 22 bp, Homo sapiens
ttatttactgagcttctctgtg

SEQ ID NO: 1308233 - DNA, 12 bp, Homo sapiens
ttatttctgcat

SEQ ID NO: 1308234 - DNA, 20 bp, Homo sapiens
ttcaaaatgctttttattat

SEQ ID NO: 1308235 - DNA, 21 bp, Homo sapiens
ttcaactgccaaaatgctcta

SEQ ID NO: 1308236 - DNA, 12 bp, Homo sapiens
ttcaattgtaaa

SEQ ID NO: 1308237 - DNA, 18 bp, Homo sapiens
ttcacctgccccaactct

SEQ ID NO: 1308238 - DNA, 19 bp, Homo sapiens
ttcacctgtttttaagctg

SEQ ID NO: 1308239 - DNA, 22 bp, Homo sapiens
ttcacctgtttttaagctgttt

SEQ ID NO: 1308240 - DNA, 16 bp, Homo sapiens
ttcagaaagtgtgctt

SEQ ID NO: 1308241 - DNA, 16 bp, Homo sapiens
ttcagccctcacccct

SEQ ID NO: 1308242 - DNA, 19 bp, Homo sapiens
ttcatcccaactgtctttt

SEQ ID NO: 1308243 - DNA, 23 bp, Homo sapiens
ttcatcgaatctactaattccac

SEQ ID NO: 1308244 - DNA, 22 bp, Homo sapiens
ttcatctcccacctagcagcac

SEQ ID NO: 1308245 - DNA, 18 bp, Homo sapiens
ttcatgtaatcctcaaga

SEQ ID NO: 1308246 - DNA, 14 bp, Homo sapiens
ttcatttttttcca

SEQ ID NO: 1308247 - DNA, 18 bp, Homo sapiens
ttcatttttttccaggct

SEQ ID NO: 1308248 - DNA, 22 bp, Homo sapiens
ttccaaagagtagaattgcatt

SEQ ID NO: 1308249 - DNA, 15 bp, Homo sapiens
ttccacaccttttat

SEQ ID NO: 1308250 - DNA, 14 bp, Homo sapiens
ttccagaatgctgt

SEQ ID NO: 1308251 - DNA, 15 bp, Homo sapiens
ttccagaatgctgta

SEQ ID NO: 1308252 - DNA, 16 bp, Homo sapiens
ttccagaatgctgtac

SEQ ID NO: 1308253 - DNA, 20 bp, Homo sapiens
ttccagacttccttgagaca

SEQ ID NO: 1308254 - DNA, 20 bp, Homo sapiens
ttccagtctccaccaggaac

SEQ ID NO: 1308255 - DNA, 22 bp, Homo sapiens
ttccagtctccaccaggaacct

SEQ ID NO: 1308256 - DNA, 17 bp, Homo sapiens
ttccatgattctattta

SEQ ID NO: 1308257 - DNA, 16 bp, Homo sapiens
ttcccaaacgcctccc

SEQ ID NO: 1308258 - DNA, 15 bp, Homo sapiens
ttcccaactctagct

SEQ ID NO: 1308259 - DNA, 17 bp, Homo sapiens
ttcccaactctagctgg

SEQ ID NO: 1308260 - DNA, 18 bp, Homo sapiens
ttcccaactctagctggg

SEQ ID NO: 1308261 - DNA, 11 bp, Homo sapiens
ttcccaagctc

SEQ ID NO: 1308262 - DNA, 11 bp, Homo sapiens
ttcccaggacc

SEQ ID NO: 1308263 - DNA, 12 bp, Homo sapiens
ttcccaggaccc

SEQ ID NO: 1308264 - DNA, 17 bp, Homo sapiens
ttcccatgtagccccct

SEQ ID NO: 1308265 - DNA, 18 bp, Homo sapiens
ttccccaaccacttcatt

SEQ ID NO: 1308266 - DNA, 21 bp, Homo sapiens
ttccctcaccttggcaccaga

SEQ ID NO: 1308267 - DNA, 17 bp, Homo sapiens
ttccgtgaaaacggagc

SEQ ID NO: 1308268 - DNA, 22 bp, Homo sapiens
ttcctagatggcagtcactgaa

SEQ ID NO: 1308269 - DNA, 11 bp, Homo sapiens
ttcctcccttc

SEQ ID NO: 1308270 - DNA, 12 bp, Homo sapiens
ttcctcccttct

SEQ ID NO: 1308271 - DNA, 18 bp, Homo sapiens
ttcctcccttctgctact

SEQ ID NO: 1308272 - DNA, 15 bp, Homo sapiens
ttcctccttccatgg

SEQ ID NO: 1308273 - DNA, 16 bp, Homo sapiens
ttcctctttgctttgc

SEQ ID NO: 1308274 - DNA, 19 bp, Homo sapiens
ttcctgaagaaccagtccc

SEQ ID NO: 1308275 - DNA, 16 bp, Homo sapiens
ttcctgtccagctcca

SEQ ID NO: 1308276 - DNA, 22 bp, Homo sapiens
ttcctgtccagctccaacctgc

SEQ ID NO: 1308277 - DNA, 24 bp, Homo sapiens
ttccttgagacacggagcccagcc

SEQ ID NO: 1308278 - DNA, 23 bp, Homo sapiens
ttccttttgaacgccccccccca

SEQ ID NO: 1308279 - DNA, 22 bp, Homo sapiens
ttcgaaacctgggattcaggaa

SEQ ID NO: 1308280 - DNA, 16 bp, Homo sapiens
ttcgcatggtcacaca

SEQ ID NO: 1308281 - DNA, 18 bp, Homo sapiens
ttcgcatggtcacacact

SEQ ID NO: 1308282 - DNA, 23 bp, Homo sapiens
ttcgcatggtcacacactgatgc

SEQ ID NO: 1308283 - DNA, 22 bp, Homo sapiens
ttcggtggctagtcaagctcct

SEQ ID NO: 1308284 - DNA, 14 bp, Homo sapiens
ttctaatagaactc

SEQ ID NO: 1308285 - DNA, 16 bp, Homo sapiens
ttctacaatgtgaact

SEQ ID NO: 1308286 - DNA, 15 bp, Homo sapiens
ttctcatctttcttg

SEQ ID NO: 1308287 - DNA, 18 bp, Homo sapiens
ttctcccctgcccccagg

SEQ ID NO: 1308288 - DNA, 19 bp, Homo sapiens
ttctcccctgcccccagga

SEQ ID NO: 1308289 - DNA, 13 bp, Homo sapiens
ttctcctcttgta

SEQ ID NO: 1308290 - DNA, 15 bp, Homo sapiens
ttctccttcagccct

SEQ ID NO: 1308291 - DNA, 20 bp, Homo sapiens
ttctctgtgaacgatttaga

SEQ ID NO: 1308292 - DNA, 15 bp, Homo sapiens
ttctgcagtaaatct

SEQ ID NO: 1308293 - DNA, 22 bp, Homo sapiens
ttctgcatatgttgaatacttt

SEQ ID NO: 1308294 - DNA, 18 bp, Homo sapiens
ttctgcctgccagctgca

SEQ ID NO: 1308295 - DNA, 22 bp, Homo sapiens
ttctgcctgccagctgcactga

SEQ ID NO: 1308296 - DNA, 12 bp, Homo sapiens
ttctgctcagct

SEQ ID NO: 1308297 - DNA, 15 bp, Homo sapiens
ttctgctcagctctg

SEQ ID NO: 1308298 - DNA, 17 bp, Homo sapiens
ttctgtatatacttttt

SEQ ID NO: 1308299 - DNA, 15 bp, Homo sapiens
ttcttatggaattga

SEQ ID NO: 1308300 - DNA, 18 bp, Homo sapiens
ttcttatggaattgattt

SEQ ID NO: 1308301 - DNA, 13 bp, Homo sapiens
ttcttgaaagctg

SEQ ID NO: 1308302 - DNA, 23 bp, Homo sapiens
ttctttaaaaaacaactatggat

SEQ ID NO: 1308303 - DNA, 13 bp, Homo sapiens
ttcttttgtaatt

SEQ ID NO: 1308304 - DNA, 12 bp, Homo sapiens
ttgaaagctgtg

SEQ ID NO: 1308305 - DNA, 15 bp, Homo sapiens
ttgaacacaaactgt

SEQ ID NO: 1308306 - DNA, 22 bp, Homo sapiens
ttgaacgcccccccccacccct

SEQ ID NO: 1308307 - DNA, 12 bp, Homo sapiens
ttgaaggcaaaa

SEQ ID NO: 1308308 - DNA, 21 bp, Homo sapiens
ttgaataaaaactttgctaaa

SEQ ID NO: 1308309 - DNA, 12 bp, Homo sapiens
ttgaataaataa

SEQ ID NO: 1308310 - DNA, 14 bp, Homo sapiens
ttgacattgcgttt

SEQ ID NO: 1308311 - DNA, 20 bp, Homo sapiens
ttgaccgcgactaatttcaa

SEQ ID NO: 1308312 - DNA, 21 bp, Homo sapiens
ttgagaaatatggacacttaa

SEQ ID NO: 1308313 - DNA, 22 bp, Homo sapiens
ttgagacacggagcccagccct

SEQ ID NO: 1308314 - DNA, 13 bp, Homo sapiens
ttgagtagaggct

SEQ ID NO: 1308315 - DNA, 21 bp, Homo sapiens
ttgattatccatattgagtca

SEQ ID NO: 1308316 - DNA, 20 bp, Homo sapiens
ttgattctccttcagccctc

SEQ ID NO: 1308317 - DNA, 20 bp, Homo sapiens
ttgattctgcagtaaatctt

SEQ ID NO: 1308318 - DNA, 14 bp, Homo sapiens
ttgattgatttgaa

SEQ ID NO: 1308319 - DNA, 19 bp, Homo sapiens
ttgatttgcattgaacaca

SEQ ID NO: 1308320 - DNA, 17 bp, Homo sapiens
ttgcaaatcttgaaatt

SEQ ID NO: 1308321 - DNA, 20 bp, Homo sapiens
ttgcacttgtgattatttat

SEQ ID NO: 1308322 - DNA, 21 bp, Homo sapiens
ttgcattaaattcacaaactt

SEQ ID NO: 1308323 - DNA, 23 bp, Homo sapiens
ttgcattgaacacaaactgtaaa

SEQ ID NO: 1308324 - DNA, 14 bp, Homo sapiens
ttgctgttttcctc

SEQ ID NO: 1308325 - DNA, 18 bp, Homo sapiens
ttgctgttttcctccctt

SEQ ID NO: 1308326 - DNA, 14 bp, Homo sapiens
ttggatttgacatt

SEQ ID NO: 1308327 - DNA, 22 bp, Homo sapiens
ttggatttgacattgcgtttga

SEQ ID NO: 1308328 - DNA, 21 bp, Homo sapiens
ttggcaccagacacccaggac

SEQ ID NO: 1308329 - DNA, 23 bp, Homo sapiens
ttggcaccagacacccaggactt

SEQ ID NO: 1308330 - DNA, 21 bp, Homo sapiens
ttggcacctaatccaggcaga

SEQ ID NO: 1308331 - DNA, 17 bp, Homo sapiens
ttggcctgatcagacca

SEQ ID NO: 1308332 - DNA, 17 bp, Homo sapiens
ttggctcacactgagaa

SEQ ID NO: 1308333 - DNA, 13 bp, Homo sapiens
ttggctcagacat

SEQ ID NO: 1308334 - DNA, 17 bp, Homo sapiens
ttgggccagacatgcca

SEQ ID NO: 1308335 - DNA, 16 bp, Homo sapiens
ttgggcctgctccaga

SEQ ID NO: 1308336 - DNA, 20 bp, Homo sapiens
ttgggcctgctccagacctg

SEQ ID NO: 1308337 - DNA, 21 bp, Homo sapiens
ttggggagttaagacctggca

SEQ ID NO: 1308338 - DNA, 13 bp, Homo sapiens
ttggttctgtgtc

SEQ ID NO: 1308339 - DNA, 17 bp, Homo sapiens
ttggttttgttcccctc

SEQ ID NO: 1308340 - DNA, 11 bp, Homo sapiens
ttgtacctctc

SEQ ID NO: 1308341 - DNA, 12 bp, Homo sapiens
ttgtctctgggc

SEQ ID NO: 1308342 - DNA, 14 bp, Homo sapiens
ttgtctttaactgt

SEQ ID NO: 1308343 - DNA, 21 bp, Homo sapiens
ttgtgaaataaaactggcttt

SEQ ID NO: 1308344 - DNA, 21 bp, Homo sapiens
ttgtgatagcactttctacaa

SEQ ID NO: 1308345 - DNA, 20 bp, Homo sapiens
ttgtgtatttacgctttgat

SEQ ID NO: 1308346 - DNA, 22 bp, Homo sapiens
ttgttatcagtcaatattttta

SEQ ID NO: 1308347 - DNA, 15 bp, Homo sapiens
ttgttcaattagaat

SEQ ID NO: 1308348 - DNA, 13 bp, Homo sapiens
ttgttcccctcct

SEQ ID NO: 1308349 - DNA, 17 bp, Homo sapiens
tttaaaaatagacactc

SEQ ID NO: 1308350 - DNA, 17 bp, Homo sapiens
tttaacagctgaattat

SEQ ID NO: 1308351 - DNA, 20 bp, Homo sapiens
tttaacagctgaattatcta

SEQ ID NO: 1308352 - DNA, 23 bp, Homo sapiens
tttaattcatcccaactgtcttt

SEQ ID NO: 1308353 - DNA, 21 bp, Homo sapiens
tttaatttattaattgctttg

SEQ ID NO: 1308354 - DNA, 19 bp, Homo sapiens
tttacaaaactacatgaga

SEQ ID NO: 1308355 - DNA, 17 bp, Homo sapiens
tttacagatgaatgtat

SEQ ID NO: 1308356 - DNA, 14 bp, Homo sapiens
tttactgagcttct

SEQ ID NO: 1308357 - DNA, 20 bp, Homo sapiens
tttagacagtctcactttgt

SEQ ID NO: 1308358 - DNA, 20 bp, Homo sapiens
tttagggctgtaaaatgcat

SEQ ID NO: 1308359 - DNA, 14 bp, Homo sapiens
tttataaaacttct

SEQ ID NO: 1308360 - DNA, 16 bp, Homo sapiens
tttatactctttctgt

SEQ ID NO: 1308361 - DNA, 20 bp, Homo sapiens
tttatactctttctgtatat

SEQ ID NO: 1308362 - DNA, 13 bp, Homo sapiens
tttatctgattaa

SEQ ID NO: 1308363 - DNA, 14 bp, Homo sapiens
tttatcttgtctct

SEQ ID NO: 1308364 - DNA, 21 bp, Homo sapiens
tttatgctgaaacagaatact

SEQ ID NO: 1308365 - DNA, 15 bp, Homo sapiens
tttattaaatacaaa

SEQ ID NO: 1308366 - DNA, 12 bp, Homo sapiens
tttattaccccc

SEQ ID NO: 1308367 - DNA, 17 bp, Homo sapiens
tttattattttcacctg

SEQ ID NO: 1308368 - DNA, 22 bp, Homo sapiens
tttattccagaatgctgtacat

SEQ ID NO: 1308369 - DNA, 14 bp, Homo sapiens
tttattgacacaga

SEQ ID NO: 1308370 - DNA, 12 bp, Homo sapiens
tttcaaaatgct

SEQ ID NO: 1308371 - DNA, 20 bp, Homo sapiens
tttcaaggtaatttcttgtg

SEQ ID NO: 1308372 - DNA, 23 bp, Homo sapiens
tttcaagtcaaattaataatctt

SEQ ID NO: 1308373 - DNA, 19 bp, Homo sapiens
tttcaataaagcatttata

SEQ ID NO: 1308374 - DNA, 22 bp, Homo sapiens
tttcacctgtttttaagctgtt

SEQ ID NO: 1308375 - DNA, 15 bp, Homo sapiens
tttcatctgctctcc

SEQ ID NO: 1308376 - DNA, 16 bp, Homo sapiens
tttcatctgctctcct

SEQ ID NO: 1308377 - DNA, 19 bp, Homo sapiens
tttcatctgctctccttcc

SEQ ID NO: 1308378 - DNA, 18 bp, Homo sapiens
tttcatgtacaagatgaa

SEQ ID NO: 1308379 - DNA, 15 bp, Homo sapiens
tttcatttttttcca

SEQ ID NO: 1308380 - DNA, 19 bp, Homo sapiens
tttccagacttccttgaga

SEQ ID NO: 1308381 - DNA, 15 bp, Homo sapiens
tttccaggctggttc

SEQ ID NO: 1308382 - DNA, 22 bp, Homo sapiens
tttccaggctggttcggatttg

SEQ ID NO: 1308383 - DNA, 21 bp, Homo sapiens
tttccagtctccaccaggaac

SEQ ID NO: 1308384 - DNA, 14 bp, Homo sapiens
tttcccaggaccct

SEQ ID NO: 1308385 - DNA, 16 bp, Homo sapiens
tttcccaggaccctga

SEQ ID NO: 1308386 - DNA, 13 bp, Homo sapiens
tttccctgacctc

SEQ ID NO: 1308387 - DNA, 23 bp, Homo sapiens
tttcctagatggcagtcactgaa

SEQ ID NO: 1308388 - DNA, 22 bp, Homo sapiens
tttcctcctgaggctttggatt

SEQ ID NO: 1308389 - DNA, 13 bp, Homo sapiens
tttctcccctgcc

SEQ ID NO: 1308390 - DNA, 22 bp, Homo sapiens
tttctcccctgcccccaggact

SEQ ID NO: 1308391 - DNA, 23 bp, Homo sapiens
tttctcccctgcccccaggactg

SEQ ID NO: 1308392 - DNA, 24 bp, Homo sapiens
tttctcccctgcccccaggactgg

SEQ ID NO: 1308393 - DNA, 23 bp, Homo sapiens
tttctgataactagatggtgctg

SEQ ID NO: 1308394 - DNA, 18 bp, Homo sapiens
tttctgctcagcttctcc

SEQ ID NO: 1308395 - DNA, 19 bp, Homo sapiens
tttctgctcagcttctcct

SEQ ID NO: 1308396 - DNA, 17 bp, Homo sapiens
tttctgtatatactttt

SEQ ID NO: 1308397 - DNA, 13 bp, Homo sapiens
tttctttaatgct

SEQ ID NO: 1308398 - DNA, 17 bp, Homo sapiens
tttgaagaacatgtgag

SEQ ID NO: 1308399 - DNA, 18 bp, Homo sapiens
tttgaagaacatgtgaga

SEQ ID NO: 1308400 - DNA, 20 bp, Homo sapiens
tttgacattgcgtttgacct

SEQ ID NO: 1308401 - DNA, 21 bp, Homo sapiens
tttgactctggcaaagctttt

SEQ ID NO: 1308402 - DNA, 13 bp, Homo sapiens
tttgagacaggag

SEQ ID NO: 1308403 - DNA, 14 bp, Homo sapiens
tttgagtgttttaa

SEQ ID NO: 1308404 - DNA, 15 bp, Homo sapiens
tttgattcatagtaa

SEQ ID NO: 1308405 - DNA, 13 bp, Homo sapiens
tttgattctcctt

SEQ ID NO: 1308406 - DNA, 21 bp, Homo sapiens
tttgcacttgtgattatttat

SEQ ID NO: 1308407 - DNA, 17 bp, Homo sapiens
tttgcattaaattcaca

SEQ ID NO: 1308408 - DNA, 12 bp, Homo sapiens
tttgcttagaaa

SEQ ID NO: 1308409 - DNA, 15 bp, Homo sapiens
tttgctttctgctca

SEQ ID NO: 1308410 - DNA, 15 bp, Homo sapiens
tttgctttgctttct

SEQ ID NO: 1308411 - DNA, 13 bp, Homo sapiens
tttggaatacttt

SEQ ID NO: 1308412 - DNA, 18 bp, Homo sapiens
tttggagagtttcctgaa

SEQ ID NO: 1308413 - DNA, 14 bp, Homo sapiens
tttggattgtatat

SEQ ID NO: 1308414 - DNA, 14 bp, Homo sapiens
tttggatttgacat

SEQ ID NO: 1308415 - DNA, 20 bp, Homo sapiens
tttgggaagtgaagactgga

SEQ ID NO: 1308416 - DNA, 14 bp, Homo sapiens
tttgggttctgcct

SEQ ID NO: 1308417 - DNA, 15 bp, Homo sapiens
tttgggttctgcctg

SEQ ID NO: 1308418 - DNA, 20 bp, Homo sapiens
tttggttcattaattctata

SEQ ID NO: 1308419 - DNA, 14 bp, Homo sapiens
tttggttttgttcc

SEQ ID NO: 1308420 - DNA, 15 bp, Homo sapiens
tttggttttgttccc

SEQ ID NO: 1308421 - DNA, 16 bp, Homo sapiens
tttggttttgttcccc

SEQ ID NO: 1308422 - DNA, 21 bp, Homo sapiens
tttgtaacccagattttgctg

SEQ ID NO: 1308423 - DNA, 17 bp, Homo sapiens
tttgtctgtcttcatag

SEQ ID NO: 1308424 - DNA, 17 bp, Homo sapiens
tttgtctttaactgtca

SEQ ID NO: 1308425 - DNA, 18 bp, Homo sapiens
tttgtggccaaggagctg

SEQ ID NO: 1308426 - DNA, 16 bp, Homo sapiens
tttgttcccctcctcc

SEQ ID NO: 1308427 - DNA, 18 bp, Homo sapiens
tttgttcccctcctccac

SEQ ID NO: 1308428 - DNA, 22 bp, Homo sapiens
ttttaagataaattataagtta

SEQ ID NO: 1308429 - DNA, 19 bp, Homo sapiens
ttttatactctttctgtat

SEQ ID NO: 1308430 - DNA, 18 bp, Homo sapiens
ttttattgacacagaaaa

SEQ ID NO: 1308431 - DNA, 14 bp, Homo sapiens
ttttcctcccttct

SEQ ID NO: 1308432 - DNA, 20 bp, Homo sapiens
ttttcctcccttctgctact

SEQ ID NO: 1308433 - DNA, 21 bp, Homo sapiens
ttttcctcccttctgctactg

SEQ ID NO: 1308434 - DNA, 16 bp, Homo sapiens
ttttggattgtatatt

SEQ ID NO: 1308435 - DNA, 14 bp, Homo sapiens
ttttggttttgttc

SEQ ID NO: 1308436 - DNA, 14 bp, Homo sapiens
ttttgttcccctcc

SEQ ID NO: 1308437 - DNA, 12 bp, Homo sapiens
tttttatttctg

SEQ ID NO: 1308438 - DNA, 16 bp, Homo sapiens
tttttcaatatttatt

SEQ ID NO: 1308439 - DNA, 12 bp, Homo sapiens
tttttccaggct

SEQ ID NO: 1308440 - DNA, 13 bp, Homo sapiens
tttttccatcttt

SEQ ID NO: 1308441 - DNA, 18 bp, Homo sapiens
ttttttcaatatttatta

SEQ ID NO: 1308442 - DNA, 19 bp, Homo sapiens
aaaaagcttccatgattct

SEQ ID NO: 1308443 - DNA, 19 bp, Homo sapiens
aaaaagtttggttctgtgt

SEQ ID NO: 1308444 - DNA, 13 bp, Homo sapiens
aaaacagaagcct

SEQ ID NO: 1308445 - DNA, 16 bp, Homo sapiens
aaaacatctattctct

SEQ ID NO: 1308446 - DNA, 21 bp, Homo sapiens
aaaacatctattctctccaaa

SEQ ID NO: 1308447 - DNA, 23 bp, Homo sapiens
aaaagatctgttttgaaggcaaa

SEQ ID NO: 1308448 - DNA, 14 bp, Homo sapiens
aaaagcttccatga

SEQ ID NO: 1308449 - DNA, 13 bp, Homo sapiens
aaaatagacactc

SEQ ID NO: 1308450 - DNA, 16 bp, Homo sapiens
aaaatgttatttaaca

SEQ ID NO: 1308451 - DNA, 14 bp, Homo sapiens
aaaatgttgagaat

SEQ ID NO: 1308452 - DNA, 15 bp, Homo sapiens
aaaattgcaaatctt

SEQ ID NO: 1308453 - DNA, 15 bp, Homo sapiens
aaacaaaatttctat

SEQ ID NO: 1308454 - DNA, 17 bp, Homo sapiens
aaacaaagttactaggt

SEQ ID NO: 1308455 - DNA, 19 bp, Homo sapiens
aaacatccaatattttctt

SEQ ID NO: 1308456 - DNA, 15 bp, Homo sapiens
aaacatctattctct

SEQ ID NO: 1308457 - DNA, 21 bp, Homo sapiens
aaacctgggattcaggaatgt

SEQ ID NO: 1308458 - DNA, 16 bp, Homo sapiens
aaaccttattgtacct

SEQ ID NO: 1308459 - DNA, 17 bp, Homo sapiens
aaaccttattgtacctc

SEQ ID NO: 1308460 - DNA, 15 bp, Homo sapiens
aaactcatttataaa

SEQ ID NO: 1308461 - DNA, 17 bp, Homo sapiens
aaactggggcctccaga

SEQ ID NO: 1308462 - DNA, 16 bp, Homo sapiens
aaagaagcccccagct

SEQ ID NO: 1308463 - DNA, 19 bp, Homo sapiens
aaagaggctgaggctggca

SEQ ID NO: 1308464 - DNA, 18 bp, Homo sapiens
aaagatctgtcctcagcc

SEQ ID NO: 1308465 - DNA, 14 bp, Homo sapiens
aaagattttaatca

SEQ ID NO: 1308466 - DNA, 15 bp, Homo sapiens
aaagattttaatcaa

SEQ ID NO: 1308467 - DNA, 14 bp, Homo sapiens
aaagcaaaacaaaa

SEQ ID NO: 1308468 - DNA, 12 bp, Homo sapiens
aaagcagccacg

SEQ ID NO: 1308469 - DNA, 23 bp, Homo sapiens
aaagcccaagggatctggtccta

SEQ ID NO: 1308470 - DNA, 17 bp, Homo sapiens
aaagcttccatgattct

SEQ ID NO: 1308471 - DNA, 13 bp, Homo sapiens
aaaggcaaggtcc

SEQ ID NO: 1308472 - DNA, 18 bp, Homo sapiens
aaaggtgttgtcccttct

SEQ ID NO: 1308473 - DNA, 16 bp, Homo sapiens
aaagtcctttttttcc

SEQ ID NO: 1308474 - DNA, 18 bp, Homo sapiens
aaagtcctttttttccat

SEQ ID NO: 1308475 - DNA, 13 bp, Homo sapiens
aaagtgtgcttta

SEQ ID NO: 1308476 - DNA, 15 bp, Homo sapiens
aaagttactaggtaa

SEQ ID NO: 1308477 - DNA, 20 bp, Homo sapiens
aaagtttaaaacagaagcct

SEQ ID NO: 1308478 - DNA, 12 bp, Homo sapiens
aaataaagccct

SEQ ID NO: 1308479 - DNA, 20 bp, Homo sapiens
aaataaagtttgcttagaaa

SEQ ID NO: 1308480 - DNA, 15 bp, Homo sapiens
aaatacaaaacttcc

SEQ ID NO: 1308481 - DNA, 17 bp, Homo sapiens
aaatactgcaagaaaat

SEQ ID NO: 1308482 - DNA, 22 bp, Homo sapiens
aaatagttaagacatgatttcc

SEQ ID NO: 1308483 - DNA, 13 bp, Homo sapiens
aaatatggaactt

SEQ ID NO: 1308484 - DNA, 15 bp, Homo sapiens
aaatatggacactta

SEQ ID NO: 1308485 - DNA, 19 bp, Homo sapiens
aaatatttataaaacttct

SEQ ID NO: 1308486 - DNA, 12 bp, Homo sapiens
aaatatttttgg

SEQ ID NO: 1308487 - DNA, 18 bp, Homo sapiens
aaatcaagtatttgggaa

SEQ ID NO: 1308488 - DNA, 22 bp, Homo sapiens
aaatcggatctggggctctggg

SEQ ID NO: 1308489 - DNA, 20 bp, Homo sapiens
aaatctgacccagtgccccc

SEQ ID NO: 1308490 - DNA, 18 bp, Homo sapiens
aaatgcatgattttgtaa

SEQ ID NO: 1308491 - DNA, 20 bp, Homo sapiens
aaatgctttttatttctgca

SEQ ID NO: 1308492 - DNA, 17 bp, Homo sapiens
aaatgtatcttattcac

SEQ ID NO: 1308493 - DNA, 20 bp, Homo sapiens
aaattagaaaatgttattta

SEQ ID NO: 1308494 - DNA, 17 bp, Homo sapiens
aaattcacaaactttta

SEQ ID NO: 1308495 - DNA, 18 bp, Homo sapiens
aaattcctctttgctttg

SEQ ID NO: 1308496 - DNA, 14 bp, Homo sapiens
aaattgcaaatctt

SEQ ID NO: 1308497 - DNA, 17 bp, Homo sapiens
aaatttgattgatttga

SEQ ID NO: 1308498 - DNA, 15 bp, Homo sapiens
aaatttggttctaat

SEQ ID NO: 1308499 - DNA, 22 bp, Homo sapiens
aacaagaccaccacttcgaaac

SEQ ID NO: 1308500 - DNA, 19 bp, Homo sapiens
aacaagagcactacattca

SEQ ID NO: 1308501 - DNA, 19 bp, Homo sapiens
aacacagaaacctttttaa

SEQ ID NO: 1308502 - DNA, 14 bp, Homo sapiens
aacaccaagcacag

SEQ ID NO: 1308503 - DNA, 19 bp, Homo sapiens
aacaccaagcacagcagcc

SEQ ID NO: 1308504 - DNA, 21 bp, Homo sapiens
aacaccaagcacagcagcctg

SEQ ID NO: 1308505 - DNA, 14 bp, Homo sapiens
aacacgcacctgcc

SEQ ID NO: 1308506 - DNA, 18 bp, Homo sapiens
aacactaactatgcatgg

SEQ ID NO: 1308507 - DNA, 23 bp, Homo sapiens
aacagaatactgttaaaggaaaa

SEQ ID NO: 1308508 - DNA, 18 bp, Homo sapiens
aacagacctaatgctcct

SEQ ID NO: 1308509 - DNA, 14 bp, Homo sapiens
aacagctcaggatc

SEQ ID NO: 1308510 - DNA, 18 bp, Homo sapiens
aacaggtaatataaaaag

SEQ ID NO: 1308511 - DNA, 14 bp, Homo sapiens
aacatctattctct

SEQ ID NO: 1308512 - DNA, 14 bp, Homo sapiens
aacattttaattca

SEQ ID NO: 1308513 - DNA, 23 bp, Homo sapiens
aaccacaccacatctaagcctga

SEQ ID NO: 1308514 - DNA, 21 bp, Homo sapiens
aaccagctaagaaaagatttt

SEQ ID NO: 1308515 - DNA, 22 bp, Homo sapiens
aacccagacctgttagcagaca

SEQ ID NO: 1308516 - DNA, 16 bp, Homo sapiens
aacccagactcagaca

SEQ ID NO: 1308517 - DNA, 18 bp, Homo sapiens
aacccagactcagacatt

SEQ ID NO: 1308518 - DNA, 20 bp, Homo sapiens
aaccccggggtgcccacagg

SEQ ID NO: 1308519 - DNA, 23 bp, Homo sapiens
aacccgagtcattcgttctgtgg

SEQ ID NO: 1308520 - DNA, 18 bp, Homo sapiens
aacccttctcctcttgta

SEQ ID NO: 1308521 - DNA, 20 bp, Homo sapiens
aacccttctcctcttgtaaa

SEQ ID NO: 1308522 - DNA, 17 bp, Homo sapiens
aaccgttttgaagctac

SEQ ID NO: 1308523 - DNA, 22 bp, Homo sapiens
aacctaaatttggttctaggcc

SEQ ID NO: 1308524 - DNA, 19 bp, Homo sapiens
aacctaggagtgccccatt

SEQ ID NO: 1308525 - DNA, 11 bp, Homo sapiens
aacctcagcct

SEQ ID NO: 1308526 - DNA, 12 bp, Homo sapiens
aacctcagcctg

SEQ ID NO: 1308527 - DNA, 20 bp, Homo sapiens
aacctgggattcaggaatgt

SEQ ID NO: 1308528 - DNA, 12 bp, Homo sapiens
aacctggggggc

SEQ ID NO: 1308529 - DNA, 22 bp, Homo sapiens
aacctgtataagtggaggcact

SEQ ID NO: 1308530 - DNA, 12 bp, Homo sapiens
aacctttttaaa

SEQ ID NO: 1308531 - DNA, 12 bp, Homo sapiens
aacgatttagaa

SEQ ID NO: 1308532 - DNA, 18 bp, Homo sapiens
aacgcctcccctgcccca

SEQ ID NO: 1308533 - DNA, 18 bp, Homo sapiens
aactaaactcatttataa

SEQ ID NO: 1308534 - DNA, 17 bp, Homo sapiens
aactagaatttattcaa

SEQ ID NO: 1308535 - DNA, 22 bp, Homo sapiens
aactagaatttattcaattcct

SEQ ID NO: 1308536 - DNA, 14 bp, Homo sapiens
aactagatggtgct

SEQ ID NO: 1308537 - DNA, 18 bp, Homo sapiens
aactcaaatggggccaga

SEQ ID NO: 1308538 - DNA, 21 bp, Homo sapiens
aactcaaatggggccagatcc

SEQ ID NO: 1308539 - DNA, 22 bp, Homo sapiens
aactcaaatggggccagatcca

SEQ ID NO: 1308540 - DNA, 23 bp, Homo sapiens
aactcaaatggggccagatccag

SEQ ID NO: 1308541 - DNA, 12 bp, Homo sapiens
aactcagatcca

SEQ ID NO: 1308542 - DNA, 13 bp, Homo sapiens
aactcagatccag

SEQ ID NO: 1308543 - DNA, 15 bp, Homo sapiens
aactcagttttaact

SEQ ID NO: 1308544 - DNA, 23 bp, Homo sapiens
aactctagctgggggtgggccag

SEQ ID NO: 1308545 - DNA, 22 bp, Homo sapiens
aactctgttgcaagtgcaataa

SEQ ID NO: 1308546 - DNA, 18 bp, Homo sapiens
aactcttcacaaaatctg

SEQ ID NO: 1308547 - DNA, 17 bp, Homo sapiens
aactcttgattatccat

SEQ ID NO: 1308548 - DNA, 16 bp, Homo sapiens
aactgcatgctgctgg

SEQ ID NO: 1308549 - DNA, 18 bp, Homo sapiens
aactgccaaaatgctcta

SEQ ID NO: 1308550 - DNA, 21 bp, Homo sapiens
aacttacattgttcaattaga

SEQ ID NO: 1308551 - DNA, 17 bp, Homo sapiens
aacttccccatcttcta

SEQ ID NO: 1308552 - DNA, 17 bp, Homo sapiens
aacttcttatggaattg

SEQ ID NO: 1308553 - DNA, 24 bp, Homo sapiens
aacttcttatggaattgatttgca

SEQ ID NO: 1308554 - DNA, 21 bp, Homo sapiens
aacttggggagttaagacctg

SEQ ID NO: 1308555 - DNA, 17 bp, Homo sapiens
aacttgtattaaagaca

SEQ ID NO: 1308556 - DNA, 14 bp, Homo sapiens
aactttattaaata

SEQ ID NO: 1308557 - DNA, 23 bp, Homo sapiens
aactttattaaatacaaaacttc

SEQ ID NO: 1308558 - DNA, 11 bp, Homo sapiens
aactttcattt

SEQ ID NO: 1308559 - DNA, 18 bp, Homo sapiens
aagaaaacatctattctc

SEQ ID NO: 1308560 - DNA, 12 bp, Homo sapiens
aagaaaagattt

SEQ ID NO: 1308561 - DNA, 22 bp, Homo sapiens
aagaacggggctcttctcattt

SEQ ID NO: 1308562 - DNA, 20 bp, Homo sapiens
aagaactgtgtttcaagttc

SEQ ID NO: 1308563 - DNA, 15 bp, Homo sapiens
aagaagcccccagct

SEQ ID NO: 1308564 - DNA, 16 bp, Homo sapiens
aagacatgatttcctt

SEQ ID NO: 1308565 - DNA, 20 bp, Homo sapiens
aagacatgatttccttgaat

SEQ ID NO: 1308566 - DNA, 21 bp, Homo sapiens
aagacatgatttccttgaatg

SEQ ID NO: 1308567 - DNA, 16 bp, Homo sapiens
aagacctcacctagaa

SEQ ID NO: 1308568 - DNA, 22 bp, Homo sapiens
aagaggacataatggggtcctg

SEQ ID NO: 1308569 - DNA, 22 bp, Homo sapiens
aagaggctgaggctggcacagg

SEQ ID NO: 1308570 - DNA, 17 bp, Homo sapiens
aagatctgtcctcagcc

SEQ ID NO: 1308571 - DNA, 17 bp, Homo sapiens
aagattttaatcaagtt

SEQ ID NO: 1308572 - DNA, 18 bp, Homo sapiens
aagattttaatcaagttg

SEQ ID NO: 1308573 - DNA, 11 bp, Homo sapiens
aagcacagcag

SEQ ID NO: 1308574 - DNA, 15 bp, Homo sapiens
aagcagacagctcca

SEQ ID NO: 1308575 - DNA, 15 bp, Homo sapiens
aagcagaggaggggc

SEQ ID NO: 1308576 - DNA, 20 bp, Homo sapiens
aagcagaggaggggccgctg

SEQ ID NO: 1308577 - DNA, 18 bp, Homo sapiens
aagcaggttcccaagctc

SEQ ID NO: 1308578 - DNA, 14 bp, Homo sapiens
aagccacaggcctg

SEQ ID NO: 1308579 - DNA, 22 bp, Homo sapiens
aagccacaggcctgagatttca

SEQ ID NO: 1308580 - DNA, 23 bp, Homo sapiens
aagccaggaatttcccaggaccc

SEQ ID NO: 1308581 - DNA, 18 bp, Homo sapiens
aagcccaatattataatt

SEQ ID NO: 1308582 - DNA, 14 bp, Homo sapiens
aagcccccaccgtg

SEQ ID NO: 1308583 - DNA, 21 bp, Homo sapiens
aagcccccagctaagaacctg

SEQ ID NO: 1308584 - DNA, 22 bp, Homo sapiens
aagccgtgctcgccccagcagg

SEQ ID NO: 1308585 - DNA, 21 bp, Homo sapiens
aagcctgaaggggcgtctgtt

SEQ ID NO: 1308586 - DNA, 14 bp, Homo sapiens
aagctaatttgcat

SEQ ID NO: 1308587 - DNA, 15 bp, Homo sapiens
aagctaatttgcatt

SEQ ID NO: 1308588 - DNA, 18 bp, Homo sapiens
aagctataaattcctctt

SEQ ID NO: 1308589 - DNA, 21 bp, Homo sapiens
aagctataaattcctctttgc

SEQ ID NO: 1308590 - DNA, 15 bp, Homo sapiens
aagctcctcctccct

SEQ ID NO: 1308591 - DNA, 19 bp, Homo sapiens
aagctcctcctccctgcat

SEQ ID NO: 1308592 - DNA, 22 bp, Homo sapiens
aagctcctctccccagcccaga

SEQ ID NO: 1308593 - DNA, 23 bp, Homo sapiens
aagctcctctccccagcccagag

SEQ ID NO: 1308594 - DNA, 11 bp, Homo sapiens
aagcttagaac

SEQ ID NO: 1308595 - DNA, 16 bp, Homo sapiens
aagcttccatgattct

SEQ ID NO: 1308596 - DNA, 17 bp, Homo sapiens
aaggacttcctgtccag

SEQ ID NO: 1308597 - DNA, 15 bp, Homo sapiens
aaggatagatgctgg

SEQ ID NO: 1308598 - DNA, 12 bp, Homo sapiens
aaggcaaaattg

SEQ ID NO: 1308599 - DNA, 15 bp, Homo sapiens
aaggcaaaattgcaa

SEQ ID NO: 1308600 - DNA, 15 bp, Homo sapiens
aagggatctggtcct

SEQ ID NO: 1308601 - DNA, 15 bp, Homo sapiens
aagggccagagccag

SEQ ID NO: 1308602 - DNA, 16 bp, Homo sapiens
aagggccagagccagg

SEQ ID NO: 1308603 - DNA, 17 bp, Homo sapiens
aaggtaatttcttgtgc

SEQ ID NO: 1308604 - DNA, 13 bp, Homo sapiens
aagtatttgggaa

SEQ ID NO: 1308605 - DNA, 15 bp, Homo sapiens
aagtcaaattaataa

SEQ ID NO: 1308606 - DNA, 19 bp, Homo sapiens
aagtcaaattaataatctt

SEQ ID NO: 1308607 - DNA, 21 bp, Homo sapiens
aagtcctttttttccatcttt

SEQ ID NO: 1308608 - DNA, 14 bp, Homo sapiens
aagtcttttgttcg

SEQ ID NO: 1308609 - DNA, 13 bp, Homo sapiens
aagtgaagactgg

SEQ ID NO: 1308610 - DNA, 23 bp, Homo sapiens
aagtgcaataaatctgacccagt

SEQ ID NO: 1308611 - DNA, 23 bp, Homo sapiens
aagtgctggcaaccactaagaat

SEQ ID NO: 1308612 - DNA, 22 bp, Homo sapiens
aagtgggcttgattctgcagta

SEQ ID NO: 1308613 - DNA, 13 bp, Homo sapiens
aagtgtatttttc

SEQ ID NO: 1308614 - DNA, 23 bp, Homo sapiens
aagtgtgctttatgctgaaacag

SEQ ID NO: 1308615 - DNA, 16 bp, Homo sapiens
aagttgcagtgagctg

SEQ ID NO: 1308616 - DNA, 15 bp, Homo sapiens
aataaaactggcttt

SEQ ID NO: 1308617 - DNA, 16 bp, Homo sapiens
aataaaagtgaccttt

SEQ ID NO: 1308618 - DNA, 16 bp, Homo sapiens
aataaaggatgtgatt

SEQ ID NO: 1308619 - DNA, 16 bp, Homo sapiens
aataaatctgacccag

SEQ ID NO: 1308620 - DNA, 21 bp, Homo sapiens
aataaatttggttctaataga

SEQ ID NO: 1308621 - DNA, 23 bp, Homo sapiens
aataatcttattagggagaaaat

SEQ ID NO: 1308622 - DNA, 20 bp, Homo sapiens
aatacaaaaattagccgggc

SEQ ID NO: 1308623 - DNA, 15 bp, Homo sapiens
aatactaccttgaaa

SEQ ID NO: 1308624 - DNA, 18 bp, Homo sapiens
aatactaccttgaaaata

SEQ ID NO: 1308625 - DNA, 22 bp, Homo sapiens
aatagacactccccgaagtctt

SEQ ID NO: 1308626 - DNA, 23 bp, Homo sapiens
aatagccacatttggaatacttt

SEQ ID NO: 1308627 - DNA, 14 bp, Homo sapiens
aatatgaaaactta

SEQ ID NO: 1308628 - DNA, 14 bp, Homo sapiens
aatatggaacttac

SEQ ID NO: 1308629 - DNA, 20 bp, Homo sapiens
aatatggaacttacattgtt

SEQ ID NO: 1308630 - DNA, 13 bp, Homo sapiens
aatattaaatctg

SEQ ID NO: 1308631 - DNA, 13 bp, Homo sapiens
aatatttataaaa

SEQ ID NO: 1308632 - DNA, 13 bp, Homo sapiens
aatatttattacc

SEQ ID NO: 1308633 - DNA, 16 bp, Homo sapiens
aatatttattacctct

SEQ ID NO: 1308634 - DNA, 19 bp, Homo sapiens
aatattttctttaatgctt

SEQ ID NO: 1308635 - DNA, 11 bp, Homo sapiens
aatcagaactc

SEQ ID NO: 1308636 - DNA, 14 bp, Homo sapiens
aatcagtataaaca

SEQ ID NO: 1308637 - DNA, 17 bp, Homo sapiens
aatcagtataaacaaag

SEQ ID NO: 1308638 - DNA, 20 bp, Homo sapiens
aatccaaatggcgtctggaa

SEQ ID NO: 1308639 - DNA, 16 bp, Homo sapiens
aatcccaaatttgatt

SEQ ID NO: 1308640 - DNA, 21 bp, Homo sapiens
aatcccaaatttgattgattt

SEQ ID NO: 1308641 - DNA, 15 bp, Homo sapiens
aatctactaattcca

SEQ ID NO: 1308642 - DNA, 15 bp, Homo sapiens
aatctgacccagtgc

SEQ ID NO: 1308643 - DNA, 14 bp, Homo sapiens
aatctggagaccag

SEQ ID NO: 1308644 - DNA, 20 bp, Homo sapiens
aatcttattagggagaaaat

SEQ ID NO: 1308645 - DNA, 18 bp, Homo sapiens
aatgaacactcttttgct

SEQ ID NO: 1308646 - DNA, 22 bp, Homo sapiens
aatgcagcagggatgccctgga

SEQ ID NO: 1308647 - DNA, 16 bp, Homo sapiens
aatgcatctagattat

SEQ ID NO: 1308648 - DNA, 17 bp, Homo sapiens
aatgcatgattttgtaa

SEQ ID NO: 1308649 - DNA, 19 bp, Homo sapiens
aatgctccttgttcctaga

SEQ ID NO: 1308650 - DNA, 11 bp, Homo sapiens
aatgctctagt

SEQ ID NO: 1308651 - DNA, 20 bp, Homo sapiens
aatggagattcagttttcat

SEQ ID NO: 1308652 - DNA, 21 bp, Homo sapiens
aatgggagctgaggccacact

SEQ ID NO: 1308653 - DNA, 18 bp, Homo sapiens
aatggtaggcatttccta

SEQ ID NO: 1308654 - DNA, 22 bp, Homo sapiens
aatggtttaacttctgcctgtg

SEQ ID NO: 1308655 - DNA, 13 bp, Homo sapiens
aatgtatcttatt

SEQ ID NO: 1308656 - DNA, 17 bp, Homo sapiens
aatgtatcttattcaca

SEQ ID NO: 1308657 - DNA, 18 bp, Homo sapiens
aatgtctctgtgagactc

SEQ ID NO: 1308658 - DNA, 20 bp, Homo sapiens
aatgtgaactttattaaata

SEQ ID NO: 1308659 - DNA, 22 bp, Homo sapiens
aatgtggcaaggaaaaacaggt

SEQ ID NO: 1308660 - DNA, 18 bp, Homo sapiens
aatgttgagaatcccaaa

SEQ ID NO: 1308661 - DNA, 13 bp, Homo sapiens
aatgttttaaatt

SEQ ID NO: 1308662 - DNA, 14 bp, Homo sapiens
aattatctatacat

SEQ ID NO: 1308663 - DNA, 22 bp, Homo sapiens
aattatctatacatatctttat

SEQ ID NO: 1308664 - DNA, 19 bp, Homo sapiens
aattcctctttgctttgct

SEQ ID NO: 1308665 - DNA, 21 bp, Homo sapiens
aattgaatcagtataaacaaa

SEQ ID NO: 1308666 - DNA, 23 bp, Homo sapiens
aattgatttgcattgaacacaaa

SEQ ID NO: 1308667 - DNA, 21 bp, Homo sapiens
aattggttggagaatttaggt

SEQ ID NO: 1308668 - DNA, 17 bp, Homo sapiens
aattgtaaattgaatca

SEQ ID NO: 1308669 - DNA, 20 bp, Homo sapiens
aatttatcttgtctctgggc

SEQ ID NO: 1308670 - DNA, 17 bp, Homo sapiens
aatttattaattgcttt

SEQ ID NO: 1308671 - DNA, 21 bp, Homo sapiens
aatttattcaattcctctggg

SEQ ID NO: 1308672 - DNA, 13 bp, Homo sapiens
aatttcagactcc

SEQ ID NO: 1308673 - DNA, 12 bp, Homo sapiens
aatttcccagga

SEQ ID NO: 1308674 - DNA, 22 bp, Homo sapiens
aatttcccaggaccctgaaggg

SEQ ID NO: 1308675 - DNA, 13 bp, Homo sapiens
aatttgattgatt

SEQ ID NO: 1308676 - DNA, 17 bp, Homo sapiens
aatttgattgatttgaa

SEQ ID NO: 1308677 - DNA, 21 bp, Homo sapiens
aatttgcattaaattcacaaa

SEQ ID NO: 1308678 - DNA, 19 bp, Homo sapiens
aattttagtagagacaggg

SEQ ID NO: 1308679 - DNA, 17 bp, Homo sapiens
acaaaactacatgagaa

SEQ ID NO: 1308680 - DNA, 13 bp, Homo sapiens
aaatggggccaga

SEQ ID NO: 1308681 - DNA, 16 bp, Homo sapiens
aaatggggccagatcc

SEQ ID NO: 1308682 - DNA, 17 bp, Homo sapiens
aaatggggccagatcca

SEQ ID NO: 1308683 - DNA, 22 bp, Homo sapiens
aaatggggccagatccagcctg

SEQ ID NO: 1308684 - DNA, 19 bp, Homo sapiens
aaatgttgagaatcccaaa

SEQ ID NO: 1308685 - DNA, 13 bp, Homo sapiens
aaattaataatct

SEQ ID NO: 1308686 - DNA, 23 bp, Homo sapiens
aaattcaattgtaaattgaatca

SEQ ID NO: 1308687 - DNA, 15 bp, Homo sapiens
aaattcacaaacttt

SEQ ID NO: 1308688 - DNA, 23 bp, Homo sapiens
aaattgaatcagtataaacaaag

SEQ ID NO: 1308689 - DNA, 13 bp, Homo sapiens
aaattgcaaatct

SEQ ID NO: 1308690 - DNA, 19 bp, Homo sapiens
aaattgcaaatcttgaaat

SEQ ID NO: 1308691 - DNA, 22 bp, Homo sapiens
aaattggttggagaatttaggt

SEQ ID NO: 1308692 - DNA, 14 bp, Homo sapiens
aaatttgattgatt

SEQ ID NO: 1308693 - DNA, 15 bp, Homo sapiens
aaatttgattgattt

SEQ ID NO: 1308694 - DNA, 15 bp, Homo sapiens
aacaaaatttctatt

SEQ ID NO: 1308695 - DNA, 15 bp, Homo sapiens
aacacaaactgtaaa

SEQ ID NO: 1308696 - DNA, 16 bp, Homo sapiens
aacacaaactgtaaat

SEQ ID NO: 1308697 - DNA, 19 bp, Homo sapiens
aacacaaactgtaaataaa

SEQ ID NO: 1308698 - DNA, 17 bp, Homo sapiens
aacaccaagcacagcag

SEQ ID NO: 1308699 - DNA, 12 bp, Homo sapiens
aacactcttttg

SEQ ID NO: 1308700 - DNA, 16 bp, Homo sapiens
aacactcttttgcttt

SEQ ID NO: 1308701 - DNA, 16 bp, Homo sapiens
aacagaagcttccatt

SEQ ID NO: 1308702 - DNA, 21 bp, Homo sapiens
aacagatctggaacctcagcc

SEQ ID NO: 1308703 - DNA, 15 bp, Homo sapiens
aacaggtaatataaa

SEQ ID NO: 1308704 - DNA, 17 bp, Homo sapiens
aacatccaaccttccca

SEQ ID NO: 1308705 - DNA, 13 bp, Homo sapiens
aaccacaccacat

SEQ ID NO: 1308706 - DNA, 18 bp, Homo sapiens
aaccagtccccccaccct

SEQ ID NO: 1308707 - DNA, 22 bp, Homo sapiens
aaccagtccccccaccctcatt

SEQ ID NO: 1308708 - DNA, 12 bp, Homo sapiens
aacccagactca

SEQ ID NO: 1308709 - DNA, 13 bp, Homo sapiens
aacccagattttg

SEQ ID NO: 1308710 - DNA, 11 bp, Homo sapiens
aacccttctcc

SEQ ID NO: 1308711 - DNA, 13 bp, Homo sapiens
aacctcagcctgg

SEQ ID NO: 1308712 - DNA, 16 bp, Homo sapiens
aacctcagcctggcca

SEQ ID NO: 1308713 - DNA, 15 bp, Homo sapiens
aacctgaacctagga

SEQ ID NO: 1308714 - DNA, 15 bp, Homo sapiens
aaccttattgtacct

SEQ ID NO: 1308715 - DNA, 18 bp, Homo sapiens
aaccttattgtacctctc

SEQ ID NO: 1308716 - DNA, 15 bp, Homo sapiens
aacggattccaaaga

SEQ ID NO: 1308717 - DNA, 16 bp, Homo sapiens
aactaaactcatttat

SEQ ID NO: 1308718 - DNA, 23 bp, Homo sapiens
aactatgcatggtgccccaggac

SEQ ID NO: 1308719 - DNA, 18 bp, Homo sapiens
aactatggatcagaatag

SEQ ID NO: 1308720 - DNA, 14 bp, Homo sapiens
aactcactttcctc

SEQ ID NO: 1308721 - DNA, 14 bp, Homo sapiens
aactcagatccagg

SEQ ID NO: 1308722 - DNA, 11 bp, Homo sapiens
aactcttgatt

SEQ ID NO: 1308723 - DNA, 13 bp, Homo sapiens
aactggtatttta

SEQ ID NO: 1308724 - DNA, 22 bp, Homo sapiens
aacttacattgttcaattagaa

SEQ ID NO: 1308725 - DNA, 19 bp, Homo sapiens
aacttccaggtgttactgt

SEQ ID NO: 1308726 - DNA, 13 bp, Homo sapiens
aacttctgcctgt

SEQ ID NO: 1308727 - DNA, 16 bp, Homo sapiens
aacttcttatggaatt

SEQ ID NO: 1308728 - DNA, 15 bp, Homo sapiens
aacttggatttttga

SEQ ID NO: 1308729 - DNA, 15 bp, Homo sapiens
aactttaagaggaca

SEQ ID NO: 1308730 - DNA, 21 bp, Homo sapiens
aactttattaaatacaaaact

SEQ ID NO: 1308731 - DNA, 14 bp, Homo sapiens
aactttcatttttt

SEQ ID NO: 1308732 - DNA, 22 bp, Homo sapiens
aagaaaagattttaatcaagtt

SEQ ID NO: 1308733 - DNA, 21 bp, Homo sapiens
aagaaataaaaggaagccaaa

SEQ ID NO: 1308734 - DNA, 20 bp, Homo sapiens
aagaaccagtccccccaccc

SEQ ID NO: 1308735 - DNA, 14 bp, Homo sapiens
aagaacctggaact

SEQ ID NO: 1308736 - DNA, 23 bp, Homo sapiens
aagaacggggctcttctcatttc

SEQ ID NO: 1308737 - DNA, 20 bp, Homo sapiens
aagaactacaaacaaaattt

SEQ ID NO: 1308738 - DNA, 21 bp, Homo sapiens
aagaactacaaacaaaatttc

SEQ ID NO: 1308739 - DNA, 19 bp, Homo sapiens
aagaagcccccagctaaga

SEQ ID NO: 1308740 - DNA, 14 bp, Homo sapiens
aagaaggcaaaaat

SEQ ID NO: 1308741 - DNA, 15 bp, Homo sapiens
aagacatgatttcct

SEQ ID NO: 1308742 - DNA, 17 bp, Homo sapiens
aagacctcacctagaaa

SEQ ID NO: 1308743 - DNA, 23 bp, Homo sapiens
aagactggaagctaatttgcatt

SEQ ID NO: 1308744 - DNA, 15 bp, Homo sapiens
aagagtagaattgca

SEQ ID NO: 1308745 - DNA, 21 bp, Homo sapiens
aagataagtgtatttttcaat

SEQ ID NO: 1308746 - DNA, 19 bp, Homo sapiens
aagatctgtcctcagcctt

SEQ ID NO: 1308747 - DNA, 14 bp, Homo sapiens
aagcagaggagggg

SEQ ID NO: 1308748 - DNA, 22 bp, Homo sapiens
aagcagaggaggggccgctgcc

SEQ ID NO: 1308749 - DNA, 22 bp, Homo sapiens
aagcagcggtcagcagacaagg

SEQ ID NO: 1308750 - DNA, 12 bp, Homo sapiens
aatttattcaat

SEQ ID NO: 1308751 - DNA, 17 bp, Homo sapiens
aatttcccaggaccctg

SEQ ID NO: 1308752 - DNA, 21 bp, Homo sapiens
aatttcccaggaccctgaagg

SEQ ID NO: 1308753 - DNA, 14 bp, Homo sapiens
aatttgattgattt

SEQ ID NO: 1308754 - DNA, 15 bp, Homo sapiens
aatttgattgatttg

SEQ ID NO: 1308755 - DNA, 20 bp, Homo sapiens
aatttgattgatttgaagaa

SEQ ID NO: 1308756 - DNA, 19 bp, Homo sapiens
aatttttttcaatatttat

SEQ ID NO: 1308757 - DNA, 15 bp, Homo sapiens
acaaaactacatgag

SEQ ID NO: 1308758 - DNA, 23 bp, Homo sapiens
acaaaactacatgagaacaaaca

SEQ ID NO: 1308759 - DNA, 16 bp, Homo sapiens
acaaacaaaatttcta

SEQ ID NO: 1308760 - DNA, 13 bp, Homo sapiens
acaaacttttata

SEQ ID NO: 1308761 - DNA, 12 bp, Homo sapiens
acaaagcagcca

SEQ ID NO: 1308762 - DNA, 13 bp, Homo sapiens
acaaagcagccac

SEQ ID NO: 1308763 - DNA, 20 bp, Homo sapiens
acaaagcccaagggatctgg

SEQ ID NO: 1308764 - DNA, 23 bp, Homo sapiens
acaaagttactaggtaacttcat

SEQ ID NO: 1308765 - DNA, 17 bp, Homo sapiens
acaaatactcttaggaa

SEQ ID NO: 1308766 - DNA, 22 bp, Homo sapiens
acaactgcctcgaaacacagaa

SEQ ID NO: 1308767 - DNA, 16 bp, Homo sapiens
acaaggatagatgctg

SEQ ID NO: 1308768 - DNA, 13 bp, Homo sapiens
acaagtggtggta

SEQ ID NO: 1308769 - DNA, 19 bp, Homo sapiens
acaatgtgaactttattaa

SEQ ID NO: 1308770 - DNA, 22 bp, Homo sapiens
acaatgtgaactttattaaata

SEQ ID NO: 1308771 - DNA, 19 bp, Homo sapiens
acacaaggatagatgctgg

SEQ ID NO: 1308772 - DNA, 20 bp, Homo sapiens
acacagaaaatgttgagaat

SEQ ID NO: 1308773 - DNA, 13 bp, Homo sapiens
acacagaaacctt

SEQ ID NO: 1308774 - DNA, 21 bp, Homo sapiens
acacagaaacctttttaaaaa

SEQ ID NO: 1308775 - DNA, 13 bp, Homo sapiens
acacaggccctcc

SEQ ID NO: 1308776 - DNA, 11 bp, Homo sapiens
acacagggcag

SEQ ID NO: 1308777 - DNA, 18 bp, Homo sapiens
acaccaagcacagcagcc

SEQ ID NO: 1308778 - DNA, 17 bp, Homo sapiens
acaccctcaacctcttc

SEQ ID NO: 1308779 - DNA, 13 bp, Homo sapiens
acacgcacctgcc

SEQ ID NO: 1308780 - DNA, 17 bp, Homo sapiens
acactatggtatttgag

SEQ ID NO: 1308781 - DNA, 18 bp, Homo sapiens
acactatggtatttgagt

SEQ ID NO: 1308782 - DNA, 19 bp, Homo sapiens
acactatggtatttgagtg

SEQ ID NO: 1308783 - DNA, 20 bp, Homo sapiens
acactgagaatgtaagaact

SEQ ID NO: 1308784 - DNA, 22 bp, Homo sapiens
acactgatgcttagatgttcca

SEQ ID NO: 1308785 - DNA, 22 bp, Homo sapiens
acagactcacaacctgaaccta

SEQ ID NO: 1308786 - DNA, 21 bp, Homo sapiens
actcagggcagcgccaggctg

SEQ ID NO: 1308787 - DNA, 22 bp, Homo sapiens
actcagggcagcgccaggctga

SEQ ID NO: 1308788 - DNA, 15 bp, Homo sapiens
actcagttttaacta

SEQ ID NO: 1308789 - DNA, 13 bp, Homo sapiens
actcccattcctg

SEQ ID NO: 1308790 - DNA, 22 bp, Homo sapiens
actcccattcctgaagaaccag

SEQ ID NO: 1308791 - DNA, 17 bp, Homo sapiens
actccccgaagtctttt

SEQ ID NO: 1308792 - DNA, 17 bp, Homo sapiens
actcgagaactttcatt

SEQ ID NO: 1308793 - DNA, 14 bp, Homo sapiens
actctcctcatctc

SEQ ID NO: 1308794 - DNA, 15 bp, Homo sapiens
actctcctcatctct

SEQ ID NO: 1308795 - DNA, 15 bp, Homo sapiens
actctggcaaagctt

SEQ ID NO: 1308796 - DNA, 20 bp, Homo sapiens
actctgttgcaagtgcaata

SEQ ID NO: 1308797 - DNA, 19 bp, Homo sapiens
actcttagatggattctcc

SEQ ID NO: 1308798 - DNA, 14 bp, Homo sapiens
actcttttgcttta

SEQ ID NO: 1308799 - DNA, 12 bp, Homo sapiens
actgaccagaac

SEQ ID NO: 1308800 - DNA, 13 bp, Homo sapiens
actgaggaagaac

SEQ ID NO: 1308801 - DNA, 22 bp, Homo sapiens
actgaggaagaacggggctctt

SEQ ID NO: 1308802 - DNA, 11 bp, Homo sapiens
actgatgctgc

SEQ ID NO: 1308803 - DNA, 15 bp, Homo sapiens
actgatgctgcccct

SEQ ID NO: 1308804 - DNA, 15 bp, Homo sapiens
actgatgcttagatg

SEQ ID NO: 1308805 - DNA, 13 bp, Homo sapiens
actgcatgctgct

SEQ ID NO: 1308806 - DNA, 18 bp, Homo sapiens
actgccaaaatgctctag

SEQ ID NO: 1308807 - DNA, 19 bp, Homo sapiens
actgcccatggacaggctg

SEQ ID NO: 1308808 - DNA, 18 bp, Homo sapiens
actgctactgtaatttta

SEQ ID NO: 1308809 - DNA, 18 bp, Homo sapiens
actggatgcagaaacagt

SEQ ID NO: 1308810 - DNA, 12 bp, Homo sapiens
actggcaaaagg

SEQ ID NO: 1308811 - DNA, 12 bp, Homo sapiens
actggggcctcc

SEQ ID NO: 1308812 - DNA, 15 bp, Homo sapiens
actgtcactcattgc

SEQ ID NO: 1308813 - DNA, 23 bp, Homo sapiens
actgtcactcattgctgagcctc

SEQ ID NO: 1308814 - DNA, 24 bp, Homo sapiens
actgtcactcattgctgagcctct

SEQ ID NO: 1308815 - DNA, 14 bp, Homo sapiens
actgtctttcctag

SEQ ID NO: 1308816 - DNA, 15 bp, Homo sapiens
actgtgaaggaccct

SEQ ID NO: 1308817 - DNA, 16 bp, Homo sapiens
actgtgaaggaccctt

SEQ ID NO: 1308818 - DNA, 22 bp, Homo sapiens
actgtgtgtgtgaatgaacact

SEQ ID NO: 1308819 - DNA, 19 bp, Homo sapiens
actgtgtgttgccacagga

SEQ ID NO: 1308820 - DNA, 18 bp, Homo sapiens
acttaatactaccttgaa

SEQ ID NO: 1308821 - DNA, 19 bp, Homo sapiens
acttaatactaccttgaaa

SEQ ID NO: 1308822 - DNA, 14 bp, Homo sapiens
acttcatattgctg

SEQ ID NO: 1308823 - DNA, 22 bp, Homo sapiens
acttcatattgctgagagaaat

SEQ ID NO: 1308824 - DNA, 15 bp, Homo sapiens
acttcattcttgaaa

SEQ ID NO: 1308825 - DNA, 19 bp, Homo sapiens
acttcattcttgaaagctg

SEQ ID NO: 1308826 - DNA, 22 bp, Homo sapiens
acttccttgagacacggagccc

SEQ ID NO: 1308827 - DNA, 16 bp, Homo sapiens
acttcttatggaattg

SEQ ID NO: 1308828 - DNA, 17 bp, Homo sapiens
acttcttatggaattga

SEQ ID NO: 1308829 - DNA, 20 bp, Homo sapiens
acttcttatggaattgattt

SEQ ID NO: 1308830 - DNA, 13 bp, Homo sapiens
acttcttgaaggt

SEQ ID NO: 1308831 - DNA, 16 bp, Homo sapiens
acttcttgaaggtgct

SEQ ID NO: 1308832 - DNA, 15 bp, Homo sapiens
acttgaagggccaga

SEQ ID NO: 1308833 - DNA, 21 bp, Homo sapiens
acttgaagggccagagccagg

SEQ ID NO: 1308834 - DNA, 21 bp, Homo sapiens
acttggacttgtcctcagcag

SEQ ID NO: 1308835 - DNA, 21 bp, Homo sapiens
acttggggagttaagacctgg

SEQ ID NO: 1308836 - DNA, 17 bp, Homo sapiens
acttgtgattatttatt

SEQ ID NO: 1308837 - DNA, 15 bp, Homo sapiens
actttagggctgtaa

SEQ ID NO: 1308838 - DNA, 23 bp, Homo sapiens
actttagggctgtaaaatgcatg

SEQ ID NO: 1308839 - DNA, 20 bp, Homo sapiens
actttcatttttttccaggc

SEQ ID NO: 1308840 - DNA, 19 bp, Homo sapiens
actttcctcctgaggcttt

SEQ ID NO: 1308841 - DNA, 12 bp, Homo sapiens
actttgggaggc

SEQ ID NO: 1308842 - DNA, 11 bp, Homo sapiens
actttttacaa

SEQ ID NO: 1308843 - DNA, 20 bp, Homo sapiens
agaaaagattttaatcaagt

SEQ ID NO: 1308844 - DNA, 18 bp, Homo sapiens
agaaaatgttatttaaca

SEQ ID NO: 1308845 - DNA, 19 bp, Homo sapiens
agaaaatgttatttaacag

SEQ ID NO: 1308846 - DNA, 14 bp, Homo sapiens
agaaaggggagccc

SEQ ID NO: 1308847 - DNA, 15 bp, Homo sapiens
agaaaggggagccca

SEQ ID NO: 1308848 - DNA, 23 bp, Homo sapiens
agaaagtgtgctttatgctgaaa

SEQ ID NO: 1308849 - DNA, 17 bp, Homo sapiens
agaaataaaaggaagcc

SEQ ID NO: 1308850 - DNA, 19 bp, Homo sapiens
agaaataaaaggaagccaa

SEQ ID NO: 1308851 - DNA, 18 bp, Homo sapiens
agaaataaagtttgctta

SEQ ID NO: 1308852 - DNA, 16 bp, Homo sapiens
agaaatatggaactta

SEQ ID NO: 1308853 - DNA, 14 bp, Homo sapiens
agaaatatggacac

SEQ ID NO: 1308854 - DNA, 20 bp, Homo sapiens
agaaatgggacttaactcct

SEQ ID NO: 1308855 - DNA, 17 bp, Homo sapiens
agaacaaccaaaatctt

SEQ ID NO: 1308856 - DNA, 16 bp, Homo sapiens
agaacattttaattca

SEQ ID NO: 1308857 - DNA, 16 bp, Homo sapiens
agaaccagtcccccca

SEQ ID NO: 1308858 - DNA, 19 bp, Homo sapiens
agaaccagtccccccaccc

SEQ ID NO: 1308859 - DNA, 20 bp, Homo sapiens
agaaccagtccccccaccct

SEQ ID NO: 1308860 - DNA, 20 bp, Homo sapiens
agaacctggaacttggggag

SEQ ID NO: 1308861 - DNA, 21 bp, Homo sapiens
agaacctggaacttggggagt

SEQ ID NO: 1308862 - DNA, 19 bp, Homo sapiens
agaacggggctcttctcat

SEQ ID NO: 1308863 - DNA, 21 bp, Homo sapiens
agaacggggctcttctcattt

SEQ ID NO: 1308864 - DNA, 18 bp, Homo sapiens
agaactaaactcatttat

SEQ ID NO: 1308865 - DNA, 18 bp, Homo sapiens
agaactacaaacaaaatt

SEQ ID NO: 1308866 - DNA, 22 bp, Homo sapiens
agaactacaaacaaaatttcta

SEQ ID NO: 1308867 - DNA, 16 bp, Homo sapiens
agaagccacaggcctg

SEQ ID NO: 1308868 - DNA, 12 bp, Homo sapiens
agaagccaggaa

SEQ ID NO: 1308869 - DNA, 22 bp, Homo sapiens
agaagccaggaatttcccagga

SEQ ID NO: 1308870 - DNA, 12 bp, Homo sapiens
agaagcccccag

SEQ ID NO: 1308871 - DNA, 23 bp, Homo sapiens
agaagcccccagctaagaacctg

SEQ ID NO: 1308872 - DNA, 13 bp, Homo sapiens
gaatatttattac

SEQ ID NO: 1308873 - DNA, 17 bp, Homo sapiens
gaatatttattacctct

SEQ ID NO: 1308874 - DNA, 12 bp, Homo sapiens
gaatccaaactt

SEQ ID NO: 1308875 - DNA, 13 bp, Homo sapiens
gaatccaaacttg

SEQ ID NO: 1308876 - DNA, 22 bp, Homo sapiens
gaatctacccccagatccaagc

SEQ ID NO: 1308877 - DNA, 16 bp, Homo sapiens
gaatctggagaccagg

SEQ ID NO: 1308878 - DNA, 18 bp, Homo sapiens
gaatctggagaccaggga

SEQ ID NO: 1308879 - DNA, 22 bp, Homo sapiens
gaatctggagaccagggagcct

SEQ ID NO: 1308880 - DNA, 21 bp, Homo sapiens
gaatgctgcaggacttgagaa

SEQ ID NO: 1308881 - DNA, 17 bp, Homo sapiens
gaatgctgtacatctat

SEQ ID NO: 1308882 - DNA, 16 bp, Homo sapiens
gaatgtatttatttgg

SEQ ID NO: 1308883 - DNA, 17 bp, Homo sapiens
gaatgttacattgtttg

SEQ ID NO: 1308884 - DNA, 22 bp, Homo sapiens
gaattatctatacatatcttta

SEQ ID NO: 1308885 - DNA, 18 bp, Homo sapiens
gaattcaaactggggcct

SEQ ID NO: 1308886 - DNA, 22 bp, Homo sapiens
gaattcaaactggggcctccag

SEQ ID NO: 1308887 - DNA, 18 bp, Homo sapiens
gaattgaggggattaata

SEQ ID NO: 1308888 - DNA, 13 bp, Homo sapiens
gaattgatttgca

SEQ ID NO: 1308889 - DNA, 16 bp, Homo sapiens
gaatttaggtttttat

SEQ ID NO: 1308890 - DNA, 19 bp, Homo sapiens
gacaaggagaagagcaagg

SEQ ID NO: 1308891 - DNA, 15 bp, Homo sapiens
gacaagtggactcag

SEQ ID NO: 1308892 - DNA, 22 bp, Homo sapiens
gacacaggtctttcctaaggct

SEQ ID NO: 1308893 - DNA, 16 bp, Homo sapiens
gacacatatgaggggg

SEQ ID NO: 1308894 - DNA, 14 bp, Homo sapiens
gacacccaggactt

SEQ ID NO: 1308895 - DNA, 13 bp, Homo sapiens
gacaccctcaacc

SEQ ID NO: 1308896 - DNA, 16 bp, Homo sapiens
gacactccccgaagtc

SEQ ID NO: 1308897 - DNA, 18 bp, Homo sapiens
gacagaggccccagcctc

SEQ ID NO: 1308898 - DNA, 15 bp, Homo sapiens
gacagccccaccctg

SEQ ID NO: 1308899 - DNA, 12 bp, Homo sapiens
gacagctccacc

SEQ ID NO: 1308900 - DNA, 21 bp, Homo sapiens
gacagctgctcctagagggag

SEQ ID NO: 1308901 - DNA, 12 bp, Homo sapiens
gacagctttgct

SEQ ID NO: 1308902 - DNA, 16 bp, Homo sapiens
gacagctttgctgctg

SEQ ID NO: 1308903 - DNA, 22 bp, Homo sapiens
gacaggctggctccagatgcag

SEQ ID NO: 1308904 - DNA, 17 bp, Homo sapiens
gacagtatcactgtctt

SEQ ID NO: 1308905 - DNA, 19 bp, Homo sapiens
gacagttgggtgagaacaa

SEQ ID NO: 1308906 - DNA, 17 bp, Homo sapiens
gacatacttgaagggcc

SEQ ID NO: 1308907 - DNA, 20 bp, Homo sapiens
gacatacttgaagggccaga

SEQ ID NO: 1308908 - DNA, 14 bp, Homo sapiens
gacatctggaatct

SEQ ID NO: 1308909 - DNA, 22 bp, Homo sapiens
gacatctggaatctggagacca

SEQ ID NO: 1308910 - DNA, 16 bp, Homo sapiens
gacatgattccttcct

SEQ ID NO: 1308911 - DNA, 18 bp, Homo sapiens
gacatgcggtagccagca

SEQ ID NO: 1308912 - DNA, 14 bp, Homo sapiens
gacattcacctgcc

SEQ ID NO: 1308913 - DNA, 21 bp, Homo sapiens
gacattcacctgccccaactc

SEQ ID NO: 1308914 - DNA, 14 bp, Homo sapiens
gacattgcgtttga

SEQ ID NO: 1308915 - DNA, 14 bp, Homo sapiens
ctgtatatactttt

SEQ ID NO: 1308916 - DNA, 22 bp, Homo sapiens
ctgtatatttgtgatagcactt

SEQ ID NO: 1308917 - DNA, 17 bp, Homo sapiens
ctgtcaaggctgcttag

SEQ ID NO: 1308918 - DNA, 19 bp, Homo sapiens
ctgtcaaggctgcttagaa

SEQ ID NO: 1308919 - DNA, 21 bp, Homo sapiens
ctgtcactcattgctgagcct

SEQ ID NO: 1308920 - DNA, 18 bp, Homo sapiens
ctgtcagtcacagccacc

SEQ ID NO: 1308921 - DNA, 14 bp, Homo sapiens
ctgtcatctgtgca

SEQ ID NO: 1308922 - DNA, 15 bp, Homo sapiens
ctgtcatctgtgcac

SEQ ID NO: 1308923 - DNA, 14 bp, Homo sapiens
ctgtccccttctct

SEQ ID NO: 1308924 - DNA, 22 bp, Homo sapiens
ctgtcctcagccttgccagaga

SEQ ID NO: 1308925 - DNA, 15 bp, Homo sapiens
ctgtcctcaggtggc

SEQ ID NO: 1308926 - DNA, 18 bp, Homo sapiens
ctgtcctcaggtggccat

SEQ ID NO: 1308927 - DNA, 13 bp, Homo sapiens
ctgtcctgggcct

SEQ ID NO: 1308928 - DNA, 17 bp, Homo sapiens
ctgtctagagagggagg

SEQ ID NO: 1308929 - DNA, 19 bp, Homo sapiens
ctgtcttcatagcagattt

SEQ ID NO: 1308930 - DNA, 16 bp, Homo sapiens
ctgtgaacgatttaga

SEQ ID NO: 1308931 - DNA, 15 bp, Homo sapiens
ctgtgacccccagct

SEQ ID NO: 1308932 - DNA, 16 bp, Homo sapiens
ctgtgacccccagctc

SEQ ID NO: 1308933 - DNA, 20 bp, Homo sapiens
ctgtgagactcgagaacttt

SEQ ID NO: 1308934 - DNA, 19 bp, Homo sapiens
ctgtgcacaaaacccagac

SEQ ID NO: 1308935 - DNA, 14 bp, Homo sapiens
ctgtgcactgccca

SEQ ID NO: 1308936 - DNA, 19 bp, Homo sapiens
ctgtgtgtccaaaactgcc

SEQ ID NO: 1308937 - DNA, 22 bp, Homo sapiens
ctgtgtgtccaaaactgcctca

SEQ ID NO: 1308938 - DNA, 14 bp, Homo sapiens
ctgtgtgtgtgaat

SEQ ID NO: 1308939 - DNA, 16 bp, Homo sapiens
ctgtgtgtgtgaatga

SEQ ID NO: 1308940 - DNA, 23 bp, Homo sapiens
ctgtgtgtgtgaatgaacactct

SEQ ID NO: 1308941 - DNA, 22 bp, Homo sapiens
ctgtgtgttgccacaggacaca

SEQ ID NO: 1308942 - DNA, 13 bp, Homo sapiens
ctgtgttttaata

SEQ ID NO: 1308943 - DNA, 13 bp, Homo sapiens
ctgttagcagaca

SEQ ID NO: 1308944 - DNA, 15 bp, Homo sapiens
ctgttagcagacagg

SEQ ID NO: 1308945 - DNA, 14 bp, Homo sapiens
ctgttccccagaga

SEQ ID NO: 1308946 - DNA, 17 bp, Homo sapiens
ctgttcccccttcacaa

SEQ ID NO: 1308947 - DNA, 23 bp, Homo sapiens
ctgttcccccttcacaaagccca

SEQ ID NO: 1308948 - DNA, 22 bp, Homo sapiens
ctgttgacacaggtctttccta

SEQ ID NO: 1308949 - DNA, 20 bp, Homo sapiens
ctgttgagctgttttccctg

SEQ ID NO: 1308950 - DNA, 17 bp, Homo sapiens
ctgtttagcagcagcct

SEQ ID NO: 1308951 - DNA, 13 bp, Homo sapiens
ctgttttccctga

SEQ ID NO: 1308952 - DNA, 12 bp, Homo sapiens
ctgttttcctcc

SEQ ID NO: 1308953 - DNA, 14 bp, Homo sapiens
ctgttttcctccct

SEQ ID NO: 1308954 - DNA, 17 bp, Homo sapiens
ctgttttcctcccttct

SEQ ID NO: 1308955 - DNA, 19 bp, Homo sapiens
ctgttttcctcccttctgc

SEQ ID NO: 1308956 - DNA, 20 bp, Homo sapiens
ctgttttcctcccttctgct

SEQ ID NO: 1308957 - DNA, 23 bp, Homo sapiens
ctgttttcctcccttctgctact

SEQ ID NO: 1308958 - DNA, 16 bp, Homo sapiens
ctgtttttaagctgtt

SEQ ID NO: 1308959 - DNA, 19 bp, Homo sapiens
ctgtttttaagctgtttcc

SEQ ID NO: 1308960 - DNA, 18 bp, Homo sapiens
cttaatccagctgatgag

SEQ ID NO: 1308961 - DNA, 16 bp, Homo sapiens
cttagaacattttaat

SEQ ID NO: 1308962 - DNA, 14 bp, Homo sapiens
cttagctcccctcc

SEQ ID NO: 1308963 - DNA, 17 bp, Homo sapiens
cttaggaagagaaacca

SEQ ID NO: 1308964 - DNA, 12 bp, Homo sapiens
cttaggccttcc

SEQ ID NO: 1308965 - DNA, 16 bp, Homo sapiens
cttatggaattgattt

SEQ ID NO: 1308966 - DNA, 19 bp, Homo sapiens
cttatggaattgatttgca

SEQ ID NO: 1308967 - DNA, 23 bp, Homo sapiens
cttatggaattgatttgcattga

SEQ ID NO: 1308968 - DNA, 15 bp, Homo sapiens
cttattgtacctctc

SEQ ID NO: 1308969 - DNA, 17 bp, Homo sapiens
cttcacaaagcccaagg

SEQ ID NO: 1308970 - DNA, 23 bp, Homo sapiens
cttcacaaagcccaagggatctg

SEQ ID NO: 1308971 - DNA, 15 bp, Homo sapiens
cttcagccctcaccc

SEQ ID NO: 1308972 - DNA, 16 bp, Homo sapiens
cttcagccctcacccc

SEQ ID NO: 1308973 - DNA, 17 bp, Homo sapiens
cttcagccctcacccct

SEQ ID NO: 1308974 - DNA, 18 bp, Homo sapiens
cttcatagcagattttaa

SEQ ID NO: 1308975 - DNA, 15 bp, Homo sapiens
cttcatcgaatctac

SEQ ID NO: 1308976 - DNA, 20 bp, Homo sapiens
cttcatctcccacctagcag

SEQ ID NO: 1308977 - DNA, 13 bp, Homo sapiens
cttcatggatggg

SEQ ID NO: 1308978 - DNA, 20 bp, Homo sapiens
cttcattcttgaaagctgtg

SEQ ID NO: 1308979 - DNA, 16 bp, Homo sapiens
cttccaggtgttactg

SEQ ID NO: 1308980 - DNA, 20 bp, Homo sapiens
cttccaggtgttactgtaat

SEQ ID NO: 1308981 - DNA, 17 bp, Homo sapiens
cttccctcaccttggca

SEQ ID NO: 1308982 - DNA, 15 bp, Homo sapiens
cttcctctctccaga

SEQ ID NO: 1308983 - DNA, 16 bp, Homo sapiens
cttcctctctccagat

SEQ ID NO: 1308984 - DNA, 17 bp, Homo sapiens
cttcctggagcccagag

SEQ ID NO: 1308985 - DNA, 15 bp, Homo sapiens
cttcctgtgtgtcca

SEQ ID NO: 1308986 - DNA, 15 bp, Homo sapiens
cttcgggctgtgccc

SEQ ID NO: 1308987 - DNA, 21 bp, Homo sapiens
cttctaaaggtgttgtccctt

SEQ ID NO: 1308988 - DNA, 22 bp, Homo sapiens
cttctaaaggtgttgtcccttc

SEQ ID NO: 1308989 - DNA, 15 bp, Homo sapiens
cttctcaagatactg

SEQ ID NO: 1308990 - DNA, 14 bp, Homo sapiens
cttctcatttcacc

SEQ ID NO: 1308991 - DNA, 15 bp, Homo sapiens
cttctcctcttgtaa

SEQ ID NO: 1308992 - DNA, 23 bp, Homo sapiens
cttctcctcttgtaaataaagcc

SEQ ID NO: 1308993 - DNA, 16 bp, Homo sapiens
cttctctcatctctta

SEQ ID NO: 1308994 - DNA, 18 bp, Homo sapiens
cttctgcctgtggaactg

SEQ ID NO: 1308995 - DNA, 15 bp, Homo sapiens
cttctgctcagctct

SEQ ID NO: 1308996 - DNA, 18 bp, Homo sapiens
cttctgctcagctctggg

SEQ ID NO: 1308997 - DNA, 12 bp, Homo sapiens
cttctggctcaa

SEQ ID NO: 1308998 - DNA, 16 bp, Homo sapiens
cttcttttgattatgt

SEQ ID NO: 1308999 - DNA, 14 bp, Homo sapiens
cttgaagggccaga

SEQ ID NO: 1309000 - DNA, 16 bp, Homo sapiens
cttgaagggccagagc

SEQ ID NO: 1309001 - DNA, 14 bp, Homo sapiens
cttgaaggtgctga

SEQ ID NO: 1309002 - DNA, 21 bp, Homo sapiens
cttgattctgcagtaaatctt

SEQ ID NO: 1309003 - DNA, 17 bp, Homo sapiens
cttgcctctgtcccctt

SEQ ID NO: 1309004 - DNA, 23 bp, Homo sapiens
cttgcctctgtccccttctctca

SEQ ID NO: 1309005 - DNA, 23 bp, Homo sapiens
cttgctctgcttgacaacatctg

SEQ ID NO: 1309006 - DNA, 17 bp, Homo sapiens
cttggcctgatcagacc

SEQ ID NO: 1309007 - DNA, 23 bp, Homo sapiens
cttggggagttaagacctggcag

SEQ ID NO: 1309008 - DNA, 14 bp, Homo sapiens
cttggggcttccta

SEQ ID NO: 1309009 - DNA, 12 bp, Homo sapiens
cttgtaaataaa

SEQ ID NO: 1309010 - DNA, 16 bp, Homo sapiens
cttgtaaataaagccc

SEQ ID NO: 1309011 - DNA, 19 bp, Homo sapiens
cttgtaaataaagccctgg

SEQ ID NO: 1309012 - DNA, 14 bp, Homo sapiens
cttgtctctgggct

SEQ ID NO: 1309013 - DNA, 15 bp, Homo sapiens
cttgttatttataac

SEQ ID NO: 1309014 - DNA, 12 bp, Homo sapiens
cttgttcctaga

SEQ ID NO: 1309015 - DNA, 12 bp, Homo sapiens
ctttaatgcatc

SEQ ID NO: 1309016 - DNA, 15 bp, Homo sapiens
ctttatgctgaaaca

SEQ ID NO: 1309017 - DNA, 21 bp, Homo sapiens
ctttattaaatacaaaacttc

SEQ ID NO: 1309018 - DNA, 22 bp, Homo sapiens
ctttattaccccctccttcaga

SEQ ID NO: 1309019 - DNA, 20 bp, Homo sapiens
ctttcatttttttccaggct

SEQ ID NO: 1309020 - DNA, 14 bp, Homo sapiens
ctttcctccttcca

SEQ ID NO: 1309021 - DNA, 15 bp, Homo sapiens
ctttctacaatgtga

SEQ ID NO: 1309022 - DNA, 20 bp, Homo sapiens
ctttctacaatgtgaacttt

SEQ ID NO: 1309023 - DNA, 14 bp, Homo sapiens
ctttctcccctgcc

SEQ ID NO: 1309024 - DNA, 14 bp, Homo sapiens
ctttctgctcagct

SEQ ID NO: 1309025 - DNA, 18 bp, Homo sapiens
ctttctgtatatactttt

SEQ ID NO: 1309026 - DNA, 21 bp, Homo sapiens
ctttcttgatcaacatctttt

SEQ ID NO: 1309027 - DNA, 21 bp, Homo sapiens
ctttgatgattaattcacctt

SEQ ID NO: 1309028 - DNA, 19 bp, Homo sapiens
ctttgattcatagtaactt

SEQ ID NO: 1309029 - DNA, 21 bp, Homo sapiens
ctttgattcatagtaacttct

SEQ ID NO: 1309030 - DNA, 14 bp, Homo sapiens
ctttgattctcctt

SEQ ID NO: 1309031 - DNA, 15 bp, Homo sapiens
ctttgattctccttc

SEQ ID NO: 1309032 - DNA, 12 bp, Homo sapiens
ctttgctttctg

SEQ ID NO: 1309033 - DNA, 19 bp, Homo sapiens
ctttgctttctgctcagct

SEQ ID NO: 1309034 - DNA, 14 bp, Homo sapiens
gatatatacatagc

SEQ ID NO: 1309035 - DNA, 14 bp, Homo sapiens
gatcaacatctttt

SEQ ID NO: 1309036 - DNA, 11 bp, Homo sapiens
gatcaggtcat

SEQ ID NO: 1309037 - DNA, 13 bp, Homo sapiens
gatccaaaagaag

SEQ ID NO: 1309038 - DNA, 23 bp, Homo sapiens
gatccaaaagaagcccccagcta

SEQ ID NO: 1309039 - DNA, 12 bp, Homo sapiens
gatccagcctgg

SEQ ID NO: 1309040 - DNA, 12 bp, Homo sapiens
gatccagggaca

SEQ ID NO: 1309041 - DNA, 13 bp, Homo sapiens
gatccctcccccc

SEQ ID NO: 1309042 - DNA, 23 bp, Homo sapiens
gatccctcccccccatgcactgt

SEQ ID NO: 1309043 - DNA, 17 bp, Homo sapiens
gatcgaaccgttttgaa

SEQ ID NO: 1309044 - DNA, 17 bp, Homo sapiens
gatctgacatgattcct

SEQ ID NO: 1309045 - DNA, 14 bp, Homo sapiens
gatctggaacccag

SEQ ID NO: 1309046 - DNA, 15 bp, Homo sapiens
gatctggaacccaga

SEQ ID NO: 1309047 - DNA, 20 bp, Homo sapiens
gatctggaacccagactcag

SEQ ID NO: 1309048 - DNA, 12 bp, Homo sapiens
gatctggaacct

SEQ ID NO: 1309049 - DNA, 16 bp, Homo sapiens
gatctggaacctcagc

SEQ ID NO: 1309050 - DNA, 17 bp, Homo sapiens
gatctggaacctcagcc

SEQ ID NO: 1309051 - DNA, 19 bp, Homo sapiens
gatctggaacctcagcctg

SEQ ID NO: 1309052 - DNA, 15 bp, Homo sapiens
gatctggtcctaccc

SEQ ID NO: 1309053 - DNA, 16 bp, Homo sapiens
gatctggtcctaccca

SEQ ID NO: 1309054 - DNA, 16 bp, Homo sapiens
gatctgtcctcagcct

SEQ ID NO: 1309055 - DNA, 19 bp, Homo sapiens
gatctgttttgaaggcaaa

SEQ ID NO: 1309056 - DNA, 11 bp, Homo sapiens
gatctttgtgg

SEQ ID NO: 1309057 - DNA, 16 bp, Homo sapiens
gatctttgtggccaag

SEQ ID NO: 1309058 - DNA, 23 bp, Homo sapiens
gatgaagttttacattgttgagc

SEQ ID NO: 1309059 - DNA, 15 bp, Homo sapiens
gatgcagggcagtca

SEQ ID NO: 1309060 - DNA, 19 bp, Homo sapiens
gatgccaatattaaatctg

SEQ ID NO: 1309061 - DNA, 15 bp, Homo sapiens
gatgccctggaggtg

SEQ ID NO: 1309062 - DNA, 21 bp, Homo sapiens
gatgctgacattcacctgccc

SEQ ID NO: 1309063 - DNA, 12 bp, Homo sapiens
gatgctgcccct

SEQ ID NO: 1309064 - DNA, 13 bp, Homo sapiens
gatgctgcccctc

SEQ ID NO: 1309065 - DNA, 15 bp, Homo sapiens
gatggcaacagatct

SEQ ID NO: 1309066 - DNA, 17 bp, Homo sapiens
gatggcaacagatctgg

SEQ ID NO: 1309067 - DNA, 21 bp, Homo sapiens
gatggcaacagatctggaacc

SEQ ID NO: 1309068 - DNA, 22 bp, Homo sapiens
gatggcaacagatctggaacct

SEQ ID NO: 1309069 - DNA, 20 bp, Homo sapiens
gatgggagggaggctcaggt

SEQ ID NO: 1309070 - DNA, 19 bp, Homo sapiens
gatgggggaactcagatcc

SEQ ID NO: 1309071 - DNA, 17 bp, Homo sapiens
gatggtgctgagaagct

SEQ ID NO: 1309072 - DNA, 14 bp, Homo sapiens
gatgtgaagccaat

SEQ ID NO: 1309073 - DNA, 15 bp, Homo sapiens
gatgtgattgtggaa

SEQ ID NO: 1309074 - DNA, 16 bp, Homo sapiens
gatgtgattgtggaat

SEQ ID NO: 1309075 - DNA, 19 bp, Homo sapiens
gatgtttccagacttcctt

SEQ ID NO: 1309076 - DNA, 19 bp, Homo sapiens
gattcatagtaacttctta

SEQ ID NO: 1309077 - DNA, 23 bp, Homo sapiens
gattccaaagagtagaattgcat

SEQ ID NO: 1309078 - DNA, 15 bp, Homo sapiens
gattccttcctgttc

SEQ ID NO: 1309079 - DNA, 21 bp, Homo sapiens
gattctatttatatgtacatg

SEQ ID NO: 1309080 - DNA, 16 bp, Homo sapiens
gattctgcagtaaatc

SEQ ID NO: 1309081 - DNA, 18 bp, Homo sapiens
gattctgcagtaaatctt

SEQ ID NO: 1309082 - DNA, 17 bp, Homo sapiens
ctatttatatgtacatg

SEQ ID NO: 1309083 - DNA, 17 bp, Homo sapiens
ctattttggattgtata

SEQ ID NO: 1309084 - DNA, 20 bp, Homo sapiens
ctcaacctcttctggctcaa

SEQ ID NO: 1309085 - DNA, 16 bp, Homo sapiens
ctcaacgtattgtttc

SEQ ID NO: 1309086 - DNA, 22 bp, Homo sapiens
ctcaagaaataaaaggaagcca

SEQ ID NO: 1309087 - DNA, 17 bp, Homo sapiens
ctcaagatactgctact

SEQ ID NO: 1309088 - DNA, 21 bp, Homo sapiens
ctcaagatactgctactgtaa

SEQ ID NO: 1309089 - DNA, 16 bp, Homo sapiens
ctcaagcgattctcct

SEQ ID NO: 1309090 - DNA, 17 bp, Homo sapiens
ctcaagcgattctcctg

SEQ ID NO: 1309091 - DNA, 13 bp, Homo sapiens
ctcacactgagaa

SEQ ID NO: 1309092 - DNA, 17 bp, Homo sapiens
ctcacccctggttctca

SEQ ID NO: 1309093 - DNA, 19 bp, Homo sapiens
ctcaccttggcaccagaca

SEQ ID NO: 1309094 - DNA, 15 bp, Homo sapiens
ctcagatccagggac

SEQ ID NO: 1309095 - DNA, 17 bp, Homo sapiens
ctcagatccagggacag

SEQ ID NO: 1309096 - DNA, 22 bp, Homo sapiens
ctcagatccagggacagaggcc

SEQ ID NO: 1309097 - DNA, 14 bp, Homo sapiens
ctcagccagagaag

SEQ ID NO: 1309098 - DNA, 17 bp, Homo sapiens
ctcagccctgaccctgt

SEQ ID NO: 1309099 - DNA, 16 bp, Homo sapiens
ctcagcctggccagac

SEQ ID NO: 1309100 - DNA, 19 bp, Homo sapiens
ctcagcctggccagacaca

SEQ ID NO: 1309101 - DNA, 15 bp, Homo sapiens
ctcagccttgccaga

SEQ ID NO: 1309102 - DNA, 18 bp, Homo sapiens
ctcagccttgccagagat

SEQ ID NO: 1309103 - DNA, 12 bp, Homo sapiens
ctcaggaagaac

SEQ ID NO: 1309104 - DNA, 17 bp, Homo sapiens
ctcaggaggcaggacct

SEQ ID NO: 1309105 - DNA, 20 bp, Homo sapiens
ctcagggcagcgccaggctg

SEQ ID NO: 1309106 - DNA, 20 bp, Homo sapiens
ctcaggtccctggggctagg

SEQ ID NO: 1309107 - DNA, 13 bp, Homo sapiens
ctcaggtggccat

SEQ ID NO: 1309108 - DNA, 20 bp, Homo sapiens
ctcaggtggccatgcctcag

SEQ ID NO: 1309109 - DNA, 23 bp, Homo sapiens
ctcagtactttggaggcccctat

SEQ ID NO: 1309110 - DNA, 13 bp, Homo sapiens
ctcagtcataatc

SEQ ID NO: 1309111 - DNA, 19 bp, Homo sapiens
ctcatctcttagctcccct

SEQ ID NO: 1309112 - DNA, 13 bp, Homo sapiens
ctcatctttcttg

SEQ ID NO: 1309113 - DNA, 14 bp, Homo sapiens
ctcatttcacccct

SEQ ID NO: 1309114 - DNA, 19 bp, Homo sapiens
ctcatttcacccctccctt

SEQ ID NO: 1309115 - DNA, 18 bp, Homo sapiens
ctccaacaccaagcacag

SEQ ID NO: 1309116 - DNA, 22 bp, Homo sapiens
ctccaacaccaagcacagcagc

SEQ ID NO: 1309117 - DNA, 15 bp, Homo sapiens
ctccaaccccccagc

SEQ ID NO: 1309118 - DNA, 17 bp, Homo sapiens
ctccaaccccccagcac

SEQ ID NO: 1309119 - DNA, 20 bp, Homo sapiens
ctccaaccccccagcactga

SEQ ID NO: 1309120 - DNA, 19 bp, Homo sapiens
ctccacagcaaccccaggc

SEQ ID NO: 1309121 - DNA, 14 bp, Homo sapiens
ctccaccaggaacc

SEQ ID NO: 1309122 - DNA, 16 bp, Homo sapiens
ctccactctcccccac

SEQ ID NO: 1309123 - DNA, 14 bp, Homo sapiens
ctccagggctggac

SEQ ID NO: 1309124 - DNA, 15 bp, Homo sapiens
ctccagggctggact

SEQ ID NO: 1309125 - DNA, 17 bp, Homo sapiens
ctccagggctggactga

SEQ ID NO: 1309126 - DNA, 20 bp, Homo sapiens
ctccagggctggactgaggc

SEQ ID NO: 1309127 - DNA, 16 bp, Homo sapiens
ctccagggtgtgtgct

SEQ ID NO: 1309128 - DNA, 22 bp, Homo sapiens
ctcccaagtagctgggattaca

SEQ ID NO: 1309129 - DNA, 18 bp, Homo sapiens
ctcccacctagcagcacc

SEQ ID NO: 1309130 - DNA, 14 bp, Homo sapiens
ctcccattcctgaa

SEQ ID NO: 1309131 - DNA, 19 bp, Homo sapiens
ctcccattcctgaagaacc

SEQ ID NO: 1309132 - DNA, 14 bp, Homo sapiens
ctccccagcccaga

SEQ ID NO: 1309133 - DNA, 17 bp, Homo sapiens
ctccccagcccagagac

SEQ ID NO: 1309134 - DNA, 18 bp, Homo sapiens
ctccccagcccagagaca

SEQ ID NO: 1309135 - DNA, 13 bp, Homo sapiens
ctcccccccatgc

SEQ ID NO: 1309136 - DNA, 15 bp, Homo sapiens
ctcccccccatgcac

SEQ ID NO: 1309137 - DNA, 18 bp, Homo sapiens
ctcccccccatgcactgt

SEQ ID NO: 1309138 - DNA, 15 bp, Homo sapiens
ctcccctccaacctg

SEQ ID NO: 1309139 - DNA, 16 bp, Homo sapiens
ctcccctgacctgtga

SEQ ID NO: 1309140 - DNA, 22 bp, Homo sapiens
ctcccctgacctgtgagcccag

SEQ ID NO: 1309141 - DNA, 14 bp, Homo sapiens
ctcccctgccccca

SEQ ID NO: 1309142 - DNA, 15 bp, Homo sapiens
ctcccctgcccccag

SEQ ID NO: 1309143 - DNA, 17 bp, Homo sapiens
ctccctgttccccagag

SEQ ID NO: 1309144 - DNA, 14 bp, Homo sapiens
ctccctttctcccc

SEQ ID NO: 1309145 - DNA, 13 bp, Homo sapiens
ctcctagagggag

SEQ ID NO: 1309146 - DNA, 15 bp, Homo sapiens
ctcctagagggaggg

SEQ ID NO: 1309147 - DNA, 18 bp, Homo sapiens
ctcctagagggaggggcc

SEQ ID NO: 1309148 - DNA, 13 bp, Homo sapiens
ctcctctcagtac

SEQ ID NO: 1309149 - DNA, 21 bp, Homo sapiens
ctcctctcccattgtccctct

SEQ ID NO: 1309150 - DNA, 23 bp, Homo sapiens
ctcctctcccattgtccctctgc

SEQ ID NO: 1309151 - DNA, 14 bp, Homo sapiens
ctcctcttgtaaat

SEQ ID NO: 1309152 - DNA, 17 bp, Homo sapiens
ctcctgaggctttggat

SEQ ID NO: 1309153 - DNA, 16 bp, Homo sapiens
ctcctgccgcagagct

SEQ ID NO: 1309154 - DNA, 18 bp, Homo sapiens
ctcctgccgcagagctgg

SEQ ID NO: 1309155 - DNA, 12 bp, Homo sapiens
ctccttcagaca

SEQ ID NO: 1309156 - DNA, 19 bp, Homo sapiens
ctccttcagacaccctcaa

SEQ ID NO: 1309157 - DNA, 23 bp, Homo sapiens
ctccttcctggagcccagaggag

SEQ ID NO: 1309158 - DNA, 14 bp, Homo sapiens
ctccttgttcctag

SEQ ID NO: 1309159 - DNA, 19 bp, Homo sapiens
ctcgagaactttcattttt

SEQ ID NO: 1309160 - DNA, 19 bp, Homo sapiens
ctcggaactgcatgctgct

SEQ ID NO: 1309161 - DNA, 15 bp, Homo sapiens
ctcggcctcccaaag

SEQ ID NO: 1309162 - DNA, 18 bp, Homo sapiens
ctcggcctcccaaagtgc

SEQ ID NO: 1309163 - DNA, 22 bp, Homo sapiens
ctctactaaaaatacaaaaatt

SEQ ID NO: 1309164 - DNA, 14 bp, Homo sapiens
ctctagtgccttct

SEQ ID NO: 1309165 - DNA, 16 bp, Homo sapiens
ctctagtgccttctaa

SEQ ID NO: 1309166 - DNA, 18 bp, Homo sapiens
ctctcagtactttggagg

SEQ ID NO: 1309167 - DNA, 20 bp, Homo sapiens
ctctccagatgtttccagac

SEQ ID NO: 1309168 - DNA, 11 bp, Homo sapiens
ctctccccagc

SEQ ID NO: 1309169 - DNA, 20 bp, Homo sapiens
ctctccccagcccagagaca

SEQ ID NO: 1309170 - DNA, 13 bp, Homo sapiens
ctctcccccaccc

SEQ ID NO: 1309171 - DNA, 16 bp, Homo sapiens
ctctcccccaccccct

SEQ ID NO: 1309172 - DNA, 12 bp, Homo sapiens
ctctccctgacc

SEQ ID NO: 1309173 - DNA, 14 bp, Homo sapiens
ctctccctgaccct

SEQ ID NO: 1309174 - DNA, 20 bp, Homo sapiens
ctctcggaactgcatgctgc

SEQ ID NO: 1309175 - DNA, 18 bp, Homo sapiens
ctctcttatagaatattt

SEQ ID NO: 1309176 - DNA, 24 bp, Homo sapiens
ctctgccccatcctccagcaggga

SEQ ID NO: 1309177 - DNA, 14 bp, Homo sapiens
ctctggagtggcca

SEQ ID NO: 1309178 - DNA, 19 bp, Homo sapiens
gctggactgaggcctgagc

SEQ ID NO: 1309179 - DNA, 16 bp, Homo sapiens
gctggagtttcatgta

SEQ ID NO: 1309180 - DNA, 16 bp, Homo sapiens
gctggcccagggccca

SEQ ID NO: 1309181 - DNA, 17 bp, Homo sapiens
gctggcccagggcccag

SEQ ID NO: 1309182 - DNA, 17 bp, Homo sapiens
gctggctccagatgcag

SEQ ID NO: 1309183 - DNA, 23 bp, Homo sapiens
gctggctccagatgcagggcagt

SEQ ID NO: 1309184 - DNA, 15 bp, Homo sapiens
gctgggggtgggcca

SEQ ID NO: 1309185 - DNA, 14 bp, Homo sapiens
gctggtggcccagg

SEQ ID NO: 1309186 - DNA, 12 bp, Homo sapiens
gctgtacatcta

SEQ ID NO: 1309187 - DNA, 20 bp, Homo sapiens
gctgtagtcctcataaaaag

SEQ ID NO: 1309188 - DNA, 20 bp, Homo sapiens
gctgtcctcaggtggccatg

SEQ ID NO: 1309189 - DNA, 21 bp, Homo sapiens
gctgtcctcaggtggccatgc

SEQ ID NO: 1309190 - DNA, 18 bp, Homo sapiens
gctgttgagctgttttcc

SEQ ID NO: 1309191 - DNA, 17 bp, Homo sapiens
gctgttttccctgacct

SEQ ID NO: 1309192 - DNA, 20 bp, Homo sapiens
gctgttttcctcccttctgc

SEQ ID NO: 1309193 - DNA, 13 bp, Homo sapiens
gcttagagacagt

SEQ ID NO: 1309194 - DNA, 18 bp, Homo sapiens
gcttccatgattctattt

SEQ ID NO: 1309195 - DNA, 22 bp, Homo sapiens
gcttctctgtgaacgatttaga

SEQ ID NO: 1309196 - DNA, 13 bp, Homo sapiens
gcttctgcctgca

SEQ ID NO: 1309197 - DNA, 13 bp, Homo sapiens
gctttatgctgaa

SEQ ID NO: 1309198 - DNA, 21 bp, Homo sapiens
gctttctgctcagcttctcct

SEQ ID NO: 1309199 - DNA, 15 bp, Homo sapiens
gctttgatccctgac

SEQ ID NO: 1309200 - DNA, 20 bp, Homo sapiens
gctttgattcatagtaactt

SEQ ID NO: 1309201 - DNA, 19 bp, Homo sapiens
gctttgctttctgctcagc

SEQ ID NO: 1309202 - DNA, 11 bp, Homo sapiens
ggaacccagac

SEQ ID NO: 1309203 - DNA, 13 bp, Homo sapiens
ggaacccagactc

SEQ ID NO: 1309204 - DNA, 21 bp, Homo sapiens
ggaaccccggggtgcccacag

SEQ ID NO: 1309205 - DNA, 12 bp, Homo sapiens
ggaacctcagcc

SEQ ID NO: 1309206 - DNA, 14 bp, Homo sapiens
ggaacctcagcctg

SEQ ID NO: 1309207 - DNA, 16 bp, Homo sapiens
ggaacctcagcctggc

SEQ ID NO: 1309208 - DNA, 15 bp, Homo sapiens
ggaactcagatccag

SEQ ID NO: 1309209 - DNA, 16 bp, Homo sapiens
ggaactcagatccagg

SEQ ID NO: 1309210 - DNA, 21 bp, Homo sapiens
ggaagcccccaccgtgggcag

SEQ ID NO: 1309211 - DNA, 12 bp, Homo sapiens
ggaatacttttt

SEQ ID NO: 1309212 - DNA, 19 bp, Homo sapiens
ggaattgatttgcattgaa

SEQ ID NO: 1309213 - DNA, 17 bp, Homo sapiens
ggaatttcccaggaccc

SEQ ID NO: 1309214 - DNA, 20 bp, Homo sapiens
ggacaagtggactcagggca

SEQ ID NO: 1309215 - DNA, 23 bp, Homo sapiens
ggacagactcacaacctgaacct

SEQ ID NO: 1309216 - DNA, 14 bp, Homo sapiens
ggacagaggcccca

SEQ ID NO: 1309217 - DNA, 18 bp, Homo sapiens
ggacagaggccccagcct

SEQ ID NO: 1309218 - DNA, 23 bp, Homo sapiens
ggacagatccagggactgaagcc

SEQ ID NO: 1309219 - DNA, 16 bp, Homo sapiens
ggacagccccaccctg

SEQ ID NO: 1309220 - DNA, 15 bp, Homo sapiens
ggacaggctggctcc

SEQ ID NO: 1309221 - DNA, 23 bp, Homo sapiens
ggacaggctggctccagatgcag

SEQ ID NO: 1309222 - DNA, 19 bp, Homo sapiens
ggacatgcggtagccagca

SEQ ID NO: 1309223 - DNA, 16 bp, Homo sapiens
ggaccagctcaggaca

SEQ ID NO: 1309224 - DNA, 17 bp, Homo sapiens
ggaccttcgggctgtgc

SEQ ID NO: 1309225 - DNA, 18 bp, Homo sapiens
ggaccttcgggctgtgcc

SEQ ID NO: 1309226 - DNA, 11 bp, Homo sapiens
ggacttcctgt

SEQ ID NO: 1309227 - DNA, 19 bp, Homo sapiens
ggacttcctgtccagctcc

SEQ ID NO: 1309228 - DNA, 20 bp, Homo sapiens
ggagaagccacaggcctgag

SEQ ID NO: 1309229 - DNA, 22 bp, Homo sapiens
ggagaatttaggtttttattag

SEQ ID NO: 1309230 - DNA, 18 bp, Homo sapiens
ggagagtttcctgaaaca

SEQ ID NO: 1309231 - DNA, 12 bp, Homo sapiens
ggagcccactgt

SEQ ID NO: 1309232 - DNA, 22 bp, Homo sapiens
ggagcccactgtcctgggcctg

SEQ ID NO: 1309233 - DNA, 19 bp, Homo sapiens
ggagcccagccctccccat

SEQ ID NO: 1309234 - DNA, 17 bp, Homo sapiens
ggagctgccttggctca

SEQ ID NO: 1309235 - DNA, 21 bp, Homo sapiens
ggagctgccttggctcagaca

SEQ ID NO: 1309236 - DNA, 11 bp, Homo sapiens
ggaggaagccc

SEQ ID NO: 1309237 - DNA, 22 bp, Homo sapiens
ggagggacaagtggactcaggg

SEQ ID NO: 1309238 - DNA, 14 bp, Homo sapiens
agaagctcctctcc

SEQ ID NO: 1309239 - DNA, 17 bp, Homo sapiens
agaagctcctctcccca

SEQ ID NO: 1309240 - DNA, 11 bp, Homo sapiens
agaaggcaaaa

SEQ ID NO: 1309241 - DNA, 19 bp, Homo sapiens
agaatactgttaaaggaaa

SEQ ID NO: 1309242 - DNA, 22 bp, Homo sapiens
agaatagaaataaaggatgtga

SEQ ID NO: 1309243 - DNA, 15 bp, Homo sapiens
agaatttaggttttt

SEQ ID NO: 1309244 - DNA, 13 bp, Homo sapiens
agacacaggccct

SEQ ID NO: 1309245 - DNA, 13 bp, Homo sapiens
agacacccaggac

SEQ ID NO: 1309246 - DNA, 14 bp, Homo sapiens
agacacccaggact

SEQ ID NO: 1309247 - DNA, 20 bp, Homo sapiens
agacactccccgaagtcttt

SEQ ID NO: 1309248 - DNA, 22 bp, Homo sapiens
agacactccccgaagtcttttg

SEQ ID NO: 1309249 - DNA, 23 bp, Homo sapiens
agacagggtttcaccatgttgcc

SEQ ID NO: 1309250 - DNA, 20 bp, Homo sapiens
agacagttgggtgagaacaa

SEQ ID NO: 1309251 - DNA, 16 bp, Homo sapiens
agacatacttgaaggg

SEQ ID NO: 1309252 - DNA, 19 bp, Homo sapiens
agacatacttgaagggcca

SEQ ID NO: 1309253 - DNA, 23 bp, Homo sapiens
agacatacttgaagggccagagc

SEQ ID NO: 1309254 - DNA, 18 bp, Homo sapiens
agacctaatgctccttgt

SEQ ID NO: 1309255 - DNA, 14 bp, Homo sapiens
agacctgatcctgg

SEQ ID NO: 1309256 - DNA, 18 bp, Homo sapiens
agacctgatcctggaggc

SEQ ID NO: 1309257 - DNA, 22 bp, Homo sapiens
agacctgatcctggaggcccag

SEQ ID NO: 1309258 - DNA, 11 bp, Homo sapiens
agacctggcag

SEQ ID NO: 1309259 - DNA, 15 bp, Homo sapiens
agacctggcagctct

SEQ ID NO: 1309260 - DNA, 18 bp, Homo sapiens
agacctggcagctctgga

SEQ ID NO: 1309261 - DNA, 23 bp, Homo sapiens
agacctggcagctctggacagcc

SEQ ID NO: 1309262 - DNA, 23 bp, Homo sapiens
agactcaggccaagaaacgtctt

SEQ ID NO: 1309263 - DNA, 17 bp, Homo sapiens
agactcccattcctgaa

SEQ ID NO: 1309264 - DNA, 19 bp, Homo sapiens
agactcgagaactttcatt

SEQ ID NO: 1309265 - DNA, 21 bp, Homo sapiens
agactctaggacataaattag

SEQ ID NO: 1309266 - DNA, 21 bp, Homo sapiens
agactggaagctaatttgcat

SEQ ID NO: 1309267 - DNA, 14 bp, Homo sapiens
agctgagcgccagg

SEQ ID NO: 1309268 - DNA, 11 bp, Homo sapiens
agctgcactga

SEQ ID NO: 1309269 - DNA, 17 bp, Homo sapiens
agctgcactgatgctgc

SEQ ID NO: 1309270 - DNA, 20 bp, Homo sapiens
agctgccttggctcagacat

SEQ ID NO: 1309271 - DNA, 18 bp, Homo sapiens
agctgctcctagagggag

SEQ ID NO: 1309272 - DNA, 17 bp, Homo sapiens
agctgggggtgggccag

SEQ ID NO: 1309273 - DNA, 18 bp, Homo sapiens
agctgggggtgggccagg

SEQ ID NO: 1309274 - DNA, 19 bp, Homo sapiens
agctgggggtgggccaggc

SEQ ID NO: 1309275 - DNA, 17 bp, Homo sapiens
agctgggtcaggcaggg

SEQ ID NO: 1309276 - DNA, 13 bp, Homo sapiens
agctgttgagctg

SEQ ID NO: 1309277 - DNA, 14 bp, Homo sapiens
agctgttgagctgt

SEQ ID NO: 1309278 - DNA, 15 bp, Homo sapiens
agctgttgagctgtt

SEQ ID NO: 1309279 - DNA, 23 bp, Homo sapiens
agcttccattccaagcctgacca

SEQ ID NO: 1309280 - DNA, 21 bp, Homo sapiens
agcttctcctgtgtgattgac

SEQ ID NO: 1309281 - DNA, 14 bp, Homo sapiens
agcttctctgtgaa

SEQ ID NO: 1309282 - DNA, 16 bp, Homo sapiens
agcttgttatttataa

SEQ ID NO: 1309283 - DNA, 13 bp, Homo sapiens
agctttgctgctg

SEQ ID NO: 1309284 - DNA, 22 bp, Homo sapiens
aggaagcccccaccgtgggcag

SEQ ID NO: 1309285 - DNA, 16 bp, Homo sapiens
aggaatgtgtggcctg

SEQ ID NO: 1309286 - DNA, 17 bp, Homo sapiens
aggaatttcccaggacc

SEQ ID NO: 1309287 - DNA, 20 bp, Homo sapiens
aggacataaattagaggtct

SEQ ID NO: 1309288 - DNA, 24 bp, Homo sapiens
aggaccagctcaggacagatgcca

SEQ ID NO: 1309289 - DNA, 15 bp, Homo sapiens
aggaccctgaagggg

SEQ ID NO: 1309290 - DNA, 11 bp, Homo sapiens
aggactgggcc

SEQ ID NO: 1309291 - DNA, 15 bp, Homo sapiens
aggactgggccactt

SEQ ID NO: 1309292 - DNA, 20 bp, Homo sapiens
aggacttcctgtccagctcc

SEQ ID NO: 1309293 - DNA, 22 bp, Homo sapiens
aggagctgccttggctcagaca

SEQ ID NO: 1309294 - DNA, 11 bp, Homo sapiens
aggagctgcta

SEQ ID NO: 1309295 - DNA, 20 bp, Homo sapiens
aggagctgctatagcctggg

SEQ ID NO: 1309296 - DNA, 14 bp, Homo sapiens
aggagggcagcaga

SEQ ID NO: 1309297 - DNA, 18 bp, Homo sapiens
aggagtgtgtgatttttt

SEQ ID NO: 1309298 - DNA, 19 bp, Homo sapiens
aggagttcctaaccagcct

SEQ ID NO: 1309299 - DNA, 21 bp, Homo sapiens
aggatagatgctggcccaggg

SEQ ID NO: 1309300 - DNA, 20 bp, Homo sapiens
aggatctttgtggccaagga

SEQ ID NO: 1309301 - DNA, 15 bp, Homo sapiens
aggcaaaaatgtaaa

SEQ ID NO: 1309302 - DNA, 13 bp, Homo sapiens
aggcaaaattgca

SEQ ID NO: 1309303 - DNA, 12 bp, Homo sapiens
aggcaagccctg

SEQ ID NO: 1309304 - DNA, 14 bp, Homo sapiens
aggccaagaaacgt

SEQ ID NO: 1309305 - DNA, 18 bp, Homo sapiens
aggccacactcagcacaa

SEQ ID NO: 1309306 - DNA, 16 bp, Homo sapiens
aggccataaaacaggt

SEQ ID NO: 1309307 - DNA, 22 bp, Homo sapiens
aggccatctgggctcctccagg

SEQ ID NO: 1309308 - DNA, 20 bp, Homo sapiens
aggccctccctgttccccag

SEQ ID NO: 1309309 - DNA, 20 bp, Homo sapiens
aggccctctggagtggccac

SEQ ID NO: 1309310 - DNA, 21 bp, Homo sapiens
aggccctctggagtggccact

SEQ ID NO: 1309311 - DNA, 14 bp, Homo sapiens
aggcctcagccaga

SEQ ID NO: 1309312 - DNA, 16 bp, Homo sapiens
aggcctcagccagaga

SEQ ID NO: 1309313 - DNA, 16 bp, Homo sapiens
aggcctgagatttcat

SEQ ID NO: 1309314 - DNA, 17 bp, Homo sapiens
aggcctgagatttcatc

SEQ ID NO: 1309315 - DNA, 21 bp, Homo sapiens
aggcctgagatttcatctgct

SEQ ID NO: 1309316 - DNA, 23 bp, Homo sapiens
aggcctgagatttcatctgctct

SEQ ID NO: 1309317 - DNA, 21 bp, Homo sapiens
aggcctgagcgctcctgccgc

SEQ ID NO: 1309318 - DNA, 20 bp, Homo sapiens
aggcctgcctccagggctgg

SEQ ID NO: 1309319 - DNA, 21 bp, Homo sapiens
aggcctgcctccagggctgga

SEQ ID NO: 1309320 - DNA, 19 bp, Homo sapiens
aggccttcctctctccaga

SEQ ID NO: 1309321 - DNA, 22 bp, Homo sapiens
aggcgcactgtgacccccagct

SEQ ID NO: 1309322 - DNA, 18 bp, Homo sapiens
aggctgaggcaagagaat

SEQ ID NO: 1309323 - DNA, 15 bp, Homo sapiens
aggctgaggctggca

SEQ ID NO: 1309324 - DNA, 21 bp, Homo sapiens
aggctgcaaggtttaggctgg

SEQ ID NO: 1309325 - DNA, 17 bp, Homo sapiens
aggctggcacaggacat

SEQ ID NO: 1309326 - DNA, 15 bp, Homo sapiens
aggctggtggcccag

SEQ ID NO: 1309327 - DNA, 17 bp, Homo sapiens
aggctggtggcccagga

SEQ ID NO: 1309328 - DNA, 22 bp, Homo sapiens
agggaaaatgcagcagggatgc

SEQ ID NO: 1309329 - DNA, 22 bp, Homo sapiens
agggacaagtggactcagggca

SEQ ID NO: 1309330 - DNA, 13 bp, Homo sapiens
agggagaagctcc

SEQ ID NO: 1309331 - DNA, 17 bp, Homo sapiens
agggagcccctttgatg

SEQ ID NO: 1309332 - DNA, 19 bp, Homo sapiens
agggagcggccggccagcc

SEQ ID NO: 1309333 - DNA, 15 bp, Homo sapiens
agggaggcaagccct

SEQ ID NO: 1309334 - DNA, 21 bp, Homo sapiens
agggatcaaccagctaagaaa

SEQ ID NO: 1309335 - DNA, 15 bp, Homo sapiens
agggcagcagaaggg

SEQ ID NO: 1309336 - DNA, 14 bp, Homo sapiens
agggcagcgccagg

SEQ ID NO: 1309337 - DNA, 16 bp, Homo sapiens
agggcagcgccaggct

SEQ ID NO: 1309338 - DNA, 20 bp, Homo sapiens
agggcagtcattggctgtct

SEQ ID NO: 1309339 - DNA, 16 bp, Homo sapiens
agggccaacccttctc

SEQ ID NO: 1309340 - DNA, 11 bp, Homo sapiens
agggccagagc

SEQ ID NO: 1309341 - DNA, 16 bp, Homo sapiens
agggcccagagcccag

SEQ ID NO: 1309342 - DNA, 20 bp, Homo sapiens
agggcccagagcccagctcc

SEQ ID NO: 1309343 - DNA, 18 bp, Homo sapiens
agggctgtcatctgtgca

SEQ ID NO: 1309344 - DNA, 19 bp, Homo sapiens
agggctgtcatctgtgcac

SEQ ID NO: 1309345 - DNA, 16 bp, Homo sapiens
aggggagttgtgtctg

SEQ ID NO: 1309346 - DNA, 17 bp, Homo sapiens
aggggcccggccagcca

SEQ ID NO: 1309347 - DNA, 16 bp, Homo sapiens
aggggccgctgccacc

SEQ ID NO: 1309348 - DNA, 23 bp, Homo sapiens
aggggcctaggcctcagccagag

SEQ ID NO: 1309349 - DNA, 16 bp, Homo sapiens
aggggcgtctgttccc

SEQ ID NO: 1309350 - DNA, 20 bp, Homo sapiens
aggtcaggagttcctaacca

SEQ ID NO: 1309351 - DNA, 13 bp, Homo sapiens
aggtcctctgtca

SEQ ID NO: 1309352 - DNA, 19 bp, Homo sapiens
aggtcctctgtcagtcaca

SEQ ID NO: 1309353 - DNA, 21 bp, Homo sapiens
aggtcttcatcgaatctacta

SEQ ID NO: 1309354 - DNA, 20 bp, Homo sapiens
aggtgctgacggccagggag

SEQ ID NO: 1309355 - DNA, 17 bp, Homo sapiens
aggtggctgagcccctg

SEQ ID NO: 1309356 - DNA, 15 bp, Homo sapiens
aggtgttactgtaat

SEQ ID NO: 1309357 - DNA, 16 bp, Homo sapiens
aggtgttgtcccttct

SEQ ID NO: 1309358 - DNA, 14 bp, Homo sapiens
aggtttgagtagag

SEQ ID NO: 1309359 - DNA, 23 bp, Homo sapiens
agtaaccatcactggttgcactt

SEQ ID NO: 1309360 - DNA, 19 bp, Homo sapiens
agtaatctaatatggccac

SEQ ID NO: 1309361 - DNA, 21 bp, Homo sapiens
catccagggcccccatctcat

SEQ ID NO: 1309362 - DNA, 20 bp, Homo sapiens
catctattctctccaaaaat

SEQ ID NO: 1309363 - DNA, 19 bp, Homo sapiens
catctcttagctcccctcc

SEQ ID NO: 1309364 - DNA, 17 bp, Homo sapiens
catctgaccagcagcgc

SEQ ID NO: 1309365 - DNA, 20 bp, Homo sapiens
catctgctctccttcctgga

SEQ ID NO: 1309366 - DNA, 16 bp, Homo sapiens
catctggaatctggag

SEQ ID NO: 1309367 - DNA, 17 bp, Homo sapiens
catctgtgcactgccca

SEQ ID NO: 1309368 - DNA, 21 bp, Homo sapiens
catcttttcttgcctctgtcc

SEQ ID NO: 1309369 - DNA, 13 bp, Homo sapiens
catgacatttctt

SEQ ID NO: 1309370 - DNA, 22 bp, Homo sapiens
catgagatgatacatccaaagc

SEQ ID NO: 1309371 - DNA, 16 bp, Homo sapiens
catgattccttcctgt

SEQ ID NO: 1309372 - DNA, 14 bp, Homo sapiens
catgcactgtgaag

SEQ ID NO: 1309373 - DNA, 16 bp, Homo sapiens
catgcactgtgaagga

SEQ ID NO: 1309374 - DNA, 22 bp, Homo sapiens
catgcactgtgaaggacccttg

SEQ ID NO: 1309375 - DNA, 17 bp, Homo sapiens
catgccacaaggacttc

SEQ ID NO: 1309376 - DNA, 21 bp, Homo sapiens
catgccacaaggacttcctgt

SEQ ID NO: 1309377 - DNA, 15 bp, Homo sapiens
catgcccctggctgg

SEQ ID NO: 1309378 - DNA, 21 bp, Homo sapiens
catgcccggctaatttttgta

SEQ ID NO: 1309379 - DNA, 14 bp, Homo sapiens
catgccctcctctc

SEQ ID NO: 1309380 - DNA, 17 bp, Homo sapiens
catgccctcctctccca

SEQ ID NO: 1309381 - DNA, 18 bp, Homo sapiens
catgccctgtgcaacctc

SEQ ID NO: 1309382 - DNA, 14 bp, Homo sapiens
catgcctcagccct

SEQ ID NO: 1309383 - DNA, 20 bp, Homo sapiens
catgcctcagccctgaccct

SEQ ID NO: 1309384 - DNA, 13 bp, Homo sapiens
catgcggtagcca

SEQ ID NO: 1309385 - DNA, 14 bp, Homo sapiens
catggacaggctgg

SEQ ID NO: 1309386 - DNA, 10 bp, Homo sapiens
catggagcca

SEQ ID NO: 1309387 - DNA, 15 bp, Homo sapiens
catggtcacacactg

SEQ ID NO: 1309388 - DNA, 21 bp, Homo sapiens
catggtcacacactgatgctt

SEQ ID NO: 1309389 - DNA, 16 bp, Homo sapiens
catggtgccccaggac

SEQ ID NO: 1309390 - DNA, 20 bp, Homo sapiens
catggtgccccaggaccagc

SEQ ID NO: 1309391 - DNA, 15 bp, Homo sapiens
catgttttcaactgc

SEQ ID NO: 1309392 - DNA, 14 bp, Homo sapiens
cattaaattcacaa

SEQ ID NO: 1309393 - DNA, 16 bp, Homo sapiens
cattcacctgccccaa

SEQ ID NO: 1309394 - DNA, 19 bp, Homo sapiens
cattcacctgccccaactc

SEQ ID NO: 1309395 - DNA, 17 bp, Homo sapiens
cattcctgaagaaccag

SEQ ID NO: 1309396 - DNA, 16 bp, Homo sapiens
cattcggtgtggtgca

SEQ ID NO: 1309397 - DNA, 15 bp, Homo sapiens
cattctactgaaaag

SEQ ID NO: 1309398 - DNA, 15 bp, Homo sapiens
cattcttttgtaatt

SEQ ID NO: 1309399 - DNA, 18 bp, Homo sapiens
cattcttttgtaatttaa

SEQ ID NO: 1309400 - DNA, 22 bp, Homo sapiens
cattgaacacaaactgtaaata

SEQ ID NO: 1309401 - DNA, 14 bp, Homo sapiens
cattgctgagcctc

SEQ ID NO: 1309402 - DNA, 15 bp, Homo sapiens
cattgctgagcctct

SEQ ID NO: 1309403 - DNA, 21 bp, Homo sapiens
cattggcacctaatccaggca

SEQ ID NO: 1309404 - DNA, 13 bp, Homo sapiens
cattgtccctctg

SEQ ID NO: 1309405 - DNA, 18 bp, Homo sapiens
cattgtccctctgcccca

SEQ ID NO: 1309406 - DNA, 18 bp, Homo sapiens
cattgtttgtctgtcttc

SEQ ID NO: 1309407 - DNA, 18 bp, Homo sapiens
catttataaagctaaaat

SEQ ID NO: 1309408 - DNA, 13 bp, Homo sapiens
catttcacccctc

SEQ ID NO: 1309409 - DNA, 19 bp, Homo sapiens
catttcacccctccctttc

SEQ ID NO: 1309410 - DNA, 23 bp, Homo sapiens
catttctatttatttactgagct

SEQ ID NO: 1309411 - DNA, 15 bp, Homo sapiens
catttggaatacttt

SEQ ID NO: 1309412 - DNA, 14 bp, Homo sapiens
catttggattgggg

SEQ ID NO: 1309413 - DNA, 21 bp, Homo sapiens
catttggcaggggtggctgcc

SEQ ID NO: 1309414 - DNA, 23 bp, Homo sapiens
cattttaatttattaattgcttt

SEQ ID NO: 1309415 - DNA, 18 bp, Homo sapiens
catttttttccaggctgg

SEQ ID NO: 1309416 - DNA, 22 bp, Homo sapiens
ccaaaagaagcccccagctaag

SEQ ID NO: 1309417 - DNA, 16 bp, Homo sapiens
ccaaataatgtctctg

SEQ ID NO: 1309418 - DNA, 13 bp, Homo sapiens
ccaaccccccagc

SEQ ID NO: 1309419 - DNA, 17 bp, Homo sapiens
ccaaccccccagcactg

SEQ ID NO: 1309420 - DNA, 14 bp, Homo sapiens
ccaacctggggggc

SEQ ID NO: 1309421 - DNA, 12 bp, Homo sapiens
ccaaccttccca

SEQ ID NO: 1309422 - DNA, 14 bp, Homo sapiens
ccaactctagctgg

SEQ ID NO: 1309423 - DNA, 23 bp, Homo sapiens
ccaacttgtattaaagacagagg

SEQ ID NO: 1309424 - DNA, 13 bp, Homo sapiens
ccaaggagctgct

SEQ ID NO: 1309425 - DNA, 18 bp, Homo sapiens
ccaatattaaatctgctg

SEQ ID NO: 1309426 - DNA, 17 bp, Homo sapiens
ccaatgtaggagctgcc

SEQ ID NO: 1309427 - DNA, 20 bp, Homo sapiens
ccaatgtaggagctgccttg

SEQ ID NO: 1309428 - DNA, 16 bp, Homo sapiens
ccaatttcagactccc

SEQ ID NO: 1309429 - DNA, 16 bp, Homo sapiens
ccacaggccgccctgc

SEQ ID NO: 1309430 - DNA, 11 bp, Homo sapiens
ccacaggcctg

SEQ ID NO: 1309431 - DNA, 22 bp, Homo sapiens
ccacatttggaatactttttgt

SEQ ID NO: 1309432 - DNA, 14 bp, Homo sapiens
ccaccaggaacctc

SEQ ID NO: 1309433 - DNA, 16 bp, Homo sapiens
ccaccaggaacctctt

SEQ ID NO: 1309434 - DNA, 20 bp, Homo sapiens
ccacccctgggggctctcat

SEQ ID NO: 1309435 - DNA, 17 bp, Homo sapiens
ccaccgcccagagaccc

SEQ ID NO: 1309436 - DNA, 16 bp, Homo sapiens
ccacctccctgcctcc

SEQ ID NO: 1309437 - DNA, 13 bp, Homo sapiens
ccactaagcagag

SEQ ID NO: 1309438 - DNA, 14 bp, Homo sapiens
ccactaagcagagg

SEQ ID NO: 1309439 - DNA, 19 bp, Homo sapiens
ccactaagcagaggagggg

SEQ ID NO: 1309440 - DNA, 15 bp, Homo sapiens
ccactgtcctgggcc

SEQ ID NO: 1309441 - DNA, 21 bp, Homo sapiens
ccactgtcctgggcctgcaga

SEQ ID NO: 1309442 - DNA, 17 bp, Homo sapiens
ccagaatgctgtacatc

SEQ ID NO: 1309443 - DNA, 14 bp, Homo sapiens
ccagacacccagga

SEQ ID NO: 1309444 - DNA, 15 bp, Homo sapiens
ccagacacccaggac

SEQ ID NO: 1309445 - DNA, 14 bp, Homo sapiens
ccagacatgccaca

SEQ ID NO: 1309446 - DNA, 17 bp, Homo sapiens
ccagacctgatcctgga

SEQ ID NO: 1309447 - DNA, 20 bp, Homo sapiens
ccagacctgatcctggaggc

SEQ ID NO: 1309448 - DNA, 23 bp, Homo sapiens
ccagacctgatcctggaggccca

SEQ ID NO: 1309449 - DNA, 24 bp, Homo sapiens
ccagacctgatcctggaggcccag

SEQ ID NO: 1309450 - DNA, 14 bp, Homo sapiens
ccagacttccttga

SEQ ID NO: 1309451 - DNA, 17 bp, Homo sapiens
ccagagacatacttgaa

SEQ ID NO: 1309452 - DNA, 18 bp, Homo sapiens
ccagagacatacttgaag

SEQ ID NO: 1309453 - DNA, 20 bp, Homo sapiens
ccagagacatacttgaaggg

SEQ ID NO: 1309454 - DNA, 13 bp, Homo sapiens
ccagagatccaaa

SEQ ID NO: 1309455 - DNA, 13 bp, Homo sapiens
ccagagcccagct

SEQ ID NO: 1309456 - DNA, 16 bp, Homo sapiens
ccagagcccagctcca

SEQ ID NO: 1309457 - DNA, 12 bp, Homo sapiens
ccagaggagggc

SEQ ID NO: 1309458 - DNA, 17 bp, Homo sapiens
ccagatgtttccagact

SEQ ID NO: 1309459 - DNA, 16 bp, Homo sapiens
ccagattggctcacac

SEQ ID NO: 1309460 - DNA, 21 bp, Homo sapiens
ccagattggctcacactgaga

SEQ ID NO: 1309461 - DNA, 22 bp, Homo sapiens
ccagattggctcacactgagaa

SEQ ID NO: 1309462 - DNA, 13 bp, Homo sapiens
ccagcactgagga

SEQ ID NO: 1309463 - DNA, 18 bp, Homo sapiens
ccagcagcgcctttccca

SEQ ID NO: 1309464 - DNA, 15 bp, Homo sapiens
ccagcaggtgctgac

SEQ ID NO: 1309465 - DNA, 18 bp, Homo sapiens
ccagccatcaaaatgctt

SEQ ID NO: 1309466 - DNA, 11 bp, Homo sapiens
ccagcccagag

SEQ ID NO: 1309467 - DNA, 23 bp, Homo sapiens
ccagcccagagacatacttgaag

SEQ ID NO: 1309468 - DNA, 13 bp, Homo sapiens
ccagcccctggcc

SEQ ID NO: 1309469 - DNA, 20 bp, Homo sapiens
ccagccctccccatggagcc

SEQ ID NO: 1309470 - DNA, 18 bp, Homo sapiens
ccagctaagaacctggaa

SEQ ID NO: 1309471 - DNA, 19 bp, Homo sapiens
ccagctaagaacctggaac

SEQ ID NO: 1309472 - DNA, 15 bp, Homo sapiens
ccagctccaacctgc

SEQ ID NO: 1309473 - DNA, 22 bp, Homo sapiens
ccagctccaaggggaatcagaa

SEQ ID NO: 1309474 - DNA, 14 bp, Homo sapiens
ccagctctttcctc

SEQ ID NO: 1309475 - DNA, 15 bp, Homo sapiens
ccagctgagcgccag

SEQ ID NO: 1309476 - DNA, 20 bp, Homo sapiens
ccagctgagcgccaggatgg

SEQ ID NO: 1309477 - DNA, 19 bp, Homo sapiens
ccagctgcactgatgctgc

SEQ ID NO: 1309478 - DNA, 23 bp, Homo sapiens
cccctggctgggacgtggctcag

SEQ ID NO: 1309479 - DNA, 18 bp, Homo sapiens
cccctggttctcatcttt

SEQ ID NO: 1309480 - DNA, 18 bp, Homo sapiens
cccctgtctagagaggga

SEQ ID NO: 1309481 - DNA, 13 bp, Homo sapiens
ccccttctctcat

SEQ ID NO: 1309482 - DNA, 16 bp, Homo sapiens
ccccttctctcatctc

SEQ ID NO: 1309483 - DNA, 24 bp, Homo sapiens
cctgcgggtgaacaaagcagccac

SEQ ID NO: 1309484 - DNA, 16 bp, Homo sapiens
cctgctccagacctga

SEQ ID NO: 1309485 - DNA, 12 bp, Homo sapiens
cctggaggccca

SEQ ID NO: 1309486 - DNA, 16 bp, Homo sapiens
cctggaggcccagttc

SEQ ID NO: 1309487 - DNA, 23 bp, Homo sapiens
cctggaggtggctgagcccctgt

SEQ ID NO: 1309488 - DNA, 21 bp, Homo sapiens
cctggcagctctggacagccc

SEQ ID NO: 1309489 - DNA, 23 bp, Homo sapiens
cctggcagctctggacagcccca

SEQ ID NO: 1309490 - DNA, 15 bp, Homo sapiens
cctggccagacacag

SEQ ID NO: 1309491 - DNA, 14 bp, Homo sapiens
cctggccatcccac

SEQ ID NO: 1309492 - DNA, 23 bp, Homo sapiens
ctgacagctgctcctagagggag

SEQ ID NO: 1309493 - DNA, 20 bp, Homo sapiens
ctgacatgattccttcctgt

SEQ ID NO: 1309494 - DNA, 17 bp, Homo sapiens
ctgacattcacctgccc

SEQ ID NO: 1309495 - DNA, 12 bp, Homo sapiens
ctgaccacagca

SEQ ID NO: 1309496 - DNA, 18 bp, Homo sapiens
ctgaccacagcacagcca

SEQ ID NO: 1309497 - DNA, 13 bp, Homo sapiens
ctgaccagaacta

SEQ ID NO: 1309498 - DNA, 15 bp, Homo sapiens
ctgaccagcagcgcc

SEQ ID NO: 1309499 - DNA, 10 bp, Homo sapiens
ctgacccagt

SEQ ID NO: 1309500 - DNA, 12 bp, Homo sapiens
ctgacccagtgc

SEQ ID NO: 1309501 - DNA, 13 bp, Homo sapiens
ctgacccagtgcc

SEQ ID NO: 1309502 - DNA, 18 bp, Homo sapiens
ctgacccagtgcccccac

SEQ ID NO: 1309503 - DNA, 21 bp, Homo sapiens
ctgaccctgtatatagcccag

SEQ ID NO: 1309504 - DNA, 21 bp, Homo sapiens
ctgacctccctctaatttatc

SEQ ID NO: 1309505 - DNA, 17 bp, Homo sapiens
ctgacttcatctcccac

SEQ ID NO: 1309506 - DNA, 16 bp, Homo sapiens
ctgagatttcatctgc

SEQ ID NO: 1309507 - DNA, 19 bp, Homo sapiens
ctgagatttcatctgctct

SEQ ID NO: 1309508 - DNA, 15 bp, Homo sapiens
ctgagcgccaggatg

SEQ ID NO: 1309509 - DNA, 16 bp, Homo sapiens
ctgagcttctctgtga

SEQ ID NO: 1309510 - DNA, 18 bp, Homo sapiens
ctgaggaagaacggggct

SEQ ID NO: 1309511 - DNA, 23 bp, Homo sapiens
ctgaggaagaacggggctcttct

SEQ ID NO: 1309512 - DNA, 21 bp, Homo sapiens
ctgaggccacactcagcacaa

SEQ ID NO: 1309513 - DNA, 24 bp, Homo sapiens
ctgaggccacactcagcacaaggc

SEQ ID NO: 1309514 - DNA, 18 bp, Homo sapiens
ctgaggcctgagcgctcc

SEQ ID NO: 1309515 - DNA, 15 bp, Homo sapiens
ctgaggctttggatt

SEQ ID NO: 1309516 - DNA, 23 bp, Homo sapiens
ctgataactagatggtgctgaga

SEQ ID NO: 1309517 - DNA, 15 bp, Homo sapiens
ctgatcctggaggcc

SEQ ID NO: 1309518 - DNA, 18 bp, Homo sapiens
ctgatcctggaggcccag

SEQ ID NO: 1309519 - DNA, 21 bp, Homo sapiens
ctgcaaaaatatttataaaac

SEQ ID NO: 1309520 - DNA, 23 bp, Homo sapiens
ctgcaaagatctgtcctcagcct

SEQ ID NO: 1309521 - DNA, 23 bp, Homo sapiens
ctgcaaaggacagatccagggac

SEQ ID NO: 1309522 - DNA, 15 bp, Homo sapiens
ctgcactgatgctgc

SEQ ID NO: 1309523 - DNA, 17 bp, Homo sapiens
ctgcactgatgctgccc

SEQ ID NO: 1309524 - DNA, 21 bp, Homo sapiens
ctgcagtttgagacaggagac

SEQ ID NO: 1309525 - DNA, 21 bp, Homo sapiens
ctgcatctgaccagcagcgcc

SEQ ID NO: 1309526 - DNA, 13 bp, Homo sapiens
ctgcatgctgctg

SEQ ID NO: 1309527 - DNA, 18 bp, Homo sapiens
ctgcatgctgctggacag

SEQ ID NO: 1309528 - DNA, 20 bp, Homo sapiens
ctgccacccacctccctgcc

SEQ ID NO: 1309529 - DNA, 16 bp, Homo sapiens
ctgccccatcctccag

SEQ ID NO: 1309530 - DNA, 19 bp, Homo sapiens
ctgcccccaggactgggcc

SEQ ID NO: 1309531 - DNA, 16 bp, Homo sapiens
ctgccgcagagctggc

SEQ ID NO: 1309532 - DNA, 18 bp, Homo sapiens
ctgcctcagcctcccaag

SEQ ID NO: 1309533 - DNA, 22 bp, Homo sapiens
ctgcctcaggaggcaggacctt

SEQ ID NO: 1309534 - DNA, 23 bp, Homo sapiens
ctgcctcaggaggcaggaccttc

SEQ ID NO: 1309535 - DNA, 14 bp, Homo sapiens
ctgcctccagggct

SEQ ID NO: 1309536 - DNA, 15 bp, Homo sapiens
ctgcctccagggctg

SEQ ID NO: 1309537 - DNA, 16 bp, Homo sapiens
ctgcctccagggctgg

SEQ ID NO: 1309538 - DNA, 17 bp, Homo sapiens
ctgcctccagggctgga

SEQ ID NO: 1309539 - DNA, 20 bp, Homo sapiens
ctgcctcccctctccttcct

SEQ ID NO: 1309540 - DNA, 19 bp, Homo sapiens
ctgcctcgaaacacagaaa

SEQ ID NO: 1309541 - DNA, 15 bp, Homo sapiens
ctgcctgcacccctg

SEQ ID NO: 1309542 - DNA, 22 bp, Homo sapiens
ctgccttggctcagacatgttt

SEQ ID NO: 1309543 - DNA, 23 bp, Homo sapiens
ctgcgggtgaacaaagcagccac

SEQ ID NO: 1309544 - DNA, 17 bp, Homo sapiens
ctgctactggcaaaagg

SEQ ID NO: 1309545 - DNA, 18 bp, Homo sapiens
ctgctactgtaattttat

SEQ ID NO: 1309546 - DNA, 13 bp, Homo sapiens
ctgctcagcttct

SEQ ID NO: 1309547 - DNA, 18 bp, Homo sapiens
ctgctcagcttctcctgt

SEQ ID NO: 1309548 - DNA, 13 bp, Homo sapiens
ctgctccagacct

SEQ ID NO: 1309549 - DNA, 15 bp, Homo sapiens
ctgctccagacctga

SEQ ID NO: 1309550 - DNA, 16 bp, Homo sapiens
ctgctctccttcctgg

SEQ ID NO: 1309551 - DNA, 20 bp, Homo sapiens
ctgctctccttcctggagcc

SEQ ID NO: 1309552 - DNA, 20 bp, Homo sapiens
ctgctggagtttcatgtaca

SEQ ID NO: 1309553 - DNA, 14 bp, Homo sapiens
ctggaacccagact

SEQ ID NO: 1309554 - DNA, 12 bp, Homo sapiens
ctggaacctcag

SEQ ID NO: 1309555 - DNA, 15 bp, Homo sapiens
ctggaacctcagcct

SEQ ID NO: 1309556 - DNA, 20 bp, Homo sapiens
ctggaacctcagcctggcca

SEQ ID NO: 1309557 - DNA, 23 bp, Homo sapiens
ctggaacctcagcctggccagac

SEQ ID NO: 1309558 - DNA, 14 bp, Homo sapiens
ctggaacttgggga

SEQ ID NO: 1309559 - DNA, 17 bp, Homo sapiens
ctggaagctaatttgca

SEQ ID NO: 1309560 - DNA, 18 bp, Homo sapiens
ctggaagctaatttgcat

SEQ ID NO: 1309561 - DNA, 24 bp, Homo sapiens
ctggaatctggagaccagggagcc

SEQ ID NO: 1309562 - DNA, 18 bp, Homo sapiens
ctggacagccccaccctg

SEQ ID NO: 1309563 - DNA, 19 bp, Homo sapiens
ctggacagccccaccctgg

SEQ ID NO: 1309564 - DNA, 20 bp, Homo sapiens
ctggacagtatcactgtctt

SEQ ID NO: 1309565 - DNA, 12 bp, Homo sapiens
ctggactgaggc

SEQ ID NO: 1309566 - DNA, 19 bp, Homo sapiens
ctggagaccagggagcctt

SEQ ID NO: 1309567 - DNA, 22 bp, Homo sapiens
ctggagaggccctctggagtgg

SEQ ID NO: 1309568 - DNA, 17 bp, Homo sapiens
ctggagcccagaggagg

SEQ ID NO: 1309569 - DNA, 15 bp, Homo sapiens
ctggaggcccagttc

SEQ ID NO: 1309570 - DNA, 15 bp, Homo sapiens
ctggagttgatctgg

SEQ ID NO: 1309571 - DNA, 18 bp, Homo sapiens
ctggagtttcatgtacaa

SEQ ID NO: 1309572 - DNA, 15 bp, Homo sapiens
ctggatcctgaaata

SEQ ID NO: 1309573 - DNA, 20 bp, Homo sapiens
ctggcaaagcttttagaaat

SEQ ID NO: 1309574 - DNA, 20 bp, Homo sapiens
ctggcagcctcccatccagg

SEQ ID NO: 1309575 - DNA, 22 bp, Homo sapiens
ctggcagcctcccatccagggc

SEQ ID NO: 1309576 - DNA, 19 bp, Homo sapiens
ctggcagtttaaaaaaatt

SEQ ID NO: 1309577 - DNA, 18 bp, Homo sapiens
ctggccagacacaggccc

SEQ ID NO: 1309578 - DNA, 19 bp, Homo sapiens
ctggccagacacaggccct

SEQ ID NO: 1309579 - DNA, 18 bp, Homo sapiens
ctggccatcccacaagtg

SEQ ID NO: 1309580 - DNA, 12 bp, Homo sapiens
ctggcccagggc

SEQ ID NO: 1309581 - DNA, 15 bp, Homo sapiens
ctggcccagggccca

SEQ ID NO: 1309582 - DNA, 16 bp, Homo sapiens
ctggcccagggcccag

SEQ ID NO: 1309583 - DNA, 20 bp, Homo sapiens
ctggcccagggcccagagcc

SEQ ID NO: 1309584 - DNA, 22 bp, Homo sapiens
ctggcccagggcccagagccca

SEQ ID NO: 1309585 - DNA, 16 bp, Homo sapiens
ctggccccaggacctg

SEQ ID NO: 1309586 - DNA, 13 bp, Homo sapiens
ctggcctctgtgc

SEQ ID NO: 1309587 - DNA, 14 bp, Homo sapiens
ctggcctctgtgcc

SEQ ID NO: 1309588 - DNA, 20 bp, Homo sapiens
ctggcctctgtgccttcttt

SEQ ID NO: 1309589 - DNA, 21 bp, Homo sapiens
ctggctccagatgcagggcag

SEQ ID NO: 1309590 - DNA, 11 bp, Homo sapiens
ctggctttggc

SEQ ID NO: 1309591 - DNA, 15 bp, Homo sapiens
ctgggacgtggctca

SEQ ID NO: 1309592 - DNA, 21 bp, Homo sapiens
ctgggccattctccacagcaa

SEQ ID NO: 1309593 - DNA, 22 bp, Homo sapiens
ctgggccattctccacagcaac

SEQ ID NO: 1309594 - DNA, 15 bp, Homo sapiens
ctgggctcctccagg

SEQ ID NO: 1309595 - DNA, 19 bp, Homo sapiens
ctgggcttggggcttccta

SEQ ID NO: 1309596 - DNA, 20 bp, Homo sapiens
ctgggcttggggcttcctaa

SEQ ID NO: 1309597 - DNA, 15 bp, Homo sapiens
ctggggcctccagaa

SEQ ID NO: 1309598 - DNA, 15 bp, Homo sapiens
ctggggctctgggat

SEQ ID NO: 1309599 - DNA, 15 bp, Homo sapiens
ctgggtacttcttga

SEQ ID NO: 1309600 - DNA, 23 bp, Homo sapiens
ctgggtacttcttgaaggtgctg

SEQ ID NO: 1309601 - DNA, 13 bp, Homo sapiens
ctgggtgacagag

SEQ ID NO: 1309602 - DNA, 15 bp, Homo sapiens
ctgggtggggcagtg

SEQ ID NO: 1309603 - DNA, 14 bp, Homo sapiens
ctggtattttatct

SEQ ID NO: 1309604 - DNA, 14 bp, Homo sapiens
ctggtgctgctgct

SEQ ID NO: 1309605 - DNA, 11 bp, Homo sapiens
ctggtggccca

SEQ ID NO: 1309606 - DNA, 14 bp, Homo sapiens
ctggtggcccagga

SEQ ID NO: 1309607 - DNA, 13 bp, Homo sapiens
ctggtgggccaac

SEQ ID NO: 1309608 - DNA, 16 bp, Homo sapiens
ctgtaattgtgtgtga

SEQ ID NO: 1309609 - DNA, 21 bp, Homo sapiens
ctgtataagtggaggcacttt

SEQ ID NO: 1309610 - DNA, 22 bp, Homo sapiens
ggctggctccagatgcagggca

SEQ ID NO: 1309611 - DNA, 13 bp, Homo sapiens
ggctggtggccca

SEQ ID NO: 1309612 - DNA, 16 bp, Homo sapiens
ggctggtggcccagga

SEQ ID NO: 1309613 - DNA, 17 bp, Homo sapiens
ggctgtcatctgtgcac

SEQ ID NO: 1309614 - DNA, 21 bp, Homo sapiens
ggcttgagaaatatggacact

SEQ ID NO: 1309615 - DNA, 15 bp, Homo sapiens
ggcttggggcttcct

SEQ ID NO: 1309616 - DNA, 12 bp, Homo sapiens
ggctttggattt

SEQ ID NO: 1309617 - DNA, 16 bp, Homo sapiens
gggaactcagatccag

SEQ ID NO: 1309618 - DNA, 23 bp, Homo sapiens
gggaagtgaagactggaagctaa

SEQ ID NO: 1309619 - DNA, 14 bp, Homo sapiens
gggaatcagaactc

SEQ ID NO: 1309620 - DNA, 19 bp, Homo sapiens
gggacgtggctcagccagc

SEQ ID NO: 1309621 - DNA, 22 bp, Homo sapiens
gggacgtggctcagccagcact

SEQ ID NO: 1309622 - DNA, 13 bp, Homo sapiens
gggagaaaattca

SEQ ID NO: 1309623 - DNA, 17 bp, Homo sapiens
gggagattcaagggacc

SEQ ID NO: 1309624 - DNA, 21 bp, Homo sapiens
gggagcccactgtcctgggcc

SEQ ID NO: 1309625 - DNA, 22 bp, Homo sapiens
gggagcctttggttctggccag

SEQ ID NO: 1309626 - DNA, 17 bp, Homo sapiens
gggagttaagacctggc

SEQ ID NO: 1309627 - DNA, 23 bp, Homo sapiens
gggatctggtcctacccatcccc

SEQ ID NO: 1309628 - DNA, 20 bp, Homo sapiens
gggattaatatgaaaactta

SEQ ID NO: 1309629 - DNA, 14 bp, Homo sapiens
gggcaaacaggcag

SEQ ID NO: 1309630 - DNA, 16 bp, Homo sapiens
gggcagcgccaggctg

SEQ ID NO: 1309631 - DNA, 12 bp, Homo sapiens
gggccagagcca

SEQ ID NO: 1309632 - DNA, 14 bp, Homo sapiens
gggccagagccagg

SEQ ID NO: 1309633 - DNA, 13 bp, Homo sapiens
gggccagatccag

SEQ ID NO: 1309634 - DNA, 19 bp, Homo sapiens
gggccagatccagcctggg

SEQ ID NO: 1309635 - DNA, 17 bp, Homo sapiens
gggcccagagcccagct

SEQ ID NO: 1309636 - DNA, 14 bp, Homo sapiens
gggcccccatctca

SEQ ID NO: 1309637 - DNA, 13 bp, Homo sapiens
gggcccggccagc

SEQ ID NO: 1309638 - DNA, 13 bp, Homo sapiens
gggccgctgccac

SEQ ID NO: 1309639 - DNA, 15 bp, Homo sapiens
gggccgctgccaccc

SEQ ID NO: 1309640 - DNA, 17 bp, Homo sapiens
gggcctaggcctcagcc

SEQ ID NO: 1309641 - DNA, 18 bp, Homo sapiens
gggcctgctccagacctg

SEQ ID NO: 1309642 - DNA, 15 bp, Homo sapiens
gggctggactgaggc

SEQ ID NO: 1309643 - DNA, 19 bp, Homo sapiens
gggctggactgaggcctga

SEQ ID NO: 1309644 - DNA, 18 bp, Homo sapiens
gggctgtaaaatgcatga

SEQ ID NO: 1309645 - DNA, 17 bp, Homo sapiens
ggggaaaggcaaggtcc

SEQ ID NO: 1309646 - DNA, 21 bp, Homo sapiens
ggggaactcagatccagggac

SEQ ID NO: 1309647 - DNA, 22 bp, Homo sapiens
ggggagccccttctgctcagct

SEQ ID NO: 1309648 - DNA, 22 bp, Homo sapiens
ggggccgctgccacccacctcc

SEQ ID NO: 1309649 - DNA, 20 bp, Homo sapiens
ggggcgtctgttcccccttc

SEQ ID NO: 1309650 - DNA, 12 bp, Homo sapiens
ggggctctggga

SEQ ID NO: 1309651 - DNA, 17 bp, Homo sapiens
ggggctggcactgactg

SEQ ID NO: 1309652 - DNA, 17 bp, Homo sapiens
gggggaactcagatcca

SEQ ID NO: 1309653 - DNA, 19 bp, Homo sapiens
ggggtcatgccctcctctc

SEQ ID NO: 1309654 - DNA, 11 bp, Homo sapiens
ggggtcctggc

SEQ ID NO: 1309655 - DNA, 20 bp, Homo sapiens
ggggtctggagttgatctgg

SEQ ID NO: 1309656 - DNA, 14 bp, Homo sapiens
ggggtgaggagctg

SEQ ID NO: 1309657 - DNA, 16 bp, Homo sapiens
gggtcctggccatccc

SEQ ID NO: 1309658 - DNA, 17 bp, Homo sapiens
gggtcctggccatccca

SEQ ID NO: 1309659 - DNA, 23 bp, Homo sapiens
gggtggcctaagagttgagctct

SEQ ID NO: 1309660 - DNA, 13 bp, Homo sapiens
gggtgggccaggc

SEQ ID NO: 1309661 - DNA, 21 bp, Homo sapiens
gggtgtgcaatgtctgagtga

SEQ ID NO: 1309662 - DNA, 19 bp, Homo sapiens
ggtacttcttgaaggtgct

SEQ ID NO: 1309663 - DNA, 21 bp, Homo sapiens
ggtcatactatctactctcct

SEQ ID NO: 1309664 - DNA, 15 bp, Homo sapiens
ggtcatgccctcctc

SEQ ID NO: 1309665 - DNA, 16 bp, Homo sapiens
ggtcatgccctcctct

SEQ ID NO: 1309666 - DNA, 20 bp, Homo sapiens
gaagctcctctccccagccc

SEQ ID NO: 1309667 - DNA, 14 bp, Homo sapiens
gaagggccagagcc

SEQ ID NO: 1309668 - DNA, 15 bp, Homo sapiens
gaagggccagagcca

SEQ ID NO: 1309669 - DNA, 17 bp, Homo sapiens
gaagggccagagccagg

SEQ ID NO: 1309670 - DNA, 12 bp, Homo sapiens
gaagggggtggt

SEQ ID NO: 1309671 - DNA, 14 bp, Homo sapiens
gaagtcttttgttc

SEQ ID NO: 1309672 - DNA, 16 bp, Homo sapiens
gaataaaaactttgct

SEQ ID NO: 1309673 - DNA, 10 bp, Homo sapiens
gaatatttat

SEQ ID NO: 1309674 - DNA, 12 bp, Homo sapiens
gaatatttatta

SEQ ID NO: 1309675 - DNA, 15 bp, Homo sapiens
gaatatttattacct

SEQ ID NO: 1309676 - DNA, 21 bp, Homo sapiens
gaatatttattacctctgata

SEQ ID NO: 1309677 - DNA, 13 bp, Homo sapiens
gaatcagaactca

SEQ ID NO: 1309678 - DNA, 19 bp, Homo sapiens
gaatcagtataaacaaagt

SEQ ID NO: 1309679 - DNA, 18 bp, Homo sapiens
gaatctacccccagatcc

SEQ ID NO: 1309680 - DNA, 18 bp, Homo sapiens
gaatgtaagaactacaaa

SEQ ID NO: 1309681 - DNA, 23 bp, Homo sapiens
gaatgtatttatttgggagaccg

SEQ ID NO: 1309682 - DNA, 15 bp, Homo sapiens
gaatgttttaaattc

SEQ ID NO: 1309683 - DNA, 16 bp, Homo sapiens
gaattcaaactggggc

SEQ ID NO: 1309684 - DNA, 22 bp, Homo sapiens
gaattgaggggattaatatgaa

SEQ ID NO: 1309685 - DNA, 15 bp, Homo sapiens
gaattgatttgcatt

SEQ ID NO: 1309686 - DNA, 17 bp, Homo sapiens
gaattgatttgcattga

SEQ ID NO: 1309687 - DNA, 18 bp, Homo sapiens
gaattgatttgcattgaa

SEQ ID NO: 1309688 - DNA, 22 bp, Homo sapiens
gaattgatttgcattgaacaca

SEQ ID NO: 1309689 - DNA, 12 bp, Homo sapiens
gaattgcattga

SEQ ID NO: 1309690 - DNA, 19 bp, Homo sapiens
gaatttaggtttttattag

SEQ ID NO: 1309691 - DNA, 13 bp, Homo sapiens
gaatttattcaat

SEQ ID NO: 1309692 - DNA, 15 bp, Homo sapiens
gaatttcccaggacc

SEQ ID NO: 1309693 - DNA, 16 bp, Homo sapiens
gaatttcccaggaccc

SEQ ID NO: 1309694 - DNA, 22 bp, Homo sapiens
gaatttcccaggaccctgaagg

SEQ ID NO: 1309695 - DNA, 11 bp, Homo sapiens
gacacagaaaa

SEQ ID NO: 1309696 - DNA, 18 bp, Homo sapiens
gacacagaaaatgttgag

SEQ ID NO: 1309697 - DNA, 17 bp, Homo sapiens
gacacaggccctccctg

SEQ ID NO: 1309698 - DNA, 21 bp, Homo sapiens
gacactccccgaagtcttttg

SEQ ID NO: 1309699 - DNA, 20 bp, Homo sapiens
gacacttaatactaccttga

SEQ ID NO: 1309700 - DNA, 23 bp, Homo sapiens
gacagactcacaacctgaaccta

SEQ ID NO: 1309701 - DNA, 17 bp, Homo sapiens
gacagctgctcctagag

SEQ ID NO: 1309702 - DNA, 20 bp, Homo sapiens
gacagctgctcctagaggga

SEQ ID NO: 1309703 - DNA, 15 bp, Homo sapiens
gacagctttgctgct

SEQ ID NO: 1309704 - DNA, 21 bp, Homo sapiens
gacaggagacctggcactgga

SEQ ID NO: 1309705 - DNA, 21 bp, Homo sapiens
gacagtatcactgtctttcct

SEQ ID NO: 1309706 - DNA, 13 bp, Homo sapiens
gacagtctcactt

SEQ ID NO: 1309707 - DNA, 22 bp, Homo sapiens
gacataatggggtcctggccat

SEQ ID NO: 1309708 - DNA, 14 bp, Homo sapiens
gacatacttgaagg

SEQ ID NO: 1309709 - DNA, 18 bp, Homo sapiens
gacatacttgaagggcca

SEQ ID NO: 1309710 - DNA, 19 bp, Homo sapiens
gacatacttgaagggccag

SEQ ID NO: 1309711 - DNA, 23 bp, Homo sapiens
gacatacttgaagggccagagcc

SEQ ID NO: 1309712 - DNA, 18 bp, Homo sapiens
gacatctggaatctggag

SEQ ID NO: 1309713 - DNA, 22 bp, Homo sapiens
gacatgattccttcctgttctg

SEQ ID NO: 1309714 - DNA, 14 bp, Homo sapiens
gacatgatttcctt

SEQ ID NO: 1309715 - DNA, 16 bp, Homo sapiens
gacatgatttccttga

SEQ ID NO: 1309716 - DNA, 16 bp, Homo sapiens
gacatgcggtagccag

SEQ ID NO: 1309717 - DNA, 22 bp, Homo sapiens
gacatgcggtagccagcacaca

SEQ ID NO: 1309718 - DNA, 21 bp, Homo sapiens
gacattgcgtttgacctttta

SEQ ID NO: 1309719 - DNA, 16 bp, Homo sapiens
gacatttctttgtgct

SEQ ID NO: 1309720 - DNA, 14 bp, Homo sapiens
gaccacagcacagc

SEQ ID NO: 1309721 - DNA, 14 bp, Homo sapiens
gaccagctcaggac

SEQ ID NO: 1309722 - DNA, 23 bp, Homo sapiens
gacccagccccttgagaaacctt

SEQ ID NO: 1309723 - DNA, 20 bp, Homo sapiens
gacccagtgcccccactgac

SEQ ID NO: 1309724 - DNA, 23 bp, Homo sapiens
gacccccagctccggcctgtcct

SEQ ID NO: 1309725 - DNA, 14 bp, Homo sapiens
gacccgtccatttg

SEQ ID NO: 1309726 - DNA, 17 bp, Homo sapiens
gaccctgtatatagccc

SEQ ID NO: 1309727 - DNA, 15 bp, Homo sapiens
gaccggcggctcgga

SEQ ID NO: 1309728 - DNA, 22 bp, Homo sapiens
gacctaatgctccttgttccta

SEQ ID NO: 1309729 - DNA, 22 bp, Homo sapiens
gacctggcactggatgcagaaa

SEQ ID NO: 1309730 - DNA, 15 bp, Homo sapiens
gacctggcagctctg

SEQ ID NO: 1309731 - DNA, 19 bp, Homo sapiens
gacctgttagcagacaggc

SEQ ID NO: 1309732 - DNA, 13 bp, Homo sapiens
gaccttaggcctt

SEQ ID NO: 1309733 - DNA, 15 bp, Homo sapiens
gaccttaggccttcc

SEQ ID NO: 1309734 - DNA, 18 bp, Homo sapiens
gaccttaggccttcctct

SEQ ID NO: 1309735 - DNA, 13 bp, Homo sapiens
gactaatttcaaa

SEQ ID NO: 1309736 - DNA, 22 bp, Homo sapiens
gactatatttgggcctgctcca

SEQ ID NO: 1309737 - DNA, 18 bp, Homo sapiens
gactcacaacctgaacct

SEQ ID NO: 1309738 - DNA, 23 bp, Homo sapiens
gactcagggcagcgccaggctga

SEQ ID NO: 1309739 - DNA, 13 bp, Homo sapiens
gactcccattcct

SEQ ID NO: 1309740 - DNA, 13 bp, Homo sapiens
gactgaggcctga

SEQ ID NO: 1309741 - DNA, 18 bp, Homo sapiens
gacttcctgtccagctcc

SEQ ID NO: 1309742 - DNA, 19 bp, Homo sapiens
gacttcctgtccagctcca

SEQ ID NO: 1309743 - DNA, 14 bp, Homo sapiens
gacttccttgagac

SEQ ID NO: 1309744 - DNA, 23 bp, Homo sapiens
gagaaaccttattgtacctctct

SEQ ID NO: 1309745 - DNA, 23 bp, Homo sapiens
gagaaataaagtttgcttagaaa

SEQ ID NO: 1309746 - DNA, 17 bp, Homo sapiens
gagaagccacaggcctg

SEQ ID NO: 1309747 - DNA, 22 bp, Homo sapiens
gagaagccacaggcctgagatt

SEQ ID NO: 1309748 - DNA, 22 bp, Homo sapiens
gagaagccaggaatttcccagg

SEQ ID NO: 1309749 - DNA, 22 bp, Homo sapiens
gagaagctcctctccccagccc

SEQ ID NO: 1309750 - DNA, 21 bp, Homo sapiens
gagaagcttttgaataaaaac

SEQ ID NO: 1309751 - DNA, 15 bp, Homo sapiens
gagaatgtaagaact

SEQ ID NO: 1309752 - DNA, 19 bp, Homo sapiens
gagacagggtttcaccatg

SEQ ID NO: 1309753 - DNA, 15 bp, Homo sapiens
gagacatacttgaag

SEQ ID NO: 1309754 - DNA, 18 bp, Homo sapiens
gagacatacttgaagggc

SEQ ID NO: 1309755 - DNA, 21 bp, Homo sapiens
gagacatacttgaagggccag

SEQ ID NO: 1309756 - DNA, 16 bp, Homo sapiens
gagaccagggagcctt

SEQ ID NO: 1309757 - DNA, 18 bp, Homo sapiens
gagagaaaacagacctaa

SEQ ID NO: 1309758 - DNA, 23 bp, Homo sapiens
gagagaaaacagacctaatgctc

SEQ ID NO: 1309759 - DNA, 20 bp, Homo sapiens
gagaggccctctggagtggc

SEQ ID NO: 1309760 - DNA, 22 bp, Homo sapiens
gagatgatacatccaaagcaga

SEQ ID NO: 1309761 - DNA, 17 bp, Homo sapiens
gagatttcatctgctct

SEQ ID NO: 1309762 - DNA, 20 bp, Homo sapiens
gagatttcatctgctctcct

SEQ ID NO: 1309763 - DNA, 14 bp, Homo sapiens
gagcccagctccaa

SEQ ID NO: 1309764 - DNA, 21 bp, Homo sapiens
gagcccctgtctagagaggga

SEQ ID NO: 1309765 - DNA, 17 bp, Homo sapiens
gagccccttctgctcag

SEQ ID NO: 1309766 - DNA, 16 bp, Homo sapiens
gagcctggtgctgctg

SEQ ID NO: 1309767 - DNA, 18 bp, Homo sapiens
gagcctttggttctggcc

SEQ ID NO: 1309768 - DNA, 23 bp, Homo sapiens
gagcctttggttctggccagaat

SEQ ID NO: 1309769 - DNA, 15 bp, Homo sapiens
gagcgctcctgccgc

SEQ ID NO: 1309770 - DNA, 13 bp, Homo sapiens
gagctattgctgt

SEQ ID NO: 1309771 - DNA, 21 bp, Homo sapiens
gagctgccttggctcagacat

SEQ ID NO: 1309772 - DNA, 18 bp, Homo sapiens
gagctgctatagcctggg

SEQ ID NO: 1309773 - DNA, 20 bp, Homo sapiens
gaggacataatggggtcctg

SEQ ID NO: 1309774 - DNA, 13 bp, Homo sapiens
gaggcaagccctg

SEQ ID NO: 1309775 - DNA, 18 bp, Homo sapiens
gaggccacactcagcaca

SEQ ID NO: 1309776 - DNA, 21 bp, Homo sapiens
gaggccacactcagcacaagg

SEQ ID NO: 1309777 - DNA, 13 bp, Homo sapiens
gaggcccagttca

SEQ ID NO: 1309778 - DNA, 13 bp, Homo sapiens
gaggccccagcct

SEQ ID NO: 1309779 - DNA, 19 bp, Homo sapiens
gaggccccagcctccctga

SEQ ID NO: 1309780 - DNA, 21 bp, Homo sapiens
gaggcctgcctccagggctgg

SEQ ID NO: 1309781 - DNA, 12 bp, Homo sapiens
gaggctcaggtc

SEQ ID NO: 1309782 - DNA, 17 bp, Homo sapiens
ggaactcagatccaggg

SEQ ID NO: 1309783 - DNA, 11 bp, Homo sapiens
ggaagaacacc

SEQ ID NO: 1309784 - DNA, 13 bp, Homo sapiens
ggaagcccccacc

SEQ ID NO: 1309785 - DNA, 20 bp, Homo sapiens
ggaagccgtgctcgccccag

SEQ ID NO: 1309786 - DNA, 16 bp, Homo sapiens
ggaagctaatttgcat

SEQ ID NO: 1309787 - DNA, 18 bp, Homo sapiens
ggaattgatttgcattga

SEQ ID NO: 1309788 - DNA, 14 bp, Homo sapiens
ggaatttcccagga

SEQ ID NO: 1309789 - DNA, 19 bp, Homo sapiens
ggaatttcccaggaccctg

SEQ ID NO: 1309790 - DNA, 15 bp, Homo sapiens
ggacagaggccccag

SEQ ID NO: 1309791 - DNA, 23 bp, Homo sapiens
ggacagaggccccagcctccctg

SEQ ID NO: 1309792 - DNA, 15 bp, Homo sapiens
ggacagccccaccct

SEQ ID NO: 1309793 - DNA, 13 bp, Homo sapiens
ggacaggctggct

SEQ ID NO: 1309794 - DNA, 19 bp, Homo sapiens
ggacataatggggtcctgg

SEQ ID NO: 1309795 - DNA, 21 bp, Homo sapiens
ggacatgcggtagccagcaca

SEQ ID NO: 1309796 - DNA, 13 bp, Homo sapiens
ggaccagctcagg

SEQ ID NO: 1309797 - DNA, 19 bp, Homo sapiens
ggaccagctcaggacagat

SEQ ID NO: 1309798 - DNA, 19 bp, Homo sapiens
ggacccaatgtaggagctg

SEQ ID NO: 1309799 - DNA, 13 bp, Homo sapiens
ggaccctgaaggg

SEQ ID NO: 1309800 - DNA, 14 bp, Homo sapiens
ggacctggctgcca

SEQ ID NO: 1309801 - DNA, 13 bp, Homo sapiens
ggactcagggcag

SEQ ID NO: 1309802 - DNA, 15 bp, Homo sapiens
ggactcagggcagcg

SEQ ID NO: 1309803 - DNA, 22 bp, Homo sapiens
ggactcagggcagcgccaggct

SEQ ID NO: 1309804 - DNA, 14 bp, Homo sapiens
ggactgaggcctga

SEQ ID NO: 1309805 - DNA, 20 bp, Homo sapiens
ggacttcctgtccagctcca

SEQ ID NO: 1309806 - DNA, 21 bp, Homo sapiens
ggacttcctgtccagctccaa

SEQ ID NO: 1309807 - DNA, 20 bp, Homo sapiens
ggagaaaattcaattgtaaa

SEQ ID NO: 1309808 - DNA, 18 bp, Homo sapiens
ggagaagccacaggcctg

SEQ ID NO: 1309809 - DNA, 19 bp, Homo sapiens
ggagaagctcctctcccca

SEQ ID NO: 1309810 - DNA, 12 bp, Homo sapiens
ggagagaaaaca

SEQ ID NO: 1309811 - DNA, 22 bp, Homo sapiens
ggagaggccctctggagtggcc

SEQ ID NO: 1309812 - DNA, 20 bp, Homo sapiens
ggagatggaagttgcagtga

SEQ ID NO: 1309813 - DNA, 20 bp, Homo sapiens
ggagcccactgtcctgggcc

SEQ ID NO: 1309814 - DNA, 16 bp, Homo sapiens
ggagcccagccctccc

SEQ ID NO: 1309815 - DNA, 18 bp, Homo sapiens
ggagccccttctgctcag

SEQ ID NO: 1309816 - DNA, 20 bp, Homo sapiens
ggagcggccggccagcccct

SEQ ID NO: 1309817 - DNA, 19 bp, Homo sapiens
ggagctgctatagcctggg

SEQ ID NO: 1309818 - DNA, 16 bp, Homo sapiens
ggagggaggctcaggt

SEQ ID NO: 1309819 - DNA, 15 bp, Homo sapiens
ggagttaagacctgg

SEQ ID NO: 1309820 - DNA, 16 bp, Homo sapiens
ggagttaagacctggc

SEQ ID NO: 1309821 - DNA, 19 bp, Homo sapiens
ggatcatctgccgtgcctg

SEQ ID NO: 1309822 - DNA, 15 bp, Homo sapiens
ggatctttgtggcca

SEQ ID NO: 1309823 - DNA, 16 bp, Homo sapiens
ggatctttgtggccaa

SEQ ID NO: 1309824 - DNA, 12 bp, Homo sapiens
ggatgccctgga

SEQ ID NO: 1309825 - DNA, 21 bp, Homo sapiens
ggatgccctggaggtggctga

SEQ ID NO: 1309826 - DNA, 21 bp, Homo sapiens
ggatgggggaactcagatcca

SEQ ID NO: 1309827 - DNA, 22 bp, Homo sapiens
ggatgggggaactcagatccag

SEQ ID NO: 1309828 - DNA, 23 bp, Homo sapiens
ggatttcctgctttgggaagccg

SEQ ID NO: 1309829 - DNA, 13 bp, Homo sapiens
ggcaaacaggcag

SEQ ID NO: 1309830 - DNA, 15 bp, Homo sapiens
ggcaacagatctgga

SEQ ID NO: 1309831 - DNA, 16 bp, Homo sapiens
ggcaaccactaagaat

SEQ ID NO: 1309832 - DNA, 19 bp, Homo sapiens
ggcaaccactaagaattca

SEQ ID NO: 1309833 - DNA, 20 bp, Homo sapiens
ggcaatgggagctgaggcca

SEQ ID NO: 1309834 - DNA, 18 bp, Homo sapiens
ggcaccagacacccagga

SEQ ID NO: 1309835 - DNA, 16 bp, Homo sapiens
ggcacctaatccaggc

SEQ ID NO: 1309836 - DNA, 17 bp, Homo sapiens
ggcacctaatccaggca

SEQ ID NO: 1309837 - DNA, 18 bp, Homo sapiens
ggcacctaatccaggcag

SEQ ID NO: 1309838 - DNA, 19 bp, Homo sapiens
ggcacctcacaggccccag

SEQ ID NO: 1309839 - DNA, 21 bp, Homo sapiens
ggcaggaccttcgggctgtgc

SEQ ID NO: 1309840 - DNA, 23 bp, Homo sapiens
ggcaggaccttcgggctgtgccc

SEQ ID NO: 1309841 - DNA, 22 bp, Homo sapiens
ggcagggagcggccggccagcc

SEQ ID NO: 1309842 - DNA, 18 bp, Homo sapiens
ggcagggccaacccttct

SEQ ID NO: 1309843 - DNA, 21 bp, Homo sapiens
ggcagtgagggagggctgtca

SEQ ID NO: 1309844 - DNA, 16 bp, Homo sapiens
ggccaacccttctcct

SEQ ID NO: 1309845 - DNA, 13 bp, Homo sapiens
ggccaaggagctg

SEQ ID NO: 1309846 - DNA, 20 bp, Homo sapiens
ggccacagtagtcttgatga

SEQ ID NO: 1309847 - DNA, 16 bp, Homo sapiens
ggccacatcaaagagg

SEQ ID NO: 1309848 - DNA, 11 bp, Homo sapiens
ggccactaagc

SEQ ID NO: 1309849 - DNA, 21 bp, Homo sapiens
ggccagagagcctggtgctgc

SEQ ID NO: 1309850 - DNA, 12 bp, Homo sapiens
ggccagagccag

SEQ ID NO: 1309851 - DNA, 13 bp, Homo sapiens
ggccagatccagc

SEQ ID NO: 1309852 - DNA, 17 bp, Homo sapiens
ggccagatccagcctgg

SEQ ID NO: 1309853 - DNA, 18 bp, Homo sapiens
ggccagatccagcctggg

SEQ ID NO: 1309854 - DNA, 21 bp, Homo sapiens
ggccaggctgatgggacagaa

SEQ ID NO: 1309855 - DNA, 14 bp, Homo sapiens
ggccatcccacaag

SEQ ID NO: 1309856 - DNA, 22 bp, Homo sapiens
ggccatctgggctcctccaggg

SEQ ID NO: 1309857 - DNA, 13 bp, Homo sapiens
ggcccagagccca

SEQ ID NO: 1309858 - DNA, 17 bp, Homo sapiens
ggcccagagcccagctc

SEQ ID NO: 1309859 - DNA, 15 bp, Homo sapiens
ggcccagggcccaga

SEQ ID NO: 1309860 - DNA, 19 bp, Homo sapiens
ggcccagggcccagagccc

SEQ ID NO: 1309861 - DNA, 22 bp, Homo sapiens
ggcccagggcccagagcccagc

SEQ ID NO: 1309862 - DNA, 18 bp, Homo sapiens
ggccccaggaaaggccca

SEQ ID NO: 1309863 - DNA, 15 bp, Homo sapiens
ggcccccatctcatg

SEQ ID NO: 1309864 - DNA, 12 bp, Homo sapiens
ggcccggccagc

SEQ ID NO: 1309865 - DNA, 22 bp, Homo sapiens
ggccctccctgttccccagaga

SEQ ID NO: 1309866 - DNA, 22 bp, Homo sapiens
ggccgcgccaaataatgtctct

SEQ ID NO: 1309867 - DNA, 21 bp, Homo sapiens
ggccgctgccacccacctccc

SEQ ID NO: 1309868 - DNA, 14 bp, Homo sapiens
ggcctaggcctcag

SEQ ID NO: 1309869 - DNA, 15 bp, Homo sapiens
ggcctccagaactca

SEQ ID NO: 1309870 - DNA, 20 bp, Homo sapiens
ggcctgagatttcatctgct

SEQ ID NO: 1309871 - DNA, 15 bp, Homo sapiens
ggcctgatcagacca

SEQ ID NO: 1309872 - DNA, 18 bp, Homo sapiens
ggcctgcctccagggctg

SEQ ID NO: 1309873 - DNA, 17 bp, Homo sapiens
ggcctgctccagacctg

SEQ ID NO: 1309874 - DNA, 22 bp, Homo sapiens
ggcgcgcacctgtaatcccagc

SEQ ID NO: 1309875 - DNA, 21 bp, Homo sapiens
ggcgtctgttcccccttcaca

SEQ ID NO: 1309876 - DNA, 16 bp, Homo sapiens
ggctagtcaagctcct

SEQ ID NO: 1309877 - DNA, 16 bp, Homo sapiens
ggctccagatgcaggg

SEQ ID NO: 1309878 - DNA, 18 bp, Homo sapiens
ggctccagatgcagggca

SEQ ID NO: 1309879 - DNA, 19 bp, Homo sapiens
ggctccagatgcagggcag

SEQ ID NO: 1309880 - DNA, 22 bp, Homo sapiens
ggctcttctcatttcacccctc

SEQ ID NO: 1309881 - DNA, 17 bp, Homo sapiens
ggctgaccacagcacag

SEQ ID NO: 1309882 - DNA, 19 bp, Homo sapiens
ggctgaccacagcacagcc

SEQ ID NO: 1309883 - DNA, 22 bp, Homo sapiens
ggctgcaaggtttaggctggtg

SEQ ID NO: 1309884 - DNA, 14 bp, Homo sapiens
ggctgcttagaatc

SEQ ID NO: 1309885 - DNA, 14 bp, Homo sapiens
ggctggactgaggc

SEQ ID NO: 1309886 - DNA, 20 bp, Homo sapiens
ggctggagtgcagtggtgtg

SEQ ID NO: 1309887 - DNA, 19 bp, Homo sapiens
ggctgggacgtggctcagc

SEQ ID NO: 1309888 - DNA, 23 bp, Homo sapiens
ggctgggacgtggctcagccagc

SEQ ID NO: 1309889 - DNA, 23 bp, Homo sapiens
ggctggttcggatttggggtgga

SEQ ID NO: 1309890 - DNA, 14 bp, Homo sapiens
ggctgtcatctgtg

SEQ ID NO: 1309891 - DNA, 20 bp, Homo sapiens
ggcttgagcccccgcgccca

SEQ ID NO: 1309892 - DNA, 23 bp, Homo sapiens
gggaatagtctagatggctcctc

SEQ ID NO: 1309893 - DNA, 18 bp, Homo sapiens
gggacaagtggactcagg

SEQ ID NO: 1309894 - DNA, 19 bp, Homo sapiens
gggacaagtggactcaggg

SEQ ID NO: 1309895 - DNA, 21 bp, Homo sapiens
gggacagaggccccagcctcc

SEQ ID NO: 1309896 - DNA, 20 bp, Homo sapiens
gggacgtggctcagccagca

SEQ ID NO: 1309897 - DNA, 15 bp, Homo sapiens
gggactgaagccaaa

SEQ ID NO: 1309898 - DNA, 12 bp, Homo sapiens
gttttaaattct

SEQ ID NO: 1309899 - DNA, 15 bp, Homo sapiens
gttttcaagtcaaat

SEQ ID NO: 1309900 - DNA, 17 bp, Homo sapiens
gttttcatttggttcat

SEQ ID NO: 1309901 - DNA, 21 bp, Homo sapiens
gttttccctgacctccctcta

SEQ ID NO: 1309902 - DNA, 13 bp, Homo sapiens
gttttcctccctt

SEQ ID NO: 1309903 - DNA, 14 bp, Homo sapiens
gttttcctcccttc

SEQ ID NO: 1309904 - DNA, 18 bp, Homo sapiens
gttttcctcccttctgct

SEQ ID NO: 1309905 - DNA, 22 bp, Homo sapiens
gttttcctcccttctgctactg

SEQ ID NO: 1309906 - DNA, 14 bp, Homo sapiens
gttttgttcccctc

SEQ ID NO: 1309907 - DNA, 16 bp, Homo sapiens
gttttgttcccctcct

SEQ ID NO: 1309908 - DNA, 17 bp, Homo sapiens
gttttgttcccctcctc

SEQ ID NO: 1309909 - DNA, 22 bp, Homo sapiens
gttttgttcccctcctccactc

SEQ ID NO: 1309910 - DNA, 13 bp, Homo sapiens
gtttttaagctgt

SEQ ID NO: 1309911 - DNA, 19 bp, Homo sapiens
taaaaaaaaagatctgttt

SEQ ID NO: 1309912 - DNA, 13 bp, Homo sapiens
taaaaaaattggt

SEQ ID NO: 1309913 - DNA, 11 bp, Homo sapiens
taaaaaacaac

SEQ ID NO: 1309914 - DNA, 17 bp, Homo sapiens
taaaactggctttggct

SEQ ID NO: 1309915 - DNA, 22 bp, Homo sapiens
taaaagtgggcttgattctgca

SEQ ID NO: 1309916 - DNA, 19 bp, Homo sapiens
taaaatgcatgattttgta

SEQ ID NO: 1309917 - DNA, 20 bp, Homo sapiens
taaacatccaatattttctt

SEQ ID NO: 1309918 - DNA, 12 bp, Homo sapiens
taaagcatttat

SEQ ID NO: 1309919 - DNA, 22 bp, Homo sapiens
taaaggatgtgattgtggaatg

SEQ ID NO: 1309920 - DNA, 15 bp, Homo sapiens
taaatctgacccagt

SEQ ID NO: 1309921 - DNA, 16 bp, Homo sapiens
taaatctgacccagtg

SEQ ID NO: 1309922 - DNA, 15 bp, Homo sapiens
tcagccttgccagag

SEQ ID NO: 1309923 - DNA, 16 bp, Homo sapiens
tcagctgtagtcctca

SEQ ID NO: 1309924 - DNA, 13 bp, Homo sapiens
tcaggaagaacac

SEQ ID NO: 1309925 - DNA, 23 bp, Homo sapiens
tcaggatctcttagcattttaat

SEQ ID NO: 1309926 - DNA, 15 bp, Homo sapiens
tcagggcagcgccag

SEQ ID NO: 1309927 - DNA, 13 bp, Homo sapiens
tcaggtggccatg

SEQ ID NO: 1309928 - DNA, 16 bp, Homo sapiens
tcagtcaatattttta

SEQ ID NO: 1309929 - DNA, 17 bp, Homo sapiens
tcagtggcgagaaataa

SEQ ID NO: 1309930 - DNA, 14 bp, Homo sapiens
tcatcgaatctact

SEQ ID NO: 1309931 - DNA, 16 bp, Homo sapiens
tcatctctctgcccaa

SEQ ID NO: 1309932 - DNA, 12 bp, Homo sapiens
tcatctgctctc

SEQ ID NO: 1309933 - DNA, 21 bp, Homo sapiens
tcatctgctctccttcctgga

SEQ ID NO: 1309934 - DNA, 13 bp, Homo sapiens
tcatctttcttga

SEQ ID NO: 1309935 - DNA, 16 bp, Homo sapiens
tcatgcccctggctgg

SEQ ID NO: 1309936 - DNA, 15 bp, Homo sapiens
tcatgccctcctctc

SEQ ID NO: 1309937 - DNA, 23 bp, Homo sapiens
tcattgctgagcctctgctcccc

SEQ ID NO: 1309938 - DNA, 16 bp, Homo sapiens
tcatttcacccctccc

SEQ ID NO: 1309939 - DNA, 21 bp, Homo sapiens
tcatttcacccctccctttct

SEQ ID NO: 1309940 - DNA, 16 bp, Homo sapiens
tcatttttttccaggc

SEQ ID NO: 1309941 - DNA, 14 bp, Homo sapiens
tccaaaagaagccc

SEQ ID NO: 1309942 - DNA, 18 bp, Homo sapiens
tccaaacttggatttttg

SEQ ID NO: 1309943 - DNA, 22 bp, Homo sapiens
tccaaacttggatttttgactc

SEQ ID NO: 1309944 - DNA, 20 bp, Homo sapiens
tccaaagagtagaattgcat

SEQ ID NO: 1309945 - DNA, 22 bp, Homo sapiens
tccaaagagtagaattgcattg

SEQ ID NO: 1309946 - DNA, 23 bp, Homo sapiens
tccaaagagtagaattgcattga

SEQ ID NO: 1309947 - DNA, 15 bp, Homo sapiens
tccaaagcagacagc

SEQ ID NO: 1309948 - DNA, 21 bp, Homo sapiens
tccaacaccaagcacagcagc

SEQ ID NO: 1309949 - DNA, 17 bp, Homo sapiens
tccaaccccccagcact

SEQ ID NO: 1309950 - DNA, 21 bp, Homo sapiens
tccaacctggggggcagtggt

SEQ ID NO: 1309951 - DNA, 15 bp, Homo sapiens
tccacaccttttatt

SEQ ID NO: 1309952 - DNA, 15 bp, Homo sapiens
tccaccaggaacctc

SEQ ID NO: 1309953 - DNA, 15 bp, Homo sapiens
tccactcagttgcaa

SEQ ID NO: 1309954 - DNA, 16 bp, Homo sapiens
tgctgttttcctccct

SEQ ID NO: 1309955 - DNA, 19 bp, Homo sapiens
tgctgttttcctcccttct

SEQ ID NO: 1309956 - DNA, 14 bp, Homo sapiens
tgcttagaaaagaa

SEQ ID NO: 1309957 - DNA, 14 bp, Homo sapiens
tgcttgagtcaggt

SEQ ID NO: 1309958 - DNA, 14 bp, Homo sapiens
tgctttatgctgaa

SEQ ID NO: 1309959 - DNA, 15 bp, Homo sapiens
tgctttatgctgaaa

SEQ ID NO: 1309960 - DNA, 17 bp, Homo sapiens
tgctttatgctgaaaca

SEQ ID NO: 1309961 - DNA, 14 bp, Homo sapiens
tgctttattccaga

SEQ ID NO: 1309962 - DNA, 17 bp, Homo sapiens
tgctttattccagaatg

SEQ ID NO: 1309963 - DNA, 12 bp, Homo sapiens
tgctttctgctc

SEQ ID NO: 1309964 - DNA, 19 bp, Homo sapiens
tgctttctgctcagcttct

SEQ ID NO: 1309965 - DNA, 13 bp, Homo sapiens
tgctttgctttct

SEQ ID NO: 1309966 - DNA, 17 bp, Homo sapiens
tgctttggcttacttgt

SEQ ID NO: 1309967 - DNA, 14 bp, Homo sapiens
tggaacccagactc

SEQ ID NO: 1309968 - DNA, 16 bp, Homo sapiens
tggaacctcagcctgg

SEQ ID NO: 1309969 - DNA, 16 bp, Homo sapiens
tggaacttacattgtt

SEQ ID NO: 1309970 - DNA, 18 bp, Homo sapiens
tggaatactttttgttat

SEQ ID NO: 1309971 - DNA, 17 bp, Homo sapiens
tggaatctggagaccag

SEQ ID NO: 1309972 - DNA, 22 bp, Homo sapiens
tggaattgatttgcattgaaca

SEQ ID NO: 1309973 - DNA, 14 bp, Homo sapiens
tggacagccccacc

SEQ ID NO: 1309974 - DNA, 19 bp, Homo sapiens
tggaccttaggccttcctc

SEQ ID NO: 1309975 - DNA, 21 bp, Homo sapiens
tggagaagccacaggcctgag

SEQ ID NO: 1309976 - DNA, 23 bp, Homo sapiens
tggagcccagaggagggcagcag

SEQ ID NO: 1309977 - DNA, 13 bp, Homo sapiens
tggagtggccact

SEQ ID NO: 1309978 - DNA, 17 bp, Homo sapiens
tggagttgatctggaac

SEQ ID NO: 1309979 - DNA, 22 bp, Homo sapiens
tggagttgatctggaacccaga

SEQ ID NO: 1309980 - DNA, 20 bp, Homo sapiens
tggatcctgaaatagaggct

SEQ ID NO: 1309981 - DNA, 18 bp, Homo sapiens
tggatgggggaactcaga

SEQ ID NO: 1309982 - DNA, 21 bp, Homo sapiens
tggatgggggaactcagatcc

SEQ ID NO: 1309983 - DNA, 23 bp, Homo sapiens
tggatgggggaactcagatccag

SEQ ID NO: 1309984 - DNA, 14 bp, Homo sapiens
tggattggggtccc

SEQ ID NO: 1309985 - DNA, 14 bp, Homo sapiens
tggatttgacattg

SEQ ID NO: 1309986 - DNA, 20 bp, Homo sapiens
tggatttttgactctggcaa

SEQ ID NO: 1309987 - DNA, 16 bp, Homo sapiens
tggcaacagatctgga

SEQ ID NO: 1309988 - DNA, 14 bp, Homo sapiens
tggcaccagacacc

SEQ ID NO: 1309989 - DNA, 20 bp, Homo sapiens
tggcaccagacacccaggac

SEQ ID NO: 1309990 - DNA, 22 bp, Homo sapiens
tggcagcctcccatccagggcc

SEQ ID NO: 1309991 - DNA, 11 bp, Homo sapiens
tggcagctctg

SEQ ID NO: 1309992 - DNA, 21 bp, Homo sapiens
tggcagctctggacagcccca

SEQ ID NO: 1309993 - DNA, 18 bp, Homo sapiens
tggccactaagcagagga

SEQ ID NO: 1309994 - DNA, 12 bp, Homo sapiens
tggccagacaca

SEQ ID NO: 1309995 - DNA, 17 bp, Homo sapiens
tggcccaggaccatcat

SEQ ID NO: 1309996 - DNA, 15 bp, Homo sapiens
tggcccagggcccag

SEQ ID NO: 1309997 - DNA, 22 bp, Homo sapiens
tggcccagggcccagagcccag

SEQ ID NO: 1309998 - DNA, 15 bp, Homo sapiens
tggccccaggacctg

SEQ ID NO: 1309999 - DNA, 20 bp, Homo sapiens
tggccccaggacctggctgc

SEQ ID NO: 1310000 - DNA, 17 bp, Homo sapiens
tggccgagtccaagctg

SEQ ID NO: 1310001 - DNA, 22 bp, Homo sapiens
tggccgcgccaaataatgtctc

SEQ ID NO: 1310002 - DNA, 23 bp, Homo sapiens
tggccgcgccaaataatgtctct

SEQ ID NO: 1310003 - DNA, 20 bp, Homo sapiens
tggctagtcaagctcctcct

SEQ ID NO: 1310004 - DNA, 13 bp, Homo sapiens
tggctcagccagc

SEQ ID NO: 1310005 - DNA, 15 bp, Homo sapiens
tgggaagtgaagact

SEQ ID NO: 1310006 - DNA, 20 bp, Homo sapiens
tgggaatgttacattgtttg

SEQ ID NO: 1310007 - DNA, 20 bp, Homo sapiens
tgggacgtggctcagccagc

SEQ ID NO: 1310008 - DNA, 23 bp, Homo sapiens
tgggagattcaagggacccatga

SEQ ID NO: 1310009 - DNA, 22 bp, Homo sapiens
tgggagctgaggccacactcag

SEQ ID NO: 1310010 - DNA, 19 bp, Homo sapiens
tgggccagacatgccacaa

SEQ ID NO: 1310011 - DNA, 19 bp, Homo sapiens
tgggccattctccacagca

SEQ ID NO: 1310012 - DNA, 13 bp, Homo sapiens
tgggcctgcagaa

SEQ ID NO: 1310013 - DNA, 15 bp, Homo sapiens
tgggcctgctccaga

SEQ ID NO: 1310014 - DNA, 20 bp, Homo sapiens
tgggcctgctccagacctga

SEQ ID NO: 1310015 - DNA, 22 bp, Homo sapiens
tggggagccaacagaagcttcc

SEQ ID NO: 1310016 - DNA, 17 bp, Homo sapiens
tggggagttaagacctg

SEQ ID NO: 1310017 - DNA, 20 bp, Homo sapiens
tggggatccctcccccccat

SEQ ID NO: 1310018 - DNA, 14 bp, Homo sapiens
tggggctggcctcc

SEQ ID NO: 1310019 - DNA, 16 bp, Homo sapiens
tgggggtgggccaggc

SEQ ID NO: 1310020 - DNA, 13 bp, Homo sapiens
tggggtccctcta

SEQ ID NO: 1310021 - DNA, 12 bp, Homo sapiens
tggggtcctggc

SEQ ID NO: 1310022 - DNA, 19 bp, Homo sapiens
tggggtcctggccatccca

SEQ ID NO: 1310023 - DNA, 17 bp, Homo sapiens
tggggtctggcagcctc

SEQ ID NO: 1310024 - DNA, 18 bp, Homo sapiens
tggggtctggcagcctcc

SEQ ID NO: 1310025 - DNA, 17 bp, Homo sapiens
tgggtgacagagcaaga

SEQ ID NO: 1310026 - DNA, 16 bp, Homo sapiens
tgggtgggcaggaaaa

SEQ ID NO: 1310027 - DNA, 15 bp, Homo sapiens
tgggtgttcctggca

SEQ ID NO: 1310028 - DNA, 19 bp, Homo sapiens
tgggtgttcctggcagttt

SEQ ID NO: 1310029 - DNA, 15 bp, Homo sapiens
tggtaatcttgctct

SEQ ID NO: 1310030 - DNA, 13 bp, Homo sapiens
tggtgccccagga

SEQ ID NO: 1310031 - DNA, 20 bp, Homo sapiens
tggtgccccaggaccagctc

SEQ ID NO: 1310032 - DNA, 13 bp, Homo sapiens
tggtgctgagaag

SEQ ID NO: 1310033 - DNA, 23 bp, Homo sapiens
tggtgggccaacaaagaacacta

SEQ ID NO: 1310034 - DNA, 14 bp, Homo sapiens
tggttctcatcttt

SEQ ID NO: 1310035 - DNA, 17 bp, Homo sapiens
tggttctcatctttctt

SEQ ID NO: 1310036 - DNA, 19 bp, Homo sapiens
tggttgctgttttcctccc

SEQ ID NO: 1310037 - DNA, 21 bp, Homo sapiens
tgtaaaggagtcaaaactaca

SEQ ID NO: 1310038 - DNA, 14 bp, Homo sapiens
tgtacatctatttt

SEQ ID NO: 1310039 - DNA, 18 bp, Homo sapiens
tgtacatctattttggat

SEQ ID NO: 1310040 - DNA, 21 bp, Homo sapiens
tgtacatctattttggattgt

SEQ ID NO: 1310041 - DNA, 12 bp, Homo sapiens
tgtaggagctgc

SEQ ID NO: 1310042 - DNA, 14 bp, Homo sapiens
tgtagtaattgaca

SEQ ID NO: 1310043 - DNA, 16 bp, Homo sapiens
tgtagtaattgacatg

SEQ ID NO: 1310044 - DNA, 17 bp, Homo sapiens
tgtagtcctcataaaaa

SEQ ID NO: 1310045 - DNA, 19 bp, Homo sapiens
tgtataagtggaggcactt

SEQ ID NO: 1310046 - DNA, 20 bp, Homo sapiens
tgtataagtggaggcacttt

SEQ ID NO: 1310047 - DNA, 23 bp, Homo sapiens
tgtataagtggaggcactttagg

SEQ ID NO: 1310048 - DNA, 21 bp, Homo sapiens
tgtatatttgtgatagcactt

SEQ ID NO: 1310049 - DNA, 22 bp, Homo sapiens
tgtcactcattgctgagcctct

SEQ ID NO: 1310050 - DNA, 22 bp, Homo sapiens
tgtcagtcacagccacccctga

SEQ ID NO: 1310051 - DNA, 16 bp, Homo sapiens
tgtccaaaactgcctc

SEQ ID NO: 1310052 - DNA, 11 bp, Homo sapiens
tgtccagctcc

SEQ ID NO: 1310053 - DNA, 16 bp, Homo sapiens
tgtccagctccaacct

SEQ ID NO: 1310054 - DNA, 11 bp, Homo sapiens
tgtccccttct

SEQ ID NO: 1310055 - DNA, 12 bp, Homo sapiens
tgtcctcagcct

SEQ ID NO: 1310056 - DNA, 20 bp, Homo sapiens
tgtgaaataaaactggcttt

SEQ ID NO: 1310057 - DNA, 20 bp, Homo sapiens
tgtgaagccaattcagacag

SEQ ID NO: 1310058 - DNA, 15 bp, Homo sapiens
tgtgacccccagctc

SEQ ID NO: 1310059 - DNA, 14 bp, Homo sapiens
tgtgagcccagctg

SEQ ID NO: 1310060 - DNA, 15 bp, Homo sapiens
tgtgcacatctctgc

SEQ ID NO: 1310061 - DNA, 20 bp, Homo sapiens
tgtgcacatctctgcttgag

SEQ ID NO: 1310062 - DNA, 13 bp, Homo sapiens
tgtgcacatcttc

SEQ ID NO: 1310063 - DNA, 12 bp, Homo sapiens
tgtgcactaagg

SEQ ID NO: 1310064 - DNA, 17 bp, Homo sapiens
tgtgcactaaggggccc

SEQ ID NO: 1310065 - DNA, 13 bp, Homo sapiens
tgtgcactgccca

SEQ ID NO: 1310066 - DNA, 21 bp, Homo sapiens
tgtgccagggcaatgatgaat

SEQ ID NO: 1310067 - DNA, 13 bp, Homo sapiens
tgtgctttatgct

SEQ ID NO: 1310068 - DNA, 14 bp, Homo sapiens
tgtggccaaggagc

SEQ ID NO: 1310069 - DNA, 15 bp, Homo sapiens
tgtggccaaggagct

SEQ ID NO: 1310070 - DNA, 20 bp, Homo sapiens
tgtggccaaggagctgctat

SEQ ID NO: 1310071 - DNA, 17 bp, Homo sapiens
tgtggcctgcacagtga

SEQ ID NO: 1310072 - DNA, 15 bp, Homo sapiens
tgtgtacccaaacgt

SEQ ID NO: 1310073 - DNA, 18 bp, Homo sapiens
tgtgtgaatgaacactct

SEQ ID NO: 1310074 - DNA, 22 bp, Homo sapiens
tgtgtgaatgaacactcttttg

SEQ ID NO: 1310075 - DNA, 13 bp, Homo sapiens
tgtgtgtgtgaat

SEQ ID NO: 1310076 - DNA, 19 bp, Homo sapiens
tgtgtgttgccacaggaca

SEQ ID NO: 1310077 - DNA, 18 bp, Homo sapiens
tgtgttgccacaggacac

SEQ ID NO: 1310078 - DNA, 14 bp, Homo sapiens
tgttactgtaattc

SEQ ID NO: 1310079 - DNA, 15 bp, Homo sapiens
tgttactgtaattcc

SEQ ID NO: 1310080 - DNA, 13 bp, Homo sapiens
tgttcccctcctc

SEQ ID NO: 1310081 - DNA, 23 bp, Homo sapiens
tgttcccctcctccactctcccc

SEQ ID NO: 1310082 - DNA, 20 bp, Homo sapiens
tgttcgcatggtcacacact

SEQ ID NO: 1310083 - DNA, 13 bp, Homo sapiens
tgttctgaactgt

SEQ ID NO: 1310084 - DNA, 23 bp, Homo sapiens
tgttctgcaaaaatatttataaa

SEQ ID NO: 1310085 - DNA, 18 bp, Homo sapiens
tgttgaatactttttaca

SEQ ID NO: 1310086 - DNA, 16 bp, Homo sapiens
tgttgacacaggtctt

SEQ ID NO: 1310087 - DNA, 13 bp, Homo sapiens
tgttgtcccttct

SEQ ID NO: 1310088 - DNA, 17 bp, Homo sapiens
tgtttagcagcagcctt

SEQ ID NO: 1310089 - DNA, 22 bp, Homo sapiens
tgtttagcagcagcctttaatg

SEQ ID NO: 1310090 - DNA, 12 bp, Homo sapiens
tgttttccctga

SEQ ID NO: 1310091 - DNA, 16 bp, Homo sapiens
tgttttccctgacctc

SEQ ID NO: 1310092 - DNA, 16 bp, Homo sapiens
tgttttccgtgaaaac

SEQ ID NO: 1310093 - DNA, 17 bp, Homo sapiens
tgttttgaaggcaaaat

SEQ ID NO: 1310094 - DNA, 20 bp, Homo sapiens
tgtttttaagctgtttccat

SEQ ID NO: 1310095 - DNA, 20 bp, Homo sapiens
ttaaaaaaattggttggaga

SEQ ID NO: 1310096 - DNA, 15 bp, Homo sapiens
ttaaatacaaaactt

SEQ ID NO: 1310097 - DNA, 16 bp, Homo sapiens
ttaaatacaaaacttc

SEQ ID NO: 1310098 - DNA, 18 bp, Homo sapiens
ttaaatacaaaacttcca

SEQ ID NO: 1310099 - DNA, 16 bp, Homo sapiens
ttaaattttgtgtctc

SEQ ID NO: 1310100 - DNA, 16 bp, Homo sapiens
ttaactagaatttatt

SEQ ID NO: 1310101 - DNA, 12 bp, Homo sapiens
ttaacttctgcc

SEQ ID NO: 1310102 - DNA, 12 bp, Homo sapiens
ttaagaaggcaa

SEQ ID NO: 1310103 - DNA, 16 bp, Homo sapiens
ttaagacatgatttcc

SEQ ID NO: 1310104 - DNA, 12 bp, Homo sapiens
ttaatatgaaaa

SEQ ID NO: 1310105 - DNA, 15 bp, Homo sapiens
ttaatatgaaaactt

SEQ ID NO: 1310106 - DNA, 17 bp, Homo sapiens
ttaatatgaaaacttat

SEQ ID NO: 1310107 - DNA, 18 bp, Homo sapiens
ttaatgcatctagattat

SEQ ID NO: 1310108 - DNA, 23 bp, Homo sapiens
ttaatgccgatatactctagatg

SEQ ID NO: 1310109 - DNA, 18 bp, Homo sapiens
ttaatgcttttatatttt

SEQ ID NO: 1310110 - DNA, 16 bp, Homo sapiens
ttacattgttcaatta

SEQ ID NO: 1310111 - DNA, 13 bp, Homo sapiens
ttacgctttgatt

SEQ ID NO: 1310112 - DNA, 15 bp, Homo sapiens
ttacgctttgattca

SEQ ID NO: 1310113 - DNA, 16 bp, Homo sapiens
ttactaggtaacttca

SEQ ID NO: 1310114 - DNA, 17 bp, Homo sapiens
ttactaggtaacttcat

SEQ ID NO: 1310115 - DNA, 19 bp, Homo sapiens
ttactaggtaacttcatat

SEQ ID NO: 1310116 - DNA, 17 bp, Homo sapiens
ttactcaggaagaacac

SEQ ID NO: 1310117 - DNA, 17 bp, Homo sapiens
ttactgagcttctctgt

SEQ ID NO: 1310118 - DNA, 15 bp, Homo sapiens
ttactgtaattcctc

SEQ ID NO: 1310119 - DNA, 19 bp, Homo sapiens
ttagaaaatgttatttaac

SEQ ID NO: 1310120 - DNA, 22 bp, Homo sapiens
ttagaatccaaacttggatttt

SEQ ID NO: 1310121 - DNA, 16 bp, Homo sapiens
ttagatggattctcca

SEQ ID NO: 1310122 - DNA, 21 bp, Homo sapiens
ttagctaaacggattccaaag

SEQ ID NO: 1310123 - DNA, 16 bp, Homo sapiens
ttaggagaagccagga

SEQ ID NO: 1310124 - DNA, 17 bp, Homo sapiens
ttaggagaagccaggaa

SEQ ID NO: 1310125 - DNA, 16 bp, Homo sapiens
ttaggccttcctctct

SEQ ID NO: 1310126 - DNA, 19 bp, Homo sapiens
ttaggctggtggcccagga

SEQ ID NO: 1310127 - DNA, 16 bp, Homo sapiens
ttataatttttttcaa

SEQ ID NO: 1310128 - DNA, 16 bp, Homo sapiens
ttatactctttctgta

SEQ ID NO: 1310129 - DNA, 14 bp, Homo sapiens
ttatcagtcaatat

SEQ ID NO: 1310130 - DNA, 19 bp, Homo sapiens
ttatcatggtctcagtcat

SEQ ID NO: 1310131 - DNA, 15 bp, Homo sapiens
ttatctaaaagaaat

SEQ ID NO: 1310132 - DNA, 19 bp, Homo sapiens
ttatctatacatatcttta

SEQ ID NO: 1310133 - DNA, 16 bp, Homo sapiens
ttatcttgtctctggg

SEQ ID NO: 1310134 - DNA, 20 bp, Homo sapiens
ttatggaattgatttgcatt

SEQ ID NO: 1310135 - DNA, 22 bp, Homo sapiens
ttatgttttttaaaatatttat

SEQ ID NO: 1310136 - DNA, 18 bp, Homo sapiens
ttattagggagaaaattc

SEQ ID NO: 1310137 - DNA, 24 bp, Homo sapiens
ttattagtaccatagtaccattta

SEQ ID NO: 1310138 - DNA, 18 bp, Homo sapiens
ttattcaattcctctggg

SEQ ID NO: 1310139 - DNA, 22 bp, Homo sapiens
ttattccagaatgctgtacatc

SEQ ID NO: 1310140 - DNA, 14 bp, Homo sapiens
ttattgacacagaa

SEQ ID NO: 1310141 - DNA, 12 bp, Homo sapiens
ttattgcatttg

SEQ ID NO: 1310142 - DNA, 15 bp, Homo sapiens
ttattgtacctctct

SEQ ID NO: 1310143 - DNA, 13 bp, Homo sapiens
ttatttaacagct

SEQ ID NO: 1310144 - DNA, 14 bp, Homo sapiens
ttattttcacctgt

SEQ ID NO: 1310145 - DNA, 16 bp, Homo sapiens
ttcaaactggggcctc

SEQ ID NO: 1310146 - DNA, 14 bp, Homo sapiens
ttcaagttcaatcc

SEQ ID NO: 1310147 - DNA, 12 bp, Homo sapiens
ttcaattcctct

SEQ ID NO: 1310148 - DNA, 16 bp, Homo sapiens
ttcaattcctctggga

SEQ ID NO: 1310149 - DNA, 16 bp, Homo sapiens
ttcacaaacttttata

SEQ ID NO: 1310150 - DNA, 15 bp, Homo sapiens
ttcacaaagcccaag

SEQ ID NO: 1310151 - DNA, 20 bp, Homo sapiens
ttcacagttctttgggccag

SEQ ID NO: 1310152 - DNA, 12 bp, Homo sapiens
ttcacccctccc

SEQ ID NO: 1310153 - DNA, 21 bp, Homo sapiens
ttcacctgtttttaagctgtt

SEQ ID NO: 1310154 - DNA, 23 bp, Homo sapiens
ttcacctgtttttaagctgtttc

SEQ ID NO: 1310155 - DNA, 14 bp, Homo sapiens
ttcaccttgaagaa

SEQ ID NO: 1310156 - DNA, 18 bp, Homo sapiens
ttcagaaagtgtgcttta

SEQ ID NO: 1310157 - DNA, 21 bp, Homo sapiens
ttcagactcccattcctgaag

SEQ ID NO: 1310158 - DNA, 20 bp, Homo sapiens
ttcatcgaatctactaattc

SEQ ID NO: 1310159 - DNA, 13 bp, Homo sapiens
ttcatctgctctc

SEQ ID NO: 1310160 - DNA, 21 bp, Homo sapiens
ttcatctgctctccttcctgg

SEQ ID NO: 1310161 - DNA, 16 bp, Homo sapiens
ttcattaattctataa

SEQ ID NO: 1310162 - DNA, 13 bp, Homo sapiens
ttcattcttgaaa

SEQ ID NO: 1310163 - DNA, 21 bp, Homo sapiens
ttcatttagctaaacggattc

SEQ ID NO: 1310164 - DNA, 22 bp, Homo sapiens
ttcatttggttcattaattcta

SEQ ID NO: 1310165 - DNA, 17 bp, Homo sapiens
ttcatttttttccaggc

SEQ ID NO: 1310166 - DNA, 21 bp, Homo sapiens
ttccaaagagtagaattgcat

SEQ ID NO: 1310167 - DNA, 22 bp, Homo sapiens
ttccacaccttttattgacaca

SEQ ID NO: 1310168 - DNA, 11 bp, Homo sapiens
ttccagtctcc

SEQ ID NO: 1310169 - DNA, 18 bp, Homo sapiens
ttccagtgtccttagaac

SEQ ID NO: 1310170 - DNA, 13 bp, Homo sapiens
ttcccaggaccct

SEQ ID NO: 1310171 - DNA, 13 bp, Homo sapiens
tttattacctctg

SEQ ID NO: 1310172 - DNA, 19 bp, Homo sapiens
tttattccagaatgctgta

SEQ ID NO: 1310173 - DNA, 12 bp, Homo sapiens
tttattgacaca

SEQ ID NO: 1310174 - DNA, 14 bp, Homo sapiens
tttatttatttaca

SEQ ID NO: 1310175 - DNA, 13 bp, Homo sapiens
tttcaaaatgctt

SEQ ID NO: 1310176 - DNA, 20 bp, Homo sapiens
tttcaataaagcatttataa

SEQ ID NO: 1310177 - DNA, 14 bp, Homo sapiens
tttcacccctccct

SEQ ID NO: 1310178 - DNA, 23 bp, Homo sapiens
tttcacctgtttttaagctgttt

SEQ ID NO: 1310179 - DNA, 11 bp, Homo sapiens
tttcagactcc

SEQ ID NO: 1310180 - DNA, 21 bp, Homo sapiens
tttcagactcccattcctgaa

SEQ ID NO: 1310181 - DNA, 20 bp, Homo sapiens
tttcatctgctctccttcct

SEQ ID NO: 1310182 - DNA, 19 bp, Homo sapiens
tttcatttggttcattaat

SEQ ID NO: 1310183 - DNA, 12 bp, Homo sapiens
tttcccaactct

SEQ ID NO: 1310184 - DNA, 18 bp, Homo sapiens
tttcccaggaccctgaag

SEQ ID NO: 1310185 - DNA, 12 bp, Homo sapiens
tttcctcccttc

SEQ ID NO: 1310186 - DNA, 13 bp, Homo sapiens
tttcctcccttct

SEQ ID NO: 1310187 - DNA, 14 bp, Homo sapiens
tttcctcccttctg

SEQ ID NO: 1310188 - DNA, 21 bp, Homo sapiens
tttcctgaaacaacttggaaa

SEQ ID NO: 1310189 - DNA, 16 bp, Homo sapiens
tttccttaatccagct

SEQ ID NO: 1310190 - DNA, 18 bp, Homo sapiens
tttctacaatgtgaactt

SEQ ID NO: 1310191 - DNA, 21 bp, Homo sapiens
tttctagctgttgagctgttt

SEQ ID NO: 1310192 - DNA, 22 bp, Homo sapiens
tttctattaaattaaattttgt

SEQ ID NO: 1310193 - DNA, 16 bp, Homo sapiens
tttctcccctgccccc

SEQ ID NO: 1310194 - DNA, 20 bp, Homo sapiens
tttctcccctgcccccagga

SEQ ID NO: 1310195 - DNA, 21 bp, Homo sapiens
tttcttgcctctgtccccttc

SEQ ID NO: 1310196 - DNA, 15 bp, Homo sapiens
tttctttaaaaaaca

SEQ ID NO: 1310197 - DNA, 13 bp, Homo sapiens
tttgaccttttat

SEQ ID NO: 1310198 - DNA, 19 bp, Homo sapiens
tttgaccttttatgtagta

SEQ ID NO: 1310199 - DNA, 19 bp, Homo sapiens
tttgactctggcaaagctt

SEQ ID NO: 1310200 - DNA, 20 bp, Homo sapiens
tttgactctggcaaagcttt

SEQ ID NO: 1310201 - DNA, 14 bp, Homo sapiens
tttgagaagaaaac

SEQ ID NO: 1310202 - DNA, 20 bp, Homo sapiens
tttgattcatagtaacttct

SEQ ID NO: 1310203 - DNA, 21 bp, Homo sapiens
tttgattctccttcagccctc

SEQ ID NO: 1310204 - DNA, 15 bp, Homo sapiens
tttgattgatttgaa

SEQ ID NO: 1310205 - DNA, 22 bp, Homo sapiens
tttgcattaaattcacaaactt

SEQ ID NO: 1310206 - DNA, 19 bp, Homo sapiens
tttgcattgaacacaaact

SEQ ID NO: 1310207 - DNA, 18 bp, Homo sapiens
tttgctgtatatttgtga

SEQ ID NO: 1310208 - DNA, 17 bp, Homo sapiens
tttggaatactttttgt

SEQ ID NO: 1310209 - DNA, 22 bp, Homo sapiens
tttgggaagtgaagactggaag

SEQ ID NO: 1310210 - DNA, 16 bp, Homo sapiens
tttgggttctgcctgc

SEQ ID NO: 1310211 - DNA, 20 bp, Homo sapiens
tttgtaacccagattttgct

SEQ ID NO: 1310212 - DNA, 17 bp, Homo sapiens
tttgtcctaaaacacct

SEQ ID NO: 1310213 - DNA, 11 bp, Homo sapiens
tttgtggccaa

SEQ ID NO: 1310214 - DNA, 13 bp, Homo sapiens
tttgttcccctcc

SEQ ID NO: 1310215 - DNA, 12 bp, Homo sapiens
ttttaactagaa

SEQ ID NO: 1310216 - DNA, 18 bp, Homo sapiens
ttttatactctttctgta

SEQ ID NO: 1310217 - DNA, 16 bp, Homo sapiens
ttttcaatatttatta

SEQ ID NO: 1310218 - DNA, 23 bp, Homo sapiens
ttttcacctgtttttaagctgtt

SEQ ID NO: 1310219 - DNA, 18 bp, Homo sapiens
ttttcttgcctctgtccc

SEQ ID NO: 1310220 - DNA, 19 bp, Homo sapiens
ttttcttgcctctgtcccc

SEQ ID NO: 1310221 - DNA, 13 bp, Homo sapiens
ttttgaaggcaaa

SEQ ID NO: 1310222 - DNA, 14 bp, Homo sapiens
ttttgaaggcaaaa

SEQ ID NO: 1310223 - DNA, 21 bp, Homo sapiens
ttttgactctggcaaagcttt

SEQ ID NO: 1310224 - DNA, 13 bp, Homo sapiens
ttttgctgtatat

SEQ ID NO: 1310225 - DNA, 16 bp, Homo sapiens
ttttggttttgttccc

SEQ ID NO: 1310226 - DNA, 23 bp, Homo sapiens
aacaaagttactaggtaacttca

SEQ ID NO: 1310227 - DNA, 13 bp, Homo sapiens
aacacaaactgta

SEQ ID NO: 1310228 - DNA, 19 bp, Homo sapiens
aacacgcacctgcctcagg

SEQ ID NO: 1310229 - DNA, 13 bp, Homo sapiens
aacacggccacat

SEQ ID NO: 1310230 - DNA, 21 bp, Homo sapiens
aacacggccacatcaaagagg

SEQ ID NO: 1310231 - DNA, 14 bp, Homo sapiens
aacagaagcttcca

SEQ ID NO: 1310232 - DNA, 13 bp, Homo sapiens
aacagatctggaa

SEQ ID NO: 1310233 - DNA, 11 bp, Homo sapiens
aacatccaaaa

SEQ ID NO: 1310234 - DNA, 15 bp, Homo sapiens
aacatcttttcttgc

SEQ ID NO: 1310235 - DNA, 18 bp, Homo sapiens
aacatgaggggacatttt

SEQ ID NO: 1310236 - DNA, 21 bp, Homo sapiens
aaccagggagcccctttgatg

SEQ ID NO: 1310237 - DNA, 15 bp, Homo sapiens
aacccaagcttagaa

SEQ ID NO: 1310238 - DNA, 16 bp, Homo sapiens
aacccaagcttagaac

SEQ ID NO: 1310239 - DNA, 14 bp, Homo sapiens
aacccaatccaaat

SEQ ID NO: 1310240 - DNA, 23 bp, Homo sapiens
aacccagacctgttagcagacag

SEQ ID NO: 1310241 - DNA, 14 bp, Homo sapiens
aacccagactcaga

SEQ ID NO: 1310242 - DNA, 15 bp, Homo sapiens
aacccagactcagac

SEQ ID NO: 1310243 - DNA, 23 bp, Homo sapiens
aacccttctcctcttgtaaataa

SEQ ID NO: 1310244 - DNA, 18 bp, Homo sapiens
aaccgttttgaagctact

SEQ ID NO: 1310245 - DNA, 20 bp, Homo sapiens
aacctcagcctggccagaca

SEQ ID NO: 1310246 - DNA, 14 bp, Homo sapiens
aacctcattcccca

SEQ ID NO: 1310247 - DNA, 17 bp, Homo sapiens
aacctgacgtagctgca

SEQ ID NO: 1310248 - DNA, 17 bp, Homo sapiens
aacctgggattcaggaa

SEQ ID NO: 1310249 - DNA, 16 bp, Homo sapiens
aaccttattgtacctc

SEQ ID NO: 1310250 - DNA, 17 bp, Homo sapiens
aaccttattgtacctct

SEQ ID NO: 1310251 - DNA, 13 bp, Homo sapiens
aacgatttagaaa

SEQ ID NO: 1310252 - DNA, 17 bp, Homo sapiens
aacgcctcccctgcccc

SEQ ID NO: 1310253 - DNA, 16 bp, Homo sapiens
aacggggctcttctca

SEQ ID NO: 1310254 - DNA, 15 bp, Homo sapiens
aactaaactcattta

SEQ ID NO: 1310255 - DNA, 17 bp, Homo sapiens
aactaaactcatttata

SEQ ID NO: 1310256 - DNA, 19 bp, Homo sapiens
aactacaaacaaaatttct

SEQ ID NO: 1310257 - DNA, 19 bp, Homo sapiens
aactagaatttattcaatt

SEQ ID NO: 1310258 - DNA, 20 bp, Homo sapiens
aactagatggtgctgagaag

SEQ ID NO: 1310259 - DNA, 22 bp, Homo sapiens
aactatgcatggtgccccagga

SEQ ID NO: 1310260 - DNA, 22 bp, Homo sapiens
aactcagatccagggacagagg

SEQ ID NO: 1310261 - DNA, 18 bp, Homo sapiens
aactcagttttaactaga

SEQ ID NO: 1310262 - DNA, 12 bp, Homo sapiens
aactctagctgg

SEQ ID NO: 1310263 - DNA, 19 bp, Homo sapiens
aactctagctgggggtggg

SEQ ID NO: 1310264 - DNA, 19 bp, Homo sapiens
aactctgttgcaagtgcaa

SEQ ID NO: 1310265 - DNA, 14 bp, Homo sapiens
aactgcatgctgct

SEQ ID NO: 1310266 - DNA, 20 bp, Homo sapiens
aactgcctcgaaacacagaa

SEQ ID NO: 1310267 - DNA, 22 bp, Homo sapiens
aactggtattttatctttgatt

SEQ ID NO: 1310268 - DNA, 22 bp, Homo sapiens
aactgtgtttcaagttcaatcc

SEQ ID NO: 1310269 - DNA, 19 bp, Homo sapiens
aacttacattgttcaatta

SEQ ID NO: 1310270 - DNA, 20 bp, Homo sapiens
aacttacattgttcaattag

SEQ ID NO: 1310271 - DNA, 21 bp, Homo sapiens
aacttatgacctcttccttta

SEQ ID NO: 1310272 - DNA, 19 bp, Homo sapiens
aacttcttatggaattgat

SEQ ID NO: 1310273 - DNA, 17 bp, Homo sapiens
aactttattaaatacaa

SEQ ID NO: 1310274 - DNA, 19 bp, Homo sapiens
aactttattaaatacaaaa

SEQ ID NO: 1310275 - DNA, 16 bp, Homo sapiens
aagaaaacatctattc

SEQ ID NO: 1310276 - DNA, 23 bp, Homo sapiens
aagaaataaaaggaagccaaaga

SEQ ID NO: 1310277 - DNA, 16 bp, Homo sapiens
aagaacaccctctaaa

SEQ ID NO: 1310278 - DNA, 17 bp, Homo sapiens
aagaaccagtcccccca

SEQ ID NO: 1310279 - DNA, 17 bp, Homo sapiens
aagaacggggctcttct

SEQ ID NO: 1310280 - DNA, 21 bp, Homo sapiens
aagaacggggctcttctcatt

SEQ ID NO: 1310281 - DNA, 16 bp, Homo sapiens
aagaagcccccagcta

SEQ ID NO: 1310282 - DNA, 19 bp, Homo sapiens
aagaattcaaactggggcc

SEQ ID NO: 1310283 - DNA, 14 bp, Homo sapiens
aagacatgatttcc

SEQ ID NO: 1310284 - DNA, 17 bp, Homo sapiens
aagacctggcagctctg

SEQ ID NO: 1310285 - DNA, 22 bp, Homo sapiens
aagactggaagctaatttgcat

SEQ ID NO: 1310286 - DNA, 18 bp, Homo sapiens
aagatctgtcctcagcct

SEQ ID NO: 1310287 - DNA, 21 bp, Homo sapiens
aagatctgttttgaaggcaaa

SEQ ID NO: 1310288 - DNA, 19 bp, Homo sapiens
aagcaggttcccaagctca

SEQ ID NO: 1310289 - DNA, 17 bp, Homo sapiens
aagccaattcagacagg

SEQ ID NO: 1310290 - DNA, 15 bp, Homo sapiens
aagccacaggcctga

SEQ ID NO: 1310291 - DNA, 23 bp, Homo sapiens
aagccacaggcctgagatttcat

SEQ ID NO: 1310292 - DNA, 16 bp, Homo sapiens
aagcccccagctaaga

SEQ ID NO: 1310293 - DNA, 19 bp, Homo sapiens
aagccctgggatcactgtg

SEQ ID NO: 1310294 - DNA, 22 bp, Homo sapiens
aagccctgttgacacaggtctt

SEQ ID NO: 1310295 - DNA, 23 bp, Homo sapiens
aagcctaaaagtgggcttgattc

SEQ ID NO: 1310296 - DNA, 15 bp, Homo sapiens
aagcctgatgctgac

SEQ ID NO: 1310297 - DNA, 19 bp, Homo sapiens
aagctactgtgtgtgtgaa

SEQ ID NO: 1310298 - DNA, 23 bp, Homo sapiens
aagctactgtgtgtgtgaatgaa

SEQ ID NO: 1310299 - DNA, 23 bp, Homo sapiens
aagctcagaggcgcactgtgacc

SEQ ID NO: 1310300 - DNA, 18 bp, Homo sapiens
aagctcctctccccagcc

SEQ ID NO: 1310301 - DNA, 19 bp, Homo sapiens
aagctcctctccccagccc

SEQ ID NO: 1310302 - DNA, 23 bp, Homo sapiens
aagctgcctcccctctccttcct

SEQ ID NO: 1310303 - DNA, 10 bp, Homo sapiens
aagcttagaa

SEQ ID NO: 1310304 - DNA, 15 bp, Homo sapiens
aagcttccatgattc

SEQ ID NO: 1310305 - DNA, 20 bp, Homo sapiens
aagcttccatgattctattt

SEQ ID NO: 1310306 - DNA, 21 bp, Homo sapiens
aagcttccatgattctattta

SEQ ID NO: 1310307 - DNA, 13 bp, Homo sapiens
aagcttttagaaa

SEQ ID NO: 1310308 - DNA, 14 bp, Homo sapiens
aagcttttagaaat

SEQ ID NO: 1310309 - DNA, 20 bp, Homo sapiens
aaggacttcctgtccagctc

SEQ ID NO: 1310310 - DNA, 23 bp, Homo sapiens
aaggacttcctgtccagctccaa

SEQ ID NO: 1310311 - DNA, 12 bp, Homo sapiens
aaggagctgcta

SEQ ID NO: 1310312 - DNA, 14 bp, Homo sapiens
aaggcaaaaatgta

SEQ ID NO: 1310313 - DNA, 19 bp, Homo sapiens
aaggcaaaattgcaaatct

SEQ ID NO: 1310314 - DNA, 14 bp, Homo sapiens
aaggccataaaaca

SEQ ID NO: 1310315 - DNA, 17 bp, Homo sapiens
aaggccataaaacaggt

SEQ ID NO: 1310316 - DNA, 18 bp, Homo sapiens
aaggccataaaacaggta

SEQ ID NO: 1310317 - DNA, 22 bp, Homo sapiens
aaggccatctgggctcctccag

SEQ ID NO: 1310318 - DNA, 16 bp, Homo sapiens
aaggggagcccactgt

SEQ ID NO: 1310319 - DNA, 20 bp, Homo sapiens
aaggtcctctgtcagtcaca

SEQ ID NO: 1310320 - DNA, 20 bp, Homo sapiens
aaggtttaggctggtggccc

SEQ ID NO: 1310321 - DNA, 21 bp, Homo sapiens
aaggtttaggctggtggccca

SEQ ID NO: 1310322 - DNA, 21 bp, Homo sapiens
aagtattctgtactcttagat

SEQ ID NO: 1310323 - DNA, 18 bp, Homo sapiens
aagtcttttgttcgcatg

SEQ ID NO: 1310324 - DNA, 16 bp, Homo sapiens
aagtgaagactggaag

SEQ ID NO: 1310325 - DNA, 22 bp, Homo sapiens
aagtgcaataaatctgacccag

SEQ ID NO: 1310326 - DNA, 22 bp, Homo sapiens
aagtggaccttaggccttcctc

SEQ ID NO: 1310327 - DNA, 12 bp, Homo sapiens
aagtgggcttga

SEQ ID NO: 1310328 - DNA, 15 bp, Homo sapiens
aagtgtatttttcaa

SEQ ID NO: 1310329 - DNA, 18 bp, Homo sapiens
aagttactaggtaacttc

SEQ ID NO: 1310330 - DNA, 19 bp, Homo sapiens
aagttactaggtaacttca

SEQ ID NO: 1310331 - DNA, 21 bp, Homo sapiens
aagttactaggtaacttcata

SEQ ID NO: 1310332 - DNA, 21 bp, Homo sapiens
aagtttcagagaccattgcaa

SEQ ID NO: 1310333 - DNA, 13 bp, Homo sapiens
aagtttgcttaga

SEQ ID NO: 1310334 - DNA, 15 bp, Homo sapiens
aagtttgcttagaaa

SEQ ID NO: 1310335 - DNA, 16 bp, Homo sapiens
aagtttgcttagaaaa

SEQ ID NO: 1310336 - DNA, 21 bp, Homo sapiens
aataaaaggaagccaaagagt

SEQ ID NO: 1310337 - DNA, 11 bp, Homo sapiens
aataaagccct

SEQ ID NO: 1310338 - DNA, 20 bp, Homo sapiens
aataaatgtatcttattcac

SEQ ID NO: 1310339 - DNA, 18 bp, Homo sapiens
aataagaatagaaataaa

SEQ ID NO: 1310340 - DNA, 11 bp, Homo sapiens
aataatgtctc

SEQ ID NO: 1310341 - DNA, 16 bp, Homo sapiens
aataattgcagaacta

SEQ ID NO: 1310342 - DNA, 20 bp, Homo sapiens
agatttcatctgctctcctt

SEQ ID NO: 1310343 - DNA, 23 bp, Homo sapiens
agatttcatctgctctccttcct

SEQ ID NO: 1310344 - DNA, 12 bp, Homo sapiens
agcaagactctg

SEQ ID NO: 1310345 - DNA, 19 bp, Homo sapiens
agcacaactttaagaggac

SEQ ID NO: 1310346 - DNA, 10 bp, Homo sapiens
agcacagcag

SEQ ID NO: 1310347 - DNA, 13 bp, Homo sapiens
agcacagcagcct

SEQ ID NO: 1310348 - DNA, 15 bp, Homo sapiens
agcacagcagcctgg

SEQ ID NO: 1310349 - DNA, 12 bp, Homo sapiens
agcacagccaac

SEQ ID NO: 1310350 - DNA, 13 bp, Homo sapiens
agcacagccaaca

SEQ ID NO: 1310351 - DNA, 12 bp, Homo sapiens
agcagaaggggg

SEQ ID NO: 1310352 - DNA, 22 bp, Homo sapiens
agcagaagggggtggtgtctcc

SEQ ID NO: 1310353 - DNA, 15 bp, Homo sapiens
agcagaggaggggcc

SEQ ID NO: 1310354 - DNA, 19 bp, Homo sapiens
agcagaggaggggccgctg

SEQ ID NO: 1310355 - DNA, 21 bp, Homo sapiens
agcagattttaattttgaata

SEQ ID NO: 1310356 - DNA, 22 bp, Homo sapiens
agcagattttaattttgaataa

SEQ ID NO: 1310357 - DNA, 19 bp, Homo sapiens
agcagcagcctttaatgca

SEQ ID NO: 1310358 - DNA, 10 bp, Homo sapiens
agcagccacg

SEQ ID NO: 1310359 - DNA, 13 bp, Homo sapiens
agcagccacgagg

SEQ ID NO: 1310360 - DNA, 13 bp, Homo sapiens
agcagcctgagca

SEQ ID NO: 1310361 - DNA, 23 bp, Homo sapiens
agcagcctgagcaactcttgatt

SEQ ID NO: 1310362 - DNA, 15 bp, Homo sapiens
agcagcgcctttccc

SEQ ID NO: 1310363 - DNA, 17 bp, Homo sapiens
agcagggatgccctgga

SEQ ID NO: 1310364 - DNA, 24 bp, Homo sapiens
agcagggatgccctggaggtggct

SEQ ID NO: 1310365 - DNA, 13 bp, Homo sapiens
agcaggtgctgac

SEQ ID NO: 1310366 - DNA, 23 bp, Homo sapiens
agcaggttcccaagctcagaggc

SEQ ID NO: 1310367 - DNA, 13 bp, Homo sapiens
agcagttttcaag

SEQ ID NO: 1310368 - DNA, 14 bp, Homo sapiens
agcatttataaatt

SEQ ID NO: 1310369 - DNA, 11 bp, Homo sapiens
agccaaagagt

SEQ ID NO: 1310370 - DNA, 19 bp, Homo sapiens
agccaacacgcacctgcct

SEQ ID NO: 1310371 - DNA, 22 bp, Homo sapiens
agccacatttggaatacttttt

SEQ ID NO: 1310372 - DNA, 13 bp, Homo sapiens
agccacccctgag

SEQ ID NO: 1310373 - DNA, 22 bp, Homo sapiens
agccagcacttgtccagctgag

SEQ ID NO: 1310374 - DNA, 14 bp, Homo sapiens
agccagctccctct

SEQ ID NO: 1310375 - DNA, 23 bp, Homo sapiens
agccaggaatttcccaggaccct

SEQ ID NO: 1310376 - DNA, 14 bp, Homo sapiens
agccaggccccagg

SEQ ID NO: 1310377 - DNA, 16 bp, Homo sapiens
agccatcaaaatgctt

SEQ ID NO: 1310378 - DNA, 15 bp, Homo sapiens
agcccaatattataa

SEQ ID NO: 1310379 - DNA, 22 bp, Homo sapiens
agcccactgtcctgggcctgca

SEQ ID NO: 1310380 - DNA, 23 bp, Homo sapiens
agcccactgtcctgggcctgcag

SEQ ID NO: 1310381 - DNA, 13 bp, Homo sapiens
agcccagccctcc

SEQ ID NO: 1310382 - DNA, 13 bp, Homo sapiens
agcccagctgggt

SEQ ID NO: 1310383 - DNA, 19 bp, Homo sapiens
agcccagctgggtcaggca

SEQ ID NO: 1310384 - DNA, 12 bp, Homo sapiens
agcccccagcta

SEQ ID NO: 1310385 - DNA, 19 bp, Homo sapiens
agcccccagctaagaacct

SEQ ID NO: 1310386 - DNA, 22 bp, Homo sapiens
agcccccagctaagaacctgga

SEQ ID NO: 1310387 - DNA, 19 bp, Homo sapiens
agccccttctgctcagctc

SEQ ID NO: 1310388 - DNA, 12 bp, Homo sapiens
agccctccccat

SEQ ID NO: 1310389 - DNA, 20 bp, Homo sapiens
agccctccccatggagccag

SEQ ID NO: 1310390 - DNA, 17 bp, Homo sapiens
agccctgaccctgtgga

SEQ ID NO: 1310391 - DNA, 18 bp, Homo sapiens
agccgtgctcgccccagc

SEQ ID NO: 1310392 - DNA, 16 bp, Homo sapiens
agcctccctgaagcct

SEQ ID NO: 1310393 - DNA, 13 bp, Homo sapiens
agcctggccagac

SEQ ID NO: 1310394 - DNA, 14 bp, Homo sapiens
agcctggccagaca

SEQ ID NO: 1310395 - DNA, 16 bp, Homo sapiens
agcctggccagacaca

SEQ ID NO: 1310396 - DNA, 14 bp, Homo sapiens
agccttgccagaga

SEQ ID NO: 1310397 - DNA, 15 bp, Homo sapiens
agcctttaatgcatc

SEQ ID NO: 1310398 - DNA, 19 bp, Homo sapiens
agcctttggttctggccag

SEQ ID NO: 1310399 - DNA, 20 bp, Homo sapiens
agcgctcctgccgcagagct

SEQ ID NO: 1310400 - DNA, 22 bp, Homo sapiens
agcgctcctgccgcagagctgg

SEQ ID NO: 1310401 - DNA, 11 bp, Homo sapiens
agcggccggcc

SEQ ID NO: 1310402 - DNA, 18 bp, Homo sapiens
agcggccggccagcccct

SEQ ID NO: 1310403 - DNA, 16 bp, Homo sapiens
agctaagaacctggaa

SEQ ID NO: 1310404 - DNA, 13 bp, Homo sapiens
agctaatttgcat

SEQ ID NO: 1310405 - DNA, 19 bp, Homo sapiens
agctactgtgtgtgtgaat

SEQ ID NO: 1310406 - DNA, 20 bp, Homo sapiens
agctactgtgtgtgtgaatg

SEQ ID NO: 1310407 - DNA, 18 bp, Homo sapiens
agctcaggacagatgcca

SEQ ID NO: 1310408 - DNA, 13 bp, Homo sapiens
agctcaggatctc

SEQ ID NO: 1310409 - DNA, 15 bp, Homo sapiens
agctccaacctgcaa

SEQ ID NO: 1310410 - DNA, 15 bp, Homo sapiens
agctccaccctggcc

SEQ ID NO: 1310411 - DNA, 13 bp, Homo sapiens
agctcctcctccc

SEQ ID NO: 1310412 - DNA, 16 bp, Homo sapiens
agctcctctccccagc

SEQ ID NO: 1310413 - DNA, 23 bp, Homo sapiens
agctcctctccccagcccagaga

SEQ ID NO: 1310414 - DNA, 22 bp, Homo sapiens
agctctatgtttacaaatggac

SEQ ID NO: 1310415 - DNA, 17 bp, Homo sapiens
agctctggacagcccca

SEQ ID NO: 1310416 - DNA, 21 bp, Homo sapiens
agctctggacagccccaccct

SEQ ID NO: 1310417 - DNA, 23 bp, Homo sapiens
agctctttcctccttccatggaa

SEQ ID NO: 1310418 - DNA, 12 bp, Homo sapiens
agctgagcgcca

SEQ ID NO: 1310419 - DNA, 17 bp, Homo sapiens
agctgaggccacactca

SEQ ID NO: 1310420 - DNA, 22 bp, Homo sapiens
agctgaggccacactcagcaca

SEQ ID NO: 1310421 - DNA, 22 bp, Homo sapiens
agctgcactgatgctgcccctc

SEQ ID NO: 1310422 - DNA, 20 bp, Homo sapiens
agctgcctcccctctccttc

SEQ ID NO: 1310423 - DNA, 23 bp, Homo sapiens
agctgcctcccctctccttcctg

SEQ ID NO: 1310424 - DNA, 14 bp, Homo sapiens
agctgccttggctc

SEQ ID NO: 1310425 - DNA, 16 bp, Homo sapiens
agctgccttggctcag

SEQ ID NO: 1310426 - DNA, 16 bp, Homo sapiens
agctgctatagcctgg

SEQ ID NO: 1310427 - DNA, 17 bp, Homo sapiens
agctgctcctagaggga

SEQ ID NO: 1310428 - DNA, 21 bp, Homo sapiens
agctgggggtgggccaggctg

SEQ ID NO: 1310429 - DNA, 16 bp, Homo sapiens
agctgttgagctgttt

SEQ ID NO: 1310430 - DNA, 18 bp, Homo sapiens
agctgttttccctgacct

SEQ ID NO: 1310431 - DNA, 10 bp, Homo sapiens
agcttagaac

SEQ ID NO: 1310432 - DNA, 22 bp, Homo sapiens
agcttccatgattctatttata

SEQ ID NO: 1310433 - DNA, 16 bp, Homo sapiens
agcttctcctgtgtga

SEQ ID NO: 1310434 - DNA, 18 bp, Homo sapiens
agcttttgaataaaaact

SEQ ID NO: 1310435 - DNA, 13 bp, Homo sapiens
aggaaaaacaggt

SEQ ID NO: 1310436 - DNA, 21 bp, Homo sapiens
aggaaaaggtgatatccattc

SEQ ID NO: 1310437 - DNA, 14 bp, Homo sapiens
aggaacttccaggt

SEQ ID NO: 1310438 - DNA, 22 bp, Homo sapiens
aggaagaacggggctcttctca

SEQ ID NO: 1310439 - DNA, 14 bp, Homo sapiens
aggaagagaaacca

SEQ ID NO: 1310440 - DNA, 21 bp, Homo sapiens
aggaatttcccaggaccctga

SEQ ID NO: 1310441 - DNA, 13 bp, Homo sapiens
aggacacagtcag

SEQ ID NO: 1310442 - DNA, 20 bp, Homo sapiens
aggacataatggggtcctgg

SEQ ID NO: 1310443 - DNA, 12 bp, Homo sapiens
aggaccagctca

SEQ ID NO: 1310444 - DNA, 14 bp, Homo sapiens
aggaccagctcagg

SEQ ID NO: 1310445 - DNA, 18 bp, Homo sapiens
aggaccagctcaggacag

SEQ ID NO: 1310446 - DNA, 19 bp, Homo sapiens
aggaccctgaaggggccat

SEQ ID NO: 1310447 - DNA, 16 bp, Homo sapiens
aggaccggcggctcgg

SEQ ID NO: 1310448 - DNA, 13 bp, Homo sapiens
aggacctggctgc

SEQ ID NO: 1310449 - DNA, 20 bp, Homo sapiens
aggaccttcgggctgtgccc

SEQ ID NO: 1310450 - DNA, 19 bp, Homo sapiens
aggacttatttaaactctg

SEQ ID NO: 1310451 - DNA, 22 bp, Homo sapiens
aggacttcctgtccagctccaa

SEQ ID NO: 1310452 - DNA, 13 bp, Homo sapiens
aggagaagccagg

SEQ ID NO: 1310453 - DNA, 21 bp, Homo sapiens
aggagacctggcactggatgc

SEQ ID NO: 1310454 - DNA, 20 bp, Homo sapiens
aggagaggcaacatccaaaa

SEQ ID NO: 1310455 - DNA, 19 bp, Homo sapiens
aggagctgccttggctcag

SEQ ID NO: 1310456 - DNA, 21 bp, Homo sapiens
aggagctgccttggctcagac

SEQ ID NO: 1310457 - DNA, 23 bp, Homo sapiens
aggagctgccttggctcagacat

SEQ ID NO: 1310458 - DNA, 13 bp, Homo sapiens
aggagctgctata

SEQ ID NO: 1310459 - DNA, 20 bp, Homo sapiens
attttgaataaataaatgta

SEQ ID NO: 1310460 - DNA, 21 bp, Homo sapiens
attttggagagtttcctgaaa

SEQ ID NO: 1310461 - DNA, 22 bp, Homo sapiens
attttggagagtttcctgaaac

SEQ ID NO: 1310462 - DNA, 14 bp, Homo sapiens
attttggtgagaaa

SEQ ID NO: 1310463 - DNA, 22 bp, Homo sapiens
attttggttttgttcccctcct

SEQ ID NO: 1310464 - DNA, 16 bp, Homo sapiens
atttttcaataaagca

SEQ ID NO: 1310465 - DNA, 17 bp, Homo sapiens
atttttcaataaagcat

SEQ ID NO: 1310466 - DNA, 22 bp, Homo sapiens
caaaaatatttataaaacttct

SEQ ID NO: 1310467 - DNA, 16 bp, Homo sapiens
caaaaattaggtattt

SEQ ID NO: 1310468 - DNA, 18 bp, Homo sapiens
caaaaattaggtattttg

SEQ ID NO: 1310469 - DNA, 13 bp, Homo sapiens
caaaagaagcccc

SEQ ID NO: 1310470 - DNA, 18 bp, Homo sapiens
caaaagaagcccccagct

SEQ ID NO: 1310471 - DNA, 20 bp, Homo sapiens
caaaaggatctttgtggcca

SEQ ID NO: 1310472 - DNA, 18 bp, Homo sapiens
caaaatgctctagtgcct

SEQ ID NO: 1310473 - DNA, 20 bp, Homo sapiens
caaaatgctttttatttctg

SEQ ID NO: 1310474 - DNA, 23 bp, Homo sapiens
caaaatgctttttatttctgcat

SEQ ID NO: 1310475 - DNA, 16 bp, Homo sapiens
caaaattgcaaatctt

SEQ ID NO: 1310476 - DNA, 14 bp, Homo sapiens
caaacgcctcccct

SEQ ID NO: 1310477 - DNA, 14 bp, Homo sapiens
caaactgtaaataa

SEQ ID NO: 1310478 - DNA, 20 bp, Homo sapiens
caaactgtaaataaaaagaa

SEQ ID NO: 1310479 - DNA, 17 bp, Homo sapiens
caaacttggatttttga

SEQ ID NO: 1310480 - DNA, 14 bp, Homo sapiens
caaagagtagaatt

SEQ ID NO: 1310481 - DNA, 12 bp, Homo sapiens
caaagcagacag

SEQ ID NO: 1310482 - DNA, 13 bp, Homo sapiens
caaagcagacagc

SEQ ID NO: 1310483 - DNA, 16 bp, Homo sapiens
caaagcagacagctcc

SEQ ID NO: 1310484 - DNA, 12 bp, Homo sapiens
caaagcagccac

SEQ ID NO: 1310485 - DNA, 19 bp, Homo sapiens
caaagtgctgggattacag

SEQ ID NO: 1310486 - DNA, 19 bp, Homo sapiens
caaatcttgaaattaagaa

SEQ ID NO: 1310487 - DNA, 13 bp, Homo sapiens
caaatgagccatg

SEQ ID NO: 1310488 - DNA, 18 bp, Homo sapiens
caaattagaaaatgttat

SEQ ID NO: 1310489 - DNA, 15 bp, Homo sapiens
caacacgcacctgcc

SEQ ID NO: 1310490 - DNA, 14 bp, Homo sapiens
caacagatctggaa

SEQ ID NO: 1310491 - DNA, 14 bp, Homo sapiens
caacatctgagtgc

SEQ ID NO: 1310492 - DNA, 13 bp, Homo sapiens
caacatcttttct

SEQ ID NO: 1310493 - DNA, 18 bp, Homo sapiens
caacatggtgaaaccccg

SEQ ID NO: 1310494 - DNA, 20 bp, Homo sapiens
caacccttctcctcttgtaa

SEQ ID NO: 1310495 - DNA, 21 bp, Homo sapiens
caacccttctcctcttgtaaa

SEQ ID NO: 1310496 - DNA, 16 bp, Homo sapiens
caacctcttctggctc

SEQ ID NO: 1310497 - DNA, 18 bp, Homo sapiens
caacctcttctggctcaa

SEQ ID NO: 1310498 - DNA, 17 bp, Homo sapiens
caacctgcaaagatctg

SEQ ID NO: 1310499 - DNA, 12 bp, Homo sapiens
caactcttgatt

SEQ ID NO: 1310500 - DNA, 16 bp, Homo sapiens
caactcttgattatcc

SEQ ID NO: 1310501 - DNA, 21 bp, Homo sapiens
caactgcctcgaaacacagaa

SEQ ID NO: 1310502 - DNA, 13 bp, Homo sapiens
caagaaataaaag

SEQ ID NO: 1310503 - DNA, 19 bp, Homo sapiens
caagaccaccacttcgaaa

SEQ ID NO: 1310504 - DNA, 15 bp, Homo sapiens
caagactctgtctca

SEQ ID NO: 1310505 - DNA, 13 bp, Homo sapiens
caagcacagcagc

SEQ ID NO: 1310506 - DNA, 21 bp, Homo sapiens
caagctcagaggcgcactgtg

SEQ ID NO: 1310507 - DNA, 15 bp, Homo sapiens
caagctcctcctccc

SEQ ID NO: 1310508 - DNA, 19 bp, Homo sapiens
caaggacttcctgtccagc

SEQ ID NO: 1310509 - DNA, 17 bp, Homo sapiens
caaggatagatgctggc

SEQ ID NO: 1310510 - DNA, 21 bp, Homo sapiens
caaggatagatgctggcccag

SEQ ID NO: 1310511 - DNA, 21 bp, Homo sapiens
caaggtcctctgtcagtcaca

SEQ ID NO: 1310512 - DNA, 20 bp, Homo sapiens
caaggtttaggctggtggcc

SEQ ID NO: 1310513 - DNA, 22 bp, Homo sapiens
caaggtttaggctggtggccca

SEQ ID NO: 1310514 - DNA, 23 bp, Homo sapiens
caaggtttaggctggtggcccag

SEQ ID NO: 1310515 - DNA, 14 bp, Homo sapiens
caagtcaaattaat

SEQ ID NO: 1310516 - DNA, 12 bp, Homo sapiens
caagtggacctt

SEQ ID NO: 1310517 - DNA, 15 bp, Homo sapiens
caagtggactcaggg

SEQ ID NO: 1310518 - DNA, 16 bp, Homo sapiens
caagtggactcagggc

SEQ ID NO: 1310519 - DNA, 14 bp, Homo sapiens
caataaagcattta

SEQ ID NO: 1310520 - DNA, 19 bp, Homo sapiens
caataaagcatttataaat

SEQ ID NO: 1310521 - DNA, 15 bp, Homo sapiens
caatattaaatctgc

SEQ ID NO: 1310522 - DNA, 16 bp, Homo sapiens
caatattttctttaat

SEQ ID NO: 1310523 - DNA, 16 bp, Homo sapiens
caatgtctgagtgaac

SEQ ID NO: 1310524 - DNA, 23 bp, Homo sapiens
caatgtggcaaggaaaaacaggt

SEQ ID NO: 1310525 - DNA, 13 bp, Homo sapiens
caattcagacagg

SEQ ID NO: 1310526 - DNA, 23 bp, Homo sapiens
cacaaactgtaaataaaaagaaa

SEQ ID NO: 1310527 - DNA, 12 bp, Homo sapiens
cacaaagcccaa

SEQ ID NO: 1310528 - DNA, 14 bp, Homo sapiens
cacaaagcccaagg

SEQ ID NO: 1310529 - DNA, 16 bp, Homo sapiens
cacaaggacttcctgt

SEQ ID NO: 1310530 - DNA, 22 bp, Homo sapiens
cacaaggacttcctgtccagct

SEQ ID NO: 1310531 - DNA, 17 bp, Homo sapiens
cacaaggatagatgctg

SEQ ID NO: 1310532 - DNA, 22 bp, Homo sapiens
cacaaggatagatgctggccca

SEQ ID NO: 1310533 - DNA, 13 bp, Homo sapiens
cacaagtggtggt

SEQ ID NO: 1310534 - DNA, 14 bp, Homo sapiens
cacaagtggtggta

SEQ ID NO: 1310535 - DNA, 19 bp, Homo sapiens
cacacaaggatagatgctg

SEQ ID NO: 1310536 - DNA, 14 bp, Homo sapiens
cacacactgatgct

SEQ ID NO: 1310537 - DNA, 22 bp, Homo sapiens
cacaccttttattgacacagaa

SEQ ID NO: 1310538 - DNA, 18 bp, Homo sapiens
cacactgatgcttagatg

SEQ ID NO: 1310539 - DNA, 18 bp, Homo sapiens
cacagcaaccccaggctg

SEQ ID NO: 1310540 - DNA, 22 bp, Homo sapiens
cacagccaacacgcacctgcct

SEQ ID NO: 1310541 - DNA, 23 bp, Homo sapiens
cacaggacatgcggtagccagca

SEQ ID NO: 1310542 - DNA, 13 bp, Homo sapiens
cacaggccctccc

SEQ ID NO: 1310543 - DNA, 18 bp, Homo sapiens
cacaggtctttcctaagg

SEQ ID NO: 1310544 - DNA, 13 bp, Homo sapiens
cacagtagtcttg

SEQ ID NO: 1310545 - DNA, 21 bp, Homo sapiens
cacagttctttgggccagaca

SEQ ID NO: 1310546 - DNA, 13 bp, Homo sapiens
cacatcaaagagg

SEQ ID NO: 1310547 - DNA, 22 bp, Homo sapiens
cacatctaagcctgaaggggcg

SEQ ID NO: 1310548 - DNA, 16 bp, Homo sapiens
caccaagcacagcagc

SEQ ID NO: 1310549 - DNA, 15 bp, Homo sapiens
caccagacacccagg

SEQ ID NO: 1310550 - DNA, 17 bp, Homo sapiens
caccagacacccaggac

SEQ ID NO: 1310551 - DNA, 18 bp, Homo sapiens
caccagacacccaggact

SEQ ID NO: 1310552 - DNA, 19 bp, Homo sapiens
caccagacacccaggactt

SEQ ID NO: 1310553 - DNA, 20 bp, Homo sapiens
caccagacacccaggactta

SEQ ID NO: 1310554 - DNA, 17 bp, Homo sapiens
caccaggaacctcttca

SEQ ID NO: 1310555 - DNA, 20 bp, Homo sapiens
caccatgttgcccaggctgg

SEQ ID NO: 1310556 - DNA, 16 bp, Homo sapiens
cacccacctccctgcc

SEQ ID NO: 1310557 - DNA, 14 bp, Homo sapiens
cacccctgggggct

SEQ ID NO: 1310558 - DNA, 18 bp, Homo sapiens
cacccctgggggctctca

SEQ ID NO: 1310559 - DNA, 18 bp, Homo sapiens
caccctcaacctcttctg

SEQ ID NO: 1310560 - DNA, 15 bp, Homo sapiens
caccctggtgggcca

SEQ ID NO: 1310561 - DNA, 15 bp, Homo sapiens
caccgtgggcaggga

SEQ ID NO: 1310562 - DNA, 13 bp, Homo sapiens
caccgttctgtgc

SEQ ID NO: 1310563 - DNA, 15 bp, Homo sapiens
caccgttctgtgcac

SEQ ID NO: 1310564 - DNA, 17 bp, Homo sapiens
cacctaatccaggcaga

SEQ ID NO: 1310565 - DNA, 15 bp, Homo sapiens
cacctgccccaactc

SEQ ID NO: 1310566 - DNA, 20 bp, Homo sapiens
caccttttgggaatgtttta

SEQ ID NO: 1310567 - DNA, 16 bp, Homo sapiens
cacgcacctgcctcag

SEQ ID NO: 1310568 - DNA, 14 bp, Homo sapiens
cacgctttctagct

SEQ ID NO: 1310569 - DNA, 13 bp, Homo sapiens
cacggccacatca

SEQ ID NO: 1310570 - DNA, 20 bp, Homo sapiens
cactaagcagaggaggggcc

SEQ ID NO: 1310571 - DNA, 21 bp, Homo sapiens
cactaagcagaggaggggccg

SEQ ID NO: 1310572 - DNA, 13 bp, Homo sapiens
cactaaggggccc

SEQ ID NO: 1310573 - DNA, 23 bp, Homo sapiens
cactaaggggcccggccagccat

SEQ ID NO: 1310574 - DNA, 15 bp, Homo sapiens
cactacattcattta

SEQ ID NO: 1310575 - DNA, 17 bp, Homo sapiens
cactatggtatttgagt

SEQ ID NO: 1310576 - DNA, 17 bp, Homo sapiens
ccaggctgaccacagca

SEQ ID NO: 1310577 - DNA, 23 bp, Homo sapiens
ccaggctgaccacagcacagcca

SEQ ID NO: 1310578 - DNA, 21 bp, Homo sapiens
ccagggacagaggccccagcc

SEQ ID NO: 1310579 - DNA, 22 bp, Homo sapiens
ccagggacagaggccccagcct

SEQ ID NO: 1310580 - DNA, 13 bp, Homo sapiens
ccagggagaagct

SEQ ID NO: 1310581 - DNA, 14 bp, Homo sapiens
ccagggagaagctc

SEQ ID NO: 1310582 - DNA, 14 bp, Homo sapiens
ccagggagcctttg

SEQ ID NO: 1310583 - DNA, 22 bp, Homo sapiens
ccagggagcctttggttctggc

SEQ ID NO: 1310584 - DNA, 13 bp, Homo sapiens
ccagggcccagag

SEQ ID NO: 1310585 - DNA, 15 bp, Homo sapiens
ccagggcccagagcc

SEQ ID NO: 1310586 - DNA, 18 bp, Homo sapiens
ccagggcccagagcccag

SEQ ID NO: 1310587 - DNA, 23 bp, Homo sapiens
ccagggcccagagcccagctcca

SEQ ID NO: 1310588 - DNA, 16 bp, Homo sapiens
ccaggggagttgtgtc

SEQ ID NO: 1310589 - DNA, 20 bp, Homo sapiens
ccagtctccaccaggaacct

SEQ ID NO: 1310590 - DNA, 19 bp, Homo sapiens
ccatagtaccatttataca

SEQ ID NO: 1310591 - DNA, 16 bp, Homo sapiens
ccatcaaaatgctttt

SEQ ID NO: 1310592 - DNA, 19 bp, Homo sapiens
ccatcaaaatgctttttat

SEQ ID NO: 1310593 - DNA, 13 bp, Homo sapiens
ccatcatcctact

SEQ ID NO: 1310594 - DNA, 15 bp, Homo sapiens
ccatcctccagcagg

SEQ ID NO: 1310595 - DNA, 16 bp, Homo sapiens
ccatcctccagcaggg

SEQ ID NO: 1310596 - DNA, 17 bp, Homo sapiens
ccatcctccagcaggga

SEQ ID NO: 1310597 - DNA, 16 bp, Homo sapiens
ccatctgggctcctcc

SEQ ID NO: 1310598 - DNA, 23 bp, Homo sapiens
ccatgagttggggtctggcagcc

SEQ ID NO: 1310599 - DNA, 16 bp, Homo sapiens
ccatgatggcaacaga

SEQ ID NO: 1310600 - DNA, 21 bp, Homo sapiens
ccatgatggcaacagatctgg

SEQ ID NO: 1310601 - DNA, 15 bp, Homo sapiens
ccatgcctcagccct

SEQ ID NO: 1310602 - DNA, 16 bp, Homo sapiens
ccatggacaggctggc

SEQ ID NO: 1310603 - DNA, 14 bp, Homo sapiens
ccatgtagccccct

SEQ ID NO: 1310604 - DNA, 22 bp, Homo sapiens
ccatgtagccccctggcctctg

SEQ ID NO: 1310605 - DNA, 13 bp, Homo sapiens
ccatgtctgcatt

SEQ ID NO: 1310606 - DNA, 15 bp, Homo sapiens
ccattctccacagca

SEQ ID NO: 1310607 - DNA, 18 bp, Homo sapiens
ccattctccacagcaacc

SEQ ID NO: 1310608 - DNA, 18 bp, Homo sapiens
ccattcttttgtaattta

SEQ ID NO: 1310609 - DNA, 17 bp, Homo sapiens
ccatttctatttattta

SEQ ID NO: 1310610 - DNA, 17 bp, Homo sapiens
cccaacccttccctcac

SEQ ID NO: 1310611 - DNA, 15 bp, Homo sapiens
cccaactctagctgg

SEQ ID NO: 1310612 - DNA, 16 bp, Homo sapiens
cccaactctagctggg

SEQ ID NO: 1310613 - DNA, 15 bp, Homo sapiens
cccaactctcccctg

SEQ ID NO: 1310614 - DNA, 11 bp, Homo sapiens
cccaactgtct

SEQ ID NO: 1310615 - DNA, 15 bp, Homo sapiens
cccaactgtcttttt

SEQ ID NO: 1310616 - DNA, 13 bp, Homo sapiens
cccaagggatctg

SEQ ID NO: 1310617 - DNA, 11 bp, Homo sapiens
cccaatattat

SEQ ID NO: 1310618 - DNA, 21 bp, Homo sapiens
cccaatccctttattaccccc

SEQ ID NO: 1310619 - DNA, 16 bp, Homo sapiens
cccaatgtaggagctg

SEQ ID NO: 1310620 - DNA, 13 bp, Homo sapiens
cccacaagtggtg

SEQ ID NO: 1310621 - DNA, 14 bp, Homo sapiens
cccacaagtggtgg

SEQ ID NO: 1310622 - DNA, 12 bp, Homo sapiens
cccacccctggg

SEQ ID NO: 1310623 - DNA, 15 bp, Homo sapiens
cccaccgtgggcagg

SEQ ID NO: 1310624 - DNA, 12 bp, Homo sapiens
cccacctccctg

SEQ ID NO: 1310625 - DNA, 14 bp, Homo sapiens
cccactgaccagaa

SEQ ID NO: 1310626 - DNA, 15 bp, Homo sapiens
cccactgtcctgggc

SEQ ID NO: 1310627 - DNA, 21 bp, Homo sapiens
cccagacctgttagcagacag

SEQ ID NO: 1310628 - DNA, 16 bp, Homo sapiens
cccagactcagacatt

SEQ ID NO: 1310629 - DNA, 22 bp, Homo sapiens
cccagagacatacttgaagggc

SEQ ID NO: 1310630 - DNA, 13 bp, Homo sapiens
cccagagcccagc

SEQ ID NO: 1310631 - DNA, 19 bp, Homo sapiens
cccagattttgctgtatat

SEQ ID NO: 1310632 - DNA, 15 bp, Homo sapiens
cccagcactgaggaa

SEQ ID NO: 1310633 - DNA, 13 bp, Homo sapiens
cccagcccagaga

SEQ ID NO: 1310634 - DNA, 17 bp, Homo sapiens
cccagcctccctgaagc

SEQ ID NO: 1310635 - DNA, 18 bp, Homo sapiens
cccagcctccctgaagcc

SEQ ID NO: 1310636 - DNA, 18 bp, Homo sapiens
cccagctaagaacctgga

SEQ ID NO: 1310637 - DNA, 17 bp, Homo sapiens
cccagctgggtcaggca

SEQ ID NO: 1310638 - DNA, 19 bp, Homo sapiens
cccagctgggtcaggcagg

SEQ ID NO: 1310639 - DNA, 14 bp, Homo sapiens
cccaggaccagctc

SEQ ID NO: 1310640 - DNA, 15 bp, Homo sapiens
cccaggaccagctca

SEQ ID NO: 1310641 - DNA, 17 bp, Homo sapiens
cccaggaccagctcagg

SEQ ID NO: 1310642 - DNA, 20 bp, Homo sapiens
cccaggaccagctcaggaca

SEQ ID NO: 1310643 - DNA, 13 bp, Homo sapiens
cccaggaccctga

SEQ ID NO: 1310644 - DNA, 23 bp, Homo sapiens
cccaggaccctgaaggggccatg

SEQ ID NO: 1310645 - DNA, 12 bp, Homo sapiens
cccaggactggg

SEQ ID NO: 1310646 - DNA, 15 bp, Homo sapiens
cccagggcccagagc

SEQ ID NO: 1310647 - DNA, 16 bp, Homo sapiens
cccagggcccagagcc

SEQ ID NO: 1310648 - DNA, 22 bp, Homo sapiens
cccagggcccagagcccagctc

SEQ ID NO: 1310649 - DNA, 14 bp, Homo sapiens
cccagtgcccccac

SEQ ID NO: 1310650 - DNA, 20 bp, Homo sapiens
cccagtgcccccactgacca

SEQ ID NO: 1310651 - DNA, 16 bp, Homo sapiens
cccatccccgcagtgt

SEQ ID NO: 1310652 - DNA, 16 bp, Homo sapiens
cccatcctccagcagg

SEQ ID NO: 1310653 - DNA, 18 bp, Homo sapiens
cccatcctccagcaggga

SEQ ID NO: 1310654 - DNA, 14 bp, Homo sapiens
cccatctcatgccc

SEQ ID NO: 1310655 - DNA, 23 bp, Homo sapiens
cccatgagttggggtctggcagc

SEQ ID NO: 1310656 - DNA, 16 bp, Homo sapiens
cccatgcactgtgaag

SEQ ID NO: 1310657 - DNA, 20 bp, Homo sapiens
cccatggacaggctggctcc

SEQ ID NO: 1310658 - DNA, 14 bp, Homo sapiens
cccatgtagccccc

SEQ ID NO: 1310659 - DNA, 21 bp, Homo sapiens
cccatgtagccccctggcctc

SEQ ID NO: 1310660 - DNA, 22 bp, Homo sapiens
cccatgtagccccctggcctct

SEQ ID NO: 1310661 - DNA, 12 bp, Homo sapiens
cccattcctgaa

SEQ ID NO: 1310662 - DNA, 21 bp, Homo sapiens
cccattcggtgtggtgcagtg

SEQ ID NO: 1310663 - DNA, 20 bp, Homo sapiens
cccattcttttgtaatttaa

SEQ ID NO: 1310664 - DNA, 14 bp, Homo sapiens
cccattgtccctct

SEQ ID NO: 1310665 - DNA, 15 bp, Homo sapiens
cccattgtccctctg

SEQ ID NO: 1310666 - DNA, 15 bp, Homo sapiens
cccatttctatttat

SEQ ID NO: 1310667 - DNA, 20 bp, Homo sapiens
cccatttctatttatttact

SEQ ID NO: 1310668 - DNA, 19 bp, Homo sapiens
ccccacccctgggggctct

SEQ ID NO: 1310669 - DNA, 15 bp, Homo sapiens
ccccagcactgagga

SEQ ID NO: 1310670 - DNA, 16 bp, Homo sapiens
ccccagcactgaggaa

SEQ ID NO: 1310671 - DNA, 13 bp, Homo sapiens
ccccagcccagag

SEQ ID NO: 1310672 - DNA, 15 bp, Homo sapiens
ccccagcccagagac

SEQ ID NO: 1310673 - DNA, 21 bp, Homo sapiens
ccccagctaagaacctggaac

SEQ ID NO: 1310674 - DNA, 11 bp, Homo sapiens
ccccagctccg

SEQ ID NO: 1310675 - DNA, 16 bp, Homo sapiens
ccccaggaccagctca

SEQ ID NO: 1310676 - DNA, 21 bp, Homo sapiens
ccccaggaccagctcaggaca

SEQ ID NO: 1310677 - DNA, 15 bp, Homo sapiens
ccccaggacctggct

SEQ ID NO: 1310678 - DNA, 22 bp, Homo sapiens
ccccaggactgggccacttctg

SEQ ID NO: 1310679 - DNA, 15 bp, Homo sapiens
ccccatcctccagca

SEQ ID NO: 1310680 - DNA, 23 bp, Homo sapiens
ccccatgcactgtgaaggaccct

SEQ ID NO: 1310681 - DNA, 15 bp, Homo sapiens
ccccattcttttgta

SEQ ID NO: 1310682 - DNA, 15 bp, Homo sapiens
cccccagcactgagg

SEQ ID NO: 1310683 - DNA, 18 bp, Homo sapiens
cccccagctaagaacctg

SEQ ID NO: 1310684 - DNA, 12 bp, Homo sapiens
cccccaggactg

SEQ ID NO: 1310685 - DNA, 17 bp, Homo sapiens
cccccaggactgggcca

SEQ ID NO: 1310686 - DNA, 15 bp, Homo sapiens
ccccctggcctctgt

SEQ ID NO: 1310687 - DNA, 20 bp, Homo sapiens
cccctcatctctctgcccaa

SEQ ID NO: 1310688 - DNA, 12 bp, Homo sapiens
cccctcctccac

SEQ ID NO: 1310689 - DNA, 13 bp, Homo sapiens
cccctccttcaga

SEQ ID NO: 1310690 - DNA, 19 bp, Homo sapiens
cccctctccttcctgtgtg

SEQ ID NO: 1310691 - DNA, 16 bp, Homo sapiens
cccctgcccccaggac

SEQ ID NO: 1310692 - DNA, 19 bp, Homo sapiens
cccctgcccccaggactgg

SEQ ID NO: 1310693 - DNA, 14 bp, Homo sapiens
ccccttctgctcag

SEQ ID NO: 1310694 - DNA, 12 bp, Homo sapiens
gggagaagctcc

SEQ ID NO: 1310695 - DNA, 12 bp, Homo sapiens
gggagctgaggc

SEQ ID NO: 1310696 - DNA, 13 bp, Homo sapiens
gggaggctcaggt

SEQ ID NO: 1310697 - DNA, 15 bp, Homo sapiens
gggagttaagacctg

SEQ ID NO: 1310698 - DNA, 20 bp, Homo sapiens
gggagttaagacctggcagc

SEQ ID NO: 1310699 - DNA, 22 bp, Homo sapiens
gggatcaaccagctaagaaaag

SEQ ID NO: 1310700 - DNA, 15 bp, Homo sapiens
gggcagcgccaggct

SEQ ID NO: 1310701 - DNA, 13 bp, Homo sapiens
gggccagagccag

SEQ ID NO: 1310702 - DNA, 18 bp, Homo sapiens
gggccagatccagcctgg

SEQ ID NO: 1310703 - DNA, 15 bp, Homo sapiens
gggcccagagcccag

SEQ ID NO: 1310704 - DNA, 14 bp, Homo sapiens
gggccgctgccacc

SEQ ID NO: 1310705 - DNA, 21 bp, Homo sapiens
gggccgctgccacccacctcc

SEQ ID NO: 1310706 - DNA, 15 bp, Homo sapiens
gggcctgctccagac

SEQ ID NO: 1310707 - DNA, 23 bp, Homo sapiens
gggctctcatgttttcaactgcc

SEQ ID NO: 1310708 - DNA, 15 bp, Homo sapiens
gggctcttctcattt

SEQ ID NO: 1310709 - DNA, 23 bp, Homo sapiens
gggctggttctgtaattgtgtgt

SEQ ID NO: 1310710 - DNA, 17 bp, Homo sapiens
gggctgtcatctgtgca

SEQ ID NO: 1310711 - DNA, 22 bp, Homo sapiens
ggggaaaggcaaggtccggccc

SEQ ID NO: 1310712 - DNA, 19 bp, Homo sapiens
ggggagcccactgtcctgg

SEQ ID NO: 1310713 - DNA, 23 bp, Homo sapiens
ggggatccctcccccccatgcac

SEQ ID NO: 1310714 - DNA, 13 bp, Homo sapiens
ggggccagatcca

SEQ ID NO: 1310715 - DNA, 14 bp, Homo sapiens
ggggccagatccag

SEQ ID NO: 1310716 - DNA, 19 bp, Homo sapiens
ggggccagatccagcctgg

SEQ ID NO: 1310717 - DNA, 23 bp, Homo sapiens
ggggcctacagctttgatccctg

SEQ ID NO: 1310718 - DNA, 20 bp, Homo sapiens
ggggcctaggcctcagccag

SEQ ID NO: 1310719 - DNA, 13 bp, Homo sapiens
ggggtcctggcca

SEQ ID NO: 1310720 - DNA, 15 bp, Homo sapiens
ggggtgaggagctgg

SEQ ID NO: 1310721 - DNA, 14 bp, Homo sapiens
gggtcatgccctcc

SEQ ID NO: 1310722 - DNA, 15 bp, Homo sapiens
gggtcctggccatcc

SEQ ID NO: 1310723 - DNA, 23 bp, Homo sapiens
gggtcggaacccaagcttagaac

SEQ ID NO: 1310724 - DNA, 20 bp, Homo sapiens
gggtctggagttgatctgga

SEQ ID NO: 1310725 - DNA, 22 bp, Homo sapiens
gggtctggcagcctcccatcca

SEQ ID NO: 1310726 - DNA, 14 bp, Homo sapiens
gggtgaggagctgg

SEQ ID NO: 1310727 - DNA, 20 bp, Homo sapiens
gggttctgcctgccagctgc

SEQ ID NO: 1310728 - DNA, 21 bp, Homo sapiens
gggttctgcctgccagctgca

SEQ ID NO: 1310729 - DNA, 13 bp, Homo sapiens
ggtagccagcaca

SEQ ID NO: 1310730 - DNA, 16 bp, Homo sapiens
ggtagccagcacacag

SEQ ID NO: 1310731 - DNA, 22 bp, Homo sapiens
ggtcatactatctactctcctc

SEQ ID NO: 1310732 - DNA, 20 bp, Homo sapiens
ggtcatgccctcctctccca

SEQ ID NO: 1310733 - DNA, 14 bp, Homo sapiens
ggtcctggccatcc

SEQ ID NO: 1310734 - DNA, 16 bp, Homo sapiens
ggtcctggccatccca

SEQ ID NO: 1310735 - DNA, 15 bp, Homo sapiens
ggtctggcagcctcc

SEQ ID NO: 1310736 - DNA, 18 bp, Homo sapiens
ggtctttcctaaggctgc

SEQ ID NO: 1310737 - DNA, 13 bp, Homo sapiens
ggtgcccacaggc

SEQ ID NO: 1310738 - DNA, 13 bp, Homo sapiens
ggtgccccaggac

SEQ ID NO: 1310739 - DNA, 20 bp, Homo sapiens
ggtgccccaggaccagctca

SEQ ID NO: 1310740 - DNA, 23 bp, Homo sapiens
ggtgccccaggaccagctcagga

SEQ ID NO: 1310741 - DNA, 15 bp, Homo sapiens
ggtgctgacggccag

SEQ ID NO: 1310742 - DNA, 20 bp, Homo sapiens
ggtgctgacggccagggaga

SEQ ID NO: 1310743 - DNA, 15 bp, Homo sapiens
ggtgctgtcctcagg

SEQ ID NO: 1310744 - DNA, 20 bp, Homo sapiens
ggtgctgtcctcaggtggcc

SEQ ID NO: 1310745 - DNA, 17 bp, Homo sapiens
ggtggccatgcctcagc

SEQ ID NO: 1310746 - DNA, 21 bp, Homo sapiens
ggtggctagtcaagctcctcc

SEQ ID NO: 1310747 - DNA, 22 bp, Homo sapiens
ggtggctagtcaagctcctcct

SEQ ID NO: 1310748 - DNA, 14 bp, Homo sapiens
ggtgggcaggaaaa

SEQ ID NO: 1310749 - DNA, 12 bp, Homo sapiens
ggtgggccaggc

SEQ ID NO: 1310750 - DNA, 19 bp, Homo sapiens
ggtggggtcatgccctcct

SEQ ID NO: 1310751 - DNA, 14 bp, Homo sapiens
ggtggtaaccctgg

SEQ ID NO: 1310752 - DNA, 21 bp, Homo sapiens
ggtggttgctgttttcctccc

SEQ ID NO: 1310753 - DNA, 23 bp, Homo sapiens
ggtgtctccaaccccccagcact

SEQ ID NO: 1310754 - DNA, 20 bp, Homo sapiens
ggtgtgcaatgtctgagtga

SEQ ID NO: 1310755 - DNA, 15 bp, Homo sapiens
ggtgtgcacatctct

SEQ ID NO: 1310756 - DNA, 19 bp, Homo sapiens
ggttctgcctgccagctgc

SEQ ID NO: 1310757 - DNA, 20 bp, Homo sapiens
ggtttaggctggtggcccag

SEQ ID NO: 1310758 - DNA, 22 bp, Homo sapiens
ggttttgttcccctcctccact

SEQ ID NO: 1310759 - DNA, 15 bp, Homo sapiens
gtaaataaagccctg

SEQ ID NO: 1310760 - DNA, 14 bp, Homo sapiens
gtaaatcttttaca

SEQ ID NO: 1310761 - DNA, 21 bp, Homo sapiens
gtaaccctggtggttgctgtt

SEQ ID NO: 1310762 - DNA, 20 bp, Homo sapiens
gtacatctattttggattgt

SEQ ID NO: 1310763 - DNA, 16 bp, Homo sapiens
gtagccccctggcctc

SEQ ID NO: 1310764 - DNA, 17 bp, Homo sapiens
gtagccccctggcctct

SEQ ID NO: 1310765 - DNA, 19 bp, Homo sapiens
gtagccccctggcctctgt

SEQ ID NO: 1310766 - DNA, 14 bp, Homo sapiens
gtaggagctgcctt

SEQ ID NO: 1310767 - DNA, 22 bp, Homo sapiens
gtagtcctcataaaaagcaaaa

SEQ ID NO: 1310768 - DNA, 19 bp, Homo sapiens
gtataagtggaggcacttt

SEQ ID NO: 1310769 - DNA, 12 bp, Homo sapiens
gtatatactttt

SEQ ID NO: 1310770 - DNA, 13 bp, Homo sapiens
gtatatacttttt

SEQ ID NO: 1310771 - DNA, 15 bp, Homo sapiens
gtatatagcccagcc

SEQ ID NO: 1310772 - DNA, 20 bp, Homo sapiens
gtatattgtgtttgtgtatt

SEQ ID NO: 1310773 - DNA, 21 bp, Homo sapiens
gtatatttgtgatagcacttt

SEQ ID NO: 1310774 - DNA, 17 bp, Homo sapiens
gtatcactgtctttcct

SEQ ID NO: 1310775 - DNA, 18 bp, Homo sapiens
gtatcactgtctttccta

SEQ ID NO: 1310776 - DNA, 17 bp, Homo sapiens
gtatttacgctttgatt

SEQ ID NO: 1310777 - DNA, 23 bp, Homo sapiens
gtattttatctttgattctcctt

SEQ ID NO: 1310778 - DNA, 18 bp, Homo sapiens
gtatttttcaataaagca

SEQ ID NO: 1310779 - DNA, 21 bp, Homo sapiens
gtatttttcaataaagcattt

SEQ ID NO: 1310780 - DNA, 17 bp, Homo sapiens
gtcaagctcctcctccc

SEQ ID NO: 1310781 - DNA, 19 bp, Homo sapiens
gtcaagctcctcctccctg

SEQ ID NO: 1310782 - DNA, 21 bp, Homo sapiens
gtcaagctcctcctccctgca

SEQ ID NO: 1310783 - DNA, 14 bp, Homo sapiens
gtcactcattgctg

SEQ ID NO: 1310784 - DNA, 14 bp, Homo sapiens
gtcagtcacagcca

SEQ ID NO: 1310785 - DNA, 20 bp, Homo sapiens
gtcatactatctactctcct

SEQ ID NO: 1310786 - DNA, 22 bp, Homo sapiens
gtcatactatctactctcctca

SEQ ID NO: 1310787 - DNA, 13 bp, Homo sapiens
gtccccttctctc

SEQ ID NO: 1310788 - DNA, 17 bp, Homo sapiens
gtccccttctctcatct

SEQ ID NO: 1310789 - DNA, 20 bp, Homo sapiens
gtccctctgccccatcctcc

SEQ ID NO: 1310790 - DNA, 21 bp, Homo sapiens
gtccctctgccccatcctcca

SEQ ID NO: 1310791 - DNA, 22 bp, Homo sapiens
gtccctggggctagggggagcc

SEQ ID NO: 1310792 - DNA, 14 bp, Homo sapiens
gtcctacccatccc

SEQ ID NO: 1310793 - DNA, 14 bp, Homo sapiens
gtcctcagccttgc

SEQ ID NO: 1310794 - DNA, 16 bp, Homo sapiens
gtcctcagccttgcca

SEQ ID NO: 1310795 - DNA, 14 bp, Homo sapiens
gtcctcaggtggcc

SEQ ID NO: 1310796 - DNA, 15 bp, Homo sapiens
gtcctcaggtggcca

SEQ ID NO: 1310797 - DNA, 22 bp, Homo sapiens
gtcctccaacaccaagcacagc

SEQ ID NO: 1310798 - DNA, 18 bp, Homo sapiens
gtcctctgtcagtcacag

SEQ ID NO: 1310799 - DNA, 15 bp, Homo sapiens
gtccttagaacattt

SEQ ID NO: 1310800 - DNA, 19 bp, Homo sapiens
gtcctttttttccatcttt

SEQ ID NO: 1310801 - DNA, 16 bp, Homo sapiens
gtctaaacaatgctga

SEQ ID NO: 1310802 - DNA, 21 bp, Homo sapiens
gtctaaacaatgctgatttgg

SEQ ID NO: 1310803 - DNA, 15 bp, Homo sapiens
gtctagagagggagg

SEQ ID NO: 1310804 - DNA, 16 bp, Homo sapiens
gtctagatggctcctc

SEQ ID NO: 1310805 - DNA, 21 bp, Homo sapiens
gtctccaaccccccagcactg

SEQ ID NO: 1310806 - DNA, 20 bp, Homo sapiens
gtctccaccaggaacctctt

SEQ ID NO: 1310807 - DNA, 19 bp, Homo sapiens
gtctcttgtattaaactct

SEQ ID NO: 1310808 - DNA, 14 bp, Homo sapiens
gtctgagtgaacct

SEQ ID NO: 1310809 - DNA, 22 bp, Homo sapiens
gtctggcagcctcccatccagg

SEQ ID NO: 1310810 - DNA, 21 bp, Homo sapiens
tctgtgaacgatttagaaaga

SEQ ID NO: 1310811 - DNA, 18 bp, Homo sapiens
tctgtgccttcttttgat

SEQ ID NO: 1310812 - DNA, 13 bp, Homo sapiens
tctgtgtctgtgt

SEQ ID NO: 1310813 - DNA, 18 bp, Homo sapiens
tcttagatggattctcca

SEQ ID NO: 1310814 - DNA, 22 bp, Homo sapiens
tcttagatggattctccactca

SEQ ID NO: 1310815 - DNA, 13 bp, Homo sapiens
tcttagctcccct

SEQ ID NO: 1310816 - DNA, 14 bp, Homo sapiens
tcttatggaattga

SEQ ID NO: 1310817 - DNA, 15 bp, Homo sapiens
tcttatggaattgat

SEQ ID NO: 1310818 - DNA, 18 bp, Homo sapiens
tcttatggaattgatttg

SEQ ID NO: 1310819 - DNA, 22 bp, Homo sapiens
tcttatggaattgatttgcatt

SEQ ID NO: 1310820 - DNA, 17 bp, Homo sapiens
tcttattagggagaaaa

SEQ ID NO: 1310821 - DNA, 22 bp, Homo sapiens
tcttctaaacttccccatcttc

SEQ ID NO: 1310822 - DNA, 20 bp, Homo sapiens
tcttctcatttcacccctcc

SEQ ID NO: 1310823 - DNA, 23 bp, Homo sapiens
tcttctcatttcacccctccctt

SEQ ID NO: 1310824 - DNA, 13 bp, Homo sapiens
tcttctggctcaa

SEQ ID NO: 1310825 - DNA, 17 bp, Homo sapiens
tcttgatcaacatcttt

SEQ ID NO: 1310826 - DNA, 18 bp, Homo sapiens
tcttgatcaacatctttt

SEQ ID NO: 1310827 - DNA, 19 bp, Homo sapiens
tcttgatcaacatcttttc

SEQ ID NO: 1310828 - DNA, 23 bp, Homo sapiens
tcttgatcaacatcttttcttgc

SEQ ID NO: 1310829 - DNA, 18 bp, Homo sapiens
tcttgtaaataaagccct

SEQ ID NO: 1310830 - DNA, 19 bp, Homo sapiens
tcttgtattaaactcttca

SEQ ID NO: 1310831 - DNA, 16 bp, Homo sapiens
tctttattaatcacta

SEQ ID NO: 1310832 - DNA, 19 bp, Homo sapiens
tctttcctagatggcagtc

SEQ ID NO: 1310833 - DNA, 15 bp, Homo sapiens
tctttcctccttcca

SEQ ID NO: 1310834 - DNA, 20 bp, Homo sapiens
tctttctgataactagatgg

SEQ ID NO: 1310835 - DNA, 10 bp, Homo sapiens
tctttctgta

SEQ ID NO: 1310836 - DNA, 19 bp, Homo sapiens
tctttgattctccttcagc

SEQ ID NO: 1310837 - DNA, 23 bp, Homo sapiens
tctttgattctccttcagccctc

SEQ ID NO: 1310838 - DNA, 12 bp, Homo sapiens
tctttgctttgc

SEQ ID NO: 1310839 - DNA, 20 bp, Homo sapiens
tcttttcttgcctctgtccc

SEQ ID NO: 1310840 - DNA, 20 bp, Homo sapiens
tgaaaacggagctgaacaat

SEQ ID NO: 1310841 - DNA, 16 bp, Homo sapiens
tgaaacaacttggaaa

SEQ ID NO: 1310842 - DNA, 11 bp, Homo sapiens
tgaaagctgtg

SEQ ID NO: 1310843 - DNA, 17 bp, Homo sapiens
tgaaataaaactggctt

SEQ ID NO: 1310844 - DNA, 15 bp, Homo sapiens
tgaacaaagcagcca

SEQ ID NO: 1310845 - DNA, 18 bp, Homo sapiens
tgaacacaaactgtaaat

SEQ ID NO: 1310846 - DNA, 20 bp, Homo sapiens
tgaactcactttcctcctga

SEQ ID NO: 1310847 - DNA, 15 bp, Homo sapiens
tgaagactggaagct

SEQ ID NO: 1310848 - DNA, 17 bp, Homo sapiens
tgaagactggaagctaa

SEQ ID NO: 1310849 - DNA, 19 bp, Homo sapiens
tgaagcaggttcccaagct

SEQ ID NO: 1310850 - DNA, 18 bp, Homo sapiens
tgaaggcaaaattgcaaa

SEQ ID NO: 1310851 - DNA, 19 bp, Homo sapiens
tgaagggccagagccaggg

SEQ ID NO: 1310852 - DNA, 19 bp, Homo sapiens
tgaaggtgctgacggccag

SEQ ID NO: 1310853 - DNA, 12 bp, Homo sapiens
tgaatgaacact

SEQ ID NO: 1310854 - DNA, 15 bp, Homo sapiens
tgaatgaacactctt

SEQ ID NO: 1310855 - DNA, 17 bp, Homo sapiens
tgaatgtatttatttgg

SEQ ID NO: 1310856 - DNA, 12 bp, Homo sapiens
tgacaacatctg

SEQ ID NO: 1310857 - DNA, 18 bp, Homo sapiens
tgacacagaaaatgttga

SEQ ID NO: 1310858 - DNA, 17 bp, Homo sapiens
tgacacaggtctttcct

SEQ ID NO: 1310859 - DNA, 12 bp, Homo sapiens
tgacagctgctc

SEQ ID NO: 1310860 - DNA, 14 bp, Homo sapiens
tgacagctgctcct

SEQ ID NO: 1310861 - DNA, 15 bp, Homo sapiens
tgacagctgctccta

SEQ ID NO: 1310862 - DNA, 21 bp, Homo sapiens
tgacagctgctcctagaggga

SEQ ID NO: 1310863 - DNA, 14 bp, Homo sapiens
tgacagctttgctg

SEQ ID NO: 1310864 - DNA, 19 bp, Homo sapiens
tgacatgattccttcctgt

SEQ ID NO: 1310865 - DNA, 22 bp, Homo sapiens
tgacatgattccttcctgttct

SEQ ID NO: 1310866 - DNA, 15 bp, Homo sapiens
tgacattcacctgcc

SEQ ID NO: 1310867 - DNA, 12 bp, Homo sapiens
tgacatttcttt

SEQ ID NO: 1310868 - DNA, 15 bp, Homo sapiens
tgaccagcagcgcct

SEQ ID NO: 1310869 - DNA, 18 bp, Homo sapiens
tgacccagccccttgaga

SEQ ID NO: 1310870 - DNA, 23 bp, Homo sapiens
tgacccagccccttgagaaacct

SEQ ID NO: 1310871 - DNA, 19 bp, Homo sapiens
tgaccctgtatatagccca

SEQ ID NO: 1310872 - DNA, 20 bp, Homo sapiens
tgaccctgtatatagcccag

SEQ ID NO: 1310873 - DNA, 14 bp, Homo sapiens
tgacctccctctaa

SEQ ID NO: 1310874 - DNA, 18 bp, Homo sapiens
tgaccttttatgtagtaa

SEQ ID NO: 1310875 - DNA, 23 bp, Homo sapiens
tgaccttttatgtagtaattgac

SEQ ID NO: 1310876 - DNA, 23 bp, Homo sapiens
tgactagatgatggatgccaata

SEQ ID NO: 1310877 - DNA, 22 bp, Homo sapiens
tgactctggcaaagcttttaga

SEQ ID NO: 1310878 - DNA, 23 bp, Homo sapiens
tgagaaaccttattgtacctctc

SEQ ID NO: 1310879 - DNA, 19 bp, Homo sapiens
tgagaacaaccaaaatctt

SEQ ID NO: 1310880 - DNA, 17 bp, Homo sapiens
tgagaagaaaacatcta

SEQ ID NO: 1310881 - DNA, 19 bp, Homo sapiens
tgagaagcttttgaataaa

SEQ ID NO: 1310882 - DNA, 21 bp, Homo sapiens
tgagaatcccaaatttgattg

SEQ ID NO: 1310883 - DNA, 12 bp, Homo sapiens
tgagaatctacc

SEQ ID NO: 1310884 - DNA, 21 bp, Homo sapiens
tgagaatctacccccagatcc

SEQ ID NO: 1310885 - DNA, 21 bp, Homo sapiens
tgagacacggagcccagccct

SEQ ID NO: 1310886 - DNA, 22 bp, Homo sapiens
tgagacacggagcccagccctc

SEQ ID NO: 1310887 - DNA, 16 bp, Homo sapiens
tgagactcgagaactt

SEQ ID NO: 1310888 - DNA, 22 bp, Homo sapiens
tgagaggtttgactagatgatg

SEQ ID NO: 1310889 - DNA, 20 bp, Homo sapiens
tgagatgatacatccaaagc

SEQ ID NO: 1310890 - DNA, 21 bp, Homo sapiens
tgagatttcatctgctctcct

SEQ ID NO: 1310891 - DNA, 18 bp, Homo sapiens
tgagcaactcttgattat

SEQ ID NO: 1310892 - DNA, 17 bp, Homo sapiens
tgagcccagctgggtca

SEQ ID NO: 1310893 - DNA, 20 bp, Homo sapiens
tgagcggtgctgtcctcagg

SEQ ID NO: 1310894 - DNA, 21 bp, Homo sapiens
tgagcggtgctgtcctcaggt

SEQ ID NO: 1310895 - DNA, 20 bp, Homo sapiens
tgagctctcggaactgcatg

SEQ ID NO: 1310896 - DNA, 19 bp, Homo sapiens
tgaggaagaacggggctct

SEQ ID NO: 1310897 - DNA, 24 bp, Homo sapiens
tgaggaagaacggggctcttctca

SEQ ID NO: 1310898 - DNA, 12 bp, Homo sapiens
tgaggagctggg

SEQ ID NO: 1310899 - DNA, 13 bp, Homo sapiens
tgaggctttggat

SEQ ID NO: 1310900 - DNA, 23 bp, Homo sapiens
tgaggctttggatttgacattgc

SEQ ID NO: 1310901 - DNA, 16 bp, Homo sapiens
tgaggtcaggagttcc

SEQ ID NO: 1310902 - DNA, 18 bp, Homo sapiens
tgataactagatggtgct

SEQ ID NO: 1310903 - DNA, 22 bp, Homo sapiens
tgatacatccaaagcagacagc

SEQ ID NO: 1310904 - DNA, 22 bp, Homo sapiens
tgatagacacatatgaggggga

SEQ ID NO: 1310905 - DNA, 13 bp, Homo sapiens
tgatagcactttc

SEQ ID NO: 1310906 - DNA, 15 bp, Homo sapiens
tgatagcactttcta

SEQ ID NO: 1310907 - DNA, 23 bp, Homo sapiens
tgatcaacatcttttcttgcctc

SEQ ID NO: 1310908 - DNA, 14 bp, Homo sapiens
tgatcctggaggcc

SEQ ID NO: 1310909 - DNA, 15 bp, Homo sapiens
tgatctggaacccag

SEQ ID NO: 1310910 - DNA, 18 bp, Homo sapiens
tgatctggaacccagact

SEQ ID NO: 1310911 - DNA, 19 bp, Homo sapiens
tgatctggaacccagactc

SEQ ID NO: 1310912 - DNA, 16 bp, Homo sapiens
tgatggcaacagatct

SEQ ID NO: 1310913 - DNA, 14 bp, Homo sapiens
tgatgtgaagccaa

SEQ ID NO: 1310914 - DNA, 19 bp, Homo sapiens
tgattcatagtaacttctt

SEQ ID NO: 1310915 - DNA, 14 bp, Homo sapiens
tgattccttcctgt

SEQ ID NO: 1310916 - DNA, 16 bp, Homo sapiens
tgattctccttcagcc

SEQ ID NO: 1310917 - DNA, 21 bp, Homo sapiens
tgattctccttcagccctcac

SEQ ID NO: 1310918 - DNA, 22 bp, Homo sapiens
tgattctgcagtaaatctttta

SEQ ID NO: 1310919 - DNA, 21 bp, Homo sapiens
tgattgacagctttgctgctg

SEQ ID NO: 1310920 - DNA, 14 bp, Homo sapiens
tgattgtggaatgg

SEQ ID NO: 1310921 - DNA, 18 bp, Homo sapiens
tgattgtggaatggagat

SEQ ID NO: 1310922 - DNA, 20 bp, Homo sapiens
tgatttaggagaagccagga

SEQ ID NO: 1310923 - DNA, 15 bp, Homo sapiens
tgatttccttgaatg

SEQ ID NO: 1310924 - DNA, 22 bp, Homo sapiens
tgcaaaaatatttataaaactt

SEQ ID NO: 1310925 - DNA, 15 bp, Homo sapiens
ttcctcccttctgct

SEQ ID NO: 1310926 - DNA, 16 bp, Homo sapiens
ttcctcccttctgcta

SEQ ID NO: 1310927 - DNA, 14 bp, Homo sapiens
ttcctctctccaga

SEQ ID NO: 1310928 - DNA, 22 bp, Homo sapiens
ttcctctttgctttgctttctg

SEQ ID NO: 1310929 - DNA, 16 bp, Homo sapiens
ttcctgaagaaccagt

SEQ ID NO: 1310930 - DNA, 15 bp, Homo sapiens
ttcctggagcccaga

SEQ ID NO: 1310931 - DNA, 21 bp, Homo sapiens
ttcctgtgtgtccaaaactgc

SEQ ID NO: 1310932 - DNA, 20 bp, Homo sapiens
ttccttttgaacgccccccc

SEQ ID NO: 1310933 - DNA, 17 bp, Homo sapiens
ttcgcatggtcacacac

SEQ ID NO: 1310934 - DNA, 21 bp, Homo sapiens
ttcgcatggtcacacactgat

SEQ ID NO: 1310935 - DNA, 22 bp, Homo sapiens
ttcgcgatggacagactcacaa

SEQ ID NO: 1310936 - DNA, 14 bp, Homo sapiens
ttcgggctgtgccc

SEQ ID NO: 1310937 - DNA, 17 bp, Homo sapiens
ttcgggtgtgcaatgtc

SEQ ID NO: 1310938 - DNA, 19 bp, Homo sapiens
ttctaaacccaatccaaat

SEQ ID NO: 1310939 - DNA, 18 bp, Homo sapiens
ttctaatagaactcagtt

SEQ ID NO: 1310940 - DNA, 18 bp, Homo sapiens
ttctacaatgtgaacttt

SEQ ID NO: 1310941 - DNA, 21 bp, Homo sapiens
ttctagctgttgagctgtttt

SEQ ID NO: 1310942 - DNA, 21 bp, Homo sapiens
ttctataaggccataaaacag

SEQ ID NO: 1310943 - DNA, 23 bp, Homo sapiens
ttctataaggccataaaacaggt

SEQ ID NO: 1310944 - DNA, 15 bp, Homo sapiens
ttctatttatttact

SEQ ID NO: 1310945 - DNA, 19 bp, Homo sapiens
ttctcatttcacccctccc

SEQ ID NO: 1310946 - DNA, 14 bp, Homo sapiens
ttctccactcagtt

SEQ ID NO: 1310947 - DNA, 17 bp, Homo sapiens
ttctccactcagttgca

SEQ ID NO: 1310948 - DNA, 16 bp, Homo sapiens
ttctcccctgccccca

SEQ ID NO: 1310949 - DNA, 14 bp, Homo sapiens
ttctcctcttgtaa

SEQ ID NO: 1310950 - DNA, 22 bp, Homo sapiens
ttctcctcttgtaaataaagcc

SEQ ID NO: 1310951 - DNA, 20 bp, Homo sapiens
ttctccttcagccctcaccc

SEQ ID NO: 1310952 - DNA, 13 bp, Homo sapiens
ttctctcatctct

SEQ ID NO: 1310953 - DNA, 17 bp, Homo sapiens
ttctctcatctcttagc

SEQ ID NO: 1310954 - DNA, 20 bp, Homo sapiens
ttctctcatctcttagctcc

SEQ ID NO: 1310955 - DNA, 17 bp, Homo sapiens
ttctcttgggaactgaa

SEQ ID NO: 1310956 - DNA, 22 bp, Homo sapiens
ttctcttgggaactgaactcac

SEQ ID NO: 1310957 - DNA, 23 bp, Homo sapiens
ttctgataactagatggtgctga

SEQ ID NO: 1310958 - DNA, 23 bp, Homo sapiens
ttctgcatatgttgaatactttt

SEQ ID NO: 1310959 - DNA, 12 bp, Homo sapiens
ttctgcctgcca

SEQ ID NO: 1310960 - DNA, 19 bp, Homo sapiens
ttctgctactggcaaaagg

SEQ ID NO: 1310961 - DNA, 14 bp, Homo sapiens
ttctgctcagctct

SEQ ID NO: 1310962 - DNA, 19 bp, Homo sapiens
ttctgggtggggcagtggg

SEQ ID NO: 1310963 - DNA, 14 bp, Homo sapiens
ttcttgaaagctgt

SEQ ID NO: 1310964 - DNA, 18 bp, Homo sapiens
ttctttaatgcttttata

SEQ ID NO: 1310965 - DNA, 13 bp, Homo sapiens
ttctttgggccag

SEQ ID NO: 1310966 - DNA, 22 bp, Homo sapiens
ttgaaagctgtggccagcttgt

SEQ ID NO: 1310967 - DNA, 20 bp, Homo sapiens
ttgaaattaagaaggcaaaa

SEQ ID NO: 1310968 - DNA, 14 bp, Homo sapiens
ttgaacacaaactg

SEQ ID NO: 1310969 - DNA, 18 bp, Homo sapiens
ttgaacacaaactgtaaa

SEQ ID NO: 1310970 - DNA, 21 bp, Homo sapiens
ttgaacacaaactgtaaataa

SEQ ID NO: 1310971 - DNA, 17 bp, Homo sapiens
ttgaagggccagagcca

SEQ ID NO: 1310972 - DNA, 20 bp, Homo sapiens
ttgaagggccagagccaggg

SEQ ID NO: 1310973 - DNA, 13 bp, Homo sapiens
ttgaatacttttt

SEQ ID NO: 1310974 - DNA, 22 bp, Homo sapiens
ttgaatgtggcttgagaaatat

SEQ ID NO: 1310975 - DNA, 18 bp, Homo sapiens
ttgacacaagtggacctt

SEQ ID NO: 1310976 - DNA, 22 bp, Homo sapiens
ttgacacaggtctttcctaagg

SEQ ID NO: 1310977 - DNA, 14 bp, Homo sapiens
ttgacagctttgct

SEQ ID NO: 1310978 - DNA, 19 bp, Homo sapiens
ttgacagctttgctgctga

SEQ ID NO: 1310979 - DNA, 23 bp, Homo sapiens
ttgactagatgatggatgccaat

SEQ ID NO: 1310980 - DNA, 10 bp, Homo sapiens
ttgagaaacc

SEQ ID NO: 1310981 - DNA, 18 bp, Homo sapiens
ttgagaagaaaacatcta

SEQ ID NO: 1310982 - DNA, 20 bp, Homo sapiens
ttgaggggattaatatgaaa

SEQ ID NO: 1310983 - DNA, 17 bp, Homo sapiens
ttgatcaacatcttttc

SEQ ID NO: 1310984 - DNA, 20 bp, Homo sapiens
ttgatgaccaaagtcctttt

SEQ ID NO: 1310985 - DNA, 17 bp, Homo sapiens
ttgattctccttcagcc

SEQ ID NO: 1310986 - DNA, 12 bp, Homo sapiens
ttgattctgcag

SEQ ID NO: 1310987 - DNA, 13 bp, Homo sapiens
ttgattgatttga

SEQ ID NO: 1310988 - DNA, 20 bp, Homo sapiens
ttgattgttcgggtgtgcaa

SEQ ID NO: 1310989 - DNA, 13 bp, Homo sapiens
ttgatttgaagaa

SEQ ID NO: 1310990 - DNA, 18 bp, Homo sapiens
ttgatttgaagaacatgt

SEQ ID NO: 1310991 - DNA, 21 bp, Homo sapiens
ttgcagaactaaactcattta

SEQ ID NO: 1310992 - DNA, 20 bp, Homo sapiens
ttgcattaaattcacaaact

SEQ ID NO: 1310993 - DNA, 22 bp, Homo sapiens
ttgcattaaattcacaaacttt

SEQ ID NO: 1310994 - DNA, 14 bp, Homo sapiens
ttgcattgaacaca

SEQ ID NO: 1310995 - DNA, 15 bp, Homo sapiens
ttgcattgaacacaa

SEQ ID NO: 1310996 - DNA, 22 bp, Homo sapiens
ttgcattgaacacaaactgtaa

SEQ ID NO: 1310997 - DNA, 21 bp, Homo sapiens
ttgcatttggattggggtccc

SEQ ID NO: 1310998 - DNA, 20 bp, Homo sapiens
ttgcctctgtccccttctct

SEQ ID NO: 1310999 - DNA, 15 bp, Homo sapiens
ttgctgagcctctgc

SEQ ID NO: 1311000 - DNA, 22 bp, Homo sapiens
ttgctgagcctctgctccccag

SEQ ID NO: 1311001 - DNA, 13 bp, Homo sapiens
ttgctgctgaagg

SEQ ID NO: 1311002 - DNA, 11 bp, Homo sapiens
ttgctgtatat

SEQ ID NO: 1311003 - DNA, 16 bp, Homo sapiens
ttgctgttttcctccc

SEQ ID NO: 1311004 - DNA, 15 bp, Homo sapiens
ttgctttattccaga

SEQ ID NO: 1311005 - DNA, 15 bp, Homo sapiens
ttggagagtttcctg

SEQ ID NO: 1311006 - DNA, 16 bp, Homo sapiens
ttggagagtttcctga

SEQ ID NO: 1311007 - DNA, 14 bp, Homo sapiens
ttggattggggtcc

SEQ ID NO: 1311008 - DNA, 18 bp, Homo sapiens
ttggattgtatattgtgt

SEQ ID NO: 1311009 - DNA, 16 bp, Homo sapiens
ttggatttttgactct

SEQ ID NO: 1311010 - DNA, 13 bp, Homo sapiens
ttggcaccagaca

SEQ ID NO: 1311011 - DNA, 18 bp, Homo sapiens
ttgggaactgaactcact

SEQ ID NO: 1311012 - DNA, 13 bp, Homo sapiens
ttgggccagacat

SEQ ID NO: 1311013 - DNA, 14 bp, Homo sapiens
ttgggccagacatg

SEQ ID NO: 1311014 - DNA, 20 bp, Homo sapiens
ttggggagttaagacctggc

SEQ ID NO: 1311015 - DNA, 20 bp, Homo sapiens
ttggttcattaattctataa

SEQ ID NO: 1311016 - DNA, 15 bp, Homo sapiens
ttggttctaatagaa

SEQ ID NO: 1311017 - DNA, 18 bp, Homo sapiens
ttggttttgttcccctcc

SEQ ID NO: 1311018 - DNA, 15 bp, Homo sapiens
ttgtatattgtgttt

SEQ ID NO: 1311019 - DNA, 19 bp, Homo sapiens
ttgtatattgtgtttgtgt

SEQ ID NO: 1311020 - DNA, 14 bp, Homo sapiens
ttgtattaaagaca

SEQ ID NO: 1311021 - DNA, 19 bp, Homo sapiens
ttgtccagctgagcgccag

SEQ ID NO: 1311022 - DNA, 16 bp, Homo sapiens
ttgtgatagcactttc

SEQ ID NO: 1311023 - DNA, 18 bp, Homo sapiens
ttgtggccaaggagctgc

SEQ ID NO: 1311024 - DNA, 17 bp, Homo sapiens
ttgtgtttgtgtattta

SEQ ID NO: 1311025 - DNA, 16 bp, Homo sapiens
ttgttatcagtcaata

SEQ ID NO: 1311026 - DNA, 18 bp, Homo sapiens
ttgttcccctcctccact

SEQ ID NO: 1311027 - DNA, 20 bp, Homo sapiens
ttgttcccctcctccactct

SEQ ID NO: 1311028 - DNA, 23 bp, Homo sapiens
ttgttcccctcctccactctccc

SEQ ID NO: 1311029 - DNA, 16 bp, Homo sapiens
ttgttcgggtgtgcaa

SEQ ID NO: 1311030 - DNA, 17 bp, Homo sapiens
ttgttcgggtgtgcaat

SEQ ID NO: 1311031 - DNA, 12 bp, Homo sapiens
tttaagctgttt

SEQ ID NO: 1311032 - DNA, 13 bp, Homo sapiens
tttaagctgtttc

SEQ ID NO: 1311033 - DNA, 18 bp, Homo sapiens
tttaagctgtttccatag

SEQ ID NO: 1311034 - DNA, 23 bp, Homo sapiens
tttagaaagaagcccaatattat

SEQ ID NO: 1311035 - DNA, 19 bp, Homo sapiens
tttagaaatactgcaagaa

SEQ ID NO: 1311036 - DNA, 22 bp, Homo sapiens
tttagaaatactgcaagaaaat

SEQ ID NO: 1311037 - DNA, 16 bp, Homo sapiens
tttagacagtctcact

SEQ ID NO: 1311038 - DNA, 15 bp, Homo sapiens
tttagagaggaaaag

SEQ ID NO: 1311039 - DNA, 22 bp, Homo sapiens
tttagcagcagcctttaatgca

SEQ ID NO: 1311040 - DNA, 15 bp, Homo sapiens
tttatacaaattaga

SEQ ID NO: 1311041 - DNA, 13 bp, Homo sapiens
aaaaaaagaaaat

SEQ ID NO: 1311042 - DNA, 16 bp, Homo sapiens
aaaaaaccacaaaggc

SEQ ID NO: 1311043 - DNA, 10 bp, Homo sapiens
aaaaaagaaa

SEQ ID NO: 1311044 - DNA, 14 bp, Homo sapiens
aaaaagaaaatgaa

SEQ ID NO: 1311045 - DNA, 12 bp, Homo sapiens
aaaaatgtttgt

SEQ ID NO: 1311046 - DNA, 13 bp, Homo sapiens
aaaaattgaagag

SEQ ID NO: 1311047 - DNA, 19 bp, Homo sapiens
aaaacgctgtcaaaagttg

SEQ ID NO: 1311048 - DNA, 20 bp, Homo sapiens
aaaactccgcccccagccta

SEQ ID NO: 1311049 - DNA, 15 bp, Homo sapiens
aaaacttttctgctg

SEQ ID NO: 1311050 - DNA, 14 bp, Homo sapiens
aaaagaaaaaccac

SEQ ID NO: 1311051 - DNA, 17 bp, Homo sapiens
aaaatagtttgtttaat

SEQ ID NO: 1311052 - DNA, 18 bp, Homo sapiens
aaaatatataccccccca

SEQ ID NO: 1311053 - DNA, 23 bp, Homo sapiens
aaaatgtgaattgcatgacttgt

SEQ ID NO: 1311054 - DNA, 11 bp, Homo sapiens
aaacacagctg

SEQ ID NO: 1311055 - DNA, 12 bp, Homo sapiens
aaacacagctgt

SEQ ID NO: 1311056 - DNA, 13 bp, Homo sapiens
aaacacagctgtt

SEQ ID NO: 1311057 - DNA, 20 bp, Homo sapiens
aaacagctttggggtgtctt

SEQ ID NO: 1311058 - DNA, 22 bp, Homo sapiens
aaaccacaaaggccaaactgct

SEQ ID NO: 1311059 - DNA, 21 bp, Homo sapiens
aaaccctaggttcccggtccc

SEQ ID NO: 1311060 - DNA, 18 bp, Homo sapiens
aaacgctgtcaaaagttg

SEQ ID NO: 1311061 - DNA, 14 bp, Homo sapiens
aaactggaataaga

SEQ ID NO: 1311062 - DNA, 13 bp, Homo sapiens
aaacttttctgct

SEQ ID NO: 1311063 - DNA, 16 bp, Homo sapiens
aaacttttctgctgat

SEQ ID NO: 1311064 - DNA, 19 bp, Homo sapiens
aaagaggactcgcttgtaa

SEQ ID NO: 1311065 - DNA, 21 bp, Homo sapiens
aaagaggactcgcttgtaaat

SEQ ID NO: 1311066 - DNA, 18 bp, Homo sapiens
aaagatatctatgactgt

SEQ ID NO: 1311067 - DNA, 12 bp, Homo sapiens
aaagattctttt

SEQ ID NO: 1311068 - DNA, 17 bp, Homo sapiens
aaagattctttttctga

SEQ ID NO: 1311069 - DNA, 16 bp, Homo sapiens
aaagttaatcttcatg

SEQ ID NO: 1311070 - DNA, 14 bp, Homo sapiens
aaataataaaagat

SEQ ID NO: 1311071 - DNA, 12 bp, Homo sapiens
aaatctgtgtat

SEQ ID NO: 1311072 - DNA, 15 bp, Homo sapiens
aaatgcctagttttt

SEQ ID NO: 1311073 - DNA, 16 bp, Homo sapiens
aaatgcctagttttta

SEQ ID NO: 1311074 - DNA, 19 bp, Homo sapiens
aaatgcctagtttttagta

SEQ ID NO: 1311075 - DNA, 13 bp, Homo sapiens
aaattaaaaagat

SEQ ID NO: 1311076 - DNA, 17 bp, Homo sapiens
aaattaaaaagattctt

SEQ ID NO: 1311077 - DNA, 12 bp, Homo sapiens
aaattgaagaga

SEQ ID NO: 1311078 - DNA, 21 bp, Homo sapiens
aaattgtcttttgtcatgtgg

SEQ ID NO: 1311079 - DNA, 22 bp, Homo sapiens
aacaacctggccgcgtttagac

SEQ ID NO: 1311080 - DNA, 22 bp, Homo sapiens
aacagctttggggtgtcttttt

SEQ ID NO: 1311081 - DNA, 21 bp, Homo sapiens
aacataacccacttgtcactg

SEQ ID NO: 1311082 - DNA, 20 bp, Homo sapiens
aaccacaaaggccaaactgc

SEQ ID NO: 1311083 - DNA, 16 bp, Homo sapiens
aacccaaggagcacag

SEQ ID NO: 1311084 - DNA, 20 bp, Homo sapiens
aacccagggctctgccccag

SEQ ID NO: 1311085 - DNA, 21 bp, Homo sapiens
aacccagggctctgccccagt

SEQ ID NO: 1311086 - DNA, 19 bp, Homo sapiens
aaccgctcacctagagcca

SEQ ID NO: 1311087 - DNA, 17 bp, Homo sapiens
aacctcccagaggtcca

SEQ ID NO: 1311088 - DNA, 21 bp, Homo sapiens
aacctcccagaggtccagccc

SEQ ID NO: 1311089 - DNA, 23 bp, Homo sapiens
aacctcccagaggtccagcccat

SEQ ID NO: 1311090 - DNA, 24 bp, Homo sapiens
aacctcccagaggtccagcccatc

SEQ ID NO: 1311091 - DNA, 19 bp, Homo sapiens
aacctggccgcgtttagac

SEQ ID NO: 1311092 - DNA, 23 bp, Homo sapiens
aacctggccgcgtttagaccaag

SEQ ID NO: 1311093 - DNA, 17 bp, Homo sapiens
aacgttactcagggctc

SEQ ID NO: 1311094 - DNA, 18 bp, Homo sapiens
aactccgcccccagccta

SEQ ID NO: 1311095 - DNA, 20 bp, Homo sapiens
aactgctggacgtctttctt

SEQ ID NO: 1311096 - DNA, 21 bp, Homo sapiens
aactggaataagaagcaaata

SEQ ID NO: 1311097 - DNA, 23 bp, Homo sapiens
aacttactattcattaaatgttt

SEQ ID NO: 1311098 - DNA, 17 bp, Homo sapiens
aagaaagatatctatga

SEQ ID NO: 1311099 - DNA, 22 bp, Homo sapiens
aagaagcttctaataaattata

SEQ ID NO: 1311100 - DNA, 23 bp, Homo sapiens
aagaggactcgcttgtaaatacc

SEQ ID NO: 1311101 - DNA, 16 bp, Homo sapiens
aagattctttttctga

SEQ ID NO: 1311102 - DNA, 14 bp, Homo sapiens
aagcaaataaatat

SEQ ID NO: 1311103 - DNA, 23 bp, Homo sapiens
aagcacaagcagagtgcacagct

SEQ ID NO: 1311104 - DNA, 18 bp, Homo sapiens
aagcagagtgcacagctg

SEQ ID NO: 1311105 - DNA, 11 bp, Homo sapiens
aagctccctgc

SEQ ID NO: 1311106 - DNA, 16 bp, Homo sapiens
aagctccctgccccaa

SEQ ID NO: 1311107 - DNA, 13 bp, Homo sapiens
agcagagaagggc

SEQ ID NO: 1311108 - DNA, 16 bp, Homo sapiens
agcagagtgcacagct

SEQ ID NO: 1311109 - DNA, 17 bp, Homo sapiens
agcagagtgcacagctg

SEQ ID NO: 1311110 - DNA, 18 bp, Homo sapiens
agcagagtgcacagctgt

SEQ ID NO: 1311111 - DNA, 19 bp, Homo sapiens
agcagagtgcacagctgtc

SEQ ID NO: 1311112 - DNA, 17 bp, Homo sapiens
agcaggacctcccttcc

SEQ ID NO: 1311113 - DNA, 22 bp, Homo sapiens
agcaggacctcccttccgaccc

SEQ ID NO: 1311114 - DNA, 18 bp, Homo sapiens
agccagctgcaggaatca

SEQ ID NO: 1311115 - DNA, 20 bp, Homo sapiens
agcccaaaggggacaggcct

SEQ ID NO: 1311116 - DNA, 14 bp, Homo sapiens
agcccagcgctctg

SEQ ID NO: 1311117 - DNA, 17 bp, Homo sapiens
agcccatgttctgcccc

SEQ ID NO: 1311118 - DNA, 22 bp, Homo sapiens
agcccatgttctgcccccagcc

SEQ ID NO: 1311119 - DNA, 22 bp, Homo sapiens
agccccgccctcttcctgacga

SEQ ID NO: 1311120 - DNA, 14 bp, Homo sapiens
agcccgggagccta

SEQ ID NO: 1311121 - DNA, 16 bp, Homo sapiens
agcccgggagcctagg

SEQ ID NO: 1311122 - DNA, 17 bp, Homo sapiens
agcccgggagcctagga

SEQ ID NO: 1311123 - DNA, 20 bp, Homo sapiens
agcccgggagcctaggacca

SEQ ID NO: 1311124 - DNA, 18 bp, Homo sapiens
agccggccaatggaaacc

SEQ ID NO: 1311125 - DNA, 23 bp, Homo sapiens
agcctaggaccactcagccccta

SEQ ID NO: 1311126 - DNA, 17 bp, Homo sapiens
agcctcactgatatatt

SEQ ID NO: 1311127 - DNA, 15 bp, Homo sapiens
agcctgatctcttcc

SEQ ID NO: 1311128 - DNA, 20 bp, Homo sapiens
agcctgatctcttcctgttt

SEQ ID NO: 1311129 - DNA, 18 bp, Homo sapiens
agctcagaacccagggct

SEQ ID NO: 1311130 - DNA, 19 bp, Homo sapiens
agctcagaacccagggctc

SEQ ID NO: 1311131 - DNA, 13 bp, Homo sapiens
agctccctgcccc

SEQ ID NO: 1311132 - DNA, 16 bp, Homo sapiens
agctgcaggaatcaaa

SEQ ID NO: 1311133 - DNA, 19 bp, Homo sapiens
agctgtaaaacgctgtcaa

SEQ ID NO: 1311134 - DNA, 16 bp, Homo sapiens
agctgtctgtggcttc

SEQ ID NO: 1311135 - DNA, 12 bp, Homo sapiens
agctgtgatttt

SEQ ID NO: 1311136 - DNA, 20 bp, Homo sapiens
aggaaagcctcactgatata

SEQ ID NO: 1311137 - DNA, 16 bp, Homo sapiens
aggaacaaaaaaacca

SEQ ID NO: 1311138 - DNA, 13 bp, Homo sapiens
aggaatctttaag

SEQ ID NO: 1311139 - DNA, 16 bp, Homo sapiens
aggaatctttaagcag

SEQ ID NO: 1311140 - DNA, 18 bp, Homo sapiens
aggaccactcagccccta

SEQ ID NO: 1311141 - DNA, 20 bp, Homo sapiens
aggactcgcttgtaaatacc

SEQ ID NO: 1311142 - DNA, 15 bp, Homo sapiens
aggagctgaggtttc

SEQ ID NO: 1311143 - DNA, 21 bp, Homo sapiens
aggagtgggtgacaagagcct

SEQ ID NO: 1311144 - DNA, 12 bp, Homo sapiens
aggccaaactgc

SEQ ID NO: 1311145 - DNA, 16 bp, Homo sapiens
aggcccagcccctaga

SEQ ID NO: 1311146 - DNA, 19 bp, Homo sapiens
aggcctcacctctacccaa

SEQ ID NO: 1311147 - DNA, 16 bp, Homo sapiens
agggcataaaacagct

SEQ ID NO: 1311148 - DNA, 13 bp, Homo sapiens
agggctcctccca

SEQ ID NO: 1311149 - DNA, 19 bp, Homo sapiens
aggggacaggcctcacctc

SEQ ID NO: 1311150 - DNA, 22 bp, Homo sapiens
agggttgtgattttgtctgctt

SEQ ID NO: 1311151 - DNA, 15 bp, Homo sapiens
aggtccagcccatct

SEQ ID NO: 1311152 - DNA, 15 bp, Homo sapiens
aggtcccacctccag

SEQ ID NO: 1311153 - DNA, 15 bp, Homo sapiens
agtaatctgtacatt

SEQ ID NO: 1311154 - DNA, 21 bp, Homo sapiens
agtaatctgtacattttgttg

SEQ ID NO: 1311155 - DNA, 23 bp, Homo sapiens
agtaatctgtacattttgttgta

SEQ ID NO: 1311156 - DNA, 18 bp, Homo sapiens
agtacttgtgaaacacag

SEQ ID NO: 1311157 - DNA, 21 bp, Homo sapiens
agtacttgtgaaacacagctg

SEQ ID NO: 1311158 - DNA, 23 bp, Homo sapiens
agtccccagcccttcacattttt

SEQ ID NO: 1311159 - DNA, 14 bp, Homo sapiens
agtcctgctccaga

SEQ ID NO: 1311160 - DNA, 23 bp, Homo sapiens
agtcctgctccagaatttggaaa

SEQ ID NO: 1311161 - DNA, 21 bp, Homo sapiens
agtctgtatcaaacccacgat

SEQ ID NO: 1311162 - DNA, 22 bp, Homo sapiens
agtcttcaacataacccacttg

SEQ ID NO: 1311163 - DNA, 21 bp, Homo sapiens
agtctttaaaggcccagcccc

SEQ ID NO: 1311164 - DNA, 14 bp, Homo sapiens
agtctttttctgtt

SEQ ID NO: 1311165 - DNA, 22 bp, Homo sapiens
agtgaagccagctgcaggaatc

SEQ ID NO: 1311166 - DNA, 12 bp, Homo sapiens
agtgcacagctg

SEQ ID NO: 1311167 - DNA, 12 bp, Homo sapiens
agtgtgttgact

SEQ ID NO: 1311168 - DNA, 21 bp, Homo sapiens
agttatccagagggttgtgat

SEQ ID NO: 1311169 - DNA, 13 bp, Homo sapiens
agttcctaagaag

SEQ ID NO: 1311170 - DNA, 15 bp, Homo sapiens
agttcctaagaagct

SEQ ID NO: 1311171 - DNA, 20 bp, Homo sapiens
agttggactaaatgcctagt

SEQ ID NO: 1311172 - DNA, 18 bp, Homo sapiens
ataaaaaagtgtcctata

SEQ ID NO: 1311173 - DNA, 15 bp, Homo sapiens
ataaaagattcacct

SEQ ID NO: 1311174 - DNA, 15 bp, Homo sapiens
ataaattatacaaat

SEQ ID NO: 1311175 - DNA, 15 bp, Homo sapiens
ataacccacttgtca

SEQ ID NO: 1311176 - DNA, 14 bp, Homo sapiens
ataacttcagtcct

SEQ ID NO: 1311177 - DNA, 20 bp, Homo sapiens
ataacttcagtcctgctcca

SEQ ID NO: 1311178 - DNA, 14 bp, Homo sapiens
ataagaagcaaata

SEQ ID NO: 1311179 - DNA, 16 bp, Homo sapiens
ataccaggattttttt

SEQ ID NO: 1311180 - DNA, 23 bp, Homo sapiens
atagatttatttttcagttccaa

SEQ ID NO: 1311181 - DNA, 18 bp, Homo sapiens
ataggtctcttctcccag

SEQ ID NO: 1311182 - DNA, 17 bp, Homo sapiens
atatacccccccatgca

SEQ ID NO: 1311183 - DNA, 19 bp, Homo sapiens
atataggtctcttctccca

SEQ ID NO: 1311184 - DNA, 19 bp, Homo sapiens
atatatacccccccatgca

SEQ ID NO: 1311185 - DNA, 18 bp, Homo sapiens
atatatctgaaaactgga

SEQ ID NO: 1311186 - DNA, 16 bp, Homo sapiens
atatgtgtaaatgtta

SEQ ID NO: 1311187 - DNA, 23 bp, Homo sapiens
atattatttgctaattaaaaagt

SEQ ID NO: 1311188 - DNA, 22 bp, Homo sapiens
atatttattgaattattttgtt

SEQ ID NO: 1311189 - DNA, 19 bp, Homo sapiens
atcaaaaattgaagagaga

SEQ ID NO: 1311190 - DNA, 21 bp, Homo sapiens
atcaatgttcacgcaacttga

SEQ ID NO: 1311191 - DNA, 22 bp, Homo sapiens
atcaatgttcacgcaacttgaa

SEQ ID NO: 1311192 - DNA, 15 bp, Homo sapiens
atccaagctccctgc

SEQ ID NO: 1311193 - DNA, 18 bp, Homo sapiens
atccaagctccctgcccc

SEQ ID NO: 1311194 - DNA, 19 bp, Homo sapiens
atccaagctccctgcccca

SEQ ID NO: 1311195 - DNA, 24 bp, Homo sapiens
atcccagccggccaatggaaacct

SEQ ID NO: 1311196 - DNA, 15 bp, Homo sapiens
atcccggaggaaatc

SEQ ID NO: 1311197 - DNA, 17 bp, Homo sapiens
atcctagtttcctctcc

SEQ ID NO: 1311198 - DNA, 20 bp, Homo sapiens
atcctgagccccgccctctt

SEQ ID NO: 1311199 - DNA, 17 bp, Homo sapiens
atcctgccttcatggaa

SEQ ID NO: 1311200 - DNA, 18 bp, Homo sapiens
atctatgactgtgtttaa

SEQ ID NO: 1311201 - DNA, 18 bp, Homo sapiens
atctcaaggaatctttaa

SEQ ID NO: 1311202 - DNA, 13 bp, Homo sapiens
atctgaaaactgg

SEQ ID NO: 1311203 - DNA, 11 bp, Homo sapiens
atctgtacatt

SEQ ID NO: 1311204 - DNA, 22 bp, Homo sapiens
atctgtacattttgttgtaaaa

SEQ ID NO: 1311205 - DNA, 21 bp, Homo sapiens
atcttgcgaatccaagctccc

SEQ ID NO: 1311206 - DNA, 19 bp, Homo sapiens
atctttaaatgatgtacag

SEQ ID NO: 1311207 - DNA, 15 bp, Homo sapiens
atgataaaaaagtgt

SEQ ID NO: 1311208 - DNA, 22 bp, Homo sapiens
atgataaaaaagtgtcctataa

SEQ ID NO: 1311209 - DNA, 15 bp, Homo sapiens
atgctattgaaaatg

SEQ ID NO: 1311210 - DNA, 17 bp, Homo sapiens
atggaaacctcacgctg

SEQ ID NO: 1311211 - DNA, 19 bp, Homo sapiens
atggatatgtgtaaatgtt

SEQ ID NO: 1311212 - DNA, 22 bp, Homo sapiens
atggctctggactctaaagacc

SEQ ID NO: 1311213 - DNA, 12 bp, Homo sapiens
atgtgaacttgt

SEQ ID NO: 1311214 - DNA, 16 bp, Homo sapiens
atgtgaacttgtagct

SEQ ID NO: 1311215 - DNA, 15 bp, Homo sapiens
atgtgtaaatgttat

SEQ ID NO: 1311216 - DNA, 19 bp, Homo sapiens
atgtgtaaatgttatgact

SEQ ID NO: 1311217 - DNA, 17 bp, Homo sapiens
atgttcacgcaacttga

SEQ ID NO: 1311218 - DNA, 12 bp, Homo sapiens
atgttctgcccc

SEQ ID NO: 1311219 - DNA, 18 bp, Homo sapiens
atgttctgcccccagccc

SEQ ID NO: 1311220 - DNA, 19 bp, Homo sapiens
attaaaaagattctttttc

SEQ ID NO: 1311221 - DNA, 22 bp, Homo sapiens
attaaaaagattctttttctga

SEQ ID NO: 1311222 - DNA, 11 bp, Homo sapiens
attaaatgttt

SEQ ID NO: 1311223 - DNA, 13 bp, Homo sapiens
attaaatgtttga

SEQ ID NO: 1311224 - DNA, 21 bp, Homo sapiens
attattcaagaaagatatcta

SEQ ID NO: 1311225 - DNA, 18 bp, Homo sapiens
attatttggcagtttggt

SEQ ID NO: 1311226 - DNA, 14 bp, Homo sapiens
attattttgttact

SEQ ID NO: 1311227 - DNA, 17 bp, Homo sapiens
attcaagaaagatatct

SEQ ID NO: 1311228 - DNA, 20 bp, Homo sapiens
attcaagaaagatatctatg

SEQ ID NO: 1311229 - DNA, 21 bp, Homo sapiens
attccatatcttgcgaatcca

SEQ ID NO: 1311230 - DNA, 15 bp, Homo sapiens
attctttttctgatt

SEQ ID NO: 1311231 - DNA, 19 bp, Homo sapiens
attgaagagagatatatct

SEQ ID NO: 1311232 - DNA, 21 bp, Homo sapiens
attgaattattttgttactgt

SEQ ID NO: 1311233 - DNA, 16 bp, Homo sapiens
attgacaaatctgtgt

SEQ ID NO: 1311234 - DNA, 20 bp, Homo sapiens
attgacaaatctgtgtatat

SEQ ID NO: 1311235 - DNA, 22 bp, Homo sapiens
attgacaaatctgtgtatatta

SEQ ID NO: 1311236 - DNA, 15 bp, Homo sapiens
atttatttttcagtt

SEQ ID NO: 1311237 - DNA, 19 bp, Homo sapiens
atttatttttcagttccaa

SEQ ID NO: 1311238 - DNA, 18 bp, Homo sapiens
atttcctctgagctgtta

SEQ ID NO: 1311239 - DNA, 21 bp, Homo sapiens
atttcctctgagctgttatct

SEQ ID NO: 1311240 - DNA, 13 bp, Homo sapiens
ccaagctcctcct

SEQ ID NO: 1311241 - DNA, 22 bp, Homo sapiens
ccaagctcctcctcggaaccgc

SEQ ID NO: 1311242 - DNA, 13 bp, Homo sapiens
ccaaggaacaaaa

SEQ ID NO: 1311243 - DNA, 17 bp, Homo sapiens
ccaaggagcacaggtcc

SEQ ID NO: 1311244 - DNA, 12 bp, Homo sapiens
ccaatggaaacc

SEQ ID NO: 1311245 - DNA, 18 bp, Homo sapiens
ccacctccagcccgggag

SEQ ID NO: 1311246 - DNA, 22 bp, Homo sapiens
ccacctccagcccgggagccta

SEQ ID NO: 1311247 - DNA, 23 bp, Homo sapiens
ccacctccagcccgggagcctag

SEQ ID NO: 1311248 - DNA, 16 bp, Homo sapiens
ccacgattttctccag

SEQ ID NO: 1311249 - DNA, 14 bp, Homo sapiens
ccacgctagggcgg

SEQ ID NO: 1311250 - DNA, 12 bp, Homo sapiens
ccactcagcccc

SEQ ID NO: 1311251 - DNA, 17 bp, Homo sapiens
ccactcagcccctagga

SEQ ID NO: 1311252 - DNA, 14 bp, Homo sapiens
ccagaatcccagcc

SEQ ID NO: 1311253 - DNA, 15 bp, Homo sapiens
ccagaatcccagccg

SEQ ID NO: 1311254 - DNA, 15 bp, Homo sapiens
ccagaatttggaaat

SEQ ID NO: 1311255 - DNA, 15 bp, Homo sapiens
ccagaggtccagccc

SEQ ID NO: 1311256 - DNA, 19 bp, Homo sapiens
ccagaggtccagcccatct

SEQ ID NO: 1311257 - DNA, 23 bp, Homo sapiens
ccagcccaaaggggacaggcctc

SEQ ID NO: 1311258 - DNA, 16 bp, Homo sapiens
ccagcccatctcggag

SEQ ID NO: 1311259 - DNA, 20 bp, Homo sapiens
ccagcccatctcggagcatc

SEQ ID NO: 1311260 - DNA, 15 bp, Homo sapiens
ccagcccctagaaac

SEQ ID NO: 1311261 - DNA, 22 bp, Homo sapiens
ccagcccctagaaacccaagct

SEQ ID NO: 1311262 - DNA, 23 bp, Homo sapiens
ccagcccctagaaacccaagctc

SEQ ID NO: 1311263 - DNA, 21 bp, Homo sapiens
cgcttgtggggacccaggctc

SEQ ID NO: 1311264 - DNA, 14 bp, Homo sapiens
cggccctagcccag

SEQ ID NO: 1311265 - DNA, 18 bp, Homo sapiens
cggccctagcccagcgct

SEQ ID NO: 1311266 - DNA, 14 bp, Homo sapiens
cggtgggcactgtt

SEQ ID NO: 1311267 - DNA, 13 bp, Homo sapiens
cgtctttcttttt

SEQ ID NO: 1311268 - DNA, 23 bp, Homo sapiens
cgttactcagggctcctcccagc

SEQ ID NO: 1311269 - DNA, 15 bp, Homo sapiens
cgtttagaccaagga

SEQ ID NO: 1311270 - DNA, 12 bp, Homo sapiens
ctaaaatgcttc

SEQ ID NO: 1311271 - DNA, 21 bp, Homo sapiens
ctaaaatttgtgggttttttt

SEQ ID NO: 1311272 - DNA, 17 bp, Homo sapiens
ctaaatgcctaataaac

SEQ ID NO: 1311273 - DNA, 22 bp, Homo sapiens
ctaagaagcttctaataaatta

SEQ ID NO: 1311274 - DNA, 23 bp, Homo sapiens
ctaagaagcttctaataaattat

SEQ ID NO: 1311275 - DNA, 17 bp, Homo sapiens
ctaataaattatacaaa

SEQ ID NO: 1311276 - DNA, 15 bp, Homo sapiens
ctaattaaaaagtta

SEQ ID NO: 1311277 - DNA, 17 bp, Homo sapiens
ctacccaaaccctaggt

SEQ ID NO: 1311278 - DNA, 21 bp, Homo sapiens
ctactttggtttctgtctgta

SEQ ID NO: 1311279 - DNA, 14 bp, Homo sapiens
ctagaaacccaagc

SEQ ID NO: 1311280 - DNA, 17 bp, Homo sapiens
ctagaaacccaagctcc

SEQ ID NO: 1311281 - DNA, 21 bp, Homo sapiens
ctagaaacccaagctcctcct

SEQ ID NO: 1311282 - DNA, 14 bp, Homo sapiens
ctagagccagacca

SEQ ID NO: 1311283 - DNA, 17 bp, Homo sapiens
ctaggaccactcagccc

SEQ ID NO: 1311284 - DNA, 19 bp, Homo sapiens
ctaggaccactcagcccct

SEQ ID NO: 1311285 - DNA, 19 bp, Homo sapiens
ctaggttcccggtcccgag

SEQ ID NO: 1311286 - DNA, 18 bp, Homo sapiens
ctagtttcctctccttcg

SEQ ID NO: 1311287 - DNA, 23 bp, Homo sapiens
ctatcctgttaacactgtaatat

SEQ ID NO: 1311288 - DNA, 15 bp, Homo sapiens
ctatgactgtgttta

SEQ ID NO: 1311289 - DNA, 17 bp, Homo sapiens
ctattcattaaatgttt

SEQ ID NO: 1311290 - DNA, 21 bp, Homo sapiens
ctattgaaagtttttaatatt

SEQ ID NO: 1311291 - DNA, 14 bp, Homo sapiens
ctcaaggaatcttt

SEQ ID NO: 1311292 - DNA, 13 bp, Homo sapiens
gcccgggagccta

SEQ ID NO: 1311293 - DNA, 15 bp, Homo sapiens
gcccgggagcctagg

SEQ ID NO: 1311294 - DNA, 17 bp, Homo sapiens
gccgcgtttagaccaag

SEQ ID NO: 1311295 - DNA, 20 bp, Homo sapiens
gccgcgtttagaccaaggaa

SEQ ID NO: 1311296 - DNA, 20 bp, Homo sapiens
gcctaggaccactcagcccc

SEQ ID NO: 1311297 - DNA, 21 bp, Homo sapiens
gcctaggaccactcagcccct

SEQ ID NO: 1311298 - DNA, 16 bp, Homo sapiens
gcctatgagcatcctg

SEQ ID NO: 1311299 - DNA, 16 bp, Homo sapiens
gcctcacctctaccca

SEQ ID NO: 1311300 - DNA, 17 bp, Homo sapiens
gcctcacctctacccaa

SEQ ID NO: 1311301 - DNA, 20 bp, Homo sapiens
gcgcatccaatctcaaggaa

SEQ ID NO: 1311302 - DNA, 20 bp, Homo sapiens
gcgctctgcctcaccgcttc

SEQ ID NO: 1311303 - DNA, 16 bp, Homo sapiens
gcggcgaccgccctcc

SEQ ID NO: 1311304 - DNA, 18 bp, Homo sapiens
gcggcgaccgccctccgc

SEQ ID NO: 1311305 - DNA, 19 bp, Homo sapiens
gcgtcagtctttttctgtt

SEQ ID NO: 1311306 - DNA, 16 bp, Homo sapiens
gcgtttagaccaagga

SEQ ID NO: 1311307 - DNA, 16 bp, Homo sapiens
gctactgtctttggaa

SEQ ID NO: 1311308 - DNA, 22 bp, Homo sapiens
gctactttggtttctgtctgta

SEQ ID NO: 1311309 - DNA, 13 bp, Homo sapiens
gctcacctagagc

SEQ ID NO: 1311310 - DNA, 16 bp, Homo sapiens
gctcacctagagccag

SEQ ID NO: 1311311 - DNA, 14 bp, Homo sapiens
gctcagaacccagg

SEQ ID NO: 1311312 - DNA, 17 bp, Homo sapiens
gctcagaacccagggct

SEQ ID NO: 1311313 - DNA, 15 bp, Homo sapiens
gctccctgccccaaa

SEQ ID NO: 1311314 - DNA, 20 bp, Homo sapiens
gctccgcccttagtccccca

SEQ ID NO: 1311315 - DNA, 23 bp, Homo sapiens
gctcctcccagcttgtaggagct

SEQ ID NO: 1311316 - DNA, 13 bp, Homo sapiens
gctctgccccagt

SEQ ID NO: 1311317 - DNA, 16 bp, Homo sapiens
gctctggactctaaag

SEQ ID NO: 1311318 - DNA, 11 bp, Homo sapiens
gctctgtgctg

SEQ ID NO: 1311319 - DNA, 22 bp, Homo sapiens
gctgcaggaatcaaaaattgaa

SEQ ID NO: 1311320 - DNA, 20 bp, Homo sapiens
gctggacgtctttctttttt

SEQ ID NO: 1311321 - DNA, 23 bp, Homo sapiens
gcttaaatatagttcctaagaag

SEQ ID NO: 1311322 - DNA, 23 bp, Homo sapiens
gcttcagtacttgtgaaacacag

SEQ ID NO: 1311323 - DNA, 13 bp, Homo sapiens
gcttccctcctgc

SEQ ID NO: 1311324 - DNA, 12 bp, Homo sapiens
gcttctaataaa

SEQ ID NO: 1311325 - DNA, 13 bp, Homo sapiens
gcttgtaggagct

SEQ ID NO: 1311326 - DNA, 22 bp, Homo sapiens
gcttgtaggagctgaggtttca

SEQ ID NO: 1311327 - DNA, 18 bp, Homo sapiens
gcttgtggggacccaggc

SEQ ID NO: 1311328 - DNA, 12 bp, Homo sapiens
ggaaaaatgttt

SEQ ID NO: 1311329 - DNA, 14 bp, Homo sapiens
ggaaaaatgtttgt

SEQ ID NO: 1311330 - DNA, 20 bp, Homo sapiens
ggaaatcctagtttcctctc

SEQ ID NO: 1311331 - DNA, 22 bp, Homo sapiens
ggaaatcctagtttcctctcct

SEQ ID NO: 1311332 - DNA, 16 bp, Homo sapiens
ggaacaaaaaaaccac

SEQ ID NO: 1311333 - DNA, 16 bp, Homo sapiens
cttatgtagatatttg

SEQ ID NO: 1311334 - DNA, 19 bp, Homo sapiens
cttatgtagatatttggct

SEQ ID NO: 1311335 - DNA, 17 bp, Homo sapiens
cttcaaattgtcttttg

SEQ ID NO: 1311336 - DNA, 20 bp, Homo sapiens
cttcagaattccatatcttg

SEQ ID NO: 1311337 - DNA, 13 bp, Homo sapiens
cttccgaccctct

SEQ ID NO: 1311338 - DNA, 17 bp, Homo sapiens
cttccgaccctctggga

SEQ ID NO: 1311339 - DNA, 22 bp, Homo sapiens
cttccgaccctctgggaacctc

SEQ ID NO: 1311340 - DNA, 17 bp, Homo sapiens
cttcgacttttcttaac

SEQ ID NO: 1311341 - DNA, 21 bp, Homo sapiens
cttcgtatcccgagtctggga

SEQ ID NO: 1311342 - DNA, 17 bp, Homo sapiens
cttctaataaattatac

SEQ ID NO: 1311343 - DNA, 13 bp, Homo sapiens
cttctcccagaat

SEQ ID NO: 1311344 - DNA, 16 bp, Homo sapiens
cttgcagtcatcagaa

SEQ ID NO: 1311345 - DNA, 17 bp, Homo sapiens
cttgcagtcatcagaag

SEQ ID NO: 1311346 - DNA, 20 bp, Homo sapiens
cttgcgaatccaagctccct

SEQ ID NO: 1311347 - DNA, 16 bp, Homo sapiens
cttgtagctgtaaaac

SEQ ID NO: 1311348 - DNA, 22 bp, Homo sapiens
cttgtagctgtaaaacgctgtc

SEQ ID NO: 1311349 - DNA, 21 bp, Homo sapiens
cttgtcactgacacaaaggaa

SEQ ID NO: 1311350 - DNA, 17 bp, Homo sapiens
cttgtgaaacacagctg

SEQ ID NO: 1311351 - DNA, 18 bp, Homo sapiens
cttgtggggacccaggct

SEQ ID NO: 1311352 - DNA, 15 bp, Homo sapiens
ctttaaaggcccagc

SEQ ID NO: 1311353 - DNA, 18 bp, Homo sapiens
ctttaaaggcccagcccc

SEQ ID NO: 1311354 - DNA, 15 bp, Homo sapiens
ctttaagcagagaag

SEQ ID NO: 1311355 - DNA, 19 bp, Homo sapiens
ctttgctgatttcccctct

SEQ ID NO: 1311356 - DNA, 17 bp, Homo sapiens
ctttggaaaaatgtttg

SEQ ID NO: 1311357 - DNA, 18 bp, Homo sapiens
ctttggaaaaatgtttgt

SEQ ID NO: 1311358 - DNA, 16 bp, Homo sapiens
ctttggtttctgtctg

SEQ ID NO: 1311359 - DNA, 11 bp, Homo sapiens
cttttctgctg

SEQ ID NO: 1311360 - DNA, 17 bp, Homo sapiens
cttttgtcatgtggcta

SEQ ID NO: 1311361 - DNA, 15 bp, Homo sapiens
ctttttctgttgtaa

SEQ ID NO: 1311362 - DNA, 14 bp, Homo sapiens
gaaaaatgtttgtc

SEQ ID NO: 1311363 - DNA, 14 bp, Homo sapiens
gaaaatgaaaaaca

SEQ ID NO: 1311364 - DNA, 12 bp, Homo sapiens
gaaacacagctg

SEQ ID NO: 1311365 - DNA, 13 bp, Homo sapiens
gaaacccaagctc

SEQ ID NO: 1311366 - DNA, 11 bp, Homo sapiens
gaaagatatct

SEQ ID NO: 1311367 - DNA, 16 bp, Homo sapiens
gaaagtagaacttact

SEQ ID NO: 1311368 - DNA, 22 bp, Homo sapiens
gaaatcctagtttcctctcctt

SEQ ID NO: 1311369 - DNA, 13 bp, Homo sapiens
gttggactaaatg

SEQ ID NO: 1311370 - DNA, 13 bp, Homo sapiens
gttgtaaaaagaa

SEQ ID NO: 1311371 - DNA, 21 bp, Homo sapiens
gtttaatgtgaacttgtagct

SEQ ID NO: 1311372 - DNA, 21 bp, Homo sapiens
gtttcacccttaacccaagga

SEQ ID NO: 1311373 - DNA, 19 bp, Homo sapiens
gtttgtctcagttggaaat

SEQ ID NO: 1311374 - DNA, 17 bp, Homo sapiens
gttttgtacatagattt

SEQ ID NO: 1311375 - DNA, 17 bp, Homo sapiens
gtttttagtaatctgta

SEQ ID NO: 1311376 - DNA, 20 bp, Homo sapiens
gtttttagtaatctgtacat

SEQ ID NO: 1311377 - DNA, 11 bp, Homo sapiens
taaaaaaagaa

SEQ ID NO: 1311378 - DNA, 12 bp, Homo sapiens
taaaaaaagaaa

SEQ ID NO: 1311379 - DNA, 14 bp, Homo sapiens
taaaaaaagaaaat

SEQ ID NO: 1311380 - DNA, 19 bp, Homo sapiens
taaaaagattctttttctg

SEQ ID NO: 1311381 - DNA, 20 bp, Homo sapiens
taaaacattatagattttca

SEQ ID NO: 1311382 - DNA, 12 bp, Homo sapiens
taaaatttgtgg

SEQ ID NO: 1311383 - DNA, 14 bp, Homo sapiens
taaagaccaaactt

SEQ ID NO: 1311384 - DNA, 15 bp, Homo sapiens
taaaggcccagcccc

SEQ ID NO: 1311385 - DNA, 17 bp, Homo sapiens
taaaggcccagccccta

SEQ ID NO: 1311386 - DNA, 12 bp, Homo sapiens
taaataccagga

SEQ ID NO: 1311387 - DNA, 22 bp, Homo sapiens
taaatgtttgacacaattggaa

SEQ ID NO: 1311388 - DNA, 15 bp, Homo sapiens
taaattatacaaatt

SEQ ID NO: 1311389 - DNA, 16 bp, Homo sapiens
taacactgtaatatct

SEQ ID NO: 1311390 - DNA, 17 bp, Homo sapiens
taacactgtaatatctt

SEQ ID NO: 1311391 - DNA, 14 bp, Homo sapiens
taacccacttgtca

SEQ ID NO: 1311392 - DNA, 19 bp, Homo sapiens
taagaagcttctaataaat

SEQ ID NO: 1311393 - DNA, 12 bp, Homo sapiens
taatatctttaa

SEQ ID NO: 1311394 - DNA, 23 bp, Homo sapiens
taatctgtacattttgttgtaaa

SEQ ID NO: 1311395 - DNA, 18 bp, Homo sapiens
taatgtgaacttgtagct

SEQ ID NO: 1311396 - DNA, 22 bp, Homo sapiens
taatgtgaacttgtagctgtaa

SEQ ID NO: 1311397 - DNA, 22 bp, Homo sapiens
taattctattgaaagtttttaa

SEQ ID NO: 1311398 - DNA, 19 bp, Homo sapiens
tacaaattaaaaagattct

SEQ ID NO: 1311399 - DNA, 13 bp, Homo sapiens
tacattttgttgt

SEQ ID NO: 1311400 - DNA, 16 bp, Homo sapiens
tacattttgttgtaaa

SEQ ID NO: 1311401 - DNA, 18 bp, Homo sapiens
tacattttgttgtaaaaa

SEQ ID NO: 1311402 - DNA, 14 bp, Homo sapiens
taccaggatttttt

SEQ ID NO: 1311403 - DNA, 20 bp, Homo sapiens
tactcagggctcctcccagc

SEQ ID NO: 1311404 - DNA, 21 bp, Homo sapiens
tactcagggctcctcccagct

SEQ ID NO: 1311405 - DNA, 13 bp, Homo sapiens
tactgtctgtagt

SEQ ID NO: 1311406 - DNA, 14 bp, Homo sapiens
tactgtctgtagtg

SEQ ID NO: 1311407 - DNA, 19 bp, Homo sapiens
tacttgtgaaacacagctg

SEQ ID NO: 1311408 - DNA, 20 bp, Homo sapiens
tacttgtgaaacacagctgt

SEQ ID NO: 1311409 - DNA, 18 bp, Homo sapiens
tactttggtttctgtctg

SEQ ID NO: 1311410 - DNA, 15 bp, Homo sapiens
tagaaacccaagctc

SEQ ID NO: 1311411 - DNA, 18 bp, Homo sapiens
tagaaacccaagctcctc

SEQ ID NO: 1311412 - DNA, 21 bp, Homo sapiens
tagaaacccaagctcctcctc

SEQ ID NO: 1311413 - DNA, 22 bp, Homo sapiens
tagaatataggtctcttctccc

SEQ ID NO: 1311414 - DNA, 13 bp, Homo sapiens
tagaccaaggaac

SEQ ID NO: 1311415 - DNA, 14 bp, Homo sapiens
tagatatttggctt

SEQ ID NO: 1311416 - DNA, 14 bp, Homo sapiens
tagattttcatgtt

SEQ ID NO: 1311417 - DNA, 22 bp, Homo sapiens
tagcatattcttttctgcaaaa

SEQ ID NO: 1311418 - DNA, 17 bp, Homo sapiens
tagcccagcgctctgcc

SEQ ID NO: 1311419 - DNA, 18 bp, Homo sapiens
tagcccagcgctctgcct

SEQ ID NO: 1311420 - DNA, 12 bp, Homo sapiens
tagctgtaaaac

SEQ ID NO: 1311421 - DNA, 15 bp, Homo sapiens
taggaccactcagcc

SEQ ID NO: 1311422 - DNA, 17 bp, Homo sapiens
tttaatatttattgaat

SEQ ID NO: 1311423 - DNA, 13 bp, Homo sapiens
tttaatgtgaact

SEQ ID NO: 1311424 - DNA, 15 bp, Homo sapiens
tttaatgtgaacttg

SEQ ID NO: 1311425 - DNA, 17 bp, Homo sapiens
tttagtaatctgtacat

SEQ ID NO: 1311426 - DNA, 19 bp, Homo sapiens
tttagtaatctgtacattt

SEQ ID NO: 1311427 - DNA, 12 bp, Homo sapiens
tttcctctgagc

SEQ ID NO: 1311428 - DNA, 22 bp, Homo sapiens
tttcctctgagctgttatcttg

SEQ ID NO: 1311429 - DNA, 19 bp, Homo sapiens
tttctcttcagtgtgttga

SEQ ID NO: 1311430 - DNA, 21 bp, Homo sapiens
tttctcttcagtgtgttgact

SEQ ID NO: 1311431 - DNA, 14 bp, Homo sapiens
tttctgcaaaatag

SEQ ID NO: 1311432 - DNA, 14 bp, Homo sapiens
tttctgttgtaact

SEQ ID NO: 1311433 - DNA, 16 bp, Homo sapiens
tttctgttgtaactta

SEQ ID NO: 1311434 - DNA, 17 bp, Homo sapiens
tttctgttgtaacttat

SEQ ID NO: 1311435 - DNA, 13 bp, Homo sapiens
tttgctaattaaa

SEQ ID NO: 1311436 - DNA, 12 bp, Homo sapiens
tttggtatttgc

SEQ ID NO: 1311437 - DNA, 12 bp, Homo sapiens
tttgtcctcaaa

SEQ ID NO: 1311438 - DNA, 15 bp, Homo sapiens
tttgttgtaaaaaga

SEQ ID NO: 1311439 - DNA, 17 bp, Homo sapiens
tttgtttaatgtgaact

SEQ ID NO: 1311440 - DNA, 15 bp, Homo sapiens
ttttagtaatctgta

SEQ ID NO: 1311441 - DNA, 19 bp, Homo sapiens
ttttagtaatctgtacatt

SEQ ID NO: 1311442 - DNA, 13 bp, Homo sapiens
ttttctccagctc

SEQ ID NO: 1311443 - DNA, 14 bp, Homo sapiens
ttttgttgattaaa

SEQ ID NO: 1311444 - DNA, 15 bp, Homo sapiens
tttttagtaatctgt

SEQ ID NO: 1311445 - DNA, 20 bp, Homo sapiens
tttttagtaatctgtacatt

SEQ ID NO: 1311446 - DNA, 21 bp, Homo sapiens
agcctatgagcatcctgagcc

SEQ ID NO: 1311447 - DNA, 16 bp, Homo sapiens
agcctgatctcttcct

SEQ ID NO: 1311448 - DNA, 12 bp, Homo sapiens
agcgctctgcct

SEQ ID NO: 1311449 - DNA, 20 bp, Homo sapiens
agctcctcctcggaaccgct

SEQ ID NO: 1311450 - DNA, 17 bp, Homo sapiens
agctgcaggaatcaaaa

SEQ ID NO: 1311451 - DNA, 14 bp, Homo sapiens
agctgttatcttgt

SEQ ID NO: 1311452 - DNA, 18 bp, Homo sapiens
agcttctaataaattata

SEQ ID NO: 1311453 - DNA, 17 bp, Homo sapiens
aggaaagagtcttcaac

SEQ ID NO: 1311454 - DNA, 15 bp, Homo sapiens
aggaacaaaaaaacc

SEQ ID NO: 1311455 - DNA, 18 bp, Homo sapiens
aggaacaaaaaaaccaca

SEQ ID NO: 1311456 - DNA, 17 bp, Homo sapiens
aggaatcaaaaattgaa

SEQ ID NO: 1311457 - DNA, 15 bp, Homo sapiens
aggaccactcagccc

SEQ ID NO: 1311458 - DNA, 13 bp, Homo sapiens
aggacctcccttc

SEQ ID NO: 1311459 - DNA, 16 bp, Homo sapiens
aggacctcccttccga

SEQ ID NO: 1311460 - DNA, 21 bp, Homo sapiens
aggactcgcttgtaaatacca

SEQ ID NO: 1311461 - DNA, 16 bp, Homo sapiens
aggagcacaggtccca

SEQ ID NO: 1311462 - DNA, 17 bp, Homo sapiens
aggagcacaggtcccac

SEQ ID NO: 1311463 - DNA, 23 bp, Homo sapiens
aggagtgggtgacaagagcctga

SEQ ID NO: 1311464 - DNA, 17 bp, Homo sapiens
aggccaaactgctggac

SEQ ID NO: 1311465 - DNA, 15 bp, Homo sapiens
aggcccagcccctag

SEQ ID NO: 1311466 - DNA, 17 bp, Homo sapiens
aggcctcacctctaccc

SEQ ID NO: 1311467 - DNA, 19 bp, Homo sapiens
agggaggacgggagctggg

SEQ ID NO: 1311468 - DNA, 14 bp, Homo sapiens
agggctcctcccag

SEQ ID NO: 1311469 - DNA, 15 bp, Homo sapiens
agggctcctcccagc

SEQ ID NO: 1311470 - DNA, 17 bp, Homo sapiens
agggctcctcccagctt

SEQ ID NO: 1311471 - DNA, 12 bp, Homo sapiens
agggctctgccc

SEQ ID NO: 1311472 - DNA, 15 bp, Homo sapiens
aggggacaggcctca

SEQ ID NO: 1311473 - DNA, 17 bp, Homo sapiens
aggggacaggcctcacc

SEQ ID NO: 1311474 - DNA, 18 bp, Homo sapiens
aggggacaggcctcacct

SEQ ID NO: 1311475 - DNA, 19 bp, Homo sapiens
agggttgtgattttgtctg

SEQ ID NO: 1311476 - DNA, 16 bp, Homo sapiens
aggtccagcccatctc

SEQ ID NO: 1311477 - DNA, 14 bp, Homo sapiens
aggtcccacctcca

SEQ ID NO: 1311478 - DNA, 16 bp, Homo sapiens
aggtcccacctccagc

SEQ ID NO: 1311479 - DNA, 17 bp, Homo sapiens
aggtcccacctccagcc

SEQ ID NO: 1311480 - DNA, 18 bp, Homo sapiens
aggtcccacctccagccc

SEQ ID NO: 1311481 - DNA, 18 bp, Homo sapiens
aggtctcttctcccagaa

SEQ ID NO: 1311482 - DNA, 19 bp, Homo sapiens
aggtctcttctcccagaat

SEQ ID NO: 1311483 - DNA, 13 bp, Homo sapiens
agtaatctgtaca

SEQ ID NO: 1311484 - DNA, 22 bp, Homo sapiens
agtacttgtgaaacacagctgt

SEQ ID NO: 1311485 - DNA, 23 bp, Homo sapiens
agtacttgtgaaacacagctgtt

SEQ ID NO: 1311486 - DNA, 22 bp, Homo sapiens
agtatctcatcaacaaagaaat

SEQ ID NO: 1311487 - DNA, 19 bp, Homo sapiens
agtcccccaactctgagcc

SEQ ID NO: 1311488 - DNA, 13 bp, Homo sapiens
agtcctgctccag

SEQ ID NO: 1311489 - DNA, 14 bp, Homo sapiens
agtctgggacacaa

SEQ ID NO: 1311490 - DNA, 20 bp, Homo sapiens
agtctttaaaggcccagccc

SEQ ID NO: 1311491 - DNA, 17 bp, Homo sapiens
agtctttttctgttgta

SEQ ID NO: 1311492 - DNA, 18 bp, Homo sapiens
agtctttttctgttgtaa

SEQ ID NO: 1311493 - DNA, 20 bp, Homo sapiens
agtctttttctgttgtaact

SEQ ID NO: 1311494 - DNA, 21 bp, Homo sapiens
agtctttttctgttgtaactt

SEQ ID NO: 1311495 - DNA, 13 bp, Homo sapiens
agtgcacagctgt

SEQ ID NO: 1311496 - DNA, 14 bp, Homo sapiens
agtgcacagctgtc

SEQ ID NO: 1311497 - DNA, 15 bp, Homo sapiens
agtgcacagctgtcc

SEQ ID NO: 1311498 - DNA, 17 bp, Homo sapiens
agtgtcctataattcta

SEQ ID NO: 1311499 - DNA, 14 bp, Homo sapiens
agttggactaaatg

SEQ ID NO: 1311500 - DNA, 15 bp, Homo sapiens
agtttggtatttgcg

SEQ ID NO: 1311501 - DNA, 18 bp, Homo sapiens
agtttttagtaatctgta

SEQ ID NO: 1311502 - DNA, 18 bp, Homo sapiens
ataaaaaatttattatgt

SEQ ID NO: 1311503 - DNA, 22 bp, Homo sapiens
ataacttcagtcctgctccaga

SEQ ID NO: 1311504 - DNA, 21 bp, Homo sapiens
ataattctattgaaagttttt

SEQ ID NO: 1311505 - DNA, 17 bp, Homo sapiens
atacaaattaaaaagat

SEQ ID NO: 1311506 - DNA, 14 bp, Homo sapiens
ataggtctcttctc

SEQ ID NO: 1311507 - DNA, 15 bp, Homo sapiens
ataggtctcttctcc

SEQ ID NO: 1311508 - DNA, 20 bp, Homo sapiens
ataggtctcttctcccagaa

SEQ ID NO: 1311509 - DNA, 21 bp, Homo sapiens
atagttcctaagaagcttcta

SEQ ID NO: 1311510 - DNA, 21 bp, Homo sapiens
atataggtctcttctcccaga

SEQ ID NO: 1311511 - DNA, 22 bp, Homo sapiens
atatagttcctaagaagcttct

SEQ ID NO: 1311512 - DNA, 11 bp, Homo sapiens
atatctgaaaa

SEQ ID NO: 1311513 - DNA, 18 bp, Homo sapiens
atatctgtggtcttcaaa

SEQ ID NO: 1311514 - DNA, 13 bp, Homo sapiens
atattatttggca

SEQ ID NO: 1311515 - DNA, 21 bp, Homo sapiens
atattcttttctgcaaaatag

SEQ ID NO: 1311516 - DNA, 15 bp, Homo sapiens
atcaacaaagaaata

SEQ ID NO: 1311517 - DNA, 23 bp, Homo sapiens
atcaatgttcacgcaacttgaaa

SEQ ID NO: 1311518 - DNA, 14 bp, Homo sapiens
atcagagcaggacc

SEQ ID NO: 1311519 - DNA, 14 bp, Homo sapiens
atccaagctccctg

SEQ ID NO: 1311520 - DNA, 20 bp, Homo sapiens
atccagagggttgtgatttt

SEQ ID NO: 1311521 - DNA, 13 bp, Homo sapiens
atcccgagtctgg

SEQ ID NO: 1311522 - DNA, 18 bp, Homo sapiens
atcctagtttcctctcct

SEQ ID NO: 1311523 - DNA, 21 bp, Homo sapiens
atcctgccttcatggaactca

SEQ ID NO: 1311524 - DNA, 16 bp, Homo sapiens
atcctgttaacactgt

SEQ ID NO: 1311525 - DNA, 21 bp, Homo sapiens
atcctgttaacactgtaatat

SEQ ID NO: 1311526 - DNA, 13 bp, Homo sapiens
atctatgactgtg

SEQ ID NO: 1311527 - DNA, 16 bp, Homo sapiens
atctcatcaacaaaga

SEQ ID NO: 1311528 - DNA, 16 bp, Homo sapiens
atctgtacattttgtt

SEQ ID NO: 1311529 - DNA, 21 bp, Homo sapiens
atctgtacattttgttgtaaa

SEQ ID NO: 1311530 - DNA, 20 bp, Homo sapiens
atctgtgtatattatttggc

SEQ ID NO: 1311531 - DNA, 22 bp, Homo sapiens
atcttgcgaatccaagctccct

SEQ ID NO: 1311532 - DNA, 15 bp, Homo sapiens
atcttgtgtatggat

SEQ ID NO: 1311533 - DNA, 17 bp, Homo sapiens
atctttaagcagagaag

SEQ ID NO: 1311534 - DNA, 13 bp, Homo sapiens
atgaaaaacaacc

SEQ ID NO: 1311535 - DNA, 22 bp, Homo sapiens
atgactgtgctactgtctttgg

SEQ ID NO: 1311536 - DNA, 16 bp, Homo sapiens
ttcacgcaacttgaaa

SEQ ID NO: 1311537 - DNA, 12 bp, Homo sapiens
ttcagtcctgct

SEQ ID NO: 1311538 - DNA, 14 bp, Homo sapiens
ttcagttccaagaa

SEQ ID NO: 1311539 - DNA, 14 bp, Homo sapiens
ttcctctgagctgt

SEQ ID NO: 1311540 - DNA, 15 bp, Homo sapiens
ttcctctgagctgtt

SEQ ID NO: 1311541 - DNA, 23 bp, Homo sapiens
ttcctgacgaaactggccccgga

SEQ ID NO: 1311542 - DNA, 13 bp, Homo sapiens
ttctccagctcag

SEQ ID NO: 1311543 - DNA, 19 bp, Homo sapiens
ttctccagctcagaaccca

SEQ ID NO: 1311544 - DNA, 20 bp, Homo sapiens
ttctcttcagtgtgttgact

SEQ ID NO: 1311545 - DNA, 13 bp, Homo sapiens
ttctgcccccagc

SEQ ID NO: 1311546 - DNA, 19 bp, Homo sapiens
ttcttgcagtcatcagaag

SEQ ID NO: 1311547 - DNA, 14 bp, Homo sapiens
ttgaaattatatct

SEQ ID NO: 1311548 - DNA, 17 bp, Homo sapiens
ttgaaattatatctgtg

SEQ ID NO: 1311549 - DNA, 20 bp, Homo sapiens
ttgacaaatctgtgtatatt

SEQ ID NO: 1311550 - DNA, 23 bp, Homo sapiens
ttgacaaatctgtgtatattatt

SEQ ID NO: 1311551 - DNA, 16 bp, Homo sapiens
ttgacttctatcctgt

SEQ ID NO: 1311552 - DNA, 19 bp, Homo sapiens
ttgacttctatcctgttaa

SEQ ID NO: 1311553 - DNA, 17 bp, Homo sapiens
ttgcagtcatcagaagt

SEQ ID NO: 1311554 - DNA, 23 bp, Homo sapiens
ttggactaaatgcctagttttta

SEQ ID NO: 1311555 - DNA, 12 bp, Homo sapiens
ttgtaaaaagaa

SEQ ID NO: 1311556 - DNA, 13 bp, Homo sapiens
ttgtaaaaagaaa

SEQ ID NO: 1311557 - DNA, 15 bp, Homo sapiens
ttgtaaataccagga

SEQ ID NO: 1311558 - DNA, 13 bp, Homo sapiens
ttgtagctgtaaa

SEQ ID NO: 1311559 - DNA, 15 bp, Homo sapiens
ttgtctcagttggaa

SEQ ID NO: 1311560 - DNA, 16 bp, Homo sapiens
ttgtgaaacacagctg

SEQ ID NO: 1311561 - DNA, 17 bp, Homo sapiens
ttgtgaaacacagctgt

SEQ ID NO: 1311562 - DNA, 18 bp, Homo sapiens
ttgtgtatggatatgtgt

SEQ ID NO: 1311563 - DNA, 22 bp, Homo sapiens
ttgtgtatggatatgtgtaaat

SEQ ID NO: 1311564 - DNA, 19 bp, Homo sapiens
tttaaaggcccagccccta

SEQ ID NO: 1311565 - DNA, 20 bp, Homo sapiens
tttaatgtgaacttgtagct

SEQ ID NO: 1311566 - DNA, 21 bp, Homo sapiens
tttaatgtgaacttgtagctg

SEQ ID NO: 1311567 - DNA, 20 bp, Homo sapiens
tttaatttctgtcagaatgc

SEQ ID NO: 1311568 - DNA, 14 bp, Homo sapiens
tttagtaatctgta

SEQ ID NO: 1311569 - DNA, 18 bp, Homo sapiens
tttatgggcattgacaaa

SEQ ID NO: 1311570 - DNA, 18 bp, Homo sapiens
tttattcattagctgtga

SEQ ID NO: 1311571 - DNA, 21 bp, Homo sapiens
tttcacccttaacccaaggag

SEQ ID NO: 1311572 - DNA, 15 bp, Homo sapiens
tttctgtcagaatgc

SEQ ID NO: 1311573 - DNA, 16 bp, Homo sapiens
tttctgtcagaatgct

SEQ ID NO: 1311574 - DNA, 21 bp, Homo sapiens
tttgctgatttcccctcttcc

SEQ ID NO: 1311575 - DNA, 15 bp, Homo sapiens
tttggaaaaatgttt

SEQ ID NO: 1311576 - DNA, 14 bp, Homo sapiens
tttggtgattcaaa

SEQ ID NO: 1311577 - DNA, 16 bp, Homo sapiens
tttgtacatagattta

SEQ ID NO: 1311578 - DNA, 18 bp, Homo sapiens
tttgtctcagttggaaat

SEQ ID NO: 1311579 - DNA, 14 bp, Homo sapiens
tttgtggagtactg

SEQ ID NO: 1311580 - DNA, 15 bp, Homo sapiens
tttgttactgtctgt

SEQ ID NO: 1311581 - DNA, 15 bp, Homo sapiens
ttttaaaaaaagaaa

SEQ ID NO: 1311582 - DNA, 18 bp, Homo sapiens
ttttaaaaaaagaaaatg

SEQ ID NO: 1311583 - DNA, 14 bp, Homo sapiens
ttttagtaatctgt

SEQ ID NO: 1311584 - DNA, 22 bp, Homo sapiens
tcctcccagcttgtaggagctg

SEQ ID NO: 1311585 - DNA, 18 bp, Homo sapiens
tcctgacgaaactggccc

SEQ ID NO: 1311586 - DNA, 12 bp, Homo sapiens
tcctgctccaga

SEQ ID NO: 1311587 - DNA, 20 bp, Homo sapiens
tcctgttaacactgtaatat

SEQ ID NO: 1311588 - DNA, 23 bp, Homo sapiens
tccttgataaaaaatttattatg

SEQ ID NO: 1311589 - DNA, 12 bp, Homo sapiens
tcgacttttctt

SEQ ID NO: 1311590 - DNA, 14 bp, Homo sapiens
tcgacttttcttaa

SEQ ID NO: 1311591 - DNA, 17 bp, Homo sapiens
tcgcttgtaaataccag

SEQ ID NO: 1311592 - DNA, 17 bp, Homo sapiens
tcggaaccgctcaccta

SEQ ID NO: 1311593 - DNA, 19 bp, Homo sapiens
tcggaaccgctcacctaga

SEQ ID NO: 1311594 - DNA, 16 bp, Homo sapiens
tcggagcatcccggag

SEQ ID NO: 1311595 - DNA, 13 bp, Homo sapiens
tctaaagaccaaa

SEQ ID NO: 1311596 - DNA, 22 bp, Homo sapiens
tctacccaaaccctaggttccc

SEQ ID NO: 1311597 - DNA, 19 bp, Homo sapiens
tctatgactgtgtttaata

SEQ ID NO: 1311598 - DNA, 23 bp, Homo sapiens
tctccttcgtatcccgagtctgg

SEQ ID NO: 1311599 - DNA, 15 bp, Homo sapiens
tctcttcagtgtgtt

SEQ ID NO: 1311600 - DNA, 17 bp, Homo sapiens
tctcttcagtgtgttga

SEQ ID NO: 1311601 - DNA, 19 bp, Homo sapiens
tctcttcagtgtgttgact

SEQ ID NO: 1311602 - DNA, 14 bp, Homo sapiens
tctcttctcccaga

SEQ ID NO: 1311603 - DNA, 12 bp, Homo sapiens
tctgaaaactgg

SEQ ID NO: 1311604 - DNA, 19 bp, Homo sapiens
tctgagctgttatcttgtg

SEQ ID NO: 1311605 - DNA, 11 bp, Homo sapiens
tctgccccagt

SEQ ID NO: 1311606 - DNA, 18 bp, Homo sapiens
tctgcccccagcccaaag

SEQ ID NO: 1311607 - DNA, 19 bp, Homo sapiens
tctgcccccagcccaaagg

SEQ ID NO: 1311608 - DNA, 15 bp, Homo sapiens
tctgggaacctccca

SEQ ID NO: 1311609 - DNA, 19 bp, Homo sapiens
tctgggaacctcccagagg

SEQ ID NO: 1311610 - DNA, 20 bp, Homo sapiens
tctgggaacctcccagaggt

SEQ ID NO: 1311611 - DNA, 20 bp, Homo sapiens
tctgggcacactctgccagc

SEQ ID NO: 1311612 - DNA, 21 bp, Homo sapiens
tctgtacattttgttgtaaaa

SEQ ID NO: 1311613 - DNA, 18 bp, Homo sapiens
tctgtcagaatgctattg

SEQ ID NO: 1311614 - DNA, 14 bp, Homo sapiens
tctgtgctgacatg

SEQ ID NO: 1311615 - DNA, 18 bp, Homo sapiens
tctgtgtatattatttgg

SEQ ID NO: 1311616 - DNA, 11 bp, Homo sapiens
tctgttgtaac

SEQ ID NO: 1311617 - DNA, 15 bp, Homo sapiens
tctgttgtaacttat

SEQ ID NO: 1311618 - DNA, 21 bp, Homo sapiens
tctgttgtaacttatgtagat

SEQ ID NO: 1311619 - DNA, 22 bp, Homo sapiens
tcttcagtgtgttgacttctat

SEQ ID NO: 1311620 - DNA, 23 bp, Homo sapiens
tcttcctgacgaaactggccccg

SEQ ID NO: 1311621 - DNA, 21 bp, Homo sapiens
tcttcctgttttgtacataga

SEQ ID NO: 1311622 - DNA, 15 bp, Homo sapiens
tcttgtgtatggata

SEQ ID NO: 1311623 - DNA, 14 bp, Homo sapiens
tctttaaaggccca

SEQ ID NO: 1311624 - DNA, 16 bp, Homo sapiens
atgtgtaaatgttatg

SEQ ID NO: 1311625 - DNA, 17 bp, Homo sapiens
atgttctgcccccagcc

SEQ ID NO: 1311626 - DNA, 20 bp, Homo sapiens
atgttctgcccccagcccaa

SEQ ID NO: 1311627 - DNA, 13 bp, Homo sapiens
attaaaaagttaa

SEQ ID NO: 1311628 - DNA, 17 bp, Homo sapiens
attaaaaagttaatctt

SEQ ID NO: 1311629 - DNA, 18 bp, Homo sapiens
attatacaaattaaaaag

SEQ ID NO: 1311630 - DNA, 19 bp, Homo sapiens
attatacaaattaaaaaga

SEQ ID NO: 1311631 - DNA, 15 bp, Homo sapiens
attatgtccattatt

SEQ ID NO: 1311632 - DNA, 15 bp, Homo sapiens
attcaagaaagatat

SEQ ID NO: 1311633 - DNA, 16 bp, Homo sapiens
attcattaaatgtttg

SEQ ID NO: 1311634 - DNA, 22 bp, Homo sapiens
attccatatcttgcgaatccaa

SEQ ID NO: 1311635 - DNA, 13 bp, Homo sapiens
attctttttctga

SEQ ID NO: 1311636 - DNA, 21 bp, Homo sapiens
attgaagagagatatatctga

SEQ ID NO: 1311637 - DNA, 15 bp, Homo sapiens
attgaattattttgt

SEQ ID NO: 1311638 - DNA, 19 bp, Homo sapiens
attgaattattttgttact

SEQ ID NO: 1311639 - DNA, 13 bp, Homo sapiens
attgacaaatctg

SEQ ID NO: 1311640 - DNA, 15 bp, Homo sapiens
attgacaaatctgtg

SEQ ID NO: 1311641 - DNA, 17 bp, Homo sapiens
attgacaaatctgtgta

SEQ ID NO: 1311642 - DNA, 21 bp, Homo sapiens
attggagagggctctgtgctg

SEQ ID NO: 1311643 - DNA, 15 bp, Homo sapiens
atttattgaattatt

SEQ ID NO: 1311644 - DNA, 20 bp, Homo sapiens
atttattgaattattttgtt

SEQ ID NO: 1311645 - DNA, 20 bp, Homo sapiens
atttatttttcagttccaag

SEQ ID NO: 1311646 - DNA, 23 bp, Homo sapiens
atttatttttcagttccaagaaa

SEQ ID NO: 1311647 - DNA, 23 bp, Homo sapiens
atttccgcacttcagaattccat

SEQ ID NO: 1311648 - DNA, 13 bp, Homo sapiens
atttctgtcagaa

SEQ ID NO: 1311649 - DNA, 15 bp, Homo sapiens
atttggcagtttggt

SEQ ID NO: 1311650 - DNA, 12 bp, Homo sapiens
attttgttactg

SEQ ID NO: 1311651 - DNA, 18 bp, Homo sapiens
attttgttactgtctgta

SEQ ID NO: 1311652 - DNA, 18 bp, Homo sapiens
atttttcagttccaagaa

SEQ ID NO: 1311653 - DNA, 13 bp, Homo sapiens
caaaaaaaccaca

SEQ ID NO: 1311654 - DNA, 19 bp, Homo sapiens
caaaagttggactaaatgc

SEQ ID NO: 1311655 - DNA, 21 bp, Homo sapiens
caaaagttggactaaatgcct

SEQ ID NO: 1311656 - DNA, 21 bp, Homo sapiens
caaacccacgattttctccag

SEQ ID NO: 1311657 - DNA, 22 bp, Homo sapiens
caaacccacgattttctccagc

SEQ ID NO: 1311658 - DNA, 24 bp, Homo sapiens
caaacccacgattttctccagctc

SEQ ID NO: 1311659 - DNA, 21 bp, Homo sapiens
caaaccctaggttcccggtcc

SEQ ID NO: 1311660 - DNA, 20 bp, Homo sapiens
caaagaggactcgcttgtaa

SEQ ID NO: 1311661 - DNA, 19 bp, Homo sapiens
caaaggaagtgccccctcc

SEQ ID NO: 1311662 - DNA, 14 bp, Homo sapiens
caaaggccaaactg

SEQ ID NO: 1311663 - DNA, 19 bp, Homo sapiens
caaaggccaaactgctgga

SEQ ID NO: 1311664 - DNA, 21 bp, Homo sapiens
caaaggggacaggcctcacct

SEQ ID NO: 1311665 - DNA, 19 bp, Homo sapiens
caaattaaaaagattcttt

SEQ ID NO: 1311666 - DNA, 13 bp, Homo sapiens
caacaaagaaata

SEQ ID NO: 1311667 - DNA, 14 bp, Homo sapiens
caacaaagaaatat

SEQ ID NO: 1311668 - DNA, 17 bp, Homo sapiens
caacataacccacttgt

SEQ ID NO: 1311669 - DNA, 15 bp, Homo sapiens
caacgttactcaggg

SEQ ID NO: 1311670 - DNA, 16 bp, Homo sapiens
caacgttactcagggc

SEQ ID NO: 1311671 - DNA, 17 bp, Homo sapiens
caacgttactcagggct

SEQ ID NO: 1311672 - DNA, 23 bp, Homo sapiens
caacttgaaattatatctgtggt

SEQ ID NO: 1311673 - DNA, 14 bp, Homo sapiens
caagagcctgatct

SEQ ID NO: 1311674 - DNA, 18 bp, Homo sapiens
caagcagagtgcacagct

SEQ ID NO: 1311675 - DNA, 19 bp, Homo sapiens
caagcagagtgcacagctg

SEQ ID NO: 1311676 - DNA, 16 bp, Homo sapiens
caagcgcatccaatct

SEQ ID NO: 1311677 - DNA, 23 bp, Homo sapiens
caagcgcatccaatctcaaggaa

SEQ ID NO: 1311678 - DNA, 19 bp, Homo sapiens
caagctccctgccccaaat

SEQ ID NO: 1311679 - DNA, 18 bp, Homo sapiens
caaggagcacaggtccca

SEQ ID NO: 1311680 - DNA, 14 bp, Homo sapiens
caagggcagaaagt

SEQ ID NO: 1311681 - DNA, 16 bp, Homo sapiens
caatggaaacctcacg

SEQ ID NO: 1311682 - DNA, 23 bp, Homo sapiens
cacaaaactccgcccccagccta

SEQ ID NO: 1311683 - DNA, 17 bp, Homo sapiens
cacaaaggccaaactgc

SEQ ID NO: 1311684 - DNA, 18 bp, Homo sapiens
cacaaaggccaaactgct

SEQ ID NO: 1311685 - DNA, 21 bp, Homo sapiens
cacaaaggccaaactgctgga

SEQ ID NO: 1311686 - DNA, 23 bp, Homo sapiens
cacaagcagagtgcacagctgtc

SEQ ID NO: 1311687 - DNA, 14 bp, Homo sapiens
cacacagaccacca

SEQ ID NO: 1311688 - DNA, 19 bp, Homo sapiens
cacactctgccagcaaaga

SEQ ID NO: 1311689 - DNA, 12 bp, Homo sapiens
cacattttttat

SEQ ID NO: 1311690 - DNA, 23 bp, Homo sapiens
cacccttaacccaaggagcacag

SEQ ID NO: 1311691 - DNA, 12 bp, Homo sapiens
cacctccagccc

SEQ ID NO: 1311692 - DNA, 14 bp, Homo sapiens
cacctccagcccgg

SEQ ID NO: 1311693 - DNA, 18 bp, Homo sapiens
cacctccagcccgggagc

SEQ ID NO: 1311694 - DNA, 20 bp, Homo sapiens
cacctccagcccgggagcct

SEQ ID NO: 1311695 - DNA, 16 bp, Homo sapiens
cacctctacccaaacc

SEQ ID NO: 1311696 - DNA, 21 bp, Homo sapiens
cacgattttctccagctcaga

SEQ ID NO: 1311697 - DNA, 19 bp, Homo sapiens
cacgcgcttcgacttttct

SEQ ID NO: 1311698 - DNA, 11 bp, Homo sapiens
cactcagcccc

SEQ ID NO: 1311699 - DNA, 13 bp, Homo sapiens
cactcagccccta

SEQ ID NO: 1311700 - DNA, 16 bp, Homo sapiens
cactctgccagcaaag

SEQ ID NO: 1311701 - DNA, 17 bp, Homo sapiens
cactctgccagcaaaga

SEQ ID NO: 1311702 - DNA, 14 bp, Homo sapiens
cactgacacaaagg

SEQ ID NO: 1311703 - DNA, 15 bp, Homo sapiens
cactgacacaaagga

SEQ ID NO: 1311704 - DNA, 14 bp, Homo sapiens
cactgtaatatctt

SEQ ID NO: 1311705 - DNA, 12 bp, Homo sapiens
cagaacccaggg

SEQ ID NO: 1311706 - DNA, 21 bp, Homo sapiens
cagaacccagggctctgcccc

SEQ ID NO: 1311707 - DNA, 18 bp, Homo sapiens
cagaatcccagccggcca

SEQ ID NO: 1311708 - DNA, 18 bp, Homo sapiens
cagacacgccttcccctc

SEQ ID NO: 1311709 - DNA, 18 bp, Homo sapiens
cagagcaggacctccctt

SEQ ID NO: 1311710 - DNA, 19 bp, Homo sapiens
cagagcaggacctcccttc

SEQ ID NO: 1311711 - DNA, 17 bp, Homo sapiens
cagagggttgtgatttt

SEQ ID NO: 1311712 - DNA, 17 bp, Homo sapiens
cagaggtccagcccatc

SEQ ID NO: 1311713 - DNA, 15 bp, Homo sapiens
cagagtgcacagctg

SEQ ID NO: 1311714 - DNA, 17 bp, Homo sapiens
cagagtgcacagctgtc

SEQ ID NO: 1311715 - DNA, 18 bp, Homo sapiens
cagatgaaaccaggtcac

SEQ ID NO: 1311716 - DNA, 21 bp, Homo sapiens
cagcaaagaggactcgcttgt

SEQ ID NO: 1311717 - DNA, 12 bp, Homo sapiens
cagcccctagaa

SEQ ID NO: 1311718 - DNA, 13 bp, Homo sapiens
cagcccctagaaa

SEQ ID NO: 1311719 - DNA, 24 bp, Homo sapiens
cagcccctagaaacccaagctcct

SEQ ID NO: 1311720 - DNA, 20 bp, Homo sapiens
cagcccgggagcctaggacc

SEQ ID NO: 1311721 - DNA, 20 bp, Homo sapiens
cagccggccaatggaaacct

SEQ ID NO: 1311722 - DNA, 19 bp, Homo sapiens
cagctcagaacccagggct

SEQ ID NO: 1311723 - DNA, 16 bp, Homo sapiens
cagctgtctgtggctt

SEQ ID NO: 1311724 - DNA, 15 bp, Homo sapiens
cagcttgtaggagct

SEQ ID NO: 1311725 - DNA, 16 bp, Homo sapiens
cagcttgtaggagctg

SEQ ID NO: 1311726 - DNA, 19 bp, Homo sapiens
caggacctcccttccgacc

SEQ ID NO: 1311727 - DNA, 12 bp, Homo sapiens
caggcctcacct

SEQ ID NO: 1311728 - DNA, 12 bp, Homo sapiens
caggctccgccc

SEQ ID NO: 1311729 - DNA, 15 bp, Homo sapiens
cagggctcctcccag

SEQ ID NO: 1311730 - DNA, 15 bp, Homo sapiens
cagggctctgcccca

SEQ ID NO: 1311731 - DNA, 17 bp, Homo sapiens
caggtcccacctccagc

SEQ ID NO: 1311732 - DNA, 23 bp, Homo sapiens
cagtacttgtgaaacacagctgt

SEQ ID NO: 1311733 - DNA, 14 bp, Homo sapiens
cagtcctgctccag

SEQ ID NO: 1311734 - DNA, 15 bp, Homo sapiens
cagtcctgctccaga

SEQ ID NO: 1311735 - DNA, 17 bp, Homo sapiens
cagtctttaaaggccca

SEQ ID NO: 1311736 - DNA, 19 bp, Homo sapiens
cagtctttaaaggcccagc

SEQ ID NO: 1311737 - DNA, 20 bp, Homo sapiens
cagtctttaaaggcccagcc

SEQ ID NO: 1311738 - DNA, 23 bp, Homo sapiens
cagtctttaaaggcccagcccct

SEQ ID NO: 1311739 - DNA, 12 bp, Homo sapiens
cagtctttttct

SEQ ID NO: 1311740 - DNA, 18 bp, Homo sapiens
cagtctttttctgttgta

SEQ ID NO: 1311741 - DNA, 22 bp, Homo sapiens
catagatttatttttcagttcc

SEQ ID NO: 1311742 - DNA, 23 bp, Homo sapiens
catatcttgcgaatccaagctcc

SEQ ID NO: 1311743 - DNA, 20 bp, Homo sapiens
catattcttttctgcaaaat

SEQ ID NO: 1311744 - DNA, 18 bp, Homo sapiens
catcccggaggaaatctg

SEQ ID NO: 1311745 - DNA, 12 bp, Homo sapiens
catcctgagccc

SEQ ID NO: 1311746 - DNA, 16 bp, Homo sapiens
catcctgagccccgcc

SEQ ID NO: 1311747 - DNA, 19 bp, Homo sapiens
catcctgagccccgccctc

SEQ ID NO: 1311748 - DNA, 22 bp, Homo sapiens
catcctgccttcatggaactca

SEQ ID NO: 1311749 - DNA, 15 bp, Homo sapiens
catctcggagcatcc

SEQ ID NO: 1311750 - DNA, 15 bp, Homo sapiens
catgcttatgacaat

SEQ ID NO: 1311751 - DNA, 19 bp, Homo sapiens
catgttctgcccccagccc

SEQ ID NO: 1311752 - DNA, 21 bp, Homo sapiens
catgttctgcccccagcccaa

SEQ ID NO: 1311753 - DNA, 13 bp, Homo sapiens
cattaaatgtttg

SEQ ID NO: 1311754 - DNA, 22 bp, Homo sapiens
gcatcctgagccccgccctctt

SEQ ID NO: 1311755 - DNA, 21 bp, Homo sapiens
gcatgacttgtagcatattct

SEQ ID NO: 1311756 - DNA, 16 bp, Homo sapiens
gcattgacaaatctgt

SEQ ID NO: 1311757 - DNA, 13 bp, Homo sapiens
gccaatggaaacc

SEQ ID NO: 1311758 - DNA, 12 bp, Homo sapiens
gccacacccagg

SEQ ID NO: 1311759 - DNA, 23 bp, Homo sapiens
gccagaccaacgttactcagggc

SEQ ID NO: 1311760 - DNA, 22 bp, Homo sapiens
gccatcacatgatctgtttttc

SEQ ID NO: 1311761 - DNA, 19 bp, Homo sapiens
gcccaaaggggacaggcct

SEQ ID NO: 1311762 - DNA, 12 bp, Homo sapiens
gcccagccccta

SEQ ID NO: 1311763 - DNA, 18 bp, Homo sapiens
gcccatctcggagcatcc

SEQ ID NO: 1311764 - DNA, 20 bp, Homo sapiens
gcccatgttctgcccccagc

SEQ ID NO: 1311765 - DNA, 22 bp, Homo sapiens
gccccaaataacttcagtcctg

SEQ ID NO: 1311766 - DNA, 14 bp, Homo sapiens
gcccccagcccaaa

SEQ ID NO: 1311767 - DNA, 12 bp, Homo sapiens
gcccccagccta

SEQ ID NO: 1311768 - DNA, 23 bp, Homo sapiens
gcccccagcctatgagcatcctg

SEQ ID NO: 1311769 - DNA, 22 bp, Homo sapiens
gccccctccccggcaccctctg

SEQ ID NO: 1311770 - DNA, 17 bp, Homo sapiens
gccccgccctcttcctg

SEQ ID NO: 1311771 - DNA, 16 bp, Homo sapiens
gccccggatcagagca

SEQ ID NO: 1311772 - DNA, 17 bp, Homo sapiens
gccccggatcagagcag

SEQ ID NO: 1311773 - DNA, 23 bp, Homo sapiens
gccccggatcagagcaggacctc

SEQ ID NO: 1311774 - DNA, 18 bp, Homo sapiens
gcccctagaaacccaagc

SEQ ID NO: 1311775 - DNA, 19 bp, Homo sapiens
gccctagcccagcgctctg

SEQ ID NO: 1311776 - DNA, 21 bp, Homo sapiens
gccctagcccagcgctctgcc

SEQ ID NO: 1311777 - DNA, 14 bp, Homo sapiens
gccctcttcctgac

SEQ ID NO: 1311778 - DNA, 22 bp, Homo sapiens
gcccttcacattttttatgggc

SEQ ID NO: 1311779 - DNA, 15 bp, Homo sapiens
gcctagtttttagta

SEQ ID NO: 1311780 - DNA, 21 bp, Homo sapiens
gcctatgagcatcctgagccc

SEQ ID NO: 1311781 - DNA, 20 bp, Homo sapiens
gcctcaccgcttccctcctg

SEQ ID NO: 1311782 - DNA, 18 bp, Homo sapiens
gcctcacctctacccaaa

SEQ ID NO: 1311783 - DNA, 15 bp, Homo sapiens
gcctgatctcttcct

SEQ ID NO: 1311784 - DNA, 16 bp, Homo sapiens
gcctgatctcttcctg

SEQ ID NO: 1311785 - DNA, 13 bp, Homo sapiens
gcgaatccaagct

SEQ ID NO: 1311786 - DNA, 22 bp, Homo sapiens
gcgaatccaagctccctgcccc

SEQ ID NO: 1311787 - DNA, 22 bp, Homo sapiens
gcgaccgccctccgcgaaaata

SEQ ID NO: 1311788 - DNA, 23 bp, Homo sapiens
gcgtcagtctttttctgttgtaa

SEQ ID NO: 1311789 - DNA, 18 bp, Homo sapiens
gctcacctagagccagac

SEQ ID NO: 1311790 - DNA, 19 bp, Homo sapiens
gctcacctagagccagacc

SEQ ID NO: 1311791 - DNA, 20 bp, Homo sapiens
gctcacctagagccagacca

SEQ ID NO: 1311792 - DNA, 15 bp, Homo sapiens
gctcagaacccaggg

SEQ ID NO: 1311793 - DNA, 16 bp, Homo sapiens
gctcagaacccagggc

SEQ ID NO: 1311794 - DNA, 22 bp, Homo sapiens
gctcagaacccagggctctgcc

SEQ ID NO: 1311795 - DNA, 23 bp, Homo sapiens
gctcagaacccagggctctgccc

SEQ ID NO: 1311796 - DNA, 13 bp, Homo sapiens
gctccctgcccca

SEQ ID NO: 1311797 - DNA, 15 bp, Homo sapiens
gctgcaggaatcaaa

SEQ ID NO: 1311798 - DNA, 15 bp, Homo sapiens
gctggacgtctttct

SEQ ID NO: 1311799 - DNA, 16 bp, Homo sapiens
gctggacgtctttctt

SEQ ID NO: 1311800 - DNA, 15 bp, Homo sapiens
gctgtctgtggcttc

SEQ ID NO: 1311801 - DNA, 22 bp, Homo sapiens
gctgtgatttttgttgattaaa

SEQ ID NO: 1311802 - DNA, 16 bp, Homo sapiens
gcttccctcctgcccg

SEQ ID NO: 1311803 - DNA, 16 bp, Homo sapiens
gcttcgacttttctta

SEQ ID NO: 1311804 - DNA, 16 bp, Homo sapiens
gcttctaataaattat

SEQ ID NO: 1311805 - DNA, 17 bp, Homo sapiens
gcttgtggggacccagg

SEQ ID NO: 1311806 - DNA, 19 bp, Homo sapiens
gcttgtggggacccaggct

SEQ ID NO: 1311807 - DNA, 21 bp, Homo sapiens
gcttgtggggacccaggctcc

SEQ ID NO: 1311808 - DNA, 18 bp, Homo sapiens
gctttggggtgtcttttt

SEQ ID NO: 1311809 - DNA, 14 bp, Homo sapiens
ggaaccgctcacct

SEQ ID NO: 1311810 - DNA, 20 bp, Homo sapiens
ggaaccgctcacctagagcc

SEQ ID NO: 1311811 - DNA, 17 bp, Homo sapiens
ggaataagaagcaaata

SEQ ID NO: 1311812 - DNA, 21 bp, Homo sapiens
ggacacaaaactccgccccca

SEQ ID NO: 1311813 - DNA, 20 bp, Homo sapiens
ggacctcccttccgaccctc

SEQ ID NO: 1311814 - DNA, 16 bp, Homo sapiens
ggactcgcttgtaaat

SEQ ID NO: 1311815 - DNA, 14 bp, Homo sapiens
ggagcacaggtccc

SEQ ID NO: 1311816 - DNA, 13 bp, Homo sapiens
ggagcatcccgga

SEQ ID NO: 1311817 - DNA, 19 bp, Homo sapiens
ggagtgggtgacaagagcc

SEQ ID NO: 1311818 - DNA, 20 bp, Homo sapiens
ggagtgggtgacaagagcct

SEQ ID NO: 1311819 - DNA, 15 bp, Homo sapiens
ggcaccctctggccg

SEQ ID NO: 1311820 - DNA, 13 bp, Homo sapiens
ggcataaaacagc

SEQ ID NO: 1311821 - DNA, 16 bp, Homo sapiens
ggcataaaacagcttt

SEQ ID NO: 1311822 - DNA, 17 bp, Homo sapiens
ggccaatggaaacctca

SEQ ID NO: 1311823 - DNA, 17 bp, Homo sapiens
ggccccggatcagagca

SEQ ID NO: 1311824 - DNA, 23 bp, Homo sapiens
ggccctagcccagcgctctgcct

SEQ ID NO: 1311825 - DNA, 15 bp, Homo sapiens
ggcgtcagtcttttt

SEQ ID NO: 1311826 - DNA, 12 bp, Homo sapiens
ggctcctcccag

SEQ ID NO: 1311827 - DNA, 14 bp, Homo sapiens
gggaacctcccaga

SEQ ID NO: 1311828 - DNA, 17 bp, Homo sapiens
gggaacctcccagaggt

SEQ ID NO: 1311829 - DNA, 23 bp, Homo sapiens
gggactttgctgatttcccctct

SEQ ID NO: 1311830 - DNA, 16 bp, Homo sapiens
gggagcctaggaccac

SEQ ID NO: 1311831 - DNA, 13 bp, Homo sapiens
gggcacactctgc

SEQ ID NO: 1311832 - DNA, 14 bp, Homo sapiens
gggctcctcccagc

SEQ ID NO: 1311833 - DNA, 13 bp, Homo sapiens
gggctctgcccca

SEQ ID NO: 1311834 - DNA, 19 bp, Homo sapiens
ggggacaggcctcacctct

SEQ ID NO: 1311835 - DNA, 17 bp, Homo sapiens
ggtcccacctccagccc

SEQ ID NO: 1311836 - DNA, 17 bp, Homo sapiens
gtaaatgttatgactcc

SEQ ID NO: 1311837 - DNA, 16 bp, Homo sapiens
gtaacttatgtagata

SEQ ID NO: 1311838 - DNA, 22 bp, Homo sapiens
gtaacttatgtagatatttggc

SEQ ID NO: 1311839 - DNA, 12 bp, Homo sapiens
gtaatatcttta

SEQ ID NO: 1311840 - DNA, 13 bp, Homo sapiens
gtaatatctttaa

SEQ ID NO: 1311841 - DNA, 22 bp, Homo sapiens
gtacttgtgaaacacagctgtt

SEQ ID NO: 1311842 - DNA, 21 bp, Homo sapiens
gtagatatttggcttaaatat

SEQ ID NO: 1311843 - DNA, 15 bp, Homo sapiens
gtatattatttggca

SEQ ID NO: 1311844 - DNA, 14 bp, Homo sapiens
gtcactgacacaaa

SEQ ID NO: 1311845 - DNA, 15 bp, Homo sapiens
gtcagaatgctattg

SEQ ID NO: 1311846 - DNA, 14 bp, Homo sapiens
gtccccagcccttc

SEQ ID NO: 1311847 - DNA, 19 bp, Homo sapiens
gtcccccaactctgagccc

SEQ ID NO: 1311848 - DNA, 11 bp, Homo sapiens
gtcctgctcca

SEQ ID NO: 1311849 - DNA, 12 bp, Homo sapiens
gtcctgctccag

SEQ ID NO: 1311850 - DNA, 14 bp, Homo sapiens
gtctcttctcccag

SEQ ID NO: 1311851 - DNA, 23 bp, Homo sapiens
gtctcttctcccagaatcccagc

SEQ ID NO: 1311852 - DNA, 14 bp, Homo sapiens
gtctgtagtgtttt

SEQ ID NO: 1311853 - DNA, 22 bp, Homo sapiens
gtcttcaacataacccacttgt

SEQ ID NO: 1311854 - DNA, 19 bp, Homo sapiens
gtctttaaaggcccagccc

SEQ ID NO: 1311855 - DNA, 20 bp, Homo sapiens
gtctttggaaaaatgtttgt

SEQ ID NO: 1311856 - DNA, 17 bp, Homo sapiens
gtctttttctgttgtaa

SEQ ID NO: 1311857 - DNA, 20 bp, Homo sapiens
gtctttttctgttgtaactt

SEQ ID NO: 1311858 - DNA, 12 bp, Homo sapiens
gtgattcaaatg

SEQ ID NO: 1311859 - DNA, 21 bp, Homo sapiens
gtgctgacatggctctggact

SEQ ID NO: 1311860 - DNA, 16 bp, Homo sapiens
gtgggtgacaagagcc

SEQ ID NO: 1311861 - DNA, 19 bp, Homo sapiens
gtggtcttcaaattgtctt

SEQ ID NO: 1311862 - DNA, 15 bp, Homo sapiens
gtgtatattatttgg

SEQ ID NO: 1311863 - DNA, 19 bp, Homo sapiens
gtgtatattatttggcagt

SEQ ID NO: 1311864 - DNA, 14 bp, Homo sapiens
gttactcagggctc

SEQ ID NO: 1311865 - DNA, 18 bp, Homo sapiens
gttcctaagaagcttcta

SEQ ID NO: 1311866 - DNA, 21 bp, Homo sapiens
gttctgcagacacgccttccc

SEQ ID NO: 1311867 - DNA, 17 bp, Homo sapiens
gttctgcccccagccca

SEQ ID NO: 1311868 - DNA, 20 bp, Homo sapiens
gttctgcccccagcccaaag

SEQ ID NO: 1311869 - DNA, 21 bp, Homo sapiens
gttcttgcagtcatcagaagt

SEQ ID NO: 1311870 - DNA, 15 bp, Homo sapiens
gttggactaaatgcc

SEQ ID NO: 1311871 - DNA, 23 bp, Homo sapiens
gttggactaaatgcctagttttt

SEQ ID NO: 1311872 - DNA, 12 bp, Homo sapiens
gttgtaacttat

SEQ ID NO: 1311873 - DNA, 19 bp, Homo sapiens
gttgtaacttatgtagata

SEQ ID NO: 1311874 - DNA, 18 bp, Homo sapiens
gtttaatgtgaacttgta

SEQ ID NO: 1311875 - DNA, 15 bp, Homo sapiens
gtttaattgtttgtc

SEQ ID NO: 1311876 - DNA, 16 bp, Homo sapiens
gtttcacccttaaccc

SEQ ID NO: 1311877 - DNA, 14 bp, Homo sapiens
gttttgtacataga

SEQ ID NO: 1311878 - DNA, 21 bp, Homo sapiens
gtttttagtaatctgtacatt

SEQ ID NO: 1311879 - DNA, 23 bp, Homo sapiens
gtttttttttttaaaaaaagaaa

SEQ ID NO: 1311880 - DNA, 20 bp, Homo sapiens
taaaacgctgtcaaaagttg

SEQ ID NO: 1311881 - DNA, 13 bp, Homo sapiens
taaaagattcacc

SEQ ID NO: 1311882 - DNA, 19 bp, Homo sapiens
taaatatagttcctaagaa

SEQ ID NO: 1311883 - DNA, 11 bp, Homo sapiens
taaatgtttga

SEQ ID NO: 1311884 - DNA, 13 bp, Homo sapiens
aacccaaggagca

SEQ ID NO: 1311885 - DNA, 17 bp, Homo sapiens
aacccaaggagcacagg

SEQ ID NO: 1311886 - DNA, 20 bp, Homo sapiens
aacccacttgtcactgacac

SEQ ID NO: 1311887 - DNA, 17 bp, Homo sapiens
aacccagggctctgccc

SEQ ID NO: 1311888 - DNA, 12 bp, Homo sapiens
aacctcccagag

SEQ ID NO: 1311889 - DNA, 13 bp, Homo sapiens
aacctcccagagg

SEQ ID NO: 1311890 - DNA, 20 bp, Homo sapiens
aacctcccagaggtccagcc

SEQ ID NO: 1311891 - DNA, 20 bp, Homo sapiens
aacgttactcagggctcctc

SEQ ID NO: 1311892 - DNA, 14 bp, Homo sapiens
aactccgcccccag

SEQ ID NO: 1311893 - DNA, 15 bp, Homo sapiens
aactccgcccccagc

SEQ ID NO: 1311894 - DNA, 19 bp, Homo sapiens
aactccgcccccagcctat

SEQ ID NO: 1311895 - DNA, 13 bp, Homo sapiens
aactctgagccca

SEQ ID NO: 1311896 - DNA, 14 bp, Homo sapiens
aactggaataagaa

SEQ ID NO: 1311897 - DNA, 20 bp, Homo sapiens
aactggccccggatcagagc

SEQ ID NO: 1311898 - DNA, 18 bp, Homo sapiens
aacttatgtagatatttg

SEQ ID NO: 1311899 - DNA, 21 bp, Homo sapiens
aacttatgtagatatttggct

SEQ ID NO: 1311900 - DNA, 22 bp, Homo sapiens
aacttatgtagatatttggctt

SEQ ID NO: 1311901 - DNA, 19 bp, Homo sapiens
aacttgaaattatatctgt

SEQ ID NO: 1311902 - DNA, 16 bp, Homo sapiens
aacttgtagctgtaaa

SEQ ID NO: 1311903 - DNA, 16 bp, Homo sapiens
aagaagcaaataaata

SEQ ID NO: 1311904 - DNA, 15 bp, Homo sapiens
aagaagcttctaata

SEQ ID NO: 1311905 - DNA, 21 bp, Homo sapiens
aagaagcttctaataaattat

SEQ ID NO: 1311906 - DNA, 13 bp, Homo sapiens
aagaccaaacttc

SEQ ID NO: 1311907 - DNA, 19 bp, Homo sapiens
aagaggactcgcttgtaaa

SEQ ID NO: 1311908 - DNA, 19 bp, Homo sapiens
aagatgaatacattttgtt

SEQ ID NO: 1311909 - DNA, 21 bp, Homo sapiens
aagcagagtgcacagctgtcc

SEQ ID NO: 1311910 - DNA, 23 bp, Homo sapiens
aagcattctccccagtgtatgtc

SEQ ID NO: 1311911 - DNA, 15 bp, Homo sapiens
aagctccctgcccca

SEQ ID NO: 1311912 - DNA, 17 bp, Homo sapiens
aagctcctcctcggaac

SEQ ID NO: 1311913 - DNA, 23 bp, Homo sapiens
aaggaacaaaaaaaccacaaagg

SEQ ID NO: 1311914 - DNA, 16 bp, Homo sapiens
aaggaagtgccccctc

SEQ ID NO: 1311915 - DNA, 21 bp, Homo sapiens
aaggaatctttaagcagagaa

SEQ ID NO: 1311916 - DNA, 12 bp, Homo sapiens
aaggagcacagg

SEQ ID NO: 1311917 - DNA, 17 bp, Homo sapiens
aagggcataaaacagct

SEQ ID NO: 1311918 - DNA, 12 bp, Homo sapiens
aaggggacaggc

SEQ ID NO: 1311919 - DNA, 15 bp, Homo sapiens
aaggggacaggcctc

SEQ ID NO: 1311920 - DNA, 14 bp, Homo sapiens
aagttggactaaat

SEQ ID NO: 1311921 - DNA, 22 bp, Homo sapiens
aagttggactaaatgcctagtt

SEQ ID NO: 1311922 - DNA, 15 bp, Homo sapiens
aataacttcagtcct

SEQ ID NO: 1311923 - DNA, 13 bp, Homo sapiens
aataccaggattt

SEQ ID NO: 1311924 - DNA, 13 bp, Homo sapiens
aatataggtctct

SEQ ID NO: 1311925 - DNA, 20 bp, Homo sapiens
aatatagttcctaagaagct

SEQ ID NO: 1311926 - DNA, 22 bp, Homo sapiens
aatatttattgaattattttgt

SEQ ID NO: 1311927 - DNA, 17 bp, Homo sapiens
aatccaagctccctgcc

SEQ ID NO: 1311928 - DNA, 12 bp, Homo sapiens
aatctgtacatt

SEQ ID NO: 1311929 - DNA, 18 bp, Homo sapiens
aatctgtgtatattattt

SEQ ID NO: 1311930 - DNA, 21 bp, Homo sapiens
aatctgtgtatattatttggc

SEQ ID NO: 1311931 - DNA, 20 bp, Homo sapiens
aatgtttgtctcagttggaa

SEQ ID NO: 1311932 - DNA, 23 bp, Homo sapiens
aattaaaaagattctttttctga

SEQ ID NO: 1311933 - DNA, 21 bp, Homo sapiens
aattattttgttactgtctgt

SEQ ID NO: 1311934 - DNA, 18 bp, Homo sapiens
aattgtctttaatttctg

SEQ ID NO: 1311935 - DNA, 24 bp, Homo sapiens
agaccaaacttcactctgggcaca

SEQ ID NO: 1311936 - DNA, 21 bp, Homo sapiens
agagaagggcataaaacagct

SEQ ID NO: 1311937 - DNA, 16 bp, Homo sapiens
agagatatatctgaaa

SEQ ID NO: 1311938 - DNA, 13 bp, Homo sapiens
agagccagaccaa

SEQ ID NO: 1311939 - DNA, 13 bp, Homo sapiens
agagcctgatctc

SEQ ID NO: 1311940 - DNA, 17 bp, Homo sapiens
agaggactcgcttgtaa

SEQ ID NO: 1311941 - DNA, 18 bp, Homo sapiens
agaggactcgcttgtaaa

SEQ ID NO: 1311942 - DNA, 19 bp, Homo sapiens
agagggctctgtgctgaca

SEQ ID NO: 1311943 - DNA, 14 bp, Homo sapiens
agaggtccagccca

SEQ ID NO: 1311944 - DNA, 17 bp, Homo sapiens
agaggtccagcccatct

SEQ ID NO: 1311945 - DNA, 18 bp, Homo sapiens
agaggtccagcccatctc

SEQ ID NO: 1311946 - DNA, 14 bp, Homo sapiens
agagtgcacagctg

SEQ ID NO: 1311947 - DNA, 20 bp, Homo sapiens
agatatatctgaaaactgga

SEQ ID NO: 1311948 - DNA, 21 bp, Homo sapiens
agatatttggcttaaatatag

SEQ ID NO: 1311949 - DNA, 22 bp, Homo sapiens
agatggtgaagcattctcccca

SEQ ID NO: 1311950 - DNA, 13 bp, Homo sapiens
agattctttttct

SEQ ID NO: 1311951 - DNA, 15 bp, Homo sapiens
agattctttttctga

SEQ ID NO: 1311952 - DNA, 20 bp, Homo sapiens
agatttatttttcagttcca

SEQ ID NO: 1311953 - DNA, 21 bp, Homo sapiens
agatttatttttcagttccaa

SEQ ID NO: 1311954 - DNA, 23 bp, Homo sapiens
agcacaagcagagtgcacagctg

SEQ ID NO: 1311955 - DNA, 15 bp, Homo sapiens
agcacaggtcccacc

SEQ ID NO: 1311956 - DNA, 18 bp, Homo sapiens
agcaggacctcccttccg

SEQ ID NO: 1311957 - DNA, 21 bp, Homo sapiens
agcatattcttttctgcaaaa

SEQ ID NO: 1311958 - DNA, 13 bp, Homo sapiens
agcatcccggagg

SEQ ID NO: 1311959 - DNA, 14 bp, Homo sapiens
agcatcccggagga

SEQ ID NO: 1311960 - DNA, 13 bp, Homo sapiens
agcatcctgagcc

SEQ ID NO: 1311961 - DNA, 17 bp, Homo sapiens
agcatcctgagccccgc

SEQ ID NO: 1311962 - DNA, 19 bp, Homo sapiens
agcatcctgagccccgccc

SEQ ID NO: 1311963 - DNA, 23 bp, Homo sapiens
agcatcctgagccccgccctctt

SEQ ID NO: 1311964 - DNA, 17 bp, Homo sapiens
agcattctccccagtgt

SEQ ID NO: 1311965 - DNA, 17 bp, Homo sapiens
agcccagcgctctgcct

SEQ ID NO: 1311966 - DNA, 15 bp, Homo sapiens
agcccatctcggagc

SEQ ID NO: 1311967 - DNA, 20 bp, Homo sapiens
agcccatgttctgcccccag

SEQ ID NO: 1311968 - DNA, 15 bp, Homo sapiens
agccccgccctcttc

SEQ ID NO: 1311969 - DNA, 16 bp, Homo sapiens
agccccgccctcttcc

SEQ ID NO: 1311970 - DNA, 17 bp, Homo sapiens
agccccgccctcttcct

SEQ ID NO: 1311971 - DNA, 18 bp, Homo sapiens
agccccgccctcttcctg

SEQ ID NO: 1311972 - DNA, 20 bp, Homo sapiens
agccccgccctcttcctgac

SEQ ID NO: 1311973 - DNA, 16 bp, Homo sapiens
agcccctagaaaccca

SEQ ID NO: 1311974 - DNA, 11 bp, Homo sapiens
agcccctagga

SEQ ID NO: 1311975 - DNA, 21 bp, Homo sapiens
agcccgggagcctaggaccac

SEQ ID NO: 1311976 - DNA, 19 bp, Homo sapiens
agcctaggaccactcagcc

SEQ ID NO: 1311977 - DNA, 17 bp, Homo sapiens
agcctatgagcatcctg

SEQ ID NO: 1311978 - DNA, 18 bp, Homo sapiens
agcctatgagcatcctga

SEQ ID NO: 1311979 - DNA, 13 bp, Homo sapiens
aaaaagattcttt

SEQ ID NO: 1311980 - DNA, 14 bp, Homo sapiens
aaaacaaccaagcg

SEQ ID NO: 1311981 - DNA, 21 bp, Homo sapiens
aaaaccacaaaggccaaactg

SEQ ID NO: 1311982 - DNA, 13 bp, Homo sapiens
aaaagaaaaacca

SEQ ID NO: 1311983 - DNA, 21 bp, Homo sapiens
aaaagaaaaaccactcccagt

SEQ ID NO: 1311984 - DNA, 19 bp, Homo sapiens
aaaagaaaatgaaaaacaa

SEQ ID NO: 1311985 - DNA, 16 bp, Homo sapiens
aaaagttggactaaat

SEQ ID NO: 1311986 - DNA, 13 bp, Homo sapiens
aaaatagtttgtt

SEQ ID NO: 1311987 - DNA, 22 bp, Homo sapiens
aaaattgaagagagatatatct

SEQ ID NO: 1311988 - DNA, 20 bp, Homo sapiens
aaacattatagattttcatg

SEQ ID NO: 1311989 - DNA, 15 bp, Homo sapiens
aaaccacaaaggcca

SEQ ID NO: 1311990 - DNA, 11 bp, Homo sapiens
aaaccctaggt

SEQ ID NO: 1311991 - DNA, 22 bp, Homo sapiens
aaacgctgtcaaaagttggact

SEQ ID NO: 1311992 - DNA, 21 bp, Homo sapiens
aaactgctggacgtctttctt

SEQ ID NO: 1311993 - DNA, 15 bp, Homo sapiens
aaactggaataagaa

SEQ ID NO: 1311994 - DNA, 17 bp, Homo sapiens
aaaggaagtgccccctc

SEQ ID NO: 1311995 - DNA, 18 bp, Homo sapiens
aaaggaagtgccccctcc

SEQ ID NO: 1311996 - DNA, 16 bp, Homo sapiens
aaaggcccagccccta

SEQ ID NO: 1311997 - DNA, 17 bp, Homo sapiens
aaaggcccagcccctag

SEQ ID NO: 1311998 - DNA, 13 bp, Homo sapiens
aaagttggactaa

SEQ ID NO: 1311999 - DNA, 14 bp, Homo sapiens
aaagttggactaaa

SEQ ID NO: 1312000 - DNA, 19 bp, Homo sapiens
aaagttggactaaatgcct

SEQ ID NO: 1312001 - DNA, 14 bp, Homo sapiens
aaataacttcagtc

SEQ ID NO: 1312002 - DNA, 23 bp, Homo sapiens
aaatatatacccccccatgcagt

SEQ ID NO: 1312003 - DNA, 20 bp, Homo sapiens
aaatctgtgtatattatttg

SEQ ID NO: 1312004 - DNA, 22 bp, Homo sapiens
aaatctgtgtatattatttggc

SEQ ID NO: 1312005 - DNA, 20 bp, Homo sapiens
aaatgaaaaacaaccaagcg

SEQ ID NO: 1312006 - DNA, 15 bp, Homo sapiens
aaatgcctaataaac

SEQ ID NO: 1312007 - DNA, 11 bp, Homo sapiens
aaatgttatga

SEQ ID NO: 1312008 - DNA, 14 bp, Homo sapiens
aaatgtttgacaca

SEQ ID NO: 1312009 - DNA, 21 bp, Homo sapiens
aaattgaagagagatatatct

SEQ ID NO: 1312010 - DNA, 18 bp, Homo sapiens
aaattgtcttttgtcatg

SEQ ID NO: 1312011 - DNA, 17 bp, Homo sapiens
aacacagctgttcttct

SEQ ID NO: 1312012 - DNA, 20 bp, Homo sapiens
aacataacccacttgtcact

SEQ ID NO: 1312013 - DNA, 18 bp, Homo sapiens
aaccactcccagtcccca

SEQ ID NO: 1312014 - DNA, 13 bp, Homo sapiens
aacccaagctcct

SEQ ID NO: 1312015 - DNA, 14 bp, Homo sapiens
aacccaagctcctc

SEQ ID NO: 1312016 - DNA, 15 bp, Homo sapiens
aacccaagctcctcc

SEQ ID NO: 1312017 - DNA, 20 bp, Homo sapiens
aacccaaggagcacaggtcc

SEQ ID NO: 1312018 - DNA, 22 bp, Homo sapiens
aacccaaggagcacaggtccca

SEQ ID NO: 1312019 - DNA, 21 bp, Homo sapiens
aacccacttgtcactgacaca

SEQ ID NO: 1312020 - DNA, 19 bp, Homo sapiens
aacccagggctctgcccca

SEQ ID NO: 1312021 - DNA, 22 bp, Homo sapiens
aacccagggctctgccccagtc

SEQ ID NO: 1312022 - DNA, 16 bp, Homo sapiens
aaccgctcacctagag

SEQ ID NO: 1312023 - DNA, 16 bp, Homo sapiens
aacgctgtcaaaagtt

SEQ ID NO: 1312024 - DNA, 12 bp, Homo sapiens
aactctgagccc

SEQ ID NO: 1312025 - DNA, 14 bp, Homo sapiens
aactctgagcccat

SEQ ID NO: 1312026 - DNA, 23 bp, Homo sapiens
aactgctggacgtctttcttttt

SEQ ID NO: 1312027 - DNA, 15 bp, Homo sapiens
aactggaataagaag

SEQ ID NO: 1312028 - DNA, 20 bp, Homo sapiens
aacttatgtagatatttggc

SEQ ID NO: 1312029 - DNA, 13 bp, Homo sapiens
aacttgtagctgt

SEQ ID NO: 1312030 - DNA, 17 bp, Homo sapiens
aacttgtagctgtaaaa

SEQ ID NO: 1312031 - DNA, 18 bp, Homo sapiens
aacttgtagctgtaaaac

SEQ ID NO: 1312032 - DNA, 23 bp, Homo sapiens
aacttgtagctgtaaaacgctgt

SEQ ID NO: 1312033 - DNA, 20 bp, Homo sapiens
aagagagatatatctgaaaa

SEQ ID NO: 1312034 - DNA, 20 bp, Homo sapiens
aagagcctgatctcttcctg

SEQ ID NO: 1312035 - DNA, 21 bp, Homo sapiens
aagagcctgatctcttcctgt

SEQ ID NO: 1312036 - DNA, 22 bp, Homo sapiens
aagaggactcgcttgtaaatac

SEQ ID NO: 1312037 - DNA, 16 bp, Homo sapiens
aagcaaataaatatca

SEQ ID NO: 1312038 - DNA, 20 bp, Homo sapiens
aagcaaatcccaacatttct

SEQ ID NO: 1312039 - DNA, 20 bp, Homo sapiens
aagcagagtgcacagctgtc

SEQ ID NO: 1312040 - DNA, 22 bp, Homo sapiens
aagcgcatccaatctcaaggaa

SEQ ID NO: 1312041 - DNA, 23 bp, Homo sapiens
aagcgcatccaatctcaaggaat

SEQ ID NO: 1312042 - DNA, 14 bp, Homo sapiens
aagctcctcctcgg

SEQ ID NO: 1312043 - DNA, 11 bp, Homo sapiens
aagcttctaat

SEQ ID NO: 1312044 - DNA, 16 bp, Homo sapiens
aagcttctaataaatt

SEQ ID NO: 1312045 - DNA, 14 bp, Homo sapiens
aaggaatctttaag

SEQ ID NO: 1312046 - DNA, 21 bp, Homo sapiens
aaggagcacaggtcccacctc

SEQ ID NO: 1312047 - DNA, 16 bp, Homo sapiens
aaggcccagcccctag

SEQ ID NO: 1312048 - DNA, 18 bp, Homo sapiens
aaggcccagcccctagaa

SEQ ID NO: 1312049 - DNA, 22 bp, Homo sapiens
aagggaggacgggagctgggga

SEQ ID NO: 1312050 - DNA, 14 bp, Homo sapiens
aagtgccccctccc

SEQ ID NO: 1312051 - DNA, 18 bp, Homo sapiens
aagttggactaaatgcct

SEQ ID NO: 1312052 - DNA, 18 bp, Homo sapiens
aatatagttcctaagaag

SEQ ID NO: 1312053 - DNA, 13 bp, Homo sapiens
aatccaagctccc

SEQ ID NO: 1312054 - DNA, 14 bp, Homo sapiens
aatccaagctccct

SEQ ID NO: 1312055 - DNA, 18 bp, Homo sapiens
aatccaagctccctgccc

SEQ ID NO: 1312056 - DNA, 19 bp, Homo sapiens
aatccaagctccctgcccc

SEQ ID NO: 1312057 - DNA, 20 bp, Homo sapiens
aatccaagctccctgcccca

SEQ ID NO: 1312058 - DNA, 22 bp, Homo sapiens
aatccaagctccctgccccaaa

SEQ ID NO: 1312059 - DNA, 16 bp, Homo sapiens
aatctcaaggaatctt

SEQ ID NO: 1312060 - DNA, 21 bp, Homo sapiens
aatctcaaggaatctttaagc

SEQ ID NO: 1312061 - DNA, 19 bp, Homo sapiens
aatctgtacattttgttgt

SEQ ID NO: 1312062 - DNA, 22 bp, Homo sapiens
aatctgtacattttgttgtaaa

SEQ ID NO: 1312063 - DNA, 20 bp, Homo sapiens
aatctgtgtatattatttgg

SEQ ID NO: 1312064 - DNA, 15 bp, Homo sapiens
aatgcctaataaaca

SEQ ID NO: 1312065 - DNA, 24 bp, Homo sapiens
aatgcctagtttttagtaatctgt

SEQ ID NO: 1312066 - DNA, 14 bp, Homo sapiens
aatgctattgaaaa

SEQ ID NO: 1312067 - DNA, 14 bp, Homo sapiens
aatggaaacctcac

SEQ ID NO: 1312068 - DNA, 22 bp, Homo sapiens
aatgtgaacttgtagctgtaaa

SEQ ID NO: 1312069 - DNA, 20 bp, Homo sapiens
aatgtttgacacaattggaa

SEQ ID NO: 1312070 - DNA, 19 bp, Homo sapiens
aatgtttgtctcagttgga

SEQ ID NO: 1312071 - DNA, 12 bp, Homo sapiens
aattaaaaagat

SEQ ID NO: 1312072 - DNA, 15 bp, Homo sapiens
aattaaaaagattct

SEQ ID NO: 1312073 - DNA, 19 bp, Homo sapiens
aattaaaaagattcttttt

SEQ ID NO: 1312074 - DNA, 21 bp, Homo sapiens
aattatatctgtggtcttcaa

SEQ ID NO: 1312075 - DNA, 19 bp, Homo sapiens
aattattttgttactgtct

SEQ ID NO: 1312076 - DNA, 13 bp, Homo sapiens
aattctattgaaa

SEQ ID NO: 1312077 - DNA, 17 bp, Homo sapiens
aattgaagagagatata

SEQ ID NO: 1312078 - DNA, 20 bp, Homo sapiens
acaagcagagtgcacagctg

SEQ ID NO: 1312079 - DNA, 12 bp, Homo sapiens
acacagaccacc

SEQ ID NO: 1312080 - DNA, 11 bp, Homo sapiens
acacagctgtt

SEQ ID NO: 1312081 - DNA, 16 bp, Homo sapiens
acagctgttcttctgt

SEQ ID NO: 1312082 - DNA, 21 bp, Homo sapiens
acaggcctcacctctacccaa

SEQ ID NO: 1312083 - DNA, 18 bp, Homo sapiens
acaggtcccacctccagc

SEQ ID NO: 1312084 - DNA, 20 bp, Homo sapiens
acaggtcccacctccagccc

SEQ ID NO: 1312085 - DNA, 21 bp, Homo sapiens
acaggtcccacctccagcccg

SEQ ID NO: 1312086 - DNA, 20 bp, Homo sapiens
acatggctctggactctaaa

SEQ ID NO: 1312087 - DNA, 20 bp, Homo sapiens
acatttctcttcagtgtgtt

SEQ ID NO: 1312088 - DNA, 23 bp, Homo sapiens
acattttgttgtaaaaagaaaaa

SEQ ID NO: 1312089 - DNA, 14 bp, Homo sapiens
accacaaaggccaa

SEQ ID NO: 1312090 - DNA, 14 bp, Homo sapiens
accactcagcccct

SEQ ID NO: 1312091 - DNA, 21 bp, Homo sapiens
accagtctttaaaggcccagc

SEQ ID NO: 1312092 - DNA, 22 bp, Homo sapiens
accagtctttaaaggcccagcc

SEQ ID NO: 1312093 - DNA, 15 bp, Homo sapiens
acccaaaccctaggt

SEQ ID NO: 1312094 - DNA, 21 bp, Homo sapiens
acccaaggagcacaggtccca

SEQ ID NO: 1312095 - DNA, 22 bp, Homo sapiens
acccaaggagcacaggtcccac

SEQ ID NO: 1312096 - DNA, 17 bp, Homo sapiens
acccaagggcagaaagt

SEQ ID NO: 1312097 - DNA, 15 bp, Homo sapiens
acccacttgtcactg

SEQ ID NO: 1312098 - DNA, 22 bp, Homo sapiens
acccacttgtcactgacacaaa

SEQ ID NO: 1312099 - DNA, 23 bp, Homo sapiens
acccacttgtcactgacacaaag

SEQ ID NO: 1312100 - DNA, 18 bp, Homo sapiens
acccagggctctgcccca

SEQ ID NO: 1312101 - DNA, 19 bp, Homo sapiens
acccagggctctgccccag

SEQ ID NO: 1312102 - DNA, 17 bp, Homo sapiens
acccttaacccaaggag

SEQ ID NO: 1312103 - DNA, 17 bp, Homo sapiens
accgctcacctagagcc

SEQ ID NO: 1312104 - DNA, 22 bp, Homo sapiens
accgcttgtggggacccaggct

SEQ ID NO: 1312105 - DNA, 16 bp, Homo sapiens
acctccagcccgggag

SEQ ID NO: 1312106 - DNA, 19 bp, Homo sapiens
acctccagcccgggagcct

SEQ ID NO: 1312107 - DNA, 12 bp, Homo sapiens
acctcccagagg

SEQ ID NO: 1312108 - DNA, 13 bp, Homo sapiens
acctcccagaggt

SEQ ID NO: 1312109 - DNA, 14 bp, Homo sapiens
acctcccagaggtc

SEQ ID NO: 1312110 - DNA, 23 bp, Homo sapiens
acctcccagaggtccagcccatc

SEQ ID NO: 1312111 - DNA, 18 bp, Homo sapiens
acgattttctccagctca

SEQ ID NO: 1312112 - DNA, 18 bp, Homo sapiens
acgcgcttcgacttttct

SEQ ID NO: 1312113 - DNA, 23 bp, Homo sapiens
acgggagctggggagaggaaaga

SEQ ID NO: 1312114 - DNA, 17 bp, Homo sapiens
actaaatgcctagtttt

SEQ ID NO: 1312115 - DNA, 19 bp, Homo sapiens
actaaatgcctagttttta

SEQ ID NO: 1312116 - DNA, 20 bp, Homo sapiens
actattcattaaatgtttga

SEQ ID NO: 1312117 - DNA, 15 bp, Homo sapiens
actcagcccctagga

SEQ ID NO: 1312118 - DNA, 16 bp, Homo sapiens
actcagcccctaggag

SEQ ID NO: 1312119 - DNA, 16 bp, Homo sapiens
actcagggctcctccc

SEQ ID NO: 1312120 - DNA, 12 bp, Homo sapiens
actccgccccca

SEQ ID NO: 1312121 - DNA, 18 bp, Homo sapiens
actccgcccccagcctat

SEQ ID NO: 1312122 - DNA, 21 bp, Homo sapiens
actccgcccccagcctatgag

SEQ ID NO: 1312123 - DNA, 15 bp, Homo sapiens
actcgcttgtaaata

SEQ ID NO: 1312124 - DNA, 18 bp, Homo sapiens
actcgcttgtaaatacca

SEQ ID NO: 1312125 - DNA, 11 bp, Homo sapiens
actctgagccc

SEQ ID NO: 1312126 - DNA, 12 bp, Homo sapiens
actctgagccca

SEQ ID NO: 1312127 - DNA, 16 bp, Homo sapiens
actctgccagcaaaga

SEQ ID NO: 1312128 - DNA, 16 bp, Homo sapiens
actgtctgtagtgttt

SEQ ID NO: 1312129 - DNA, 19 bp, Homo sapiens
actgtctgtagtgttttgt

SEQ ID NO: 1312130 - DNA, 21 bp, Homo sapiens
actgtctttggaaaaatgttt

SEQ ID NO: 1312131 - DNA, 23 bp, Homo sapiens
actgtctttggaaaaatgtttgt

SEQ ID NO: 1312132 - DNA, 15 bp, Homo sapiens
actgtgctactgtct

SEQ ID NO: 1312133 - DNA, 22 bp, Homo sapiens
actgtgctactgtctttggaaa

SEQ ID NO: 1312134 - DNA, 15 bp, Homo sapiens
acttaagcacaagca

SEQ ID NO: 1312135 - DNA, 15 bp, Homo sapiens
acttcactgaaagac

SEQ ID NO: 1312136 - DNA, 15 bp, Homo sapiens
acttcagaattccat

SEQ ID NO: 1312137 - DNA, 20 bp, Homo sapiens
acttgtcactgacacaaagg

SEQ ID NO: 1312138 - DNA, 19 bp, Homo sapiens
acttgtgaaacacagctgt

SEQ ID NO: 1312139 - DNA, 16 bp, Homo sapiens
agaaaatgaaaaacaa

SEQ ID NO: 1312140 - DNA, 13 bp, Homo sapiens
agaacccagggct

SEQ ID NO: 1312141 - DNA, 14 bp, Homo sapiens
agaacccagggctc

SEQ ID NO: 1312142 - DNA, 18 bp, Homo sapiens
agaacccagggctctgcc

SEQ ID NO: 1312143 - DNA, 21 bp, Homo sapiens
agaacccagggctctgcccca

SEQ ID NO: 1312144 - DNA, 18 bp, Homo sapiens
agaagcttctaataaatt

SEQ ID NO: 1312145 - DNA, 14 bp, Homo sapiens
agaatataggtctc

SEQ ID NO: 1312146 - DNA, 22 bp, Homo sapiens
agaatttggaaatcctagtttc

SEQ ID NO: 1312147 - DNA, 18 bp, Homo sapiens
agacacgccttcccctca

SEQ ID NO: 1312148 - DNA, 21 bp, Homo sapiens
agaccaacgttactcagggct

SEQ ID NO: 1312149 - DNA, 22 bp, Homo sapiens
agaccaacgttactcagggctc

SEQ ID NO: 1312150 - DNA, 14 bp, Homo sapiens
agaccaaggaacaa

SEQ ID NO: 1312151 - DNA, 15 bp, Homo sapiens
agagatatatctgaa

SEQ ID NO: 1312152 - DNA, 23 bp, Homo sapiens
agagatatatctgaaaactggaa

SEQ ID NO: 1312153 - DNA, 14 bp, Homo sapiens
agagcctgatctct

SEQ ID NO: 1312154 - DNA, 18 bp, Homo sapiens
agagcctgatctcttcct

SEQ ID NO: 1312155 - DNA, 12 bp, Homo sapiens
agaggtccagcc

SEQ ID NO: 1312156 - DNA, 16 bp, Homo sapiens
agaggtccagcccatc

SEQ ID NO: 1312157 - DNA, 17 bp, Homo sapiens
agatatatctgaaaact

SEQ ID NO: 1312158 - DNA, 18 bp, Homo sapiens
agatatatctgaaaactg

SEQ ID NO: 1312159 - DNA, 13 bp, Homo sapiens
agatatctatgac

SEQ ID NO: 1312160 - DNA, 16 bp, Homo sapiens
agatatctatgactgt

SEQ ID NO: 1312161 - DNA, 19 bp, Homo sapiens
agatatttggcttaaatat

SEQ ID NO: 1312162 - DNA, 20 bp, Homo sapiens
agatatttggcttaaatata

SEQ ID NO: 1312163 - DNA, 18 bp, Homo sapiens
agatttatttttcagttc

SEQ ID NO: 1312164 - DNA, 18 bp, Homo sapiens
agcaaagaggactcgctt

SEQ ID NO: 1312165 - DNA, 22 bp, Homo sapiens
agcaaagaggactcgcttgtaa

SEQ ID NO: 1312166 - DNA, 20 bp, Homo sapiens
agcacaggtcccacctccag

SEQ ID NO: 1312167 - DNA, 21 bp, Homo sapiens
agcacaggtcccacctccagc

SEQ ID NO: 1312168 - DNA, 23 bp, Homo sapiens
agcagagtgcacagctgtccact

SEQ ID NO: 1312169 - DNA, 14 bp, Homo sapiens
agcaggacctccct

SEQ ID NO: 1312170 - DNA, 19 bp, Homo sapiens
agcatcccggaggaaatct

SEQ ID NO: 1312171 - DNA, 20 bp, Homo sapiens
agcatcccggaggaaatctg

SEQ ID NO: 1312172 - DNA, 13 bp, Homo sapiens
agcattctcccca

SEQ ID NO: 1312173 - DNA, 15 bp, Homo sapiens
agccacacccaggca

SEQ ID NO: 1312174 - DNA, 21 bp, Homo sapiens
agcccaaaggggacaggcctc

SEQ ID NO: 1312175 - DNA, 23 bp, Homo sapiens
agcccaaaggggacaggcctcac

SEQ ID NO: 1312176 - DNA, 19 bp, Homo sapiens
agccccgccctcttcctga

SEQ ID NO: 1312177 - DNA, 12 bp, Homo sapiens
agcccctagaaa

SEQ ID NO: 1312178 - DNA, 15 bp, Homo sapiens
agcccgggagcctag

SEQ ID NO: 1312179 - DNA, 15 bp, Homo sapiens
agcctaggaccactc

SEQ ID NO: 1312180 - DNA, 18 bp, Homo sapiens
agcctaggaccactcagc

SEQ ID NO: 1312181 - DNA, 21 bp, Homo sapiens
agcctaggaccactcagcccc

SEQ ID NO: 1312182 - DNA, 22 bp, Homo sapiens
agcctaggaccactcagcccct

SEQ ID NO: 1312183 - DNA, 16 bp, Homo sapiens
agcctatgagcatcct

SEQ ID NO: 1312184 - DNA, 13 bp, Homo sapiens
agcctcactgata

SEQ ID NO: 1312185 - DNA, 18 bp, Homo sapiens
agcggcgaccgccctccg

SEQ ID NO: 1312186 - DNA, 15 bp, Homo sapiens
agctcagaacccagg

SEQ ID NO: 1312187 - DNA, 17 bp, Homo sapiens
agctcagaacccagggc

SEQ ID NO: 1312188 - DNA, 22 bp, Homo sapiens
agctgcaggaatcaaaaattga

SEQ ID NO: 1312189 - DNA, 12 bp, Homo sapiens
agctgtaaaacg

SEQ ID NO: 1312190 - DNA, 14 bp, Homo sapiens
agctgtaaaacgct

SEQ ID NO: 1312191 - DNA, 18 bp, Homo sapiens
agctgtaaaacgctgtca

SEQ ID NO: 1312192 - DNA, 18 bp, Homo sapiens
agctgttatcttgtgtat

SEQ ID NO: 1312193 - DNA, 17 bp, Homo sapiens
agcttgtaggagctgag

SEQ ID NO: 1312194 - DNA, 23 bp, Homo sapiens
agctttggggtgtctttttttgg

SEQ ID NO: 1312195 - DNA, 15 bp, Homo sapiens
aggaagtgccccctc

SEQ ID NO: 1312196 - DNA, 14 bp, Homo sapiens
aggaccactcagcc

SEQ ID NO: 1312197 - DNA, 17 bp, Homo sapiens
aggaccactcagcccct

SEQ ID NO: 1312198 - DNA, 16 bp, Homo sapiens
aggactcgcttgtaaa

SEQ ID NO: 1312199 - DNA, 21 bp, Homo sapiens
aggagctgaggtttcaccctt

SEQ ID NO: 1312200 - DNA, 21 bp, Homo sapiens
aggatttttttttttttttga

SEQ ID NO: 1312201 - DNA, 13 bp, Homo sapiens
aggccaaactgct

SEQ ID NO: 1312202 - DNA, 14 bp, Homo sapiens
aggccaaactgctg

SEQ ID NO: 1312203 - DNA, 15 bp, Homo sapiens
aggctccgcccttag

SEQ ID NO: 1312204 - DNA, 19 bp, Homo sapiens
agggcataaaacagctttg

SEQ ID NO: 1312205 - DNA, 23 bp, Homo sapiens
agggcggggcacagattggagag

SEQ ID NO: 1312206 - DNA, 11 bp, Homo sapiens
agggctcctcc

SEQ ID NO: 1312207 - DNA, 14 bp, Homo sapiens
agggctctgcccca

SEQ ID NO: 1312208 - DNA, 18 bp, Homo sapiens
agggctctgtgctgacat

SEQ ID NO: 1312209 - DNA, 12 bp, Homo sapiens
aggtccagccca

SEQ ID NO: 1312210 - DNA, 23 bp, Homo sapiens
aggtccagcccatctcggagcat

SEQ ID NO: 1312211 - DNA, 16 bp, Homo sapiens
aggtctcttctcccag

SEQ ID NO: 1312212 - DNA, 22 bp, Homo sapiens
aggtctcttctcccagaatccc

SEQ ID NO: 1312213 - DNA, 23 bp, Homo sapiens
aggtctcttctcccagaatccca

SEQ ID NO: 1312214 - DNA, 18 bp, Homo sapiens
agtaatctgtacattttg

SEQ ID NO: 1312215 - DNA, 24 bp, Homo sapiens
agtacttgtgaaacacagctgttc

SEQ ID NO: 1312216 - DNA, 10 bp, Homo sapiens
agtatctcat

SEQ ID NO: 1312217 - DNA, 21 bp, Homo sapiens
agtatctcatcaacaaagaaa

SEQ ID NO: 1312218 - DNA, 22 bp, Homo sapiens
agtcccccaactctgagcccat

SEQ ID NO: 1312219 - DNA, 23 bp, Homo sapiens
agtcccccaactctgagcccatg

SEQ ID NO: 1312220 - DNA, 21 bp, Homo sapiens
agtctgggacacaaaactccg

SEQ ID NO: 1312221 - DNA, 17 bp, Homo sapiens
agtctttaaaggcccag

SEQ ID NO: 1312222 - DNA, 19 bp, Homo sapiens
agtctttaaaggcccagcc

SEQ ID NO: 1312223 - DNA, 19 bp, Homo sapiens
agtctttttctgttgtaac

SEQ ID NO: 1312224 - DNA, 13 bp, Homo sapiens
agtgtatgtcttg

SEQ ID NO: 1312225 - DNA, 16 bp, Homo sapiens
agtgtatgtcttgtat

SEQ ID NO: 1312226 - DNA, 20 bp, Homo sapiens
agttcctaagaagcttctaa

SEQ ID NO: 1312227 - DNA, 13 bp, Homo sapiens
agttggactaaat

SEQ ID NO: 1312228 - DNA, 20 bp, Homo sapiens
agtttgtttaatgtgaactt

SEQ ID NO: 1312229 - DNA, 14 bp, Homo sapiens
ataaaacagctttg

SEQ ID NO: 1312230 - DNA, 12 bp, Homo sapiens
ataacttcagtc

SEQ ID NO: 1312231 - DNA, 13 bp, Homo sapiens
ataacttcagtcc

SEQ ID NO: 1312232 - DNA, 14 bp, Homo sapiens
ataattctattgaa

SEQ ID NO: 1312233 - DNA, 16 bp, Homo sapiens
atacaaattaaaaaga

SEQ ID NO: 1312234 - DNA, 17 bp, Homo sapiens
atacccccccatgcagt

SEQ ID NO: 1312235 - DNA, 20 bp, Homo sapiens
atagatttatttttcagttc

SEQ ID NO: 1312236 - DNA, 17 bp, Homo sapiens
ataggtctcttctccca

SEQ ID NO: 1312237 - DNA, 18 bp, Homo sapiens
atagttcctaagaagctt

SEQ ID NO: 1312238 - DNA, 23 bp, Homo sapiens
atagttcctaagaagcttctaat

SEQ ID NO: 1312239 - DNA, 22 bp, Homo sapiens
atataggtctcttctcccagaa

SEQ ID NO: 1312240 - DNA, 16 bp, Homo sapiens
atatagttcctaagaa

SEQ ID NO: 1312241 - DNA, 21 bp, Homo sapiens
atatagttcctaagaagcttc

SEQ ID NO: 1312242 - DNA, 12 bp, Homo sapiens
atatatctgaaa

SEQ ID NO: 1312243 - DNA, 21 bp, Homo sapiens
atatctatgactgtgtttaat

SEQ ID NO: 1312244 - DNA, 16 bp, Homo sapiens
atatctgaaaactgga

SEQ ID NO: 1312245 - DNA, 17 bp, Homo sapiens
atatctgaaaactggaa

SEQ ID NO: 1312246 - DNA, 23 bp, Homo sapiens
atatctgaaaactggaataagaa

SEQ ID NO: 1312247 - DNA, 17 bp, Homo sapiens
atatcttgcgaatccaa

SEQ ID NO: 1312248 - DNA, 14 bp, Homo sapiens
atatgtgtaaatgt

SEQ ID NO: 1312249 - DNA, 19 bp, Homo sapiens
atatgtgtaaatgttatga

SEQ ID NO: 1312250 - DNA, 14 bp, Homo sapiens
atattaacatgctt

SEQ ID NO: 1312251 - DNA, 18 bp, Homo sapiens
atattatttggcagtttg

SEQ ID NO: 1312252 - DNA, 12 bp, Homo sapiens
atatttattgaa

SEQ ID NO: 1312253 - DNA, 14 bp, Homo sapiens
atatttattgaatt

SEQ ID NO: 1312254 - DNA, 21 bp, Homo sapiens
atatttggcttaaatatagtt

SEQ ID NO: 1312255 - DNA, 16 bp, Homo sapiens
atcagagcaggacctc

SEQ ID NO: 1312256 - DNA, 17 bp, Homo sapiens
atccaagctccctgccc

SEQ ID NO: 1312257 - DNA, 16 bp, Homo sapiens
atccaatctcaaggaa

SEQ ID NO: 1312258 - DNA, 14 bp, Homo sapiens
atcccagccggcca

SEQ ID NO: 1312259 - DNA, 15 bp, Homo sapiens
atcccgagtctggga

SEQ ID NO: 1312260 - DNA, 17 bp, Homo sapiens
atcccgagtctgggaca

SEQ ID NO: 1312261 - DNA, 16 bp, Homo sapiens
atcccggaggaaatct

SEQ ID NO: 1312262 - DNA, 17 bp, Homo sapiens
atcccggaggaaatctg

SEQ ID NO: 1312263 - DNA, 15 bp, Homo sapiens
atcctagtttcctct

SEQ ID NO: 1312264 - DNA, 12 bp, Homo sapiens
atcctgagcccc

SEQ ID NO: 1312265 - DNA, 13 bp, Homo sapiens
atcctgagccccg

SEQ ID NO: 1312266 - DNA, 21 bp, Homo sapiens
atctacccaagggcagaaagt

SEQ ID NO: 1312267 - DNA, 11 bp, Homo sapiens
atctcttcctg

SEQ ID NO: 1312268 - DNA, 12 bp, Homo sapiens
atctcttcctgt

SEQ ID NO: 1312269 - DNA, 14 bp, Homo sapiens
atctgaaaactgga

SEQ ID NO: 1312270 - DNA, 23 bp, Homo sapiens
atctgtacattttgttgtaaaaa

SEQ ID NO: 1312271 - DNA, 21 bp, Homo sapiens
atctgtgtatattatttggca

SEQ ID NO: 1312272 - DNA, 16 bp, Homo sapiens
atcttgcgaatccaag

SEQ ID NO: 1312273 - DNA, 23 bp, Homo sapiens
atcttgcgaatccaagctccctg

SEQ ID NO: 1312274 - DNA, 16 bp, Homo sapiens
atctttaaatgatgta

SEQ ID NO: 1312275 - DNA, 15 bp, Homo sapiens
atgacaatgactgtg

SEQ ID NO: 1312276 - DNA, 20 bp, Homo sapiens
atgacttgtagcatattctt

SEQ ID NO: 1312277 - DNA, 16 bp, Homo sapiens
atgagcatcctgagcc

SEQ ID NO: 1312278 - DNA, 16 bp, Homo sapiens
atgggcattgacaaat

SEQ ID NO: 1312279 - DNA, 15 bp, Homo sapiens
atgtagatatttggc

SEQ ID NO: 1312280 - DNA, 16 bp, Homo sapiens
atgtagatatttggct

SEQ ID NO: 1312281 - DNA, 20 bp, Homo sapiens
atgtagatatttggcttaaa

SEQ ID NO: 1312282 - DNA, 21 bp, Homo sapiens
atgtagatatttggcttaaat

SEQ ID NO: 1312283 - DNA, 18 bp, Homo sapiens
atgtctttctccaaagtt

SEQ ID NO: 1312284 - DNA, 14 bp, Homo sapiens
atgtgaacttgtag

SEQ ID NO: 1312285 - DNA, 20 bp, Homo sapiens
atgtgaacttgtagctgtaa

SEQ ID NO: 1312286 - DNA, 22 bp, Homo sapiens
atgtgaacttgtagctgtaaaa

SEQ ID NO: 1312287 - DNA, 16 bp, Homo sapiens
atgttctgcccccagc

SEQ ID NO: 1312288 - DNA, 19 bp, Homo sapiens
atgttcttgcagtcatcag

SEQ ID NO: 1312289 - DNA, 20 bp, Homo sapiens
atgtttgtctcagttggaaa

SEQ ID NO: 1312290 - DNA, 16 bp, Homo sapiens
attaaaaagattcttt

SEQ ID NO: 1312291 - DNA, 17 bp, Homo sapiens
attaaaaagattctttt

SEQ ID NO: 1312292 - DNA, 21 bp, Homo sapiens
attaacatgcttatgacaatg

SEQ ID NO: 1312293 - DNA, 15 bp, Homo sapiens
attagctgtgatttt

SEQ ID NO: 1312294 - DNA, 11 bp, Homo sapiens
attatttggca

SEQ ID NO: 1312295 - DNA, 23 bp, Homo sapiens
attatttggcagtttggtatttg

SEQ ID NO: 1312296 - DNA, 13 bp, Homo sapiens
attattttgttac

SEQ ID NO: 1312297 - DNA, 20 bp, Homo sapiens
attattttgttactgtctgt

SEQ ID NO: 1312298 - DNA, 15 bp, Homo sapiens
attcattaaatgttt

SEQ ID NO: 1312299 - DNA, 23 bp, Homo sapiens
attccatatcttgcgaatccaag

SEQ ID NO: 1312300 - DNA, 20 bp, Homo sapiens
attcttttctgcaaaataga

SEQ ID NO: 1312301 - DNA, 22 bp, Homo sapiens
attgaattattttgttactgtc

SEQ ID NO: 1312302 - DNA, 23 bp, Homo sapiens
attgaattattttgttactgtct

SEQ ID NO: 1312303 - DNA, 18 bp, Homo sapiens
attgacaaatctgtgtat

SEQ ID NO: 1312304 - DNA, 21 bp, Homo sapiens
attgacaaatctgtgtatatt

SEQ ID NO: 1312305 - DNA, 20 bp, Homo sapiens
attgtcttttgtcatgtggc

SEQ ID NO: 1312306 - DNA, 18 bp, Homo sapiens
attgtggtgtgagcttca

SEQ ID NO: 1312307 - DNA, 11 bp, Homo sapiens
atttattatgt

SEQ ID NO: 1312308 - DNA, 19 bp, Homo sapiens
atttattgaattattttgt

SEQ ID NO: 1312309 - DNA, 16 bp, Homo sapiens
atttatttttcagttc

SEQ ID NO: 1312310 - DNA, 22 bp, Homo sapiens
atttatttttcagttccaagaa

SEQ ID NO: 1312311 - DNA, 22 bp, Homo sapiens
atttccgcacttcagaattcca

SEQ ID NO: 1312312 - DNA, 15 bp, Homo sapiens
atttctcttcagtgt

SEQ ID NO: 1312313 - DNA, 21 bp, Homo sapiens
atttctcttcagtgtgttgac

SEQ ID NO: 1312314 - DNA, 23 bp, Homo sapiens
atttgcggcgtcagtctttttct

SEQ ID NO: 1312315 - DNA, 12 bp, Homo sapiens
atttggaaatcc

SEQ ID NO: 1312316 - DNA, 21 bp, Homo sapiens
atttggaaatcctagtttcct

SEQ ID NO: 1312317 - DNA, 16 bp, Homo sapiens
atttggcagtttggta

SEQ ID NO: 1312318 - DNA, 16 bp, Homo sapiens
atttggcttaaatata

SEQ ID NO: 1312319 - DNA, 17 bp, Homo sapiens
attttccagggcaatca

SEQ ID NO: 1312320 - DNA, 22 bp, Homo sapiens
attttccagggcaatcaatgtt

SEQ ID NO: 1312321 - DNA, 14 bp, Homo sapiens
attttctccagctc

SEQ ID NO: 1312322 - DNA, 20 bp, Homo sapiens
attttgtctgcttagtatct

SEQ ID NO: 1312323 - DNA, 15 bp, Homo sapiens
attttgttactgtct

SEQ ID NO: 1312324 - DNA, 17 bp, Homo sapiens
attttgttactgtctgt

SEQ ID NO: 1312325 - DNA, 13 bp, Homo sapiens
attttgttgtaaa

SEQ ID NO: 1312326 - DNA, 17 bp, Homo sapiens
attttgttgtaaaaaga

SEQ ID NO: 1312327 - DNA, 15 bp, Homo sapiens
atttttcagttccaa

SEQ ID NO: 1312328 - DNA, 22 bp, Homo sapiens
atttttcagttccaagaaagat

SEQ ID NO: 1312329 - DNA, 18 bp, Homo sapiens
caaaaaaaccacaaaggc

SEQ ID NO: 1312330 - DNA, 21 bp, Homo sapiens
caaagaggactcgcttgtaaa

SEQ ID NO: 1312331 - DNA, 22 bp, Homo sapiens
caaagaggactcgcttgtaaat

SEQ ID NO: 1312332 - DNA, 23 bp, Homo sapiens
caaagaggactcgcttgtaaata

SEQ ID NO: 1312333 - DNA, 20 bp, Homo sapiens
caaaggaagtgccccctccc

SEQ ID NO: 1312334 - DNA, 13 bp, Homo sapiens
caaaggccaaact

SEQ ID NO: 1312335 - DNA, 16 bp, Homo sapiens
caaaggccaaactgct

SEQ ID NO: 1312336 - DNA, 18 bp, Homo sapiens
caaaggggacaggcctca

SEQ ID NO: 1312337 - DNA, 15 bp, Homo sapiens
caaataacttcagtc

SEQ ID NO: 1312338 - DNA, 16 bp, Homo sapiens
caaataacttcagtcc

SEQ ID NO: 1312339 - DNA, 17 bp, Homo sapiens
caaatctgtgtatatta

SEQ ID NO: 1312340 - DNA, 14 bp, Homo sapiens
caaattaaaaagat

SEQ ID NO: 1312341 - DNA, 22 bp, Homo sapiens
caaattgtcttttgtcatgtgg

SEQ ID NO: 1312342 - DNA, 16 bp, Homo sapiens
caacataacccacttg

SEQ ID NO: 1312343 - DNA, 18 bp, Homo sapiens
caacataacccacttgtc

SEQ ID NO: 1312344 - DNA, 18 bp, Homo sapiens
caacgttactcagggctc

SEQ ID NO: 1312345 - DNA, 22 bp, Homo sapiens
caacgttactcagggctcctcc

SEQ ID NO: 1312346 - DNA, 19 bp, Homo sapiens
caagagcctgatctcttcc

SEQ ID NO: 1312347 - DNA, 21 bp, Homo sapiens
caagagcctgatctcttcctg

SEQ ID NO: 1312348 - DNA, 23 bp, Homo sapiens
caagagcctgatctcttcctgtt

SEQ ID NO: 1312349 - DNA, 21 bp, Homo sapiens
caagcagagtgcacagctgtc

SEQ ID NO: 1312350 - DNA, 12 bp, Homo sapiens
caagctcctcct

SEQ ID NO: 1312351 - DNA, 14 bp, Homo sapiens
caagctcctcctcg

SEQ ID NO: 1312352 - DNA, 20 bp, Homo sapiens
caagctcctcctcggaaccg

SEQ ID NO: 1312353 - DNA, 16 bp, Homo sapiens
caaggagcacaggtcc

SEQ ID NO: 1312354 - DNA, 17 bp, Homo sapiens
caaggagcacaggtccc

SEQ ID NO: 1312355 - DNA, 22 bp, Homo sapiens
caaggagcacaggtcccacctc

SEQ ID NO: 1312356 - DNA, 21 bp, Homo sapiens
caatgactgtgctactgtctt

SEQ ID NO: 1312357 - DNA, 20 bp, Homo sapiens
cacaaaactccgcccccagc

SEQ ID NO: 1312358 - DNA, 22 bp, Homo sapiens
cacaagcagagtgcacagctgt

SEQ ID NO: 1312359 - DNA, 22 bp, Homo sapiens
cacagctgttcttctgttctgc

SEQ ID NO: 1312360 - DNA, 15 bp, Homo sapiens
cacaggtcccacctc

SEQ ID NO: 1312361 - DNA, 22 bp, Homo sapiens
cacaggtcccacctccagcccg

SEQ ID NO: 1312362 - DNA, 12 bp, Homo sapiens
caccctctggcc

SEQ ID NO: 1312363 - DNA, 19 bp, Homo sapiens
caccgctgctccacgcgct

SEQ ID NO: 1312364 - DNA, 16 bp, Homo sapiens
cacctagagccagacc

SEQ ID NO: 1312365 - DNA, 16 bp, Homo sapiens
cacctccagcccggga

SEQ ID NO: 1312366 - DNA, 21 bp, Homo sapiens
cacctccagcccgggagccta

SEQ ID NO: 1312367 - DNA, 23 bp, Homo sapiens
cacgattttctccagctcagaac

SEQ ID NO: 1312368 - DNA, 15 bp, Homo sapiens
cacgcaacttgaaat

SEQ ID NO: 1312369 - DNA, 16 bp, Homo sapiens
cacgccttcccctcag

SEQ ID NO: 1312370 - DNA, 15 bp, Homo sapiens
cactcagcccctagg

SEQ ID NO: 1312371 - DNA, 18 bp, Homo sapiens
cactcagcccctaggagt

SEQ ID NO: 1312372 - DNA, 20 bp, Homo sapiens
cactctgggcacactctgcc

SEQ ID NO: 1312373 - DNA, 18 bp, Homo sapiens
cactgatatattttccag

SEQ ID NO: 1312374 - DNA, 20 bp, Homo sapiens
cacttgtcactgacacaaag

SEQ ID NO: 1312375 - DNA, 14 bp, Homo sapiens
cagaacccagggct

SEQ ID NO: 1312376 - DNA, 15 bp, Homo sapiens
cagaacccagggctc

SEQ ID NO: 1312377 - DNA, 13 bp, Homo sapiens
cagaatcccagcc

SEQ ID NO: 1312378 - DNA, 14 bp, Homo sapiens
cagaatcccagccg

SEQ ID NO: 1312379 - DNA, 21 bp, Homo sapiens
cagaccaacgttactcagggc

SEQ ID NO: 1312380 - DNA, 13 bp, Homo sapiens
cagagcaggacct

SEQ ID NO: 1312381 - DNA, 14 bp, Homo sapiens
cagagcaggacctc

SEQ ID NO: 1312382 - DNA, 22 bp, Homo sapiens
cagagcaggacctcccttccga

SEQ ID NO: 1312383 - DNA, 15 bp, Homo sapiens
cagaggtccagccca

SEQ ID NO: 1312384 - DNA, 16 bp, Homo sapiens
cagaggtccagcccat

SEQ ID NO: 1312385 - DNA, 16 bp, Homo sapiens
cagatggtgaagcatt

SEQ ID NO: 1312386 - DNA, 19 bp, Homo sapiens
cagccacacccaggcactt

SEQ ID NO: 1312387 - DNA, 22 bp, Homo sapiens
cagcccaaaggggacaggcctc

SEQ ID NO: 1312388 - DNA, 16 bp, Homo sapiens
cagcccatctcggagc

SEQ ID NO: 1312389 - DNA, 17 bp, Homo sapiens
cagcccatctcggagca

SEQ ID NO: 1312390 - DNA, 20 bp, Homo sapiens
cagcccctagaaacccaagc

SEQ ID NO: 1312391 - DNA, 12 bp, Homo sapiens
cagcccctagga

SEQ ID NO: 1312392 - DNA, 15 bp, Homo sapiens
cagcccgggagccta

SEQ ID NO: 1312393 - DNA, 19 bp, Homo sapiens
cagccggccaatggaaacc

SEQ ID NO: 1312394 - DNA, 13 bp, Homo sapiens
cagcctatgagca

SEQ ID NO: 1312395 - DNA, 21 bp, Homo sapiens
cagcctatgagcatcctgagc

SEQ ID NO: 1312396 - DNA, 22 bp, Homo sapiens
cagcctatgagcatcctgagcc

SEQ ID NO: 1312397 - DNA, 20 bp, Homo sapiens
cagcgctctgcctcaccgct

SEQ ID NO: 1312398 - DNA, 15 bp, Homo sapiens
cagctcagaacccag

SEQ ID NO: 1312399 - DNA, 18 bp, Homo sapiens
cagctcagaacccagggc

SEQ ID NO: 1312400 - DNA, 20 bp, Homo sapiens
cagctcagaacccagggctc

SEQ ID NO: 1312401 - DNA, 15 bp, Homo sapiens
cagctgcaggaatca

SEQ ID NO: 1312402 - DNA, 17 bp, Homo sapiens
caggacctcccttccga

SEQ ID NO: 1312403 - DNA, 23 bp, Homo sapiens
caggacctcccttccgaccctct

SEQ ID NO: 1312404 - DNA, 21 bp, Homo sapiens
caggcacttaagcacaagcag

SEQ ID NO: 1312405 - DNA, 13 bp, Homo sapiens
caggcctcacctc

SEQ ID NO: 1312406 - DNA, 19 bp, Homo sapiens
caggcctcacctctaccca

SEQ ID NO: 1312407 - DNA, 17 bp, Homo sapiens
caggctccgcccttagt

SEQ ID NO: 1312408 - DNA, 17 bp, Homo sapiens
cagggcaatcaatgttc

SEQ ID NO: 1312409 - DNA, 13 bp, Homo sapiens
cagggctcctccc

SEQ ID NO: 1312410 - DNA, 16 bp, Homo sapiens
cagggctcctcccagc

SEQ ID NO: 1312411 - DNA, 20 bp, Homo sapiens
cagggctcctcccagcttgt

SEQ ID NO: 1312412 - DNA, 16 bp, Homo sapiens
cagggctctgccccag

SEQ ID NO: 1312413 - DNA, 19 bp, Homo sapiens
cagggctctgccccagtcg

SEQ ID NO: 1312414 - DNA, 19 bp, Homo sapiens
caggtcccacctccagccc

SEQ ID NO: 1312415 - DNA, 20 bp, Homo sapiens
caggtcccacctccagcccg

SEQ ID NO: 1312416 - DNA, 21 bp, Homo sapiens
cagtacttgtgaaacacagct

SEQ ID NO: 1312417 - DNA, 22 bp, Homo sapiens
cagtacttgtgaaacacagctg

SEQ ID NO: 1312418 - DNA, 16 bp, Homo sapiens
cagtcctgctccagaa

SEQ ID NO: 1312419 - DNA, 18 bp, Homo sapiens
cagtctttaaaggcccag

SEQ ID NO: 1312420 - DNA, 14 bp, Homo sapiens
cagtctttttctgt

SEQ ID NO: 1312421 - DNA, 16 bp, Homo sapiens
cagtctttttctgttg

SEQ ID NO: 1312422 - DNA, 12 bp, Homo sapiens
cagttccaagaa

SEQ ID NO: 1312423 - DNA, 16 bp, Homo sapiens
cagttccaagaaagat

SEQ ID NO: 1312424 - DNA, 16 bp, Homo sapiens
cagtttggtatttgcg

SEQ ID NO: 1312425 - DNA, 16 bp, Homo sapiens
catagatttatttttc

SEQ ID NO: 1312426 - DNA, 20 bp, Homo sapiens
catagatttatttttcagtt

SEQ ID NO: 1312427 - DNA, 21 bp, Homo sapiens
catagatttatttttcagttc

SEQ ID NO: 1312428 - DNA, 21 bp, Homo sapiens
catatcttgcgaatccaagct

SEQ ID NO: 1312429 - DNA, 22 bp, Homo sapiens
catatcttgcgaatccaagctc

SEQ ID NO: 1312430 - DNA, 14 bp, Homo sapiens
catcagaagtggta

SEQ ID NO: 1312431 - DNA, 18 bp, Homo sapiens
catccaccgctgctccac

SEQ ID NO: 1312432 - DNA, 13 bp, Homo sapiens
catcctgagcccc

SEQ ID NO: 1312433 - DNA, 14 bp, Homo sapiens
catctcggagcatc

SEQ ID NO: 1312434 - DNA, 21 bp, Homo sapiens
catgacttgtagcatattctt

SEQ ID NO: 1312435 - DNA, 20 bp, Homo sapiens
catgtctttctccaaagtta

SEQ ID NO: 1312436 - DNA, 18 bp, Homo sapiens
catgttctgcccccagcc

SEQ ID NO: 1312437 - DNA, 20 bp, Homo sapiens
catgttctgcccccagccca

SEQ ID NO: 1312438 - DNA, 12 bp, Homo sapiens
cattaaatgttt

SEQ ID NO: 1312439 - DNA, 22 bp, Homo sapiens
cattaattaccctactttcatt

SEQ ID NO: 1312440 - DNA, 12 bp, Homo sapiens
cattctccccag

SEQ ID NO: 1312441 - DNA, 18 bp, Homo sapiens
cattgacaaatctgtgta

SEQ ID NO: 1312442 - DNA, 18 bp, Homo sapiens
cattttgttgtaaaaaga

SEQ ID NO: 1312443 - DNA, 19 bp, Homo sapiens
cattttgttgtaaaaagaa

SEQ ID NO: 1312444 - DNA, 23 bp, Homo sapiens
ccaaaccctaggttcccggtccc

SEQ ID NO: 1312445 - DNA, 18 bp, Homo sapiens
ccaaaggggacaggcctc

SEQ ID NO: 1312446 - DNA, 23 bp, Homo sapiens
ccaaaggggacaggcctcacctc

SEQ ID NO: 1312447 - DNA, 14 bp, Homo sapiens
ccaactctgagccc

SEQ ID NO: 1312448 - DNA, 20 bp, Homo sapiens
ccaagctcctcctcggaacc

SEQ ID NO: 1312449 - DNA, 12 bp, Homo sapiens
ccaaggagcaca

SEQ ID NO: 1312450 - DNA, 19 bp, Homo sapiens
ccaccgctgctccacgcgc

SEQ ID NO: 1312451 - DNA, 20 bp, Homo sapiens
ccacctccagcccgggagcc

SEQ ID NO: 1312452 - DNA, 19 bp, Homo sapiens
ccacgattttctccagctc

SEQ ID NO: 1312453 - DNA, 13 bp, Homo sapiens
ccactcagcccct

SEQ ID NO: 1312454 - DNA, 14 bp, Homo sapiens
ccactcagccccta

SEQ ID NO: 1312455 - DNA, 15 bp, Homo sapiens
ccactcagcccctag

SEQ ID NO: 1312456 - DNA, 14 bp, Homo sapiens
ccactcccagtccc

SEQ ID NO: 1312457 - DNA, 18 bp, Homo sapiens
ccacttgtcactgacaca

SEQ ID NO: 1312458 - DNA, 21 bp, Homo sapiens
ccagaatttggaaatcctagt

SEQ ID NO: 1312459 - DNA, 23 bp, Homo sapiens
ccagaatttggaaatcctagttt

SEQ ID NO: 1312460 - DNA, 23 bp, Homo sapiens
ccagaccaacgttactcagggct

SEQ ID NO: 1312461 - DNA, 22 bp, Homo sapiens
ccagcccaaaggggacaggcct

SEQ ID NO: 1312462 - DNA, 21 bp, Homo sapiens
ccagcccctagaaacccaagc

SEQ ID NO: 1312463 - DNA, 14 bp, Homo sapiens
ccagcccgggagcc

SEQ ID NO: 1312464 - DNA, 16 bp, Homo sapiens
ccagccggccaatgga

SEQ ID NO: 1312465 - DNA, 19 bp, Homo sapiens
ccagcctatgagcatcctg

SEQ ID NO: 1312466 - DNA, 21 bp, Homo sapiens
ccagcctatgagcatcctgag

SEQ ID NO: 1312467 - DNA, 20 bp, Homo sapiens
ccagctcagaacccagggct

SEQ ID NO: 1312468 - DNA, 21 bp, Homo sapiens
ccagctcagaacccagggctc

SEQ ID NO: 1312469 - DNA, 23 bp, Homo sapiens
ccagctgcaggaatcaaaaattg

SEQ ID NO: 1312470 - DNA, 14 bp, Homo sapiens
ccaggctccgccct

SEQ ID NO: 1312471 - DNA, 18 bp, Homo sapiens
ccaggctccgcccttagt

SEQ ID NO: 1312472 - DNA, 19 bp, Homo sapiens
ccagggctctgccccagtc

SEQ ID NO: 1312473 - DNA, 18 bp, Homo sapiens
ccagtcgttagaatatag

SEQ ID NO: 1312474 - DNA, 18 bp, Homo sapiens
ccagtctttaaaggccca

SEQ ID NO: 1312475 - DNA, 20 bp, Homo sapiens
ccagtctttaaaggcccagc

SEQ ID NO: 1312476 - DNA, 21 bp, Homo sapiens
ccagtctttaaaggcccagcc

SEQ ID NO: 1312477 - DNA, 23 bp, Homo sapiens
ccagtctttaaaggcccagcccc

SEQ ID NO: 1312478 - DNA, 21 bp, Homo sapiens
ccatatcttgcgaatccaagc

SEQ ID NO: 1312479 - DNA, 22 bp, Homo sapiens
ccatctcggagcatcccggagg

SEQ ID NO: 1312480 - DNA, 16 bp, Homo sapiens
ccatgttctgccccca

SEQ ID NO: 1312481 - DNA, 17 bp, Homo sapiens
ccatgttctgcccccag

SEQ ID NO: 1312482 - DNA, 22 bp, Homo sapiens
ccatgttctgcccccagcccaa

SEQ ID NO: 1312483 - DNA, 22 bp, Homo sapiens
cccaaaggggacaggcctcacc

SEQ ID NO: 1312484 - DNA, 19 bp, Homo sapiens
cccaactctgagcccatgt

SEQ ID NO: 1312485 - DNA, 15 bp, Homo sapiens
cccaaggagcacagg

SEQ ID NO: 1312486 - DNA, 20 bp, Homo sapiens
cccaaggagcacaggtccca

SEQ ID NO: 1312487 - DNA, 22 bp, Homo sapiens
cccaaggagcacaggtcccacc

SEQ ID NO: 1312488 - DNA, 14 bp, Homo sapiens
cccacctccagccc

SEQ ID NO: 1312489 - DNA, 18 bp, Homo sapiens
cccacgattttctccagc

SEQ ID NO: 1312490 - DNA, 22 bp, Homo sapiens
cccacttgtcactgacacaaag

SEQ ID NO: 1312491 - DNA, 15 bp, Homo sapiens
cccagaatcccagcc

SEQ ID NO: 1312492 - DNA, 13 bp, Homo sapiens
cccagaggtccag

SEQ ID NO: 1312493 - DNA, 15 bp, Homo sapiens
cccagaggtccagcc

SEQ ID NO: 1312494 - DNA, 17 bp, Homo sapiens
cccagaggtccagccca

SEQ ID NO: 1312495 - DNA, 19 bp, Homo sapiens
cccagcccaaaggggacag

SEQ ID NO: 1312496 - DNA, 11 bp, Homo sapiens
cccagccccta

SEQ ID NO: 1312497 - DNA, 19 bp, Homo sapiens
cccagcccctagaaaccca

SEQ ID NO: 1312498 - DNA, 21 bp, Homo sapiens
cccagcccctagaaacccaag

SEQ ID NO: 1312499 - DNA, 15 bp, Homo sapiens
cccagcctatgagca

SEQ ID NO: 1312500 - DNA, 16 bp, Homo sapiens
cccagcgctctgcctc

SEQ ID NO: 1312501 - DNA, 17 bp, Homo sapiens
cccagggctctgcccca

SEQ ID NO: 1312502 - DNA, 13 bp, Homo sapiens
cccatctcggagc

SEQ ID NO: 1312503 - DNA, 14 bp, Homo sapiens
ccccaactctgagc

SEQ ID NO: 1312504 - DNA, 18 bp, Homo sapiens
ccccaactctgagcccat

SEQ ID NO: 1312505 - DNA, 19 bp, Homo sapiens
ccccaactctgagcccatg

SEQ ID NO: 1312506 - DNA, 23 bp, Homo sapiens
ccccagcctatgagcatcctgag

SEQ ID NO: 1312507 - DNA, 12 bp, Homo sapiens
cccccagcccaa

SEQ ID NO: 1312508 - DNA, 15 bp, Homo sapiens
cccccagcccaaagg

SEQ ID NO: 1312509 - DNA, 15 bp, Homo sapiens
cccccagcctatgag

SEQ ID NO: 1312510 - DNA, 23 bp, Homo sapiens
cccccagcctatgagcatcctga

SEQ ID NO: 1312511 - DNA, 15 bp, Homo sapiens
ccccggatcagagca

SEQ ID NO: 1312512 - DNA, 13 bp, Homo sapiens
cccctagaaaccc

SEQ ID NO: 1312513 - DNA, 16 bp, Homo sapiens
cccggaggaaatctgc

SEQ ID NO: 1312514 - DNA, 20 bp, Homo sapiens
cccggaggaaatctgcagag

SEQ ID NO: 1312515 - DNA, 17 bp, Homo sapiens
cccggcaccctctggcc

SEQ ID NO: 1312516 - DNA, 19 bp, Homo sapiens
cccggcaccctctggccgc

SEQ ID NO: 1312517 - DNA, 18 bp, Homo sapiens
ccctagaaacccaagctc

SEQ ID NO: 1312518 - DNA, 17 bp, Homo sapiens
ccctaggttcccggtcc

SEQ ID NO: 1312519 - DNA, 21 bp, Homo sapiens
ccctccccggcaccctctggc

SEQ ID NO: 1312520 - DNA, 19 bp, Homo sapiens
ccctctgggaacctcccag

SEQ ID NO: 1312521 - DNA, 21 bp, Homo sapiens
ccctctgggaacctcccagag

SEQ ID NO: 1312522 - DNA, 22 bp, Homo sapiens
ccctctgggaacctcccagagg

SEQ ID NO: 1312523 - DNA, 12 bp, Homo sapiens
ccctcttcctga

SEQ ID NO: 1312524 - DNA, 16 bp, Homo sapiens
cccttaacccaaggag

SEQ ID NO: 1312525 - DNA, 20 bp, Homo sapiens
cccttaacccaaggagcaca

SEQ ID NO: 1312526 - DNA, 18 bp, Homo sapiens
cccttagtcccccaactc

SEQ ID NO: 1312527 - DNA, 23 bp, Homo sapiens
cccttagtcccccaactctgagc

SEQ ID NO: 1312528 - DNA, 18 bp, Homo sapiens
ccgaccctctgggaacct

SEQ ID NO: 1312529 - DNA, 19 bp, Homo sapiens
ccgaccctctgggaacctc

SEQ ID NO: 1312530 - DNA, 14 bp, Homo sapiens
ccgagtacagtctg

SEQ ID NO: 1312531 - DNA, 17 bp, Homo sapiens
ccgagtctgggacacaa

SEQ ID NO: 1312532 - DNA, 12 bp, Homo sapiens
ccgcccccagcc

SEQ ID NO: 1312533 - DNA, 14 bp, Homo sapiens
ccgcccccagccta

SEQ ID NO: 1312534 - DNA, 13 bp, Homo sapiens
ccgccctcttcct

SEQ ID NO: 1312535 - DNA, 19 bp, Homo sapiens
ccgcgtttagaccaaggaa

SEQ ID NO: 1312536 - DNA, 16 bp, Homo sapiens
ccgcttccctcctgcc

SEQ ID NO: 1312537 - DNA, 14 bp, Homo sapiens
ccggaggaaatctg

SEQ ID NO: 1312538 - DNA, 17 bp, Homo sapiens
ccggatcagagcaggac

SEQ ID NO: 1312539 - DNA, 18 bp, Homo sapiens
ccggccaatggaaacctc

SEQ ID NO: 1312540 - DNA, 17 bp, Homo sapiens
ccgggagcctaggacca

SEQ ID NO: 1312541 - DNA, 18 bp, Homo sapiens
ccgggagcctaggaccac

SEQ ID NO: 1312542 - DNA, 13 bp, Homo sapiens
cctagagccagac

SEQ ID NO: 1312543 - DNA, 15 bp, Homo sapiens
cctagagccagacca

SEQ ID NO: 1312544 - DNA, 23 bp, Homo sapiens
cctagcccagcgctctgcctcac

SEQ ID NO: 1312545 - DNA, 18 bp, Homo sapiens
cctaggaccactcagccc

SEQ ID NO: 1312546 - DNA, 21 bp, Homo sapiens
cctaggaccactcagccccta

SEQ ID NO: 1312547 - DNA, 16 bp, Homo sapiens
cctaggagtatatttc

SEQ ID NO: 1312548 - DNA, 18 bp, Homo sapiens
cctaggttcccggtcccg

SEQ ID NO: 1312549 - DNA, 15 bp, Homo sapiens
cctagtttcctctcc

SEQ ID NO: 1312550 - DNA, 15 bp, Homo sapiens
cctcaccgcttccct

SEQ ID NO: 1312551 - DNA, 13 bp, Homo sapiens
cctcacctctacc

SEQ ID NO: 1312552 - DNA, 19 bp, Homo sapiens
cctcagccacacccaggca

SEQ ID NO: 1312553 - DNA, 16 bp, Homo sapiens
cctccagcccgggagc

SEQ ID NO: 1312554 - DNA, 19 bp, Homo sapiens
cctccagcccgggagccta

SEQ ID NO: 1312555 - DNA, 20 bp, Homo sapiens
cctcccagaggtccagccca

SEQ ID NO: 1312556 - DNA, 21 bp, Homo sapiens
cctcccagaggtccagcccat

SEQ ID NO: 1312557 - DNA, 23 bp, Homo sapiens
cctcccagaggtccagcccatct

SEQ ID NO: 1312558 - DNA, 17 bp, Homo sapiens
cctccccggcaccctct

SEQ ID NO: 1312559 - DNA, 19 bp, Homo sapiens
cctcccttccgaccctctg

SEQ ID NO: 1312560 - DNA, 21 bp, Homo sapiens
cctcccttccgaccctctggg

SEQ ID NO: 1312561 - DNA, 14 bp, Homo sapiens
cctctacccaaacc

SEQ ID NO: 1312562 - DNA, 16 bp, Homo sapiens
cctctacccaaaccct

SEQ ID NO: 1312563 - DNA, 21 bp, Homo sapiens
cctctccttcgtatcccgagt

SEQ ID NO: 1312564 - DNA, 13 bp, Homo sapiens
cctctgggaacct

SEQ ID NO: 1312565 - DNA, 14 bp, Homo sapiens
cctctgggaacctc

SEQ ID NO: 1312566 - DNA, 22 bp, Homo sapiens
cctctgggaacctcccagaggt

SEQ ID NO: 1312567 - DNA, 20 bp, Homo sapiens
cctcttcctgacgaaactgg

SEQ ID NO: 1312568 - DNA, 14 bp, Homo sapiens
cctgagccccgccc

SEQ ID NO: 1312569 - DNA, 15 bp, Homo sapiens
cctgatctcttcctg

SEQ ID NO: 1312570 - DNA, 17 bp, Homo sapiens
cctgatctcttcctgtt

SEQ ID NO: 1312571 - DNA, 20 bp, Homo sapiens
cctgatctcttcctgttttg

SEQ ID NO: 1312572 - DNA, 21 bp, Homo sapiens
cctgctccagaatttggaaat

SEQ ID NO: 1312573 - DNA, 22 bp, Homo sapiens
cctgctccagaatttggaaatc

SEQ ID NO: 1312574 - DNA, 21 bp, Homo sapiens
cctggccgcgtttagaccaag

SEQ ID NO: 1312575 - DNA, 16 bp, Homo sapiens
cctgttttgtacatag

SEQ ID NO: 1312576 - DNA, 20 bp, Homo sapiens
ccttaacccaaggagcacag

SEQ ID NO: 1312577 - DNA, 16 bp, Homo sapiens
ccttcacattttttat

SEQ ID NO: 1312578 - DNA, 18 bp, Homo sapiens
ccttcacattttttatgg

SEQ ID NO: 1312579 - DNA, 23 bp, Homo sapiens
ccttcccctcagccacacccagg

SEQ ID NO: 1312580 - DNA, 17 bp, Homo sapiens
ccttccgaccctctggg

SEQ ID NO: 1312581 - DNA, 18 bp, Homo sapiens
ccttccgaccctctggga

SEQ ID NO: 1312582 - DNA, 15 bp, Homo sapiens
cgagtctgggacaca

SEQ ID NO: 1312583 - DNA, 17 bp, Homo sapiens
cgattttctccagctca

SEQ ID NO: 1312584 - DNA, 21 bp, Homo sapiens
cgcccttagtcccccaactct

SEQ ID NO: 1312585 - DNA, 19 bp, Homo sapiens
cgctgctccacgcgcttcg

SEQ ID NO: 1312586 - DNA, 16 bp, Homo sapiens
cgcttcgacttttctt

SEQ ID NO: 1312587 - DNA, 20 bp, Homo sapiens
cgcttgtggggacccaggct

SEQ ID NO: 1312588 - DNA, 15 bp, Homo sapiens
cggagcatcccggag

SEQ ID NO: 1312589 - DNA, 16 bp, Homo sapiens
cggagcatcccggagg

SEQ ID NO: 1312590 - DNA, 12 bp, Homo sapiens
cggaggaaatct

SEQ ID NO: 1312591 - DNA, 18 bp, Homo sapiens
cggatcagagcaggacct

SEQ ID NO: 1312592 - DNA, 19 bp, Homo sapiens
cggatcagagcaggacctc

SEQ ID NO: 1312593 - DNA, 13 bp, Homo sapiens
cggcaccctctgg

SEQ ID NO: 1312594 - DNA, 15 bp, Homo sapiens
cggcaccctctggcc

SEQ ID NO: 1312595 - DNA, 12 bp, Homo sapiens
cggccaatggaa

SEQ ID NO: 1312596 - DNA, 20 bp, Homo sapiens
cggcgaccgccctccgcgaa

SEQ ID NO: 1312597 - DNA, 17 bp, Homo sapiens
cgggagcctaggaccac

SEQ ID NO: 1312598 - DNA, 22 bp, Homo sapiens
cgtcagtctttttctgttgtaa

SEQ ID NO: 1312599 - DNA, 13 bp, Homo sapiens
cgtttagaccaag

SEQ ID NO: 1312600 - DNA, 16 bp, Homo sapiens
cgtttagaccaaggaa

SEQ ID NO: 1312601 - DNA, 18 bp, Homo sapiens
cgtttagaccaaggaaca

SEQ ID NO: 1312602 - DNA, 13 bp, Homo sapiens
ctaaaatgcttca

SEQ ID NO: 1312603 - DNA, 16 bp, Homo sapiens
ctaaagaccaaacttc

SEQ ID NO: 1312604 - DNA, 14 bp, Homo sapiens
ctaagaagcttcta

SEQ ID NO: 1312605 - DNA, 16 bp, Homo sapiens
ctaagaagcttctaat

SEQ ID NO: 1312606 - DNA, 12 bp, Homo sapiens
ctaataaattat

SEQ ID NO: 1312607 - DNA, 16 bp, Homo sapiens
ctacccaaaccctagg

SEQ ID NO: 1312608 - DNA, 20 bp, Homo sapiens
ctactgtctttggaaaaatg

SEQ ID NO: 1312609 - DNA, 22 bp, Homo sapiens
ctactgtctttggaaaaatgtt

SEQ ID NO: 1312610 - DNA, 23 bp, Homo sapiens
ctagaaacccaagctcctcctcg

SEQ ID NO: 1312611 - DNA, 19 bp, Homo sapiens
ctagcccagcgctctgcct

SEQ ID NO: 1312612 - DNA, 18 bp, Homo sapiens
ctaggaccactcagcccc

SEQ ID NO: 1312613 - DNA, 14 bp, Homo sapiens
ctagtttttagtaa

SEQ ID NO: 1312614 - DNA, 15 bp, Homo sapiens
ctataattctattga

SEQ ID NO: 1312615 - DNA, 14 bp, Homo sapiens
ctatgagcatcctg

SEQ ID NO: 1312616 - DNA, 19 bp, Homo sapiens
ctatgagcatcctgagccc

SEQ ID NO: 1312617 - DNA, 18 bp, Homo sapiens
ctcaccgcttccctcctg

SEQ ID NO: 1312618 - DNA, 12 bp, Homo sapiens
ctcacctagagc

SEQ ID NO: 1312619 - DNA, 14 bp, Homo sapiens
ctcacctagagcca

SEQ ID NO: 1312620 - DNA, 18 bp, Homo sapiens
ctcacctagagccagacc

SEQ ID NO: 1312621 - DNA, 16 bp, Homo sapiens
ctcagaacccagggct

SEQ ID NO: 1312622 - DNA, 17 bp, Homo sapiens
ctcagaacccagggctc

SEQ ID NO: 1312623 - DNA, 15 bp, Homo sapiens
ctcagcccctaggag

SEQ ID NO: 1312624 - DNA, 23 bp, Homo sapiens
ctcagcccctaggagtatatttc

SEQ ID NO: 1312625 - DNA, 17 bp, Homo sapiens
ctcagggctcctcccag

SEQ ID NO: 1312626 - DNA, 19 bp, Homo sapiens
ctcagggctcctcccagct

SEQ ID NO: 1312627 - DNA, 19 bp, Homo sapiens
ctccagaatttggaaatcc

SEQ ID NO: 1312628 - DNA, 20 bp, Homo sapiens
ctccagcccgggagcctagg

SEQ ID NO: 1312629 - DNA, 21 bp, Homo sapiens
ctccagcccgggagcctagga

SEQ ID NO: 1312630 - DNA, 20 bp, Homo sapiens
ctccagctcagaacccaggg

SEQ ID NO: 1312631 - DNA, 22 bp, Homo sapiens
ctccagctcagaacccagggct

SEQ ID NO: 1312632 - DNA, 23 bp, Homo sapiens
ctccagctcagaacccagggctc

SEQ ID NO: 1312633 - DNA, 15 bp, Homo sapiens
ctcccagaatcccag

SEQ ID NO: 1312634 - DNA, 17 bp, Homo sapiens
ctcccagaatcccagcc

SEQ ID NO: 1312635 - DNA, 19 bp, Homo sapiens
ctcccagaatcccagccgg

SEQ ID NO: 1312636 - DNA, 20 bp, Homo sapiens
ctcccagaggtccagcccat

SEQ ID NO: 1312637 - DNA, 18 bp, Homo sapiens
ctcccagcttgtaggagc

SEQ ID NO: 1312638 - DNA, 20 bp, Homo sapiens
ctcccagtccccagcccttc

SEQ ID NO: 1312639 - DNA, 17 bp, Homo sapiens
ctccccggcaccctctg

SEQ ID NO: 1312640 - DNA, 15 bp, Homo sapiens
ctccctgccccaaat

SEQ ID NO: 1312641 - DNA, 15 bp, Homo sapiens
ctccgcccccagcct

SEQ ID NO: 1312642 - DNA, 17 bp, Homo sapiens
ctccgcccccagcctat

SEQ ID NO: 1312643 - DNA, 19 bp, Homo sapiens
ctccttcgtatcccgagtc

SEQ ID NO: 1312644 - DNA, 11 bp, Homo sapiens
ctcgcttgtaa

SEQ ID NO: 1312645 - DNA, 12 bp, Homo sapiens
ctcgcttgtaaa

SEQ ID NO: 1312646 - DNA, 20 bp, Homo sapiens
ctcgcttgtaaataccagga

SEQ ID NO: 1312647 - DNA, 15 bp, Homo sapiens
ctctaaagaccaaac

SEQ ID NO: 1312648 - DNA, 17 bp, Homo sapiens
ctctaaagaccaaactt

SEQ ID NO: 1312649 - DNA, 20 bp, Homo sapiens
ctctaaagaccaaacttcac

SEQ ID NO: 1312650 - DNA, 18 bp, Homo sapiens
ctctacccaaaccctagg

SEQ ID NO: 1312651 - DNA, 19 bp, Homo sapiens
ctctgagctgttatcttgt

SEQ ID NO: 1312652 - DNA, 15 bp, Homo sapiens
ctctgccagcaaaga

SEQ ID NO: 1312653 - DNA, 16 bp, Homo sapiens
ctctgccagcaaagag

SEQ ID NO: 1312654 - DNA, 12 bp, Homo sapiens
ctctgccccagt

SEQ ID NO: 1312655 - DNA, 13 bp, Homo sapiens
ctctgccccagtc

SEQ ID NO: 1312656 - DNA, 19 bp, Homo sapiens
ctctgcctcaccgcttccc

SEQ ID NO: 1312657 - DNA, 13 bp, Homo sapiens
ctctgggaacctc

SEQ ID NO: 1312658 - DNA, 15 bp, Homo sapiens
ctctgggaacctccc

SEQ ID NO: 1312659 - DNA, 17 bp, Homo sapiens
ctctgggaacctcccag

SEQ ID NO: 1312660 - DNA, 19 bp, Homo sapiens
ctctgggcacactctgcca

SEQ ID NO: 1312661 - DNA, 17 bp, Homo sapiens
ctcttcagtgtgttgac

SEQ ID NO: 1312662 - DNA, 14 bp, Homo sapiens
ctcttctcccagaa

SEQ ID NO: 1312663 - DNA, 16 bp, Homo sapiens
ctcttctcccagaatc

SEQ ID NO: 1312664 - DNA, 21 bp, Homo sapiens
ctcttctcccagaatcccagc

SEQ ID NO: 1312665 - DNA, 13 bp, Homo sapiens
ctgacatggctct

SEQ ID NO: 1312666 - DNA, 17 bp, Homo sapiens
ctgacgaaactggcccc

SEQ ID NO: 1312667 - DNA, 20 bp, Homo sapiens
ctgacgaaactggccccgga

SEQ ID NO: 1312668 - DNA, 21 bp, Homo sapiens
ctgacgaaactggccccggat

SEQ ID NO: 1312669 - DNA, 19 bp, Homo sapiens
ctgagcccatgttctgccc

SEQ ID NO: 1312670 - DNA, 20 bp, Homo sapiens
ctgagcccatgttctgcccc

SEQ ID NO: 1312671 - DNA, 23 bp, Homo sapiens
ctgagcccatgttctgcccccag

SEQ ID NO: 1312672 - DNA, 22 bp, Homo sapiens
ctgagccccgccctcttcctga

SEQ ID NO: 1312673 - DNA, 14 bp, Homo sapiens
ctgcagacacgcct

SEQ ID NO: 1312674 - DNA, 22 bp, Homo sapiens
ctgcagagggttaggagtgggt

SEQ ID NO: 1312675 - DNA, 15 bp, Homo sapiens
ctgcaggaatcaaaa

SEQ ID NO: 1312676 - DNA, 20 bp, Homo sapiens
ctgcaggaatcaaaaattga

SEQ ID NO: 1312677 - DNA, 23 bp, Homo sapiens
ctgccccagtcgttagaatatag

SEQ ID NO: 1312678 - DNA, 14 bp, Homo sapiens
ctgcccccagccca

SEQ ID NO: 1312679 - DNA, 12 bp, Homo sapiens
ctgctccacgcg

SEQ ID NO: 1312680 - DNA, 20 bp, Homo sapiens
ctgctccacgcgcttcgact

SEQ ID NO: 1312681 - DNA, 20 bp, Homo sapiens
ctgctccagaatttggaaat

SEQ ID NO: 1312682 - DNA, 21 bp, Homo sapiens
ctgctccagaatttggaaatc

SEQ ID NO: 1312683 - DNA, 16 bp, Homo sapiens
ctggacgtctttcttt

SEQ ID NO: 1312684 - DNA, 19 bp, Homo sapiens
ctggactctaaagaccaaa

SEQ ID NO: 1312685 - DNA, 22 bp, Homo sapiens
ctggccgcgtttagaccaagga

SEQ ID NO: 1312686 - DNA, 21 bp, Homo sapiens
ctgggcacactctgccagcaa

SEQ ID NO: 1312687 - DNA, 16 bp, Homo sapiens
ctggggagaggaaaga

SEQ ID NO: 1312688 - DNA, 18 bp, Homo sapiens
ctggtttttctttttcct

SEQ ID NO: 1312689 - DNA, 12 bp, Homo sapiens
ctgtaaaacgct

SEQ ID NO: 1312690 - DNA, 16 bp, Homo sapiens
ctgtacattttgttgt

SEQ ID NO: 1312691 - DNA, 23 bp, Homo sapiens
ctgtacattttgttgtaaaaaga

SEQ ID NO: 1312692 - DNA, 12 bp, Homo sapiens
ctgtcagaatgc

SEQ ID NO: 1312693 - DNA, 12 bp, Homo sapiens
ctgtctgtggct

SEQ ID NO: 1312694 - DNA, 21 bp, Homo sapiens
ctgtgctgacatggctctgga

SEQ ID NO: 1312695 - DNA, 17 bp, Homo sapiens
ctgtggcattgttgatg

SEQ ID NO: 1312696 - DNA, 13 bp, Homo sapiens
cttaaatatagtt

SEQ ID NO: 1312697 - DNA, 14 bp, Homo sapiens
cttaacccaaggag

SEQ ID NO: 1312698 - DNA, 23 bp, Homo sapiens
cttactattcattaaatgtttga

SEQ ID NO: 1312699 - DNA, 23 bp, Homo sapiens
cttagtcccccaactctgagccc

SEQ ID NO: 1312700 - DNA, 17 bp, Homo sapiens
cttatgtagatatttgg

SEQ ID NO: 1312701 - DNA, 12 bp, Homo sapiens
cttcagtcctgc

SEQ ID NO: 1312702 - DNA, 17 bp, Homo sapiens
cttcagtcctgctccag

SEQ ID NO: 1312703 - DNA, 18 bp, Homo sapiens
cttcagtcctgctccaga

SEQ ID NO: 1312704 - DNA, 14 bp, Homo sapiens
cttcagtgtgttga

SEQ ID NO: 1312705 - DNA, 18 bp, Homo sapiens
cttccgaccctctgggaa

SEQ ID NO: 1312706 - DNA, 23 bp, Homo sapiens
cttccgaccctctgggaacctcc

SEQ ID NO: 1312707 - DNA, 18 bp, Homo sapiens
cttcctgacgaaactggc

SEQ ID NO: 1312708 - DNA, 18 bp, Homo sapiens
cttcgacttttcttaaca

SEQ ID NO: 1312709 - DNA, 22 bp, Homo sapiens
cttcgtatcccgagtctgggac

SEQ ID NO: 1312710 - DNA, 21 bp, Homo sapiens
cttctaataaattatacaaat

SEQ ID NO: 1312711 - DNA, 23 bp, Homo sapiens
cttctcccagaatcccagccggc

SEQ ID NO: 1312712 - DNA, 17 bp, Homo sapiens
cttgaaattatatctgt

SEQ ID NO: 1312713 - DNA, 21 bp, Homo sapiens
cttgaaattatatctgtggtc

SEQ ID NO: 1312714 - DNA, 15 bp, Homo sapiens
cttgcagtcatcaga

SEQ ID NO: 1312715 - DNA, 19 bp, Homo sapiens
cttgcgaatccaagctccc

SEQ ID NO: 1312716 - DNA, 17 bp, Homo sapiens
cttgtcactgacacaaa

SEQ ID NO: 1312717 - DNA, 20 bp, Homo sapiens
cttgtcactgacacaaagga

SEQ ID NO: 1312718 - DNA, 14 bp, Homo sapiens
cttgtgaaacacag

SEQ ID NO: 1312719 - DNA, 20 bp, Homo sapiens
cttgtgaaacacagctgttc

SEQ ID NO: 1312720 - DNA, 21 bp, Homo sapiens
cttgtggggacccaggctccg

SEQ ID NO: 1312721 - DNA, 16 bp, Homo sapiens
ctttaaaggcccagcc

SEQ ID NO: 1312722 - DNA, 19 bp, Homo sapiens
ctttaaaggcccagcccct

SEQ ID NO: 1312723 - DNA, 20 bp, Homo sapiens
ctttaaaggcccagccccta

SEQ ID NO: 1312724 - DNA, 20 bp, Homo sapiens
ctttctccaaagttatccag

SEQ ID NO: 1312725 - DNA, 16 bp, Homo sapiens
ctttctttttttcccc

SEQ ID NO: 1312726 - DNA, 19 bp, Homo sapiens
ctttctttttttccccccc

SEQ ID NO: 1312727 - DNA, 11 bp, Homo sapiens
ctttttttccc

SEQ ID NO: 1312728 - DNA, 20 bp, Homo sapiens
gaaaaaccactcccagtccc

SEQ ID NO: 1312729 - DNA, 13 bp, Homo sapiens
gaaaatagtttgt

SEQ ID NO: 1312730 - DNA, 18 bp, Homo sapiens
gaaacccaagctcctcct

SEQ ID NO: 1312731 - DNA, 23 bp, Homo sapiens
gaaacccaagctcctcctcggaa

SEQ ID NO: 1312732 - DNA, 15 bp, Homo sapiens
gaaactggccccgga

SEQ ID NO: 1312733 - DNA, 16 bp, Homo sapiens
gaaactggccccggat

SEQ ID NO: 1312734 - DNA, 18 bp, Homo sapiens
gaaagcctcactgatata

SEQ ID NO: 1312735 - DNA, 20 bp, Homo sapiens
gaaatcctagtttcctctcc

SEQ ID NO: 1312736 - DNA, 15 bp, Homo sapiens
gaaattatatctgtg

SEQ ID NO: 1312737 - DNA, 19 bp, Homo sapiens
gaacaaaaaaaccacaaag

SEQ ID NO: 1312738 - DNA, 21 bp, Homo sapiens
gaacccagggctctgccccag

SEQ ID NO: 1312739 - DNA, 16 bp, Homo sapiens
gaaccgctcacctaga

SEQ ID NO: 1312740 - DNA, 12 bp, Homo sapiens
gaacctcccaga

SEQ ID NO: 1312741 - DNA, 18 bp, Homo sapiens
gaacctcccagaggtcca

SEQ ID NO: 1312742 - DNA, 21 bp, Homo sapiens
gaactcagctgtctgtggctt

SEQ ID NO: 1312743 - DNA, 17 bp, Homo sapiens
gaacttgtagctgtaaa

SEQ ID NO: 1312744 - DNA, 18 bp, Homo sapiens
gaacttgtagctgtaaaa

SEQ ID NO: 1312745 - DNA, 14 bp, Homo sapiens
gaagcaaataaata

SEQ ID NO: 1312746 - DNA, 15 bp, Homo sapiens
gaagcaaataaatat

SEQ ID NO: 1312747 - DNA, 15 bp, Homo sapiens
gaagcattctcccca

SEQ ID NO: 1312748 - DNA, 17 bp, Homo sapiens
gaagcattctccccagt

SEQ ID NO: 1312749 - DNA, 11 bp, Homo sapiens
gaagcttctaa

SEQ ID NO: 1312750 - DNA, 19 bp, Homo sapiens
gaagcttctaataaattat

SEQ ID NO: 1312751 - DNA, 21 bp, Homo sapiens
gaagggcataaaacagctttg

SEQ ID NO: 1312752 - DNA, 18 bp, Homo sapiens
gaagtggtaggaaagcct

SEQ ID NO: 1312753 - DNA, 20 bp, Homo sapiens
gaatataggtctcttctccc

SEQ ID NO: 1312754 - DNA, 17 bp, Homo sapiens
gaatccaagctccctgc

SEQ ID NO: 1312755 - DNA, 14 bp, Homo sapiens
gaattattttgtta

SEQ ID NO: 1312756 - DNA, 14 bp, Homo sapiens
gacacaaaggaagt

SEQ ID NO: 1312757 - DNA, 17 bp, Homo sapiens
gacacgccttcccctca

SEQ ID NO: 1312758 - DNA, 21 bp, Homo sapiens
gacaggcctcacctctaccca

SEQ ID NO: 1312759 - DNA, 23 bp, Homo sapiens
gacatggctctggactctaaaga

SEQ ID NO: 1312760 - DNA, 21 bp, Homo sapiens
gaccaacgttactcagggctc

SEQ ID NO: 1312761 - DNA, 12 bp, Homo sapiens
gaccactcagcc

SEQ ID NO: 1312762 - DNA, 15 bp, Homo sapiens
gaccactcagcccct

SEQ ID NO: 1312763 - DNA, 17 bp, Homo sapiens
gaccactcagcccctag

SEQ ID NO: 1312764 - DNA, 12 bp, Homo sapiens
gacccaggctcc

SEQ ID NO: 1312765 - DNA, 16 bp, Homo sapiens
gacccaggctccgccc

SEQ ID NO: 1312766 - DNA, 18 bp, Homo sapiens
gacccaggctccgccctt

SEQ ID NO: 1312767 - DNA, 20 bp, Homo sapiens
gaccctctgggaacctccca

SEQ ID NO: 1312768 - DNA, 21 bp, Homo sapiens
gaccctctgggaacctcccag

SEQ ID NO: 1312769 - DNA, 22 bp, Homo sapiens
gaccctctgggaacctcccaga

SEQ ID NO: 1312770 - DNA, 23 bp, Homo sapiens
gaccctctgggaacctcccagag

SEQ ID NO: 1312771 - DNA, 19 bp, Homo sapiens
gacctcccttccgaccctc

SEQ ID NO: 1312772 - DNA, 21 bp, Homo sapiens
gacctcccttccgaccctctg

SEQ ID NO: 1312773 - DNA, 14 bp, Homo sapiens
gacgtctttctttt

SEQ ID NO: 1312774 - DNA, 15 bp, Homo sapiens
gactctaaagaccaa

SEQ ID NO: 1312775 - DNA, 14 bp, Homo sapiens
gacttcggaccgct

SEQ ID NO: 1312776 - DNA, 17 bp, Homo sapiens
gacttcggaccgcttgt

SEQ ID NO: 1312777 - DNA, 18 bp, Homo sapiens
gacttgtagcatattctt

SEQ ID NO: 1312778 - DNA, 22 bp, Homo sapiens
gacttttcttaacaacctggcc

SEQ ID NO: 1312779 - DNA, 14 bp, Homo sapiens
gagagatatatctg

SEQ ID NO: 1312780 - DNA, 18 bp, Homo sapiens
gagatatatctgaaaact

SEQ ID NO: 1312781 - DNA, 14 bp, Homo sapiens
gagcacaggtccca

SEQ ID NO: 1312782 - DNA, 12 bp, Homo sapiens
gagcaggacctc

SEQ ID NO: 1312783 - DNA, 20 bp, Homo sapiens
gagcatcccggaggaaatct

SEQ ID NO: 1312784 - DNA, 14 bp, Homo sapiens
gagcatcctgagcc

SEQ ID NO: 1312785 - DNA, 16 bp, Homo sapiens
gagcatcctgagcccc

SEQ ID NO: 1312786 - DNA, 18 bp, Homo sapiens
gagcccatgttctgcccc

SEQ ID NO: 1312787 - DNA, 20 bp, Homo sapiens
gagcccatgttctgccccca

SEQ ID NO: 1312788 - DNA, 21 bp, Homo sapiens
gagcccatgttctgcccccag

SEQ ID NO: 1312789 - DNA, 14 bp, Homo sapiens
gagccccgccctct

SEQ ID NO: 1312790 - DNA, 15 bp, Homo sapiens
gagccccgccctctt

SEQ ID NO: 1312791 - DNA, 18 bp, Homo sapiens
gagccccgccctcttcct

SEQ ID NO: 1312792 - DNA, 19 bp, Homo sapiens
gagccccgccctcttcctg

SEQ ID NO: 1312793 - DNA, 20 bp, Homo sapiens
gagcctaggaccactcagcc

SEQ ID NO: 1312794 - DNA, 15 bp, Homo sapiens
gagcctgatctcttc

SEQ ID NO: 1312795 - DNA, 19 bp, Homo sapiens
gagcctgatctcttcctgt

SEQ ID NO: 1312796 - DNA, 14 bp, Homo sapiens
gagctgaggtttca

SEQ ID NO: 1312797 - DNA, 15 bp, Homo sapiens
gagtgggtgacaaga

SEQ ID NO: 1312798 - DNA, 22 bp, Homo sapiens
gatatgtgtaaatgttatgact

SEQ ID NO: 1312799 - DNA, 16 bp, Homo sapiens
gatcagagcaggacct

SEQ ID NO: 1312800 - DNA, 12 bp, Homo sapiens
gatctcttcctg

SEQ ID NO: 1312801 - DNA, 14 bp, Homo sapiens
gattctttttctga

SEQ ID NO: 1312802 - DNA, 17 bp, Homo sapiens
gatttatttttcagttc

SEQ ID NO: 1312803 - DNA, 12 bp, Homo sapiens
gatttcccctct

SEQ ID NO: 1312804 - DNA, 20 bp, Homo sapiens
gcaaagaggactcgcttgta

SEQ ID NO: 1312805 - DNA, 21 bp, Homo sapiens
gcaaagaggactcgcttgtaa

SEQ ID NO: 1312806 - DNA, 22 bp, Homo sapiens
gcacaagcagagtgcacagctg

SEQ ID NO: 1312807 - DNA, 15 bp, Homo sapiens
gcacaggtcccacct

SEQ ID NO: 1312808 - DNA, 17 bp, Homo sapiens
gcacaggtcccacctcc

SEQ ID NO: 1312809 - DNA, 21 bp, Homo sapiens
gcacaggtcccacctccagcc

SEQ ID NO: 1312810 - DNA, 23 bp, Homo sapiens
gcacaggtcccacctccagcccg

SEQ ID NO: 1312811 - DNA, 17 bp, Homo sapiens
gcacttcagaattccat

SEQ ID NO: 1312812 - DNA, 19 bp, Homo sapiens
gcaggaatcaaaaattgaa

SEQ ID NO: 1312813 - DNA, 21 bp, Homo sapiens
gcaggacctcccttccgaccc

SEQ ID NO: 1312814 - DNA, 12 bp, Homo sapiens
gcataaaacagc

SEQ ID NO: 1312815 - DNA, 16 bp, Homo sapiens
gcatcccggaggaaat

SEQ ID NO: 1312816 - DNA, 21 bp, Homo sapiens
gcatcctgagccccgccctct

SEQ ID NO: 1312817 - DNA, 15 bp, Homo sapiens
gcattgacaaatctg

SEQ ID NO: 1312818 - DNA, 12 bp, Homo sapiens
gccaaactgctg

SEQ ID NO: 1312819 - DNA, 13 bp, Homo sapiens
gccaaactgctgg

SEQ ID NO: 1312820 - DNA, 14 bp, Homo sapiens
gccaaactgctgga

SEQ ID NO: 1312821 - DNA, 19 bp, Homo sapiens
gccaatggaaacctcacgc

SEQ ID NO: 1312822 - DNA, 20 bp, Homo sapiens
gccacacagaccaccatcca

SEQ ID NO: 1312823 - DNA, 15 bp, Homo sapiens
gccacacccaggcac

SEQ ID NO: 1312824 - DNA, 23 bp, Homo sapiens
gccagcaaagaggactcgcttgt

SEQ ID NO: 1312825 - DNA, 20 bp, Homo sapiens
gcccaaaggggacaggcctc

SEQ ID NO: 1312826 - DNA, 15 bp, Homo sapiens
gcccagcgctctgcc

SEQ ID NO: 1312827 - DNA, 23 bp, Homo sapiens
gcccatctcggagcatcccggag

SEQ ID NO: 1312828 - DNA, 16 bp, Homo sapiens
gcccatgttctgcccc

SEQ ID NO: 1312829 - DNA, 20 bp, Homo sapiens
gccccaaataacttcagtcc

SEQ ID NO: 1312830 - DNA, 16 bp, Homo sapiens
gccccgccctcttcct

SEQ ID NO: 1312831 - DNA, 22 bp, Homo sapiens
gccccgccctcttcctgacgaa

SEQ ID NO: 1312832 - DNA, 21 bp, Homo sapiens
gccccggatcagagcaggacc

SEQ ID NO: 1312833 - DNA, 21 bp, Homo sapiens
gcccctagaaacccaagctcc

SEQ ID NO: 1312834 - DNA, 15 bp, Homo sapiens
gcccgccacacagac

SEQ ID NO: 1312835 - DNA, 20 bp, Homo sapiens
gcccgggagcctaggaccac

SEQ ID NO: 1312836 - DNA, 18 bp, Homo sapiens
gccctccgcgaaaatagt

SEQ ID NO: 1312837 - DNA, 16 bp, Homo sapiens
gcccttagtcccccaa

SEQ ID NO: 1312838 - DNA, 20 bp, Homo sapiens
gcccttagtcccccaactct

SEQ ID NO: 1312839 - DNA, 23 bp, Homo sapiens
gcccttagtcccccaactctgag

SEQ ID NO: 1312840 - DNA, 17 bp, Homo sapiens
gccgcctaggctcagcg

SEQ ID NO: 1312841 - DNA, 19 bp, Homo sapiens
gccgcgtttagaccaagga

SEQ ID NO: 1312842 - DNA, 15 bp, Homo sapiens
gcctaataaacaatt

SEQ ID NO: 1312843 - DNA, 15 bp, Homo sapiens
gcctaggaccactca

SEQ ID NO: 1312844 - DNA, 19 bp, Homo sapiens
gcctaggaccactcagccc

SEQ ID NO: 1312845 - DNA, 22 bp, Homo sapiens
gcctcactgatatattttccag

SEQ ID NO: 1312846 - DNA, 14 bp, Homo sapiens
gcctgatctcttcc

SEQ ID NO: 1312847 - DNA, 17 bp, Homo sapiens
gcctgatctcttcctgt

SEQ ID NO: 1312848 - DNA, 12 bp, Homo sapiens
gccttcccctca

SEQ ID NO: 1312849 - DNA, 18 bp, Homo sapiens
gccttcccctcagccaca

SEQ ID NO: 1312850 - DNA, 11 bp, Homo sapiens
gcgaaaatagt

SEQ ID NO: 1312851 - DNA, 18 bp, Homo sapiens
gcgaatccaagctccctg

SEQ ID NO: 1312852 - DNA, 21 bp, Homo sapiens
gcgcatccaatctcaaggaat

SEQ ID NO: 1312853 - DNA, 14 bp, Homo sapiens
gcgtcagtcttttt

SEQ ID NO: 1312854 - DNA, 18 bp, Homo sapiens
gctaaatgcctaataaac

SEQ ID NO: 1312855 - DNA, 19 bp, Homo sapiens
gctaaatgcctaataaaca

SEQ ID NO: 1312856 - DNA, 14 bp, Homo sapiens
gctaattaaaaagt

SEQ ID NO: 1312857 - DNA, 18 bp, Homo sapiens
gctactttggtttctgtc

SEQ ID NO: 1312858 - DNA, 18 bp, Homo sapiens
gctcagaacccagggctc

SEQ ID NO: 1312859 - DNA, 19 bp, Homo sapiens
gctccagaatttggaaatc

SEQ ID NO: 1312860 - DNA, 12 bp, Homo sapiens
gctccgccctta

SEQ ID NO: 1312861 - DNA, 16 bp, Homo sapiens
gctccgcccttagtcc

SEQ ID NO: 1312862 - DNA, 12 bp, Homo sapiens
gctcctcccagc

SEQ ID NO: 1312863 - DNA, 19 bp, Homo sapiens
gctgacatggctctggact

SEQ ID NO: 1312864 - DNA, 17 bp, Homo sapiens
gctgaggtttcaccctt

SEQ ID NO: 1312865 - DNA, 15 bp, Homo sapiens
gctgatttcccctct

SEQ ID NO: 1312866 - DNA, 15 bp, Homo sapiens
gctggggagaggaaa

SEQ ID NO: 1312867 - DNA, 15 bp, Homo sapiens
gctgtaaaacgctgt

SEQ ID NO: 1312868 - DNA, 12 bp, Homo sapiens
gctgttcttctg

SEQ ID NO: 1312869 - DNA, 20 bp, Homo sapiens
gctgttcttctgttctgcag

SEQ ID NO: 1312870 - DNA, 14 bp, Homo sapiens
gcttagtatctcat

SEQ ID NO: 1312871 - DNA, 23 bp, Homo sapiens
gcttagtatctcatcaacaaaga

SEQ ID NO: 1312872 - DNA, 22 bp, Homo sapiens
gcttcatttcctctgagctgtt

SEQ ID NO: 1312873 - DNA, 13 bp, Homo sapiens
gcttgtaaatacc

SEQ ID NO: 1312874 - DNA, 14 bp, Homo sapiens
gcttgtaggagctg

SEQ ID NO: 1312875 - DNA, 13 bp, Homo sapiens
ggaaaaatgtttg

SEQ ID NO: 1312876 - DNA, 21 bp, Homo sapiens
ggaaccgctcacctagagcca

SEQ ID NO: 1312877 - DNA, 20 bp, Homo sapiens
ggaataagaagcaaataaat

SEQ ID NO: 1312878 - DNA, 21 bp, Homo sapiens
ggaataagaagcaaataaata

SEQ ID NO: 1312879 - DNA, 17 bp, Homo sapiens
ggacacaaaactccgcc

SEQ ID NO: 1312880 - DNA, 12 bp, Homo sapiens
ggacccaggctc

SEQ ID NO: 1312881 - DNA, 13 bp, Homo sapiens
ggacctcccttcc

SEQ ID NO: 1312882 - DNA, 16 bp, Homo sapiens
ggacttcggaccgctt

SEQ ID NO: 1312883 - DNA, 21 bp, Homo sapiens
ggagcatcccggaggaaatct

SEQ ID NO: 1312884 - DNA, 21 bp, Homo sapiens
ggagcctaggaccactcagcc

SEQ ID NO: 1312885 - DNA, 15 bp, Homo sapiens
ggatcagagcaggac

SEQ ID NO: 1312886 - DNA, 17 bp, Homo sapiens
ggatcagagcaggacct

SEQ ID NO: 1312887 - DNA, 15 bp, Homo sapiens
ggcacactctgccag

SEQ ID NO: 1312888 - DNA, 12 bp, Homo sapiens
ggcaccctctgg

SEQ ID NO: 1312889 - DNA, 20 bp, Homo sapiens
ggcaccctctggccgcctag

SEQ ID NO: 1312890 - DNA, 12 bp, Homo sapiens
ggccaaactgct

SEQ ID NO: 1312891 - DNA, 12 bp, Homo sapiens
ggcccagcccct

SEQ ID NO: 1312892 - DNA, 24 bp, Homo sapiens
ggcccagcccctagaaacccaagc

SEQ ID NO: 1312893 - DNA, 23 bp, Homo sapiens
ggccccggatcagagcaggacct

SEQ ID NO: 1312894 - DNA, 24 bp, Homo sapiens
ggccccggatcagagcaggacctc

SEQ ID NO: 1312895 - DNA, 20 bp, Homo sapiens
ggctaaatgcctaataaaca

SEQ ID NO: 1312896 - DNA, 21 bp, Homo sapiens
ggctctgccccagtcgttaga

SEQ ID NO: 1312897 - DNA, 16 bp, Homo sapiens
ggctctggactctaaa

SEQ ID NO: 1312898 - DNA, 19 bp, Homo sapiens
gggacacaaaactccgccc

SEQ ID NO: 1312899 - DNA, 20 bp, Homo sapiens
gggacacaaaactccgcccc

SEQ ID NO: 1312900 - DNA, 23 bp, Homo sapiens
gggacacaaaactccgcccccag

SEQ ID NO: 1312901 - DNA, 17 bp, Homo sapiens
gggacaggcctcacctc

SEQ ID NO: 1312902 - DNA, 22 bp, Homo sapiens
gggcacactctgccagcaaaga

SEQ ID NO: 1312903 - DNA, 13 bp, Homo sapiens
gggcattgacaaa

SEQ ID NO: 1312904 - DNA, 14 bp, Homo sapiens
gggctctgccccag

SEQ ID NO: 1312905 - DNA, 17 bp, Homo sapiens
ggggacaggcctcacct

SEQ ID NO: 1312906 - DNA, 13 bp, Homo sapiens
ggggacccaggct

SEQ ID NO: 1312907 - DNA, 13 bp, Homo sapiens
ggggtgtcttttt

SEQ ID NO: 1312908 - DNA, 20 bp, Homo sapiens
gggtcctaattaccagtctt

SEQ ID NO: 1312909 - DNA, 16 bp, Homo sapiens
gggtgacaagagcctg

SEQ ID NO: 1312910 - DNA, 20 bp, Homo sapiens
ggtttcacccttaacccaag

SEQ ID NO: 1312911 - DNA, 22 bp, Homo sapiens
ggtttcacccttaacccaagga

SEQ ID NO: 1312912 - DNA, 11 bp, Homo sapiens
gtaaaaagaaa

SEQ ID NO: 1312913 - DNA, 12 bp, Homo sapiens
gtaaaaagaaaa

SEQ ID NO: 1312914 - DNA, 13 bp, Homo sapiens
gtaaataccagga

SEQ ID NO: 1312915 - DNA, 13 bp, Homo sapiens
gtaaatgttatga

SEQ ID NO: 1312916 - DNA, 16 bp, Homo sapiens
gtacattttgttgtaa

SEQ ID NO: 1312917 - DNA, 18 bp, Homo sapiens
gtacattttgttgtaaaa

SEQ ID NO: 1312918 - DNA, 23 bp, Homo sapiens
gtacattttgttgtaaaaagaaa

SEQ ID NO: 1312919 - DNA, 21 bp, Homo sapiens
gtacttgtgaaacacagctgt

SEQ ID NO: 1312920 - DNA, 14 bp, Homo sapiens
gtagatatttggct

SEQ ID NO: 1312921 - DNA, 15 bp, Homo sapiens
gtcaaaagttggact

SEQ ID NO: 1312922 - DNA, 19 bp, Homo sapiens
gtcaaaagttggactaaat

SEQ ID NO: 1312923 - DNA, 21 bp, Homo sapiens
gtcaaaagttggactaaatgc

SEQ ID NO: 1312924 - DNA, 16 bp, Homo sapiens
gtcactgacacaaagg

SEQ ID NO: 1312925 - DNA, 17 bp, Homo sapiens
gtcagtctttttctgtt

SEQ ID NO: 1312926 - DNA, 19 bp, Homo sapiens
gtccagcccatctcggagc

SEQ ID NO: 1312927 - DNA, 15 bp, Homo sapiens
gtcccacctccagcc

SEQ ID NO: 1312928 - DNA, 17 bp, Homo sapiens
gtcttcaaattgtcttt

SEQ ID NO: 1312929 - DNA, 22 bp, Homo sapiens
gtctttaaaggcccagccccta

SEQ ID NO: 1312930 - DNA, 18 bp, Homo sapiens
gtctttggaaaaatgttt

SEQ ID NO: 1312931 - DNA, 19 bp, Homo sapiens
gtctttttctgttgtaact

SEQ ID NO: 1312932 - DNA, 22 bp, Homo sapiens
gtctttttctgttgtaacttat

SEQ ID NO: 1312933 - DNA, 23 bp, Homo sapiens
gtctttttttggtgattcaaatg

SEQ ID NO: 1312934 - DNA, 13 bp, Homo sapiens
gtgaaacacagct

SEQ ID NO: 1312935 - DNA, 15 bp, Homo sapiens
gtgaaacacagctgt

SEQ ID NO: 1312936 - DNA, 21 bp, Homo sapiens
gtgaacttgtagctgtaaaac

SEQ ID NO: 1312937 - DNA, 14 bp, Homo sapiens
gtgacaagagcctg

SEQ ID NO: 1312938 - DNA, 12 bp, Homo sapiens
gtgcacagctgt

SEQ ID NO: 1312939 - DNA, 15 bp, Homo sapiens
gtgctactgtctttg

SEQ ID NO: 1312940 - DNA, 22 bp, Homo sapiens
gtggctaaatgcctaataaaca

SEQ ID NO: 1312941 - DNA, 16 bp, Homo sapiens
gtggggacccaggctc

SEQ ID NO: 1312942 - DNA, 18 bp, Homo sapiens
gtggggacccaggctccg

SEQ ID NO: 1312943 - DNA, 14 bp, Homo sapiens
gtgtatattatttg

SEQ ID NO: 1312944 - DNA, 16 bp, Homo sapiens
gtgtatattatttggc

SEQ ID NO: 1312945 - DNA, 15 bp, Homo sapiens
gttaacactgtaata

SEQ ID NO: 1312946 - DNA, 22 bp, Homo sapiens
gttactcagggctcctcccagc

SEQ ID NO: 1312947 - DNA, 16 bp, Homo sapiens
gttactgtctgtagtg

SEQ ID NO: 1312948 - DNA, 20 bp, Homo sapiens
gttaggagtgggtgacaaga

SEQ ID NO: 1312949 - DNA, 15 bp, Homo sapiens
gttcacgcaacttga

SEQ ID NO: 1312950 - DNA, 17 bp, Homo sapiens
gttcctaagaagcttct

SEQ ID NO: 1312951 - DNA, 15 bp, Homo sapiens
gttctgcccccagcc

SEQ ID NO: 1312952 - DNA, 16 bp, Homo sapiens
gttctgcccccagccc

SEQ ID NO: 1312953 - DNA, 12 bp, Homo sapiens
gttgtaaaaaga

SEQ ID NO: 1312954 - DNA, 18 bp, Homo sapiens
gttgtaacttatgtagat

SEQ ID NO: 1312955 - DNA, 15 bp, Homo sapiens
gtttaatgtgaactt

SEQ ID NO: 1312956 - DNA, 19 bp, Homo sapiens
gtttaattgtttgtcctca

SEQ ID NO: 1312957 - DNA, 12 bp, Homo sapiens
gtttagaccaag

SEQ ID NO: 1312958 - DNA, 20 bp, Homo sapiens
gtttagaccaaggaacaaaa

SEQ ID NO: 1312959 - DNA, 22 bp, Homo sapiens
gtttcacccttaacccaaggag

SEQ ID NO: 1312960 - DNA, 13 bp, Homo sapiens
gtttctgtctgta

SEQ ID NO: 1312961 - DNA, 18 bp, Homo sapiens
gtttgtctcagttggaaa

SEQ ID NO: 1312962 - DNA, 16 bp, Homo sapiens
gtttttttttttaaaa

SEQ ID NO: 1312963 - DNA, 22 bp, Homo sapiens
gtttttttttttaaaaaaagaa

SEQ ID NO: 1312964 - DNA, 14 bp, Homo sapiens
taaaaaatttatta

SEQ ID NO: 1312965 - DNA, 12 bp, Homo sapiens
taaaaagaaaaa

SEQ ID NO: 1312966 - DNA, 23 bp, Homo sapiens
taaaaagaaaaaccactcccagt

SEQ ID NO: 1312967 - DNA, 13 bp, Homo sapiens
taaaaagattctt

SEQ ID NO: 1312968 - DNA, 16 bp, Homo sapiens
taaaacttttctgctg

SEQ ID NO: 1312969 - DNA, 9 bp, Homo sapiens
taaaatttg

SEQ ID NO: 1312970 - DNA, 11 bp, Homo sapiens
taaagaccaaa

SEQ ID NO: 1312971 - DNA, 13 bp, Homo sapiens
taaagaccaaact

SEQ ID NO: 1312972 - DNA, 23 bp, Homo sapiens
taaatatagttcctaagaagctt

SEQ ID NO: 1312973 - DNA, 20 bp, Homo sapiens
taaatgttatgactccttga

SEQ ID NO: 1312974 - DNA, 10 bp, Homo sapiens
taaatgtttg

SEQ ID NO: 1312975 - DNA, 17 bp, Homo sapiens
taaatgtttgacacaat

SEQ ID NO: 1312976 - DNA, 13 bp, Homo sapiens
taacaacctggcc

SEQ ID NO: 1312977 - DNA, 24 bp, Homo sapiens
taacccacttgtcactgacacaaa

SEQ ID NO: 1312978 - DNA, 15 bp, Homo sapiens
taacttatgtagata

SEQ ID NO: 1312979 - DNA, 17 bp, Homo sapiens
taacttatgtagatatt

SEQ ID NO: 1312980 - DNA, 21 bp, Homo sapiens
taacttatgtagatatttggc

SEQ ID NO: 1312981 - DNA, 13 bp, Homo sapiens
taacttcagtcct

SEQ ID NO: 1312982 - DNA, 20 bp, Homo sapiens
taagaagcttctaataaatt

SEQ ID NO: 1312983 - DNA, 16 bp, Homo sapiens
taatatctttaaatga

SEQ ID NO: 1312984 - DNA, 22 bp, Homo sapiens
taatctgtacattttgttgtaa

SEQ ID NO: 1312985 - DNA, 21 bp, Homo sapiens
tacatagatttatttttcagt

SEQ ID NO: 1312986 - DNA, 16 bp, Homo sapiens
tacccaaaccctaggt

SEQ ID NO: 1312987 - DNA, 20 bp, Homo sapiens
tacccaaaccctaggttccc

SEQ ID NO: 1312988 - DNA, 18 bp, Homo sapiens
tacccaagggcagaaagt

SEQ ID NO: 1312989 - DNA, 19 bp, Homo sapiens
tactcagggctcctcccag

SEQ ID NO: 1312990 - DNA, 15 bp, Homo sapiens
tactgtctgtagtgt

SEQ ID NO: 1312991 - DNA, 21 bp, Homo sapiens
tacttgtgaaacacagctgtt

SEQ ID NO: 1312992 - DNA, 18 bp, Homo sapiens
tagaacttactattcatt

SEQ ID NO: 1312993 - DNA, 16 bp, Homo sapiens
tagaatataggtctct

SEQ ID NO: 1312994 - DNA, 19 bp, Homo sapiens
tagaatataggtctcttct

SEQ ID NO: 1312995 - DNA, 14 bp, Homo sapiens
tagaccaaggaaca

SEQ ID NO: 1312996 - DNA, 13 bp, Homo sapiens
tagatatttggct

SEQ ID NO: 1312997 - DNA, 18 bp, Homo sapiens
tagatatttggcttaaat

SEQ ID NO: 1312998 - DNA, 19 bp, Homo sapiens
tagatatttggcttaaata

SEQ ID NO: 1312999 - DNA, 21 bp, Homo sapiens
tagatatttggcttaaatata

SEQ ID NO: 1313000 - DNA, 21 bp, Homo sapiens
tagatttatttttcagttcca

SEQ ID NO: 1313001 - DNA, 19 bp, Homo sapiens
taggaaagcctcactgata

SEQ ID NO: 1313002 - DNA, 16 bp, Homo sapiens
taggaccactcagccc

SEQ ID NO: 1313003 - DNA, 17 bp, Homo sapiens
taggaccactcagcccc

SEQ ID NO: 1313004 - DNA, 19 bp, Homo sapiens
taggaccactcagccccta

SEQ ID NO: 1313005 - DNA, 16 bp, Homo sapiens
taggagctgaggtttc

SEQ ID NO: 1313006 - DNA, 19 bp, Homo sapiens
taggtctcttctcccagaa

SEQ ID NO: 1313007 - DNA, 21 bp, Homo sapiens
tagtcccccaactctgagccc

SEQ ID NO: 1313008 - DNA, 16 bp, Homo sapiens
tagttcctaagaagct

SEQ ID NO: 1313009 - DNA, 21 bp, Homo sapiens
tagttcctaagaagcttctaa

SEQ ID NO: 1313010 - DNA, 13 bp, Homo sapiens
tagtttgtttaat

SEQ ID NO: 1313011 - DNA, 21 bp, Homo sapiens
tagtttgtttaatgtgaactt

SEQ ID NO: 1313012 - DNA, 14 bp, Homo sapiens
tataattctattga

SEQ ID NO: 1313013 - DNA, 20 bp, Homo sapiens
tataggtctcttctcccaga

SEQ ID NO: 1313014 - DNA, 22 bp, Homo sapiens
tatagttcctaagaagcttcta

SEQ ID NO: 1313015 - DNA, 12 bp, Homo sapiens
tatatctgaaaa

SEQ ID NO: 1313016 - DNA, 18 bp, Homo sapiens
tatatctgaaaactggaa

SEQ ID NO: 1313017 - DNA, 22 bp, Homo sapiens
tatctacccaagggcagaaagt

SEQ ID NO: 1313018 - DNA, 19 bp, Homo sapiens
tatctatgactgtgtttaa

SEQ ID NO: 1313019 - DNA, 14 bp, Homo sapiens
tatctgaaaactgg

SEQ ID NO: 1313020 - DNA, 13 bp, Homo sapiens
tatcttgtgtatg

SEQ ID NO: 1313021 - DNA, 23 bp, Homo sapiens
tatgataaaaaagtgtcctataa

SEQ ID NO: 1313022 - DNA, 15 bp, Homo sapiens
tatgggcattgacaa

SEQ ID NO: 1313023 - DNA, 15 bp, Homo sapiens
tatgtagatatttgg

SEQ ID NO: 1313024 - DNA, 22 bp, Homo sapiens
tatgtagatatttggcttaaat

SEQ ID NO: 1313025 - DNA, 23 bp, Homo sapiens
tatgtagatatttggcttaaata

SEQ ID NO: 1313026 - DNA, 20 bp, Homo sapiens
tattcaagaaagatatctat

SEQ ID NO: 1313027 - DNA, 21 bp, Homo sapiens
tattcaagaaagatatctatg

SEQ ID NO: 1313028 - DNA, 20 bp, Homo sapiens
tattgaattattttgttact

SEQ ID NO: 1313029 - DNA, 19 bp, Homo sapiens
tatttattgaattattttg

SEQ ID NO: 1313030 - DNA, 17 bp, Homo sapiens
tatttggcagtttggta

SEQ ID NO: 1313031 - DNA, 16 bp, Homo sapiens
tattttgttactgtct

SEQ ID NO: 1313032 - DNA, 18 bp, Homo sapiens
tattttgttactgtctgt

SEQ ID NO: 1313033 - DNA, 21 bp, Homo sapiens
tcaaaaattgaagagagatat

SEQ ID NO: 1313034 - DNA, 15 bp, Homo sapiens
tcaacaaagaaatat

SEQ ID NO: 1313035 - DNA, 23 bp, Homo sapiens
tcaacataacccacttgtcactg

SEQ ID NO: 1313036 - DNA, 22 bp, Homo sapiens
tcaatgttcacgcaacttgaaa

SEQ ID NO: 1313037 - DNA, 17 bp, Homo sapiens
tcacccttaacccaagg

SEQ ID NO: 1313038 - DNA, 18 bp, Homo sapiens
tcacccttaacccaagga

SEQ ID NO: 1313039 - DNA, 19 bp, Homo sapiens
tcacccttaacccaaggag

SEQ ID NO: 1313040 - DNA, 15 bp, Homo sapiens
tcacctagagccaga

SEQ ID NO: 1313041 - DNA, 23 bp, Homo sapiens
tcacctctacccaaaccctaggt

SEQ ID NO: 1313042 - DNA, 15 bp, Homo sapiens
tcacgcaacttgaaa

SEQ ID NO: 1313043 - DNA, 17 bp, Homo sapiens
tcactgacacaaaggaa

SEQ ID NO: 1313044 - DNA, 13 bp, Homo sapiens
tcagagcaggacc

SEQ ID NO: 1313045 - DNA, 19 bp, Homo sapiens
tcagcggcgaccgccctcc

SEQ ID NO: 1313046 - DNA, 22 bp, Homo sapiens
tcagtacttgtgaaacacagct

SEQ ID NO: 1313047 - DNA, 20 bp, Homo sapiens
tcagtctttttctgttgtaa

SEQ ID NO: 1313048 - DNA, 16 bp, Homo sapiens
tcattaaatgtttgac

SEQ ID NO: 1313049 - DNA, 13 bp, Homo sapiens
tcattagctgtga

SEQ ID NO: 1313050 - DNA, 19 bp, Homo sapiens
tcatttcctctgagctgtt

SEQ ID NO: 1313051 - DNA, 15 bp, Homo sapiens
tccaagctccctgcc

SEQ ID NO: 1313052 - DNA, 18 bp, Homo sapiens
tccaagctccctgcccca

SEQ ID NO: 1313053 - DNA, 15 bp, Homo sapiens
tccaccgctgctcca

SEQ ID NO: 1313054 - DNA, 17 bp, Homo sapiens
tccacgcgcttcgactt

SEQ ID NO: 1313055 - DNA, 14 bp, Homo sapiens
tccagcccgggagc

SEQ ID NO: 1313056 - DNA, 18 bp, Homo sapiens
tccagcccgggagcctag

SEQ ID NO: 1313057 - DNA, 20 bp, Homo sapiens
tccagcccgggagcctagga

SEQ ID NO: 1313058 - DNA, 20 bp, Homo sapiens
tccagctcagaacccagggc

SEQ ID NO: 1313059 - DNA, 14 bp, Homo sapiens
tcccagaggtccag

SEQ ID NO: 1313060 - DNA, 23 bp, Homo sapiens
tcccagaggtccagcccatctcg

SEQ ID NO: 1313061 - DNA, 19 bp, Homo sapiens
tcccagcttgtaggagctg

SEQ ID NO: 1313062 - DNA, 12 bp, Homo sapiens
tcccccaactct

SEQ ID NO: 1313063 - DNA, 17 bp, Homo sapiens
tcccccaactctgagcc

SEQ ID NO: 1313064 - DNA, 17 bp, Homo sapiens
tccccggcaccctctgg

SEQ ID NO: 1313065 - DNA, 18 bp, Homo sapiens
tccccggcaccctctggc

SEQ ID NO: 1313066 - DNA, 19 bp, Homo sapiens
tccccggcaccctctggcc

SEQ ID NO: 1313067 - DNA, 16 bp, Homo sapiens
tcccgagtacagtctg

SEQ ID NO: 1313068 - DNA, 18 bp, Homo sapiens
tcccgagtacagtctgta

SEQ ID NO: 1313069 - DNA, 12 bp, Homo sapiens
tcccgagtctgg

SEQ ID NO: 1313070 - DNA, 22 bp, Homo sapiens
tccctcctgcccgccacacaga

SEQ ID NO: 1313071 - DNA, 22 bp, Homo sapiens
tcccttccgaccctctgggaac

SEQ ID NO: 1313072 - DNA, 11 bp, Homo sapiens
tccgcccccag

SEQ ID NO: 1313073 - DNA, 19 bp, Homo sapiens
tccgcccttagtcccccaa

SEQ ID NO: 1313074 - DNA, 12 bp, Homo sapiens
tccgcgaaaata

SEQ ID NO: 1313075 - DNA, 13 bp, Homo sapiens
tcctaagaagctt

SEQ ID NO: 1313076 - DNA, 15 bp, Homo sapiens
tcctaagaagcttct

SEQ ID NO: 1313077 - DNA, 16 bp, Homo sapiens
tcctaagaagcttcta

SEQ ID NO: 1313078 - DNA, 18 bp, Homo sapiens
tcctaattaccagtcttt

SEQ ID NO: 1313079 - DNA, 22 bp, Homo sapiens
tcctcctcggaaccgctcacct

SEQ ID NO: 1313080 - DNA, 23 bp, Homo sapiens
tcctcctcggaaccgctcaccta

SEQ ID NO: 1313081 - DNA, 16 bp, Homo sapiens
tcctctgagctgttat

SEQ ID NO: 1313082 - DNA, 21 bp, Homo sapiens
tcctctgagctgttatcttgt

SEQ ID NO: 1313083 - DNA, 22 bp, Homo sapiens
tcctgacgaaactggccccgga

SEQ ID NO: 1313084 - DNA, 13 bp, Homo sapiens
tcctgagccccgc

SEQ ID NO: 1313085 - DNA, 22 bp, Homo sapiens
tcctgagccccgccctcttcct

SEQ ID NO: 1313086 - DNA, 23 bp, Homo sapiens
tcctgagccccgccctcttcctg

SEQ ID NO: 1313087 - DNA, 14 bp, Homo sapiens
tcctgctccagaat

SEQ ID NO: 1313088 - DNA, 17 bp, Homo sapiens
tccttcgtatcccgagt

SEQ ID NO: 1313089 - DNA, 23 bp, Homo sapiens
tcggaccgcttgtggggacccag

SEQ ID NO: 1313090 - DNA, 21 bp, Homo sapiens
tcggagcatcccggaggaaat

SEQ ID NO: 1313091 - DNA, 13 bp, Homo sapiens
tctaataaattat

SEQ ID NO: 1313092 - DNA, 16 bp, Homo sapiens
tctacccaaaccctag

SEQ ID NO: 1313093 - DNA, 23 bp, Homo sapiens
tctatcctgttaacactgtaata

SEQ ID NO: 1313094 - DNA, 20 bp, Homo sapiens
tctccagctcagaacccagg

SEQ ID NO: 1313095 - DNA, 21 bp, Homo sapiens
tctccagctcagaacccaggg

SEQ ID NO: 1313096 - DNA, 22 bp, Homo sapiens
tctccagctcagaacccagggc

SEQ ID NO: 1313097 - DNA, 15 bp, Homo sapiens
tctcccagaatccca

SEQ ID NO: 1313098 - DNA, 18 bp, Homo sapiens
tctcccagaatcccagcc

SEQ ID NO: 1313099 - DNA, 18 bp, Homo sapiens
tctccttcgtatcccgag

SEQ ID NO: 1313100 - DNA, 19 bp, Homo sapiens
tctccttcgtatcccgagt

SEQ ID NO: 1313101 - DNA, 13 bp, Homo sapiens
tctcttcagtgtg

SEQ ID NO: 1313102 - DNA, 11 bp, Homo sapiens
tctcttcctgt

SEQ ID NO: 1313103 - DNA, 12 bp, Homo sapiens
tctgagcccatg

SEQ ID NO: 1313104 - DNA, 14 bp, Homo sapiens
tctgagctgttatc

SEQ ID NO: 1313105 - DNA, 14 bp, Homo sapiens
tctgcccccagccc

SEQ ID NO: 1313106 - DNA, 14 bp, Homo sapiens
tctggactctaaag

SEQ ID NO: 1313107 - DNA, 15 bp, Homo sapiens
tctggactctaaaga

SEQ ID NO: 1313108 - DNA, 18 bp, Homo sapiens
tctggactctaaagacca

SEQ ID NO: 1313109 - DNA, 20 bp, Homo sapiens
tctggactctaaagaccaaa

SEQ ID NO: 1313110 - DNA, 17 bp, Homo sapiens
tctgggaacctcccaga

SEQ ID NO: 1313111 - DNA, 22 bp, Homo sapiens
tctgtacattttgttgtaaaaa

SEQ ID NO: 1313112 - DNA, 21 bp, Homo sapiens
tctgtggcttcccatgtcttt

SEQ ID NO: 1313113 - DNA, 19 bp, Homo sapiens
tctgtgtatattatttggc

SEQ ID NO: 1313114 - DNA, 18 bp, Homo sapiens
tcttcctgttttgtacat

SEQ ID NO: 1313115 - DNA, 21 bp, Homo sapiens
tcttctcccagaatcccagcc

SEQ ID NO: 1313116 - DNA, 22 bp, Homo sapiens
tcttctcccagaatcccagccg

SEQ ID NO: 1313117 - DNA, 22 bp, Homo sapiens
tctttaaaggcccagcccctag

SEQ ID NO: 1313118 - DNA, 21 bp, Homo sapiens
tctttctccaaagttatccag

SEQ ID NO: 1313119 - DNA, 14 bp, Homo sapiens
tctttttctgttgt

SEQ ID NO: 1313120 - DNA, 17 bp, Homo sapiens
tctttttctgttgtaac

SEQ ID NO: 1313121 - DNA, 13 bp, Homo sapiens
tgaaaactggaat

SEQ ID NO: 1313122 - DNA, 18 bp, Homo sapiens
tgaaacacagctgttctt

SEQ ID NO: 1313123 - DNA, 21 bp, Homo sapiens
tgaaacacagctgttcttctg

SEQ ID NO: 1313124 - DNA, 13 bp, Homo sapiens
tgaaagacaccat

SEQ ID NO: 1313125 - DNA, 23 bp, Homo sapiens
tgaaagtttttaatatttattga

SEQ ID NO: 1313126 - DNA, 18 bp, Homo sapiens
tgaacttgtagctgtaaa

SEQ ID NO: 1313127 - DNA, 21 bp, Homo sapiens
tgaacttgtagctgtaaaacg

SEQ ID NO: 1313128 - DNA, 21 bp, Homo sapiens
tgaagagagatatatctgaaa

SEQ ID NO: 1313129 - DNA, 18 bp, Homo sapiens
tgaagcattctccccagt

SEQ ID NO: 1313130 - DNA, 15 bp, Homo sapiens
tgacaaatctgtgta

SEQ ID NO: 1313131 - DNA, 23 bp, Homo sapiens
tgacaagagcctgatctcttcct

SEQ ID NO: 1313132 - DNA, 14 bp, Homo sapiens
tgacacaaaggaag

SEQ ID NO: 1313133 - DNA, 18 bp, Homo sapiens
tgacgaaactggccccgg

SEQ ID NO: 1313134 - DNA, 16 bp, Homo sapiens
tgactgtgctactgtc

SEQ ID NO: 1313135 - DNA, 20 bp, Homo sapiens
tgacttctatcctgttaaca

SEQ ID NO: 1313136 - DNA, 14 bp, Homo sapiens
tgagcatcctgagc

SEQ ID NO: 1313137 - DNA, 17 bp, Homo sapiens
tgagcatcctgagcccc

SEQ ID NO: 1313138 - DNA, 20 bp, Homo sapiens
tgagccccgccctcttcctg

SEQ ID NO: 1313139 - DNA, 13 bp, Homo sapiens
tgattcaaatggg

SEQ ID NO: 1313140 - DNA, 13 bp, Homo sapiens
tgatttcccctct

SEQ ID NO: 1313141 - DNA, 19 bp, Homo sapiens
tgatttttgttgattaaaa

SEQ ID NO: 1313142 - DNA, 21 bp, Homo sapiens
tgcagacacgccttcccctca

SEQ ID NO: 1313143 - DNA, 12 bp, Homo sapiens
tgcaggaatcaa

SEQ ID NO: 1313144 - DNA, 15 bp, Homo sapiens
tgcaggaatcaaaaa

SEQ ID NO: 1313145 - DNA, 21 bp, Homo sapiens
tgcaggaatcaaaaattgaag

SEQ ID NO: 1313146 - DNA, 16 bp, Homo sapiens
tgcagtcatcagaagt

SEQ ID NO: 1313147 - DNA, 15 bp, Homo sapiens
tgcatgacttgtagc

SEQ ID NO: 1313148 - DNA, 13 bp, Homo sapiens
tgcctagttttta

SEQ ID NO: 1313149 - DNA, 24 bp, Homo sapiens
tgccttcatggaactcagctgtct

SEQ ID NO: 1313150 - DNA, 18 bp, Homo sapiens
tgctccacgcgcttcgac

SEQ ID NO: 1313151 - DNA, 14 bp, Homo sapiens
tgctccagaatttg

SEQ ID NO: 1313152 - DNA, 16 bp, Homo sapiens
tgctgatttcccctct

SEQ ID NO: 1313153 - DNA, 16 bp, Homo sapiens
tgctggacgtctttct

SEQ ID NO: 1313154 - DNA, 14 bp, Homo sapiens
tggaaaaatgtttg

SEQ ID NO: 1313155 - DNA, 19 bp, Homo sapiens
tggaaatcctagtttcctc

SEQ ID NO: 1313156 - DNA, 17 bp, Homo sapiens
tggactctaaagaccaa

SEQ ID NO: 1313157 - DNA, 19 bp, Homo sapiens
tggagagggctctgtgctg

SEQ ID NO: 1313158 - DNA, 18 bp, Homo sapiens
tggatatgtgtaaatgtt

SEQ ID NO: 1313159 - DNA, 19 bp, Homo sapiens
tggatatgtgtaaatgtta

SEQ ID NO: 1313160 - DNA, 13 bp, Homo sapiens
tggcattgttgat

SEQ ID NO: 1313161 - DNA, 22 bp, Homo sapiens
tggctgtggcattgttgatgct

SEQ ID NO: 1313162 - DNA, 19 bp, Homo sapiens
tgggaacctcccagaggtc

SEQ ID NO: 1313163 - DNA, 19 bp, Homo sapiens
tgggcattgacaaatctgt

SEQ ID NO: 1313164 - DNA, 23 bp, Homo sapiens
tgggcattgacaaatctgtgtat

SEQ ID NO: 1313165 - DNA, 13 bp, Homo sapiens
tgtaaaaagaaaa

SEQ ID NO: 1313166 - DNA, 19 bp, Homo sapiens
tgtaaataccaggattttt

SEQ ID NO: 1313167 - DNA, 13 bp, Homo sapiens
tgtaacttatgta

SEQ ID NO: 1313168 - DNA, 17 bp, Homo sapiens
tgtaacttatgtagata

SEQ ID NO: 1313169 - DNA, 21 bp, Homo sapiens
tgtaatatctttaaatgatgt

SEQ ID NO: 1313170 - DNA, 23 bp, Homo sapiens
tgtaatatctttaaatgatgtac

SEQ ID NO: 1313171 - DNA, 16 bp, Homo sapiens
tgtacattttgttgta

SEQ ID NO: 1313172 - DNA, 14 bp, Homo sapiens
tgtagatatttggc

SEQ ID NO: 1313173 - DNA, 15 bp, Homo sapiens
tgtagatatttggct

SEQ ID NO: 1313174 - DNA, 22 bp, Homo sapiens
tgtagatatttggcttaaatat

SEQ ID NO: 1313175 - DNA, 14 bp, Homo sapiens
tgtagctgtaaaac

SEQ ID NO: 1313176 - DNA, 18 bp, Homo sapiens
tgtagctgtaaaacgctg

SEQ ID NO: 1313177 - DNA, 17 bp, Homo sapiens
tgtatcaaacccacgat

SEQ ID NO: 1313178 - DNA, 15 bp, Homo sapiens
tgtatggatatgtgt

SEQ ID NO: 1313179 - DNA, 17 bp, Homo sapiens
tgtatggatatgtgtaa

SEQ ID NO: 1313180 - DNA, 19 bp, Homo sapiens
tgtcactgacacaaaggaa

SEQ ID NO: 1313181 - DNA, 15 bp, Homo sapiens
tgtctcagttggaaa

SEQ ID NO: 1313182 - DNA, 16 bp, Homo sapiens
tgtctcagttggaaat

SEQ ID NO: 1313183 - DNA, 22 bp, Homo sapiens
tgtctttaatttctgtcagaat

SEQ ID NO: 1313184 - DNA, 17 bp, Homo sapiens
tgtctttctccaaagtt

SEQ ID NO: 1313185 - DNA, 21 bp, Homo sapiens
tgtctttggaaaaatgtttgt

SEQ ID NO: 1313186 - DNA, 13 bp, Homo sapiens
tgtcttttgtcat

SEQ ID NO: 1313187 - DNA, 16 bp, Homo sapiens
tgtgaaacacagctgt

SEQ ID NO: 1313188 - DNA, 17 bp, Homo sapiens
tgtgaaacacagctgtt

SEQ ID NO: 1313189 - DNA, 15 bp, Homo sapiens
tgtggagtactggac

SEQ ID NO: 1313190 - DNA, 17 bp, Homo sapiens
tgtggggacccaggctc

SEQ ID NO: 1313191 - DNA, 14 bp, Homo sapiens
tgtgtaaatgttat

SEQ ID NO: 1313192 - DNA, 15 bp, Homo sapiens
tgtgtatattatttg

SEQ ID NO: 1313193 - DNA, 18 bp, Homo sapiens
tgtgtatattatttggca

SEQ ID NO: 1313194 - DNA, 19 bp, Homo sapiens
tgttaacactgtaatatct

SEQ ID NO: 1313195 - DNA, 13 bp, Homo sapiens
tgttactgtctgt

SEQ ID NO: 1313196 - DNA, 17 bp, Homo sapiens
tgttcacgcaacttgaa

SEQ ID NO: 1313197 - DNA, 13 bp, Homo sapiens
tgttgattaaaac

SEQ ID NO: 1313198 - DNA, 14 bp, Homo sapiens
tgttgattaaaaca

SEQ ID NO: 1313199 - DNA, 13 bp, Homo sapiens
tgttgtaaaaaga

SEQ ID NO: 1313200 - DNA, 14 bp, Homo sapiens
tgttgtaaaaagaa

SEQ ID NO: 1313201 - DNA, 12 bp, Homo sapiens
tgttgtaactta

SEQ ID NO: 1313202 - DNA, 13 bp, Homo sapiens
tgttgtaacttat

SEQ ID NO: 1313203 - DNA, 19 bp, Homo sapiens
tgttgtaacttatgtagat

SEQ ID NO: 1313204 - DNA, 14 bp, Homo sapiens
tgtttaatagtata

SEQ ID NO: 1313205 - DNA, 18 bp, Homo sapiens
tgtttaatagtatatcta

SEQ ID NO: 1313206 - DNA, 15 bp, Homo sapiens
tgtttaatgtgaact

SEQ ID NO: 1313207 - DNA, 19 bp, Homo sapiens
ttaacatgcttatgacaat

SEQ ID NO: 1313208 - DNA, 13 bp, Homo sapiens
ttaacccaaggag

SEQ ID NO: 1313209 - DNA, 21 bp, Homo sapiens
ttactattcattaaatgtttg

SEQ ID NO: 1313210 - DNA, 18 bp, Homo sapiens
ttactcagggctcctccc

SEQ ID NO: 1313211 - DNA, 12 bp, Homo sapiens
ttagaccaagga

SEQ ID NO: 1313212 - DNA, 22 bp, Homo sapiens
ttaggagtgggtgacaagagcc

SEQ ID NO: 1313213 - DNA, 15 bp, Homo sapiens
ttagtaatctgtaca

SEQ ID NO: 1313214 - DNA, 22 bp, Homo sapiens
ttagtcccccaactctgagccc

SEQ ID NO: 1313215 - DNA, 23 bp, Homo sapiens
ttatctacccaagggcagaaagt

SEQ ID NO: 1313216 - DNA, 14 bp, Homo sapiens
ttatcttgtgtatg

SEQ ID NO: 1313217 - DNA, 16 bp, Homo sapiens
ttatcttgtgtatgga

SEQ ID NO: 1313218 - DNA, 22 bp, Homo sapiens
ttatgggcattgacaaatctgt

SEQ ID NO: 1313219 - DNA, 22 bp, Homo sapiens
ttatttggcagtttggtatttg

SEQ ID NO: 1313220 - DNA, 19 bp, Homo sapiens
ttattttgttactgtctgt

SEQ ID NO: 1313221 - DNA, 18 bp, Homo sapiens
ttcaagaaagatatctat

SEQ ID NO: 1313222 - DNA, 20 bp, Homo sapiens
ttcaagaaagatatctatga

SEQ ID NO: 1313223 - DNA, 24 bp, Homo sapiens
ttcaagaaagatatctatgactgt

SEQ ID NO: 1313224 - DNA, 18 bp, Homo sapiens
ttcacccttaacccaagg

SEQ ID NO: 1313225 - DNA, 14 bp, Homo sapiens
ttcacgcaacttga

SEQ ID NO: 1313226 - DNA, 18 bp, Homo sapiens
ttcagtcctgctccagaa

SEQ ID NO: 1313227 - DNA, 10 bp, Homo sapiens
ttcagttcca

SEQ ID NO: 1313228 - DNA, 15 bp, Homo sapiens
ttcattaaatgtttg

SEQ ID NO: 1313229 - DNA, 22 bp, Homo sapiens
ttcatttcctctgagctgttat

SEQ ID NO: 1313230 - DNA, 19 bp, Homo sapiens
ttcccctcttcccttcaac

SEQ ID NO: 1313231 - DNA, 15 bp, Homo sapiens
ttcccggtcccgagt

SEQ ID NO: 1313232 - DNA, 18 bp, Homo sapiens
ttccgaccctctgggaac

SEQ ID NO: 1313233 - DNA, 21 bp, Homo sapiens
ttccgcacttcagaattccat

SEQ ID NO: 1313234 - DNA, 22 bp, Homo sapiens
ttcctctccttcgtatcccgag

SEQ ID NO: 1313235 - DNA, 16 bp, Homo sapiens
ttctaataaattatac

SEQ ID NO: 1313236 - DNA, 18 bp, Homo sapiens
ttctaataaattatacaa

SEQ ID NO: 1313237 - DNA, 17 bp, Homo sapiens
ttctcccagaatcccag

SEQ ID NO: 1313238 - DNA, 13 bp, Homo sapiens
ttctgttgtaact

SEQ ID NO: 1313239 - DNA, 16 bp, Homo sapiens
ttcttaacaacctggc

SEQ ID NO: 1313240 - DNA, 16 bp, Homo sapiens
ttcttctgttctgcag

SEQ ID NO: 1313241 - DNA, 18 bp, Homo sapiens
ttcttgcagtcatcagaa

SEQ ID NO: 1313242 - DNA, 12 bp, Homo sapiens
ttctttttctga

SEQ ID NO: 1313243 - DNA, 19 bp, Homo sapiens
ttgaaattatatctgtggt

SEQ ID NO: 1313244 - DNA, 14 bp, Homo sapiens
ttgacaaatctgtg

SEQ ID NO: 1313245 - DNA, 22 bp, Homo sapiens
ttgacaaatctgtgtatattat

SEQ ID NO: 1313246 - DNA, 16 bp, Homo sapiens
ttgacacaattggaat

SEQ ID NO: 1313247 - DNA, 22 bp, Homo sapiens
ttggaaatcctagtttcctctc

SEQ ID NO: 1313248 - DNA, 24 bp, Homo sapiens
ttggaaatcctagtttcctctcct

SEQ ID NO: 1313249 - DNA, 15 bp, Homo sapiens
ttggaattgtcttta

SEQ ID NO: 1313250 - DNA, 17 bp, Homo sapiens
ttggactaaatgcctag

SEQ ID NO: 1313251 - DNA, 15 bp, Homo sapiens
ttggtgattcaaatg

SEQ ID NO: 1313252 - DNA, 17 bp, Homo sapiens
ttgtaacttatgtagat

SEQ ID NO: 1313253 - DNA, 20 bp, Homo sapiens
ttgtaggagctgaggtttca

SEQ ID NO: 1313254 - DNA, 13 bp, Homo sapiens
ttgtcatgtggct

SEQ ID NO: 1313255 - DNA, 14 bp, Homo sapiens
ttgttactgtctgt

SEQ ID NO: 1313256 - DNA, 19 bp, Homo sapiens
ttgttactgtctgtagtgt

SEQ ID NO: 1313257 - DNA, 21 bp, Homo sapiens
ttgttactgtctgtagtgttt

SEQ ID NO: 1313258 - DNA, 21 bp, Homo sapiens
ttgttgatgctcacatatgat

SEQ ID NO: 1313259 - DNA, 17 bp, Homo sapiens
ttgttgtaaaaagaaaa

SEQ ID NO: 1313260 - DNA, 20 bp, Homo sapiens
ttgtttaatgtgaacttgta

SEQ ID NO: 1313261 - DNA, 19 bp, Homo sapiens
ttgttttttccccttgcct

SEQ ID NO: 1313262 - DNA, 13 bp, Homo sapiens
tttaaaaaaagaa

SEQ ID NO: 1313263 - DNA, 17 bp, Homo sapiens
tttaatgtgaacttgta

SEQ ID NO: 1313264 - DNA, 13 bp, Homo sapiens
tttagaccaagga

SEQ ID NO: 1313265 - DNA, 22 bp, Homo sapiens
tttatctacccaagggcagaaa

SEQ ID NO: 1313266 - DNA, 16 bp, Homo sapiens
tttattcattagctgt

SEQ ID NO: 1313267 - DNA, 23 bp, Homo sapiens
tttattgaattattttgttactg

SEQ ID NO: 1313268 - DNA, 22 bp, Homo sapiens
tttcacccttaacccaaggagc

SEQ ID NO: 1313269 - DNA, 13 bp, Homo sapiens
tttcagttccaag

SEQ ID NO: 1313270 - DNA, 15 bp, Homo sapiens
tttcctctgagctgt

SEQ ID NO: 1313271 - DNA, 20 bp, Homo sapiens
tttcctctgagctgttatct

SEQ ID NO: 1313272 - DNA, 21 bp, Homo sapiens
tttctccagctcagaacccag

SEQ ID NO: 1313273 - DNA, 14 bp, Homo sapiens
tttctgtcagaatg

SEQ ID NO: 1313274 - DNA, 15 bp, Homo sapiens
tttctgttgtaactt

SEQ ID NO: 1313275 - DNA, 23 bp, Homo sapiens
tttctgttgtaacttatgtagat

SEQ ID NO: 1313276 - DNA, 14 bp, Homo sapiens
tttgctaattaaaa

SEQ ID NO: 1313277 - DNA, 19 bp, Homo sapiens
tttgctaattaaaaagtta

SEQ ID NO: 1313278 - DNA, 11 bp, Homo sapiens
tttggaaatcc

SEQ ID NO: 1313279 - DNA, 16 bp, Homo sapiens
tttggcttaaatatag

SEQ ID NO: 1313280 - DNA, 22 bp, Homo sapiens
tttgttactgtctgtagtgttt

SEQ ID NO: 1313281 - DNA, 13 bp, Homo sapiens
ttttaaaaaaaga

SEQ ID NO: 1313282 - DNA, 18 bp, Homo sapiens
ttttagtaatctgtacat

SEQ ID NO: 1313283 - DNA, 20 bp, Homo sapiens
ttttccagggcaatcaatgt

SEQ ID NO: 1313284 - DNA, 12 bp, Homo sapiens
ttttctccagct

SEQ ID NO: 1313285 - DNA, 13 bp, Homo sapiens
ttttctgttgtaa

SEQ ID NO: 1313286 - DNA, 17 bp, Homo sapiens
ttttggtgattcaaatg

SEQ ID NO: 1313287 - DNA, 15 bp, Homo sapiens
ttttgttgattaaaa

SEQ ID NO: 1313288 - DNA, 19 bp, Homo sapiens
ttttgttgattaaaacatt

SEQ ID NO: 1313289 - DNA, 15 bp, Homo sapiens
tttttaaaaaaagaa

SEQ ID NO: 1313290 - DNA, 13 bp, Homo sapiens
tttttagtaatct

SEQ ID NO: 1313291 - DNA, 18 bp, Homo sapiens
tttttctgttgtaactta

SEQ ID NO: 1313292 - DNA, 19 bp, Homo sapiens
attttgttgtaaaaagaaa

SEQ ID NO: 1313293 - DNA, 22 bp, Homo sapiens
attttttatgggcattgacaaa

SEQ ID NO: 1313294 - DNA, 22 bp, Homo sapiens
caaaaaaaccacaaaggccaaa

SEQ ID NO: 1313295 - DNA, 18 bp, Homo sapiens
caaaactccgcccccagc

SEQ ID NO: 1313296 - DNA, 21 bp, Homo sapiens
caaaactccgcccccagccta

SEQ ID NO: 1313297 - DNA, 18 bp, Homo sapiens
caaaagttggactaaatg

SEQ ID NO: 1313298 - DNA, 23 bp, Homo sapiens
caaacccacgattttctccagct

SEQ ID NO: 1313299 - DNA, 22 bp, Homo sapiens
caaactgctggacgtctttctt

SEQ ID NO: 1313300 - DNA, 17 bp, Homo sapiens
caaacttcactctgggc

SEQ ID NO: 1313301 - DNA, 15 bp, Homo sapiens
caaaggggacaggcc

SEQ ID NO: 1313302 - DNA, 17 bp, Homo sapiens
caaataacttcagtcct

SEQ ID NO: 1313303 - DNA, 23 bp, Homo sapiens
caaataacttcagtcctgctcca

SEQ ID NO: 1313304 - DNA, 15 bp, Homo sapiens
caaatctgtgtatat

SEQ ID NO: 1313305 - DNA, 18 bp, Homo sapiens
caaatctgtgtatattat

SEQ ID NO: 1313306 - DNA, 18 bp, Homo sapiens
caaatgggttttccacgc

SEQ ID NO: 1313307 - DNA, 15 bp, Homo sapiens
caaattaaaaagatt

SEQ ID NO: 1313308 - DNA, 18 bp, Homo sapiens
caaattaaaaagattctt

SEQ ID NO: 1313309 - DNA, 21 bp, Homo sapiens
caaattaaaaagattcttttt

SEQ ID NO: 1313310 - DNA, 22 bp, Homo sapiens
caaattaaaaagattctttttc

SEQ ID NO: 1313311 - DNA, 23 bp, Homo sapiens
caaattaaaaagattctttttct

SEQ ID NO: 1313312 - DNA, 14 bp, Homo sapiens
caactctgagccca

SEQ ID NO: 1313313 - DNA, 22 bp, Homo sapiens
caagaaagatatctatgactgt

SEQ ID NO: 1313314 - DNA, 16 bp, Homo sapiens
caagagcctgatctct

SEQ ID NO: 1313315 - DNA, 22 bp, Homo sapiens
caagagcctgatctcttcctgt

SEQ ID NO: 1313316 - DNA, 13 bp, Homo sapiens
caagctccctgcc

SEQ ID NO: 1313317 - DNA, 16 bp, Homo sapiens
caagctccctgcccca

SEQ ID NO: 1313318 - DNA, 19 bp, Homo sapiens
caagctcctcctcggaacc

SEQ ID NO: 1313319 - DNA, 16 bp, Homo sapiens
caaggaacaaaaaaac

SEQ ID NO: 1313320 - DNA, 18 bp, Homo sapiens
caaggaacaaaaaaacca

SEQ ID NO: 1313321 - DNA, 14 bp, Homo sapiens
caatctcaaggaat

SEQ ID NO: 1313322 - DNA, 18 bp, Homo sapiens
caatctcaaggaatcttt

SEQ ID NO: 1313323 - DNA, 20 bp, Homo sapiens
caatctcaaggaatctttaa

SEQ ID NO: 1313324 - DNA, 20 bp, Homo sapiens
caatgactgtgctactgtct

SEQ ID NO: 1313325 - DNA, 17 bp, Homo sapiens
caatggaaacctcacgc

SEQ ID NO: 1313326 - DNA, 19 bp, Homo sapiens
cacaaaggccaaactgctg

SEQ ID NO: 1313327 - DNA, 21 bp, Homo sapiens
cacaagcagagtgcacagctg

SEQ ID NO: 1313328 - DNA, 23 bp, Homo sapiens
cacacccaggcacttaagcacaa

SEQ ID NO: 1313329 - DNA, 12 bp, Homo sapiens
cacaggtcccac

SEQ ID NO: 1313330 - DNA, 19 bp, Homo sapiens
cacaggtcccacctccagc

SEQ ID NO: 1313331 - DNA, 21 bp, Homo sapiens
cacaggtcccacctccagccc

SEQ ID NO: 1313332 - DNA, 17 bp, Homo sapiens
cacccttaacccaagga

SEQ ID NO: 1313333 - DNA, 18 bp, Homo sapiens
cacccttaacccaaggag

SEQ ID NO: 1313334 - DNA, 18 bp, Homo sapiens
cacctctacccaaaccct

SEQ ID NO: 1313335 - DNA, 21 bp, Homo sapiens
cacctctacccaaaccctagg

SEQ ID NO: 1313336 - DNA, 13 bp, Homo sapiens
cacgcaacttgaa

SEQ ID NO: 1313337 - DNA, 12 bp, Homo sapiens
cactcagcccct

SEQ ID NO: 1313338 - DNA, 22 bp, Homo sapiens
cactcagcccctaggagtatat

SEQ ID NO: 1313339 - DNA, 20 bp, Homo sapiens
cactctgccagcaaagagga

SEQ ID NO: 1313340 - DNA, 22 bp, Homo sapiens
cacttgtcactgacacaaagga

SEQ ID NO: 1313341 - DNA, 13 bp, Homo sapiens
cagaacccagggc

SEQ ID NO: 1313342 - DNA, 18 bp, Homo sapiens
cagaacccagggctctgc

SEQ ID NO: 1313343 - DNA, 19 bp, Homo sapiens
cagaacccagggctctgcc

SEQ ID NO: 1313344 - DNA, 20 bp, Homo sapiens
cagaacccagggctctgccc

SEQ ID NO: 1313345 - DNA, 22 bp, Homo sapiens
cagaacccagggctctgcccca

SEQ ID NO: 1313346 - DNA, 16 bp, Homo sapiens
cagaatttggaaatcc

SEQ ID NO: 1313347 - DNA, 22 bp, Homo sapiens
cagagaagggcataaaacagct

SEQ ID NO: 1313348 - DNA, 12 bp, Homo sapiens
cagagcaggacc

SEQ ID NO: 1313349 - DNA, 16 bp, Homo sapiens
cagagtgcacagctgt

SEQ ID NO: 1313350 - DNA, 20 bp, Homo sapiens
cagcaaagaggactcgcttg

SEQ ID NO: 1313351 - DNA, 15 bp, Homo sapiens
cagccacacccaggc

SEQ ID NO: 1313352 - DNA, 21 bp, Homo sapiens
cagcccaaaggggacaggcct

SEQ ID NO: 1313353 - DNA, 23 bp, Homo sapiens
cagcccaaaggggacaggcctca

SEQ ID NO: 1313354 - DNA, 16 bp, Homo sapiens
cagcccctagaaaccc

SEQ ID NO: 1313355 - DNA, 16 bp, Homo sapiens
cagccggccaatggaa

SEQ ID NO: 1313356 - DNA, 19 bp, Homo sapiens
cagcctatgagcatcctga

SEQ ID NO: 1313357 - DNA, 12 bp, Homo sapiens
cagctcagaacc

SEQ ID NO: 1313358 - DNA, 13 bp, Homo sapiens
cagctcagaaccc

SEQ ID NO: 1313359 - DNA, 14 bp, Homo sapiens
cagctcagaaccca

SEQ ID NO: 1313360 - DNA, 21 bp, Homo sapiens
cagctcagaacccagggctct

SEQ ID NO: 1313361 - DNA, 14 bp, Homo sapiens
cagctgtctgtggc

SEQ ID NO: 1313362 - DNA, 18 bp, Homo sapiens
caggaatcaaaaattgaa

SEQ ID NO: 1313363 - DNA, 21 bp, Homo sapiens
caggcctcacctctacccaaa

SEQ ID NO: 1313364 - DNA, 18 bp, Homo sapiens
caggctccgcccttagtc

SEQ ID NO: 1313365 - DNA, 17 bp, Homo sapiens
cagggctcctcccagct

SEQ ID NO: 1313366 - DNA, 18 bp, Homo sapiens
cagggctcctcccagctt

SEQ ID NO: 1313367 - DNA, 19 bp, Homo sapiens
cagggctcctcccagcttg

SEQ ID NO: 1313368 - DNA, 17 bp, Homo sapiens
cagggctctgccccagt

SEQ ID NO: 1313369 - DNA, 19 bp, Homo sapiens
cagtccccagcccttcaca

SEQ ID NO: 1313370 - DNA, 15 bp, Homo sapiens
cagtcgttagaatat

SEQ ID NO: 1313371 - DNA, 22 bp, Homo sapiens
cagtctttaaaggcccagcccc

SEQ ID NO: 1313372 - DNA, 19 bp, Homo sapiens
cagtctttttctgttgtaa

SEQ ID NO: 1313373 - DNA, 20 bp, Homo sapiens
cagtctttttctgttgtaac

SEQ ID NO: 1313374 - DNA, 15 bp, Homo sapiens
cagtgtgttgacttc

SEQ ID NO: 1313375 - DNA, 13 bp, Homo sapiens
cagttccaagaaa

SEQ ID NO: 1313376 - DNA, 21 bp, Homo sapiens
cagttggaaataataaaagat

SEQ ID NO: 1313377 - DNA, 18 bp, Homo sapiens
cataacccacttgtcact

SEQ ID NO: 1313378 - DNA, 16 bp, Homo sapiens
catcaacaaagaaata

SEQ ID NO: 1313379 - DNA, 15 bp, Homo sapiens
catcccggaggaaat

SEQ ID NO: 1313380 - DNA, 14 bp, Homo sapiens
catcctgagccccg

SEQ ID NO: 1313381 - DNA, 21 bp, Homo sapiens
catcctgagccccgccctctt

SEQ ID NO: 1313382 - DNA, 16 bp, Homo sapiens
catcctgccttcatgg

SEQ ID NO: 1313383 - DNA, 20 bp, Homo sapiens
catctcggagcatcccggag

SEQ ID NO: 1313384 - DNA, 21 bp, Homo sapiens
catctcggagcatcccggagg

SEQ ID NO: 1313385 - DNA, 21 bp, Homo sapiens
catggctctggactctaaaga

SEQ ID NO: 1313386 - DNA, 13 bp, Homo sapiens
catgttctgcccc

SEQ ID NO: 1313387 - DNA, 17 bp, Homo sapiens
catgttctgcccccagc

SEQ ID NO: 1313388 - DNA, 14 bp, Homo sapiens
cattaaatgtttga

SEQ ID NO: 1313389 - DNA, 23 bp, Homo sapiens
cattattcaagaaagatatctat

SEQ ID NO: 1313390 - DNA, 21 bp, Homo sapiens
cattgacaaatctgtgtatat

SEQ ID NO: 1313391 - DNA, 23 bp, Homo sapiens
cattgttgatgctcacatatgat

SEQ ID NO: 1313392 - DNA, 21 bp, Homo sapiens
catttctcttcagtgtgttga

SEQ ID NO: 1313393 - DNA, 12 bp, Homo sapiens
cattttgttgta

SEQ ID NO: 1313394 - DNA, 14 bp, Homo sapiens
cattttgttgtaaa

SEQ ID NO: 1313395 - DNA, 21 bp, Homo sapiens
cattttttatgggcattgaca

SEQ ID NO: 1313396 - DNA, 12 bp, Homo sapiens
ccaaaccctagg

SEQ ID NO: 1313397 - DNA, 13 bp, Homo sapiens
ccaaaccctaggt

SEQ ID NO: 1313398 - DNA, 13 bp, Homo sapiens
ccaaactgctgga

SEQ ID NO: 1313399 - DNA, 15 bp, Homo sapiens
ccaaataacttcagt

SEQ ID NO: 1313400 - DNA, 15 bp, Homo sapiens
ccaactctgagccca

SEQ ID NO: 1313401 - DNA, 22 bp, Homo sapiens
ccaagctccctgccccaaataa

SEQ ID NO: 1313402 - DNA, 20 bp, Homo sapiens
ccagcccgggagcctaggac

SEQ ID NO: 1313403 - DNA, 22 bp, Homo sapiens
ccagcctatgagcatcctgagc

SEQ ID NO: 1313404 - DNA, 13 bp, Homo sapiens
ccagcgctctgcc

SEQ ID NO: 1313405 - DNA, 17 bp, Homo sapiens
ccagctcagaacccagg

SEQ ID NO: 1313406 - DNA, 19 bp, Homo sapiens
ccagctcagaacccagggc

SEQ ID NO: 1313407 - DNA, 19 bp, Homo sapiens
ccagctgcaggaatcaaaa

SEQ ID NO: 1313408 - DNA, 18 bp, Homo sapiens
ccagggctctgccccagt

SEQ ID NO: 1313409 - DNA, 19 bp, Homo sapiens
ccagtctttaaaggcccag

SEQ ID NO: 1313410 - DNA, 14 bp, Homo sapiens
ccatatcttgcgaa

SEQ ID NO: 1313411 - DNA, 13 bp, Homo sapiens
ccatctcggagca

SEQ ID NO: 1313412 - DNA, 23 bp, Homo sapiens
ccatctcggagcatcccggagga

SEQ ID NO: 1313413 - DNA, 14 bp, Homo sapiens
ccatgttctgcccc

SEQ ID NO: 1313414 - DNA, 20 bp, Homo sapiens
ccatgttctgcccccagccc

SEQ ID NO: 1313415 - DNA, 20 bp, Homo sapiens
cccaaaggggacaggcctca

SEQ ID NO: 1313416 - DNA, 16 bp, Homo sapiens
cccaactctgagccca

SEQ ID NO: 1313417 - DNA, 14 bp, Homo sapiens
cccaagctcctcct

SEQ ID NO: 1313418 - DNA, 12 bp, Homo sapiens
cccacctccagc

SEQ ID NO: 1313419 - DNA, 20 bp, Homo sapiens
cccacgattttctccagctc

SEQ ID NO: 1313420 - DNA, 23 bp, Homo sapiens
cccacttgtcactgacacaaagg

SEQ ID NO: 1313421 - DNA, 16 bp, Homo sapiens
cccagaatcccagccg

SEQ ID NO: 1313422 - DNA, 16 bp, Homo sapiens
cccagaggtccagccc

SEQ ID NO: 1313423 - DNA, 14 bp, Homo sapiens
cccagcccctagaa

SEQ ID NO: 1313424 - DNA, 16 bp, Homo sapiens
cccagcccctagaaac

SEQ ID NO: 1313425 - DNA, 12 bp, Homo sapiens
cccagcctatga

SEQ ID NO: 1313426 - DNA, 15 bp, Homo sapiens
cccagcgctctgcct

SEQ ID NO: 1313427 - DNA, 17 bp, Homo sapiens
cccagcttgtaggagct

SEQ ID NO: 1313428 - DNA, 21 bp, Homo sapiens
cccaggctccgcccttagtcc

SEQ ID NO: 1313429 - DNA, 23 bp, Homo sapiens
cccaggctccgcccttagtcccc

SEQ ID NO: 1313430 - DNA, 18 bp, Homo sapiens
cccagggctctgccccag

SEQ ID NO: 1313431 - DNA, 14 bp, Homo sapiens
ccccagcctatgag

SEQ ID NO: 1313432 - DNA, 13 bp, Homo sapiens
ccccatgcagtct

SEQ ID NO: 1313433 - DNA, 20 bp, Homo sapiens
cccccagcctatgagcatcc

SEQ ID NO: 1313434 - DNA, 17 bp, Homo sapiens
ccccgccctcttcctga

SEQ ID NO: 1313435 - DNA, 19 bp, Homo sapiens
cccctagaaacccaagctc

SEQ ID NO: 1313436 - DNA, 18 bp, Homo sapiens
cccgagtctgggacacaa

SEQ ID NO: 1313437 - DNA, 14 bp, Homo sapiens
cccgccacacagac

SEQ ID NO: 1313438 - DNA, 15 bp, Homo sapiens
cccggaggaaatctg

SEQ ID NO: 1313439 - DNA, 22 bp, Homo sapiens
cccggaggaaatctgcagaggg

SEQ ID NO: 1313440 - DNA, 14 bp, Homo sapiens
cccggatcagagca

SEQ ID NO: 1313441 - DNA, 17 bp, Homo sapiens
cccggatcagagcagga

SEQ ID NO: 1313442 - DNA, 21 bp, Homo sapiens
cccggatcagagcaggacctc

SEQ ID NO: 1313443 - DNA, 16 bp, Homo sapiens
cccgggagcctaggac

SEQ ID NO: 1313444 - DNA, 17 bp, Homo sapiens
cccggtcccgagtacag

SEQ ID NO: 1313445 - DNA, 17 bp, Homo sapiens
ccctagaaacccaagct

SEQ ID NO: 1313446 - DNA, 19 bp, Homo sapiens
ccctagaaacccaagctcc

SEQ ID NO: 1313447 - DNA, 21 bp, Homo sapiens
ccctaggagtatatttccgca

SEQ ID NO: 1313448 - DNA, 12 bp, Homo sapiens
ccctctgggaac

SEQ ID NO: 1313449 - DNA, 16 bp, Homo sapiens
ccctctgggaacctcc

SEQ ID NO: 1313450 - DNA, 11 bp, Homo sapiens
ccctcttcctg

SEQ ID NO: 1313451 - DNA, 15 bp, Homo sapiens
ccctcttcctgacga

SEQ ID NO: 1313452 - DNA, 16 bp, Homo sapiens
cccttcacatttttta

SEQ ID NO: 1313453 - DNA, 15 bp, Homo sapiens
cccttccgaccctct

SEQ ID NO: 1313454 - DNA, 16 bp, Homo sapiens
cccttccgaccctctg

SEQ ID NO: 1313455 - DNA, 20 bp, Homo sapiens
cccttccgaccctctgggaa

SEQ ID NO: 1313456 - DNA, 16 bp, Homo sapiens
ccgaccctctgggaac

SEQ ID NO: 1313457 - DNA, 22 bp, Homo sapiens
ccgagtctgggacacaaaactc

SEQ ID NO: 1313458 - DNA, 16 bp, Homo sapiens
ccgcgtttagaccaag

SEQ ID NO: 1313459 - DNA, 17 bp, Homo sapiens
ccgctcacctagagcca

SEQ ID NO: 1313460 - DNA, 20 bp, Homo sapiens
ccgcttgtggggacccaggc

SEQ ID NO: 1313461 - DNA, 23 bp, Homo sapiens
ccgcttgtggggacccaggctcc

SEQ ID NO: 1313462 - DNA, 13 bp, Homo sapiens
ccggatcagagca

SEQ ID NO: 1313463 - DNA, 19 bp, Homo sapiens
ccggatcagagcaggacct

SEQ ID NO: 1313464 - DNA, 21 bp, Homo sapiens
ccggatcagagcaggacctcc

SEQ ID NO: 1313465 - DNA, 16 bp, Homo sapiens
ccggccaatggaaacc

SEQ ID NO: 1313466 - DNA, 17 bp, Homo sapiens
ccggccaatggaaacct

SEQ ID NO: 1313467 - DNA, 16 bp, Homo sapiens
cctaattaccagtctt

SEQ ID NO: 1313468 - DNA, 12 bp, Homo sapiens
cctagagccaga

SEQ ID NO: 1313469 - DNA, 20 bp, Homo sapiens
cctagcccagcgctctgcct

SEQ ID NO: 1313470 - DNA, 16 bp, Homo sapiens
cctaggaccactcagc

SEQ ID NO: 1313471 - DNA, 19 bp, Homo sapiens
cctaggaccactcagcccc

SEQ ID NO: 1313472 - DNA, 23 bp, Homo sapiens
cctaggaccactcagcccctagg

SEQ ID NO: 1313473 - DNA, 19 bp, Homo sapiens
cctaggttcccggtcccga

SEQ ID NO: 1313474 - DNA, 16 bp, Homo sapiens
cctcacctctacccaa

SEQ ID NO: 1313475 - DNA, 13 bp, Homo sapiens
cctcacgctgggt

SEQ ID NO: 1313476 - DNA, 16 bp, Homo sapiens
cctcagccacacccag

SEQ ID NO: 1313477 - DNA, 15 bp, Homo sapiens
cctccagcccgggag

SEQ ID NO: 1313478 - DNA, 20 bp, Homo sapiens
cctccagcccgggagcctag

SEQ ID NO: 1313479 - DNA, 18 bp, Homo sapiens
cctcccagaggtccagcc

SEQ ID NO: 1313480 - DNA, 19 bp, Homo sapiens
cctcccagaggtccagccc

SEQ ID NO: 1313481 - DNA, 21 bp, Homo sapiens
cctcggaaccgctcacctaga

SEQ ID NO: 1313482 - DNA, 23 bp, Homo sapiens
cctcggaaccgctcacctagagc

SEQ ID NO: 1313483 - DNA, 15 bp, Homo sapiens
cctctgggaacctcc

SEQ ID NO: 1313484 - DNA, 20 bp, Homo sapiens
cctctgggaacctcccagag

SEQ ID NO: 1313485 - DNA, 13 bp, Homo sapiens
cctgacgaaactg

SEQ ID NO: 1313486 - DNA, 18 bp, Homo sapiens
cctgacgaaactggcccc

SEQ ID NO: 1313487 - DNA, 18 bp, Homo sapiens
cctgagccccgccctctt

SEQ ID NO: 1313488 - DNA, 20 bp, Homo sapiens
cctgagccccgccctcttcc

SEQ ID NO: 1313489 - DNA, 22 bp, Homo sapiens
cctgagccccgccctcttcctg

SEQ ID NO: 1313490 - DNA, 14 bp, Homo sapiens
cctgatctcttcct

SEQ ID NO: 1313491 - DNA, 16 bp, Homo sapiens
cctgatctcttcctgt

SEQ ID NO: 1313492 - DNA, 14 bp, Homo sapiens
cctgccttcatgga

SEQ ID NO: 1313493 - DNA, 21 bp, Homo sapiens
cctgttaacactgtaatatct

SEQ ID NO: 1313494 - DNA, 18 bp, Homo sapiens
ccttaacccaaggagcac

SEQ ID NO: 1313495 - DNA, 15 bp, Homo sapiens
cgaccctctgggaac

SEQ ID NO: 1313496 - DNA, 16 bp, Homo sapiens
cgaccctctgggaacc

SEQ ID NO: 1313497 - DNA, 17 bp, Homo sapiens
cgaccctctgggaacct

SEQ ID NO: 1313498 - DNA, 21 bp, Homo sapiens
cgaccctctgggaacctccca

SEQ ID NO: 1313499 - DNA, 22 bp, Homo sapiens
cgcacttcagaattccatatct

SEQ ID NO: 1313500 - DNA, 21 bp, Homo sapiens
cgccacacagaccaccatcca

SEQ ID NO: 1313501 - DNA, 15 bp, Homo sapiens
cgccctcttcctgac

SEQ ID NO: 1313502 - DNA, 18 bp, Homo sapiens
cgctcacctagagccaga

SEQ ID NO: 1313503 - DNA, 21 bp, Homo sapiens
cgctctgcctcaccgcttccc

SEQ ID NO: 1313504 - DNA, 21 bp, Homo sapiens
cgctgctccacgcgcttcgac

SEQ ID NO: 1313505 - DNA, 22 bp, Homo sapiens
cgctgggtcctaattaccagtc

SEQ ID NO: 1313506 - DNA, 12 bp, Homo sapiens
ctcaccgcttcc

SEQ ID NO: 1313507 - DNA, 13 bp, Homo sapiens
ctcacctagagcc

SEQ ID NO: 1313508 - DNA, 15 bp, Homo sapiens
ctcacctctacccaa

SEQ ID NO: 1313509 - DNA, 19 bp, Homo sapiens
ctcacctctacccaaaccc

SEQ ID NO: 1313510 - DNA, 14 bp, Homo sapiens
ctcagcccctagga

SEQ ID NO: 1313511 - DNA, 15 bp, Homo sapiens
ctcagggctcctccc

SEQ ID NO: 1313512 - DNA, 16 bp, Homo sapiens
ctccaaagttatccag

SEQ ID NO: 1313513 - DNA, 17 bp, Homo sapiens
ctccagaatttggaaat

SEQ ID NO: 1313514 - DNA, 20 bp, Homo sapiens
ctccagaatttggaaatcct

SEQ ID NO: 1313515 - DNA, 22 bp, Homo sapiens
ctccagaatttggaaatcctag

SEQ ID NO: 1313516 - DNA, 24 bp, Homo sapiens
ctccagctcagaacccagggctct

SEQ ID NO: 1313517 - DNA, 21 bp, Homo sapiens
ctcccagaatcccagccggcc

SEQ ID NO: 1313518 - DNA, 14 bp, Homo sapiens
ctcccagaggtcca

SEQ ID NO: 1313519 - DNA, 15 bp, Homo sapiens
ctcccagaggtccag

SEQ ID NO: 1313520 - DNA, 17 bp, Homo sapiens
ctcccagaggtccagcc

SEQ ID NO: 1313521 - DNA, 22 bp, Homo sapiens
ctcccagaggtccagcccatct

SEQ ID NO: 1313522 - DNA, 20 bp, Homo sapiens
ctcccagcttgtaggagctg

SEQ ID NO: 1313523 - DNA, 11 bp, Homo sapiens
ctccccagtgt

SEQ ID NO: 1313524 - DNA, 15 bp, Homo sapiens
ctccccggcaccctc

SEQ ID NO: 1313525 - DNA, 20 bp, Homo sapiens
ctccccggcaccctctggcc

SEQ ID NO: 1313526 - DNA, 17 bp, Homo sapiens
ctcccttccgaccctct

SEQ ID NO: 1313527 - DNA, 19 bp, Homo sapiens
ctcccttccgaccctctgg

SEQ ID NO: 1313528 - DNA, 20 bp, Homo sapiens
ctcccttccgaccctctggg

SEQ ID NO: 1313529 - DNA, 21 bp, Homo sapiens
ctcccttccgaccctctggga

SEQ ID NO: 1313530 - DNA, 23 bp, Homo sapiens
ctcccttccgaccctctgggaac

SEQ ID NO: 1313531 - DNA, 21 bp, Homo sapiens
ctccgcccccagcctatgagc

SEQ ID NO: 1313532 - DNA, 12 bp, Homo sapiens
ctcctcccagct

SEQ ID NO: 1313533 - DNA, 14 bp, Homo sapiens
ctcctcccagcttg

SEQ ID NO: 1313534 - DNA, 13 bp, Homo sapiens
ctcctcctcggaa

SEQ ID NO: 1313535 - DNA, 19 bp, Homo sapiens
ctcctcggaaccgctcacc

SEQ ID NO: 1313536 - DNA, 18 bp, Homo sapiens
ctccttcgtatcccgagt

SEQ ID NO: 1313537 - DNA, 13 bp, Homo sapiens
ctcgcttgtaaat

SEQ ID NO: 1313538 - DNA, 20 bp, Homo sapiens
ctcggaaccgctcacctaga

SEQ ID NO: 1313539 - DNA, 18 bp, Homo sapiens
ctcggagcatcccggagg

SEQ ID NO: 1313540 - DNA, 13 bp, Homo sapiens
ctctgagcccatg

SEQ ID NO: 1313541 - DNA, 21 bp, Homo sapiens
ctctgagcccatgttctgccc

SEQ ID NO: 1313542 - DNA, 15 bp, Homo sapiens
ctctgagctgttatc

SEQ ID NO: 1313543 - DNA, 18 bp, Homo sapiens
ctctgggaacctcccaga

SEQ ID NO: 1313544 - DNA, 12 bp, Homo sapiens
ctcttctcccag

SEQ ID NO: 1313545 - DNA, 13 bp, Homo sapiens
ctgaaaactggaa

SEQ ID NO: 1313546 - DNA, 21 bp, Homo sapiens
ctgaaaactggaataagaagc

SEQ ID NO: 1313547 - DNA, 23 bp, Homo sapiens
ctgaaaactggaataagaagcaa

SEQ ID NO: 1313548 - DNA, 12 bp, Homo sapiens
ctgacacaaagg

SEQ ID NO: 1313549 - DNA, 18 bp, Homo sapiens
ctgagccccgccctcttc

SEQ ID NO: 1313550 - DNA, 21 bp, Homo sapiens
ctgagccccgccctcttcctg

SEQ ID NO: 1313551 - DNA, 17 bp, Homo sapiens
ctgagctgttatcttgt

SEQ ID NO: 1313552 - DNA, 14 bp, Homo sapiens
ctgaggtttcaccc

SEQ ID NO: 1313553 - DNA, 16 bp, Homo sapiens
ctgatatattttccag

SEQ ID NO: 1313554 - DNA, 13 bp, Homo sapiens
ctgatctcttcct

SEQ ID NO: 1313555 - DNA, 14 bp, Homo sapiens
ctgatctcttcctg

SEQ ID NO: 1313556 - DNA, 16 bp, Homo sapiens
ctgatctcttcctgtt

SEQ ID NO: 1313557 - DNA, 21 bp, Homo sapiens
ctgatctcttcctgttttgta

SEQ ID NO: 1313558 - DNA, 12 bp, Homo sapiens
ctgcaaaataga

SEQ ID NO: 1313559 - DNA, 13 bp, Homo sapiens
ctgcagagggtta

SEQ ID NO: 1313560 - DNA, 22 bp, Homo sapiens
ctgcaggaatcaaaaattgaag

SEQ ID NO: 1313561 - DNA, 14 bp, Homo sapiens
ctgcatcttggact

SEQ ID NO: 1313562 - DNA, 15 bp, Homo sapiens
ctgcctcaccgcttc

SEQ ID NO: 1313563 - DNA, 14 bp, Homo sapiens
ctgctccacgcgct

SEQ ID NO: 1313564 - DNA, 23 bp, Homo sapiens
ctgctccagaatttggaaatcct

SEQ ID NO: 1313565 - DNA, 13 bp, Homo sapiens
ctggaataagaag

SEQ ID NO: 1313566 - DNA, 19 bp, Homo sapiens
ctggaataagaagcaaata

SEQ ID NO: 1313567 - DNA, 14 bp, Homo sapiens
ctggactctaaaga

SEQ ID NO: 1313568 - DNA, 18 bp, Homo sapiens
ctggactctaaagaccaa

SEQ ID NO: 1313569 - DNA, 19 bp, Homo sapiens
ctggccccggatcagagca

SEQ ID NO: 1313570 - DNA, 23 bp, Homo sapiens
ctggccccggatcagagcaggac

SEQ ID NO: 1313571 - DNA, 15 bp, Homo sapiens
ctgggaacctcccag

SEQ ID NO: 1313572 - DNA, 17 bp, Homo sapiens
ctgggaacctcccagag

SEQ ID NO: 1313573 - DNA, 21 bp, Homo sapiens
ctgggaacctcccagaggtcc

SEQ ID NO: 1313574 - DNA, 16 bp, Homo sapiens
ctgggacacaaaactc

SEQ ID NO: 1313575 - DNA, 18 bp, Homo sapiens
ctgggcacactctgccag

SEQ ID NO: 1313576 - DNA, 21 bp, Homo sapiens
ctgggtcctaattaccagtct

SEQ ID NO: 1313577 - DNA, 13 bp, Homo sapiens
ctgtaaaacgctg

SEQ ID NO: 1313578 - DNA, 13 bp, Homo sapiens
ctgtaatatcttt

SEQ ID NO: 1313579 - DNA, 17 bp, Homo sapiens
ctgtacattttgttgta

SEQ ID NO: 1313580 - DNA, 19 bp, Homo sapiens
ctgtacattttgttgtaaa

SEQ ID NO: 1313581 - DNA, 13 bp, Homo sapiens
ctgtagtgttttg

SEQ ID NO: 1313582 - DNA, 14 bp, Homo sapiens
ctgtctgtagtgtt

SEQ ID NO: 1313583 - DNA, 22 bp, Homo sapiens
ctgtgctactgtctttggaaaa

SEQ ID NO: 1313584 - DNA, 13 bp, Homo sapiens
ctgtgtatattat

SEQ ID NO: 1313585 - DNA, 15 bp, Homo sapiens
ctgtgtatattattt

SEQ ID NO: 1313586 - DNA, 17 bp, Homo sapiens
ctgtgtatattatttgg

SEQ ID NO: 1313587 - DNA, 19 bp, Homo sapiens
ctgtgtatattatttggca

SEQ ID NO: 1313588 - DNA, 20 bp, Homo sapiens
ctgtgtatattatttggcag

SEQ ID NO: 1313589 - DNA, 20 bp, Homo sapiens
ctgttaacactgtaatatct

SEQ ID NO: 1313590 - DNA, 21 bp, Homo sapiens
ctgttaacactgtaatatctt

SEQ ID NO: 1313591 - DNA, 14 bp, Homo sapiens
ctgttatcttgtgt

SEQ ID NO: 1313592 - DNA, 17 bp, Homo sapiens
ctgttatcttgtgtatg

SEQ ID NO: 1313593 - DNA, 14 bp, Homo sapiens
ctgttctgcagaca

SEQ ID NO: 1313594 - DNA, 15 bp, Homo sapiens
ctgttgtaacttatg

SEQ ID NO: 1313595 - DNA, 17 bp, Homo sapiens
ctgttgtaacttatgta

SEQ ID NO: 1313596 - DNA, 18 bp, Homo sapiens
ctgttgtaacttatgtag

SEQ ID NO: 1313597 - DNA, 21 bp, Homo sapiens
ctgttgtaacttatgtagata

SEQ ID NO: 1313598 - DNA, 16 bp, Homo sapiens
cttaacccaaggagca

SEQ ID NO: 1313599 - DNA, 17 bp, Homo sapiens
cttaacccaaggagcac

SEQ ID NO: 1313600 - DNA, 21 bp, Homo sapiens
cttactattcattaaatgttt

SEQ ID NO: 1313601 - DNA, 13 bp, Homo sapiens
cttagtatctcat

SEQ ID NO: 1313602 - DNA, 19 bp, Homo sapiens
cttagtatctcatcaacaa

SEQ ID NO: 1313603 - DNA, 12 bp, Homo sapiens
cttagtccccca

SEQ ID NO: 1313604 - DNA, 22 bp, Homo sapiens
cttagtcccccaactctgagcc

SEQ ID NO: 1313605 - DNA, 23 bp, Homo sapiens
gaaatcctagtttcctctccttc

SEQ ID NO: 1313606 - DNA, 18 bp, Homo sapiens
gaacccagggctctgccc

SEQ ID NO: 1313607 - DNA, 17 bp, Homo sapiens
gaaccgctcacctagag

SEQ ID NO: 1313608 - DNA, 18 bp, Homo sapiens
gaaccgctcacctagagc

SEQ ID NO: 1313609 - DNA, 20 bp, Homo sapiens
gaaccgctcacctagagcca

SEQ ID NO: 1313610 - DNA, 22 bp, Homo sapiens
gaaccgctcacctagagccaga

SEQ ID NO: 1313611 - DNA, 14 bp, Homo sapiens
gaacctcccagagg

SEQ ID NO: 1313612 - DNA, 19 bp, Homo sapiens
gaacctcccagaggtccag

SEQ ID NO: 1313613 - DNA, 21 bp, Homo sapiens
gaacctcccagaggtccagcc

SEQ ID NO: 1313614 - DNA, 20 bp, Homo sapiens
gaactcagctgtctgtggct

SEQ ID NO: 1313615 - DNA, 14 bp, Homo sapiens
gaacttgtagctgt

SEQ ID NO: 1313616 - DNA, 19 bp, Homo sapiens
gaagcattctccccagtgt

SEQ ID NO: 1313617 - DNA, 14 bp, Homo sapiens
gaatataggtctct

SEQ ID NO: 1313618 - DNA, 15 bp, Homo sapiens
gaatcccagccggcc

SEQ ID NO: 1313619 - DNA, 14 bp, Homo sapiens
gacaaatctgtgta

SEQ ID NO: 1313620 - DNA, 20 bp, Homo sapiens
gacaaatctgtgtatattat

SEQ ID NO: 1313621 - DNA, 22 bp, Homo sapiens
gacaagagcctgatctcttcct

SEQ ID NO: 1313622 - DNA, 17 bp, Homo sapiens
gacacaaaactccgccc

SEQ ID NO: 1313623 - DNA, 21 bp, Homo sapiens
gacacaaaactccgcccccag

SEQ ID NO: 1313624 - DNA, 21 bp, Homo sapiens
gacacgccttcccctcagcca

SEQ ID NO: 1313625 - DNA, 15 bp, Homo sapiens
gacaggcctcacctc

SEQ ID NO: 1313626 - DNA, 20 bp, Homo sapiens
gacaggcctcacctctaccc

SEQ ID NO: 1313627 - DNA, 13 bp, Homo sapiens
gaccactcagccc

SEQ ID NO: 1313628 - DNA, 14 bp, Homo sapiens
gaccactcagcccc

SEQ ID NO: 1313629 - DNA, 19 bp, Homo sapiens
gaccactcagcccctagga

SEQ ID NO: 1313630 - DNA, 17 bp, Homo sapiens
gacccaggctccgccct

SEQ ID NO: 1313631 - DNA, 20 bp, Homo sapiens
gaccgcttgtggggacccag

SEQ ID NO: 1313632 - DNA, 22 bp, Homo sapiens
gaccgcttgtggggacccaggc

SEQ ID NO: 1313633 - DNA, 12 bp, Homo sapiens
gacctcccttcc

SEQ ID NO: 1313634 - DNA, 22 bp, Homo sapiens
gacctcccttccgaccctctgg

SEQ ID NO: 1313635 - DNA, 23 bp, Homo sapiens
gacctcccttccgaccctctggg

SEQ ID NO: 1313636 - DNA, 17 bp, Homo sapiens
gactctaaagaccaaac

SEQ ID NO: 1313637 - DNA, 17 bp, Homo sapiens
gagagatatatctgaaa

SEQ ID NO: 1313638 - DNA, 13 bp, Homo sapiens
gagcacaggtccc

SEQ ID NO: 1313639 - DNA, 16 bp, Homo sapiens
gagcacaggtcccacc

SEQ ID NO: 1313640 - DNA, 20 bp, Homo sapiens
gagcaggacctcccttccga

SEQ ID NO: 1313641 - DNA, 13 bp, Homo sapiens
gagcatcccggag

SEQ ID NO: 1313642 - DNA, 22 bp, Homo sapiens
gagcccatgttctgcccccagc

SEQ ID NO: 1313643 - DNA, 20 bp, Homo sapiens
gagccccgccctcttcctga

SEQ ID NO: 1313644 - DNA, 21 bp, Homo sapiens
gagccccgccctcttcctgac

SEQ ID NO: 1313645 - DNA, 19 bp, Homo sapiens
gagcctaggaccactcagc

SEQ ID NO: 1313646 - DNA, 21 bp, Homo sapiens
gagcctaggaccactcagccc

SEQ ID NO: 1313647 - DNA, 22 bp, Homo sapiens
gagcctaggaccactcagcccc

SEQ ID NO: 1313648 - DNA, 23 bp, Homo sapiens
gagctgaggtttcacccttaacc

SEQ ID NO: 1313649 - DNA, 21 bp, Homo sapiens
gaggaaagagtcttcaacata

SEQ ID NO: 1313650 - DNA, 20 bp, Homo sapiens
gaggactcgcttgtaaatac

SEQ ID NO: 1313651 - DNA, 11 bp, Homo sapiens
gagtctgggac

SEQ ID NO: 1313652 - DNA, 12 bp, Homo sapiens
gagtgcacagct

SEQ ID NO: 1313653 - DNA, 14 bp, Homo sapiens
gagtgcacagctgt

SEQ ID NO: 1313654 - DNA, 15 bp, Homo sapiens
gatatctatgactgt

SEQ ID NO: 1313655 - DNA, 21 bp, Homo sapiens
gatatgtgtaaatgttatgac

SEQ ID NO: 1313656 - DNA, 19 bp, Homo sapiens
gatatttggcttaaatata

SEQ ID NO: 1313657 - DNA, 15 bp, Homo sapiens
gatcagagcaggacc

SEQ ID NO: 1313658 - DNA, 14 bp, Homo sapiens
gatctcttcctgtt

SEQ ID NO: 1313659 - DNA, 14 bp, Homo sapiens
gatgaatacatttt

SEQ ID NO: 1313660 - DNA, 14 bp, Homo sapiens
gattttctccagct

SEQ ID NO: 1313661 - DNA, 16 bp, Homo sapiens
gcaaagaggactcgct

SEQ ID NO: 1313662 - DNA, 15 bp, Homo sapiens
gcaacttgaaattat

SEQ ID NO: 1313663 - DNA, 19 bp, Homo sapiens
gcaacttgaaattatatct

SEQ ID NO: 1313664 - DNA, 14 bp, Homo sapiens
gcacaagcagagtg

SEQ ID NO: 1313665 - DNA, 19 bp, Homo sapiens
gcacactctgccagcaaag

SEQ ID NO: 1313666 - DNA, 20 bp, Homo sapiens
gcacactctgccagcaaaga

SEQ ID NO: 1313667 - DNA, 19 bp, Homo sapiens
gcacaggtcccacctccag

SEQ ID NO: 1313668 - DNA, 20 bp, Homo sapiens
gcagacacgccttcccctca

SEQ ID NO: 1313669 - DNA, 22 bp, Homo sapiens
gcagagaagggcataaaacagc

SEQ ID NO: 1313670 - DNA, 17 bp, Homo sapiens
gcagagtgcacagctgt

SEQ ID NO: 1313671 - DNA, 18 bp, Homo sapiens
gcaggacctcccttccga

SEQ ID NO: 1313672 - DNA, 22 bp, Homo sapiens
gcaggacctcccttccgaccct

SEQ ID NO: 1313673 - DNA, 17 bp, Homo sapiens
gcagtttggtatttgcg

SEQ ID NO: 1313674 - DNA, 13 bp, Homo sapiens
gcataaaacagct

SEQ ID NO: 1313675 - DNA, 18 bp, Homo sapiens
gcatccaatctcaaggaa

SEQ ID NO: 1313676 - DNA, 19 bp, Homo sapiens
gcatccaatctcaaggaat

SEQ ID NO: 1313677 - DNA, 18 bp, Homo sapiens
gcatcccggaggaaatct

SEQ ID NO: 1313678 - DNA, 22 bp, Homo sapiens
gcatcccggaggaaatctgcag

SEQ ID NO: 1313679 - DNA, 14 bp, Homo sapiens
gcatcctgagcccc

SEQ ID NO: 1313680 - DNA, 21 bp, Homo sapiens
gcattctccccagtgtatgtc

SEQ ID NO: 1313681 - DNA, 20 bp, Homo sapiens
gcattgacaaatctgtgtat

SEQ ID NO: 1313682 - DNA, 16 bp, Homo sapiens
gcattgttgatgctca

SEQ ID NO: 1313683 - DNA, 23 bp, Homo sapiens
gccaaactgctggacgtctttct

SEQ ID NO: 1313684 - DNA, 15 bp, Homo sapiens
gccacacagaccacc

SEQ ID NO: 1313685 - DNA, 20 bp, Homo sapiens
gccagctgcaggaatcaaaa

SEQ ID NO: 1313686 - DNA, 15 bp, Homo sapiens
gcccagcccctagaa

SEQ ID NO: 1313687 - DNA, 13 bp, Homo sapiens
gcccatctcggag

SEQ ID NO: 1313688 - DNA, 14 bp, Homo sapiens
gcccatgttctgcc

SEQ ID NO: 1313689 - DNA, 19 bp, Homo sapiens
gcccatgttctgcccccag

SEQ ID NO: 1313690 - DNA, 22 bp, Homo sapiens
gcccatgttctgcccccagccc

SEQ ID NO: 1313691 - DNA, 13 bp, Homo sapiens
gcccccagcccaa

SEQ ID NO: 1313692 - DNA, 15 bp, Homo sapiens
gcccccagcccaaag

SEQ ID NO: 1313693 - DNA, 23 bp, Homo sapiens
gccccctccccggcaccctctgg

SEQ ID NO: 1313694 - DNA, 15 bp, Homo sapiens
gccccggatcagagc

SEQ ID NO: 1313695 - DNA, 18 bp, Homo sapiens
gccccggatcagagcagg

SEQ ID NO: 1313696 - DNA, 22 bp, Homo sapiens
gccccggatcagagcaggacct

SEQ ID NO: 1313697 - DNA, 21 bp, Homo sapiens
ggaacaaaaaaaccacaaagg

SEQ ID NO: 1313698 - DNA, 19 bp, Homo sapiens
ggaaccgctcacctagagc

SEQ ID NO: 1313699 - DNA, 13 bp, Homo sapiens
ggaacctcccaga

SEQ ID NO: 1313700 - DNA, 14 bp, Homo sapiens
ggaacctcccagag

SEQ ID NO: 1313701 - DNA, 20 bp, Homo sapiens
ggacacaaaactccgccccc

SEQ ID NO: 1313702 - DNA, 23 bp, Homo sapiens
ggacacaaaactccgcccccagc

SEQ ID NO: 1313703 - DNA, 11 bp, Homo sapiens
ggacaggcctc

SEQ ID NO: 1313704 - DNA, 16 bp, Homo sapiens
ggacaggcctcacctc

SEQ ID NO: 1313705 - DNA, 16 bp, Homo sapiens
ggaccactcagcccct

SEQ ID NO: 1313706 - DNA, 21 bp, Homo sapiens
ggaccactcagcccctaggag

SEQ ID NO: 1313707 - DNA, 13 bp, Homo sapiens
ggacccaggctcc

SEQ ID NO: 1313708 - DNA, 17 bp, Homo sapiens
ggacccaggctccgccc

SEQ ID NO: 1313709 - DNA, 14 bp, Homo sapiens
ggactcgcttgtaa

SEQ ID NO: 1313710 - DNA, 17 bp, Homo sapiens
ggagcacaggtcccacc

SEQ ID NO: 1313711 - DNA, 14 bp, Homo sapiens
ggagcatcccggag

SEQ ID NO: 1313712 - DNA, 14 bp, Homo sapiens
ggagcctaggacca

SEQ ID NO: 1313713 - DNA, 22 bp, Homo sapiens
ggatcagagcaggacctccctt

SEQ ID NO: 1313714 - DNA, 17 bp, Homo sapiens
ggcattgacaaatctgt

SEQ ID NO: 1313715 - DNA, 20 bp, Homo sapiens
ggcattgacaaatctgtgta

SEQ ID NO: 1313716 - DNA, 11 bp, Homo sapiens
ggccaaactgc

SEQ ID NO: 1313717 - DNA, 18 bp, Homo sapiens
ggccccggatcagagcag

SEQ ID NO: 1313718 - DNA, 15 bp, Homo sapiens
ggcctcacctctacc

SEQ ID NO: 1313719 - DNA, 21 bp, Homo sapiens
ggctccgcccttagtccccca

SEQ ID NO: 1313720 - DNA, 22 bp, Homo sapiens
ggctccgcccttagtcccccaa

SEQ ID NO: 1313721 - DNA, 13 bp, Homo sapiens
ggctcctcccagc

SEQ ID NO: 1313722 - DNA, 13 bp, Homo sapiens
ggctctgccccag

SEQ ID NO: 1313723 - DNA, 18 bp, Homo sapiens
ggctctggactctaaaga

SEQ ID NO: 1313724 - DNA, 16 bp, Homo sapiens
gggaacctcccagagg

SEQ ID NO: 1313725 - DNA, 13 bp, Homo sapiens
gggacaggcctca

SEQ ID NO: 1313726 - DNA, 12 bp, Homo sapiens
gggctcctccca

SEQ ID NO: 1313727 - DNA, 15 bp, Homo sapiens
gggctctgccccagt

SEQ ID NO: 1313728 - DNA, 12 bp, Homo sapiens
ggggacaggcct

SEQ ID NO: 1313729 - DNA, 14 bp, Homo sapiens
ggggacccaggctc

SEQ ID NO: 1313730 - DNA, 19 bp, Homo sapiens
ggggacccaggctccgccc

SEQ ID NO: 1313731 - DNA, 20 bp, Homo sapiens
gggtgtctttttttggtgat

SEQ ID NO: 1313732 - DNA, 22 bp, Homo sapiens
ggtcctaattaccagtctttaa

SEQ ID NO: 1313733 - DNA, 15 bp, Homo sapiens
ggtctcttctcccag

SEQ ID NO: 1313734 - DNA, 17 bp, Homo sapiens
ggtgacaagagcctgat

SEQ ID NO: 1313735 - DNA, 16 bp, Homo sapiens
ggttcccggtcccgag

SEQ ID NO: 1313736 - DNA, 23 bp, Homo sapiens
ggtttttttttttaaaaaaagaa

SEQ ID NO: 1313737 - DNA, 19 bp, Homo sapiens
gtaaaacgctgtcaaaagt

SEQ ID NO: 1313738 - DNA, 15 bp, Homo sapiens
gtaaatgttatgact

SEQ ID NO: 1313739 - DNA, 23 bp, Homo sapiens
gtaatctgtacattttgttgtaa

SEQ ID NO: 1313740 - DNA, 17 bp, Homo sapiens
gtacattttgttgtaaa

SEQ ID NO: 1313741 - DNA, 17 bp, Homo sapiens
gtagaacttactattca

SEQ ID NO: 1313742 - DNA, 13 bp, Homo sapiens
gtagatatttggc

SEQ ID NO: 1313743 - DNA, 16 bp, Homo sapiens
gtagctgtaaaacgct

SEQ ID NO: 1313744 - DNA, 14 bp, Homo sapiens
gtatattatttggc

SEQ ID NO: 1313745 - DNA, 18 bp, Homo sapiens
gtatcccgagtctgggac

SEQ ID NO: 1313746 - DNA, 21 bp, Homo sapiens
gtatggatatgtgtaaatgtt

SEQ ID NO: 1313747 - DNA, 16 bp, Homo sapiens
gtcagtctttttctgt

SEQ ID NO: 1313748 - DNA, 21 bp, Homo sapiens
gtcagtctttttctgttgtaa

SEQ ID NO: 1313749 - DNA, 15 bp, Homo sapiens
gtccagcccatctcg

SEQ ID NO: 1313750 - DNA, 17 bp, Homo sapiens
gtcccacctccagcccg

SEQ ID NO: 1313751 - DNA, 22 bp, Homo sapiens
gtcccacctccagcccgggagc

SEQ ID NO: 1313752 - DNA, 16 bp, Homo sapiens
gtcccccaactctgag

SEQ ID NO: 1313753 - DNA, 15 bp, Homo sapiens
gtctcttctcccaga

SEQ ID NO: 1313754 - DNA, 17 bp, Homo sapiens
gtctcttctcccagaat

SEQ ID NO: 1313755 - DNA, 22 bp, Homo sapiens
gtctcttctcccagaatcccag

SEQ ID NO: 1313756 - DNA, 20 bp, Homo sapiens
gtcttcaaattgtcttttgt

SEQ ID NO: 1313757 - DNA, 16 bp, Homo sapiens
gtctttaaaggcccag

SEQ ID NO: 1313758 - DNA, 18 bp, Homo sapiens
gtctttaaaggcccagcc

SEQ ID NO: 1313759 - DNA, 20 bp, Homo sapiens
gtctttaaaggcccagcccc

SEQ ID NO: 1313760 - DNA, 16 bp, Homo sapiens
gtctttctccaaagtt

SEQ ID NO: 1313761 - DNA, 19 bp, Homo sapiens
gtctttggaaaaatgtttg

SEQ ID NO: 1313762 - DNA, 13 bp, Homo sapiens
gtgaacttgtagc

SEQ ID NO: 1313763 - DNA, 18 bp, Homo sapiens
gtgaacttgtagctgtaa

SEQ ID NO: 1313764 - DNA, 11 bp, Homo sapiens
gtgcacagctg

SEQ ID NO: 1313765 - DNA, 13 bp, Homo sapiens
gtgcacagctgtc

SEQ ID NO: 1313766 - DNA, 14 bp, Homo sapiens
gtgcacagctgtcc

SEQ ID NO: 1313767 - DNA, 18 bp, Homo sapiens
gtggcttcccatgtcttt

SEQ ID NO: 1313768 - DNA, 13 bp, Homo sapiens
gtggggacccagg

SEQ ID NO: 1313769 - DNA, 23 bp, Homo sapiens
gtggtcttcaaattgtcttttgt

SEQ ID NO: 1313770 - DNA, 17 bp, Homo sapiens
gtgtatattatttggca

SEQ ID NO: 1313771 - DNA, 16 bp, Homo sapiens
gttaacactgtaatat

SEQ ID NO: 1313772 - DNA, 20 bp, Homo sapiens
gttactcagggctcctccca

SEQ ID NO: 1313773 - DNA, 19 bp, Homo sapiens
gttactgtctgtagtgttt

SEQ ID NO: 1313774 - DNA, 16 bp, Homo sapiens
gttatcttgtgtatgg

SEQ ID NO: 1313775 - DNA, 11 bp, Homo sapiens
gttatgactcc

SEQ ID NO: 1313776 - DNA, 16 bp, Homo sapiens
gttcacgcaacttgaa

SEQ ID NO: 1313777 - DNA, 19 bp, Homo sapiens
gttcctaagaagcttctaa

SEQ ID NO: 1313778 - DNA, 21 bp, Homo sapiens
gttcttctgttctgcagacac

SEQ ID NO: 1313779 - DNA, 17 bp, Homo sapiens
taggtctcttctcccag

SEQ ID NO: 1313780 - DNA, 20 bp, Homo sapiens
taggtctcttctcccagaat

SEQ ID NO: 1313781 - DNA, 12 bp, Homo sapiens
tagtaatctgta

SEQ ID NO: 1313782 - DNA, 15 bp, Homo sapiens
tagtaatctgtacat

SEQ ID NO: 1313783 - DNA, 22 bp, Homo sapiens
tagtcccccaactctgagccca

SEQ ID NO: 1313784 - DNA, 22 bp, Homo sapiens
tataggtctcttctcccagaat

SEQ ID NO: 1313785 - DNA, 17 bp, Homo sapiens
tatatctgaaaactgga

SEQ ID NO: 1313786 - DNA, 14 bp, Homo sapiens
tatatctgtggtct

SEQ ID NO: 1313787 - DNA, 14 bp, Homo sapiens
tatattatttggca

SEQ ID NO: 1313788 - DNA, 20 bp, Homo sapiens
tatcctgttaacactgtaat

SEQ ID NO: 1313789 - DNA, 21 bp, Homo sapiens
tatcctgttaacactgtaata

SEQ ID NO: 1313790 - DNA, 21 bp, Homo sapiens
tatctacccaagggcagaaag

SEQ ID NO: 1313791 - DNA, 14 bp, Homo sapiens
tatctcatcaacaa

SEQ ID NO: 1313792 - DNA, 12 bp, Homo sapiens
tatctgaaaact

SEQ ID NO: 1313793 - DNA, 15 bp, Homo sapiens
tatctgaaaactgga

SEQ ID NO: 1313794 - DNA, 19 bp, Homo sapiens
tatctttaaatgatgtaca

SEQ ID NO: 1313795 - DNA, 15 bp, Homo sapiens
tatggatatgtgtaa

SEQ ID NO: 1313796 - DNA, 20 bp, Homo sapiens
tattatgtccattattcaag

SEQ ID NO: 1313797 - DNA, 18 bp, Homo sapiens
tattcaagaaagatatct

SEQ ID NO: 1313798 - DNA, 13 bp, Homo sapiens
tattgaattattt

SEQ ID NO: 1313799 - DNA, 15 bp, Homo sapiens
tattgaattattttg

SEQ ID NO: 1313800 - DNA, 15 bp, Homo sapiens
tatttgctaattaaa

SEQ ID NO: 1313801 - DNA, 23 bp, Homo sapiens
tatttgctaattaaaaagttaat

SEQ ID NO: 1313802 - DNA, 15 bp, Homo sapiens
tattttgttactgtc

SEQ ID NO: 1313803 - DNA, 14 bp, Homo sapiens
tatttttcagttcc

SEQ ID NO: 1313804 - DNA, 15 bp, Homo sapiens
tcaaaagttggacta

SEQ ID NO: 1313805 - DNA, 21 bp, Homo sapiens
tcaacaaagaaatattatttg

SEQ ID NO: 1313806 - DNA, 21 bp, Homo sapiens
tcaagaaagatatctatgact

SEQ ID NO: 1313807 - DNA, 20 bp, Homo sapiens
tcaatgttcacgcaacttga

SEQ ID NO: 1313808 - DNA, 12 bp, Homo sapiens
tcacatatgata

SEQ ID NO: 1313809 - DNA, 23 bp, Homo sapiens
tcacccttaacccaaggagcaca

SEQ ID NO: 1313810 - DNA, 18 bp, Homo sapiens
tcacctagagccagacca

SEQ ID NO: 1313811 - DNA, 16 bp, Homo sapiens
tcacgcaacttgaaat

SEQ ID NO: 1313812 - DNA, 14 bp, Homo sapiens
tcactgacacaaag

SEQ ID NO: 1313813 - DNA, 15 bp, Homo sapiens
tcactgacacaaagg

SEQ ID NO: 1313814 - DNA, 16 bp, Homo sapiens
tcactgacacaaagga

SEQ ID NO: 1313815 - DNA, 12 bp, Homo sapiens
tcagaacccagg

SEQ ID NO: 1313816 - DNA, 14 bp, Homo sapiens
tcagaacccagggc

SEQ ID NO: 1313817 - DNA, 17 bp, Homo sapiens
tcagggctcctcccagc

SEQ ID NO: 1313818 - DNA, 18 bp, Homo sapiens
tcagggctcctcccagct

SEQ ID NO: 1313819 - DNA, 20 bp, Homo sapiens
tcagtacttgtgaaacacag

SEQ ID NO: 1313820 - DNA, 16 bp, Homo sapiens
tcagtcctgctccaga

SEQ ID NO: 1313821 - DNA, 16 bp, Homo sapiens
tcatcaacaaagaaat

SEQ ID NO: 1313822 - DNA, 22 bp, Homo sapiens
tcatcagaagtggtaggaaagc

SEQ ID NO: 1313823 - DNA, 17 bp, Homo sapiens
tcatcctgccttcatgg

SEQ ID NO: 1313824 - DNA, 24 bp, Homo sapiens
tcatttcctctgagctgttatctt

SEQ ID NO: 1313825 - DNA, 12 bp, Homo sapiens
tccaagctccct

SEQ ID NO: 1313826 - DNA, 17 bp, Homo sapiens
tccaatctcaaggaatc

SEQ ID NO: 1313827 - DNA, 14 bp, Homo sapiens
tccaccgctgctcc

SEQ ID NO: 1313828 - DNA, 21 bp, Homo sapiens
tccacgcgcttcgacttttct

SEQ ID NO: 1313829 - DNA, 20 bp, Homo sapiens
tccagagggttgtgattttg

SEQ ID NO: 1313830 - DNA, 23 bp, Homo sapiens
tccagcccgggagcctaggacca

SEQ ID NO: 1313831 - DNA, 16 bp, Homo sapiens
tccagctcagaaccca

SEQ ID NO: 1313832 - DNA, 17 bp, Homo sapiens
tccagctcagaacccag

SEQ ID NO: 1313833 - DNA, 22 bp, Homo sapiens
tccatatcttgcgaatccaagc

SEQ ID NO: 1313834 - DNA, 13 bp, Homo sapiens
tcccacctccagc

SEQ ID NO: 1313835 - DNA, 15 bp, Homo sapiens
tcccacctccagccc

SEQ ID NO: 1313836 - DNA, 19 bp, Homo sapiens
tcccagaatcccagccggc

SEQ ID NO: 1313837 - DNA, 13 bp, Homo sapiens
tcccagaggtcca

SEQ ID NO: 1313838 - DNA, 23 bp, Homo sapiens
tcccagccggccaatggaaacct

SEQ ID NO: 1313839 - DNA, 18 bp, Homo sapiens
tcccagcttgtaggagct

SEQ ID NO: 1313840 - DNA, 23 bp, Homo sapiens
tcccagtccccagcccttcacat

SEQ ID NO: 1313841 - DNA, 16 bp, Homo sapiens
tccccagcccttcaca

SEQ ID NO: 1313842 - DNA, 18 bp, Homo sapiens
tcccccaactctgagccc

SEQ ID NO: 1313843 - DNA, 21 bp, Homo sapiens
tcccccaactctgagcccatg

SEQ ID NO: 1313844 - DNA, 15 bp, Homo sapiens
tcccgagtacagtct

SEQ ID NO: 1313845 - DNA, 15 bp, Homo sapiens
tcccggaggaaatct

SEQ ID NO: 1313846 - DNA, 20 bp, Homo sapiens
tcccttccgaccctctggga

SEQ ID NO: 1313847 - DNA, 17 bp, Homo sapiens
tccgaccctctgggaac

SEQ ID NO: 1313848 - DNA, 12 bp, Homo sapiens
tccgcccccagc

SEQ ID NO: 1313849 - DNA, 13 bp, Homo sapiens
tccgcccccagcc

SEQ ID NO: 1313850 - DNA, 15 bp, Homo sapiens
tccgcccccagccta

SEQ ID NO: 1313851 - DNA, 21 bp, Homo sapiens
tccgcccttagtcccccaact

SEQ ID NO: 1313852 - DNA, 19 bp, Homo sapiens
tccgcgaaaatagtttgtt

SEQ ID NO: 1313853 - DNA, 22 bp, Homo sapiens
tcctaagaagcttctaataaat

SEQ ID NO: 1313854 - DNA, 14 bp, Homo sapiens
tcctcggaaccgct

SEQ ID NO: 1313855 - DNA, 18 bp, Homo sapiens
tcctctgagctgttatct

SEQ ID NO: 1313856 - DNA, 21 bp, Homo sapiens
tcctgacgaaactggccccgg

SEQ ID NO: 1313857 - DNA, 14 bp, Homo sapiens
tcctgagccccgcc

SEQ ID NO: 1313858 - DNA, 18 bp, Homo sapiens
tcctgagccccgccctct

SEQ ID NO: 1313859 - DNA, 13 bp, Homo sapiens
tcctgctccagaa

SEQ ID NO: 1313860 - DNA, 12 bp, Homo sapiens
tcgcttgtaaat

SEQ ID NO: 1313861 - DNA, 16 bp, Homo sapiens
tcgcttgtaaatacca

SEQ ID NO: 1313862 - DNA, 23 bp, Homo sapiens
tcggagcatcccggaggaaatct

SEQ ID NO: 1313863 - DNA, 20 bp, Homo sapiens
tcgtatcccgagtctgggac

SEQ ID NO: 1313864 - DNA, 20 bp, Homo sapiens
tctaaagaccaaacttcact

SEQ ID NO: 1313865 - DNA, 22 bp, Homo sapiens
tctaatggctgtggcattgttg

SEQ ID NO: 1313866 - DNA, 20 bp, Homo sapiens
tctacccaagggcagaaagt

SEQ ID NO: 1313867 - DNA, 19 bp, Homo sapiens
tctatcctgttaacactgt

SEQ ID NO: 1313868 - DNA, 15 bp, Homo sapiens
tctcagttggaaata

SEQ ID NO: 1313869 - DNA, 16 bp, Homo sapiens
tctccagctcagaacc

SEQ ID NO: 1313870 - DNA, 23 bp, Homo sapiens
tctccagctcagaacccagggct

SEQ ID NO: 1313871 - DNA, 17 bp, Homo sapiens
tctcccagaatcccagc

SEQ ID NO: 1313872 - DNA, 19 bp, Homo sapiens
tctcccagaatcccagccg

SEQ ID NO: 1313873 - DNA, 20 bp, Homo sapiens
tctcggagcatcccggagga

SEQ ID NO: 1313874 - DNA, 13 bp, Homo sapiens
tctcttctcccag

SEQ ID NO: 1313875 - DNA, 14 bp, Homo sapiens
tctgaaaactggaa

SEQ ID NO: 1313876 - DNA, 20 bp, Homo sapiens
tctgagctgttatcttgtgt

SEQ ID NO: 1313877 - DNA, 22 bp, Homo sapiens
tctgagctgttatcttgtgtat

SEQ ID NO: 1313878 - DNA, 19 bp, Homo sapiens
tctgcagacacgccttccc

SEQ ID NO: 1313879 - DNA, 23 bp, Homo sapiens
tctgcagacacgccttcccctca

SEQ ID NO: 1313880 - DNA, 13 bp, Homo sapiens
tctgcccccagcc

SEQ ID NO: 1313881 - DNA, 15 bp, Homo sapiens
tctgcccccagccca

SEQ ID NO: 1313882 - DNA, 16 bp, Homo sapiens
tctgcccccagcccaa

SEQ ID NO: 1313883 - DNA, 21 bp, Homo sapiens
tctgcctcaccgcttccctcc

SEQ ID NO: 1313884 - DNA, 18 bp, Homo sapiens
tctgggaacctcccagag

SEQ ID NO: 1313885 - DNA, 13 bp, Homo sapiens
tctgtacattttg

SEQ ID NO: 1313886 - DNA, 12 bp, Homo sapiens
tctgttgtaact

SEQ ID NO: 1313887 - DNA, 13 bp, Homo sapiens
tctgttgtaactt

SEQ ID NO: 1313888 - DNA, 20 bp, Homo sapiens
tcttcagtgtgttgacttct

SEQ ID NO: 1313889 - DNA, 11 bp, Homo sapiens
tcttcctgacg

SEQ ID NO: 1313890 - DNA, 12 bp, Homo sapiens
tcttctcccaga

SEQ ID NO: 1313891 - DNA, 16 bp, Homo sapiens
tcttctcccagaatcc

SEQ ID NO: 1313892 - DNA, 19 bp, Homo sapiens
tcttgcgaatccaagctcc

SEQ ID NO: 1313893 - DNA, 20 bp, Homo sapiens
tcttgcgaatccaagctccc

SEQ ID NO: 1313894 - DNA, 21 bp, Homo sapiens
tcttgcgaatccaagctccct

SEQ ID NO: 1313895 - DNA, 23 bp, Homo sapiens
tcttgcgaatccaagctccctgc

SEQ ID NO: 1313896 - DNA, 15 bp, Homo sapiens
tctttaaaggcccag

SEQ ID NO: 1313897 - DNA, 18 bp, Homo sapiens
tctttaaaggcccagccc

SEQ ID NO: 1313898 - DNA, 23 bp, Homo sapiens
tctttaaaggcccagcccctaga

SEQ ID NO: 1313899 - DNA, 17 bp, Homo sapiens
tctttctccaaagttat

SEQ ID NO: 1313900 - DNA, 18 bp, Homo sapiens
tctttggaaaaatgtttg

SEQ ID NO: 1313901 - DNA, 17 bp, Homo sapiens
tctttttttccccccct

SEQ ID NO: 1313902 - DNA, 22 bp, Homo sapiens
tctttttttggtgattcaaatg

SEQ ID NO: 1313903 - DNA, 12 bp, Homo sapiens
tgaaaactggaa

SEQ ID NO: 1313904 - DNA, 14 bp, Homo sapiens
tgaaaactggaata

SEQ ID NO: 1313905 - DNA, 13 bp, Homo sapiens
tgaaacacagctg

SEQ ID NO: 1313906 - DNA, 15 bp, Homo sapiens
tgaaacacagctgtt

SEQ ID NO: 1313907 - DNA, 14 bp, Homo sapiens
tgaaattatatctg

SEQ ID NO: 1313908 - DNA, 16 bp, Homo sapiens
tgaacttgtagctgta

SEQ ID NO: 1313909 - DNA, 17 bp, Homo sapiens
tgaacttgtagctgtaa

SEQ ID NO: 1313910 - DNA, 19 bp, Homo sapiens
tgaacttgtagctgtaaaa

SEQ ID NO: 1313911 - DNA, 9 bp, Homo sapiens
tgaagggag

SEQ ID NO: 1313912 - DNA, 19 bp, Homo sapiens
tgaattattttgttactgt

SEQ ID NO: 1313913 - DNA, 21 bp, Homo sapiens
tgaattattttgttactgtct

SEQ ID NO: 1313914 - DNA, 23 bp, Homo sapiens
tgacaaatctgtgtatattattt

SEQ ID NO: 1313915 - DNA, 11 bp, Homo sapiens
tgacaagagcc

SEQ ID NO: 1313916 - DNA, 14 bp, Homo sapiens
tgacaagagcctga

SEQ ID NO: 1313917 - DNA, 22 bp, Homo sapiens
tgacaagagcctgatctcttcc

SEQ ID NO: 1313918 - DNA, 13 bp, Homo sapiens
tgacacaaaggaa

SEQ ID NO: 1313919 - DNA, 16 bp, Homo sapiens
tgacttctatcctgtt

SEQ ID NO: 1313920 - DNA, 16 bp, Homo sapiens
tgagcatcctgagccc

SEQ ID NO: 1313921 - DNA, 18 bp, Homo sapiens
tgagcatcctgagccccg

SEQ ID NO: 1313922 - DNA, 18 bp, Homo sapiens
tgagcccatgttctgccc

SEQ ID NO: 1313923 - DNA, 22 bp, Homo sapiens
tgagcccatgttctgcccccag

SEQ ID NO: 1313924 - DNA, 19 bp, Homo sapiens
tgagccccgccctcttcct

SEQ ID NO: 1313925 - DNA, 22 bp, Homo sapiens
tgataaaaaatttattatgtcc

SEQ ID NO: 1313926 - DNA, 14 bp, Homo sapiens
tgatatattttcca

SEQ ID NO: 1313927 - DNA, 12 bp, Homo sapiens
tgatctcttcct

SEQ ID NO: 1313928 - DNA, 13 bp, Homo sapiens
tgatctcttcctg

SEQ ID NO: 1313929 - DNA, 14 bp, Homo sapiens
tgatctcttcctgt

SEQ ID NO: 1313930 - DNA, 15 bp, Homo sapiens
tgatctgtttttcac

SEQ ID NO: 1313931 - DNA, 14 bp, Homo sapiens
tgatttttgttgat

SEQ ID NO: 1313932 - DNA, 10 bp, Homo sapiens
tgcacagctg

SEQ ID NO: 1313933 - DNA, 12 bp, Homo sapiens
tgcacagctgtc

SEQ ID NO: 1313934 - DNA, 13 bp, Homo sapiens
tgcacagctgtcc

SEQ ID NO: 1313935 - DNA, 14 bp, Homo sapiens
tgcacagctgtcca

SEQ ID NO: 1313936 - DNA, 14 bp, Homo sapiens
tgcaggaatcaaaa

SEQ ID NO: 1313937 - DNA, 19 bp, Homo sapiens
tgcaggaatcaaaaattga

SEQ ID NO: 1313938 - DNA, 20 bp, Homo sapiens
tgcaggaatcaaaaattgaa

SEQ ID NO: 1313939 - DNA, 15 bp, Homo sapiens
tgcagtcatcagaag

SEQ ID NO: 1313940 - DNA, 23 bp, Homo sapiens
tgccccaaataacttcagtcctg

SEQ ID NO: 1313941 - DNA, 20 bp, Homo sapiens
tgccccagtcgttagaatat

SEQ ID NO: 1313942 - DNA, 14 bp, Homo sapiens
tgcccccagcccaa

SEQ ID NO: 1313943 - DNA, 16 bp, Homo sapiens
tgcctcaccgcttccc

SEQ ID NO: 1313944 - DNA, 20 bp, Homo sapiens
tgctccagaatttggaaatc

SEQ ID NO: 1313945 - DNA, 23 bp, Homo sapiens
tggaactcagctgtctgtggctt

SEQ ID NO: 1313946 - DNA, 16 bp, Homo sapiens
tggactaaatgcctag

SEQ ID NO: 1313947 - DNA, 16 bp, Homo sapiens
tggcagtttggtattt

SEQ ID NO: 1313948 - DNA, 19 bp, Homo sapiens
tggccgcgtttagaccaag

SEQ ID NO: 1313949 - DNA, 20 bp, Homo sapiens
tggctaaatgcctaataaac

SEQ ID NO: 1313950 - DNA, 22 bp, Homo sapiens
tggctactttggtttctgtctg

SEQ ID NO: 1313951 - DNA, 18 bp, Homo sapiens
tggctgtggcattgttga

SEQ ID NO: 1313952 - DNA, 22 bp, Homo sapiens
tgggaacctcccagaggtccag

SEQ ID NO: 1313953 - DNA, 16 bp, Homo sapiens
tgggcacactctgcca

SEQ ID NO: 1313954 - DNA, 14 bp, Homo sapiens
tggggacccaggct

SEQ ID NO: 1313955 - DNA, 18 bp, Homo sapiens
tgggtgacaagagcctga

SEQ ID NO: 1313956 - DNA, 21 bp, Homo sapiens
tgggtttttttttttaaaaaa

SEQ ID NO: 1313957 - DNA, 12 bp, Homo sapiens
tgtaaaacgctg

SEQ ID NO: 1313958 - DNA, 23 bp, Homo sapiens
tgtaacttatgtagatatttggc

SEQ ID NO: 1313959 - DNA, 19 bp, Homo sapiens
tgtacattttgttgtaaaa

SEQ ID NO: 1313960 - DNA, 16 bp, Homo sapiens
tgtagatatttggctt

SEQ ID NO: 1313961 - DNA, 19 bp, Homo sapiens
tgtagatatttggcttaaa

SEQ ID NO: 1313962 - DNA, 13 bp, Homo sapiens
tgtagctgtaaaa

SEQ ID NO: 1313963 - DNA, 16 bp, Homo sapiens
tgtcaaaagttggact

SEQ ID NO: 1313964 - DNA, 19 bp, Homo sapiens
tgtccattattcaagaaag

SEQ ID NO: 1313965 - DNA, 23 bp, Homo sapiens
tgtctgcttagtatctcatcaac

SEQ ID NO: 1313966 - DNA, 19 bp, Homo sapiens
tgtctttctccaaagttat

SEQ ID NO: 1313967 - DNA, 15 bp, Homo sapiens
tgtgaaacacagctg

SEQ ID NO: 1313968 - DNA, 15 bp, Homo sapiens
tgtgaacttgtagct

SEQ ID NO: 1313969 - DNA, 20 bp, Homo sapiens
tgtgaacttgtagctgtaaa

SEQ ID NO: 1313970 - DNA, 18 bp, Homo sapiens
tgtgaattgcatgacttg

SEQ ID NO: 1313971 - DNA, 17 bp, Homo sapiens
tgtgtaaatgttatgac

SEQ ID NO: 1313972 - DNA, 19 bp, Homo sapiens
tgtgtatggatatgtgtaa

SEQ ID NO: 1313973 - DNA, 14 bp, Homo sapiens
tgttaacactgtaa

SEQ ID NO: 1313974 - DNA, 20 bp, Homo sapiens
tgttaacactgtaatatctt

SEQ ID NO: 1313975 - DNA, 12 bp, Homo sapiens
tgttatcttgtg

SEQ ID NO: 1313976 - DNA, 15 bp, Homo sapiens
tgttatcttgtgtat

SEQ ID NO: 1313977 - DNA, 19 bp, Homo sapiens
tgttatcttgtgtatggat

SEQ ID NO: 1313978 - DNA, 16 bp, Homo sapiens
tgttctgcccccagcc

SEQ ID NO: 1313979 - DNA, 14 bp, Homo sapiens
tgtttaatgtgaac

SEQ ID NO: 1313980 - DNA, 17 bp, Homo sapiens
tgtttaatgtgaacttg

SEQ ID NO: 1313981 - DNA, 22 bp, Homo sapiens
tgtttaatgtgaacttgtagct

SEQ ID NO: 1313982 - DNA, 18 bp, Homo sapiens
tgttttgtacatagattt

SEQ ID NO: 1313983 - DNA, 13 bp, Homo sapiens
ttaaaaaaagaaa

SEQ ID NO: 1313984 - DNA, 13 bp, Homo sapiens
ttaaaaagattct

SEQ ID NO: 1313985 - DNA, 20 bp, Homo sapiens
ttaaaaagttaatcttcatg

SEQ ID NO: 1313986 - DNA, 18 bp, Homo sapiens
ttaaaggcccagccccta

SEQ ID NO: 1313987 - DNA, 23 bp, Homo sapiens
ttaaatatagttcctaagaagct

SEQ ID NO: 1313988 - DNA, 14 bp, Homo sapiens
ttaaatgatgtaca

SEQ ID NO: 1313989 - DNA, 17 bp, Homo sapiens
ttaacactgtaatatct

SEQ ID NO: 1313990 - DNA, 18 bp, Homo sapiens
ttaacactgtaatatctt

SEQ ID NO: 1313991 - DNA, 16 bp, Homo sapiens
ttaatagtatatctaa

SEQ ID NO: 1313992 - DNA, 13 bp, Homo sapiens
ttactcagggctc

SEQ ID NO: 1313993 - DNA, 19 bp, Homo sapiens
ttactcagggctcctccca

SEQ ID NO: 1313994 - DNA, 20 bp, Homo sapiens
ttactcagggctcctcccag

SEQ ID NO: 1313995 - DNA, 14 bp, Homo sapiens
ttactgtctgtagt

SEQ ID NO: 1313996 - DNA, 16 bp, Homo sapiens
ttactgtctgtagtgt

SEQ ID NO: 1313997 - DNA, 13 bp, Homo sapiens
ttagtaatctgta

SEQ ID NO: 1313998 - DNA, 21 bp, Homo sapiens
ttatctacccaagggcagaaa

SEQ ID NO: 1313999 - DNA, 23 bp, Homo sapiens
ttatgacaatgactgtgctactg

SEQ ID NO: 1314000 - DNA, 17 bp, Homo sapiens
ttatgggcattgacaaa

SEQ ID NO: 1314001 - DNA, 23 bp, Homo sapiens
ttattcaagaaagatatctatga

SEQ ID NO: 1314002 - DNA, 16 bp, Homo sapiens
ttattcattagctgtg

SEQ ID NO: 1314003 - DNA, 17 bp, Homo sapiens
ttattcattagctgtga

SEQ ID NO: 1314004 - DNA, 17 bp, Homo sapiens
ttattttgttactgtct

SEQ ID NO: 1314005 - DNA, 22 bp, Homo sapiens
ttcacccttaacccaaggagca

SEQ ID NO: 1314006 - DNA, 21 bp, Homo sapiens
ttcactctgggcacactctgc

SEQ ID NO: 1314007 - DNA, 14 bp, Homo sapiens
ttcattaaatgttt

SEQ ID NO: 1314008 - DNA, 14 bp, Homo sapiens
ttcattagctgtga

SEQ ID NO: 1314009 - DNA, 17 bp, Homo sapiens
ttcatttcctctgagct

SEQ ID NO: 1314010 - DNA, 13 bp, Homo sapiens
ttccaagaaagat

SEQ ID NO: 1314011 - DNA, 23 bp, Homo sapiens
ttccaagaaagatgaatacattt

SEQ ID NO: 1314012 - DNA, 14 bp, Homo sapiens
ttccagggcaatca

SEQ ID NO: 1314013 - DNA, 21 bp, Homo sapiens
ttccatatcttgcgaatccaa

SEQ ID NO: 1314014 - DNA, 14 bp, Homo sapiens
ttcccggtcccgag

SEQ ID NO: 1314015 - DNA, 19 bp, Homo sapiens
ttcccggtcccgagtacag

SEQ ID NO: 1314016 - DNA, 20 bp, Homo sapiens
ttcccggtcccgagtacagt

SEQ ID NO: 1314017 - DNA, 16 bp, Homo sapiens
ttcctaagaagcttct

SEQ ID NO: 1314018 - DNA, 13 bp, Homo sapiens
ttctaataaatta

SEQ ID NO: 1314019 - DNA, 20 bp, Homo sapiens
ttctcccagaatcccagccg

SEQ ID NO: 1314020 - DNA, 13 bp, Homo sapiens
ttctcttcagtgt

SEQ ID NO: 1314021 - DNA, 16 bp, Homo sapiens
ttctcttcagtgtgtt

SEQ ID NO: 1314022 - DNA, 13 bp, Homo sapiens
ttctgcaaaatag

SEQ ID NO: 1314023 - DNA, 14 bp, Homo sapiens
ttctgcccccagcc

SEQ ID NO: 1314024 - DNA, 15 bp, Homo sapiens
ttctgcccccagccc

SEQ ID NO: 1314025 - DNA, 16 bp, Homo sapiens
ttctgcccccagccca

SEQ ID NO: 1314026 - DNA, 11 bp, Homo sapiens
ttctgttgtaa

SEQ ID NO: 1314027 - DNA, 12 bp, Homo sapiens
ttctgttgtaac

SEQ ID NO: 1314028 - DNA, 22 bp, Homo sapiens
ttctgttgtaacttatgtagat

SEQ ID NO: 1314029 - DNA, 16 bp, Homo sapiens
ttgaaattatatctgt

SEQ ID NO: 1314030 - DNA, 18 bp, Homo sapiens
ttgaagagagatatatct

SEQ ID NO: 1314031 - DNA, 18 bp, Homo sapiens
ttgaattattttgttact

SEQ ID NO: 1314032 - DNA, 13 bp, Homo sapiens
ttgacaaatctgt

SEQ ID NO: 1314033 - DNA, 17 bp, Homo sapiens
ttgacaaatctgtgtat

SEQ ID NO: 1314034 - DNA, 15 bp, Homo sapiens
ttgacacaattggaa

SEQ ID NO: 1314035 - DNA, 20 bp, Homo sapiens
ttgacttctatcctgttaac

SEQ ID NO: 1314036 - DNA, 20 bp, Homo sapiens
ttgcgaatccaagctccctg

SEQ ID NO: 1314037 - DNA, 17 bp, Homo sapiens
ttgctgatttcccctct

SEQ ID NO: 1314038 - DNA, 14 bp, Homo sapiens
ttggcagtttggta

SEQ ID NO: 1314039 - DNA, 15 bp, Homo sapiens
ttggcagtttggtat

SEQ ID NO: 1314040 - DNA, 14 bp, Homo sapiens
ttgtaaaaagaaaa

SEQ ID NO: 1314041 - DNA, 19 bp, Homo sapiens
ttgtcactgacacaaagga

SEQ ID NO: 1314042 - DNA, 18 bp, Homo sapiens
ttgtgaaacacagctgtt

SEQ ID NO: 1314043 - DNA, 20 bp, Homo sapiens
ttgtggggacccaggctccg

SEQ ID NO: 1314044 - DNA, 16 bp, Homo sapiens
ttgttgtaaaaagaaa

SEQ ID NO: 1314045 - DNA, 16 bp, Homo sapiens
ttgtttaatgtgaact

SEQ ID NO: 1314046 - DNA, 23 bp, Homo sapiens
tttaaaggcccagcccctagaaa

SEQ ID NO: 1314047 - DNA, 22 bp, Homo sapiens
tttaatagtatatctaatggct

SEQ ID NO: 1314048 - DNA, 18 bp, Homo sapiens
cttgtgaaacacagctgt

SEQ ID NO: 1314049 - DNA, 19 bp, Homo sapiens
cttgtgaaacacagctgtt

SEQ ID NO: 1314050 - DNA, 13 bp, Homo sapiens
ctttaaatgatgt

SEQ ID NO: 1314051 - DNA, 21 bp, Homo sapiens
ctttaatttctgtcagaatgc

SEQ ID NO: 1314052 - DNA, 19 bp, Homo sapiens
cttttcttaacaacctggc

SEQ ID NO: 1314053 - DNA, 14 bp, Homo sapiens
ctttttctgttgta

SEQ ID NO: 1314054 - DNA, 16 bp, Homo sapiens
ctttttctgttgtaac

SEQ ID NO: 1314055 - DNA, 18 bp, Homo sapiens
ctttttctgttgtaactt

SEQ ID NO: 1314056 - DNA, 21 bp, Homo sapiens
ctttttttggtgattcaaatg

SEQ ID NO: 1314057 - DNA, 11 bp, Homo sapiens
gaaaaatgttt

SEQ ID NO: 1314058 - DNA, 12 bp, Homo sapiens
gaaaaatgtttg

SEQ ID NO: 1314059 - DNA, 17 bp, Homo sapiens
gaaaactggaataagaa

SEQ ID NO: 1314060 - DNA, 14 bp, Homo sapiens
gaaaatagtttgtt

SEQ ID NO: 1314061 - DNA, 15 bp, Homo sapiens
gaaacacagctgttc

SEQ ID NO: 1314062 - DNA, 23 bp, Homo sapiens
gaaacacagctgttcttctgttc

SEQ ID NO: 1314063 - DNA, 17 bp, Homo sapiens
gaaacccaagctcctcc

SEQ ID NO: 1314064 - DNA, 17 bp, Homo sapiens
gaaagagtcttcaacat

SEQ ID NO: 1314065 - DNA, 15 bp, Homo sapiens
gaaagatatctatga

SEQ ID NO: 1314066 - DNA, 19 bp, Homo sapiens
gaaattatatctgtggtct

SEQ ID NO: 1314067 - DNA, 14 bp, Homo sapiens
gaacaaaaaaacca

SEQ ID NO: 1314068 - DNA, 18 bp, Homo sapiens
gaacaaaaaaaccacaaa

SEQ ID NO: 1314069 - DNA, 12 bp, Homo sapiens
gaacccagggct

SEQ ID NO: 1314070 - DNA, 13 bp, Homo sapiens
gaacctcccagag

SEQ ID NO: 1314071 - DNA, 22 bp, Homo sapiens
gaacctcccagaggtccagccc

SEQ ID NO: 1314072 - DNA, 16 bp, Homo sapiens
gaactcagctgtctgt

SEQ ID NO: 1314073 - DNA, 21 bp, Homo sapiens
gaacttactattcattaaatg

SEQ ID NO: 1314074 - DNA, 15 bp, Homo sapiens
gaacttgtagctgta

SEQ ID NO: 1314075 - DNA, 18 bp, Homo sapiens
gaagagagatatatctga

SEQ ID NO: 1314076 - DNA, 19 bp, Homo sapiens
gaagagagatatatctgaa

SEQ ID NO: 1314077 - DNA, 23 bp, Homo sapiens
gaagagagatatatctgaaaact

SEQ ID NO: 1314078 - DNA, 13 bp, Homo sapiens
gaagcttctaata

SEQ ID NO: 1314079 - DNA, 15 bp, Homo sapiens
gaagcttctaataaa

SEQ ID NO: 1314080 - DNA, 22 bp, Homo sapiens
gaatataggtctcttctcccag

SEQ ID NO: 1314081 - DNA, 23 bp, Homo sapiens
gaatataggtctcttctcccaga

SEQ ID NO: 1314082 - DNA, 15 bp, Homo sapiens
gaatcaaaaattgaa

SEQ ID NO: 1314083 - DNA, 21 bp, Homo sapiens
gaatcaaaaattgaagagaga

SEQ ID NO: 1314084 - DNA, 18 bp, Homo sapiens
gaatccaagctccctgcc

SEQ ID NO: 1314085 - DNA, 15 bp, Homo sapiens
gaattattttgttac

SEQ ID NO: 1314086 - DNA, 16 bp, Homo sapiens
gaattattttgttact

SEQ ID NO: 1314087 - DNA, 12 bp, Homo sapiens
gacaaatctgtg

SEQ ID NO: 1314088 - DNA, 23 bp, Homo sapiens
gacaagagcctgatctcttcctg

SEQ ID NO: 1314089 - DNA, 18 bp, Homo sapiens
gacacaaaactccgcccc

SEQ ID NO: 1314090 - DNA, 19 bp, Homo sapiens
gacaggcctcacctctacc

SEQ ID NO: 1314091 - DNA, 18 bp, Homo sapiens
gaccaaacttcactctgg

SEQ ID NO: 1314092 - DNA, 20 bp, Homo sapiens
gaccaacgttactcagggct

SEQ ID NO: 1314093 - DNA, 11 bp, Homo sapiens
gaccaaggaac

SEQ ID NO: 1314094 - DNA, 15 bp, Homo sapiens
gaccaaggaacaaaa

SEQ ID NO: 1314095 - DNA, 23 bp, Homo sapiens
gaccaaggaacaaaaaaaccaca

SEQ ID NO: 1314096 - DNA, 14 bp, Homo sapiens
gaccctctgggaac

SEQ ID NO: 1314097 - DNA, 22 bp, Homo sapiens
gaccgccctccgcgaaaatagt

SEQ ID NO: 1314098 - DNA, 21 bp, Homo sapiens
gaccgcttgtggggacccagg

SEQ ID NO: 1314099 - DNA, 15 bp, Homo sapiens
gactcgcttgtaaat

SEQ ID NO: 1314100 - DNA, 16 bp, Homo sapiens
gactctaaagaccaaa

SEQ ID NO: 1314101 - DNA, 19 bp, Homo sapiens
gactctaaagaccaaactt

SEQ ID NO: 1314102 - DNA, 12 bp, Homo sapiens
gactgtgtttaa

SEQ ID NO: 1314103 - DNA, 18 bp, Homo sapiens
gagagatatatctgaaaa

SEQ ID NO: 1314104 - DNA, 22 bp, Homo sapiens
gagcacaggtcccacctccagc

SEQ ID NO: 1314105 - DNA, 15 bp, Homo sapiens
gagcatcctgagccc

SEQ ID NO: 1314106 - DNA, 22 bp, Homo sapiens
gagcatcctgagccccgccctc

SEQ ID NO: 1314107 - DNA, 17 bp, Homo sapiens
gagccccgccctcttcc

SEQ ID NO: 1314108 - DNA, 16 bp, Homo sapiens
gagcctgatctcttcc

SEQ ID NO: 1314109 - DNA, 18 bp, Homo sapiens
gagcctgatctcttcctg

SEQ ID NO: 1314110 - DNA, 16 bp, Homo sapiens
gaggaaagagtcttca

SEQ ID NO: 1314111 - DNA, 20 bp, Homo sapiens
gaggaaagagtcttcaacat

SEQ ID NO: 1314112 - DNA, 18 bp, Homo sapiens
gaggaaatctgcagaggg

SEQ ID NO: 1314113 - DNA, 21 bp, Homo sapiens
gaggactcgcttgtaaatacc

SEQ ID NO: 1314114 - DNA, 22 bp, Homo sapiens
gaggactcgcttgtaaatacca

SEQ ID NO: 1314115 - DNA, 21 bp, Homo sapiens
gagggactttgctgatttccc

SEQ ID NO: 1314116 - DNA, 14 bp, Homo sapiens
gagggctctgtgct

SEQ ID NO: 1314117 - DNA, 13 bp, Homo sapiens
gaggtccagccca

SEQ ID NO: 1314118 - DNA, 14 bp, Homo sapiens
gaggtccagcccat

SEQ ID NO: 1314119 - DNA, 15 bp, Homo sapiens
gagtgcacagctgtc

SEQ ID NO: 1314120 - DNA, 12 bp, Homo sapiens
gatatatctgaa

SEQ ID NO: 1314121 - DNA, 16 bp, Homo sapiens
gatatatctgaaaact

SEQ ID NO: 1314122 - DNA, 14 bp, Homo sapiens
gatatttggcttaa

SEQ ID NO: 1314123 - DNA, 13 bp, Homo sapiens
gatctcttcctgt

SEQ ID NO: 1314124 - DNA, 20 bp, Homo sapiens
gatttatttttcagttccaa

SEQ ID NO: 1314125 - DNA, 14 bp, Homo sapiens
gattttcatgttct

SEQ ID NO: 1314126 - DNA, 15 bp, Homo sapiens
gattttcatgttctt

SEQ ID NO: 1314127 - DNA, 16 bp, Homo sapiens
gattttctccagctca

SEQ ID NO: 1314128 - DNA, 14 bp, Homo sapiens
gatttttgttgatt

SEQ ID NO: 1314129 - DNA, 21 bp, Homo sapiens
gcacaagcagagtgcacagct

SEQ ID NO: 1314130 - DNA, 22 bp, Homo sapiens
gcacaggtcccacctccagccc

SEQ ID NO: 1314131 - DNA, 21 bp, Homo sapiens
gcacttcagaattccatatct

SEQ ID NO: 1314132 - DNA, 16 bp, Homo sapiens
gcagagtgcacagctg

SEQ ID NO: 1314133 - DNA, 18 bp, Homo sapiens
gcagagtgcacagctgtc

SEQ ID NO: 1314134 - DNA, 11 bp, Homo sapiens
gcataaaacag

SEQ ID NO: 1314135 - DNA, 22 bp, Homo sapiens
gcatattcttttctgcaaaata

SEQ ID NO: 1314136 - DNA, 19 bp, Homo sapiens
gcattgacaaatctgtgta

SEQ ID NO: 1314137 - DNA, 23 bp, Homo sapiens
gcattgttgatgctcacatatga

SEQ ID NO: 1314138 - DNA, 14 bp, Homo sapiens
gccacacagaccac

SEQ ID NO: 1314139 - DNA, 21 bp, Homo sapiens
gcccaaaggggacaggcctca

SEQ ID NO: 1314140 - DNA, 14 bp, Homo sapiens
gcccagcccctaga

SEQ ID NO: 1314141 - DNA, 16 bp, Homo sapiens
gcccagcgctctgcct

SEQ ID NO: 1314142 - DNA, 14 bp, Homo sapiens
gcccatctcggagc

SEQ ID NO: 1314143 - DNA, 20 bp, Homo sapiens
gcccatctcggagcatcccg

SEQ ID NO: 1314144 - DNA, 15 bp, Homo sapiens
gcccatgttctgccc

SEQ ID NO: 1314145 - DNA, 23 bp, Homo sapiens
gcccatgttctgcccccagccca

SEQ ID NO: 1314146 - DNA, 14 bp, Homo sapiens
gcccccagcctatg

SEQ ID NO: 1314147 - DNA, 15 bp, Homo sapiens
gccccgccctcttcc

SEQ ID NO: 1314148 - DNA, 18 bp, Homo sapiens
gccccgccctcttcctga

SEQ ID NO: 1314149 - DNA, 19 bp, Homo sapiens
gcccctagaaacccaagct

SEQ ID NO: 1314150 - DNA, 12 bp, Homo sapiens
gccctcttcctg

SEQ ID NO: 1314151 - DNA, 13 bp, Homo sapiens
gccctcttcctga

SEQ ID NO: 1314152 - DNA, 16 bp, Homo sapiens
gccctcttcctgacga

SEQ ID NO: 1314153 - DNA, 15 bp, Homo sapiens
gcccttagtccccca

SEQ ID NO: 1314154 - DNA, 17 bp, Homo sapiens
gcccttagtcccccaac

SEQ ID NO: 1314155 - DNA, 18 bp, Homo sapiens
gcccttagtcccccaact

SEQ ID NO: 1314156 - DNA, 15 bp, Homo sapiens
cttcagtcctgctcc

SEQ ID NO: 1314157 - DNA, 23 bp, Homo sapiens
cttcagtcctgctccagaatttg

SEQ ID NO: 1314158 - DNA, 14 bp, Homo sapiens
cttcatggaactca

SEQ ID NO: 1314159 - DNA, 21 bp, Homo sapiens
cttcatggaactcagctgtct

SEQ ID NO: 1314160 - DNA, 19 bp, Homo sapiens
cttcatggccatagctttt

SEQ ID NO: 1314161 - DNA, 20 bp, Homo sapiens
cttcatttcctctgagctgt

SEQ ID NO: 1314162 - DNA, 17 bp, Homo sapiens
cttcccatgtctttctc

SEQ ID NO: 1314163 - DNA, 21 bp, Homo sapiens
cttccgaccctctgggaacct

SEQ ID NO: 1314164 - DNA, 14 bp, Homo sapiens
cttcggaccgcttg

SEQ ID NO: 1314165 - DNA, 19 bp, Homo sapiens
cttcgtatcccgagtctgg

SEQ ID NO: 1314166 - DNA, 13 bp, Homo sapiens
cttctaataaatt

SEQ ID NO: 1314167 - DNA, 15 bp, Homo sapiens
cttctatcctgttaa

SEQ ID NO: 1314168 - DNA, 20 bp, Homo sapiens
cttctcccagaatcccagcc

SEQ ID NO: 1314169 - DNA, 24 bp, Homo sapiens
cttgaaattatatctgtggtcttc

SEQ ID NO: 1314170 - DNA, 19 bp, Homo sapiens
cttgtaaataccaggattt

SEQ ID NO: 1314171 - DNA, 13 bp, Homo sapiens
cttgtagctgtaa

SEQ ID NO: 1314172 - DNA, 14 bp, Homo sapiens
cttgtagctgtaaa

SEQ ID NO: 1314173 - DNA, 15 bp, Homo sapiens
cttgtagctgtaaaa

SEQ ID NO: 1314174 - DNA, 21 bp, Homo sapiens
cttgtaggagctgaggtttca

SEQ ID NO: 1314175 - DNA, 17 bp, Homo sapiens
ccttaacccaaggagca

SEQ ID NO: 1314176 - DNA, 14 bp, Homo sapiens
ccttccgaccctct

SEQ ID NO: 1314177 - DNA, 19 bp, Homo sapiens
ccttccgaccctctgggaa

SEQ ID NO: 1314178 - DNA, 22 bp, Homo sapiens
ccttccgaccctctgggaacct

SEQ ID NO: 1314179 - DNA, 14 bp, Homo sapiens
ccttcgtatcccga

SEQ ID NO: 1314180 - DNA, 22 bp, Homo sapiens
ccttcgtatcccgagtctggga

SEQ ID NO: 1314181 - DNA, 22 bp, Homo sapiens
cgaatccaagctccctgcccca

SEQ ID NO: 1314182 - DNA, 18 bp, Homo sapiens
cgaccctctgggaacctc

SEQ ID NO: 1314183 - DNA, 22 bp, Homo sapiens
cgaccctctgggaacctcccag

SEQ ID NO: 1314184 - DNA, 23 bp, Homo sapiens
cgaccctctgggaacctcccaga

SEQ ID NO: 1314185 - DNA, 15 bp, Homo sapiens
cgcgtttagaccaag

SEQ ID NO: 1314186 - DNA, 24 bp, Homo sapiens
ccaaactgctggacgtctttcttt

SEQ ID NO: 1314187 - DNA, 17 bp, Homo sapiens
ccaaaggggacaggcct

SEQ ID NO: 1314188 - DNA, 19 bp, Homo sapiens
ccaaaggggacaggcctca

SEQ ID NO: 1314189 - DNA, 16 bp, Homo sapiens
ccaaataacttcagtc

SEQ ID NO: 1314190 - DNA, 18 bp, Homo sapiens
ccaaataacttcagtcct

SEQ ID NO: 1314191 - DNA, 22 bp, Homo sapiens
gcttaaatatagttcctaagaa

SEQ ID NO: 1314192 - DNA, 22 bp, Homo sapiens
gcttagtatctcatcaacaaag

SEQ ID NO: 1314193 - DNA, 17 bp, Homo sapiens
gcttcccatgtctttct

SEQ ID NO: 1314194 - DNA, 14 bp, Homo sapiens
gcttcgacttttct

SEQ ID NO: 1314195 - DNA, 15 bp, Homo sapiens
gcttgtaaataccag

SEQ ID NO: 1314196 - DNA, 17 bp, Homo sapiens
gcttgtaaataccagga

SEQ ID NO: 1314197 - DNA, 17 bp, Homo sapiens
ggaacaaaaaaaccaca

SEQ ID NO: 1314198 - DNA, 15 bp, Homo sapiens
ggaacctcccagagg

SEQ ID NO: 1314199 - DNA, 16 bp, Homo sapiens
ggaacctcccagaggt

SEQ ID NO: 1314200 - DNA, 22 bp, Homo sapiens
ggaacctcccagaggtccagcc

SEQ ID NO: 1314201 - DNA, 23 bp, Homo sapiens
ggaacctcccagaggtccagccc

SEQ ID NO: 1314202 - DNA, 14 bp, Homo sapiens
ggaatcaaaaattg

SEQ ID NO: 1314203 - DNA, 18 bp, Homo sapiens
ggacacaaaactccgccc

SEQ ID NO: 1314204 - DNA, 22 bp, Homo sapiens
ggacacaaaactccgcccccag

SEQ ID NO: 1314205 - DNA, 23 bp, Homo sapiens
ggacaggcctcacctctacccaa

SEQ ID NO: 1314206 - DNA, 13 bp, Homo sapiens
ggaccactcagcc

SEQ ID NO: 1314207 - DNA, 17 bp, Homo sapiens
ggaccactcagccccta

SEQ ID NO: 1314208 - DNA, 11 bp, Homo sapiens
ggacctccctt

SEQ ID NO: 1314209 - DNA, 17 bp, Homo sapiens
ggacctcccttccgacc

SEQ ID NO: 1314210 - DNA, 24 bp, Homo sapiens
ggacgccgggccggccctagccca

SEQ ID NO: 1314211 - DNA, 13 bp, Homo sapiens
ggacgtctttctt

SEQ ID NO: 1314212 - DNA, 21 bp, Homo sapiens
ggactaaatgcctagttttta

SEQ ID NO: 1314213 - DNA, 23 bp, Homo sapiens
ggacttcggaccgcttgtgggga

SEQ ID NO: 1314214 - DNA, 22 bp, Homo sapiens
ggactttgctgatttcccctct

SEQ ID NO: 1314215 - DNA, 15 bp, Homo sapiens
ggagcacaggtccca

SEQ ID NO: 1314216 - DNA, 18 bp, Homo sapiens
ggagcacaggtcccacct

SEQ ID NO: 1314217 - DNA, 22 bp, Homo sapiens
ggagcctaggaccactcagccc

SEQ ID NO: 1314218 - DNA, 20 bp, Homo sapiens
ggagctggggagaggaaaga

SEQ ID NO: 1314219 - DNA, 16 bp, Homo sapiens
ggatcagagcaggacc

SEQ ID NO: 1314220 - DNA, 18 bp, Homo sapiens
ggatcagagcaggacctc

SEQ ID NO: 1314221 - DNA, 15 bp, Homo sapiens
ggcaatcaatgttca

SEQ ID NO: 1314222 - DNA, 21 bp, Homo sapiens
ggcacactctgccagcaaaga

SEQ ID NO: 1314223 - DNA, 11 bp, Homo sapiens
ggcacagattg

SEQ ID NO: 1314224 - DNA, 15 bp, Homo sapiens
ggcacttaagcacaa

SEQ ID NO: 1314225 - DNA, 14 bp, Homo sapiens
ggccaaactgctgg

SEQ ID NO: 1314226 - DNA, 22 bp, Homo sapiens
ggccaatggaaacctcacgctg

SEQ ID NO: 1314227 - DNA, 13 bp, Homo sapiens
ggcccagccccta

SEQ ID NO: 1314228 - DNA, 14 bp, Homo sapiens
ggcccagcccctag

SEQ ID NO: 1314229 - DNA, 21 bp, Homo sapiens
ggccctagcccagcgctctgc

SEQ ID NO: 1314230 - DNA, 16 bp, Homo sapiens
ggcgaccgccctccgc

SEQ ID NO: 1314231 - DNA, 11 bp, Homo sapiens
gggaacctccc

SEQ ID NO: 1314232 - DNA, 18 bp, Homo sapiens
gggacacaaaactccgcc

SEQ ID NO: 1314233 - DNA, 12 bp, Homo sapiens
gggacaggcctc

SEQ ID NO: 1314234 - DNA, 12 bp, Homo sapiens
gggacccaggct

SEQ ID NO: 1314235 - DNA, 13 bp, Homo sapiens
gggacccaggctc

SEQ ID NO: 1314236 - DNA, 17 bp, Homo sapiens
gggacccaggctccgcc

SEQ ID NO: 1314237 - DNA, 19 bp, Homo sapiens
gggacccaggctccgccct

SEQ ID NO: 1314238 - DNA, 22 bp, Homo sapiens
gggacccaggctccgcccttag

SEQ ID NO: 1314239 - DNA, 13 bp, Homo sapiens
gggagaggaaaga

SEQ ID NO: 1314240 - DNA, 20 bp, Homo sapiens
gggagcctaggaccactcag

SEQ ID NO: 1314241 - DNA, 15 bp, Homo sapiens
gggcacactctgcca

SEQ ID NO: 1314242 - DNA, 12 bp, Homo sapiens
gggctctgcccc

SEQ ID NO: 1314243 - DNA, 13 bp, Homo sapiens
ggggacaggcctc

SEQ ID NO: 1314244 - DNA, 16 bp, Homo sapiens
ggtcccacctccagcc

SEQ ID NO: 1314245 - DNA, 22 bp, Homo sapiens
ggtcccacctccagcccgggag

SEQ ID NO: 1314246 - DNA, 14 bp, Homo sapiens
ggtctcttctccca

SEQ ID NO: 1314247 - DNA, 16 bp, Homo sapiens
ggtctcttctcccaga

SEQ ID NO: 1314248 - DNA, 17 bp, Homo sapiens
ggtctcttctcccagaa

SEQ ID NO: 1314249 - DNA, 13 bp, Homo sapiens
ggtgacaagagcc

SEQ ID NO: 1314250 - DNA, 14 bp, Homo sapiens
ggtgacaagagcct

SEQ ID NO: 1314251 - DNA, 13 bp, Homo sapiens
ggttttccacgct

SEQ ID NO: 1314252 - DNA, 21 bp, Homo sapiens
gtaaaacgctgtcaaaagttg

SEQ ID NO: 1314253 - DNA, 15 bp, Homo sapiens
gtaacttatgtagat

SEQ ID NO: 1314254 - DNA, 19 bp, Homo sapiens
gtacattttgttgtaaaaa

SEQ ID NO: 1314255 - DNA, 21 bp, Homo sapiens
gtacattttgttgtaaaaaga

SEQ ID NO: 1314256 - DNA, 22 bp, Homo sapiens
gtacattttgttgtaaaaagaa

SEQ ID NO: 1314257 - DNA, 20 bp, Homo sapiens
gtacttgtgaaacacagctg

SEQ ID NO: 1314258 - DNA, 16 bp, Homo sapiens
gtatatttccgcactt

SEQ ID NO: 1314259 - DNA, 15 bp, Homo sapiens
gtatcaaacccacga

SEQ ID NO: 1314260 - DNA, 19 bp, Homo sapiens
gtatcccgagtctgggaca

SEQ ID NO: 1314261 - DNA, 20 bp, Homo sapiens
gtatcccgagtctgggacac

SEQ ID NO: 1314262 - DNA, 16 bp, Homo sapiens
gtcaaaagttggacta

SEQ ID NO: 1314263 - DNA, 12 bp, Homo sapiens
gtcatgtggcta

SEQ ID NO: 1314264 - DNA, 16 bp, Homo sapiens
gtcccacctccagccc

SEQ ID NO: 1314265 - DNA, 20 bp, Homo sapiens
gtcccccaactctgagccca

SEQ ID NO: 1314266 - DNA, 22 bp, Homo sapiens
gtcctgctccagaatttggaaa

SEQ ID NO: 1314267 - DNA, 15 bp, Homo sapiens
gtctcagttggaaat

SEQ ID NO: 1314268 - DNA, 16 bp, Homo sapiens
gtctcttctcccagaa

SEQ ID NO: 1314269 - DNA, 14 bp, Homo sapiens
gtctgggacacaaa

SEQ ID NO: 1314270 - DNA, 23 bp, Homo sapiens
gtctttaatttctgtcagaatgc

SEQ ID NO: 1314271 - DNA, 14 bp, Homo sapiens
gtctttctccaaag

SEQ ID NO: 1314272 - DNA, 14 bp, Homo sapiens
gtgaaacacagctg

SEQ ID NO: 1314273 - DNA, 16 bp, Homo sapiens
gtgaaacacagctgtt

SEQ ID NO: 1314274 - DNA, 12 bp, Homo sapiens
gtgaacttgtag

SEQ ID NO: 1314275 - DNA, 15 bp, Homo sapiens
gtgaacttgtagctg

SEQ ID NO: 1314276 - DNA, 20 bp, Homo sapiens
gtgaacttgtagctgtaaaa

SEQ ID NO: 1314277 - DNA, 20 bp, Homo sapiens
gtgctactgtctttggaaaa

SEQ ID NO: 1314278 - DNA, 21 bp, Homo sapiens
gtggggacccaggctccgccc

SEQ ID NO: 1314279 - DNA, 17 bp, Homo sapiens
gttaacactgtaatatc

SEQ ID NO: 1314280 - DNA, 21 bp, Homo sapiens
gttaacactgtaatatcttta

SEQ ID NO: 1314281 - DNA, 14 bp, Homo sapiens
gttaatcttcatgg

SEQ ID NO: 1314282 - DNA, 17 bp, Homo sapiens
gttactgtctgtagtgt

SEQ ID NO: 1314283 - DNA, 22 bp, Homo sapiens
gttagaatataggtctcttctc

SEQ ID NO: 1314284 - DNA, 15 bp, Homo sapiens
gttcccggtcccgag

SEQ ID NO: 1314285 - DNA, 21 bp, Homo sapiens
gttcctaagaagcttctaata

SEQ ID NO: 1314286 - DNA, 20 bp, Homo sapiens
gttctgcagacacgccttcc

SEQ ID NO: 1314287 - DNA, 19 bp, Homo sapiens
gttctgcccccagcccaaa

SEQ ID NO: 1314288 - DNA, 14 bp, Homo sapiens
gttggactaaatgc

SEQ ID NO: 1314289 - DNA, 18 bp, Homo sapiens
gttggactaaatgcctag

SEQ ID NO: 1314290 - DNA, 15 bp, Homo sapiens
gtttagaccaaggaa

SEQ ID NO: 1314291 - DNA, 22 bp, Homo sapiens
gtttagaccaaggaacaaaaaa

SEQ ID NO: 1314292 - DNA, 18 bp, Homo sapiens
gttttgtacatagattta

SEQ ID NO: 1314293 - DNA, 15 bp, Homo sapiens
tacaaattaaaaaga

SEQ ID NO: 1314294 - DNA, 16 bp, Homo sapiens
tacaaattaaaaagat

SEQ ID NO: 1314295 - DNA, 22 bp, Homo sapiens
tacatagatttatttttcagtt

SEQ ID NO: 1314296 - DNA, 22 bp, Homo sapiens
tacattttgttgtaaaaagaaa

SEQ ID NO: 1314297 - DNA, 21 bp, Homo sapiens
taccagtctttaaaggcccag

SEQ ID NO: 1314298 - DNA, 18 bp, Homo sapiens
tactcagggctcctccca

SEQ ID NO: 1314299 - DNA, 22 bp, Homo sapiens
tactggaccaaaaaaataaagc

SEQ ID NO: 1314300 - DNA, 18 bp, Homo sapiens
tacttgtgaaacacagct

SEQ ID NO: 1314301 - DNA, 15 bp, Homo sapiens
tagaacttactattc

SEQ ID NO: 1314302 - DNA, 15 bp, Homo sapiens
tagaccaaggaacaa

SEQ ID NO: 1314303 - DNA, 18 bp, Homo sapiens
tagaccaaggaacaaaaa

SEQ ID NO: 1314304 - DNA, 12 bp, Homo sapiens
tagatatttggc

SEQ ID NO: 1314305 - DNA, 22 bp, Homo sapiens
tagatttatttttcagttccaa

SEQ ID NO: 1314306 - DNA, 21 bp, Homo sapiens
taggaccactcagcccctagg

SEQ ID NO: 1314307 - DNA, 14 bp, Homo sapiens
tagttcctaagaag

SEQ ID NO: 1314308 - DNA, 19 bp, Homo sapiens
tagttcctaagaagcttct

SEQ ID NO: 1314309 - DNA, 17 bp, Homo sapiens
tatacaaattaaaaaga

SEQ ID NO: 1314310 - DNA, 23 bp, Homo sapiens
tatacaaattaaaaagattcttt

SEQ ID NO: 1314311 - DNA, 23 bp, Homo sapiens
tatagttcctaagaagcttctaa

SEQ ID NO: 1314312 - DNA, 16 bp, Homo sapiens
tatatctgaaaactgg

SEQ ID NO: 1314313 - DNA, 18 bp, Homo sapiens
tatatctgtggtcttcaa

SEQ ID NO: 1314314 - DNA, 13 bp, Homo sapiens
tatattatttggc

SEQ ID NO: 1314315 - DNA, 22 bp, Homo sapiens
tatattatttggcagtttggta

SEQ ID NO: 1314316 - DNA, 17 bp, Homo sapiens
tatcccgagtctgggac

SEQ ID NO: 1314317 - DNA, 19 bp, Homo sapiens
tatcccgagtctgggacac

SEQ ID NO: 1314318 - DNA, 13 bp, Homo sapiens
tatcctgttaaca

SEQ ID NO: 1314319 - DNA, 23 bp, Homo sapiens
tatctcatcaacaaagaaatatt

SEQ ID NO: 1314320 - DNA, 13 bp, Homo sapiens
tatctgaaaactg

SEQ ID NO: 1314321 - DNA, 14 bp, Homo sapiens
tatcttgtgtatgg

SEQ ID NO: 1314322 - DNA, 22 bp, Homo sapiens
tatgagcatcctgagccccgcc

SEQ ID NO: 1314323 - DNA, 23 bp, Homo sapiens
tatggatatgtgtaaatgttatg

SEQ ID NO: 1314324 - DNA, 16 bp, Homo sapiens
tatgtagatatttggc

SEQ ID NO: 1314325 - DNA, 22 bp, Homo sapiens
tattgaattattttgttactgt

SEQ ID NO: 1314326 - DNA, 14 bp, Homo sapiens
tatttggcttaaat

SEQ ID NO: 1314327 - DNA, 15 bp, Homo sapiens
tatttggcttaaata

SEQ ID NO: 1314328 - DNA, 16 bp, Homo sapiens
tatttggcttaaatat

SEQ ID NO: 1314329 - DNA, 18 bp, Homo sapiens
tcaaaagttggactaaat

SEQ ID NO: 1314330 - DNA, 20 bp, Homo sapiens
tcaaaagttggactaaatgc

SEQ ID NO: 1314331 - DNA, 22 bp, Homo sapiens
tcaaacccacgattttctccag

SEQ ID NO: 1314332 - DNA, 18 bp, Homo sapiens
tcaacaaagaaatattat

SEQ ID NO: 1314333 - DNA, 17 bp, Homo sapiens
tcacattttttatgggc

SEQ ID NO: 1314334 - DNA, 22 bp, Homo sapiens
tcacccttaacccaaggagcac

SEQ ID NO: 1314335 - DNA, 14 bp, Homo sapiens
tcacctagagccag

SEQ ID NO: 1314336 - DNA, 18 bp, Homo sapiens
tcacctctacccaaaccc

SEQ ID NO: 1314337 - DNA, 19 bp, Homo sapiens
tcactgacacaaaggaagt

SEQ ID NO: 1314338 - DNA, 17 bp, Homo sapiens
tcactggggagtctgct

SEQ ID NO: 1314339 - DNA, 13 bp, Homo sapiens
tcagaacccaggg

SEQ ID NO: 1314340 - DNA, 23 bp, Homo sapiens
tcagaacccagggctctgcccca

SEQ ID NO: 1314341 - DNA, 18 bp, Homo sapiens
tcagagcaggacctccct

SEQ ID NO: 1314342 - DNA, 15 bp, Homo sapiens
tcagccacacccagg

SEQ ID NO: 1314343 - DNA, 13 bp, Homo sapiens
tcagcccctagga

SEQ ID NO: 1314344 - DNA, 14 bp, Homo sapiens
tcagcccctaggag

SEQ ID NO: 1314345 - DNA, 17 bp, Homo sapiens
tcagctgtctgtggctt

SEQ ID NO: 1314346 - DNA, 13 bp, Homo sapiens
tcagggctcctcc

SEQ ID NO: 1314347 - DNA, 24 bp, Homo sapiens
tcagtacttgtgaaacacagctgt

SEQ ID NO: 1314348 - DNA, 15 bp, Homo sapiens
tcagtctttttctgt

SEQ ID NO: 1314349 - DNA, 21 bp, Homo sapiens
tcagtctttttctgttgtaac

SEQ ID NO: 1314350 - DNA, 15 bp, Homo sapiens
tcagtgtgttgactt

SEQ ID NO: 1314351 - DNA, 12 bp, Homo sapiens
tcagttccaaga

SEQ ID NO: 1314352 - DNA, 18 bp, Homo sapiens
tcatcaacaaagaaatat

SEQ ID NO: 1314353 - DNA, 15 bp, Homo sapiens
tcatcctgccttcat

SEQ ID NO: 1314354 - DNA, 18 bp, Homo sapiens
tcattagctgtgattttt

SEQ ID NO: 1314355 - DNA, 16 bp, Homo sapiens
tccaagaaagatgaat

SEQ ID NO: 1314356 - DNA, 15 bp, Homo sapiens
tccaatctcaaggaa

SEQ ID NO: 1314357 - DNA, 19 bp, Homo sapiens
tccaatctcaaggaatctt

SEQ ID NO: 1314358 - DNA, 18 bp, Homo sapiens
tccagctcagaacccagg

SEQ ID NO: 1314359 - DNA, 19 bp, Homo sapiens
tccagctcagaacccaggg

SEQ ID NO: 1314360 - DNA, 14 bp, Homo sapiens
tccatatcttgcga

SEQ ID NO: 1314361 - DNA, 21 bp, Homo sapiens
tccatatcttgcgaatccaag

SEQ ID NO: 1314362 - DNA, 14 bp, Homo sapiens
tccattattcaaga

SEQ ID NO: 1314363 - DNA, 21 bp, Homo sapiens
tccattattcaagaaagatat

SEQ ID NO: 1314364 - DNA, 22 bp, Homo sapiens
tcccacctccagcccgggagcc

SEQ ID NO: 1314365 - DNA, 14 bp, Homo sapiens
tcccagaatcccag

SEQ ID NO: 1314366 - DNA, 16 bp, Homo sapiens
tcccagaatcccagcc

SEQ ID NO: 1314367 - DNA, 16 bp, Homo sapiens
tcccagaggtccagcc

SEQ ID NO: 1314368 - DNA, 17 bp, Homo sapiens
tcccagaggtccagccc

SEQ ID NO: 1314369 - DNA, 19 bp, Homo sapiens
tcccagaggtccagcccat

SEQ ID NO: 1314370 - DNA, 22 bp, Homo sapiens
tcccagaggtccagcccatctc

SEQ ID NO: 1314371 - DNA, 21 bp, Homo sapiens
tcccagccggccaatggaaac

SEQ ID NO: 1314372 - DNA, 14 bp, Homo sapiens
tccccggcaccctc

SEQ ID NO: 1314373 - DNA, 20 bp, Homo sapiens
tccccggcaccctctggccg

SEQ ID NO: 1314374 - DNA, 21 bp, Homo sapiens
tcccctcagccacacccaggc

SEQ ID NO: 1314375 - DNA, 17 bp, Homo sapiens
tcccctcttcccttcaa

SEQ ID NO: 1314376 - DNA, 14 bp, Homo sapiens
tcccgagtctggga

SEQ ID NO: 1314377 - DNA, 15 bp, Homo sapiens
tcccgagtctgggac

SEQ ID NO: 1314378 - DNA, 16 bp, Homo sapiens
tcccttccgaccctct

SEQ ID NO: 1314379 - DNA, 21 bp, Homo sapiens
tcccttccgaccctctgggaa

SEQ ID NO: 1314380 - DNA, 15 bp, Homo sapiens
tccgaccctctggga

SEQ ID NO: 1314381 - DNA, 18 bp, Homo sapiens
tccgaccctctgggaacc

SEQ ID NO: 1314382 - DNA, 21 bp, Homo sapiens
tccgaccctctgggaacctcc

SEQ ID NO: 1314383 - DNA, 16 bp, Homo sapiens
tccgcccccagcctat

SEQ ID NO: 1314384 - DNA, 19 bp, Homo sapiens
tcctaagaagcttctaata

SEQ ID NO: 1314385 - DNA, 17 bp, Homo sapiens
tcctagtttcctctcct

SEQ ID NO: 1314386 - DNA, 16 bp, Homo sapiens
aaaactccgcccccag

SEQ ID NO: 1314387 - DNA, 19 bp, Homo sapiens
aaaactccgcccccagcct

SEQ ID NO: 1314388 - DNA, 17 bp, Homo sapiens
aaaactggaataagaag

SEQ ID NO: 1314389 - DNA, 21 bp, Homo sapiens
aaaactggaataagaagcaaa

SEQ ID NO: 1314390 - DNA, 11 bp, Homo sapiens
aaaagaaaatg

SEQ ID NO: 1314391 - DNA, 19 bp, Homo sapiens
aaaagtgtcctataattct

SEQ ID NO: 1314392 - DNA, 20 bp, Homo sapiens
aaaagttggactaaatgcct

SEQ ID NO: 1314393 - DNA, 23 bp, Homo sapiens
aaaagttggactaaatgcctagt

SEQ ID NO: 1314394 - DNA, 13 bp, Homo sapiens
aaacgctgtcaaa

SEQ ID NO: 1314395 - DNA, 15 bp, Homo sapiens
aaactggccccggat

SEQ ID NO: 1314396 - DNA, 17 bp, Homo sapiens
aaagacaccatttatct

SEQ ID NO: 1314397 - DNA, 14 bp, Homo sapiens
aaagaccaaacttc

SEQ ID NO: 1314398 - DNA, 22 bp, Homo sapiens
aaagaccaaacttcactctggg

SEQ ID NO: 1314399 - DNA, 20 bp, Homo sapiens
aaagaggactcgcttgtaaa

SEQ ID NO: 1314400 - DNA, 14 bp, Homo sapiens
aaagatatctatga

SEQ ID NO: 1314401 - DNA, 14 bp, Homo sapiens
aaagattcacctga

SEQ ID NO: 1314402 - DNA, 15 bp, Homo sapiens
aaaggggacaggcct

SEQ ID NO: 1314403 - DNA, 16 bp, Homo sapiens
aaataacttcagtcct

SEQ ID NO: 1314404 - DNA, 16 bp, Homo sapiens
aaataccaggattttt

SEQ ID NO: 1314405 - DNA, 19 bp, Homo sapiens
aaatagacatattaacatg

SEQ ID NO: 1314406 - DNA, 12 bp, Homo sapiens
aaatagtttgtt

SEQ ID NO: 1314407 - DNA, 14 bp, Homo sapiens
aaatatagttccta

SEQ ID NO: 1314408 - DNA, 21 bp, Homo sapiens
aaatcctagtttcctctcctt

SEQ ID NO: 1314409 - DNA, 18 bp, Homo sapiens
aaatctgtgtatattatt

SEQ ID NO: 1314410 - DNA, 14 bp, Homo sapiens
aaatgttatgactc

SEQ ID NO: 1314411 - DNA, 21 bp, Homo sapiens
aaatgtttgtctcagttggaa

SEQ ID NO: 1314412 - DNA, 23 bp, Homo sapiens
aaattaaaaagattctttttctg

SEQ ID NO: 1314413 - DNA, 17 bp, Homo sapiens
aaattgaagagagatat

SEQ ID NO: 1314414 - DNA, 13 bp, Homo sapiens
aaatttattatgt

SEQ ID NO: 1314415 - DNA, 14 bp, Homo sapiens
aaatttattatgtc

SEQ ID NO: 1314416 - DNA, 18 bp, Homo sapiens
aaatttgtgggttttttt

SEQ ID NO: 1314417 - DNA, 12 bp, Homo sapiens
aacaaagaaata

SEQ ID NO: 1314418 - DNA, 18 bp, Homo sapiens
aacacagctgttcttctg

SEQ ID NO: 1314419 - DNA, 19 bp, Homo sapiens
aacactgtaatatctttaa

SEQ ID NO: 1314420 - DNA, 17 bp, Homo sapiens
aacataacccacttgtc

SEQ ID NO: 1314421 - DNA, 23 bp, Homo sapiens
aacatgcttatgacaatgactgt

SEQ ID NO: 1314422 - DNA, 21 bp, Homo sapiens
aacattatagattttcatgtt

SEQ ID NO: 1314423 - DNA, 15 bp, Homo sapiens
aaccacaaaggccaa

SEQ ID NO: 1314424 - DNA, 21 bp, Homo sapiens
aaccacaaaggccaaactgct

SEQ ID NO: 1314425 - DNA, 16 bp, Homo sapiens
aacccaagctcctcct

SEQ ID NO: 1314426 - DNA, 21 bp, Homo sapiens
aacccaaggagcacaggtccc

SEQ ID NO: 1314427 - DNA, 20 bp, Homo sapiens
aaccctaggttcccggtccc

SEQ ID NO: 1314428 - DNA, 12 bp, Homo sapiens
aaccgctcacct

SEQ ID NO: 1314429 - DNA, 11 bp, Homo sapiens
aacctcccaga

SEQ ID NO: 1314430 - DNA, 18 bp, Homo sapiens
aacctcccagaggtccag

SEQ ID NO: 1314431 - DNA, 21 bp, Homo sapiens
aactggccccggatcagagca

SEQ ID NO: 1314432 - DNA, 14 bp, Homo sapiens
aacttatgtagata

SEQ ID NO: 1314433 - DNA, 17 bp, Homo sapiens
aacttatgtagatattt

SEQ ID NO: 1314434 - DNA, 19 bp, Homo sapiens
aacttatgtagatatttgg

SEQ ID NO: 1314435 - DNA, 13 bp, Homo sapiens
aacttcactctgg

SEQ ID NO: 1314436 - DNA, 14 bp, Homo sapiens
aacttgtagctgta

SEQ ID NO: 1314437 - DNA, 18 bp, Homo sapiens
aagaagcttctaataaat

SEQ ID NO: 1314438 - DNA, 19 bp, Homo sapiens
aagaagcttctaataaatt

SEQ ID NO: 1314439 - DNA, 16 bp, Homo sapiens
aagagagatatatctg

SEQ ID NO: 1314440 - DNA, 17 bp, Homo sapiens
aagagagatatatctga

SEQ ID NO: 1314441 - DNA, 19 bp, Homo sapiens
aagagcctgatctcttcct

SEQ ID NO: 1314442 - DNA, 20 bp, Homo sapiens
aagaggactcgcttgtaaat

SEQ ID NO: 1314443 - DNA, 14 bp, Homo sapiens
aagagtcttcaaca

SEQ ID NO: 1314444 - DNA, 13 bp, Homo sapiens
aagcaaataaata

SEQ ID NO: 1314445 - DNA, 17 bp, Homo sapiens
aagcagagtgcacagct

SEQ ID NO: 1314446 - DNA, 19 bp, Homo sapiens
aagcagagtgcacagctgt

SEQ ID NO: 1314447 - DNA, 14 bp, Homo sapiens
aagcattctcccca

SEQ ID NO: 1314448 - DNA, 18 bp, Homo sapiens
aagcattctccccagtgt

SEQ ID NO: 1314449 - DNA, 14 bp, Homo sapiens
aagcttctaataaa

SEQ ID NO: 1314450 - DNA, 18 bp, Homo sapiens
aagcttctaataaattat

SEQ ID NO: 1314451 - DNA, 19 bp, Homo sapiens
aagcttctaataaattata

SEQ ID NO: 1314452 - DNA, 17 bp, Homo sapiens
aaggccaaactgctgga

SEQ ID NO: 1314453 - DNA, 14 bp, Homo sapiens
aaggcccagcccct

SEQ ID NO: 1314454 - DNA, 15 bp, Homo sapiens
aataagaagcaaata

SEQ ID NO: 1314455 - DNA, 13 bp, Homo sapiens
aatagtatatcta

SEQ ID NO: 1314456 - DNA, 23 bp, Homo sapiens
aatataggtctcttctcccagaa

SEQ ID NO: 1314457 - DNA, 15 bp, Homo sapiens
aatatagttcctaag

SEQ ID NO: 1314458 - DNA, 21 bp, Homo sapiens
aatatagttcctaagaagctt

SEQ ID NO: 1314459 - DNA, 19 bp, Homo sapiens
aatatctttaaatgatgta

SEQ ID NO: 1314460 - DNA, 14 bp, Homo sapiens
aatcaaaaattgaa

SEQ ID NO: 1314461 - DNA, 17 bp, Homo sapiens
aatcaaaaattgaagag

SEQ ID NO: 1314462 - DNA, 23 bp, Homo sapiens
aatcaatgttcacgcaacttgaa

SEQ ID NO: 1314463 - DNA, 19 bp, Homo sapiens
aatcccaacatttctcttc

SEQ ID NO: 1314464 - DNA, 13 bp, Homo sapiens
aatctgtacattt

SEQ ID NO: 1314465 - DNA, 15 bp, Homo sapiens
aatgaaaaacaacca

SEQ ID NO: 1314466 - DNA, 16 bp, Homo sapiens
aatgaaaaacaaccaa

SEQ ID NO: 1314467 - DNA, 21 bp, Homo sapiens
aatgatgtacaggcagatgaa

SEQ ID NO: 1314468 - DNA, 16 bp, Homo sapiens
aatgcctaataaacaa

SEQ ID NO: 1314469 - DNA, 22 bp, Homo sapiens
aatgtttgtctcagttggaaat

SEQ ID NO: 1314470 - DNA, 16 bp, Homo sapiens
aattaaaaagattctt

SEQ ID NO: 1314471 - DNA, 22 bp, Homo sapiens
aattattttgttactgtctgta

SEQ ID NO: 1314472 - DNA, 23 bp, Homo sapiens
aattgaagagagatatatctgaa

SEQ ID NO: 1314473 - DNA, 19 bp, Homo sapiens
aattgtctttaatttctgt

SEQ ID NO: 1314474 - DNA, 20 bp, Homo sapiens
aattgtcttttgtcatgtgg

SEQ ID NO: 1314475 - DNA, 12 bp, Homo sapiens
acaaagaaatat

SEQ ID NO: 1314476 - DNA, 14 bp, Homo sapiens
acaaattaaaaaga

SEQ ID NO: 1314477 - DNA, 17 bp, Homo sapiens
acaaattaaaaagattc

SEQ ID NO: 1314478 - DNA, 21 bp, Homo sapiens
acaaccaagcgcatccaatct

SEQ ID NO: 1314479 - DNA, 21 bp, Homo sapiens
acaagcagagtgcacagctgt

SEQ ID NO: 1314480 - DNA, 19 bp, Homo sapiens
acacaaaactccgccccca

SEQ ID NO: 1314481 - DNA, 18 bp, Homo sapiens
acacagctgttcttctgt

SEQ ID NO: 1314482 - DNA, 18 bp, Homo sapiens
acactgtaatatctttaa

SEQ ID NO: 1314483 - DNA, 24 bp, Homo sapiens
acagattggagagggctctgtgct

SEQ ID NO: 1314484 - DNA, 14 bp, Homo sapiens
acaggcctcacctc

SEQ ID NO: 1314485 - DNA, 13 bp, Homo sapiens
acaggtcccacct

SEQ ID NO: 1314486 - DNA, 13 bp, Homo sapiens
acattttgttgta

SEQ ID NO: 1314487 - DNA, 14 bp, Homo sapiens
acattttgttgtaa

SEQ ID NO: 1314488 - DNA, 19 bp, Homo sapiens
acattttgttgtaaaaaga

SEQ ID NO: 1314489 - DNA, 17 bp, Homo sapiens
accaacgttactcaggg

SEQ ID NO: 1314490 - DNA, 20 bp, Homo sapiens
accaccatccaccgctgctc

SEQ ID NO: 1314491 - DNA, 12 bp, Homo sapiens
accactcagccc

SEQ ID NO: 1314492 - DNA, 13 bp, Homo sapiens
accactcagcccc

SEQ ID NO: 1314493 - DNA, 17 bp, Homo sapiens
accactcagcccctagg

SEQ ID NO: 1314494 - DNA, 16 bp, Homo sapiens
accacttcactgaaag

SEQ ID NO: 1314495 - DNA, 18 bp, Homo sapiens
accacttcactgaaagac

SEQ ID NO: 1314496 - DNA, 14 bp, Homo sapiens
acccaaaccctagg

SEQ ID NO: 1314497 - DNA, 16 bp, Homo sapiens
acccaaggagcacagg

SEQ ID NO: 1314498 - DNA, 19 bp, Homo sapiens
acccaaggagcacaggtcc

SEQ ID NO: 1314499 - DNA, 17 bp, Homo sapiens
acccacgattttctcca

SEQ ID NO: 1314500 - DNA, 18 bp, Homo sapiens
acccacgattttctccag

SEQ ID NO: 1314501 - DNA, 19 bp, Homo sapiens
acccacgattttctccagc

SEQ ID NO: 1314502 - DNA, 19 bp, Homo sapiens
acccacttgtcactgacac

SEQ ID NO: 1314503 - DNA, 11 bp, Homo sapiens
acccaggctcc

SEQ ID NO: 1314504 - DNA, 21 bp, Homo sapiens
acccaggctccgcccttagtc

SEQ ID NO: 1314505 - DNA, 15 bp, Homo sapiens
acccagggctctgcc

SEQ ID NO: 1314506 - DNA, 20 bp, Homo sapiens
acccagggctctgccccagt

SEQ ID NO: 1314507 - DNA, 21 bp, Homo sapiens
acccagggctctgccccagtc

SEQ ID NO: 1314508 - DNA, 19 bp, Homo sapiens
accctaggttcccggtccc

SEQ ID NO: 1314509 - DNA, 23 bp, Homo sapiens
accctctgggaacctcccagagg

SEQ ID NO: 1314510 - DNA, 15 bp, Homo sapiens
acccttaacccaagg

SEQ ID NO: 1314511 - DNA, 19 bp, Homo sapiens
accgctcacctagagccag

SEQ ID NO: 1314512 - DNA, 15 bp, Homo sapiens
accgcttccctcctg

SEQ ID NO: 1314513 - DNA, 18 bp, Homo sapiens
accgcttgtggggaccca

SEQ ID NO: 1314514 - DNA, 21 bp, Homo sapiens
accgcttgtggggacccaggc

SEQ ID NO: 1314515 - DNA, 16 bp, Homo sapiens
acctagagccagacca

SEQ ID NO: 1314516 - DNA, 21 bp, Homo sapiens
acctccagcccgggagcctag

SEQ ID NO: 1314517 - DNA, 16 bp, Homo sapiens
acctcccagaggtcca

SEQ ID NO: 1314518 - DNA, 17 bp, Homo sapiens
acctcccagaggtccag

SEQ ID NO: 1314519 - DNA, 19 bp, Homo sapiens
acctcccagaggtccagcc

SEQ ID NO: 1314520 - DNA, 20 bp, Homo sapiens
acctcccagaggtccagccc

SEQ ID NO: 1314521 - DNA, 17 bp, Homo sapiens
acgccttcccctcagcc

SEQ ID NO: 1314522 - DNA, 20 bp, Homo sapiens
acgctgtcaaaagttggact

SEQ ID NO: 1314523 - DNA, 19 bp, Homo sapiens
acgttactcagggctcctc

SEQ ID NO: 1314524 - DNA, 20 bp, Homo sapiens
actaaatgcctagtttttag

SEQ ID NO: 1314525 - DNA, 17 bp, Homo sapiens
actcagggctcctccca

SEQ ID NO: 1314526 - DNA, 20 bp, Homo sapiens
actcagggctcctcccagct

SEQ ID NO: 1314527 - DNA, 22 bp, Homo sapiens
actcagggctcctcccagcttg

SEQ ID NO: 1314528 - DNA, 13 bp, Homo sapiens
actccgcccccag

SEQ ID NO: 1314529 - DNA, 15 bp, Homo sapiens
actccgcccccagcc

SEQ ID NO: 1314530 - DNA, 13 bp, Homo sapiens
actcgcttgtaaa

SEQ ID NO: 1314531 - DNA, 14 bp, Homo sapiens
actcgcttgtaaat

SEQ ID NO: 1314532 - DNA, 15 bp, Homo sapiens
actctaaagaccaaa

SEQ ID NO: 1314533 - DNA, 13 bp, Homo sapiens
actctgagcccat

SEQ ID NO: 1314534 - DNA, 14 bp, Homo sapiens
actctgccagcaaa

SEQ ID NO: 1314535 - DNA, 13 bp, Homo sapiens
actgacacaaagg

SEQ ID NO: 1314536 - DNA, 14 bp, Homo sapiens
actgatatattttc

SEQ ID NO: 1314537 - DNA, 20 bp, Homo sapiens
actggccccggatcagagca

SEQ ID NO: 1314538 - DNA, 21 bp, Homo sapiens
actggccccggatcagagcag

SEQ ID NO: 1314539 - DNA, 14 bp, Homo sapiens
actgtaatatcttt

SEQ ID NO: 1314540 - DNA, 17 bp, Homo sapiens
actgtctgtagtgtttt

SEQ ID NO: 1314541 - DNA, 23 bp, Homo sapiens
actgtgctactgtctttggaaaa

SEQ ID NO: 1314542 - DNA, 19 bp, Homo sapiens
actgtgtttaatagtatat

SEQ ID NO: 1314543 - DNA, 23 bp, Homo sapiens
actgtgtttaatagtatatctaa

SEQ ID NO: 1314544 - DNA, 14 bp, Homo sapiens
actgttaagaagca

SEQ ID NO: 1314545 - DNA, 15 bp, Homo sapiens
acttatgtagatatt

SEQ ID NO: 1314546 - DNA, 21 bp, Homo sapiens
acttatgtagatatttggctt

SEQ ID NO: 1314547 - DNA, 13 bp, Homo sapiens
acttctatcctgt

SEQ ID NO: 1314548 - DNA, 16 bp, Homo sapiens
acttgaaattatatct

SEQ ID NO: 1314549 - DNA, 23 bp, Homo sapiens
acttgaaattatatctgtggtct

SEQ ID NO: 1314550 - DNA, 14 bp, Homo sapiens
acttgtagctgtaa

SEQ ID NO: 1314551 - DNA, 21 bp, Homo sapiens
acttgtagctgtaaaacgctg

SEQ ID NO: 1314552 - DNA, 15 bp, Homo sapiens
actttgctgatttcc

SEQ ID NO: 1314553 - DNA, 18 bp, Homo sapiens
actttggtttctgtctgt

SEQ ID NO: 1314554 - DNA, 15 bp, Homo sapiens
agaaacccaagctcc

SEQ ID NO: 1314555 - DNA, 19 bp, Homo sapiens
agaaacccaagctcctcct

SEQ ID NO: 1314556 - DNA, 19 bp, Homo sapiens
agaacccagggctctgccc

SEQ ID NO: 1314557 - DNA, 22 bp, Homo sapiens
agaacccagggctctgccccag

SEQ ID NO: 1314558 - DNA, 12 bp, Homo sapiens
agaagcttctaa

SEQ ID NO: 1314559 - DNA, 16 bp, Homo sapiens
agaagcttctaataaa

SEQ ID NO: 1314560 - DNA, 22 bp, Homo sapiens
agaagcttctaataaattatac

SEQ ID NO: 1314561 - DNA, 19 bp, Homo sapiens
agaatataggtctcttctc

SEQ ID NO: 1314562 - DNA, 12 bp, Homo sapiens
agaatcccagcc

SEQ ID NO: 1314563 - DNA, 16 bp, Homo sapiens
agaatttggaaatcct

SEQ ID NO: 1314564 - DNA, 17 bp, Homo sapiens
agaccaccatccaccgc

SEQ ID NO: 1314565 - DNA, 22 bp, Homo sapiens
agagagatatatctgaaaactg

SEQ ID NO: 1314566 - DNA, 19 bp, Homo sapiens
agagatatatctgaaaact

SEQ ID NO: 1314567 - DNA, 13 bp, Homo sapiens
agagcaggacctc

SEQ ID NO: 1314568 - DNA, 16 bp, Homo sapiens
agagcctgatctcttc

SEQ ID NO: 1314569 - DNA, 19 bp, Homo sapiens
agagcctgatctcttcctg

SEQ ID NO: 1314570 - DNA, 23 bp, Homo sapiens
agaggactcgcttgtaaatacca

SEQ ID NO: 1314571 - DNA, 19 bp, Homo sapiens
cattatagattttcatgtt

SEQ ID NO: 1314572 - DNA, 15 bp, Homo sapiens
cattctccccagtgt

SEQ ID NO: 1314573 - DNA, 22 bp, Homo sapiens
cattctccccagtgtatgtctt

SEQ ID NO: 1314574 - DNA, 13 bp, Homo sapiens
cattgacaaatct

SEQ ID NO: 1314575 - DNA, 16 bp, Homo sapiens
cattgacaaatctgtg

SEQ ID NO: 1314576 - DNA, 23 bp, Homo sapiens
catttatctacccaagggcagaa

SEQ ID NO: 1314577 - DNA, 20 bp, Homo sapiens
catttcctctgagctgttat

SEQ ID NO: 1314578 - DNA, 22 bp, Homo sapiens
catttcctctgagctgttatct

SEQ ID NO: 1314579 - DNA, 15 bp, Homo sapiens
cattttgttgtaaaa

SEQ ID NO: 1314580 - DNA, 16 bp, Homo sapiens
cattttgttgtaaaaa

SEQ ID NO: 1314581 - DNA, 23 bp, Homo sapiens
cattttgttgtaaaaagaaaaac

SEQ ID NO: 1314582 - DNA, 15 bp, Homo sapiens
ccaaacttcactctg

SEQ ID NO: 1314583 - DNA, 19 bp, Homo sapiens
ccaacgttactcagggctc

SEQ ID NO: 1314584 - DNA, 22 bp, Homo sapiens
ccaagaaagatgaatacatttt

SEQ ID NO: 1314585 - DNA, 15 bp, Homo sapiens
ccaagctccctgccc

SEQ ID NO: 1314586 - DNA, 17 bp, Homo sapiens
ccaagctccctgcccca

SEQ ID NO: 1314587 - DNA, 19 bp, Homo sapiens
ccaagctccctgccccaaa

SEQ ID NO: 1314588 - DNA, 21 bp, Homo sapiens
ccaagctccctgccccaaata

SEQ ID NO: 1314589 - DNA, 13 bp, Homo sapiens
ccaaggagcacag

SEQ ID NO: 1314590 - DNA, 14 bp, Homo sapiens
ccaaggagcacagg

SEQ ID NO: 1314591 - DNA, 16 bp, Homo sapiens
ccaaggagcacaggtc

SEQ ID NO: 1314592 - DNA, 18 bp, Homo sapiens
ccaaggagcacaggtccc

SEQ ID NO: 1314593 - DNA, 15 bp, Homo sapiens
ccaatggaaacctca

SEQ ID NO: 1314594 - DNA, 12 bp, Homo sapiens
ccacctccagcc

SEQ ID NO: 1314595 - DNA, 13 bp, Homo sapiens
ccacctccagccc

SEQ ID NO: 1314596 - DNA, 17 bp, Homo sapiens
ccacgattttctccagc

SEQ ID NO: 1314597 - DNA, 20 bp, Homo sapiens
ccacgattttctccagctca

SEQ ID NO: 1314598 - DNA, 21 bp, Homo sapiens
ccacgattttctccagctcag

SEQ ID NO: 1314599 - DNA, 18 bp, Homo sapiens
ccactcagcccctaggag

SEQ ID NO: 1314600 - DNA, 13 bp, Homo sapiens
ccagaatcccagc

SEQ ID NO: 1314601 - DNA, 16 bp, Homo sapiens
ccagaatttggaaatc

SEQ ID NO: 1314602 - DNA, 17 bp, Homo sapiens
ccagaatttggaaatcc

SEQ ID NO: 1314603 - DNA, 21 bp, Homo sapiens
ccagaccaacgttactcaggg

SEQ ID NO: 1314604 - DNA, 14 bp, Homo sapiens
ccagaggtccagcc

SEQ ID NO: 1314605 - DNA, 17 bp, Homo sapiens
ccagaggtccagcccat

SEQ ID NO: 1314606 - DNA, 12 bp, Homo sapiens
ccagcccaaagg

SEQ ID NO: 1314607 - DNA, 12 bp, Homo sapiens
ccagcccctaga

SEQ ID NO: 1314608 - DNA, 13 bp, Homo sapiens
ccagcccgggagc

SEQ ID NO: 1314609 - DNA, 15 bp, Homo sapiens
ccagcccgggagcct

SEQ ID NO: 1314610 - DNA, 16 bp, Homo sapiens
ccagcccgggagccta

SEQ ID NO: 1314611 - DNA, 17 bp, Homo sapiens
ccagcccgggagcctag

SEQ ID NO: 1314612 - DNA, 21 bp, Homo sapiens
ccagcccgggagcctaggacc

SEQ ID NO: 1314613 - DNA, 22 bp, Homo sapiens
ccagcccgggagcctaggacca

SEQ ID NO: 1314614 - DNA, 17 bp, Homo sapiens
ccagccggccaatggaa

SEQ ID NO: 1314615 - DNA, 22 bp, Homo sapiens
ccagccggccaatggaaacctc

SEQ ID NO: 1314616 - DNA, 20 bp, Homo sapiens
ccagcctatgagcatcctga

SEQ ID NO: 1314617 - DNA, 16 bp, Homo sapiens
ccagcttgtaggagct

SEQ ID NO: 1314618 - DNA, 17 bp, Homo sapiens
ccaggctccgcccttag

SEQ ID NO: 1314619 - DNA, 23 bp, Homo sapiens
ccaggctccgcccttagtccccc

SEQ ID NO: 1314620 - DNA, 16 bp, Homo sapiens
ccagggctctgcccca

SEQ ID NO: 1314621 - DNA, 15 bp, Homo sapiens
ccagtccccagccct

SEQ ID NO: 1314622 - DNA, 22 bp, Homo sapiens
ccagtctttaaaggcccagccc

SEQ ID NO: 1314623 - DNA, 19 bp, Homo sapiens
ccatccaccgctgctccac

SEQ ID NO: 1314624 - DNA, 21 bp, Homo sapiens
ccatctcggagcatcccggag

SEQ ID NO: 1314625 - DNA, 15 bp, Homo sapiens
ccatgtctttctcca

SEQ ID NO: 1314626 - DNA, 21 bp, Homo sapiens
ccatgtctttctccaaagtta

SEQ ID NO: 1314627 - DNA, 19 bp, Homo sapiens
ccatgttctgcccccagcc

SEQ ID NO: 1314628 - DNA, 21 bp, Homo sapiens
ccatgttctgcccccagccca

SEQ ID NO: 1314629 - DNA, 21 bp, Homo sapiens
cccaaataacttcagtcctgc

SEQ ID NO: 1314630 - DNA, 15 bp, Homo sapiens
cccaactctgagccc

SEQ ID NO: 1314631 - DNA, 17 bp, Homo sapiens
cccaactctgagcccat

SEQ ID NO: 1314632 - DNA, 18 bp, Homo sapiens
cccaactctgagcccatg

SEQ ID NO: 1314633 - DNA, 13 bp, Homo sapiens
cccaagctcctcc

SEQ ID NO: 1314634 - DNA, 18 bp, Homo sapiens
cccacctccagcccggga

SEQ ID NO: 1314635 - DNA, 19 bp, Homo sapiens
cccacgattttctccagct

SEQ ID NO: 1314636 - DNA, 21 bp, Homo sapiens
cccacgattttctccagctca

SEQ ID NO: 1314637 - DNA, 22 bp, Homo sapiens
cccacgattttctccagctcag

SEQ ID NO: 1314638 - DNA, 12 bp, Homo sapiens
cccagaatccca

SEQ ID NO: 1314639 - DNA, 20 bp, Homo sapiens
cccagaatcccagccggcca

SEQ ID NO: 1314640 - DNA, 13 bp, Homo sapiens
cccagcccaaagg

SEQ ID NO: 1314641 - DNA, 18 bp, Homo sapiens
cccagcttgtaggagctg

SEQ ID NO: 1314642 - DNA, 18 bp, Homo sapiens
cccaggctccgcccttag

SEQ ID NO: 1314643 - DNA, 22 bp, Homo sapiens
cccatgtctttctccaaagtta

SEQ ID NO: 1314644 - DNA, 18 bp, Homo sapiens
cccatgttctgcccccag

SEQ ID NO: 1314645 - DNA, 19 bp, Homo sapiens
cccatgttctgcccccagc

SEQ ID NO: 1314646 - DNA, 16 bp, Homo sapiens
ccccaactctgagccc

SEQ ID NO: 1314647 - DNA, 17 bp, Homo sapiens
ccccaactctgagccca

SEQ ID NO: 1314648 - DNA, 22 bp, Homo sapiens
ccccagcccaaaggggacaggc

SEQ ID NO: 1314649 - DNA, 22 bp, Homo sapiens
ccccagcctatgagcatcctga

SEQ ID NO: 1314650 - DNA, 20 bp, Homo sapiens
cccccaactctgagcccatg

SEQ ID NO: 1314651 - DNA, 14 bp, Homo sapiens
ccccggcaccctct

SEQ ID NO: 1314652 - DNA, 17 bp, Homo sapiens
ccccggcaccctctggc

SEQ ID NO: 1314653 - DNA, 17 bp, Homo sapiens
cccctagaaacccaagc

SEQ ID NO: 1314654 - DNA, 21 bp, Homo sapiens
cccctagaaacccaagctcct

SEQ ID NO: 1314655 - DNA, 15 bp, Homo sapiens
cccgagtacagtctg

SEQ ID NO: 1314656 - DNA, 14 bp, Homo sapiens
cccgagtctgggac

SEQ ID NO: 1314657 - DNA, 20 bp, Homo sapiens
cccggatcagagcaggacct

SEQ ID NO: 1314658 - DNA, 12 bp, Homo sapiens
cccgggagccta

SEQ ID NO: 1314659 - DNA, 18 bp, Homo sapiens
cccgggagcctaggacca

SEQ ID NO: 1314660 - DNA, 19 bp, Homo sapiens
cccgggagcctaggaccac

SEQ ID NO: 1314661 - DNA, 19 bp, Homo sapiens
ccctcagccacacccaggc

SEQ ID NO: 1314662 - DNA, 12 bp, Homo sapiens
ccctctggccgc

SEQ ID NO: 1314663 - DNA, 14 bp, Homo sapiens
ccctctgggaacct

SEQ ID NO: 1314664 - DNA, 20 bp, Homo sapiens
ccctctgggaacctcccaga

SEQ ID NO: 1314665 - DNA, 20 bp, Homo sapiens
ccctcttcctgacgaaactg

SEQ ID NO: 1314666 - DNA, 12 bp, Homo sapiens
ccctgccccaaa

SEQ ID NO: 1314667 - DNA, 13 bp, Homo sapiens
ccctgccccaaat

SEQ ID NO: 1314668 - DNA, 14 bp, Homo sapiens
cccttaacccaagg

SEQ ID NO: 1314669 - DNA, 15 bp, Homo sapiens
cccttaacccaagga

SEQ ID NO: 1314670 - DNA, 17 bp, Homo sapiens
cccttaacccaaggagc

SEQ ID NO: 1314671 - DNA, 22 bp, Homo sapiens
cccttaacccaaggagcacagg

SEQ ID NO: 1314672 - DNA, 12 bp, Homo sapiens
cccttagtcccc

SEQ ID NO: 1314673 - DNA, 18 bp, Homo sapiens
cccttccgaccctctggg

SEQ ID NO: 1314674 - DNA, 13 bp, Homo sapiens
ccgagtacagtct

SEQ ID NO: 1314675 - DNA, 13 bp, Homo sapiens
ccgagtctgggac

SEQ ID NO: 1314676 - DNA, 14 bp, Homo sapiens
ccgagtctgggaca

SEQ ID NO: 1314677 - DNA, 16 bp, Homo sapiens
ccgccacacagaccac

SEQ ID NO: 1314678 - DNA, 15 bp, Homo sapiens
ccgccctcttcctga

SEQ ID NO: 1314679 - DNA, 15 bp, Homo sapiens
ccgctcacctagagc

SEQ ID NO: 1314680 - DNA, 16 bp, Homo sapiens
ccgctcacctagagcc

SEQ ID NO: 1314681 - DNA, 19 bp, Homo sapiens
ccgctcacctagagccaga

SEQ ID NO: 1314682 - DNA, 15 bp, Homo sapiens
ccgctgctccacgcg

SEQ ID NO: 1314683 - DNA, 17 bp, Homo sapiens
ccgctgctccacgcgct

SEQ ID NO: 1314684 - DNA, 16 bp, Homo sapiens
ccgcttgtggggaccc

SEQ ID NO: 1314685 - DNA, 19 bp, Homo sapiens
ccgcttgtggggacccagg

SEQ ID NO: 1314686 - DNA, 19 bp, Homo sapiens
ccgggagcctaggaccact

SEQ ID NO: 1314687 - DNA, 17 bp, Homo sapiens
cctagaaacccaagctc

SEQ ID NO: 1314688 - DNA, 14 bp, Homo sapiens
cctagagccagacc

SEQ ID NO: 1314689 - DNA, 16 bp, Homo sapiens
cctagagccagaccaa

SEQ ID NO: 1314690 - DNA, 17 bp, Homo sapiens
cctagcccagcgctctg

SEQ ID NO: 1314691 - DNA, 17 bp, Homo sapiens
cctaggaccactcagcc

SEQ ID NO: 1314692 - DNA, 20 bp, Homo sapiens
cctaggaccactcagcccct

SEQ ID NO: 1314693 - DNA, 21 bp, Homo sapiens
cctaggagtatatttccgcac

SEQ ID NO: 1314694 - DNA, 16 bp, Homo sapiens
cctaggttcccggtcc

SEQ ID NO: 1314695 - DNA, 13 bp, Homo sapiens
cctagtttcctct

SEQ ID NO: 1314696 - DNA, 14 bp, Homo sapiens
cctagtttcctctc

SEQ ID NO: 1314697 - DNA, 16 bp, Homo sapiens
cctagtttcctctcct

SEQ ID NO: 1314698 - DNA, 16 bp, Homo sapiens
cctatgagcatcctga

SEQ ID NO: 1314699 - DNA, 21 bp, Homo sapiens
cctatgagcatcctgagcccc

SEQ ID NO: 1314700 - DNA, 22 bp, Homo sapiens
cctatgagcatcctgagccccg

SEQ ID NO: 1314701 - DNA, 21 bp, Homo sapiens
ctgtacattttgttgtaaaaa

SEQ ID NO: 1314702 - DNA, 17 bp, Homo sapiens
ctgtagtgttttgtgga

SEQ ID NO: 1314703 - DNA, 21 bp, Homo sapiens
ctgtcaaaagttggactaaat

SEQ ID NO: 1314704 - DNA, 14 bp, Homo sapiens
ctgtctttggaaaa

SEQ ID NO: 1314705 - DNA, 20 bp, Homo sapiens
ctgtctttggaaaaatgttt

SEQ ID NO: 1314706 - DNA, 22 bp, Homo sapiens
ctgtctttggaaaaatgtttgt

SEQ ID NO: 1314707 - DNA, 20 bp, Homo sapiens
ctgtggcttcccatgtcttt

SEQ ID NO: 1314708 - DNA, 22 bp, Homo sapiens
ctgtggtcttcaaattgtcttt

SEQ ID NO: 1314709 - DNA, 12 bp, Homo sapiens
ctgtgtatatta

SEQ ID NO: 1314710 - DNA, 20 bp, Homo sapiens
ctgtgtttaatagtatatct

SEQ ID NO: 1314711 - DNA, 20 bp, Homo sapiens
ctgttgtaacttatgtagat

SEQ ID NO: 1314712 - DNA, 20 bp, Homo sapiens
ctgttttgtacatagattta

SEQ ID NO: 1314713 - DNA, 15 bp, Homo sapiens
cttaaatatagttcc

SEQ ID NO: 1314714 - DNA, 22 bp, Homo sapiens
cttaaatatagttcctaagaag

SEQ ID NO: 1314715 - DNA, 17 bp, Homo sapiens
cttagtatctcatcaac

SEQ ID NO: 1314716 - DNA, 22 bp, Homo sapiens
cttagtatctcatcaacaaaga

SEQ ID NO: 1314717 - DNA, 18 bp, Homo sapiens
cttatgtagatatttggc

SEQ ID NO: 1314718 - DNA, 23 bp, Homo sapiens
cttcaacataacccacttgtcac

SEQ ID NO: 1314719 - DNA, 19 bp, Homo sapiens
cttcagtcctgctccagaa

SEQ ID NO: 1314720 - DNA, 23 bp, Homo sapiens
cttcatttcctctgagctgttat

SEQ ID NO: 1314721 - DNA, 21 bp, Homo sapiens
cttcccatgtctttctccaaa

SEQ ID NO: 1314722 - DNA, 15 bp, Homo sapiens
cttccgaccctctgg

SEQ ID NO: 1314723 - DNA, 19 bp, Homo sapiens
cttccgaccctctgggaac

SEQ ID NO: 1314724 - DNA, 21 bp, Homo sapiens
cttcggaccgcttgtggggac

SEQ ID NO: 1314725 - DNA, 23 bp, Homo sapiens
cttcgtatcccgagtctgggaca

SEQ ID NO: 1314726 - DNA, 15 bp, Homo sapiens
cttctaataaattat

SEQ ID NO: 1314727 - DNA, 12 bp, Homo sapiens
cttctcccagaa

SEQ ID NO: 1314728 - DNA, 16 bp, Homo sapiens
cttctcccagaatccc

SEQ ID NO: 1314729 - DNA, 14 bp, Homo sapiens
cttctgttctgcag

SEQ ID NO: 1314730 - DNA, 20 bp, Homo sapiens
cttgaaattatatctgtggt

SEQ ID NO: 1314731 - DNA, 14 bp, Homo sapiens
cttgcgaatccaag

SEQ ID NO: 1314732 - DNA, 16 bp, Homo sapiens
cttgcgaatccaagct

SEQ ID NO: 1314733 - DNA, 12 bp, Homo sapiens
cttgtaaatacc

SEQ ID NO: 1314734 - DNA, 14 bp, Homo sapiens
cttgtaaataccag

SEQ ID NO: 1314735 - DNA, 18 bp, Homo sapiens
cttgtcactgacacaaag

SEQ ID NO: 1314736 - DNA, 23 bp, Homo sapiens
cttgtcactgacacaaaggaagt

SEQ ID NO: 1314737 - DNA, 16 bp, Homo sapiens
cttgtgaaacacagct

SEQ ID NO: 1314738 - DNA, 16 bp, Homo sapiens
cttgtggggacccagg

SEQ ID NO: 1314739 - DNA, 17 bp, Homo sapiens
cttgtggggacccaggc

SEQ ID NO: 1314740 - DNA, 20 bp, Homo sapiens
cttgtggggacccaggctcc

SEQ ID NO: 1314741 - DNA, 14 bp, Homo sapiens
ctttaaaggcccag

SEQ ID NO: 1314742 - DNA, 18 bp, Homo sapiens
ctttaatttctgtcagaa

SEQ ID NO: 1314743 - DNA, 14 bp, Homo sapiens
ctttctccaaagtt

SEQ ID NO: 1314744 - DNA, 15 bp, Homo sapiens
ctttctccaaagtta

SEQ ID NO: 1314745 - DNA, 23 bp, Homo sapiens
ctttctccaaagttatccagagg

SEQ ID NO: 1314746 - DNA, 18 bp, Homo sapiens
cttttattcattagctgt

SEQ ID NO: 1314747 - DNA, 13 bp, Homo sapiens
cttttcttaacaa

SEQ ID NO: 1314748 - DNA, 18 bp, Homo sapiens
cttttcttaacaacctgg

SEQ ID NO: 1314749 - DNA, 17 bp, Homo sapiens
ctttttctgttgtaact

SEQ ID NO: 1314750 - DNA, 13 bp, Homo sapiens
gaaaaatgtttgt

SEQ ID NO: 1314751 - DNA, 13 bp, Homo sapiens
gaaacacagctgt

SEQ ID NO: 1314752 - DNA, 14 bp, Homo sapiens
gaaacacagctgtt

SEQ ID NO: 1314753 - DNA, 14 bp, Homo sapiens
gaaacccaagctcc

SEQ ID NO: 1314754 - DNA, 12 bp, Homo sapiens
gaaactggcccc

SEQ ID NO: 1314755 - DNA, 18 bp, Homo sapiens
gaaagacaccatttatct

SEQ ID NO: 1314756 - DNA, 21 bp, Homo sapiens
gaaatcctagtttcctctcct

SEQ ID NO: 1314757 - DNA, 13 bp, Homo sapiens
gaaattatatctg

SEQ ID NO: 1314758 - DNA, 20 bp, Homo sapiens
gaacaaaaaaaccacaaagg

SEQ ID NO: 1314759 - DNA, 13 bp, Homo sapiens
gaacccagggctc

SEQ ID NO: 1314760 - DNA, 14 bp, Homo sapiens
gaacccagggctct

SEQ ID NO: 1314761 - DNA, 17 bp, Homo sapiens
gaacccagggctctgcc

SEQ ID NO: 1314762 - DNA, 20 bp, Homo sapiens
gaacccagggctctgcccca

SEQ ID NO: 1314763 - DNA, 15 bp, Homo sapiens
gaacttactattcat

SEQ ID NO: 1314764 - DNA, 16 bp, Homo sapiens
gaagtgccccctcccc

SEQ ID NO: 1314765 - DNA, 15 bp, Homo sapiens
gaatccaagctccct

SEQ ID NO: 1314766 - DNA, 16 bp, Homo sapiens
gaatccaagctccctg

SEQ ID NO: 1314767 - DNA, 20 bp, Homo sapiens
gaatccaagctccctgcccc

SEQ ID NO: 1314768 - DNA, 13 bp, Homo sapiens
gaatcccagccgg

SEQ ID NO: 1314769 - DNA, 13 bp, Homo sapiens
gaatttggaaatc

SEQ ID NO: 1314770 - DNA, 14 bp, Homo sapiens
gaatttggaaatcc

SEQ ID NO: 1314771 - DNA, 22 bp, Homo sapiens
gacacaaaactccgcccccagc

SEQ ID NO: 1314772 - DNA, 23 bp, Homo sapiens
gacacaaaactccgcccccagcc

SEQ ID NO: 1314773 - DNA, 11 bp, Homo sapiens
gacaggcctca

SEQ ID NO: 1314774 - DNA, 16 bp, Homo sapiens
gaccaaggaacaaaaa

SEQ ID NO: 1314775 - DNA, 16 bp, Homo sapiens
gaccactcagccccta

SEQ ID NO: 1314776 - DNA, 23 bp, Homo sapiens
gacccaggctccgcccttagtcc

SEQ ID NO: 1314777 - DNA, 13 bp, Homo sapiens
gaccctctgggaa

SEQ ID NO: 1314778 - DNA, 14 bp, Homo sapiens
gacctcccttccga

SEQ ID NO: 1314779 - DNA, 20 bp, Homo sapiens
gacctcccttccgaccctct

SEQ ID NO: 1314780 - DNA, 22 bp, Homo sapiens
gacgtctttctttttttccccc

SEQ ID NO: 1314781 - DNA, 20 bp, Homo sapiens
gactaaatgcctagttttta

SEQ ID NO: 1314782 - DNA, 13 bp, Homo sapiens
gactcgcttgtaa

SEQ ID NO: 1314783 - DNA, 14 bp, Homo sapiens
gactcgcttgtaaa

SEQ ID NO: 1314784 - DNA, 19 bp, Homo sapiens
gactcgcttgtaaatacca

SEQ ID NO: 1314785 - DNA, 14 bp, Homo sapiens
gactctaaagacca

SEQ ID NO: 1314786 - DNA, 13 bp, Homo sapiens
gactgtgctactg

SEQ ID NO: 1314787 - DNA, 16 bp, Homo sapiens
gacttctatcctgtta

SEQ ID NO: 1314788 - DNA, 19 bp, Homo sapiens
gacttctatcctgttaaca

SEQ ID NO: 1314789 - DNA, 21 bp, Homo sapiens
gactttgctgatttcccctct

SEQ ID NO: 1314790 - DNA, 17 bp, Homo sapiens
gagaagggcataaaaca

SEQ ID NO: 1314791 - DNA, 18 bp, Homo sapiens
gagcacaggtcccacctc

SEQ ID NO: 1314792 - DNA, 23 bp, Homo sapiens
gagcacaggtcccacctccagcc

SEQ ID NO: 1314793 - DNA, 13 bp, Homo sapiens
gagcaggacctcc

SEQ ID NO: 1314794 - DNA, 19 bp, Homo sapiens
gagcatcccggaggaaatc

SEQ ID NO: 1314795 - DNA, 18 bp, Homo sapiens
gagcatcctgagccccgc

SEQ ID NO: 1314796 - DNA, 23 bp, Homo sapiens
gagcccatgttctgcccccagcc

SEQ ID NO: 1314797 - DNA, 13 bp, Homo sapiens
gagccccgccctc

SEQ ID NO: 1314798 - DNA, 16 bp, Homo sapiens
gagccccgccctcttc

SEQ ID NO: 1314799 - DNA, 15 bp, Homo sapiens
gagcctaggaccact

SEQ ID NO: 1314800 - DNA, 17 bp, Homo sapiens
gagcctgatctcttcct

SEQ ID NO: 1314801 - DNA, 13 bp, Homo sapiens
gagctgttatctt

SEQ ID NO: 1314802 - DNA, 19 bp, Homo sapiens
gaggactcgcttgtaaata

SEQ ID NO: 1314803 - DNA, 12 bp, Homo sapiens
gaggtccagccc

SEQ ID NO: 1314804 - DNA, 21 bp, Homo sapiens
gaggtttcacccttaacccaa

SEQ ID NO: 1314805 - DNA, 13 bp, Homo sapiens
gagtgcacagctg

SEQ ID NO: 1314806 - DNA, 16 bp, Homo sapiens
gagtgcacagctgtcc

SEQ ID NO: 1314807 - DNA, 19 bp, Homo sapiens
gagtgggtgacaagagcct

SEQ ID NO: 1314808 - DNA, 20 bp, Homo sapiens
gagtgggtgacaagagcctg

SEQ ID NO: 1314809 - DNA, 21 bp, Homo sapiens
gagtgggtgacaagagcctga

SEQ ID NO: 1314810 - DNA, 14 bp, Homo sapiens
gatatatctgaaaa

SEQ ID NO: 1314811 - DNA, 18 bp, Homo sapiens
gatatatctgaaaactgg

SEQ ID NO: 1314812 - DNA, 13 bp, Homo sapiens
gatatttggctta

SEQ ID NO: 1314813 - DNA, 18 bp, Homo sapiens
gatatttggcttaaatat

SEQ ID NO: 1314814 - DNA, 17 bp, Homo sapiens
gatcagagcaggacctc

SEQ ID NO: 1314815 - DNA, 23 bp, Homo sapiens
gatcagagcaggacctcccttcc

SEQ ID NO: 1314816 - DNA, 17 bp, Homo sapiens
gatgtacaggcagatga

SEQ ID NO: 1314817 - DNA, 13 bp, Homo sapiens
gattttctccagc

SEQ ID NO: 1314818 - DNA, 15 bp, Homo sapiens
gattttctccagctc

SEQ ID NO: 1314819 - DNA, 23 bp, Homo sapiens
gcaaagaggactcgcttgtaaat

SEQ ID NO: 1314820 - DNA, 23 bp, Homo sapiens
gcacaagcagagtgcacagctgt

SEQ ID NO: 1314821 - DNA, 13 bp, Homo sapiens
gcacactctgcca

SEQ ID NO: 1314822 - DNA, 13 bp, Homo sapiens
gcacaggtcccac

SEQ ID NO: 1314823 - DNA, 14 bp, Homo sapiens
gcacaggtcccacc

SEQ ID NO: 1314824 - DNA, 12 bp, Homo sapiens
gcaccctctggc

SEQ ID NO: 1314825 - DNA, 22 bp, Homo sapiens
gcacttaagcacaagcagagtg

SEQ ID NO: 1314826 - DNA, 15 bp, Homo sapiens
gcagagtgcacagct

SEQ ID NO: 1314827 - DNA, 16 bp, Homo sapiens
gcaggacctcccttcc

SEQ ID NO: 1314828 - DNA, 14 bp, Homo sapiens
gcagtcatcagaag

SEQ ID NO: 1314829 - DNA, 15 bp, Homo sapiens
gcatccaatctcaag

SEQ ID NO: 1314830 - DNA, 13 bp, Homo sapiens
gcatcccggagga

SEQ ID NO: 1314831 - DNA, 19 bp, Homo sapiens
gcatcccggaggaaatctg

SEQ ID NO: 1314832 - DNA, 22 bp, Homo sapiens
taaattatacaaattaaaaaga

SEQ ID NO: 1314833 - DNA, 12 bp, Homo sapiens
taacccaaggag

SEQ ID NO: 1314834 - DNA, 19 bp, Homo sapiens
taacttatgtagatatttg

SEQ ID NO: 1314835 - DNA, 14 bp, Homo sapiens
taagaagcaaataa

SEQ ID NO: 1314836 - DNA, 16 bp, Homo sapiens
taagaagcttctaata

SEQ ID NO: 1314837 - DNA, 13 bp, Homo sapiens
taagcagagaagg

SEQ ID NO: 1314838 - DNA, 24 bp, Homo sapiens
taagcagagaagggcataaaacag

SEQ ID NO: 1314839 - DNA, 14 bp, Homo sapiens
taatagtatatcta

SEQ ID NO: 1314840 - DNA, 18 bp, Homo sapiens
taatatctttaaatgatg

SEQ ID NO: 1314841 - DNA, 13 bp, Homo sapiens
taatctgtacatt

SEQ ID NO: 1314842 - DNA, 15 bp, Homo sapiens
taattaaaaagttaa

SEQ ID NO: 1314843 - DNA, 15 bp, Homo sapiens
taattctattgaaag

SEQ ID NO: 1314844 - DNA, 14 bp, Homo sapiens
tacaaattaaaaag

SEQ ID NO: 1314845 - DNA, 17 bp, Homo sapiens
tacattttgttgtaaaa

SEQ ID NO: 1314846 - DNA, 20 bp, Homo sapiens
tacattttgttgtaaaaaga

SEQ ID NO: 1314847 - DNA, 21 bp, Homo sapiens
tacattttgttgtaaaaagaa

SEQ ID NO: 1314848 - DNA, 23 bp, Homo sapiens
tacattttgttgtaaaaagaaaa

SEQ ID NO: 1314849 - DNA, 23 bp, Homo sapiens
taccagtctttaaaggcccagcc

SEQ ID NO: 1314850 - DNA, 15 bp, Homo sapiens
tactcagggctcctc

SEQ ID NO: 1314851 - DNA, 16 bp, Homo sapiens
tactcagggctcctcc

SEQ ID NO: 1314852 - DNA, 17 bp, Homo sapiens
tactcagggctcctccc

SEQ ID NO: 1314853 - DNA, 19 bp, Homo sapiens
tactttggtttctgtctgt

SEQ ID NO: 1314854 - DNA, 20 bp, Homo sapiens
tagaaacccaagctcctcct

SEQ ID NO: 1314855 - DNA, 15 bp, Homo sapiens
tagaatataggtctc

SEQ ID NO: 1314856 - DNA, 21 bp, Homo sapiens
tagaatataggtctcttctcc

SEQ ID NO: 1314857 - DNA, 17 bp, Homo sapiens
tagatatttggcttaaa

SEQ ID NO: 1314858 - DNA, 17 bp, Homo sapiens
tagattttcatgttctt

SEQ ID NO: 1314859 - DNA, 21 bp, Homo sapiens
taggaaagcctcactgatata

SEQ ID NO: 1314860 - DNA, 18 bp, Homo sapiens
taggaccactcagcccct

SEQ ID NO: 1314861 - DNA, 21 bp, Homo sapiens
taggagtgggtgacaagagcc

SEQ ID NO: 1314862 - DNA, 18 bp, Homo sapiens
taggtctcttctcccaga

SEQ ID NO: 1314863 - DNA, 16 bp, Homo sapiens
tagtaatctgtacatt

SEQ ID NO: 1314864 - DNA, 16 bp, Homo sapiens
tatacaaattaaaaag

SEQ ID NO: 1314865 - DNA, 18 bp, Homo sapiens
tatacaaattaaaaagat

SEQ ID NO: 1314866 - DNA, 17 bp, Homo sapiens
tatagttcctaagaagc

SEQ ID NO: 1314867 - DNA, 14 bp, Homo sapiens
tatcccgagtctgg

SEQ ID NO: 1314868 - DNA, 16 bp, Homo sapiens
tatctgaaaactggaa

SEQ ID NO: 1314869 - DNA, 13 bp, Homo sapiens
tatctgtggtctt

SEQ ID NO: 1314870 - DNA, 13 bp, Homo sapiens
tatgagcatcctg

SEQ ID NO: 1314871 - DNA, 17 bp, Homo sapiens
tatgagcatcctgagcc

SEQ ID NO: 1314872 - DNA, 18 bp, Homo sapiens
tatgagcatcctgagccc

SEQ ID NO: 1314873 - DNA, 20 bp, Homo sapiens
tatgagcatcctgagccccg

SEQ ID NO: 1314874 - DNA, 16 bp, Homo sapiens
tatgggcattgacaaa

SEQ ID NO: 1314875 - DNA, 17 bp, Homo sapiens
tatgtagatatttggct

SEQ ID NO: 1314876 - DNA, 18 bp, Homo sapiens
tatgtagatatttggctt

SEQ ID NO: 1314877 - DNA, 12 bp, Homo sapiens
tattatttggca

SEQ ID NO: 1314878 - DNA, 14 bp, Homo sapiens
tattatttggcagt

SEQ ID NO: 1314879 - DNA, 23 bp, Homo sapiens
tattatttggcagtttggtattt

SEQ ID NO: 1314880 - DNA, 16 bp, Homo sapiens
tattcaagaaagatat

SEQ ID NO: 1314881 - DNA, 18 bp, Homo sapiens
tattcattaaatgtttga

SEQ ID NO: 1314882 - DNA, 18 bp, Homo sapiens
tattcttttctgcaaaat

SEQ ID NO: 1314883 - DNA, 16 bp, Homo sapiens
tattgaattattttgt

SEQ ID NO: 1314884 - DNA, 21 bp, Homo sapiens
tattgaattattttgttactg

SEQ ID NO: 1314885 - DNA, 14 bp, Homo sapiens
tatttggcagtttg

SEQ ID NO: 1314886 - DNA, 21 bp, Homo sapiens
tatttggcagtttggtatttg

SEQ ID NO: 1314887 - DNA, 19 bp, Homo sapiens
tatttggcttaaatatagt

SEQ ID NO: 1314888 - DNA, 12 bp, Homo sapiens
tattttgttact

SEQ ID NO: 1314889 - DNA, 17 bp, Homo sapiens
tattttgttactgtctg

SEQ ID NO: 1314890 - DNA, 17 bp, Homo sapiens
tatttttcagttccaag

SEQ ID NO: 1314891 - DNA, 16 bp, Homo sapiens
tcaaaaattgaagaga

SEQ ID NO: 1314892 - DNA, 18 bp, Homo sapiens
tcaaaaattgaagagaga

SEQ ID NO: 1314893 - DNA, 17 bp, Homo sapiens
tcaaaagttggactaaa

SEQ ID NO: 1314894 - DNA, 14 bp, Homo sapiens
tcaacaaagaaata

SEQ ID NO: 1314895 - DNA, 16 bp, Homo sapiens
tcaacaaagaaatatt

SEQ ID NO: 1314896 - DNA, 17 bp, Homo sapiens
tcaagaaagatatctat

SEQ ID NO: 1314897 - DNA, 21 bp, Homo sapiens
tcaatgttcacgcaacttgaa

SEQ ID NO: 1314898 - DNA, 21 bp, Homo sapiens
tcacatgatctgtttttcacc

SEQ ID NO: 1314899 - DNA, 19 bp, Homo sapiens
tcaccgcttccctcctgcc

SEQ ID NO: 1314900 - DNA, 13 bp, Homo sapiens
tcacctagagcca

SEQ ID NO: 1314901 - DNA, 21 bp, Homo sapiens
tcactctgggcacactctgcc

SEQ ID NO: 1314902 - DNA, 22 bp, Homo sapiens
tcactctgggcacactctgcca

SEQ ID NO: 1314903 - DNA, 12 bp, Homo sapiens
tcactgacacaa

SEQ ID NO: 1314904 - DNA, 16 bp, Homo sapiens
tcagaacccagggctc

SEQ ID NO: 1314905 - DNA, 20 bp, Homo sapiens
tcagaacccagggctctgcc

SEQ ID NO: 1314906 - DNA, 22 bp, Homo sapiens
tcagaacccagggctctgcccc

SEQ ID NO: 1314907 - DNA, 19 bp, Homo sapiens
tcagaatgctattgaaaat

SEQ ID NO: 1314908 - DNA, 14 bp, Homo sapiens
tcagagcaggacct

SEQ ID NO: 1314909 - DNA, 21 bp, Homo sapiens
tcagagcaggacctcccttcc

SEQ ID NO: 1314910 - DNA, 17 bp, Homo sapiens
tcagccacacccaggca

SEQ ID NO: 1314911 - DNA, 16 bp, Homo sapiens
tcagcccctaggagta

SEQ ID NO: 1314912 - DNA, 22 bp, Homo sapiens
tcagcccctaggagtatatttc

SEQ ID NO: 1314913 - DNA, 15 bp, Homo sapiens
tcagggctcctccca

SEQ ID NO: 1314914 - DNA, 16 bp, Homo sapiens
tcagggctcctcccag

SEQ ID NO: 1314915 - DNA, 23 bp, Homo sapiens
tcagtacttgtgaaacacagctg

SEQ ID NO: 1314916 - DNA, 12 bp, Homo sapiens
tcagtctttttc

SEQ ID NO: 1314917 - DNA, 13 bp, Homo sapiens
tcatcagaagtgg

SEQ ID NO: 1314918 - DNA, 23 bp, Homo sapiens
tcatcctgccttcatggaactca

SEQ ID NO: 1314919 - DNA, 14 bp, Homo sapiens
tcattaaatgtttg

SEQ ID NO: 1314920 - DNA, 15 bp, Homo sapiens
tcattaaatgtttga

SEQ ID NO: 1314921 - DNA, 17 bp, Homo sapiens
tcattagctgtgatttt

SEQ ID NO: 1314922 - DNA, 23 bp, Homo sapiens
tcattcctcccaccccaagcaaa

SEQ ID NO: 1314923 - DNA, 20 bp, Homo sapiens
tcatttcctctgagctgtta

SEQ ID NO: 1314924 - DNA, 21 bp, Homo sapiens
tcatttcctctgagctgttat

SEQ ID NO: 1314925 - DNA, 14 bp, Homo sapiens
tccaagctccctgc

SEQ ID NO: 1314926 - DNA, 18 bp, Homo sapiens
tccagaatttggaaatcc

SEQ ID NO: 1314927 - DNA, 22 bp, Homo sapiens
tccagaatttggaaatcctagt

SEQ ID NO: 1314928 - DNA, 11 bp, Homo sapiens
tccagcccatc

SEQ ID NO: 1314929 - DNA, 18 bp, Homo sapiens
tccagcccatctcggagc

SEQ ID NO: 1314930 - DNA, 19 bp, Homo sapiens
tccagcccatctcggagca

SEQ ID NO: 1314931 - DNA, 13 bp, Homo sapiens
tccagcccgggag

SEQ ID NO: 1314932 - DNA, 15 bp, Homo sapiens
tccagcccgggagcc

SEQ ID NO: 1314933 - DNA, 21 bp, Homo sapiens
tccagcccgggagcctaggac

SEQ ID NO: 1314934 - DNA, 15 bp, Homo sapiens
tccagctcagaaccc

SEQ ID NO: 1314935 - DNA, 21 bp, Homo sapiens
tccagctcagaacccagggct

SEQ ID NO: 1314936 - DNA, 18 bp, Homo sapiens
tccattattcaagaaaga

SEQ ID NO: 1314937 - DNA, 16 bp, Homo sapiens
tcccacctccagcccg

SEQ ID NO: 1314938 - DNA, 17 bp, Homo sapiens
tcccacctccagcccgg

SEQ ID NO: 1314939 - DNA, 18 bp, Homo sapiens
tcccagaatcccagccgg

SEQ ID NO: 1314940 - DNA, 18 bp, Homo sapiens
tcccagaggtccagccca

SEQ ID NO: 1314941 - DNA, 13 bp, Homo sapiens
tcccagccggcca

SEQ ID NO: 1314942 - DNA, 19 bp, Homo sapiens
tcccagccggccaatggaa

SEQ ID NO: 1314943 - DNA, 22 bp, Homo sapiens
tcccagccggccaatggaaacc

SEQ ID NO: 1314944 - DNA, 18 bp, Homo sapiens
tcccctcttcccttcaac

SEQ ID NO: 1314945 - DNA, 16 bp, Homo sapiens
tcccgagtctgggaca

SEQ ID NO: 1314946 - DNA, 14 bp, Homo sapiens
tcccggaggaaatc

SEQ ID NO: 1314947 - DNA, 14 bp, Homo sapiens
tcccggtcccgagt

SEQ ID NO: 1314948 - DNA, 13 bp, Homo sapiens
tccctgccccaaa

SEQ ID NO: 1314949 - DNA, 14 bp, Homo sapiens
tccgcccccagcct

SEQ ID NO: 1314950 - DNA, 20 bp, Homo sapiens
tcctgacgaaactggccccg

SEQ ID NO: 1314951 - DNA, 12 bp, Homo sapiens
tcctgagccccg

SEQ ID NO: 1314952 - DNA, 22 bp, Homo sapiens
tcctgcccgccacacagaccac

SEQ ID NO: 1314953 - DNA, 20 bp, Homo sapiens
tcctgctccagaatttggaa

SEQ ID NO: 1314954 - DNA, 18 bp, Homo sapiens
tcctgttaacactgtaat

SEQ ID NO: 1314955 - DNA, 23 bp, Homo sapiens
tccttcgtatcccgagtctggga

SEQ ID NO: 1314956 - DNA, 16 bp, Homo sapiens
tcgcttgttttttccc

SEQ ID NO: 1314957 - DNA, 16 bp, Homo sapiens
tcggaaccgctcacct

SEQ ID NO: 1314958 - DNA, 20 bp, Homo sapiens
tcggaaccgctcacctagag

SEQ ID NO: 1314959 - DNA, 22 bp, Homo sapiens
tcggaaccgctcacctagagcc

SEQ ID NO: 1314960 - DNA, 18 bp, Homo sapiens
tctaaagaccaaacttca

SEQ ID NO: 1314961 - DNA, 22 bp, Homo sapiens
tctaaagaccaaacttcactct

SEQ ID NO: 1314962 - DNA, 22 bp, Homo sapiens
ttcacgcaacttgaaattatat

SEQ ID NO: 1314963 - DNA, 16 bp, Homo sapiens
ttcagtcctgctccag

SEQ ID NO: 1314964 - DNA, 23 bp, Homo sapiens
ttcattaattaccctactttcat

SEQ ID NO: 1314965 - DNA, 21 bp, Homo sapiens
ttcatttcctctgagctgtta

SEQ ID NO: 1314966 - DNA, 21 bp, Homo sapiens
ttccaagaaagatgaatacat

SEQ ID NO: 1314967 - DNA, 15 bp, Homo sapiens
ttccatatcttgcga

SEQ ID NO: 1314968 - DNA, 16 bp, Homo sapiens
ttccgaccctctggga

SEQ ID NO: 1314969 - DNA, 17 bp, Homo sapiens
ttccgaccctctgggaa

SEQ ID NO: 1314970 - DNA, 18 bp, Homo sapiens
ttcctaagaagcttctaa

SEQ ID NO: 1314971 - DNA, 22 bp, Homo sapiens
ttcctcccaccccaagcaaatc

SEQ ID NO: 1314972 - DNA, 19 bp, Homo sapiens
ttcctctccttcgtatccc

SEQ ID NO: 1314973 - DNA, 17 bp, Homo sapiens
ttcctctgagctgttat

SEQ ID NO: 1314974 - DNA, 19 bp, Homo sapiens
ttcctctgagctgttatct

SEQ ID NO: 1314975 - DNA, 22 bp, Homo sapiens
ttcctgttttgtacatagattt

SEQ ID NO: 1314976 - DNA, 14 bp, Homo sapiens
ttctccagctcaga

SEQ ID NO: 1314977 - DNA, 20 bp, Homo sapiens
ttctccagctcagaacccag

SEQ ID NO: 1314978 - DNA, 15 bp, Homo sapiens
ttctcttcagtgtgt

SEQ ID NO: 1314979 - DNA, 20 bp, Homo sapiens
ttctgcagacacgccttccc

SEQ ID NO: 1314980 - DNA, 14 bp, Homo sapiens
ttctgttgtaactt

SEQ ID NO: 1314981 - DNA, 15 bp, Homo sapiens
ttctgttgtaactta

SEQ ID NO: 1314982 - DNA, 17 bp, Homo sapiens
ttctgttgtaacttatg

SEQ ID NO: 1314983 - DNA, 18 bp, Homo sapiens
ttgaaagtttttaatatt

SEQ ID NO: 1314984 - DNA, 20 bp, Homo sapiens
ttgaagagagatatatctga

SEQ ID NO: 1314985 - DNA, 21 bp, Homo sapiens
ttgaagagagatatatctgaa

SEQ ID NO: 1314986 - DNA, 19 bp, Homo sapiens
ttgcgaatccaagctccct

SEQ ID NO: 1314987 - DNA, 23 bp, Homo sapiens
ttgcggcgtcagtctttttctgt

SEQ ID NO: 1314988 - DNA, 16 bp, Homo sapiens
ttgctaattaaaaagt

SEQ ID NO: 1314989 - DNA, 14 bp, Homo sapiens
ttggaaaaatgttt

SEQ ID NO: 1314990 - DNA, 19 bp, Homo sapiens
ttggaaatcctagtttcct

SEQ ID NO: 1314991 - DNA, 14 bp, Homo sapiens
ttggcttaaatata

SEQ ID NO: 1314992 - DNA, 15 bp, Homo sapiens
ttggcttaaatatag

SEQ ID NO: 1314993 - DNA, 21 bp, Homo sapiens
ttggggtgtctttttttggtg

SEQ ID NO: 1314994 - DNA, 16 bp, Homo sapiens
ttggtgattcaaatgg

SEQ ID NO: 1314995 - DNA, 13 bp, Homo sapiens
ttgtaacttatgt

SEQ ID NO: 1314996 - DNA, 18 bp, Homo sapiens
ttgtaacttatgtagata

SEQ ID NO: 1314997 - DNA, 16 bp, Homo sapiens
ttgtcactgacacaaa

SEQ ID NO: 1314998 - DNA, 22 bp, Homo sapiens
ttgtcactgacacaaaggaagt

SEQ ID NO: 1314999 - DNA, 15 bp, Homo sapiens
ttgtggggacccagg

SEQ ID NO: 1315000 - DNA, 13 bp, Homo sapiens
ttgttgtaaaaag

SEQ ID NO: 1315001 - DNA, 15 bp, Homo sapiens
ttgttgtaaaaagaa

SEQ ID NO: 1315002 - DNA, 17 bp, Homo sapiens
ttgtttaatgtgaactt

SEQ ID NO: 1315003 - DNA, 23 bp, Homo sapiens
ttgtttaatgtgaacttgtagct

SEQ ID NO: 1315004 - DNA, 15 bp, Homo sapiens
tttaaaaaaagaaaa

SEQ ID NO: 1315005 - DNA, 22 bp, Homo sapiens
tttaaaaaaagaaaatgaaaaa

SEQ ID NO: 1315006 - DNA, 16 bp, Homo sapiens
tttaatgtgaacttgt

SEQ ID NO: 1315007 - DNA, 19 bp, Homo sapiens
tttaatgtgaacttgtagc

SEQ ID NO: 1315008 - DNA, 11 bp, Homo sapiens
tttagaccaag

SEQ ID NO: 1315009 - DNA, 14 bp, Homo sapiens
tttagaccaaggaa

SEQ ID NO: 1315010 - DNA, 15 bp, Homo sapiens
tttagaccaaggaac

SEQ ID NO: 1315011 - DNA, 18 bp, Homo sapiens
tttagaccaaggaacaaa

SEQ ID NO: 1315012 - DNA, 12 bp, Homo sapiens
tttcagttccaa

SEQ ID NO: 1315013 - DNA, 16 bp, Homo sapiens
tttcctctgagctgtt

SEQ ID NO: 1315014 - DNA, 19 bp, Homo sapiens
tttctgttgtaacttatgt

SEQ ID NO: 1315015 - DNA, 16 bp, Homo sapiens
ttttcagttccaagaa

SEQ ID NO: 1315016 - DNA, 16 bp, Homo sapiens
ttttgttgtaaaaaga

SEQ ID NO: 1315017 - DNA, 19 bp, Homo sapiens
ttttgttgtaaaaagaaaa

SEQ ID NO: 1315018 - DNA, 14 bp, Homo sapiens
tttttaaaaaaaga

SEQ ID NO: 1315019 - DNA, 17 bp, Homo sapiens
tttttaaaaaaagaaaa

SEQ ID NO: 1315020 - DNA, 17 bp, Homo sapiens
tttttcagttccaagaa

SEQ ID NO: 1315021 - DNA, 21 bp, Homo sapiens
tttttcagttccaagaaagat

SEQ ID NO: 1315022 - DNA, 17 bp, Homo sapiens
tttttctgttgtaactt

SEQ ID NO: 1315023 - DNA, 19 bp, Homo sapiens
tttttggtgattcaaatgg

SEQ ID NO: 1315024 - DNA, 10 bp, Homo sapiens
aaaaaaagaa

SEQ ID NO: 1315025 - DNA, 11 bp, Homo sapiens
aaaaaaagaaa

SEQ ID NO: 1315026 - DNA, 12 bp, Homo sapiens
aaaaacaaccaa

SEQ ID NO: 1315027 - DNA, 15 bp, Homo sapiens
aaaaagattcttttt

SEQ ID NO: 1315028 - DNA, 19 bp, Homo sapiens
aaaaattgaagagagatat

SEQ ID NO: 1315029 - DNA, 14 bp, Homo sapiens
aaaaccacaaaggc

SEQ ID NO: 1315030 - DNA, 10 bp, Homo sapiens
aaaagaaaat

SEQ ID NO: 1315031 - DNA, 22 bp, Homo sapiens
aaaagaaaatgaaaaacaacca

SEQ ID NO: 1315032 - DNA, 18 bp, Homo sapiens
aaaagattctttttctga

SEQ ID NO: 1315033 - DNA, 14 bp, Homo sapiens
aaaagtgtcctata

SEQ ID NO: 1315034 - DNA, 12 bp, Homo sapiens
aaaatagtttgt

SEQ ID NO: 1315035 - DNA, 12 bp, Homo sapiens
aaaccacaaagg

SEQ ID NO: 1315036 - DNA, 19 bp, Homo sapiens
aaaccacaaaggccaaact

SEQ ID NO: 1315037 - DNA, 16 bp, Homo sapiens
aaactccgcccccagc

SEQ ID NO: 1315038 - DNA, 22 bp, Homo sapiens
aaagaaaatgaaaaacaaccaa

SEQ ID NO: 1315039 - DNA, 11 bp, Homo sapiens
aaagaccaaac

SEQ ID NO: 1315040 - DNA, 13 bp, Homo sapiens
aaagaccaaactt

SEQ ID NO: 1315041 - DNA, 13 bp, Homo sapiens
aaaggccaaactg

SEQ ID NO: 1315042 - DNA, 15 bp, Homo sapiens
aaaggccaaactgct

SEQ ID NO: 1315043 - DNA, 18 bp, Homo sapiens
aaaggccaaactgctgga

SEQ ID NO: 1315044 - DNA, 13 bp, Homo sapiens
aaaggcccagccc

SEQ ID NO: 1315045 - DNA, 14 bp, Homo sapiens
aaaggcccagcccc

SEQ ID NO: 1315046 - DNA, 16 bp, Homo sapiens
aaaggggacaggcctc

SEQ ID NO: 1315047 - DNA, 15 bp, Homo sapiens
aaagttggactaaat

SEQ ID NO: 1315048 - DNA, 12 bp, Homo sapiens
aaataaatatca

SEQ ID NO: 1315049 - DNA, 15 bp, Homo sapiens
aaataacttcagtcc

SEQ ID NO: 1315050 - DNA, 18 bp, Homo sapiens
aaatatagttcctaagaa

SEQ ID NO: 1315051 - DNA, 13 bp, Homo sapiens
aaatctgcagagg

SEQ ID NO: 1315052 - DNA, 15 bp, Homo sapiens
aaatgttatgactcc

SEQ ID NO: 1315053 - DNA, 18 bp, Homo sapiens
aaattaaaaagattcttt

SEQ ID NO: 1315054 - DNA, 13 bp, Homo sapiens
aacaaagaaatat

SEQ ID NO: 1315055 - DNA, 14 bp, Homo sapiens
aacaaagaaatatt

SEQ ID NO: 1315056 - DNA, 11 bp, Homo sapiens
aacacagctgt

SEQ ID NO: 1315057 - DNA, 24 bp, Homo sapiens
aacacagctgttcttctgttctgc

SEQ ID NO: 1315058 - DNA, 15 bp, Homo sapiens
aacactgtaatatct

SEQ ID NO: 1315059 - DNA, 11 bp, Homo sapiens
aaccacaaagg

SEQ ID NO: 1315060 - DNA, 15 bp, Homo sapiens
aattgtttgtcctca

SEQ ID NO: 1315061 - DNA, 16 bp, Homo sapiens
aatttctgtcagaatg

SEQ ID NO: 1315062 - DNA, 19 bp, Homo sapiens
acaaaggaagtgccccctc

SEQ ID NO: 1315063 - DNA, 15 bp, Homo sapiens
acaaaggccaaactg

SEQ ID NO: 1315064 - DNA, 17 bp, Homo sapiens
acaaaggccaaactgct

SEQ ID NO: 1315065 - DNA, 19 bp, Homo sapiens
acaaatctgtgtatattat

SEQ ID NO: 1315066 - DNA, 20 bp, Homo sapiens
acaaatctgtgtatattatt

SEQ ID NO: 1315067 - DNA, 21 bp, Homo sapiens
acaaattaaaaagattctttt

SEQ ID NO: 1315068 - DNA, 22 bp, Homo sapiens
acaagagcctgatctcttcctg

SEQ ID NO: 1315069 - DNA, 21 bp, Homo sapiens
acacaaaactccgcccccagc

SEQ ID NO: 1315070 - DNA, 13 bp, Homo sapiens
acacaaaggaagt

SEQ ID NO: 1315071 - DNA, 21 bp, Homo sapiens
acacaaaggaagtgccccctc

SEQ ID NO: 1315072 - DNA, 21 bp, Homo sapiens
acacaattggaattgtcttta

SEQ ID NO: 1315073 - DNA, 11 bp, Homo sapiens
acacagaccac

SEQ ID NO: 1315074 - DNA, 19 bp, Homo sapiens
acactctgccagcaaagag

SEQ ID NO: 1315075 - DNA, 16 bp, Homo sapiens
acactgtaatatcttt

SEQ ID NO: 1315076 - DNA, 17 bp, Homo sapiens
acactgtaatatcttta

SEQ ID NO: 1315077 - DNA, 22 bp, Homo sapiens
acagctttggggtgtctttttt

SEQ ID NO: 1315078 - DNA, 13 bp, Homo sapiens
acaggcctcacct

SEQ ID NO: 1315079 - DNA, 15 bp, Homo sapiens
acaggcctcacctct

SEQ ID NO: 1315080 - DNA, 20 bp, Homo sapiens
acaggcctcacctctaccca

SEQ ID NO: 1315081 - DNA, 19 bp, Homo sapiens
acatggctctggactctaa

SEQ ID NO: 1315082 - DNA, 22 bp, Homo sapiens
acatggctctggactctaaaga

SEQ ID NO: 1315083 - DNA, 15 bp, Homo sapiens
acattatagattttc

SEQ ID NO: 1315084 - DNA, 15 bp, Homo sapiens
acattttgttgtaaa

SEQ ID NO: 1315085 - DNA, 21 bp, Homo sapiens
acattttgttgtaaaaagaaa

SEQ ID NO: 1315086 - DNA, 20 bp, Homo sapiens
accaacgttactcagggctc

SEQ ID NO: 1315087 - DNA, 21 bp, Homo sapiens
accaacgttactcagggctcc

SEQ ID NO: 1315088 - DNA, 18 bp, Homo sapiens
accacaaaggccaaactg

SEQ ID NO: 1315089 - DNA, 21 bp, Homo sapiens
accacaaaggccaaactgctg

SEQ ID NO: 1315090 - DNA, 17 bp, Homo sapiens
accaccatccaccgctg

SEQ ID NO: 1315091 - DNA, 15 bp, Homo sapiens
accactcagccccta

SEQ ID NO: 1315092 - DNA, 16 bp, Homo sapiens
accactcagcccctag

SEQ ID NO: 1315093 - DNA, 17 bp, Homo sapiens
accacttcactgaaaga

SEQ ID NO: 1315094 - DNA, 20 bp, Homo sapiens
accagtctttaaaggcccag

SEQ ID NO: 1315095 - DNA, 23 bp, Homo sapiens
accagtctttaaaggcccagccc

SEQ ID NO: 1315096 - DNA, 15 bp, Homo sapiens
acccaagctcctcct

SEQ ID NO: 1315097 - DNA, 15 bp, Homo sapiens
acccaaggagcacag

SEQ ID NO: 1315098 - DNA, 20 bp, Homo sapiens
acccacgattttctccagct

SEQ ID NO: 1315099 - DNA, 15 bp, Homo sapiens
acccaggctccgccc

SEQ ID NO: 1315100 - DNA, 23 bp, Homo sapiens
acccaggctccgcccttagtccc

SEQ ID NO: 1315101 - DNA, 16 bp, Homo sapiens
acccagggctctgccc

SEQ ID NO: 1315102 - DNA, 11 bp, Homo sapiens
accctctggcc

SEQ ID NO: 1315103 - DNA, 16 bp, Homo sapiens
acccttaacccaagga

SEQ ID NO: 1315104 - DNA, 18 bp, Homo sapiens
acccttaacccaaggagc

SEQ ID NO: 1315105 - DNA, 23 bp, Homo sapiens
acccttaacccaaggagcacagg

SEQ ID NO: 1315106 - DNA, 13 bp, Homo sapiens
acctagagccaga

SEQ ID NO: 1315107 - DNA, 15 bp, Homo sapiens
acctagagccagacc

SEQ ID NO: 1315108 - DNA, 17 bp, Homo sapiens
acctccagcccgggagc

SEQ ID NO: 1315109 - DNA, 21 bp, Homo sapiens
acctcccagaggtccagccca

SEQ ID NO: 1315110 - DNA, 22 bp, Homo sapiens
acctcccagaggtccagcccat

SEQ ID NO: 1315111 - DNA, 18 bp, Homo sapiens
acctcccttccgaccctc

SEQ ID NO: 1315112 - DNA, 22 bp, Homo sapiens
acctcccttccgaccctctggg

SEQ ID NO: 1315113 - DNA, 21 bp, Homo sapiens
acctctacccaaaccctaggt

SEQ ID NO: 1315114 - DNA, 22 bp, Homo sapiens
acctggccgcgtttagaccaag

SEQ ID NO: 1315115 - DNA, 18 bp, Homo sapiens
actattcattaaatgttt

SEQ ID NO: 1315116 - DNA, 12 bp, Homo sapiens
actcagccccta

SEQ ID NO: 1315117 - DNA, 14 bp, Homo sapiens
actcagcccctagg

SEQ ID NO: 1315118 - DNA, 18 bp, Homo sapiens
actcagctgtctgtggct

SEQ ID NO: 1315119 - DNA, 14 bp, Homo sapiens
actcagggctcctc

SEQ ID NO: 1315120 - DNA, 19 bp, Homo sapiens
actcagggctcctcccagc

SEQ ID NO: 1315121 - DNA, 15 bp, Homo sapiens
actcccagtccccag

SEQ ID NO: 1315122 - DNA, 12 bp, Homo sapiens
actcgcttgtaa

SEQ ID NO: 1315123 - DNA, 16 bp, Homo sapiens
actctaaagaccaaac

SEQ ID NO: 1315124 - DNA, 18 bp, Homo sapiens
actctaaagaccaaactt

SEQ ID NO: 1315125 - DNA, 14 bp, Homo sapiens
actctgagcccatg

SEQ ID NO: 1315126 - DNA, 20 bp, Homo sapiens
actctgggcacactctgcca

SEQ ID NO: 1315127 - DNA, 14 bp, Homo sapiens
actgacacaaagga

SEQ ID NO: 1315128 - DNA, 16 bp, Homo sapiens
actgacacaaaggaag

SEQ ID NO: 1315129 - DNA, 17 bp, Homo sapiens
actgacacaaaggaagt

SEQ ID NO: 1315130 - DNA, 22 bp, Homo sapiens
actgctggacgtctttcttttt

SEQ ID NO: 1315131 - DNA, 23 bp, Homo sapiens
actggaataagaagcaaataaat

SEQ ID NO: 1315132 - DNA, 19 bp, Homo sapiens
actggccccggatcagagc

SEQ ID NO: 1315133 - DNA, 21 bp, Homo sapiens
actgtgtttaatagtatatct

SEQ ID NO: 1315134 - DNA, 19 bp, Homo sapiens
acttatgtagatatttggc

SEQ ID NO: 1315135 - DNA, 11 bp, Homo sapiens
acttgtagctg

SEQ ID NO: 1315136 - DNA, 21 bp, Homo sapiens
acttgtcactgacacaaagga

SEQ ID NO: 1315137 - DNA, 18 bp, Homo sapiens
acttgtgaaacacagctg

SEQ ID NO: 1315138 - DNA, 18 bp, Homo sapiens
agaaacccaagctcctcc

SEQ ID NO: 1315139 - DNA, 20 bp, Homo sapiens
agaacccagggctctgcccc

SEQ ID NO: 1315140 - DNA, 19 bp, Homo sapiens
agaagggcataaaacagct

SEQ ID NO: 1315141 - DNA, 23 bp, Homo sapiens
agaatcccagccggccaatggaa

SEQ ID NO: 1315142 - DNA, 16 bp, Homo sapiens
ttttagtaatctgtac

SEQ ID NO: 1315143 - DNA, 15 bp, Homo sapiens
ttttctgttgtaact

SEQ ID NO: 1315144 - DNA, 13 bp, Homo sapiens
ttttgaagggagg

SEQ ID NO: 1315145 - DNA, 12 bp, Homo sapiens
ttttgttactgt

SEQ ID NO: 1315146 - DNA, 15 bp, Homo sapiens
ttttgttgtaaaaag

SEQ ID NO: 1315147 - DNA, 17 bp, Homo sapiens
tttttaatatttattga

SEQ ID NO: 1315148 - DNA, 16 bp, Homo sapiens
tttttagtaatctgta

SEQ ID NO: 1315149 - DNA, 14 bp, Homo sapiens
tttttcagttccaa

SEQ ID NO: 1315150 - DNA, 18 bp, Homo sapiens
ttttttaaaaaaagaaaa

SEQ ID NO: 1315151 - DNA, 17 bp, Homo sapiens
tctttaaatgatgtaca

SEQ ID NO: 1315152 - DNA, 22 bp, Homo sapiens
tctttaatttctgtcagaatgc

SEQ ID NO: 1315153 - DNA, 11 bp, Homo sapiens
tctttttctga

SEQ ID NO: 1315154 - DNA, 15 bp, Homo sapiens
tctttttctgttgta

SEQ ID NO: 1315155 - DNA, 16 bp, Homo sapiens
tctttttctgttgtaa

SEQ ID NO: 1315156 - DNA, 19 bp, Homo sapiens
tgaaacacagctgttcttc

SEQ ID NO: 1315157 - DNA, 15 bp, Homo sapiens
tgaaattatatctgt

SEQ ID NO: 1315158 - DNA, 15 bp, Homo sapiens
tgaagagagatatat

SEQ ID NO: 1315159 - DNA, 17 bp, Homo sapiens
tgacacaattggaattg

SEQ ID NO: 1315160 - DNA, 19 bp, Homo sapiens
tgagcatcctgagccccgc

SEQ ID NO: 1315161 - DNA, 23 bp, Homo sapiens
tgagcatcctgagccccgccctc

SEQ ID NO: 1315162 - DNA, 22 bp, Homo sapiens
tgagccccgccctcttcctgac

SEQ ID NO: 1315163 - DNA, 13 bp, Homo sapiens
tgagctgttatct

SEQ ID NO: 1315164 - DNA, 11 bp, Homo sapiens
tgattcaaatg

SEQ ID NO: 1315165 - DNA, 20 bp, Homo sapiens
tgccccaaataacttcagtc

SEQ ID NO: 1315166 - DNA, 21 bp, Homo sapiens
tgccccaaataacttcagtcc

SEQ ID NO: 1315167 - DNA, 17 bp, Homo sapiens
tgcccccagcccaaagg

SEQ ID NO: 1315168 - DNA, 22 bp, Homo sapiens
tgcgaatccaagctccctgccc

SEQ ID NO: 1315169 - DNA, 19 bp, Homo sapiens
tgctccagaatttggaaat

SEQ ID NO: 1315170 - DNA, 19 bp, Homo sapiens
tgctgatttcccctcttcc

SEQ ID NO: 1315171 - DNA, 21 bp, Homo sapiens
tgcttagtatctcatcaacaa

SEQ ID NO: 1315172 - DNA, 17 bp, Homo sapiens
tggaaataataaaagat

SEQ ID NO: 1315173 - DNA, 14 bp, Homo sapiens
tggacgtctttctt

SEQ ID NO: 1315174 - DNA, 14 bp, Homo sapiens
tggactaaatgcct

SEQ ID NO: 1315175 - DNA, 22 bp, Homo sapiens
tggactaaatgcctagttttta

SEQ ID NO: 1315176 - DNA, 21 bp, Homo sapiens
tggactctaaagaccaaactt

SEQ ID NO: 1315177 - DNA, 13 bp, Homo sapiens
tggcttaaatata

SEQ ID NO: 1315178 - DNA, 22 bp, Homo sapiens
tggcttaaatatagttcctaag

SEQ ID NO: 1315179 - DNA, 17 bp, Homo sapiens
tgggaacctcccagagg

SEQ ID NO: 1315180 - DNA, 15 bp, Homo sapiens
tggggagaggaaaga

SEQ ID NO: 1315181 - DNA, 15 bp, Homo sapiens
tgtaaataccaggat

SEQ ID NO: 1315182 - DNA, 15 bp, Homo sapiens
tgtaacttatgtaga

SEQ ID NO: 1315183 - DNA, 20 bp, Homo sapiens
tgtaacttatgtagatattt

SEQ ID NO: 1315184 - DNA, 22 bp, Homo sapiens
tgtaacttatgtagatatttgg

SEQ ID NO: 1315185 - DNA, 14 bp, Homo sapiens
tgtaatatctttaa

SEQ ID NO: 1315186 - DNA, 14 bp, Homo sapiens
tgtacatagattta

SEQ ID NO: 1315187 - DNA, 22 bp, Homo sapiens
tgtacattttgttgtaaaaaga

SEQ ID NO: 1315188 - DNA, 17 bp, Homo sapiens
tgtagatatttggctta

SEQ ID NO: 1315189 - DNA, 12 bp, Homo sapiens
tgtagctgtaaa

SEQ ID NO: 1315190 - DNA, 17 bp, Homo sapiens
tgtaggagctgaggttt

SEQ ID NO: 1315191 - DNA, 15 bp, Homo sapiens
tgtatattatttggc

SEQ ID NO: 1315192 - DNA, 16 bp, Homo sapiens
tgtatattatttggca

SEQ ID NO: 1315193 - DNA, 21 bp, Homo sapiens
tgtatattatttggcagtttg

SEQ ID NO: 1315194 - DNA, 24 bp, Homo sapiens
tgtatattatttggcagtttggta

SEQ ID NO: 1315195 - DNA, 16 bp, Homo sapiens
tgtatggatatgtgta

SEQ ID NO: 1315196 - DNA, 18 bp, Homo sapiens
tgtatggatatgtgtaaa

SEQ ID NO: 1315197 - DNA, 21 bp, Homo sapiens
tgtcaaaagttggactaaatg

SEQ ID NO: 1315198 - DNA, 22 bp, Homo sapiens
tgtcaaaagttggactaaatgc

SEQ ID NO: 1315199 - DNA, 18 bp, Homo sapiens
tgtcactgacacaaagga

SEQ ID NO: 1315200 - DNA, 22 bp, Homo sapiens
tgtcagaatgctattgaaaatg

SEQ ID NO: 1315201 - DNA, 12 bp, Homo sapiens
tgtcctataatt

SEQ ID NO: 1315202 - DNA, 14 bp, Homo sapiens
tgtcctataattct

SEQ ID NO: 1315203 - DNA, 14 bp, Homo sapiens
tgtctgtagtgttt

SEQ ID NO: 1315204 - DNA, 21 bp, Homo sapiens
tgtgctactgtctttggaaaa

SEQ ID NO: 1315205 - DNA, 21 bp, Homo sapiens
tgtggctaaatgcctaataaa

SEQ ID NO: 1315206 - DNA, 18 bp, Homo sapiens
tgtgtaaatgttatgact

SEQ ID NO: 1315207 - DNA, 19 bp, Homo sapiens
tgtgtaaatgttatgactc

SEQ ID NO: 1315208 - DNA, 16 bp, Homo sapiens
tgttaacactgtaata

SEQ ID NO: 1315209 - DNA, 16 bp, Homo sapiens
tgttactgtctgtagt

SEQ ID NO: 1315210 - DNA, 17 bp, Homo sapiens
tgttactgtctgtagtg

SEQ ID NO: 1315211 - DNA, 18 bp, Homo sapiens
tgttctgcccccagccca

SEQ ID NO: 1315212 - DNA, 19 bp, Homo sapiens
tgttgacttctatcctgtt

SEQ ID NO: 1315213 - DNA, 15 bp, Homo sapiens
tgttgtaaaaagaaa

SEQ ID NO: 1315214 - DNA, 24 bp, Homo sapiens
tgttgtaacttatgtagatatttg

SEQ ID NO: 1315215 - DNA, 13 bp, Homo sapiens
tgtttaatgtgaa

SEQ ID NO: 1315216 - DNA, 14 bp, Homo sapiens
ttaaaaaaagaaaa

SEQ ID NO: 1315217 - DNA, 18 bp, Homo sapiens
ttaaaaagattctttttc

SEQ ID NO: 1315218 - DNA, 20 bp, Homo sapiens
ttaaaggcccagcccctaga

SEQ ID NO: 1315219 - DNA, 12 bp, Homo sapiens
ttaaatgtttga

SEQ ID NO: 1315220 - DNA, 18 bp, Homo sapiens
ttaacccaaggagcacag

SEQ ID NO: 1315221 - DNA, 14 bp, Homo sapiens
ttaatagtatatct

SEQ ID NO: 1315222 - DNA, 16 bp, Homo sapiens
ttaatatttattgaat

SEQ ID NO: 1315223 - DNA, 13 bp, Homo sapiens
ttaatcttcatgg

SEQ ID NO: 1315224 - DNA, 13 bp, Homo sapiens
ttaatgtgaactt

SEQ ID NO: 1315225 - DNA, 19 bp, Homo sapiens
ttaatgtgaacttgtagct

SEQ ID NO: 1315226 - DNA, 23 bp, Homo sapiens
ttaccagtctttaaaggcccagc

SEQ ID NO: 1315227 - DNA, 19 bp, Homo sapiens
ttactattcattaaatgtt

SEQ ID NO: 1315228 - DNA, 21 bp, Homo sapiens
ttactcagggctcctcccagc

SEQ ID NO: 1315229 - DNA, 17 bp, Homo sapiens
ttactgtctgtagtgtt

SEQ ID NO: 1315230 - DNA, 16 bp, Homo sapiens
ttagtaatctgtacat

SEQ ID NO: 1315231 - DNA, 18 bp, Homo sapiens
ttatacaaattaaaaaga

SEQ ID NO: 1315232 - DNA, 15 bp, Homo sapiens
ttatgtagatatttg

SEQ ID NO: 1315233 - DNA, 21 bp, Homo sapiens
ttcaaatgggttttccacgct

SEQ ID NO: 1315234 - DNA, 16 bp, Homo sapiens
ttcaaattgtcttttg

SEQ ID NO: 1315235 - DNA, 17 bp, Homo sapiens
ttcaagaaagatatcta

SEQ ID NO: 1315236 - DNA, 16 bp, Homo sapiens
ttcaccacttcactga

SEQ ID NO: 1315237 - DNA, 20 bp, Homo sapiens
gtttttcaccacttcactga

SEQ ID NO: 1315238 - DNA, 21 bp, Homo sapiens
gtttttttttttaaaaaaaga

SEQ ID NO: 1315239 - DNA, 13 bp, Homo sapiens
taaaaaaagaaaa

SEQ ID NO: 1315240 - DNA, 19 bp, Homo sapiens
taaaaaatttattatgtcc

SEQ ID NO: 1315241 - DNA, 20 bp, Homo sapiens
taaaaagaaaaaccactccc

SEQ ID NO: 1315242 - DNA, 12 bp, Homo sapiens
taaaaagttaat

SEQ ID NO: 1315243 - DNA, 16 bp, Homo sapiens
taaacaattcaagtga

SEQ ID NO: 1315244 - DNA, 16 bp, Homo sapiens
taaaggcccagcccct

SEQ ID NO: 1315245 - DNA, 14 bp, Homo sapiens
taaataccaggatt

SEQ ID NO: 1315246 - DNA, 15 bp, Homo sapiens
taaatatagttccta

SEQ ID NO: 1315247 - DNA, 16 bp, Homo sapiens
taaatatagttcctaa

SEQ ID NO: 1315248 - DNA, 20 bp, Homo sapiens
taaatatagttcctaagaag

SEQ ID NO: 1315249 - DNA, 14 bp, Homo sapiens
taaatgcctaataa

SEQ ID NO: 1315250 - DNA, 14 bp, Homo sapiens
taaatgcctagttt

SEQ ID NO: 1315251 - DNA, 17 bp, Homo sapiens
taaatgcctagttttta

SEQ ID NO: 1315252 - DNA, 20 bp, Homo sapiens
taaatgcctagtttttagta

SEQ ID NO: 1315253 - DNA, 13 bp, Homo sapiens
taaatgttatgac

SEQ ID NO: 1315254 - DNA, 15 bp, Homo sapiens
taaatgttatgactc

SEQ ID NO: 1315255 - DNA, 13 bp, Homo sapiens
taacactgtaata

SEQ ID NO: 1315256 - DNA, 14 bp, Homo sapiens
taacactgtaatat

SEQ ID NO: 1315257 - DNA, 18 bp, Homo sapiens
taacactgtaatatcttt

SEQ ID NO: 1315258 - DNA, 18 bp, Homo sapiens
taacccaaggagcacagg

SEQ ID NO: 1315259 - DNA, 22 bp, Homo sapiens
taacttatgtagatatttggct

SEQ ID NO: 1315260 - DNA, 14 bp, Homo sapiens
taagaagcttctaa

SEQ ID NO: 1315261 - DNA, 22 bp, Homo sapiens
taagaagcttctaataaattat

SEQ ID NO: 1315262 - DNA, 21 bp, Homo sapiens
taatatctttaaatgatgtac

SEQ ID NO: 1315263 - DNA, 13 bp, Homo sapiens
taatatttattga

SEQ ID NO: 1315264 - DNA, 15 bp, Homo sapiens
taatatttattgaat

SEQ ID NO: 1315265 - DNA, 18 bp, Homo sapiens
taatatttattgaattat

SEQ ID NO: 1315266 - DNA, 18 bp, Homo sapiens
taatctgtacattttgtt

SEQ ID NO: 1315267 - DNA, 12 bp, Homo sapiens
taatgtgaactt

SEQ ID NO: 1315268 - DNA, 18 bp, Homo sapiens
taattaaaaagttaatct

SEQ ID NO: 1315269 - DNA, 18 bp, Homo sapiens
taatttctgtcagaatgc

SEQ ID NO: 1315270 - DNA, 18 bp, Homo sapiens
cgcttccctcctgcccgc

SEQ ID NO: 1315271 - DNA, 19 bp, Homo sapiens
cgcttgtggggacccaggc

SEQ ID NO: 1315272 - DNA, 22 bp, Homo sapiens
cggaccgcttgtggggacccag

SEQ ID NO: 1315273 - DNA, 22 bp, Homo sapiens
cggagcatcccggaggaaatct

SEQ ID NO: 1315274 - DNA, 13 bp, Homo sapiens
cggatcagagcag

SEQ ID NO: 1315275 - DNA, 15 bp, Homo sapiens
cggccaatggaaacc

SEQ ID NO: 1315276 - DNA, 17 bp, Homo sapiens
cgtcagtctttttctgt

SEQ ID NO: 1315277 - DNA, 19 bp, Homo sapiens
cgttactcagggctcctcc

SEQ ID NO: 1315278 - DNA, 21 bp, Homo sapiens
cgttactcagggctcctccca

SEQ ID NO: 1315279 - DNA, 12 bp, Homo sapiens
ctaaagaccaaa

SEQ ID NO: 1315280 - DNA, 18 bp, Homo sapiens
ctaaatgcctaataaaca

SEQ ID NO: 1315281 - DNA, 19 bp, Homo sapiens
ctaaatgcctaataaacaa

SEQ ID NO: 1315282 - DNA, 17 bp, Homo sapiens
ctaaatgcctagttttt

SEQ ID NO: 1315283 - DNA, 20 bp, Homo sapiens
ctaaatgcctagtttttagt

SEQ ID NO: 1315284 - DNA, 17 bp, Homo sapiens
ctaagaagcttctaata

SEQ ID NO: 1315285 - DNA, 18 bp, Homo sapiens
ctaagaagcttctaataa

SEQ ID NO: 1315286 - DNA, 20 bp, Homo sapiens
ctactttggtttctgtctgt

SEQ ID NO: 1315287 - DNA, 18 bp, Homo sapiens
ctagaaacccaagctcct

SEQ ID NO: 1315288 - DNA, 16 bp, Homo sapiens
ctaggaccactcagcc

SEQ ID NO: 1315289 - DNA, 22 bp, Homo sapiens
ctaggaccactcagcccctagg

SEQ ID NO: 1315290 - DNA, 20 bp, Homo sapiens
ctaggttcccggtcccgagt

SEQ ID NO: 1315291 - DNA, 19 bp, Homo sapiens
ctagtttttagtaatctgt

SEQ ID NO: 1315292 - DNA, 18 bp, Homo sapiens
ctatcctgttaacactgt

SEQ ID NO: 1315293 - DNA, 22 bp, Homo sapiens
ctatcctgttaacactgtaata

SEQ ID NO: 1315294 - DNA, 18 bp, Homo sapiens
ctattcattaaatgtttg

SEQ ID NO: 1315295 - DNA, 21 bp, Homo sapiens
ctcaaggaatctttaagcaga

SEQ ID NO: 1315296 - DNA, 15 bp, Homo sapiens
ctcacctagagccag

SEQ ID NO: 1315297 - DNA, 19 bp, Homo sapiens
ctcacctagagccagacca

SEQ ID NO: 1315298 - DNA, 14 bp, Homo sapiens
ctcacgctgggtcc

SEQ ID NO: 1315299 - DNA, 15 bp, Homo sapiens
ctcactgatatattt

SEQ ID NO: 1315300 - DNA, 22 bp, Homo sapiens
ctcactgatatattttccaggg

SEQ ID NO: 1315301 - DNA, 13 bp, Homo sapiens
ctcagaacccagg

SEQ ID NO: 1315302 - DNA, 23 bp, Homo sapiens
ctcagaacccagggctctgcccc

SEQ ID NO: 1315303 - DNA, 17 bp, Homo sapiens
ctcagccacacccaggc

SEQ ID NO: 1315304 - DNA, 11 bp, Homo sapiens
ctcagccccta

SEQ ID NO: 1315305 - DNA, 12 bp, Homo sapiens
ctcagcccctag

SEQ ID NO: 1315306 - DNA, 20 bp, Homo sapiens
ctcagcggcgaccgccctcc

SEQ ID NO: 1315307 - DNA, 18 bp, Homo sapiens
ctcagctgtctgtggctt

SEQ ID NO: 1315308 - DNA, 18 bp, Homo sapiens
ctcagggctcctcccagc

SEQ ID NO: 1315309 - DNA, 13 bp, Homo sapiens
ctcagttggaaat

SEQ ID NO: 1315310 - DNA, 21 bp, Homo sapiens
ctcagttggaaataataaaag

SEQ ID NO: 1315311 - DNA, 14 bp, Homo sapiens
ctcatcaacaaaga

SEQ ID NO: 1315312 - DNA, 15 bp, Homo sapiens
ctcatcaacaaagaa

SEQ ID NO: 1315313 - DNA, 18 bp, Homo sapiens
ctcatcaacaaagaaata

SEQ ID NO: 1315314 - DNA, 18 bp, Homo sapiens
ctccagaatttggaaatc

SEQ ID NO: 1315315 - DNA, 14 bp, Homo sapiens
ctccagcccgggag

SEQ ID NO: 1315316 - DNA, 15 bp, Homo sapiens
ctccagcccgggagc

SEQ ID NO: 1315317 - DNA, 13 bp, Homo sapiens
ctcccagaatccc

SEQ ID NO: 1315318 - DNA, 16 bp, Homo sapiens
ctcccagaatcccagc

SEQ ID NO: 1315319 - DNA, 16 bp, Homo sapiens
ctcccagaggtccagc

SEQ ID NO: 1315320 - DNA, 19 bp, Homo sapiens
ctcccagaggtccagccca

SEQ ID NO: 1315321 - DNA, 23 bp, Homo sapiens
ctcccagaggtccagcccatctc

SEQ ID NO: 1315322 - DNA, 19 bp, Homo sapiens
ctcccagcttgtaggagct

SEQ ID NO: 1315323 - DNA, 14 bp, Homo sapiens
ctcccttccgaccc

SEQ ID NO: 1315324 - DNA, 22 bp, Homo sapiens
ctcccttccgaccctctgggaa

SEQ ID NO: 1315325 - DNA, 16 bp, Homo sapiens
ctccgcccccagccta

SEQ ID NO: 1315326 - DNA, 20 bp, Homo sapiens
ctccgcccccagcctatgag

SEQ ID NO: 1315327 - DNA, 12 bp, Homo sapiens
ctcctcctcgga

SEQ ID NO: 1315328 - DNA, 22 bp, Homo sapiens
ctcctcggaaccgctcacctag

SEQ ID NO: 1315329 - DNA, 19 bp, Homo sapiens
ctcctgcccgccacacaga

SEQ ID NO: 1315330 - DNA, 22 bp, Homo sapiens
ctccttcgtatcccgagtctgg

SEQ ID NO: 1315331 - DNA, 22 bp, Homo sapiens
ctcggagcatcccggaggaaat

SEQ ID NO: 1315332 - DNA, 14 bp, Homo sapiens
ctctaaagaccaaa

SEQ ID NO: 1315333 - DNA, 19 bp, Homo sapiens
ctctaaagaccaaacttca

SEQ ID NO: 1315334 - DNA, 14 bp, Homo sapiens
ctctacccaaaccc

SEQ ID NO: 1315335 - DNA, 17 bp, Homo sapiens
ctctacccaaaccctag

SEQ ID NO: 1315336 - DNA, 12 bp, Homo sapiens
ctctgagctgtt

SEQ ID NO: 1315337 - DNA, 17 bp, Homo sapiens
ctctgccccagtcgtta

SEQ ID NO: 1315338 - DNA, 14 bp, Homo sapiens
ctctggactctaaa

SEQ ID NO: 1315339 - DNA, 16 bp, Homo sapiens
ctctggactctaaaga

SEQ ID NO: 1315340 - DNA, 17 bp, Homo sapiens
ctcttctcccagaatcc

SEQ ID NO: 1315341 - DNA, 15 bp, Homo sapiens
ctgaaaactggaata

SEQ ID NO: 1315342 - DNA, 22 bp, Homo sapiens
ctgaaaactggaataagaagca

SEQ ID NO: 1315343 - DNA, 13 bp, Homo sapiens
ctgacacaaagga

SEQ ID NO: 1315344 - DNA, 15 bp, Homo sapiens
ctgacacaaaggaag

SEQ ID NO: 1315345 - DNA, 14 bp, Homo sapiens
ctgacatggctctg

SEQ ID NO: 1315346 - DNA, 17 bp, Homo sapiens
ctgacatggctctggac

SEQ ID NO: 1315347 - DNA, 18 bp, Homo sapiens
ctgacatggctctggact

SEQ ID NO: 1315348 - DNA, 19 bp, Homo sapiens
ctgacatggctctggactc

SEQ ID NO: 1315349 - DNA, 19 bp, Homo sapiens
ctgagccccgccctcttcc

SEQ ID NO: 1315350 - DNA, 14 bp, Homo sapiens
ctgagctgttatct

SEQ ID NO: 1315351 - DNA, 15 bp, Homo sapiens
ctgatctcttcctgt

SEQ ID NO: 1315352 - DNA, 21 bp, Homo sapiens
ctgccccaaataacttcagtc

SEQ ID NO: 1315353 - DNA, 22 bp, Homo sapiens
ctgccccaaataacttcagtcc

SEQ ID NO: 1315354 - DNA, 23 bp, Homo sapiens
ctgccccaaataacttcagtcct

SEQ ID NO: 1315355 - DNA, 15 bp, Homo sapiens
ctgcccccagcccaa

SEQ ID NO: 1315356 - DNA, 16 bp, Homo sapiens
ctgcccccagcccaaa

SEQ ID NO: 1315357 - DNA, 18 bp, Homo sapiens
ctgcctcaccgcttccct

SEQ ID NO: 1315358 - DNA, 13 bp, Homo sapiens
ctgctccacgcgc

SEQ ID NO: 1315359 - DNA, 22 bp, Homo sapiens
ctgctccagaatttggaaatcc

SEQ ID NO: 1315360 - DNA, 23 bp, Homo sapiens
ctgcttagtatctcatcaacaaa

SEQ ID NO: 1315361 - DNA, 21 bp, Homo sapiens
ctggaataagaagcaaataaa

SEQ ID NO: 1315362 - DNA, 21 bp, Homo sapiens
ctggactctaaagaccaaact

SEQ ID NO: 1315363 - DNA, 21 bp, Homo sapiens
ctggccccggatcagagcagg

SEQ ID NO: 1315364 - DNA, 13 bp, Homo sapiens
ctgggaacctccc

SEQ ID NO: 1315365 - DNA, 18 bp, Homo sapiens
ctgggaacctcccagagg

SEQ ID NO: 1315366 - DNA, 23 bp, Homo sapiens
ctgggaacctcccagaggtccag

SEQ ID NO: 1315367 - DNA, 17 bp, Homo sapiens
ctgggcacactctgcca

SEQ ID NO: 1315368 - DNA, 16 bp, Homo sapiens
ctgtaaaacgctgtca

SEQ ID NO: 1315369 - DNA, 18 bp, Homo sapiens
ctgtacattttgttgtaa

SEQ ID NO: 1315370 - DNA, 17 bp, Homo sapiens
ctgtcagaatgctattg

SEQ ID NO: 1315371 - DNA, 13 bp, Homo sapiens
ctgtctgtagtgt

SEQ ID NO: 1315372 - DNA, 22 bp, Homo sapiens
ctgtggcattgttgatgctcac

SEQ ID NO: 1315373 - DNA, 20 bp, Homo sapiens
ctgtgggagggactttgctg

SEQ ID NO: 1315374 - DNA, 18 bp, Homo sapiens
ctgtgtatattatttggc

SEQ ID NO: 1315375 - DNA, 11 bp, Homo sapiens
ctgttgtaact

SEQ ID NO: 1315376 - DNA, 12 bp, Homo sapiens
ctgttgtaactt

SEQ ID NO: 1315377 - DNA, 17 bp, Homo sapiens
cttaacaacctggccgc

SEQ ID NO: 1315378 - DNA, 13 bp, Homo sapiens
cttaacccaagga

SEQ ID NO: 1315379 - DNA, 11 bp, Homo sapiens
cttaagcacaa

SEQ ID NO: 1315380 - DNA, 17 bp, Homo sapiens
cttagtcccccaactct

SEQ ID NO: 1315381 - DNA, 15 bp, Homo sapiens
cttatgtagatattt

SEQ ID NO: 1315382 - DNA, 20 bp, Homo sapiens
cttcactctgggcacactct

SEQ ID NO: 1315383 - DNA, 21 bp, Homo sapiens
cttcagaattccatatcttgc

SEQ ID NO: 1315384 - DNA, 11 bp, Homo sapiens
cttcagtcctg

SEQ ID NO: 1315385 - DNA, 19 bp, Homo sapiens
gccggccaatggaaacctc

SEQ ID NO: 1315386 - DNA, 18 bp, Homo sapiens
gcctaggaccactcagcc

SEQ ID NO: 1315387 - DNA, 22 bp, Homo sapiens
gcctaggaccactcagccccta

SEQ ID NO: 1315388 - DNA, 23 bp, Homo sapiens
gcctaggaccactcagcccctag

SEQ ID NO: 1315389 - DNA, 21 bp, Homo sapiens
gcctagtttttagtaatctgt

SEQ ID NO: 1315390 - DNA, 20 bp, Homo sapiens
gcctatgagcatcctgagcc

SEQ ID NO: 1315391 - DNA, 22 bp, Homo sapiens
gcctatgagcatcctgagcccc

SEQ ID NO: 1315392 - DNA, 17 bp, Homo sapiens
gcctcaccgcttccctc

SEQ ID NO: 1315393 - DNA, 19 bp, Homo sapiens
gcgaaaatagtttgtttaa

SEQ ID NO: 1315394 - DNA, 15 bp, Homo sapiens
gcgaatccaagctcc

SEQ ID NO: 1315395 - DNA, 21 bp, Homo sapiens
gcgaatccaagctccctgccc

SEQ ID NO: 1315396 - DNA, 18 bp, Homo sapiens
gcgtcagtctttttctgt

SEQ ID NO: 1315397 - DNA, 14 bp, Homo sapiens
gcgtttagaccaag

SEQ ID NO: 1315398 - DNA, 15 bp, Homo sapiens
gctaattaaaaagtt

SEQ ID NO: 1315399 - DNA, 14 bp, Homo sapiens
gctcacctagagcc

SEQ ID NO: 1315400 - DNA, 15 bp, Homo sapiens
gctcacctagagcca

SEQ ID NO: 1315401 - DNA, 17 bp, Homo sapiens
gctcacctagagccaga

SEQ ID NO: 1315402 - DNA, 21 bp, Homo sapiens
gctccagaatttggaaatcct

SEQ ID NO: 1315403 - DNA, 14 bp, Homo sapiens
gctccctgccccaa

SEQ ID NO: 1315404 - DNA, 13 bp, Homo sapiens
gctcctcccagct

SEQ ID NO: 1315405 - DNA, 12 bp, Homo sapiens
gctctgccccag

SEQ ID NO: 1315406 - DNA, 16 bp, Homo sapiens
gctgcaggaatcaaaa

SEQ ID NO: 1315407 - DNA, 21 bp, Homo sapiens
gctgcaggaatcaaaaattga

SEQ ID NO: 1315408 - DNA, 18 bp, Homo sapiens
gctggacgtctttctttt

SEQ ID NO: 1315409 - DNA, 14 bp, Homo sapiens
gctgtctgtggctt

SEQ ID NO: 1315410 - DNA, 13 bp, Homo sapiens
gctgttatcttgt

SEQ ID NO: 1315411 - DNA, 18 bp, Homo sapiens
ccaacgttactcagggct

SEQ ID NO: 1315412 - DNA, 16 bp, Homo sapiens
ccaactctgagcccat

SEQ ID NO: 1315413 - DNA, 22 bp, Homo sapiens
ccaactctgagcccatgttctg

SEQ ID NO: 1315414 - DNA, 11 bp, Homo sapiens
ccaagctccct

SEQ ID NO: 1315415 - DNA, 13 bp, Homo sapiens
ccaagctccctgc

SEQ ID NO: 1315416 - DNA, 19 bp, Homo sapiens
ccaaggagcacaggtccca

SEQ ID NO: 1315417 - DNA, 20 bp, Homo sapiens
ccaaggagcacaggtcccac

SEQ ID NO: 1315418 - DNA, 15 bp, Homo sapiens
ccaagggcagaaagt

SEQ ID NO: 1315419 - DNA, 14 bp, Homo sapiens
ccaatggaaacctc

SEQ ID NO: 1315420 - DNA, 9 bp, Homo sapiens
ccacaaagg

SEQ ID NO: 1315421 - DNA, 22 bp, Homo sapiens
ccacaaaggccaaactgctgga

SEQ ID NO: 1315422 - DNA, 13 bp, Homo sapiens
ccaccgctgctcc

SEQ ID NO: 1315423 - DNA, 14 bp, Homo sapiens
ccacctccagcccg

SEQ ID NO: 1315424 - DNA, 19 bp, Homo sapiens
ccacctccagcccgggagc

SEQ ID NO: 1315425 - DNA, 22 bp, Homo sapiens
ccacgattttctccagctcaga

SEQ ID NO: 1315426 - DNA, 22 bp, Homo sapiens
ccacgctagggcggggcacaga

SEQ ID NO: 1315427 - DNA, 16 bp, Homo sapiens
ccactcagcccctagg

SEQ ID NO: 1315428 - DNA, 13 bp, Homo sapiens
ccagaatttggaa

SEQ ID NO: 1315429 - DNA, 18 bp, Homo sapiens
ccagaatttggaaatcct

SEQ ID NO: 1315430 - DNA, 16 bp, Homo sapiens
ccagaggtccagccca

SEQ ID NO: 1315431 - DNA, 21 bp, Homo sapiens
ccagcccaaaggggacaggcc

SEQ ID NO: 1315432 - DNA, 17 bp, Homo sapiens
ccagcccatctcggagc

SEQ ID NO: 1315433 - DNA, 19 bp, Homo sapiens
ccagccggccaatggaaac

SEQ ID NO: 1315434 - DNA, 23 bp, Homo sapiens
ccagcctatgagcatcctgagcc

SEQ ID NO: 1315435 - DNA, 14 bp, Homo sapiens
ccagcgctctgcct

SEQ ID NO: 1315436 - DNA, 15 bp, Homo sapiens
ccagcgctctgcctc

SEQ ID NO: 1315437 - DNA, 14 bp, Homo sapiens
ccagctcagaaccc

SEQ ID NO: 1315438 - DNA, 15 bp, Homo sapiens
ccagctcagaaccca

SEQ ID NO: 1315439 - DNA, 16 bp, Homo sapiens
ccagctcagaacccag

SEQ ID NO: 1315440 - DNA, 18 bp, Homo sapiens
ccagctcagaacccaggg

SEQ ID NO: 1315441 - DNA, 16 bp, Homo sapiens
ccagctgcaggaatca

SEQ ID NO: 1315442 - DNA, 20 bp, Homo sapiens
ccagctgcaggaatcaaaaa

SEQ ID NO: 1315443 - DNA, 13 bp, Homo sapiens
ccaggctccgccc

SEQ ID NO: 1315444 - DNA, 14 bp, Homo sapiens
ccagggctctgccc

SEQ ID NO: 1315445 - DNA, 17 bp, Homo sapiens
ccagggctctgccccag

SEQ ID NO: 1315446 - DNA, 22 bp, Homo sapiens
ccatatcttgcgaatccaagct

SEQ ID NO: 1315447 - DNA, 23 bp, Homo sapiens
ccatatcttgcgaatccaagctc

SEQ ID NO: 1315448 - DNA, 20 bp, Homo sapiens
ccatctcggagcatcccgga

SEQ ID NO: 1315449 - DNA, 18 bp, Homo sapiens
ccatgttctgcccccagc

SEQ ID NO: 1315450 - DNA, 13 bp, Homo sapiens
cccaaaccctagg

SEQ ID NO: 1315451 - DNA, 18 bp, Homo sapiens
cccaaaggggacaggcct

SEQ ID NO: 1315452 - DNA, 18 bp, Homo sapiens
cccaaataacttcagtcc

SEQ ID NO: 1315453 - DNA, 14 bp, Homo sapiens
cccaactctgagcc

SEQ ID NO: 1315454 - DNA, 12 bp, Homo sapiens
cccaagctcctc

SEQ ID NO: 1315455 - DNA, 14 bp, Homo sapiens
cccaaggagcacag

SEQ ID NO: 1315456 - DNA, 18 bp, Homo sapiens
cccaaggagcacaggtcc

SEQ ID NO: 1315457 - DNA, 13 bp, Homo sapiens
cccacctccagcc

SEQ ID NO: 1315458 - DNA, 14 bp, Homo sapiens
cccagaatcccagc

SEQ ID NO: 1315459 - DNA, 19 bp, Homo sapiens
cccagaatcccagccggcc

SEQ ID NO: 1315460 - DNA, 18 bp, Homo sapiens
cccagaggtccagcccat

SEQ ID NO: 1315461 - DNA, 19 bp, Homo sapiens
cccagaggtccagcccatc

SEQ ID NO: 1315462 - DNA, 13 bp, Homo sapiens
cccagcccctaga

SEQ ID NO: 1315463 - DNA, 22 bp, Homo sapiens
cccagcccctagaaacccaagc

SEQ ID NO: 1315464 - DNA, 18 bp, Homo sapiens
cccagccggccaatggaa

SEQ ID NO: 1315465 - DNA, 23 bp, Homo sapiens
cccagcctatgagcatcctgagc

SEQ ID NO: 1315466 - DNA, 14 bp, Homo sapiens
cccaggctccgccc

SEQ ID NO: 1315467 - DNA, 16 bp, Homo sapiens
cccagggctctgcccc

SEQ ID NO: 1315468 - DNA, 19 bp, Homo sapiens
cccagggctctgccccagt

SEQ ID NO: 1315469 - DNA, 19 bp, Homo sapiens
cccagtgtatgtcttgtat

SEQ ID NO: 1315470 - DNA, 18 bp, Homo sapiens
cccatctcggagcatccc

SEQ ID NO: 1315471 - DNA, 21 bp, Homo sapiens
cccatgttctgcccccagccc

SEQ ID NO: 1315472 - DNA, 14 bp, Homo sapiens
ccccagcccaaagg

SEQ ID NO: 1315473 - DNA, 12 bp, Homo sapiens
cccccagcctat

SEQ ID NO: 1315474 - DNA, 13 bp, Homo sapiens
cccccagcctatg

SEQ ID NO: 1315475 - DNA, 13 bp, Homo sapiens
cccccccatgcag

SEQ ID NO: 1315476 - DNA, 16 bp, Homo sapiens
cccctagaaacccaag

SEQ ID NO: 1315477 - DNA, 18 bp, Homo sapiens
cccctagaaacccaagct

SEQ ID NO: 1315478 - DNA, 15 bp, Homo sapiens
cccgccctcttcctg

SEQ ID NO: 1315479 - DNA, 14 bp, Homo sapiens
cccggaggaaatct

SEQ ID NO: 1315480 - DNA, 15 bp, Homo sapiens
cccggatcagagcag

SEQ ID NO: 1315481 - DNA, 16 bp, Homo sapiens
cccggatcagagcagg

SEQ ID NO: 1315482 - DNA, 22 bp, Homo sapiens
cccggatcagagcaggacctcc

SEQ ID NO: 1315483 - DNA, 16 bp, Homo sapiens
cccggcaccctctggc

SEQ ID NO: 1315484 - DNA, 13 bp, Homo sapiens
cccgggagcctag

SEQ ID NO: 1315485 - DNA, 20 bp, Homo sapiens
ccctagcccagcgctctgcc

SEQ ID NO: 1315486 - DNA, 20 bp, Homo sapiens
ccctaggagtatatttccgc

SEQ ID NO: 1315487 - DNA, 12 bp, Homo sapiens
ccctaggttccc

SEQ ID NO: 1315488 - DNA, 15 bp, Homo sapiens
ccctctgggaacctc

SEQ ID NO: 1315489 - DNA, 15 bp, Homo sapiens
cccttagtcccccaa

SEQ ID NO: 1315490 - DNA, 14 bp, Homo sapiens
cccttccgaccctc

SEQ ID NO: 1315491 - DNA, 17 bp, Homo sapiens
cccttccgaccctctgg

SEQ ID NO: 1315492 - DNA, 19 bp, Homo sapiens
cccttccgaccctctggga

SEQ ID NO: 1315493 - DNA, 21 bp, Homo sapiens
cccttccgaccctctgggaac

SEQ ID NO: 1315494 - DNA, 15 bp, Homo sapiens
ccgaccctctgggaa

SEQ ID NO: 1315495 - DNA, 17 bp, Homo sapiens
ccgaccctctgggaacc

SEQ ID NO: 1315496 - DNA, 13 bp, Homo sapiens
ccgcccccagcct

SEQ ID NO: 1315497 - DNA, 14 bp, Homo sapiens
ccgccctcttcctg

SEQ ID NO: 1315498 - DNA, 18 bp, Homo sapiens
ccgctcacctagagccag

SEQ ID NO: 1315499 - DNA, 20 bp, Homo sapiens
ccgctcacctagagccagac

SEQ ID NO: 1315500 - DNA, 14 bp, Homo sapiens
ccgctgctccacgc

SEQ ID NO: 1315501 - DNA, 17 bp, Homo sapiens
ccgcttgtggggaccca

SEQ ID NO: 1315502 - DNA, 21 bp, Homo sapiens
ccgcttgtggggacccaggct

SEQ ID NO: 1315503 - DNA, 20 bp, Homo sapiens
ccggatcagagcaggacctc

SEQ ID NO: 1315504 - DNA, 15 bp, Homo sapiens
ccggccaatggaaac

SEQ ID NO: 1315505 - DNA, 14 bp, Homo sapiens
ccggccctagccca

SEQ ID NO: 1315506 - DNA, 23 bp, Homo sapiens
ccgggagcctaggaccactcagc

SEQ ID NO: 1315507 - DNA, 18 bp, Homo sapiens
cctagaaacccaagctcc

SEQ ID NO: 1315508 - DNA, 23 bp, Homo sapiens
cctagaaacccaagctcctcctc

SEQ ID NO: 1315509 - DNA, 13 bp, Homo sapiens
cctagcccagcgc

SEQ ID NO: 1315510 - DNA, 20 bp, Homo sapiens
cctaggttcccggtcccgag

SEQ ID NO: 1315511 - DNA, 21 bp, Homo sapiens
cctaggttcccggtcccgagt

SEQ ID NO: 1315512 - DNA, 17 bp, Homo sapiens
cctagtttcctctcctt

SEQ ID NO: 1315513 - DNA, 15 bp, Homo sapiens
cctatgagcatcctg

SEQ ID NO: 1315514 - DNA, 20 bp, Homo sapiens
cctatgagcatcctgagccc

SEQ ID NO: 1315515 - DNA, 12 bp, Homo sapiens
cctccagcccgg

SEQ ID NO: 1315516 - DNA, 17 bp, Homo sapiens
cctccagcccgggagcc

SEQ ID NO: 1315517 - DNA, 18 bp, Homo sapiens
cctccagcccgggagcct

SEQ ID NO: 1315518 - DNA, 23 bp, Homo sapiens
cctccagcccgggagcctaggac

SEQ ID NO: 1315519 - DNA, 12 bp, Homo sapiens
cctcccagaggt

SEQ ID NO: 1315520 - DNA, 16 bp, Homo sapiens
cctcccagaggtccag

SEQ ID NO: 1315521 - DNA, 15 bp, Homo sapiens
cctcccttccgaccc

SEQ ID NO: 1315522 - DNA, 22 bp, Homo sapiens
cctcccttccgaccctctggga

SEQ ID NO: 1315523 - DNA, 23 bp, Homo sapiens
cctcctcggaaccgctcacctag

SEQ ID NO: 1315524 - DNA, 17 bp, Homo sapiens
cctctgggaacctccca

SEQ ID NO: 1315525 - DNA, 19 bp, Homo sapiens
cctctgggaacctcccaga

SEQ ID NO: 1315526 - DNA, 21 bp, Homo sapiens
cctctgggaacctcccagagg

SEQ ID NO: 1315527 - DNA, 23 bp, Homo sapiens
cctctgggaacctcccagaggtc

SEQ ID NO: 1315528 - DNA, 11 bp, Homo sapiens
cctcttcctga

SEQ ID NO: 1315529 - DNA, 17 bp, Homo sapiens
cctgacgaaactggccc

SEQ ID NO: 1315530 - DNA, 21 bp, Homo sapiens
cctgacgaaactggccccgga

SEQ ID NO: 1315531 - DNA, 23 bp, Homo sapiens
cctgccccaaataacttcagtcc

SEQ ID NO: 1315532 - DNA, 13 bp, Homo sapiens
ccttaacccaagg

SEQ ID NO: 1315533 - DNA, 15 bp, Homo sapiens
ccttaacccaaggag

SEQ ID NO: 1315534 - DNA, 17 bp, Homo sapiens
atgatgtacaggcagat

SEQ ID NO: 1315535 - DNA, 13 bp, Homo sapiens
atgcctaataaac

SEQ ID NO: 1315536 - DNA, 22 bp, Homo sapiens
atggaactcagctgtctgtggc

SEQ ID NO: 1315537 - DNA, 23 bp, Homo sapiens
atggaactcagctgtctgtggct

SEQ ID NO: 1315538 - DNA, 22 bp, Homo sapiens
atggatatgtgtaaatgttatg

SEQ ID NO: 1315539 - DNA, 23 bp, Homo sapiens
atggatatgtgtaaatgttatga

SEQ ID NO: 1315540 - DNA, 18 bp, Homo sapiens
atggctactttggtttct

SEQ ID NO: 1315541 - DNA, 22 bp, Homo sapiens
atggctactttggtttctgtct

SEQ ID NO: 1315542 - DNA, 14 bp, Homo sapiens
atgggcattgacaa

SEQ ID NO: 1315543 - DNA, 13 bp, Homo sapiens
atgtgaacttgta

SEQ ID NO: 1315544 - DNA, 17 bp, Homo sapiens
atgtgaacttgtagctg

SEQ ID NO: 1315545 - DNA, 17 bp, Homo sapiens
atgtgtaaatgttatga

SEQ ID NO: 1315546 - DNA, 19 bp, Homo sapiens
atgttcacgcaacttgaaa

SEQ ID NO: 1315547 - DNA, 14 bp, Homo sapiens
atgttctgccccca

SEQ ID NO: 1315548 - DNA, 21 bp, Homo sapiens
atgtttgtctcagttggaaat

SEQ ID NO: 1315549 - DNA, 15 bp, Homo sapiens
attaaaaagttaatc

SEQ ID NO: 1315550 - DNA, 23 bp, Homo sapiens
attaccagtctttaaaggcccag

SEQ ID NO: 1315551 - DNA, 22 bp, Homo sapiens
attagctgtgatttttgttgat

SEQ ID NO: 1315552 - DNA, 18 bp, Homo sapiens
attatatctgtggtcttc

SEQ ID NO: 1315553 - DNA, 17 bp, Homo sapiens
attattttgttactgtc

SEQ ID NO: 1315554 - DNA, 18 bp, Homo sapiens
attattttgttactgtct

SEQ ID NO: 1315555 - DNA, 13 bp, Homo sapiens
attcaagaaagat

SEQ ID NO: 1315556 - DNA, 18 bp, Homo sapiens
attcaagaaagatatcta

SEQ ID NO: 1315557 - DNA, 22 bp, Homo sapiens
attgaaagtttttaatatttat

SEQ ID NO: 1315558 - DNA, 23 bp, Homo sapiens
attgaagagagatatatctgaaa

SEQ ID NO: 1315559 - DNA, 20 bp, Homo sapiens
attgaattattttgttactg

SEQ ID NO: 1315560 - DNA, 21 bp, Homo sapiens
attggagcggtgggcactgtt

SEQ ID NO: 1315561 - DNA, 18 bp, Homo sapiens
attgtcttttgtcatgtg

SEQ ID NO: 1315562 - DNA, 13 bp, Homo sapiens
atttattatgtcc

SEQ ID NO: 1315563 - DNA, 18 bp, Homo sapiens
atttatttttcagttcca

SEQ ID NO: 1315564 - DNA, 17 bp, Homo sapiens
atttcctctgagctgtt

SEQ ID NO: 1315565 - DNA, 15 bp, Homo sapiens
atttctgtcagaatg

SEQ ID NO: 1315566 - DNA, 14 bp, Homo sapiens
atttggaaatccta

SEQ ID NO: 1315567 - DNA, 14 bp, Homo sapiens
atttggcttaaata

SEQ ID NO: 1315568 - DNA, 15 bp, Homo sapiens
atttggcttaaatat

SEQ ID NO: 1315569 - DNA, 17 bp, Homo sapiens
atttggcttaaatatag

SEQ ID NO: 1315570 - DNA, 11 bp, Homo sapiens
attttcatgtt

SEQ ID NO: 1315571 - DNA, 22 bp, Homo sapiens
attttgttactgtctgtagtgt

SEQ ID NO: 1315572 - DNA, 14 bp, Homo sapiens
attttgttgtaaaa

SEQ ID NO: 1315573 - DNA, 18 bp, Homo sapiens
attttgttgtaaaaagaa

SEQ ID NO: 1315574 - DNA, 16 bp, Homo sapiens
atttttcagttccaag

SEQ ID NO: 1315575 - DNA, 17 bp, Homo sapiens
caaaaaaaccacaaagg

SEQ ID NO: 1315576 - DNA, 17 bp, Homo sapiens
caaaactccgcccccag

SEQ ID NO: 1315577 - DNA, 20 bp, Homo sapiens
caaaactccgcccccagcct

SEQ ID NO: 1315578 - DNA, 15 bp, Homo sapiens
caaaggccaaactgc

SEQ ID NO: 1315579 - DNA, 19 bp, Homo sapiens
caaaggggacaggcctcac

SEQ ID NO: 1315580 - DNA, 13 bp, Homo sapiens
caaagttatccag

SEQ ID NO: 1315581 - DNA, 12 bp, Homo sapiens
caaatctgtgta

SEQ ID NO: 1315582 - DNA, 16 bp, Homo sapiens
caaatctgtgtatatt

SEQ ID NO: 1315583 - DNA, 24 bp, Homo sapiens
caacttgaaattatatctgtggtc

SEQ ID NO: 1315584 - DNA, 12 bp, Homo sapiens
caagagcctgat

SEQ ID NO: 1315585 - DNA, 20 bp, Homo sapiens
caagagcctgatctcttcct

SEQ ID NO: 1315586 - DNA, 20 bp, Homo sapiens
caagcagagtgcacagctgt

SEQ ID NO: 1315587 - DNA, 16 bp, Homo sapiens
caagctcctcctcgga

SEQ ID NO: 1315588 - DNA, 17 bp, Homo sapiens
caatgactgtgctactg

SEQ ID NO: 1315589 - DNA, 15 bp, Homo sapiens
caatggaaacctcac

SEQ ID NO: 1315590 - DNA, 21 bp, Homo sapiens
cacaaaactccgcccccagcc

SEQ ID NO: 1315591 - DNA, 22 bp, Homo sapiens
cacaaaactccgcccccagcct

SEQ ID NO: 1315592 - DNA, 17 bp, Homo sapiens
cacagctgttcttctgt

SEQ ID NO: 1315593 - DNA, 14 bp, Homo sapiens
cacaggtcccacct

SEQ ID NO: 1315594 - DNA, 20 bp, Homo sapiens
cacatatgataaaaaagtgt

SEQ ID NO: 1315595 - DNA, 13 bp, Homo sapiens
caccctctggccg

SEQ ID NO: 1315596 - DNA, 20 bp, Homo sapiens
cacccttaacccaaggagca

SEQ ID NO: 1315597 - DNA, 14 bp, Homo sapiens
cacctagagccaga

SEQ ID NO: 1315598 - DNA, 17 bp, Homo sapiens
cacctagagccagacca

SEQ ID NO: 1315599 - DNA, 17 bp, Homo sapiens
cacctccagcccgggag

SEQ ID NO: 1315600 - DNA, 22 bp, Homo sapiens
cacctccagcccgggagcctag

SEQ ID NO: 1315601 - DNA, 15 bp, Homo sapiens
cacctctacccaaac

SEQ ID NO: 1315602 - DNA, 22 bp, Homo sapiens
cacctctacccaaaccctaggt

SEQ ID NO: 1315603 - DNA, 17 bp, Homo sapiens
cacgattttctccagct

SEQ ID NO: 1315604 - DNA, 19 bp, Homo sapiens
cacgattttctccagctca

SEQ ID NO: 1315605 - DNA, 15 bp, Homo sapiens
cacgccttcccctca

SEQ ID NO: 1315606 - DNA, 18 bp, Homo sapiens
cacgctgggtcctaatta

SEQ ID NO: 1315607 - DNA, 16 bp, Homo sapiens
cactcagcccctagga

SEQ ID NO: 1315608 - DNA, 17 bp, Homo sapiens
cactcagcccctaggag

SEQ ID NO: 1315609 - DNA, 21 bp, Homo sapiens
cactctgggcacactctgcca

SEQ ID NO: 1315610 - DNA, 13 bp, Homo sapiens
cactgacacaaag

SEQ ID NO: 1315611 - DNA, 22 bp, Homo sapiens
cactgtaatatctttaaatgat

SEQ ID NO: 1315612 - DNA, 16 bp, Homo sapiens
cacttcagaattccat

SEQ ID NO: 1315613 - DNA, 22 bp, Homo sapiens
cagaatttggaaatcctagttt

SEQ ID NO: 1315614 - DNA, 19 bp, Homo sapiens
cagacacgccttcccctca

SEQ ID NO: 1315615 - DNA, 23 bp, Homo sapiens
cagaccaacgttactcagggctc

SEQ ID NO: 1315616 - DNA, 18 bp, Homo sapiens
cagagaagggcataaaac

SEQ ID NO: 1315617 - DNA, 15 bp, Homo sapiens
cagagcaggacctcc

SEQ ID NO: 1315618 - DNA, 16 bp, Homo sapiens
cagagcaggacctccc

SEQ ID NO: 1315619 - DNA, 16 bp, Homo sapiens
cagagggttaggagtg

SEQ ID NO: 1315620 - DNA, 13 bp, Homo sapiens
cagaggtccagcc

SEQ ID NO: 1315621 - DNA, 14 bp, Homo sapiens
cagaggtccagccc

SEQ ID NO: 1315622 - DNA, 20 bp, Homo sapiens
cagcccaaaggggacaggcc

SEQ ID NO: 1315623 - DNA, 21 bp, Homo sapiens
cagcccctagaaacccaagct

SEQ ID NO: 1315624 - DNA, 13 bp, Homo sapiens
cagcccctaggag

SEQ ID NO: 1315625 - DNA, 14 bp, Homo sapiens
cagcccgggagcct

SEQ ID NO: 1315626 - DNA, 16 bp, Homo sapiens
cagcccgggagcctag

SEQ ID NO: 1315627 - DNA, 19 bp, Homo sapiens
cagcccgggagcctaggac

SEQ ID NO: 1315628 - DNA, 21 bp, Homo sapiens
cagcccgggagcctaggacca

SEQ ID NO: 1315629 - DNA, 23 bp, Homo sapiens
cagcctatgagcatcctgagccc

SEQ ID NO: 1315630 - DNA, 13 bp, Homo sapiens
cagcgctctgcct

SEQ ID NO: 1315631 - DNA, 16 bp, Homo sapiens
cagctcagaacccagg

SEQ ID NO: 1315632 - DNA, 17 bp, Homo sapiens
cagctcagaacccaggg

SEQ ID NO: 1315633 - DNA, 20 bp, Homo sapiens
caggacctcccttccgaccc

SEQ ID NO: 1315634 - DNA, 22 bp, Homo sapiens
caggacctcccttccgaccctc

SEQ ID NO: 1315635 - DNA, 17 bp, Homo sapiens
caggcctcacctctacc

SEQ ID NO: 1315636 - DNA, 22 bp, Homo sapiens
caggcctcacctctacccaaac

SEQ ID NO: 1315637 - DNA, 16 bp, Homo sapiens
caggctccgcccttag

SEQ ID NO: 1315638 - DNA, 22 bp, Homo sapiens
caggctccgcccttagtccccc

SEQ ID NO: 1315639 - DNA, 14 bp, Homo sapiens
cagggctcctccca

SEQ ID NO: 1315640 - DNA, 18 bp, Homo sapiens
caggtcccacctccagcc

SEQ ID NO: 1315641 - DNA, 23 bp, Homo sapiens
caggtcccacctccagcccggga

SEQ ID NO: 1315642 - DNA, 13 bp, Homo sapiens
cagtcctgctcca

SEQ ID NO: 1315643 - DNA, 19 bp, Homo sapiens
cagtctaaaatgcttcagt

SEQ ID NO: 1315644 - DNA, 21 bp, Homo sapiens
cagtctttaaaggcccagccc

SEQ ID NO: 1315645 - DNA, 21 bp, Homo sapiens
cagtctttttctgttgtaact

SEQ ID NO: 1315646 - DNA, 23 bp, Homo sapiens
catagatttatttttcagttcca

SEQ ID NO: 1315647 - DNA, 20 bp, Homo sapiens
catatcttgcgaatccaagc

SEQ ID NO: 1315648 - DNA, 16 bp, Homo sapiens
catcccggaggaaatc

SEQ ID NO: 1315649 - DNA, 17 bp, Homo sapiens
catcccggaggaaatct

SEQ ID NO: 1315650 - DNA, 19 bp, Homo sapiens
catcccggaggaaatctgc

SEQ ID NO: 1315651 - DNA, 20 bp, Homo sapiens
catcctgagccccgccctct

SEQ ID NO: 1315652 - DNA, 22 bp, Homo sapiens
catcctgagccccgccctcttc

SEQ ID NO: 1315653 - DNA, 23 bp, Homo sapiens
catgcagtctaaaatgcttcagt

SEQ ID NO: 1315654 - DNA, 21 bp, Homo sapiens
catgtctttctccaaagttat

SEQ ID NO: 1315655 - DNA, 15 bp, Homo sapiens
catgttctgccccca

SEQ ID NO: 1315656 - DNA, 16 bp, Homo sapiens
catgttctgcccccag

SEQ ID NO: 1315657 - DNA, 16 bp, Homo sapiens
catgttcttgcagtca

SEQ ID NO: 1315658 - DNA, 15 bp, Homo sapiens
cattattcaagaaag

SEQ ID NO: 1315659 - DNA, 21 bp, Homo sapiens
cattgtggtgtgagcttcaga

SEQ ID NO: 1315660 - DNA, 13 bp, Homo sapiens
cattttgttgtaa

SEQ ID NO: 1315661 - DNA, 20 bp, Homo sapiens
cattttgttgtaaaaagaaa

SEQ ID NO: 1315662 - DNA, 17 bp, Homo sapiens
aagctccctgccccaaa

SEQ ID NO: 1315663 - DNA, 15 bp, Homo sapiens
aaggcccagccccta

SEQ ID NO: 1315664 - DNA, 18 bp, Homo sapiens
aagggaggacgggagctg

SEQ ID NO: 1315665 - DNA, 16 bp, Homo sapiens
aaggggacaggcctca

SEQ ID NO: 1315666 - DNA, 12 bp, Homo sapiens
aagtgccccctc

SEQ ID NO: 1315667 - DNA, 16 bp, Homo sapiens
aagtttttaatattta

SEQ ID NO: 1315668 - DNA, 13 bp, Homo sapiens
aataacttcagtc

SEQ ID NO: 1315669 - DNA, 14 bp, Homo sapiens
aataacttcagtcc

SEQ ID NO: 1315670 - DNA, 21 bp, Homo sapiens
aataacttcagtcctgctcca

SEQ ID NO: 1315671 - DNA, 24 bp, Homo sapiens
aataacttcagtcctgctccagaa

SEQ ID NO: 1315672 - DNA, 21 bp, Homo sapiens
aataataaaagattcacctga

SEQ ID NO: 1315673 - DNA, 14 bp, Homo sapiens
aatagtatatctaa

SEQ ID NO: 1315674 - DNA, 21 bp, Homo sapiens
aatagtatatctaatggctgt

SEQ ID NO: 1315675 - DNA, 15 bp, Homo sapiens
aatagtttgtttaat

SEQ ID NO: 1315676 - DNA, 23 bp, Homo sapiens
aatcccagccggccaatggaaac

SEQ ID NO: 1315677 - DNA, 15 bp, Homo sapiens
aatctcaaggaatct

SEQ ID NO: 1315678 - DNA, 11 bp, Homo sapiens
aatctgtacat

SEQ ID NO: 1315679 - DNA, 14 bp, Homo sapiens
aatctgtacatttt

SEQ ID NO: 1315680 - DNA, 17 bp, Homo sapiens
aatctgtgtatattatt

SEQ ID NO: 1315681 - DNA, 15 bp, Homo sapiens
aatgctattgaaaat

SEQ ID NO: 1315682 - DNA, 16 bp, Homo sapiens
aatgctattgaaaatg

SEQ ID NO: 1315683 - DNA, 15 bp, Homo sapiens
aatgtgaacttgtag

SEQ ID NO: 1315684 - DNA, 17 bp, Homo sapiens
aatgtgaacttgtagct

SEQ ID NO: 1315685 - DNA, 19 bp, Homo sapiens
aatgttcacgcaacttgaa

SEQ ID NO: 1315686 - DNA, 21 bp, Homo sapiens
aattaaaaagattctttttct

SEQ ID NO: 1315687 - DNA, 13 bp, Homo sapiens
aattatacaaatt

SEQ ID NO: 1315688 - DNA, 20 bp, Homo sapiens
aattatacaaattaaaaaga

SEQ ID NO: 1315689 - DNA, 12 bp, Homo sapiens
aattatatctgt

SEQ ID NO: 1315690 - DNA, 15 bp, Homo sapiens
aattattttgttact

SEQ ID NO: 1315691 - DNA, 18 bp, Homo sapiens
aatttctgtcagaatgct

SEQ ID NO: 1315692 - DNA, 14 bp, Homo sapiens
aatttggaaatcct

SEQ ID NO: 1315693 - DNA, 19 bp, Homo sapiens
acaaaaaaaccacaaaggc

SEQ ID NO: 1315694 - DNA, 14 bp, Homo sapiens
acaaaggccaaact

SEQ ID NO: 1315695 - DNA, 17 bp, Homo sapiens
acaaatctgtgtatatt

SEQ ID NO: 1315696 - DNA, 16 bp, Homo sapiens
acaaattaaaaagatt

SEQ ID NO: 1315697 - DNA, 22 bp, Homo sapiens
acaagcagagtgcacagctgtc

SEQ ID NO: 1315698 - DNA, 16 bp, Homo sapiens
acacaaaactccgccc

SEQ ID NO: 1315699 - DNA, 20 bp, Homo sapiens
acacaaaggaagtgccccct

SEQ ID NO: 1315700 - DNA, 16 bp, Homo sapiens
acacgccttcccctca

SEQ ID NO: 1315701 - DNA, 15 bp, Homo sapiens
acactgtaatatctt

SEQ ID NO: 1315702 - DNA, 21 bp, Homo sapiens
acagctgttcttctgttctgc

SEQ ID NO: 1315703 - DNA, 21 bp, Homo sapiens
acagctttggggtgtcttttt

SEQ ID NO: 1315704 - DNA, 19 bp, Homo sapiens
acaggcctcacctctaccc

SEQ ID NO: 1315705 - DNA, 19 bp, Homo sapiens
acaggtcccacctccagcc

SEQ ID NO: 1315706 - DNA, 22 bp, Homo sapiens
acatagatttatttttcagttc

SEQ ID NO: 1315707 - DNA, 20 bp, Homo sapiens
acatgatctgtttttcacca

SEQ ID NO: 1315708 - DNA, 23 bp, Homo sapiens
acatggctctggactctaaagac

SEQ ID NO: 1315709 - DNA, 19 bp, Homo sapiens
acatttctcttcagtgtgt

SEQ ID NO: 1315710 - DNA, 16 bp, Homo sapiens
acattttgttgtaaaa

SEQ ID NO: 1315711 - DNA, 17 bp, Homo sapiens
acattttgttgtaaaaa

SEQ ID NO: 1315712 - DNA, 20 bp, Homo sapiens
acattttgttgtaaaaagaa

SEQ ID NO: 1315713 - DNA, 10 bp, Homo sapiens
accacaaagg

SEQ ID NO: 1315714 - DNA, 20 bp, Homo sapiens
accacaaaggccaaactgct

SEQ ID NO: 1315715 - DNA, 19 bp, Homo sapiens
accaccatccaccgctgct

SEQ ID NO: 1315716 - DNA, 21 bp, Homo sapiens
accaccatccaccgctgctcc

SEQ ID NO: 1315717 - DNA, 18 bp, Homo sapiens
accactcagcccctagga

SEQ ID NO: 1315718 - DNA, 13 bp, Homo sapiens
accacttcactga

SEQ ID NO: 1315719 - DNA, 13 bp, Homo sapiens
accaggatttttt

SEQ ID NO: 1315720 - DNA, 19 bp, Homo sapiens
accagtctttaaaggccca

SEQ ID NO: 1315721 - DNA, 13 bp, Homo sapiens
acccaagctcctc

SEQ ID NO: 1315722 - DNA, 20 bp, Homo sapiens
acccaagggcagaaagtaga

SEQ ID NO: 1315723 - DNA, 16 bp, Homo sapiens
acccaggctccgccct

SEQ ID NO: 1315724 - DNA, 19 bp, Homo sapiens
acccaggctccgcccttag

SEQ ID NO: 1315725 - DNA, 20 bp, Homo sapiens
acccaggctccgcccttagt

SEQ ID NO: 1315726 - DNA, 17 bp, Homo sapiens
acccagggctctgcccc

SEQ ID NO: 1315727 - DNA, 22 bp, Homo sapiens
accctaggttcccggtcccgag

SEQ ID NO: 1315728 - DNA, 12 bp, Homo sapiens
accctctgggaa

SEQ ID NO: 1315729 - DNA, 13 bp, Homo sapiens
accctctgggaac

SEQ ID NO: 1315730 - DNA, 15 bp, Homo sapiens
accctctgggaacct

SEQ ID NO: 1315731 - DNA, 19 bp, Homo sapiens
accctctgggaacctccca

SEQ ID NO: 1315732 - DNA, 20 bp, Homo sapiens
accctctgggaacctcccag

SEQ ID NO: 1315733 - DNA, 21 bp, Homo sapiens
accctctgggaacctcccaga

SEQ ID NO: 1315734 - DNA, 22 bp, Homo sapiens
accctctgggaacctcccagag

SEQ ID NO: 1315735 - DNA, 14 bp, Homo sapiens
acccttaacccaag

SEQ ID NO: 1315736 - DNA, 15 bp, Homo sapiens
accgctcacctagag

SEQ ID NO: 1315737 - DNA, 18 bp, Homo sapiens
accgctcacctagagcca

SEQ ID NO: 1315738 - DNA, 19 bp, Homo sapiens
accgcttccctcctgcccg

SEQ ID NO: 1315739 - DNA, 22 bp, Homo sapiens
acctccagcccgggagcctagg

SEQ ID NO: 1315740 - DNA, 13 bp, Homo sapiens
acctcccttccga

SEQ ID NO: 1315741 - DNA, 19 bp, Homo sapiens
acctctacccaaaccctag

SEQ ID NO: 1315742 - DNA, 20 bp, Homo sapiens
acctctacccaaaccctagg

SEQ ID NO: 1315743 - DNA, 14 bp, Homo sapiens
acgccttcccctca

SEQ ID NO: 1315744 - DNA, 15 bp, Homo sapiens
acgtctttctttttt

SEQ ID NO: 1315745 - DNA, 15 bp, Homo sapiens
acgttactcagggct

SEQ ID NO: 1315746 - DNA, 23 bp, Homo sapiens
acgttactcagggctcctcccag

SEQ ID NO: 1315747 - DNA, 15 bp, Homo sapiens
actaaatgcctagtt

SEQ ID NO: 1315748 - DNA, 19 bp, Homo sapiens
actattcattaaatgtttg

SEQ ID NO: 1315749 - DNA, 17 bp, Homo sapiens
actcagcccctaggagt

SEQ ID NO: 1315750 - DNA, 18 bp, Homo sapiens
actcagggctcctcccag

SEQ ID NO: 1315751 - DNA, 16 bp, Homo sapiens
actccgcccccagcct

SEQ ID NO: 1315752 - DNA, 17 bp, Homo sapiens
actccgcccccagccta

SEQ ID NO: 1315753 - DNA, 17 bp, Homo sapiens
actcgcttgtaaatacc

SEQ ID NO: 1315754 - DNA, 14 bp, Homo sapiens
actctaaagaccaa

SEQ ID NO: 1315755 - DNA, 21 bp, Homo sapiens
actgaaagacaccatttatct

SEQ ID NO: 1315756 - DNA, 20 bp, Homo sapiens
actgctggacgtctttcttt

SEQ ID NO: 1315757 - DNA, 16 bp, Homo sapiens
actgtaatatctttaa

SEQ ID NO: 1315758 - DNA, 22 bp, Homo sapiens
actgtaatatctttaaatgatg

SEQ ID NO: 1315759 - DNA, 15 bp, Homo sapiens
actgtctgtagtgtt

SEQ ID NO: 1315760 - DNA, 22 bp, Homo sapiens
actgtctttggaaaaatgtttg

SEQ ID NO: 1315761 - DNA, 13 bp, Homo sapiens
acttatgtagata

SEQ ID NO: 1315762 - DNA, 20 bp, Homo sapiens
acttatgtagatatttggct

SEQ ID NO: 1315763 - DNA, 15 bp, Homo sapiens
acttcagtcctgctc

SEQ ID NO: 1315764 - DNA, 19 bp, Homo sapiens
acttcagtcctgctccaga

SEQ ID NO: 1315765 - DNA, 17 bp, Homo sapiens
acttgaaattatatctg

SEQ ID NO: 1315766 - DNA, 16 bp, Homo sapiens
acttgtagctgtaaaa

SEQ ID NO: 1315767 - DNA, 17 bp, Homo sapiens
acttgtagctgtaaaac

SEQ ID NO: 1315768 - DNA, 18 bp, Homo sapiens
acttgtcactgacacaaa

SEQ ID NO: 1315769 - DNA, 22 bp, Homo sapiens
acttgtcactgacacaaaggaa

SEQ ID NO: 1315770 - DNA, 17 bp, Homo sapiens
acttgtgaaacacagct

SEQ ID NO: 1315771 - DNA, 20 bp, Homo sapiens
acttgtgaaacacagctgtt

SEQ ID NO: 1315772 - DNA, 20 bp, Homo sapiens
actttgctgatttcccctct

SEQ ID NO: 1315773 - DNA, 16 bp, Homo sapiens
agaaacccaagctcct

SEQ ID NO: 1315774 - DNA, 17 bp, Homo sapiens
agaaacccaagctcctc

SEQ ID NO: 1315775 - DNA, 20 bp, Homo sapiens
agaaacccaagctcctcctc

SEQ ID NO: 1315776 - DNA, 13 bp, Homo sapiens
agaaagatatcta

SEQ ID NO: 1315777 - DNA, 18 bp, Homo sapiens
agaaagatatctatgact

SEQ ID NO: 1315778 - DNA, 15 bp, Homo sapiens
agaatttggaaatcc

SEQ ID NO: 1315779 - DNA, 22 bp, Homo sapiens
agacacgccttcccctcagcca

SEQ ID NO: 1315780 - DNA, 13 bp, Homo sapiens
agaccaaacttca

SEQ ID NO: 1315781 - DNA, 18 bp, Homo sapiens
agaccaacgttactcagg

SEQ ID NO: 1315782 - DNA, 11 bp, Homo sapiens
agaccaaggaa

SEQ ID NO: 1315783 - DNA, 12 bp, Homo sapiens
agaccaaggaac

SEQ ID NO: 1315784 - DNA, 14 bp, Homo sapiens
agagatatatctga

SEQ ID NO: 1315785 - DNA, 20 bp, Homo sapiens
agagcctgatctcttcctgt

SEQ ID NO: 1315786 - DNA, 19 bp, Homo sapiens
agaggactcgcttgtaaat

SEQ ID NO: 1315787 - DNA, 17 bp, Homo sapiens
agagggctctgtgctga

SEQ ID NO: 1315788 - DNA, 13 bp, Homo sapiens
agaggtccagccc

SEQ ID NO: 1315789 - DNA, 15 bp, Homo sapiens
agagtgcacagctgt

SEQ ID NO: 1315790 - DNA, 16 bp, Homo sapiens
agagtgcacagctgtc

SEQ ID NO: 1315791 - DNA, 15 bp, Homo sapiens
agatatatctgaaaa

SEQ ID NO: 1315792 - DNA, 14 bp, Homo sapiens
agatatctatgact

SEQ ID NO: 1315793 - DNA, 15 bp, Homo sapiens
agatatctatgactg

SEQ ID NO: 1315794 - DNA, 23 bp, Homo sapiens
agatatctatgactgtgtttaat

SEQ ID NO: 1315795 - DNA, 23 bp, Homo sapiens
agcacaggtcccacctccagccc

SEQ ID NO: 1315796 - DNA, 15 bp, Homo sapiens
agaggtccagcccat

SEQ ID NO: 1315797 - DNA, 21 bp, Homo sapiens
agatatatctgaaaactggaa

SEQ ID NO: 1315798 - DNA, 11 bp, Homo sapiens
agatatttggc

SEQ ID NO: 1315799 - DNA, 12 bp, Homo sapiens
agatatttggct

SEQ ID NO: 1315800 - DNA, 16 bp, Homo sapiens
agatatttggcttaaa

SEQ ID NO: 1315801 - DNA, 20 bp, Homo sapiens
agatggtgaagcattctccc

SEQ ID NO: 1315802 - DNA, 23 bp, Homo sapiens
agcaaagaggactcgcttgtaaa

SEQ ID NO: 1315803 - DNA, 16 bp, Homo sapiens
agcacaggtcccacct

SEQ ID NO: 1315804 - DNA, 16 bp, Homo sapiens
agcaggacctcccttc

SEQ ID NO: 1315805 - DNA, 16 bp, Homo sapiens
agcatcctgagccccg

SEQ ID NO: 1315806 - DNA, 16 bp, Homo sapiens
agcccatgttctgccc

SEQ ID NO: 1315807 - DNA, 19 bp, Homo sapiens
agcccatgttctgccccca

SEQ ID NO: 1315808 - DNA, 21 bp, Homo sapiens
agcccatgttctgcccccagc

SEQ ID NO: 1315809 - DNA, 23 bp, Homo sapiens
agcccatgttctgcccccagccc

SEQ ID NO: 1315810 - DNA, 14 bp, Homo sapiens
agccccgccctctt

SEQ ID NO: 1315811 - DNA, 18 bp, Homo sapiens
agcccctagaaacccaag

SEQ ID NO: 1315812 - DNA, 23 bp, Homo sapiens
agcccctagaaacccaagctcct

SEQ ID NO: 1315813 - DNA, 18 bp, Homo sapiens
agcccgggagcctaggac

SEQ ID NO: 1315814 - DNA, 20 bp, Homo sapiens
agcctaggaccactcagccc

SEQ ID NO: 1315815 - DNA, 19 bp, Homo sapiens
agcctatgagcatcctgag

SEQ ID NO: 1315816 - DNA, 23 bp, Homo sapiens
agcctatgagcatcctgagcccc

SEQ ID NO: 1315817 - DNA, 13 bp, Homo sapiens
agcctgatctctt

SEQ ID NO: 1315818 - DNA, 17 bp, Homo sapiens
agcctgatctcttcctg

SEQ ID NO: 1315819 - DNA, 18 bp, Homo sapiens
agcctgatctcttcctgt

SEQ ID NO: 1315820 - DNA, 15 bp, Homo sapiens
agcggcgaccgccct

SEQ ID NO: 1315821 - DNA, 14 bp, Homo sapiens
agctcagaacccag

SEQ ID NO: 1315822 - DNA, 16 bp, Homo sapiens
agctcagaacccaggg

SEQ ID NO: 1315823 - DNA, 14 bp, Homo sapiens
agctccctgcccca

SEQ ID NO: 1315824 - DNA, 16 bp, Homo sapiens
agctcctcctcggaac

SEQ ID NO: 1315825 - DNA, 16 bp, Homo sapiens
agctgaggtttcaccc

SEQ ID NO: 1315826 - DNA, 18 bp, Homo sapiens
agctgaggtttcaccctt

SEQ ID NO: 1315827 - DNA, 20 bp, Homo sapiens
agctgcaggaatcaaaaatt

SEQ ID NO: 1315828 - DNA, 23 bp, Homo sapiens
agctgcaggaatcaaaaattgaa

SEQ ID NO: 1315829 - DNA, 21 bp, Homo sapiens
agcttcagatggtgaagcatt

SEQ ID NO: 1315830 - DNA, 17 bp, Homo sapiens
agcttctaataaattat

SEQ ID NO: 1315831 - DNA, 23 bp, Homo sapiens
agcttctaataaattatacaaat

SEQ ID NO: 1315832 - DNA, 16 bp, Homo sapiens
aggaaagcctcactga

SEQ ID NO: 1315833 - DNA, 22 bp, Homo sapiens
aggaacaaaaaaaccacaaagg

SEQ ID NO: 1315834 - DNA, 19 bp, Homo sapiens
aggaccactcagcccctag

SEQ ID NO: 1315835 - DNA, 15 bp, Homo sapiens
aggacctcccttccg

SEQ ID NO: 1315836 - DNA, 14 bp, Homo sapiens
aggactcgcttgta

SEQ ID NO: 1315837 - DNA, 15 bp, Homo sapiens
aggactcgcttgtaa

SEQ ID NO: 1315838 - DNA, 17 bp, Homo sapiens
aggactcgcttgtaaat

SEQ ID NO: 1315839 - DNA, 15 bp, Homo sapiens
aggagcacaggtccc

SEQ ID NO: 1315840 - DNA, 20 bp, Homo sapiens
aggagtgggtgacaagagcc

SEQ ID NO: 1315841 - DNA, 16 bp, Homo sapiens
aggcacttaagcacaa

SEQ ID NO: 1315842 - DNA, 13 bp, Homo sapiens
aggcccagcccct

SEQ ID NO: 1315843 - DNA, 14 bp, Homo sapiens
aggcccagccccta

SEQ ID NO: 1315844 - DNA, 17 bp, Homo sapiens
aggcccagcccctagaa

SEQ ID NO: 1315845 - DNA, 19 bp, Homo sapiens
aggcccagcccctagaaac

SEQ ID NO: 1315846 - DNA, 18 bp, Homo sapiens
aggcctcacctctaccca

SEQ ID NO: 1315847 - DNA, 18 bp, Homo sapiens
aggctcagcggcgaccgc

SEQ ID NO: 1315848 - DNA, 13 bp, Homo sapiens
aggctccgccctt

SEQ ID NO: 1315849 - DNA, 15 bp, Homo sapiens
agggcagaaagtaga

SEQ ID NO: 1315850 - DNA, 14 bp, Homo sapiens
agggcataaaacag

SEQ ID NO: 1315851 - DNA, 15 bp, Homo sapiens
agggcataaaacagc

SEQ ID NO: 1315852 - DNA, 18 bp, Homo sapiens
agggctcctcccagcttg

SEQ ID NO: 1315853 - DNA, 15 bp, Homo sapiens
agggctctgccccag

SEQ ID NO: 1315854 - DNA, 16 bp, Homo sapiens
agggctctgccccagt

SEQ ID NO: 1315855 - DNA, 13 bp, Homo sapiens
aggggacaggcct

SEQ ID NO: 1315856 - DNA, 14 bp, Homo sapiens
aggggacaggcctc

SEQ ID NO: 1315857 - DNA, 21 bp, Homo sapiens
aggggacaggcctcacctcta

SEQ ID NO: 1315858 - DNA, 14 bp, Homo sapiens
agggttgtgatttt

SEQ ID NO: 1315859 - DNA, 11 bp, Homo sapiens
aggtccagccc

SEQ ID NO: 1315860 - DNA, 14 bp, Homo sapiens
aggtccagcccatc

SEQ ID NO: 1315861 - DNA, 19 bp, Homo sapiens
aggtcccacctccagcccg

SEQ ID NO: 1315862 - DNA, 17 bp, Homo sapiens
aggtctcttctcccaga

SEQ ID NO: 1315863 - DNA, 14 bp, Homo sapiens
agtaatctgtacat

SEQ ID NO: 1315864 - DNA, 19 bp, Homo sapiens
agtaatctgtacattttgt

SEQ ID NO: 1315865 - DNA, 20 bp, Homo sapiens
agtacttgtgaaacacagct

SEQ ID NO: 1315866 - DNA, 18 bp, Homo sapiens
agtatatctaatggctgt

SEQ ID NO: 1315867 - DNA, 18 bp, Homo sapiens
agtcccccaactctgagc

SEQ ID NO: 1315868 - DNA, 15 bp, Homo sapiens
agtcctgctccagaa

SEQ ID NO: 1315869 - DNA, 18 bp, Homo sapiens
agtcctgctccagaattt

SEQ ID NO: 1315870 - DNA, 22 bp, Homo sapiens
agtctgggacacaaaactccgc

SEQ ID NO: 1315871 - DNA, 23 bp, Homo sapiens
agtctttaaaggcccagccccta

SEQ ID NO: 1315872 - DNA, 13 bp, Homo sapiens
agtctttttctgt

SEQ ID NO: 1315873 - DNA, 16 bp, Homo sapiens
agtgggtgacaagagc

SEQ ID NO: 1315874 - DNA, 18 bp, Homo sapiens
agtgggtgacaagagcct

SEQ ID NO: 1315875 - DNA, 19 bp, Homo sapiens
agtgggtgacaagagcctg

SEQ ID NO: 1315876 - DNA, 21 bp, Homo sapiens
agtgggtgacaagagcctgat

SEQ ID NO: 1315877 - DNA, 16 bp, Homo sapiens
agttcctaagaagctt

SEQ ID NO: 1315878 - DNA, 22 bp, Homo sapiens
agttcctaagaagcttctaata

SEQ ID NO: 1315879 - DNA, 19 bp, Homo sapiens
agtttttaatatttattga

SEQ ID NO: 1315880 - DNA, 21 bp, Homo sapiens
agtttttagtaatctgtacat

SEQ ID NO: 1315881 - DNA, 21 bp, Homo sapiens
atagatttatttttcagttcc

SEQ ID NO: 1315882 - DNA, 22 bp, Homo sapiens
atagatttatttttcagttcca

SEQ ID NO: 1315883 - DNA, 13 bp, Homo sapiens
ataggtctcttct

SEQ ID NO: 1315884 - DNA, 19 bp, Homo sapiens
ataggtctcttctcccaga

SEQ ID NO: 1315885 - DNA, 12 bp, Homo sapiens
atagtatatcta

SEQ ID NO: 1315886 - DNA, 16 bp, Homo sapiens
atagttcctaagaagc

SEQ ID NO: 1315887 - DNA, 15 bp, Homo sapiens
atatataccccccca

SEQ ID NO: 1315888 - DNA, 18 bp, Homo sapiens
atatcttgcgaatccaag

SEQ ID NO: 1315889 - DNA, 20 bp, Homo sapiens
atatgtgtaaatgttatgac

SEQ ID NO: 1315890 - DNA, 12 bp, Homo sapiens
atattatttggc

SEQ ID NO: 1315891 - DNA, 14 bp, Homo sapiens
atattatttggcag

SEQ ID NO: 1315892 - DNA, 16 bp, Homo sapiens
atattatttggcagtt

SEQ ID NO: 1315893 - DNA, 19 bp, Homo sapiens
atattatttggcagtttgg

SEQ ID NO: 1315894 - DNA, 21 bp, Homo sapiens
atattatttggcagtttggta

SEQ ID NO: 1315895 - DNA, 15 bp, Homo sapiens
atatttggcttaaat

SEQ ID NO: 1315896 - DNA, 18 bp, Homo sapiens
atatttggcttaaatata

SEQ ID NO: 1315897 - DNA, 15 bp, Homo sapiens
atcagagcaggacct

SEQ ID NO: 1315898 - DNA, 13 bp, Homo sapiens
atccaagctccct

SEQ ID NO: 1315899 - DNA, 22 bp, Homo sapiens
atcccagccggccaatggaaac

SEQ ID NO: 1315900 - DNA, 16 bp, Homo sapiens
atcccgagtctgggac

SEQ ID NO: 1315901 - DNA, 14 bp, Homo sapiens
atcctgagccccgc

SEQ ID NO: 1315902 - DNA, 22 bp, Homo sapiens
atcctgagccccgccctcttcc

SEQ ID NO: 1315903 - DNA, 23 bp, Homo sapiens
atcctgagccccgccctcttcct

SEQ ID NO: 1315904 - DNA, 17 bp, Homo sapiens
atcctgttaacactgta

SEQ ID NO: 1315905 - DNA, 14 bp, Homo sapiens
atctatgactgtgt

SEQ ID NO: 1315906 - DNA, 16 bp, Homo sapiens
atctatgactgtgttt

SEQ ID NO: 1315907 - DNA, 19 bp, Homo sapiens
atctcggagcatcccggag

SEQ ID NO: 1315908 - DNA, 15 bp, Homo sapiens
atctgaaaactggaa

SEQ ID NO: 1315909 - DNA, 15 bp, Homo sapiens
atctgtacattttgt

SEQ ID NO: 1315910 - DNA, 20 bp, Homo sapiens
atctgtacattttgttgtaa

SEQ ID NO: 1315911 - DNA, 16 bp, Homo sapiens
atctgtggtcttcaaa

SEQ ID NO: 1315912 - DNA, 13 bp, Homo sapiens
atctttaagcaga

SEQ ID NO: 1315913 - DNA, 17 bp, Homo sapiens
atgagcatcctgagccc

SEQ ID NO: 1315914 - DNA, 18 bp, Homo sapiens
atgagcatcctgagcccc

SEQ ID NO: 1315915 - DNA, 20 bp, Homo sapiens
atgagcatcctgagccccgc

SEQ ID NO: 1315916 - DNA, 18 bp, Homo sapiens
atgcctagtttttagtaa

SEQ ID NO: 1315917 - DNA, 15 bp, Homo sapiens
atgcttatgacaatg

SEQ ID NO: 1315918 - DNA, 13 bp, Homo sapiens
atggaaacctcac

SEQ ID NO: 1315919 - DNA, 12 bp, Homo sapiens
atggctctggac

SEQ ID NO: 1315920 - DNA, 17 bp, Homo sapiens
atggctctggactctaa

SEQ ID NO: 1315921 - DNA, 19 bp, Homo sapiens
atggctctggactctaaag

SEQ ID NO: 1315922 - DNA, 13 bp, Homo sapiens
atgtagatatttg

SEQ ID NO: 1315923 - DNA, 22 bp, Homo sapiens
atgtctttctccaaagttatcc

SEQ ID NO: 1315924 - DNA, 18 bp, Homo sapiens
atgtgaacttgtagctgt

SEQ ID NO: 1315925 - DNA, 23 bp, Homo sapiens
atgtgaacttgtagctgtaaaac

SEQ ID NO: 1315926 - DNA, 14 bp, Homo sapiens
cctcaccgcttccc

SEQ ID NO: 1315927 - DNA, 17 bp, Homo sapiens
cctcaccgcttccctcc

SEQ ID NO: 1315928 - DNA, 14 bp, Homo sapiens
cctcacctctaccc

SEQ ID NO: 1315929 - DNA, 14 bp, Homo sapiens
cctccagcccggga

SEQ ID NO: 1315930 - DNA, 22 bp, Homo sapiens
cctccagcccgggagcctagga

SEQ ID NO: 1315931 - DNA, 11 bp, Homo sapiens
cctcccagagg

SEQ ID NO: 1315932 - DNA, 22 bp, Homo sapiens
cctcccagaggtccagcccatc

SEQ ID NO: 1315933 - DNA, 20 bp, Homo sapiens
cctcccagcttgtaggagct

SEQ ID NO: 1315934 - DNA, 20 bp, Homo sapiens
cctcccttccgaccctctgg

SEQ ID NO: 1315935 - DNA, 23 bp, Homo sapiens
cctcccttccgaccctctgggaa

SEQ ID NO: 1315936 - DNA, 24 bp, Homo sapiens
cctcctcggaaccgctcacctaga

SEQ ID NO: 1315937 - DNA, 18 bp, Homo sapiens
cctcggaaccgctcacct

SEQ ID NO: 1315938 - DNA, 19 bp, Homo sapiens
cctctacccaaaccctagg

SEQ ID NO: 1315939 - DNA, 17 bp, Homo sapiens
cctctggccgcctaggc

SEQ ID NO: 1315940 - DNA, 20 bp, Homo sapiens
cctctggccgcctaggctca

SEQ ID NO: 1315941 - DNA, 12 bp, Homo sapiens
cctctgggaacc

SEQ ID NO: 1315942 - DNA, 18 bp, Homo sapiens
cctctgggaacctcccag

SEQ ID NO: 1315943 - DNA, 16 bp, Homo sapiens
cctgacgaaactggcc

SEQ ID NO: 1315944 - DNA, 21 bp, Homo sapiens
cctgagccccgccctcttcct

SEQ ID NO: 1315945 - DNA, 23 bp, Homo sapiens
cctgagccccgccctcttcctga

SEQ ID NO: 1315946 - DNA, 22 bp, Homo sapiens
ccttagtcccccaactctgagc

SEQ ID NO: 1315947 - DNA, 16 bp, Homo sapiens
ccttccgaccctctgg

SEQ ID NO: 1315948 - DNA, 16 bp, Homo sapiens
cgaatccaagctccct

SEQ ID NO: 1315949 - DNA, 18 bp, Homo sapiens
cgaatccaagctccctgc

SEQ ID NO: 1315950 - DNA, 14 bp, Homo sapiens
cgaccctctgggaa

SEQ ID NO: 1315951 - DNA, 16 bp, Homo sapiens
cgagtctgggacacaa

SEQ ID NO: 1315952 - DNA, 11 bp, Homo sapiens
cgcccccagcc

SEQ ID NO: 1315953 - DNA, 13 bp, Homo sapiens
cgcccccagccta

SEQ ID NO: 1315954 - DNA, 13 bp, Homo sapiens
cgccctcttcctg

SEQ ID NO: 1315955 - DNA, 14 bp, Homo sapiens
cgccctcttcctga

SEQ ID NO: 1315956 - DNA, 19 bp, Homo sapiens
cgcccttagtcccccaact

SEQ ID NO: 1315957 - DNA, 17 bp, Homo sapiens
cgctcacctagagccag

SEQ ID NO: 1315958 - DNA, 18 bp, Homo sapiens
cgcttgtaaataccagga

SEQ ID NO: 1315959 - DNA, 18 bp, Homo sapiens
cgcttgtggggacccagg

SEQ ID NO: 1315960 - DNA, 22 bp, Homo sapiens
cgcttgtggggacccaggctcc

SEQ ID NO: 1315961 - DNA, 21 bp, Homo sapiens
cggaaccgctcacctagagcc

SEQ ID NO: 1315962 - DNA, 23 bp, Homo sapiens
cggaccgcttgtggggacccagg

SEQ ID NO: 1315963 - DNA, 22 bp, Homo sapiens
cggatcagagcaggacctccct

SEQ ID NO: 1315964 - DNA, 16 bp, Homo sapiens
cggcaccctctggccg

SEQ ID NO: 1315965 - DNA, 14 bp, Homo sapiens
cggccaatggaaac

SEQ ID NO: 1315966 - DNA, 16 bp, Homo sapiens
cgtatcccgagtctgg

SEQ ID NO: 1315967 - DNA, 22 bp, Homo sapiens
cgttactcagggctcctcccag

SEQ ID NO: 1315968 - DNA, 21 bp, Homo sapiens
cgtttagaccaaggaacaaaa

SEQ ID NO: 1315969 - DNA, 15 bp, Homo sapiens
ctaaagaccaaactt

SEQ ID NO: 1315970 - DNA, 23 bp, Homo sapiens
ctaaagaccaaacttcactctgg

SEQ ID NO: 1315971 - DNA, 21 bp, Homo sapiens
ctaaatgcctagtttttagta

SEQ ID NO: 1315972 - DNA, 21 bp, Homo sapiens
ctaagaagcttctaataaatt

SEQ ID NO: 1315973 - DNA, 16 bp, Homo sapiens
ctaattaaaaagttaa

SEQ ID NO: 1315974 - DNA, 17 bp, Homo sapiens
ctactgtctttggaaaa

SEQ ID NO: 1315975 - DNA, 15 bp, Homo sapiens
ctagagccagaccaa

SEQ ID NO: 1315976 - DNA, 20 bp, Homo sapiens
ctaggaccactcagccccta

SEQ ID NO: 1315977 - DNA, 21 bp, Homo sapiens
ctaggaccactcagcccctag

SEQ ID NO: 1315978 - DNA, 19 bp, Homo sapiens
ctaggagtatatttccgca

SEQ ID NO: 1315979 - DNA, 15 bp, Homo sapiens
ctaggctcagcggcg

SEQ ID NO: 1315980 - DNA, 15 bp, Homo sapiens
ctagtttcctctcct

SEQ ID NO: 1315981 - DNA, 22 bp, Homo sapiens
ctagtttttagtaatctgtaca

SEQ ID NO: 1315982 - DNA, 23 bp, Homo sapiens
ctagtttttagtaatctgtacat

SEQ ID NO: 1315983 - DNA, 18 bp, Homo sapiens
ctatgagcatcctgagcc

SEQ ID NO: 1315984 - DNA, 21 bp, Homo sapiens
ctatgagcatcctgagccccg

SEQ ID NO: 1315985 - DNA, 22 bp, Homo sapiens
ctatgagcatcctgagccccgc

SEQ ID NO: 1315986 - DNA, 13 bp, Homo sapiens
ctcaaggaatctt

SEQ ID NO: 1315987 - DNA, 17 bp, Homo sapiens
ctcacctagagccagac

SEQ ID NO: 1315988 - DNA, 20 bp, Homo sapiens
ctcacctagagccagaccaa

SEQ ID NO: 1315989 - DNA, 13 bp, Homo sapiens
ctcacctctaccc

SEQ ID NO: 1315990 - DNA, 18 bp, Homo sapiens
ctcacctctacccaaacc

SEQ ID NO: 1315991 - DNA, 14 bp, Homo sapiens
ctcagaacccaggg

SEQ ID NO: 1315992 - DNA, 19 bp, Homo sapiens
ctcagccacacccaggcac

SEQ ID NO: 1315993 - DNA, 16 bp, Homo sapiens
ctcagctgtctgtggc

SEQ ID NO: 1315994 - DNA, 16 bp, Homo sapiens
ctcagggctcctccca

SEQ ID NO: 1315995 - DNA, 21 bp, Homo sapiens
ctcagggctcctcccagcttg

SEQ ID NO: 1315996 - DNA, 14 bp, Homo sapiens
ctcagttggaaata

SEQ ID NO: 1315997 - DNA, 15 bp, Homo sapiens
ctccacgcgcttcga

SEQ ID NO: 1315998 - DNA, 16 bp, Homo sapiens
ctccagcccgggagcc

SEQ ID NO: 1315999 - DNA, 19 bp, Homo sapiens
ctccagcccgggagcctag

SEQ ID NO: 1316000 - DNA, 22 bp, Homo sapiens
ctccagcccgggagcctaggac

SEQ ID NO: 1316001 - DNA, 23 bp, Homo sapiens
ctccagcccgggagcctaggacc

SEQ ID NO: 1316002 - DNA, 16 bp, Homo sapiens
ctccagctcagaaccc

SEQ ID NO: 1316003 - DNA, 17 bp, Homo sapiens
ctccagctcagaaccca

SEQ ID NO: 1316004 - DNA, 19 bp, Homo sapiens
ctccagctcagaacccagg

SEQ ID NO: 1316005 - DNA, 21 bp, Homo sapiens
ctccagctcagaacccagggc

SEQ ID NO: 1316006 - DNA, 20 bp, Homo sapiens
ctcccagaatcccagccggc

SEQ ID NO: 1316007 - DNA, 18 bp, Homo sapiens
ctcccagaggtccagccc

SEQ ID NO: 1316008 - DNA, 21 bp, Homo sapiens
ctcccagaggtccagcccatc

SEQ ID NO: 1316009 - DNA, 11 bp, Homo sapiens
ctcccagtccc

SEQ ID NO: 1316010 - DNA, 16 bp, Homo sapiens
ctccccagtgtatgtc

SEQ ID NO: 1316011 - DNA, 19 bp, Homo sapiens
ctccccggcaccctctggc

SEQ ID NO: 1316012 - DNA, 14 bp, Homo sapiens
ctccgcccttagtc

SEQ ID NO: 1316013 - DNA, 11 bp, Homo sapiens
ctcctcccagc

SEQ ID NO: 1316014 - DNA, 23 bp, Homo sapiens
ctcctcccagcttgtaggagctg

SEQ ID NO: 1316015 - DNA, 23 bp, Homo sapiens
ctcctcggaaccgctcacctaga

SEQ ID NO: 1316016 - DNA, 21 bp, Homo sapiens
ctcgattttgcacttttttct

SEQ ID NO: 1316017 - DNA, 14 bp, Homo sapiens
ctcgcttgtaaata

SEQ ID NO: 1316018 - DNA, 21 bp, Homo sapiens
ctcgcttgtaaataccaggat

SEQ ID NO: 1316019 - DNA, 18 bp, Homo sapiens
ctcggaaccgctcaccta

SEQ ID NO: 1316020 - DNA, 21 bp, Homo sapiens
ctcggaaccgctcacctagag

SEQ ID NO: 1316021 - DNA, 23 bp, Homo sapiens
ctcggaaccgctcacctagagcc

SEQ ID NO: 1316022 - DNA, 12 bp, Homo sapiens
ctctgagcccat

SEQ ID NO: 1316023 - DNA, 22 bp, Homo sapiens
ctctgagcccatgttctgcccc

SEQ ID NO: 1316024 - DNA, 16 bp, Homo sapiens
ctctgagctgttatct

SEQ ID NO: 1316025 - DNA, 21 bp, Homo sapiens
ctctggactctaaagaccaaa

SEQ ID NO: 1316026 - DNA, 19 bp, Homo sapiens
ctctgggaacctcccagag

SEQ ID NO: 1316027 - DNA, 20 bp, Homo sapiens
ctctgggaacctcccagagg

SEQ ID NO: 1316028 - DNA, 23 bp, Homo sapiens
ctctgggaacctcccagaggtcc

SEQ ID NO: 1316029 - DNA, 14 bp, Homo sapiens
ctctgtgctgacat

SEQ ID NO: 1316030 - DNA, 18 bp, Homo sapiens
ctcttcagtgtgttgact

SEQ ID NO: 1316031 - DNA, 14 bp, Homo sapiens
ctcttcccttcaac

SEQ ID NO: 1316032 - DNA, 13 bp, Homo sapiens
ctcttctcccaga

SEQ ID NO: 1316033 - DNA, 15 bp, Homo sapiens
ctcttctcccagaat

SEQ ID NO: 1316034 - DNA, 22 bp, Homo sapiens
ctcttctcccagaatcccagcc

SEQ ID NO: 1316035 - DNA, 19 bp, Homo sapiens
ctgaaaactggaataagaa

SEQ ID NO: 1316036 - DNA, 14 bp, Homo sapiens
ctgacacaaaggaa

SEQ ID NO: 1316037 - DNA, 16 bp, Homo sapiens
ctgagcccatgttctg

SEQ ID NO: 1316038 - DNA, 20 bp, Homo sapiens
ctgagccccgccctcttcct

SEQ ID NO: 1316039 - DNA, 23 bp, Homo sapiens
ctgagccccgccctcttcctgac

SEQ ID NO: 1316040 - DNA, 21 bp, Homo sapiens
ctgaggtttcacccttaaccc

SEQ ID NO: 1316041 - DNA, 13 bp, Homo sapiens
ctgatttcccctc

SEQ ID NO: 1316042 - DNA, 18 bp, Homo sapiens
ctgcccccagcccaaagg

SEQ ID NO: 1316043 - DNA, 16 bp, Homo sapiens
ctgcctcaccgcttcc

SEQ ID NO: 1316044 - DNA, 18 bp, Homo sapiens
ctgctccagaatttggaa

SEQ ID NO: 1316045 - DNA, 18 bp, Homo sapiens
ctggccccggatcagagc

SEQ ID NO: 1316046 - DNA, 20 bp, Homo sapiens
ctggccccggatcagagcag

SEQ ID NO: 1316047 - DNA, 24 bp, Homo sapiens
ctggccccggatcagagcaggacc

SEQ ID NO: 1316048 - DNA, 16 bp, Homo sapiens
ctgggaacctcccaga

SEQ ID NO: 1316049 - DNA, 22 bp, Homo sapiens
ctgggaacctcccagaggtcca

SEQ ID NO: 1316050 - DNA, 21 bp, Homo sapiens
ctgggacacaaaactccgccc

SEQ ID NO: 1316051 - DNA, 22 bp, Homo sapiens
ctgggcacactctgccagcaaa

SEQ ID NO: 1316052 - DNA, 17 bp, Homo sapiens
ctgtaatatctttaaat

SEQ ID NO: 1316053 - DNA, 20 bp, Homo sapiens
ctgtacattttgttgtaaaa

SEQ ID NO: 1316054 - DNA, 14 bp, Homo sapiens
tctaataaattata

SEQ ID NO: 1316055 - DNA, 14 bp, Homo sapiens
tctacccaaaccct

SEQ ID NO: 1316056 - DNA, 15 bp, Homo sapiens
tctattgaaagtttt

SEQ ID NO: 1316057 - DNA, 17 bp, Homo sapiens
tctccagctcagaaccc

SEQ ID NO: 1316058 - DNA, 12 bp, Homo sapiens
tctccccagtgt

SEQ ID NO: 1316059 - DNA, 16 bp, Homo sapiens
tctcttctcccagaat

SEQ ID NO: 1316060 - DNA, 21 bp, Homo sapiens
tctcttctcccagaatcccag

SEQ ID NO: 1316061 - DNA, 23 bp, Homo sapiens
tctgagcccatgttctgccccca

SEQ ID NO: 1316062 - DNA, 15 bp, Homo sapiens
tctgagctgttatct

SEQ ID NO: 1316063 - DNA, 17 bp, Homo sapiens
tctgccagcaaagagga

SEQ ID NO: 1316064 - DNA, 24 bp, Homo sapiens
tctgcttcatttcctctgagctgt

SEQ ID NO: 1316065 - DNA, 16 bp, Homo sapiens
tctgggaacctcccag

SEQ ID NO: 1316066 - DNA, 22 bp, Homo sapiens
tctgggaacctcccagaggtcc

SEQ ID NO: 1316067 - DNA, 18 bp, Homo sapiens
tctgggcacactctgcca

SEQ ID NO: 1316068 - DNA, 19 bp, Homo sapiens
tctgtacattttgttgtaa

SEQ ID NO: 1316069 - DNA, 14 bp, Homo sapiens
tctgtgtatattat

SEQ ID NO: 1316070 - DNA, 14 bp, Homo sapiens
tctgttgtaactta

SEQ ID NO: 1316071 - DNA, 16 bp, Homo sapiens
tctgttgtaacttatg

SEQ ID NO: 1316072 - DNA, 22 bp, Homo sapiens
tcttcaacataacccacttgtc

SEQ ID NO: 1316073 - DNA, 13 bp, Homo sapiens
tcttctcccagaa

SEQ ID NO: 1316074 - DNA, 17 bp, Homo sapiens
tcttgcgaatccaagct

SEQ ID NO: 1316075 - DNA, 21 bp, Homo sapiens
tctttaaaggcccagccccta

SEQ ID NO: 1316076 - DNA, 19 bp, Homo sapiens
tctttggaaaaatgtttgt

SEQ ID NO: 1316077 - DNA, 21 bp, Homo sapiens
tgaaaactggaataagaagca

SEQ ID NO: 1316078 - DNA, 23 bp, Homo sapiens
tgaaaactggaataagaagcaaa

SEQ ID NO: 1316079 - DNA, 14 bp, Homo sapiens
tgaaacacagctgt

SEQ ID NO: 1316080 - DNA, 17 bp, Homo sapiens
tgaaacacagctgttct

SEQ ID NO: 1316081 - DNA, 14 bp, Homo sapiens
tgaacttgtagctg

SEQ ID NO: 1316082 - DNA, 15 bp, Homo sapiens
tgaacttgtagctgt

SEQ ID NO: 1316083 - DNA, 22 bp, Homo sapiens
tgaagagagatatatctgaaaa

SEQ ID NO: 1316084 - DNA, 21 bp, Homo sapiens
tgaagcattctccccagtgta

SEQ ID NO: 1316085 - DNA, 13 bp, Homo sapiens
tgaattattttgt

SEQ ID NO: 1316086 - DNA, 16 bp, Homo sapiens
tgacaaatctgtgtat

SEQ ID NO: 1316087 - DNA, 15 bp, Homo sapiens
tgacacaaaggaagt

SEQ ID NO: 1316088 - DNA, 19 bp, Homo sapiens
tgacgaaactggccccgga

SEQ ID NO: 1316089 - DNA, 15 bp, Homo sapiens
tgacttctatcctgt

SEQ ID NO: 1316090 - DNA, 15 bp, Homo sapiens
tgagcatcctgagcc

SEQ ID NO: 1316091 - DNA, 21 bp, Homo sapiens
tgagcccatgttctgccccca

SEQ ID NO: 1316092 - DNA, 23 bp, Homo sapiens
tgagcccatgttctgcccccagc

SEQ ID NO: 1316093 - DNA, 14 bp, Homo sapiens
tgagccccgccctc

SEQ ID NO: 1316094 - DNA, 21 bp, Homo sapiens
tgagccccgccctcttcctga

SEQ ID NO: 1316095 - DNA, 15 bp, Homo sapiens
tgaggtttcaccctt

SEQ ID NO: 1316096 - DNA, 20 bp, Homo sapiens
tgataaaaaatttattatgt

SEQ ID NO: 1316097 - DNA, 11 bp, Homo sapiens
tgcacagctgt

SEQ ID NO: 1316098 - DNA, 22 bp, Homo sapiens
tgccccaaataacttcagtcct

SEQ ID NO: 1316099 - DNA, 16 bp, Homo sapiens
tgcctagtttttagta

SEQ ID NO: 1316100 - DNA, 15 bp, Homo sapiens
tgcctcaccgcttcc

SEQ ID NO: 1316101 - DNA, 22 bp, Homo sapiens
tgcctcaccgcttccctcctgc

SEQ ID NO: 1316102 - DNA, 15 bp, Homo sapiens
tgctaattaaaaagt

SEQ ID NO: 1316103 - DNA, 17 bp, Homo sapiens
tgctaattaaaaagtta

SEQ ID NO: 1316104 - DNA, 18 bp, Homo sapiens
tgctactgtctttggaaa

SEQ ID NO: 1316105 - DNA, 21 bp, Homo sapiens
tgctccagaatttggaaatcc

SEQ ID NO: 1316106 - DNA, 22 bp, Homo sapiens
tgctccagaatttggaaatcct

SEQ ID NO: 1316107 - DNA, 20 bp, Homo sapiens
tgctgacatggctctggact

SEQ ID NO: 1316108 - DNA, 15 bp, Homo sapiens
tggaaaaatgtttgt

SEQ ID NO: 1316109 - DNA, 22 bp, Homo sapiens
tggaaatcctagtttcctctcc

SEQ ID NO: 1316110 - DNA, 22 bp, Homo sapiens
tggaccaaaaaaataaagcatt

SEQ ID NO: 1316111 - DNA, 16 bp, Homo sapiens
tggactctaaagacca

SEQ ID NO: 1316112 - DNA, 18 bp, Homo sapiens
tggactctaaagaccaaa

SEQ ID NO: 1316113 - DNA, 14 bp, Homo sapiens
tggatatgtgtaaa

SEQ ID NO: 1316114 - DNA, 23 bp, Homo sapiens
tggctactttggtttctgtctgt

SEQ ID NO: 1316115 - DNA, 15 bp, Homo sapiens
tggctctggactcta

SEQ ID NO: 1316116 - DNA, 19 bp, Homo sapiens
tggctgtggcattgttgat

SEQ ID NO: 1316117 - DNA, 19 bp, Homo sapiens
tggcttaaatatagttcct

SEQ ID NO: 1316118 - DNA, 15 bp, Homo sapiens
tggcttcccatgtct

SEQ ID NO: 1316119 - DNA, 17 bp, Homo sapiens
tggcttcccatgtcttt

SEQ ID NO: 1316120 - DNA, 14 bp, Homo sapiens
tgggaacctcccag

SEQ ID NO: 1316121 - DNA, 15 bp, Homo sapiens
tgggaacctcccaga

SEQ ID NO: 1316122 - DNA, 21 bp, Homo sapiens
tgggaacctcccagaggtcca

SEQ ID NO: 1316123 - DNA, 20 bp, Homo sapiens
tgggacacaaaactccgccc

SEQ ID NO: 1316124 - DNA, 13 bp, Homo sapiens
tggggacccaggc

SEQ ID NO: 1316125 - DNA, 21 bp, Homo sapiens
tggggacccaggctccgccct

SEQ ID NO: 1316126 - DNA, 22 bp, Homo sapiens
tggggacccaggctccgccctt

SEQ ID NO: 1316127 - DNA, 19 bp, Homo sapiens
tggtcttcaaattgtcttt

SEQ ID NO: 1316128 - DNA, 12 bp, Homo sapiens
tgtaaaaagaaa

SEQ ID NO: 1316129 - DNA, 16 bp, Homo sapiens
tgtaaaacgctgtcaa

SEQ ID NO: 1316130 - DNA, 14 bp, Homo sapiens
tgtaaataccagga

SEQ ID NO: 1316131 - DNA, 16 bp, Homo sapiens
tgtaaatgttatgact

SEQ ID NO: 1316132 - DNA, 16 bp, Homo sapiens
tgtaacttatgtagat

SEQ ID NO: 1316133 - DNA, 17 bp, Homo sapiens
tgtacattttgttgtaa

SEQ ID NO: 1316134 - DNA, 21 bp, Homo sapiens
tgtacattttgttgtaaaaag

SEQ ID NO: 1316135 - DNA, 23 bp, Homo sapiens
tgtacattttgttgtaaaaagaa

SEQ ID NO: 1316136 - DNA, 17 bp, Homo sapiens
tgtagctgtaaaacgct

SEQ ID NO: 1316137 - DNA, 13 bp, Homo sapiens
tgtatattatttg

SEQ ID NO: 1316138 - DNA, 18 bp, Homo sapiens
tgtatattatttggcagt

SEQ ID NO: 1316139 - DNA, 22 bp, Homo sapiens
tgtatattatttggcagtttgg

SEQ ID NO: 1316140 - DNA, 17 bp, Homo sapiens
tgtcaaaagttggacta

SEQ ID NO: 1316141 - DNA, 20 bp, Homo sapiens
tgtcaaaagttggactaaat

SEQ ID NO: 1316142 - DNA, 20 bp, Homo sapiens
tgtcactgacacaaaggaag

SEQ ID NO: 1316143 - DNA, 13 bp, Homo sapiens
tgtctgtagtgtt

SEQ ID NO: 1316144 - DNA, 13 bp, Homo sapiens
tgtctttggaaaa

SEQ ID NO: 1316145 - DNA, 12 bp, Homo sapiens
tgtgaacttgta

SEQ ID NO: 1316146 - DNA, 21 bp, Homo sapiens
tgtgaacttgtagctgtaaaa

SEQ ID NO: 1316147 - DNA, 16 bp, Homo sapiens
tgtggtgtgagcttca

SEQ ID NO: 1316148 - DNA, 15 bp, Homo sapiens
tgtgtaaatgttatg

SEQ ID NO: 1316149 - DNA, 16 bp, Homo sapiens
tgtgtatattatttgg

SEQ ID NO: 1316150 - DNA, 17 bp, Homo sapiens
tgtgtatattatttggc

SEQ ID NO: 1316151 - DNA, 13 bp, Homo sapiens
tgttatgactcct

SEQ ID NO: 1316152 - DNA, 18 bp, Homo sapiens
tgttcacgcaacttgaaa

SEQ ID NO: 1316153 - DNA, 14 bp, Homo sapiens
tgttctgcccccag

SEQ ID NO: 1316154 - DNA, 22 bp, Homo sapiens
tgttctgcccccagcccaaagg

SEQ ID NO: 1316155 - DNA, 18 bp, Homo sapiens
tgttgacttctatcctgt

SEQ ID NO: 1316156 - DNA, 17 bp, Homo sapiens
tgttgtaaaaagaaaaa

SEQ ID NO: 1316157 - DNA, 16 bp, Homo sapiens
tgtttaatgtgaactt

SEQ ID NO: 1316158 - DNA, 18 bp, Homo sapiens
tgtttaatgtgaacttgt

SEQ ID NO: 1316159 - DNA, 19 bp, Homo sapiens
tgtttaatgtgaacttgta

SEQ ID NO: 1316160 - DNA, 23 bp, Homo sapiens
tgtttaatgtgaacttgtagctg

SEQ ID NO: 1316161 - DNA, 12 bp, Homo sapiens
ttaaaaaaagaa

SEQ ID NO: 1316162 - DNA, 16 bp, Homo sapiens
ttaaaggcccagcccc

SEQ ID NO: 1316163 - DNA, 12 bp, Homo sapiens
ttaaatatagtt

SEQ ID NO: 1316164 - DNA, 21 bp, Homo sapiens
ttaaatgatgtacaggcagat

SEQ ID NO: 1316165 - DNA, 11 bp, Homo sapiens
ttaaatgtttg

SEQ ID NO: 1316166 - DNA, 20 bp, Homo sapiens
ttaacactgtaatatcttta

SEQ ID NO: 1316167 - DNA, 21 bp, Homo sapiens
ttaacactgtaatatctttaa

SEQ ID NO: 1316168 - DNA, 14 bp, Homo sapiens
ttaatatttattga

SEQ ID NO: 1316169 - DNA, 21 bp, Homo sapiens
ttaccagtctttaaaggccca

SEQ ID NO: 1316170 - DNA, 15 bp, Homo sapiens
ttactgtctgtagtg

SEQ ID NO: 1316171 - DNA, 18 bp, Homo sapiens
ttactgtctgtagtgttt

SEQ ID NO: 1316172 - DNA, 13 bp, Homo sapiens
ttagaccaaggaa

SEQ ID NO: 1316173 - DNA, 17 bp, Homo sapiens
ttagtaatctgtacatt

SEQ ID NO: 1316174 - DNA, 21 bp, Homo sapiens
ttagtaatctgtacattttgt

SEQ ID NO: 1316175 - DNA, 19 bp, Homo sapiens
ttatacaaattaaaaagat

SEQ ID NO: 1316176 - DNA, 22 bp, Homo sapiens
ttatatctgtggtcttcaaatt

SEQ ID NO: 1316177 - DNA, 22 bp, Homo sapiens
ttatcttgtgtatggatatgtg

SEQ ID NO: 1316178 - DNA, 18 bp, Homo sapiens
ttatgtagatatttggct

SEQ ID NO: 1316179 - DNA, 22 bp, Homo sapiens
ttatgtagatatttggcttaaa

SEQ ID NO: 1316180 - DNA, 19 bp, Homo sapiens
ttattcaagaaagatatct

SEQ ID NO: 1316181 - DNA, 21 bp, Homo sapiens
ttattttgttactgtctgtag

SEQ ID NO: 1316182 - DNA, 16 bp, Homo sapiens
ttcaaatgggttttcc

SEQ ID NO: 1316183 - DNA, 21 bp, Homo sapiens
ttcaagaaagatatctatgac

SEQ ID NO: 1316184 - DNA, 13 bp, Homo sapiens
tcctttccacctt

SEQ ID NO: 1316185 - DNA, 13 bp, Homo sapiens
ttggtctcatgcc

SEQ ID NO: 1316186 - DNA, 17 bp, Homo sapiens
ttgtaaaagcaacatca

SEQ ID NO: 1316187 - DNA, 23 bp, Homo sapiens
ttgtaaaagcaacatcagcttga

SEQ ID NO: 1316188 - DNA, 14 bp, Homo sapiens
ttgtaaatattaaa

SEQ ID NO: 1316189 - DNA, 23 bp, Homo sapiens
ttgtaaatattaaaccataagat

SEQ ID NO: 1316190 - DNA, 15 bp, Homo sapiens
ttgtgaattgcctgc

SEQ ID NO: 1316191 - DNA, 20 bp, Homo sapiens
ttgtgaattgcctgccatgg

SEQ ID NO: 1316192 - DNA, 23 bp, Homo sapiens
ttgtgactagtgctgaagcttat

SEQ ID NO: 1316193 - DNA, 23 bp, Homo sapiens
ttgtgcattggataacaccacca

SEQ ID NO: 1316194 - DNA, 17 bp, Homo sapiens
ttgtggacctcaccaga

SEQ ID NO: 1316195 - DNA, 23 bp, Homo sapiens
ttgtgtaatattactttaacatg

SEQ ID NO: 1316196 - DNA, 16 bp, Homo sapiens
ttgttagaaaaatgga

SEQ ID NO: 1316197 - DNA, 14 bp, Homo sapiens
ttgttttcgatgag

SEQ ID NO: 1316198 - DNA, 12 bp, Homo sapiens
ttgttttcttgg

SEQ ID NO: 1316199 - DNA, 12 bp, Homo sapiens
tttaaagctttt

SEQ ID NO: 1316200 - DNA, 23 bp, Homo sapiens
tttaaataaaaattactgtgtta

SEQ ID NO: 1316201 - DNA, 21 bp, Homo sapiens
tttaaatgacagcacctgaga

SEQ ID NO: 1316202 - DNA, 19 bp, Homo sapiens
tttaagaatggtctcagtg

SEQ ID NO: 1316203 - DNA, 21 bp, Homo sapiens
tttaagaatggtctcagtgtt

SEQ ID NO: 1316204 - DNA, 12 bp, Homo sapiens
tttactgagaga

SEQ ID NO: 1316205 - DNA, 18 bp, Homo sapiens
tttagtaaaaaagagaat

SEQ ID NO: 1316206 - DNA, 14 bp, Homo sapiens
tttatgcagtgctg

SEQ ID NO: 1316207 - DNA, 18 bp, Homo sapiens
tttatggaacttccctcc

SEQ ID NO: 1316208 - DNA, 16 bp, Homo sapiens
tttattttttttctgt

SEQ ID NO: 1316209 - DNA, 24 bp, Homo sapiens
tttcactctaaaaatcttggcaat

SEQ ID NO: 1316210 - DNA, 17 bp, Homo sapiens
tttctaatttgctgctg

SEQ ID NO: 1316211 - DNA, 21 bp, Homo sapiens
tttctcatgtagaacaagaaa

SEQ ID NO: 1316212 - DNA, 23 bp, Homo sapiens
tttctggaattgatgtttacatg

SEQ ID NO: 1316213 - DNA, 23 bp, Homo sapiens
tttctgtaaagatacaagtaaga

SEQ ID NO: 1316214 - DNA, 11 bp, Homo sapiens
tttctgtgcca

SEQ ID NO: 1316215 - DNA, 14 bp, Homo sapiens
tttctgtgtgttcc

SEQ ID NO: 1316216 - DNA, 15 bp, Homo sapiens
tttctgtgtgttcct

SEQ ID NO: 1316217 - DNA, 17 bp, Homo sapiens
tttctgtgtgttcctgg

SEQ ID NO: 1316218 - DNA, 18 bp, Homo sapiens
tttctgtgtgttcctggc

SEQ ID NO: 1316219 - DNA, 22 bp, Homo sapiens
tttctgtttctaatttgctgct

SEQ ID NO: 1316220 - DNA, 23 bp, Homo sapiens
tttcttggacacttaattctgtt

SEQ ID NO: 1316221 - DNA, 18 bp, Homo sapiens
tttcttgggaataaatta

SEQ ID NO: 1316222 - DNA, 16 bp, Homo sapiens
tttctttgaagaagga

SEQ ID NO: 1316223 - DNA, 14 bp, Homo sapiens
tttgctgctgataa

SEQ ID NO: 1316224 - DNA, 12 bp, Homo sapiens
tttgctgtgtga

SEQ ID NO: 1316225 - DNA, 18 bp, Homo sapiens
tttggaaactaataaaat

SEQ ID NO: 1316226 - DNA, 19 bp, Homo sapiens
tttggaaactaataaaata

SEQ ID NO: 1316227 - DNA, 21 bp, Homo sapiens
tttggaaactaataaaatatt

SEQ ID NO: 1316228 - DNA, 14 bp, Homo sapiens
tttggtaagggaag

SEQ ID NO: 1316229 - DNA, 15 bp, Homo sapiens
tttggtaagggaagt

SEQ ID NO: 1316230 - DNA, 18 bp, Homo sapiens
tttggttagctcacagga

SEQ ID NO: 1316231 - DNA, 16 bp, Homo sapiens
tttgtcccaaaacaaa

SEQ ID NO: 1316232 - DNA, 14 bp, Homo sapiens
tttgtccctgttgg

SEQ ID NO: 1316233 - DNA, 17 bp, Homo sapiens
tttgttaccttaaaact

SEQ ID NO: 1316234 - DNA, 17 bp, Homo sapiens
ttttaagaatggtctca

SEQ ID NO: 1316235 - DNA, 23 bp, Homo sapiens
ttttagcacagcgttatgtgtct

SEQ ID NO: 1316236 - DNA, 13 bp, Homo sapiens
ttttcaatgtgat

SEQ ID NO: 1316237 - DNA, 10 bp, Homo sapiens
ttttctgtgt

SEQ ID NO: 1316238 - DNA, 18 bp, Homo sapiens
ttttctgtgtgttcctgg

SEQ ID NO: 1316239 - DNA, 15 bp, Homo sapiens
ttttcttgggaataa

SEQ ID NO: 1316240 - DNA, 22 bp, Homo sapiens
ttttgcttgaagcaaacagttg

SEQ ID NO: 1316241 - DNA, 14 bp, Homo sapiens
ttttggactttgtt

SEQ ID NO: 1316242 - DNA, 19 bp, Homo sapiens
ttttggccaccccttgctc

SEQ ID NO: 1316243 - DNA, 16 bp, Homo sapiens
tttttaaagcttttga

SEQ ID NO: 1316244 - DNA, 20 bp, Homo sapiens
tttttcactctaaaaatctt

SEQ ID NO: 1316245 - DNA, 10 bp, Homo sapiens
tttttttcct

SEQ ID NO: 1316246 - DNA, 23 bp, Homo sapiens
ctgtggggagggtcatgtacttc

SEQ ID NO: 1316247 - DNA, 20 bp, Homo sapiens
ctgtggttcactgcactgtt

SEQ ID NO: 1316248 - DNA, 18 bp, Homo sapiens
ctgtgtatggtgacctct

SEQ ID NO: 1316249 - DNA, 14 bp, Homo sapiens
ctgtgtgaaatctt

SEQ ID NO: 1316250 - DNA, 21 bp, Homo sapiens
ctgtgtgaaatctttcaagtt

SEQ ID NO: 1316251 - DNA, 22 bp, Homo sapiens
ctgttatttatccctcattcat

SEQ ID NO: 1316252 - DNA, 19 bp, Homo sapiens
ctgttccccacaggtcctc

SEQ ID NO: 1316253 - DNA, 22 bp, Homo sapiens
ctgttccccacaggtcctccat

SEQ ID NO: 1316254 - DNA, 12 bp, Homo sapiens
ctgttccttcct

SEQ ID NO: 1316255 - DNA, 17 bp, Homo sapiens
ctgttccttcctgcaga

SEQ ID NO: 1316256 - DNA, 19 bp, Homo sapiens
ctgttccttcctgcagacc

SEQ ID NO: 1316257 - DNA, 11 bp, Homo sapiens
ctgttgactct

SEQ ID NO: 1316258 - DNA, 19 bp, Homo sapiens
ctgttgactctagtactgt

SEQ ID NO: 1316259 - DNA, 22 bp, Homo sapiens
ctgttgactctagtactgtgaa

SEQ ID NO: 1316260 - DNA, 12 bp, Homo sapiens
cttaaaactagg

SEQ ID NO: 1316261 - DNA, 22 bp, Homo sapiens
cttaaaactaggcatttgtaaa

SEQ ID NO: 1316262 - DNA, 22 bp, Homo sapiens
cttaaaatatccactggacact

SEQ ID NO: 1316263 - DNA, 15 bp, Homo sapiens
cttaacatgctgtgt

SEQ ID NO: 1316264 - DNA, 17 bp, Homo sapiens
cttaacatgctgtgtaa

SEQ ID NO: 1316265 - DNA, 16 bp, Homo sapiens
cttaatttggaaacta

SEQ ID NO: 1316266 - DNA, 21 bp, Homo sapiens
cttaatttggaaactaataaa

SEQ ID NO: 1316267 - DNA, 13 bp, Homo sapiens
cttagggtctcag

SEQ ID NO: 1316268 - DNA, 16 bp, Homo sapiens
cttagggtctcagggt

SEQ ID NO: 1316269 - DNA, 13 bp, Homo sapiens
cttagtttgtgaa

SEQ ID NO: 1316270 - DNA, 16 bp, Homo sapiens
cttattaatgctaagg

SEQ ID NO: 1316271 - DNA, 19 bp, Homo sapiens
cttattaatgctaagggca

SEQ ID NO: 1316272 - DNA, 19 bp, Homo sapiens
cttcaatcaacatctcttg

SEQ ID NO: 1316273 - DNA, 15 bp, Homo sapiens
cttcactccagacag

SEQ ID NO: 1316274 - DNA, 15 bp, Homo sapiens
cttcagtaaaaggac

SEQ ID NO: 1316275 - DNA, 13 bp, Homo sapiens
cttcatgccagtg

SEQ ID NO: 1316276 - DNA, 14 bp, Homo sapiens
cttcatgccagtgc

SEQ ID NO: 1316277 - DNA, 15 bp, Homo sapiens
cttcatgccagtgca

SEQ ID NO: 1316278 - DNA, 18 bp, Homo sapiens
cttcatgccagtgcatgc

SEQ ID NO: 1316279 - DNA, 12 bp, Homo sapiens
cttcattccatt

SEQ ID NO: 1316280 - DNA, 19 bp, Homo sapiens
cttccatatccgggtgctc

SEQ ID NO: 1316281 - DNA, 21 bp, Homo sapiens
cttccatatccgggtgctcaa

SEQ ID NO: 1316282 - DNA, 21 bp, Homo sapiens
cttcccctcccagccctgagg

SEQ ID NO: 1316283 - DNA, 14 bp, Homo sapiens
cttcctgcagacct

SEQ ID NO: 1316284 - DNA, 16 bp, Homo sapiens
cttcctgcagacctgg

SEQ ID NO: 1316285 - DNA, 18 bp, Homo sapiens
cttcctgcagacctggct

SEQ ID NO: 1316286 - DNA, 20 bp, Homo sapiens
cttcctgcagacctggctgg

SEQ ID NO: 1316287 - DNA, 18 bp, Homo sapiens
cttcctggggcccaaatg

SEQ ID NO: 1316288 - DNA, 13 bp, Homo sapiens
cttctaccctggg

SEQ ID NO: 1316289 - DNA, 15 bp, Homo sapiens
cttctaccctgggtc

SEQ ID NO: 1316290 - DNA, 17 bp, Homo sapiens
cttctaccctgggtcct

SEQ ID NO: 1316291 - DNA, 21 bp, Homo sapiens
cttctaccctgggtcctcggg

SEQ ID NO: 1316292 - DNA, 17 bp, Homo sapiens
cttctccaggcttcccc

SEQ ID NO: 1316293 - DNA, 14 bp, Homo sapiens
cttctcccaactca

SEQ ID NO: 1316294 - DNA, 17 bp, Homo sapiens
cttctcccaactcagcc

SEQ ID NO: 1316295 - DNA, 22 bp, Homo sapiens
cttctcccaactcagcctgttc

SEQ ID NO: 1316296 - DNA, 22 bp, Homo sapiens
cttctctcagaccgtcttcctc

SEQ ID NO: 1316297 - DNA, 23 bp, Homo sapiens
cttctctcagaccgtcttcctcc

SEQ ID NO: 1316298 - DNA, 10 bp, Homo sapiens
cttctgagtt

SEQ ID NO: 1316299 - DNA, 14 bp, Homo sapiens
cttctgtgcacctg

SEQ ID NO: 1316300 - DNA, 15 bp, Homo sapiens
cttctgtgcacctgg

SEQ ID NO: 1316301 - DNA, 17 bp, Homo sapiens
cttctgtgcacctgggc

SEQ ID NO: 1316302 - DNA, 16 bp, Homo sapiens
cttctgtttagtctcc

SEQ ID NO: 1316303 - DNA, 21 bp, Homo sapiens
cttcttcccacaaagaatata

SEQ ID NO: 1316304 - DNA, 15 bp, Homo sapiens
cttcttgctgcccac

SEQ ID NO: 1316305 - DNA, 15 bp, Homo sapiens
cttcttggcttcctg

SEQ ID NO: 1316306 - DNA, 16 bp, Homo sapiens
cttcttggcttcctgg

SEQ ID NO: 1316307 - DNA, 15 bp, Homo sapiens
cttctttatttttta

SEQ ID NO: 1316308 - DNA, 20 bp, Homo sapiens
cttgaaggccacatgtgaaa

SEQ ID NO: 1316309 - DNA, 15 bp, Homo sapiens
cttgacctctccagc

SEQ ID NO: 1316310 - DNA, 22 bp, Homo sapiens
cttgacctctccagcatcccag

SEQ ID NO: 1316311 - DNA, 23 bp, Homo sapiens
cttgcaaactatgagttcacatg

SEQ ID NO: 1316312 - DNA, 12 bp, Homo sapiens
cttgcacagagg

SEQ ID NO: 1316313 - DNA, 19 bp, Homo sapiens
cttgccatgaaggcacctg

SEQ ID NO: 1316314 - DNA, 17 bp, Homo sapiens
cttgccccaacccttct

SEQ ID NO: 1316315 - DNA, 18 bp, Homo sapiens
cttgccccaacccttctt

SEQ ID NO: 1316316 - DNA, 15 bp, Homo sapiens
cttgctctctgttct

SEQ ID NO: 1316317 - DNA, 18 bp, Homo sapiens
cttgctctctgttctctt

SEQ ID NO: 1316318 - DNA, 23 bp, Homo sapiens
gcccacaacgtcccctcaagccc

SEQ ID NO: 1316319 - DNA, 18 bp, Homo sapiens
gcccacacctcctggggc

SEQ ID NO: 1316320 - DNA, 18 bp, Homo sapiens
gcccagacctggcctctg

SEQ ID NO: 1316321 - DNA, 23 bp, Homo sapiens
gcccagacctggcctctgccatc

SEQ ID NO: 1316322 - DNA, 13 bp, Homo sapiens
gcccagcctctgc

SEQ ID NO: 1316323 - DNA, 21 bp, Homo sapiens
gcccagcctctgccccaccca

SEQ ID NO: 1316324 - DNA, 12 bp, Homo sapiens
gcccaggcaggc

SEQ ID NO: 1316325 - DNA, 22 bp, Homo sapiens
gcccaggcaggcccagcctctg

SEQ ID NO: 1316326 - DNA, 19 bp, Homo sapiens
gcccatgagagcgcagccc

SEQ ID NO: 1316327 - DNA, 20 bp, Homo sapiens
gcccatgagagcgcagcccg

SEQ ID NO: 1316328 - DNA, 14 bp, Homo sapiens
gcccatgggaggga

SEQ ID NO: 1316329 - DNA, 19 bp, Homo sapiens
gcccattgctgcaaatgca

SEQ ID NO: 1316330 - DNA, 17 bp, Homo sapiens
gccccaacccttcttca

SEQ ID NO: 1316331 - DNA, 19 bp, Homo sapiens
gccccaagactctgctctc

SEQ ID NO: 1316332 - DNA, 16 bp, Homo sapiens
gccccagggtctgaaa

SEQ ID NO: 1316333 - DNA, 22 bp, Homo sapiens
gccccagggtctgaaaggggtg

SEQ ID NO: 1316334 - DNA, 23 bp, Homo sapiens
gccccagggtctgaaaggggtgt

SEQ ID NO: 1316335 - DNA, 14 bp, Homo sapiens
gccccgccatggtc

SEQ ID NO: 1316336 - DNA, 16 bp, Homo sapiens
gcccctcagccaccct

SEQ ID NO: 1316337 - DNA, 17 bp, Homo sapiens
gcccctgggactaaagc

SEQ ID NO: 1316338 - DNA, 15 bp, Homo sapiens
gcccgatccagattc

SEQ ID NO: 1316339 - DNA, 21 bp, Homo sapiens
gcccgtagatcatccccgagg

SEQ ID NO: 1316340 - DNA, 15 bp, Homo sapiens
gcccgtggggccggg

SEQ ID NO: 1316341 - DNA, 19 bp, Homo sapiens
gcccgtggggccggggctt

SEQ ID NO: 1316342 - DNA, 22 bp, Homo sapiens
gcccgtggggccggggcttctg

SEQ ID NO: 1316343 - DNA, 12 bp, Homo sapiens
gccctgaggggt

SEQ ID NO: 1316344 - DNA, 14 bp, Homo sapiens
gccctgttgacctg

SEQ ID NO: 1316345 - DNA, 20 bp, Homo sapiens
gcctaaagcccattgctgca

SEQ ID NO: 1316346 - DNA, 12 bp, Homo sapiens
gcctaataaaac

SEQ ID NO: 1316347 - DNA, 17 bp, Homo sapiens
gcctaataaaactgatg

SEQ ID NO: 1316348 - DNA, 21 bp, Homo sapiens
gcctaataaaactgatgtgaa

SEQ ID NO: 1316349 - DNA, 23 bp, Homo sapiens
gcctaataaaactgatgtgaaac

SEQ ID NO: 1316350 - DNA, 20 bp, Homo sapiens
gcctcaactctgctgagggt

SEQ ID NO: 1316351 - DNA, 18 bp, Homo sapiens
gcctcacaaatgctgtgg

SEQ ID NO: 1316352 - DNA, 21 bp, Homo sapiens
gcctcagaagccttcttgctg

SEQ ID NO: 1316353 - DNA, 22 bp, Homo sapiens
gcctcagaagccttcttgctgc

SEQ ID NO: 1316354 - DNA, 23 bp, Homo sapiens
gcctcagaagccttcttgctgcc

SEQ ID NO: 1316355 - DNA, 19 bp, Homo sapiens
gcctcggctggctcccctg

SEQ ID NO: 1316356 - DNA, 22 bp, Homo sapiens
gcctcggctggctcccctgcag

SEQ ID NO: 1316357 - DNA, 14 bp, Homo sapiens
gcctctctccacta

SEQ ID NO: 1316358 - DNA, 18 bp, Homo sapiens
gcctctctccactacccc

SEQ ID NO: 1316359 - DNA, 21 bp, Homo sapiens
gcctctgccatcctccctgtt

SEQ ID NO: 1316360 - DNA, 14 bp, Homo sapiens
gcctgcaggccagt

SEQ ID NO: 1316361 - DNA, 15 bp, Homo sapiens
gcctgccatggctgt

SEQ ID NO: 1316362 - DNA, 17 bp, Homo sapiens
gcctgccatggctgtga

SEQ ID NO: 1316363 - DNA, 23 bp, Homo sapiens
gcctgctggagaaaccttcactc

SEQ ID NO: 1316364 - DNA, 14 bp, Homo sapiens
gcctggcctcaact

SEQ ID NO: 1316365 - DNA, 15 bp, Homo sapiens
gcctggctcccctgg

SEQ ID NO: 1316366 - DNA, 16 bp, Homo sapiens
gcctggctcccctggg

SEQ ID NO: 1316367 - DNA, 15 bp, Homo sapiens
gcctgggcccctcag

SEQ ID NO: 1316368 - DNA, 16 bp, Homo sapiens
gcctgggcccctcagc

SEQ ID NO: 1316369 - DNA, 15 bp, Homo sapiens
gcctgtcccactggc

SEQ ID NO: 1316370 - DNA, 12 bp, Homo sapiens
gcctgtgtcctg

SEQ ID NO: 1316371 - DNA, 13 bp, Homo sapiens
gcctgtgtcctga

SEQ ID NO: 1316372 - DNA, 15 bp, Homo sapiens
gcctgttccttcctg

SEQ ID NO: 1316373 - DNA, 16 bp, Homo sapiens
gcctgttccttcctgc

SEQ ID NO: 1316374 - DNA, 18 bp, Homo sapiens
gcctgttccttcctgcag

SEQ ID NO: 1316375 - DNA, 20 bp, Homo sapiens
gcctgttccttcctgcagac

SEQ ID NO: 1316376 - DNA, 23 bp, Homo sapiens
gcctgttccttcctgcagacctg

SEQ ID NO: 1316377 - DNA, 18 bp, Homo sapiens
gcctgtttttgtgagaga

SEQ ID NO: 1316378 - DNA, 20 bp, Homo sapiens
gccttctccaggcttcccct

SEQ ID NO: 1316379 - DNA, 16 bp, Homo sapiens
gcgcagcccgcggcaa

SEQ ID NO: 1316380 - DNA, 21 bp, Homo sapiens
gcgcctcaactctgctgaggg

SEQ ID NO: 1316381 - DNA, 14 bp, Homo sapiens
gcgctcagatgccg

SEQ ID NO: 1316382 - DNA, 18 bp, Homo sapiens
gcggcctcttctctcaga

SEQ ID NO: 1316383 - DNA, 19 bp, Homo sapiens
gcggcctcttctctcagac

SEQ ID NO: 1316384 - DNA, 14 bp, Homo sapiens
gcggggcctgcagg

SEQ ID NO: 1316385 - DNA, 15 bp, Homo sapiens
gcggggcctgcaggc

SEQ ID NO: 1316386 - DNA, 18 bp, Homo sapiens
gcggggcctgcaggccag

SEQ ID NO: 1316387 - DNA, 19 bp, Homo sapiens
gcggggcctgcaggccagt

SEQ ID NO: 1316388 - DNA, 12 bp, Homo sapiens
gctaagctgcag

SEQ ID NO: 1316389 - DNA, 21 bp, Homo sapiens
gctaaggggctagggctgagc

SEQ ID NO: 1316390 - DNA, 23 bp, Homo sapiens
gctaataaaatatcattcagcaa

SEQ ID NO: 1316391 - DNA, 22 bp, Homo sapiens
gctacagttgggaagtctcagc

SEQ ID NO: 1316392 - DNA, 15 bp, Homo sapiens
gctaccttgccccaa

SEQ ID NO: 1316393 - DNA, 20 bp, Homo sapiens
gctactgaaaaaaatggagt

SEQ ID NO: 1316394 - DNA, 19 bp, Homo sapiens
ccaatctggctggtaaatg

SEQ ID NO: 1316395 - DNA, 22 bp, Homo sapiens
ccacaacgtcccctcaagcccc

SEQ ID NO: 1316396 - DNA, 15 bp, Homo sapiens
ccacacctcctgggg

SEQ ID NO: 1316397 - DNA, 14 bp, Homo sapiens
ccacaggtcctcca

SEQ ID NO: 1316398 - DNA, 17 bp, Homo sapiens
ccaccaccccacccacc

SEQ ID NO: 1316399 - DNA, 20 bp, Homo sapiens
ccacccatcagtggagtcca

SEQ ID NO: 1316400 - DNA, 18 bp, Homo sapiens
ccaccctctccacaccca

SEQ ID NO: 1316401 - DNA, 23 bp, Homo sapiens
ccaccctctccacacccagcctg

SEQ ID NO: 1316402 - DNA, 20 bp, Homo sapiens
ccacctatccaccaccccac

SEQ ID NO: 1316403 - DNA, 21 bp, Homo sapiens
ccaccttctcacatggaatga

SEQ ID NO: 1316404 - DNA, 12 bp, Homo sapiens
ccactcctcagt

SEQ ID NO: 1316405 - DNA, 22 bp, Homo sapiens
ccactcctcagtaaaagtcttc

SEQ ID NO: 1316406 - DNA, 12 bp, Homo sapiens
ccactgaagagg

SEQ ID NO: 1316407 - DNA, 14 bp, Homo sapiens
ccactgaagaggag

SEQ ID NO: 1316408 - DNA, 20 bp, Homo sapiens
ccactggctcctcccagcac

SEQ ID NO: 1316409 - DNA, 20 bp, Homo sapiens
ccagacagacagggggctaa

SEQ ID NO: 1316410 - DNA, 19 bp, Homo sapiens
ccagacctggcctctgcca

SEQ ID NO: 1316411 - DNA, 10 bp, Homo sapiens
ccagagaagg

SEQ ID NO: 1316412 - DNA, 14 bp, Homo sapiens
ccagattcccaggc

SEQ ID NO: 1316413 - DNA, 15 bp, Homo sapiens
ccagattcccaggcc

SEQ ID NO: 1316414 - DNA, 24 bp, Homo sapiens
ccagcatcccagcctcagaagcct

SEQ ID NO: 1316415 - DNA, 23 bp, Homo sapiens
ccagcccctagatgaagaaagag

SEQ ID NO: 1316416 - DNA, 13 bp, Homo sapiens
ccagccctgaggg

SEQ ID NO: 1316417 - DNA, 23 bp, Homo sapiens
ccagcctcagaagccttcttgct

SEQ ID NO: 1316418 - DNA, 12 bp, Homo sapiens
ccagcgtcctca

SEQ ID NO: 1316419 - DNA, 13 bp, Homo sapiens
ccagcgtcctcag

SEQ ID NO: 1316420 - DNA, 15 bp, Homo sapiens
ccagcgtcctcagca

SEQ ID NO: 1316421 - DNA, 20 bp, Homo sapiens
ccagcgtcctcagcacccca

SEQ ID NO: 1316422 - DNA, 11 bp, Homo sapiens
ccagctccccg

SEQ ID NO: 1316423 - DNA, 16 bp, Homo sapiens
ccagctctacattctg

SEQ ID NO: 1316424 - DNA, 15 bp, Homo sapiens
ccaggaaactgctac

SEQ ID NO: 1316425 - DNA, 14 bp, Homo sapiens
ccaggaacagggac

SEQ ID NO: 1316426 - DNA, 16 bp, Homo sapiens
ccaggaacagggacca

SEQ ID NO: 1316427 - DNA, 17 bp, Homo sapiens
ccaggaacagggaccag

SEQ ID NO: 1316428 - DNA, 21 bp, Homo sapiens
ccaggaagcacgttcactaga

SEQ ID NO: 1316429 - DNA, 14 bp, Homo sapiens
ccaggacagcacac

SEQ ID NO: 1316430 - DNA, 16 bp, Homo sapiens
ccaggagagcttaggg

SEQ ID NO: 1316431 - DNA, 23 bp, Homo sapiens
ccaggagagcttagggtctcagg

SEQ ID NO: 1316432 - DNA, 19 bp, Homo sapiens
ccaggagtaagcccaagct

SEQ ID NO: 1316433 - DNA, 15 bp, Homo sapiens
ccaggcaggcccagc

SEQ ID NO: 1316434 - DNA, 16 bp, Homo sapiens
ccaggcaggcccagcc

SEQ ID NO: 1316435 - DNA, 17 bp, Homo sapiens
ccaggcaggcccagcct

SEQ ID NO: 1316436 - DNA, 13 bp, Homo sapiens
ccaggccaggctc

SEQ ID NO: 1316437 - DNA, 19 bp, Homo sapiens
ccagggacagatccagcag

SEQ ID NO: 1316438 - DNA, 19 bp, Homo sapiens
ccagggtctgaaaggggtg

SEQ ID NO: 1316439 - DNA, 15 bp, Homo sapiens
ccaggtgcctcctga

SEQ ID NO: 1316440 - DNA, 23 bp, Homo sapiens
ccagtcccacggctctgtgcccg

SEQ ID NO: 1316441 - DNA, 19 bp, Homo sapiens
ccagtccgccgctgcacat

SEQ ID NO: 1316442 - DNA, 22 bp, Homo sapiens
ccagtggcggaagtgaccgcac

SEQ ID NO: 1316443 - DNA, 18 bp, Homo sapiens
ccatattttacttggaaa

SEQ ID NO: 1316444 - DNA, 14 bp, Homo sapiens
ccatcacagcttgt

SEQ ID NO: 1316445 - DNA, 19 bp, Homo sapiens
ccatcatggggggagcacc

SEQ ID NO: 1316446 - DNA, 22 bp, Homo sapiens
ccatcctccctgttccccacag

SEQ ID NO: 1316447 - DNA, 15 bp, Homo sapiens
ccatgaaggcacctg

SEQ ID NO: 1316448 - DNA, 16 bp, Homo sapiens
ccatgaaggcacctgc

SEQ ID NO: 1316449 - DNA, 16 bp, Homo sapiens
ccatgagtccatgtcc

SEQ ID NO: 1316450 - DNA, 22 bp, Homo sapiens
ccatgcctaaagcccattgctg

SEQ ID NO: 1316451 - DNA, 20 bp, Homo sapiens
ccatgctgagacatccctca

SEQ ID NO: 1316452 - DNA, 23 bp, Homo sapiens
ccatgctgagacatccctcatct

SEQ ID NO: 1316453 - DNA, 11 bp, Homo sapiens
ccatgggaggg

SEQ ID NO: 1316454 - DNA, 14 bp, Homo sapiens
ccatgggagggagc

SEQ ID NO: 1316455 - DNA, 17 bp, Homo sapiens
ccatgggagggagctga

SEQ ID NO: 1316456 - DNA, 20 bp, Homo sapiens
cccaacccttcttcatgttc

SEQ ID NO: 1316457 - DNA, 19 bp, Homo sapiens
cccaagctaagctgcaggc

SEQ ID NO: 1316458 - DNA, 12 bp, Homo sapiens
cccaatctggct

SEQ ID NO: 1316459 - DNA, 20 bp, Homo sapiens
cccacaacgtcccctcaagc

SEQ ID NO: 1316460 - DNA, 21 bp, Homo sapiens
cccacaacgtcccctcaagcc

SEQ ID NO: 1316461 - DNA, 16 bp, Homo sapiens
cccacacctcctgggg

SEQ ID NO: 1316462 - DNA, 16 bp, Homo sapiens
cccacagctccttgca

SEQ ID NO: 1316463 - DNA, 14 bp, Homo sapiens
cccacccacctttg

SEQ ID NO: 1316464 - DNA, 16 bp, Homo sapiens
cccacggctctgtgcc

SEQ ID NO: 1316465 - DNA, 12 bp, Homo sapiens
cccactggctcc

SEQ ID NO: 1316466 - DNA, 14 bp, Homo sapiens
cccactggctcctc

SEQ ID NO: 1316467 - DNA, 18 bp, Homo sapiens
cccactggctcctcccag

SEQ ID NO: 1316468 - DNA, 21 bp, Homo sapiens
cccactggctcctcccagcac

SEQ ID NO: 1316469 - DNA, 13 bp, Homo sapiens
cccagaccccgac

SEQ ID NO: 1316470 - DNA, 16 bp, Homo sapiens
cccagacctggcctct

SEQ ID NO: 1316471 - DNA, 18 bp, Homo sapiens
cccagacctggcctctgc

SEQ ID NO: 1316472 - DNA, 14 bp, Homo sapiens
cccagccctgaggg

SEQ ID NO: 1316473 - DNA, 15 bp, Homo sapiens
cccagcctcagaagc

SEQ ID NO: 1316474 - DNA, 22 bp, Homo sapiens
cccagcctcagaagccttcttg

SEQ ID NO: 1316475 - DNA, 13 bp, Homo sapiens
cccagcctgtccc

SEQ ID NO: 1316476 - DNA, 21 bp, Homo sapiens
cccagctctacattctgctct

SEQ ID NO: 1316477 - DNA, 23 bp, Homo sapiens
cccagctctacattctgctctgc

SEQ ID NO: 1316478 - DNA, 18 bp, Homo sapiens
cccaggacagcacacggt

SEQ ID NO: 1316479 - DNA, 16 bp, Homo sapiens
cccaggcaggcccagc

SEQ ID NO: 1316480 - DNA, 18 bp, Homo sapiens
cccaggcaggcccagcct

SEQ ID NO: 1316481 - DNA, 23 bp, Homo sapiens
cccaggcaggcccagcctctgcc

SEQ ID NO: 1316482 - DNA, 9 bp, Homo sapiens
cccagggtc

SEQ ID NO: 1316483 - DNA, 11 bp, Homo sapiens
cccagggtctg

SEQ ID NO: 1316484 - DNA, 12 bp, Homo sapiens
cccagggtctga

SEQ ID NO: 1316485 - DNA, 16 bp, Homo sapiens
cccatccacctatcca

SEQ ID NO: 1316486 - DNA, 15 bp, Homo sapiens
cccatcccgccttct

SEQ ID NO: 1316487 - DNA, 19 bp, Homo sapiens
cccatgagagcgcagcccg

SEQ ID NO: 1316488 - DNA, 20 bp, Homo sapiens
cccatgagagcgcagcccgc

SEQ ID NO: 1316489 - DNA, 12 bp, Homo sapiens
cccatttttccc

SEQ ID NO: 1316490 - DNA, 13 bp, Homo sapiens
ccccaacccttct

SEQ ID NO: 1316491 - DNA, 14 bp, Homo sapiens
ccccacagctcctt

SEQ ID NO: 1316492 - DNA, 15 bp, Homo sapiens
ccccacagctccttg

SEQ ID NO: 1316493 - DNA, 13 bp, Homo sapiens
ccccacccatcag

SEQ ID NO: 1316494 - DNA, 12 bp, Homo sapiens
ccccaccccaga

SEQ ID NO: 1316495 - DNA, 22 bp, Homo sapiens
ccccagggtctgaaaggggtgt

SEQ ID NO: 1316496 - DNA, 16 bp, Homo sapiens
cccccacagctccttg

SEQ ID NO: 1316497 - DNA, 22 bp, Homo sapiens
cccctagtccggttcttcttgt

SEQ ID NO: 1316498 - DNA, 14 bp, Homo sapiens
cccctcagccaccc

SEQ ID NO: 1316499 - DNA, 22 bp, Homo sapiens
cccctgagcctgtgtcctgaag

SEQ ID NO: 1316500 - DNA, 23 bp, Homo sapiens
cccctgggactaaagccaggaac

SEQ ID NO: 1316501 - DNA, 17 bp, Homo sapiens
cccgacaccggccagtg

SEQ ID NO: 1316502 - DNA, 20 bp, Homo sapiens
cccgattctttcagattgct

SEQ ID NO: 1316503 - DNA, 13 bp, Homo sapiens
cccgccccagggt

SEQ ID NO: 1316504 - DNA, 14 bp, Homo sapiens
cccgccccagggtc

SEQ ID NO: 1316505 - DNA, 15 bp, Homo sapiens
cccgccccagggtct

SEQ ID NO: 1316506 - DNA, 19 bp, Homo sapiens
cccgcccgtagatcatccc

SEQ ID NO: 1316507 - DNA, 18 bp, Homo sapiens
cccggtgccatcttccat

SEQ ID NO: 1316508 - DNA, 21 bp, Homo sapiens
cccgtggggccggggcttctg

SEQ ID NO: 1316509 - DNA, 17 bp, Homo sapiens
ccctagatgaagaaaga

SEQ ID NO: 1316510 - DNA, 19 bp, Homo sapiens
ccctagatgaagaaagaga

SEQ ID NO: 1316511 - DNA, 20 bp, Homo sapiens
ccctagtccggttcttcttg

SEQ ID NO: 1316512 - DNA, 16 bp, Homo sapiens
ccctcaagccccttct

SEQ ID NO: 1316513 - DNA, 12 bp, Homo sapiens
ccctcagccacc

SEQ ID NO: 1316514 - DNA, 19 bp, Homo sapiens
ccctcatccccacagtctt

SEQ ID NO: 1316515 - DNA, 13 bp, Homo sapiens
ccctcccagccct

SEQ ID NO: 1316516 - DNA, 16 bp, Homo sapiens
ccctcccagccctgag

SEQ ID NO: 1316517 - DNA, 18 bp, Homo sapiens
ccctcccagccctgaggg

SEQ ID NO: 1316518 - DNA, 17 bp, Homo sapiens
ccctctccacacccagc

SEQ ID NO: 1316519 - DNA, 19 bp, Homo sapiens
ccctctccacacccagcct

SEQ ID NO: 1316520 - DNA, 21 bp, Homo sapiens
ccctctccacacccagcctgt

SEQ ID NO: 1316521 - DNA, 18 bp, Homo sapiens
ccctgagcctgtgtcctg

SEQ ID NO: 1316522 - DNA, 22 bp, Homo sapiens
ccctgagcctgtgtcctgaaga

SEQ ID NO: 1316523 - DNA, 22 bp, Homo sapiens
ccctgggactaaagccaggaac

SEQ ID NO: 1316524 - DNA, 21 bp, Homo sapiens
ccctggtggctgcaggcaccg

SEQ ID NO: 1316525 - DNA, 16 bp, Homo sapiens
ccctggtgtgtaaata

SEQ ID NO: 1316526 - DNA, 18 bp, Homo sapiens
ccctgttccccacaggtc

SEQ ID NO: 1316527 - DNA, 12 bp, Homo sapiens
cccttcttcatg

SEQ ID NO: 1316528 - DNA, 22 bp, Homo sapiens
cccttggcccatcccgccttct

SEQ ID NO: 1316529 - DNA, 16 bp, Homo sapiens
cccttggtctcatgcc

SEQ ID NO: 1316530 - DNA, 17 bp, Homo sapiens
cccttggtctcatgccc

SEQ ID NO: 1316531 - DNA, 17 bp, Homo sapiens
ctccttcccagctctac

SEQ ID NO: 1316532 - DNA, 22 bp, Homo sapiens
ctcggctggctcccctgcagcc

SEQ ID NO: 1316533 - DNA, 23 bp, Homo sapiens
ctcggctggctcccctgcagccc

SEQ ID NO: 1316534 - DNA, 12 bp, Homo sapiens
ctcggggaataa

SEQ ID NO: 1316535 - DNA, 17 bp, Homo sapiens
ctcgtgatatgctgctt

SEQ ID NO: 1316536 - DNA, 13 bp, Homo sapiens
ctcgttttcaaag

SEQ ID NO: 1316537 - DNA, 19 bp, Homo sapiens
ctctacattctgctctgcc

SEQ ID NO: 1316538 - DNA, 16 bp, Homo sapiens
ctctagtactgtgaat

SEQ ID NO: 1316539 - DNA, 16 bp, Homo sapiens
ctctcaatccctttgc

SEQ ID NO: 1316540 - DNA, 17 bp, Homo sapiens
ctctcaatccctttgca

SEQ ID NO: 1316541 - DNA, 18 bp, Homo sapiens
ctctcagaccgtcttcct

SEQ ID NO: 1316542 - DNA, 19 bp, Homo sapiens
ctctcagaccgtcttcctc

SEQ ID NO: 1316543 - DNA, 21 bp, Homo sapiens
ctctcagaccgtcttcctcca

SEQ ID NO: 1316544 - DNA, 18 bp, Homo sapiens
ctctcagagcaagccttt

SEQ ID NO: 1316545 - DNA, 21 bp, Homo sapiens
ctctcagagcaagcctttgac

SEQ ID NO: 1316546 - DNA, 23 bp, Homo sapiens
ctctcagagcaagcctttgacct

SEQ ID NO: 1316547 - DNA, 16 bp, Homo sapiens
ctctccagcatcccag

SEQ ID NO: 1316548 - DNA, 17 bp, Homo sapiens
ctctccagcatcccagc

SEQ ID NO: 1316549 - DNA, 19 bp, Homo sapiens
ctctccagcatcccagcct

SEQ ID NO: 1316550 - DNA, 16 bp, Homo sapiens
ctctccggcctggcct

SEQ ID NO: 1316551 - DNA, 20 bp, Homo sapiens
ctctcctcgggccctgtggt

SEQ ID NO: 1316552 - DNA, 19 bp, Homo sapiens
ctctcgtgatatgctgctt

SEQ ID NO: 1316553 - DNA, 20 bp, Homo sapiens
ctctcgtgatatgctgcttg

SEQ ID NO: 1316554 - DNA, 22 bp, Homo sapiens
ctctcgtgatatgctgcttgtg

SEQ ID NO: 1316555 - DNA, 15 bp, Homo sapiens
ctctctccactaccc

SEQ ID NO: 1316556 - DNA, 14 bp, Homo sapiens
ctctctgaggcaag

SEQ ID NO: 1316557 - DNA, 16 bp, Homo sapiens
ctctctgttctcttgc

SEQ ID NO: 1316558 - DNA, 12 bp, Homo sapiens
ctctgaggcaag

SEQ ID NO: 1316559 - DNA, 17 bp, Homo sapiens
ctctgaggcaaggccca

SEQ ID NO: 1316560 - DNA, 18 bp, Homo sapiens
ctctgaggcaaggcccag

SEQ ID NO: 1316561 - DNA, 22 bp, Homo sapiens
ctctgaggcaaggcccagacct

SEQ ID NO: 1316562 - DNA, 24 bp, Homo sapiens
ctctgaggcaaggcccagacctgg

SEQ ID NO: 1316563 - DNA, 13 bp, Homo sapiens
ctctgccatcctc

SEQ ID NO: 1316564 - DNA, 17 bp, Homo sapiens
ctctgccatcctccctg

SEQ ID NO: 1316565 - DNA, 18 bp, Homo sapiens
ctctgccccacccatcag

SEQ ID NO: 1316566 - DNA, 22 bp, Homo sapiens
ctctgctctcctcgggccctgt

SEQ ID NO: 1316567 - DNA, 17 bp, Homo sapiens
ctctggaccatgctgag

SEQ ID NO: 1316568 - DNA, 19 bp, Homo sapiens
ctctggaccatgctgagac

SEQ ID NO: 1316569 - DNA, 19 bp, Homo sapiens
ctctgtgcccggtgccatc

SEQ ID NO: 1316570 - DNA, 16 bp, Homo sapiens
ctctgttctcttgctt

SEQ ID NO: 1316571 - DNA, 14 bp, Homo sapiens
ctcttctctcagac

SEQ ID NO: 1316572 - DNA, 21 bp, Homo sapiens
ctcttggggacatgggtcgcc

SEQ ID NO: 1316573 - DNA, 20 bp, Homo sapiens
ctgaagaatctcgactctcg

SEQ ID NO: 1316574 - DNA, 23 bp, Homo sapiens
ctgaagaatctcgactctcgtga

SEQ ID NO: 1316575 - DNA, 11 bp, Homo sapiens
ctgaagaggag

SEQ ID NO: 1316576 - DNA, 20 bp, Homo sapiens
ctgaagcttattaatgctaa

SEQ ID NO: 1316577 - DNA, 21 bp, Homo sapiens
ctgaagcttattaatgctaag

SEQ ID NO: 1316578 - DNA, 18 bp, Homo sapiens
ctgactctggaccatgct

SEQ ID NO: 1316579 - DNA, 19 bp, Homo sapiens
ctgactctggaccatgctg

SEQ ID NO: 1316580 - DNA, 16 bp, Homo sapiens
ctgagaagccaagcct

SEQ ID NO: 1316581 - DNA, 17 bp, Homo sapiens
ctgagaagccaagcctg

SEQ ID NO: 1316582 - DNA, 15 bp, Homo sapiens
ctgaggcaaggccca

SEQ ID NO: 1316583 - DNA, 18 bp, Homo sapiens
ctgaggcaaggcccagac

SEQ ID NO: 1316584 - DNA, 17 bp, Homo sapiens
ctgaggtggatttactg

SEQ ID NO: 1316585 - DNA, 23 bp, Homo sapiens
ctgaggtggatttactgagagaa

SEQ ID NO: 1316586 - DNA, 18 bp, Homo sapiens
ctgagtagctttacactg

SEQ ID NO: 1316587 - DNA, 17 bp, Homo sapiens
ctgagtttacgtggagg

SEQ ID NO: 1316588 - DNA, 20 bp, Homo sapiens
ctgatattaatttatcagat

SEQ ID NO: 1316589 - DNA, 23 bp, Homo sapiens
ctgatattaatttatcagattgc

SEQ ID NO: 1316590 - DNA, 15 bp, Homo sapiens
ctgatgtttgttttc

SEQ ID NO: 1316591 - DNA, 23 bp, Homo sapiens
ctgcacatccttcttggcttcct

SEQ ID NO: 1316592 - DNA, 16 bp, Homo sapiens
ctgcagacctggctgg

SEQ ID NO: 1316593 - DNA, 13 bp, Homo sapiens
ctgcagcctccct

SEQ ID NO: 1316594 - DNA, 17 bp, Homo sapiens
ctgcagctgggaagagg

SEQ ID NO: 1316595 - DNA, 18 bp, Homo sapiens
ctgcaggcacacacgcct

SEQ ID NO: 1316596 - DNA, 19 bp, Homo sapiens
ctgcaggcacacacgcctt

SEQ ID NO: 1316597 - DNA, 14 bp, Homo sapiens
ctgcaggcaccgct

SEQ ID NO: 1316598 - DNA, 15 bp, Homo sapiens
ctgccatcctccctg

SEQ ID NO: 1316599 - DNA, 13 bp, Homo sapiens
ctgccatggctgt

SEQ ID NO: 1316600 - DNA, 14 bp, Homo sapiens
ctgccatggctgtg

SEQ ID NO: 1316601 - DNA, 24 bp, Homo sapiens
ctgcccacaacgtcccctcaagcc

SEQ ID NO: 1316602 - DNA, 16 bp, Homo sapiens
ctgcccacacctcctg

SEQ ID NO: 1316603 - DNA, 17 bp, Homo sapiens
ctgcccacacctcctgg

SEQ ID NO: 1316604 - DNA, 19 bp, Homo sapiens
ctgcccacacctcctgggg

SEQ ID NO: 1316605 - DNA, 18 bp, Homo sapiens
ctgcccatgcctaaagcc

SEQ ID NO: 1316606 - DNA, 14 bp, Homo sapiens
ctgccccacccatc

SEQ ID NO: 1316607 - DNA, 20 bp, Homo sapiens
ctgcccccacagctccttgc

SEQ ID NO: 1316608 - DNA, 22 bp, Homo sapiens
ctgcccgatccagattcccagg

SEQ ID NO: 1316609 - DNA, 17 bp, Homo sapiens
ctgccttgaacaaccca

SEQ ID NO: 1316610 - DNA, 24 bp, Homo sapiens
ctgcgtgccatgagtccatgtcct

SEQ ID NO: 1316611 - DNA, 24 bp, Homo sapiens
ctgctacttgtggacctcaccaga

SEQ ID NO: 1316612 - DNA, 14 bp, Homo sapiens
ctgctctcctcggg

SEQ ID NO: 1316613 - DNA, 15 bp, Homo sapiens
ctgctctcctcgggc

SEQ ID NO: 1316614 - DNA, 18 bp, Homo sapiens
ctgctctcctcgggccct

SEQ ID NO: 1316615 - DNA, 24 bp, Homo sapiens
ctgctctcctcgggccctgtggtg

SEQ ID NO: 1316616 - DNA, 11 bp, Homo sapiens
ctgctggctga

SEQ ID NO: 1316617 - DNA, 14 bp, Homo sapiens
ctgcttgtgacctt

SEQ ID NO: 1316618 - DNA, 19 bp, Homo sapiens
ctgcttgtgaccttgactt

SEQ ID NO: 1316619 - DNA, 19 bp, Homo sapiens
ctggaactgcaactccagc

SEQ ID NO: 1316620 - DNA, 22 bp, Homo sapiens
ctggaaggaggaagaatagggc

SEQ ID NO: 1316621 - DNA, 18 bp, Homo sapiens
ctggaagttaaagtgagg

SEQ ID NO: 1316622 - DNA, 19 bp, Homo sapiens
ctggaagttaaagtgaggc

SEQ ID NO: 1316623 - DNA, 12 bp, Homo sapiens
ctggaccatgct

SEQ ID NO: 1316624 - DNA, 14 bp, Homo sapiens
ctggagtaggcctg

SEQ ID NO: 1316625 - DNA, 13 bp, Homo sapiens
ctggatagtgaag

SEQ ID NO: 1316626 - DNA, 13 bp, Homo sapiens
ctggcccatcatg

SEQ ID NO: 1316627 - DNA, 11 bp, Homo sapiens
ctggcctctgc

SEQ ID NO: 1316628 - DNA, 21 bp, Homo sapiens
ctggccttgtggtccaaatag

SEQ ID NO: 1316629 - DNA, 17 bp, Homo sapiens
ctggctcccctgcagcc

SEQ ID NO: 1316630 - DNA, 19 bp, Homo sapiens
ctggctcccctgcagccct

SEQ ID NO: 1316631 - DNA, 16 bp, Homo sapiens
ctggctcccctggggt

SEQ ID NO: 1316632 - DNA, 15 bp, Homo sapiens
ctggctcctcccagc

SEQ ID NO: 1316633 - DNA, 19 bp, Homo sapiens
ctggctggccttgtggtcc

SEQ ID NO: 1316634 - DNA, 21 bp, Homo sapiens
ctggctggccttgtggtccaa

SEQ ID NO: 1316635 - DNA, 16 bp, Homo sapiens
ctggctgggcctgggc

SEQ ID NO: 1316636 - DNA, 23 bp, Homo sapiens
ctggcttgctcccgccccagggt

SEQ ID NO: 1316637 - DNA, 19 bp, Homo sapiens
ctgggactaaagccaggaa

SEQ ID NO: 1316638 - DNA, 15 bp, Homo sapiens
ctgggagatgctctc

SEQ ID NO: 1316639 - DNA, 22 bp, Homo sapiens
ctgggagatgctctctgaggca

SEQ ID NO: 1316640 - DNA, 15 bp, Homo sapiens
ctgggcccctcagcc

SEQ ID NO: 1316641 - DNA, 16 bp, Homo sapiens
ctgggcccctcagcca

SEQ ID NO: 1316642 - DNA, 13 bp, Homo sapiens
ctgggcctgggct

SEQ ID NO: 1316643 - DNA, 20 bp, Homo sapiens
ctgggcttccacagtgtgaa

SEQ ID NO: 1316644 - DNA, 18 bp, Homo sapiens
ctggggcctaataaaact

SEQ ID NO: 1316645 - DNA, 17 bp, Homo sapiens
ctggggcgcgtgaggcc

SEQ ID NO: 1316646 - DNA, 22 bp, Homo sapiens
ctggggtcattttgactggctt

SEQ ID NO: 1316647 - DNA, 23 bp, Homo sapiens
ctggggtcattttgactggcttg

SEQ ID NO: 1316648 - DNA, 14 bp, Homo sapiens
ctgggttctgactc

SEQ ID NO: 1316649 - DNA, 17 bp, Homo sapiens
ctggtcacacaaggaac

SEQ ID NO: 1316650 - DNA, 20 bp, Homo sapiens
ctggtcacacaaggaactct

SEQ ID NO: 1316651 - DNA, 20 bp, Homo sapiens
ctggtgatgcgcagttgctg

SEQ ID NO: 1316652 - DNA, 18 bp, Homo sapiens
ctggtggctgcaggcacc

SEQ ID NO: 1316653 - DNA, 20 bp, Homo sapiens
ctggttcctaggggaatgag

SEQ ID NO: 1316654 - DNA, 23 bp, Homo sapiens
ctggttcctaggggaatgagggg

SEQ ID NO: 1316655 - DNA, 19 bp, Homo sapiens
ctgtcagttcagaaaaaat

SEQ ID NO: 1316656 - DNA, 21 bp, Homo sapiens
ctgtcccactggctcctccca

SEQ ID NO: 1316657 - DNA, 23 bp, Homo sapiens
ctgtgatttctgtgccattttct

SEQ ID NO: 1316658 - DNA, 12 bp, Homo sapiens
ctgtgcaggccc

SEQ ID NO: 1316659 - DNA, 13 bp, Homo sapiens
ctgtgcaggccca

SEQ ID NO: 1316660 - DNA, 20 bp, Homo sapiens
ctgtgcaggcccaggcaggc

SEQ ID NO: 1316661 - DNA, 21 bp, Homo sapiens
ctgtgcaggcccaggcaggcc

SEQ ID NO: 1316662 - DNA, 18 bp, Homo sapiens
ctgtgccattttctgtaa

SEQ ID NO: 1316663 - DNA, 19 bp, Homo sapiens
ctgtgccattttctgtaaa

SEQ ID NO: 1316664 - DNA, 21 bp, Homo sapiens
ctgtgcccggtgccatcttcc

SEQ ID NO: 1316665 - DNA, 23 bp, Homo sapiens
ctgtgcttgttgaatgtcaatca

SEQ ID NO: 1316666 - DNA, 16 bp, Homo sapiens
ggaacagggaccagct

SEQ ID NO: 1316667 - DNA, 20 bp, Homo sapiens
ggaaggaaatctggcccttg

SEQ ID NO: 1316668 - DNA, 17 bp, Homo sapiens
ggaagttaaagtgaggc

SEQ ID NO: 1316669 - DNA, 16 bp, Homo sapiens
ggaataaggagctggg

SEQ ID NO: 1316670 - DNA, 17 bp, Homo sapiens
ggaatgactttgaagta

SEQ ID NO: 1316671 - DNA, 22 bp, Homo sapiens
ggaatgatttctatgaacttgt

SEQ ID NO: 1316672 - DNA, 19 bp, Homo sapiens
ggacacttaattctgttct

SEQ ID NO: 1316673 - DNA, 21 bp, Homo sapiens
ggacatgggtcgcccatgaga

SEQ ID NO: 1316674 - DNA, 17 bp, Homo sapiens
ggacatgtactgagaca

SEQ ID NO: 1316675 - DNA, 23 bp, Homo sapiens
ggaccacgtctatttcatcagaa

SEQ ID NO: 1316676 - DNA, 12 bp, Homo sapiens
ggaccagctccc

SEQ ID NO: 1316677 - DNA, 13 bp, Homo sapiens
ggactaggcccta

SEQ ID NO: 1316678 - DNA, 22 bp, Homo sapiens
ggactgtgggtttgtgggggga

SEQ ID NO: 1316679 - DNA, 16 bp, Homo sapiens
ggagaaaccttcactc

SEQ ID NO: 1316680 - DNA, 16 bp, Homo sapiens
ggagaaccacctaccc

SEQ ID NO: 1316681 - DNA, 11 bp, Homo sapiens
ggagacagagg

SEQ ID NO: 1316682 - DNA, 19 bp, Homo sapiens
ggagacagagggaggacct

SEQ ID NO: 1316683 - DNA, 19 bp, Homo sapiens
ggagagcttagggtctcag

SEQ ID NO: 1316684 - DNA, 17 bp, Homo sapiens
ggagatgctctctgagg

SEQ ID NO: 1316685 - DNA, 12 bp, Homo sapiens
ggaggaggaggg

SEQ ID NO: 1316686 - DNA, 17 bp, Homo sapiens
ggaggctgactcctggt

SEQ ID NO: 1316687 - DNA, 14 bp, Homo sapiens
ggagggtcatgtac

SEQ ID NO: 1316688 - DNA, 23 bp, Homo sapiens
ggagggtttggttagctcacagg

SEQ ID NO: 1316689 - DNA, 16 bp, Homo sapiens
ggagtaagcccaagct

SEQ ID NO: 1316690 - DNA, 12 bp, Homo sapiens
ggataacaccac

SEQ ID NO: 1316691 - DNA, 18 bp, Homo sapiens
ggatagcgaatgcactca

SEQ ID NO: 1316692 - DNA, 21 bp, Homo sapiens
ggatagtttgggggaacttgt

SEQ ID NO: 1316693 - DNA, 22 bp, Homo sapiens
ggatatctgttagatgctacta

SEQ ID NO: 1316694 - DNA, 16 bp, Homo sapiens
ggatatgctttaagac

SEQ ID NO: 1316695 - DNA, 18 bp, Homo sapiens
ggcaacgattcacagcct

SEQ ID NO: 1316696 - DNA, 11 bp, Homo sapiens
ggcaaggccca

SEQ ID NO: 1316697 - DNA, 12 bp, Homo sapiens
ggcaaggcccag

SEQ ID NO: 1316698 - DNA, 19 bp, Homo sapiens
ggcaaggcccagacctggc

SEQ ID NO: 1316699 - DNA, 20 bp, Homo sapiens
ggcacacacgccttcatgcc

SEQ ID NO: 1316700 - DNA, 22 bp, Homo sapiens
ggcacacacgccttcatgccag

SEQ ID NO: 1316701 - DNA, 20 bp, Homo sapiens
ggcacctgcccccacagctc

SEQ ID NO: 1316702 - DNA, 16 bp, Homo sapiens
ggcaggtagatcactt

SEQ ID NO: 1316703 - DNA, 20 bp, Homo sapiens
ggcatcatcaataaaacagt

SEQ ID NO: 1316704 - DNA, 19 bp, Homo sapiens
ggcattgcctcggctggct

SEQ ID NO: 1316705 - DNA, 19 bp, Homo sapiens
ggcatttgtaaatattaaa

SEQ ID NO: 1316706 - DNA, 15 bp, Homo sapiens
ggccaactcaccctt

SEQ ID NO: 1316707 - DNA, 15 bp, Homo sapiens
ggccaccccttgctc

SEQ ID NO: 1316708 - DNA, 15 bp, Homo sapiens
ggccactgaagagga

SEQ ID NO: 1316709 - DNA, 17 bp, Homo sapiens
ggccactgaagaggagg

SEQ ID NO: 1316710 - DNA, 19 bp, Homo sapiens
ggccactgaagaggaggag

SEQ ID NO: 1316711 - DNA, 22 bp, Homo sapiens
ggccaggagtaagcccaagcta

SEQ ID NO: 1316712 - DNA, 13 bp, Homo sapiens
ggccaggctcccg

SEQ ID NO: 1316713 - DNA, 16 bp, Homo sapiens
ggccaggtgcctcctg

SEQ ID NO: 1316714 - DNA, 20 bp, Homo sapiens
ggccagtcccacggctctgt

SEQ ID NO: 1316715 - DNA, 15 bp, Homo sapiens
ggcccagacctggcc

SEQ ID NO: 1316716 - DNA, 16 bp, Homo sapiens
ggcccagacctggcct

SEQ ID NO: 1316717 - DNA, 21 bp, Homo sapiens
ggcccagacctggcctctgcc

SEQ ID NO: 1316718 - DNA, 22 bp, Homo sapiens
ggcccagacctggcctctgcca

SEQ ID NO: 1316719 - DNA, 13 bp, Homo sapiens
ggcccagcctctg

SEQ ID NO: 1316720 - DNA, 20 bp, Homo sapiens
ggcccaggcaggcccagcct

SEQ ID NO: 1316721 - DNA, 21 bp, Homo sapiens
ggcccatcccgccttctccag

SEQ ID NO: 1316722 - DNA, 16 bp, Homo sapiens
ggcccatgggagggag

SEQ ID NO: 1316723 - DNA, 13 bp, Homo sapiens
ggcccctcagcca

SEQ ID NO: 1316724 - DNA, 14 bp, Homo sapiens
ggcccctcagccac

SEQ ID NO: 1316725 - DNA, 14 bp, Homo sapiens
ggcccctgagcctg

SEQ ID NO: 1316726 - DNA, 20 bp, Homo sapiens
ggccctacacacagaccgcg

SEQ ID NO: 1316727 - DNA, 17 bp, Homo sapiens
ggccctgtggtgctggg

SEQ ID NO: 1316728 - DNA, 20 bp, Homo sapiens
ggcctctgccatcctccctg

SEQ ID NO: 1316729 - DNA, 18 bp, Homo sapiens
ggcctcttctctcagacc

SEQ ID NO: 1316730 - DNA, 20 bp, Homo sapiens
ggcctgaaatcctggttcct

SEQ ID NO: 1316731 - DNA, 15 bp, Homo sapiens
ggcctgcaggccagt

SEQ ID NO: 1316732 - DNA, 19 bp, Homo sapiens
ggcctgggcttccacagtg

SEQ ID NO: 1316733 - DNA, 21 bp, Homo sapiens
ggccttcccctcccagccctg

SEQ ID NO: 1316734 - DNA, 15 bp, Homo sapiens
ggccttgtggtccaa

SEQ ID NO: 1316735 - DNA, 22 bp, Homo sapiens
ggcgggggcaacgattcacagc

SEQ ID NO: 1316736 - DNA, 21 bp, Homo sapiens
ggctatagatgggactgtgtc

SEQ ID NO: 1316737 - DNA, 20 bp, Homo sapiens
ggctcaggagagggccttcc

SEQ ID NO: 1316738 - DNA, 22 bp, Homo sapiens
ggctcaggagagggccttcccc

SEQ ID NO: 1316739 - DNA, 15 bp, Homo sapiens
ggctcccctgcagcc

SEQ ID NO: 1316740 - DNA, 11 bp, Homo sapiens
ggctcccctgg

SEQ ID NO: 1316741 - DNA, 20 bp, Homo sapiens
ggctcctcccagcacaggca

SEQ ID NO: 1316742 - DNA, 21 bp, Homo sapiens
ggctcgatttttaagagcctt

SEQ ID NO: 1316743 - DNA, 21 bp, Homo sapiens
ggctctcgcggcctcttctct

SEQ ID NO: 1316744 - DNA, 21 bp, Homo sapiens
ggctctgtgcccggtgccatc

SEQ ID NO: 1316745 - DNA, 15 bp, Homo sapiens
ggctggaaggaggaa

SEQ ID NO: 1316746 - DNA, 16 bp, Homo sapiens
ggcttactcatggaca

SEQ ID NO: 1316747 - DNA, 13 bp, Homo sapiens
ggcttcccctccc

SEQ ID NO: 1316748 - DNA, 20 bp, Homo sapiens
ggcttctttctgctggctga

SEQ ID NO: 1316749 - DNA, 12 bp, Homo sapiens
gggaaaaaggct

SEQ ID NO: 1316750 - DNA, 15 bp, Homo sapiens
gggaagaggagcctg

SEQ ID NO: 1316751 - DNA, 11 bp, Homo sapiens
gggaatgaggg

SEQ ID NO: 1316752 - DNA, 13 bp, Homo sapiens
gggaatgaggggg

SEQ ID NO: 1316753 - DNA, 18 bp, Homo sapiens
gggacatgggtcgcccat

SEQ ID NO: 1316754 - DNA, 23 bp, Homo sapiens
gggagcacatagccctgttgacc

SEQ ID NO: 1316755 - DNA, 15 bp, Homo sapiens
gggagcaccctgagg

SEQ ID NO: 1316756 - DNA, 12 bp, Homo sapiens
gggatctcaggg

SEQ ID NO: 1316757 - DNA, 17 bp, Homo sapiens
gggcaacgattcacagc

SEQ ID NO: 1316758 - DNA, 19 bp, Homo sapiens
gggcaacgattcacagcct

SEQ ID NO: 1316759 - DNA, 18 bp, Homo sapiens
gggccctgtggtgctggg

SEQ ID NO: 1316760 - DNA, 17 bp, Homo sapiens
gggccggggcttctgtg

SEQ ID NO: 1316761 - DNA, 11 bp, Homo sapiens
gggcctgctgg

SEQ ID NO: 1316762 - DNA, 19 bp, Homo sapiens
gggccttcccctcccagcc

SEQ ID NO: 1316763 - DNA, 20 bp, Homo sapiens
gggccttcccctcccagccc

SEQ ID NO: 1316764 - DNA, 20 bp, Homo sapiens
gggcgcgtgaggcccgtggg

SEQ ID NO: 1316765 - DNA, 23 bp, Homo sapiens
gggcttctgtgcacctgggctct

SEQ ID NO: 1316766 - DNA, 18 bp, Homo sapiens
gggcttctttctgctggc

SEQ ID NO: 1316767 - DNA, 14 bp, Homo sapiens
ggggagcaccctga

SEQ ID NO: 1316768 - DNA, 18 bp, Homo sapiens
ggggcaacgattcacagc

SEQ ID NO: 1316769 - DNA, 18 bp, Homo sapiens
ggggcaccggctcaggag

SEQ ID NO: 1316770 - DNA, 18 bp, Homo sapiens
ggggcttctttctgctgg

SEQ ID NO: 1316771 - DNA, 21 bp, Homo sapiens
gggggcaacgattcacagcct

SEQ ID NO: 1316772 - DNA, 19 bp, Homo sapiens
gggggcaccggctcaggag

SEQ ID NO: 1316773 - DNA, 22 bp, Homo sapiens
ggggtgacctccggccaggtgc

SEQ ID NO: 1316774 - DNA, 18 bp, Homo sapiens
gggtcattttgactggct

SEQ ID NO: 1316775 - DNA, 21 bp, Homo sapiens
gggtcctcgggcccctgagcc

SEQ ID NO: 1316776 - DNA, 11 bp, Homo sapiens
gggtctgaaag

SEQ ID NO: 1316777 - DNA, 17 bp, Homo sapiens
gggtctgaaaggggtgt

SEQ ID NO: 1316778 - DNA, 16 bp, Homo sapiens
gggtgctcaataaact

SEQ ID NO: 1316779 - DNA, 11 bp, Homo sapiens
ggtaagggaag

SEQ ID NO: 1316780 - DNA, 22 bp, Homo sapiens
ggtagattttaagaatggtctc

SEQ ID NO: 1316781 - DNA, 13 bp, Homo sapiens
ggtcatgtacttc

SEQ ID NO: 1316782 - DNA, 21 bp, Homo sapiens
ggtctagaggcctgaaatcct

SEQ ID NO: 1316783 - DNA, 23 bp, Homo sapiens
ggtctcagtgttaatactgagaa

SEQ ID NO: 1316784 - DNA, 15 bp, Homo sapiens
ggtctcatgccccgc

SEQ ID NO: 1316785 - DNA, 22 bp, Homo sapiens
ggtctcatgccccgccatggtc

SEQ ID NO: 1316786 - DNA, 12 bp, Homo sapiens
ggtgagggtgcg

SEQ ID NO: 1316787 - DNA, 19 bp, Homo sapiens
ggtgctcaataaacttgtg

SEQ ID NO: 1316788 - DNA, 20 bp, Homo sapiens
ggtgctcaataaacttgtgc

SEQ ID NO: 1316789 - DNA, 21 bp, Homo sapiens
ggtggatttactgagagaagg

SEQ ID NO: 1316790 - DNA, 13 bp, Homo sapiens
ggtggctgcaggc

SEQ ID NO: 1316791 - DNA, 21 bp, Homo sapiens
ggtggctgcaggcaccgctgg

SEQ ID NO: 1316792 - DNA, 17 bp, Homo sapiens
ggttcaaacctgtgaag

SEQ ID NO: 1316793 - DNA, 17 bp, Homo sapiens
ggttcctaggggaatga

SEQ ID NO: 1316794 - DNA, 19 bp, Homo sapiens
ggttcctaggggaatgagg

SEQ ID NO: 1316795 - DNA, 20 bp, Homo sapiens
ggttctgactctggaccatg

SEQ ID NO: 1316796 - DNA, 12 bp, Homo sapiens
ggttctgtaaaa

SEQ ID NO: 1316797 - DNA, 20 bp, Homo sapiens
gtaaaagcaacatcagcttg

SEQ ID NO: 1316798 - DNA, 17 bp, Homo sapiens
catctcagtcctcaaag

SEQ ID NO: 1316799 - DNA, 12 bp, Homo sapiens
catcttgtttct

SEQ ID NO: 1316800 - DNA, 13 bp, Homo sapiens
catcttgtttctg

SEQ ID NO: 1316801 - DNA, 15 bp, Homo sapiens
catcttgtttctgag

SEQ ID NO: 1316802 - DNA, 15 bp, Homo sapiens
catgaaggcacctgc

SEQ ID NO: 1316803 - DNA, 17 bp, Homo sapiens
catgaaggcacctgccc

SEQ ID NO: 1316804 - DNA, 16 bp, Homo sapiens
catgagtccatgtcct

SEQ ID NO: 1316805 - DNA, 12 bp, Homo sapiens
catgccagtgca

SEQ ID NO: 1316806 - DNA, 22 bp, Homo sapiens
catgcctaaagcccattgctgc

SEQ ID NO: 1316807 - DNA, 18 bp, Homo sapiens
catgctgagacatccctc

SEQ ID NO: 1316808 - DNA, 20 bp, Homo sapiens
catggggggagcaccctgag

SEQ ID NO: 1316809 - DNA, 17 bp, Homo sapiens
catgggtcgcccatgag

SEQ ID NO: 1316810 - DNA, 22 bp, Homo sapiens
catgggtgggctctgatgcaga

SEQ ID NO: 1316811 - DNA, 19 bp, Homo sapiens
catgtactgagacaaaaag

SEQ ID NO: 1316812 - DNA, 23 bp, Homo sapiens
catgtactgagacaaaaaggaaa

SEQ ID NO: 1316813 - DNA, 17 bp, Homo sapiens
catgtcctatgcctcac

SEQ ID NO: 1316814 - DNA, 14 bp, Homo sapiens
catgtctgttgttg

SEQ ID NO: 1316815 - DNA, 23 bp, Homo sapiens
catgtctgttgttggtcatctct

SEQ ID NO: 1316816 - DNA, 12 bp, Homo sapiens
catgtgccctgc

SEQ ID NO: 1316817 - DNA, 13 bp, Homo sapiens
catgtgccctgcc

SEQ ID NO: 1316818 - DNA, 16 bp, Homo sapiens
catgtgccctgccttg

SEQ ID NO: 1316819 - DNA, 15 bp, Homo sapiens
cattaagggcctgct

SEQ ID NO: 1316820 - DNA, 18 bp, Homo sapiens
cattctgctctgcccatg

SEQ ID NO: 1316821 - DNA, 15 bp, Homo sapiens
cattctggtattcct

SEQ ID NO: 1316822 - DNA, 18 bp, Homo sapiens
cattgcctcggctggctc

SEQ ID NO: 1316823 - DNA, 21 bp, Homo sapiens
cattgtgaattgcctgccatg

SEQ ID NO: 1316824 - DNA, 18 bp, Homo sapiens
catttatggaacttccct

SEQ ID NO: 1316825 - DNA, 22 bp, Homo sapiens
catttatggaacttccctcccc

SEQ ID NO: 1316826 - DNA, 15 bp, Homo sapiens
cattttgactggctt

SEQ ID NO: 1316827 - DNA, 16 bp, Homo sapiens
cattttgactggcttg

SEQ ID NO: 1316828 - DNA, 16 bp, Homo sapiens
ccaacaccatcacagc

SEQ ID NO: 1316829 - DNA, 23 bp, Homo sapiens
ccaactcagcctgttccttcctg

SEQ ID NO: 1316830 - DNA, 14 bp, Homo sapiens
ccaagactctgctc

SEQ ID NO: 1316831 - DNA, 16 bp, Homo sapiens
ccaagactctgctctc

SEQ ID NO: 1316832 - DNA, 20 bp, Homo sapiens
ccaagcctggagtaggcctg

SEQ ID NO: 1316833 - DNA, 22 bp, Homo sapiens
ccgaccccatccacctatccac

SEQ ID NO: 1316834 - DNA, 22 bp, Homo sapiens
ccgatccagattcccaggccag

SEQ ID NO: 1316835 - DNA, 21 bp, Homo sapiens
ccgccatggtcaccctcagga

SEQ ID NO: 1316836 - DNA, 11 bp, Homo sapiens
ccgccccaggg

SEQ ID NO: 1316837 - DNA, 12 bp, Homo sapiens
ccgccccagggt

SEQ ID NO: 1316838 - DNA, 13 bp, Homo sapiens
ccgccccagggtc

SEQ ID NO: 1316839 - DNA, 19 bp, Homo sapiens
ccgcccgtagatcatcccc

SEQ ID NO: 1316840 - DNA, 13 bp, Homo sapiens
ccgccgctgcaca

SEQ ID NO: 1316841 - DNA, 14 bp, Homo sapiens
ccgccgctgcacat

SEQ ID NO: 1316842 - DNA, 13 bp, Homo sapiens
ccgccttctccag

SEQ ID NO: 1316843 - DNA, 14 bp, Homo sapiens
ccgcgcccctggga

SEQ ID NO: 1316844 - DNA, 19 bp, Homo sapiens
ccgcggcgggccctgccca

SEQ ID NO: 1316845 - DNA, 13 bp, Homo sapiens
ccgctgggttctg

SEQ ID NO: 1316846 - DNA, 23 bp, Homo sapiens
ccgctgggttctgactctggacc

SEQ ID NO: 1316847 - DNA, 21 bp, Homo sapiens
ccggagccccaagactctgct

SEQ ID NO: 1316848 - DNA, 18 bp, Homo sapiens
ccggccaggtgcctcctg

SEQ ID NO: 1316849 - DNA, 14 bp, Homo sapiens
ccggcctggccttt

SEQ ID NO: 1316850 - DNA, 18 bp, Homo sapiens
ccggtgccatcttccata

SEQ ID NO: 1316851 - DNA, 18 bp, Homo sapiens
ccgtagatcatccccgag

SEQ ID NO: 1316852 - DNA, 20 bp, Homo sapiens
ccgtggggccggggcttctg

SEQ ID NO: 1316853 - DNA, 16 bp, Homo sapiens
cctaataaaactgatg

SEQ ID NO: 1316854 - DNA, 21 bp, Homo sapiens
cctaataaaactgatgtgaaa

SEQ ID NO: 1316855 - DNA, 22 bp, Homo sapiens
cctaataaaactgatgtgaaac

SEQ ID NO: 1316856 - DNA, 23 bp, Homo sapiens
cctaataaaactgatgtgaaact

SEQ ID NO: 1316857 - DNA, 20 bp, Homo sapiens
cctacacacagaccgcgccc

SEQ ID NO: 1316858 - DNA, 14 bp, Homo sapiens
cctacccctgactt

SEQ ID NO: 1316859 - DNA, 17 bp, Homo sapiens
cctagatgaagaaagag

SEQ ID NO: 1316860 - DNA, 16 bp, Homo sapiens
cctaggctggaaggag

SEQ ID NO: 1316861 - DNA, 20 bp, Homo sapiens
cctagtccggttcttcttgt

SEQ ID NO: 1316862 - DNA, 13 bp, Homo sapiens
cctatccaccacc

SEQ ID NO: 1316863 - DNA, 17 bp, Homo sapiens
cctatccaccaccccac

SEQ ID NO: 1316864 - DNA, 22 bp, Homo sapiens
cctatgcctcacaaatgctgtg

SEQ ID NO: 1316865 - DNA, 14 bp, Homo sapiens
cctcaactctgctg

SEQ ID NO: 1316866 - DNA, 19 bp, Homo sapiens
cctcaactgagaagccaag

SEQ ID NO: 1316867 - DNA, 19 bp, Homo sapiens
cctcaagccccttctctca

SEQ ID NO: 1316868 - DNA, 17 bp, Homo sapiens
cctcaccagagaccagg

SEQ ID NO: 1316869 - DNA, 20 bp, Homo sapiens
cctcactctgctaccttgcc

SEQ ID NO: 1316870 - DNA, 20 bp, Homo sapiens
cctcagaagccttcttgctg

SEQ ID NO: 1316871 - DNA, 13 bp, Homo sapiens
cctcagccaccct

SEQ ID NO: 1316872 - DNA, 23 bp, Homo sapiens
cctcaggaacccaccctctccac

SEQ ID NO: 1316873 - DNA, 19 bp, Homo sapiens
cctcagtaaaagtcttctc

SEQ ID NO: 1316874 - DNA, 23 bp, Homo sapiens
cctcagtaaaagtcttctcccaa

SEQ ID NO: 1316875 - DNA, 14 bp, Homo sapiens
cctccccctagtcc

SEQ ID NO: 1316876 - DNA, 19 bp, Homo sapiens
cctccggccaggtgcctcc

SEQ ID NO: 1316877 - DNA, 20 bp, Homo sapiens
cctccggccaggtgcctcct

SEQ ID NO: 1316878 - DNA, 21 bp, Homo sapiens
cctccggccaggtgcctcctg

SEQ ID NO: 1316879 - DNA, 19 bp, Homo sapiens
cctcctgacacacctgcag

SEQ ID NO: 1316880 - DNA, 15 bp, Homo sapiens
cctcggctggctccc

SEQ ID NO: 1316881 - DNA, 16 bp, Homo sapiens
cctcggctggctcccc

SEQ ID NO: 1316882 - DNA, 22 bp, Homo sapiens
cctcggctggctcccctgcagc

SEQ ID NO: 1316883 - DNA, 16 bp, Homo sapiens
cctcgggcccctgagc

SEQ ID NO: 1316884 - DNA, 12 bp, Homo sapiens
cctcgggccctg

SEQ ID NO: 1316885 - DNA, 16 bp, Homo sapiens
cctcgttttcaaagat

SEQ ID NO: 1316886 - DNA, 13 bp, Homo sapiens
cctctccacaccc

SEQ ID NO: 1316887 - DNA, 19 bp, Homo sapiens
cctctccacacccagcctg

SEQ ID NO: 1316888 - DNA, 20 bp, Homo sapiens
cctctccacacccagcctgt

SEQ ID NO: 1316889 - DNA, 11 bp, Homo sapiens
cctctccagca

SEQ ID NO: 1316890 - DNA, 13 bp, Homo sapiens
cctctccagcatc

SEQ ID NO: 1316891 - DNA, 23 bp, Homo sapiens
cctctccagcatcccagcctcag

SEQ ID NO: 1316892 - DNA, 19 bp, Homo sapiens
cctctccggcctggccttt

SEQ ID NO: 1316893 - DNA, 17 bp, Homo sapiens
cctctgccatcctccct

SEQ ID NO: 1316894 - DNA, 15 bp, Homo sapiens
cctctgccccaccca

SEQ ID NO: 1316895 - DNA, 13 bp, Homo sapiens
cctcttctctcag

SEQ ID NO: 1316896 - DNA, 17 bp, Homo sapiens
cctgaaatcctggttcc

SEQ ID NO: 1316897 - DNA, 17 bp, Homo sapiens
cctgaatggagaataca

SEQ ID NO: 1316898 - DNA, 12 bp, Homo sapiens
cctgagcctgtg

SEQ ID NO: 1316899 - DNA, 16 bp, Homo sapiens
cctgagcctgtgtcct

SEQ ID NO: 1316900 - DNA, 17 bp, Homo sapiens
cctgagcctgtgtcctg

SEQ ID NO: 1316901 - DNA, 18 bp, Homo sapiens
cctgagcctgtgtcctga

SEQ ID NO: 1316902 - DNA, 21 bp, Homo sapiens
cctgagcctgtgtcctgaaga

SEQ ID NO: 1316903 - DNA, 19 bp, Homo sapiens
cctgcagacctggctgggc

SEQ ID NO: 1316904 - DNA, 17 bp, Homo sapiens
cctgcagcctccctccg

SEQ ID NO: 1316905 - DNA, 12 bp, Homo sapiens
cctgcaggccag

SEQ ID NO: 1316906 - DNA, 14 bp, Homo sapiens
cctgcaggccagtc

SEQ ID NO: 1316907 - DNA, 13 bp, Homo sapiens
cctgccatggctg

SEQ ID NO: 1316908 - DNA, 14 bp, Homo sapiens
cctgccatggctgt

SEQ ID NO: 1316909 - DNA, 19 bp, Homo sapiens
cctgcccacacctcctggg

SEQ ID NO: 1316910 - DNA, 13 bp, Homo sapiens
cctgcccccacag

SEQ ID NO: 1316911 - DNA, 18 bp, Homo sapiens
cctgcccccacagctcct

SEQ ID NO: 1316912 - DNA, 18 bp, Homo sapiens
cctggcctcaactgagaa

SEQ ID NO: 1316913 - DNA, 18 bp, Homo sapiens
cctggcctctgccatcct

SEQ ID NO: 1316914 - DNA, 15 bp, Homo sapiens
cctggcgccccctat

SEQ ID NO: 1316915 - DNA, 13 bp, Homo sapiens
cctggctcccctg

SEQ ID NO: 1316916 - DNA, 14 bp, Homo sapiens
cctggctcccctgg

SEQ ID NO: 1316917 - DNA, 15 bp, Homo sapiens
cctggctcccctggg

SEQ ID NO: 1316918 - DNA, 14 bp, Homo sapiens
cctggctgggcctg

SEQ ID NO: 1316919 - DNA, 19 bp, Homo sapiens
cctgggactaaagccagga

SEQ ID NO: 1316920 - DNA, 16 bp, Homo sapiens
cctgggcccctcagcc

SEQ ID NO: 1316921 - DNA, 18 bp, Homo sapiens
cctgggcccctcagccac

SEQ ID NO: 1316922 - DNA, 17 bp, Homo sapiens
cctggggcgcgtgaggc

SEQ ID NO: 1316923 - DNA, 18 bp, Homo sapiens
cctggggcgcgtgaggcc

SEQ ID NO: 1316924 - DNA, 13 bp, Homo sapiens
cctggggctatgc

SEQ ID NO: 1316925 - DNA, 15 bp, Homo sapiens
cctggggctatgcat

SEQ ID NO: 1316926 - DNA, 21 bp, Homo sapiens
cctgggtcctcgggcccctga

SEQ ID NO: 1316927 - DNA, 24 bp, Homo sapiens
cctggtcctaggctggaaggagga

SEQ ID NO: 1316928 - DNA, 13 bp, Homo sapiens
cctggtggctgca

SEQ ID NO: 1316929 - DNA, 16 bp, Homo sapiens
cctggtggctgcaggc

SEQ ID NO: 1316930 - DNA, 22 bp, Homo sapiens
cctgtcccactggctcctccca

SEQ ID NO: 1316931 - DNA, 16 bp, Homo sapiens
cctgtgatttctgtgc

SEQ ID NO: 1316932 - DNA, 15 bp, Homo sapiens
cctgtggtgctggga

SEQ ID NO: 1316933 - DNA, 14 bp, Homo sapiens
cctgttccccacag

SEQ ID NO: 1316934 - DNA, 17 bp, Homo sapiens
cctgttccccacaggtc

SEQ ID NO: 1316935 - DNA, 13 bp, Homo sapiens
cctgttccttcct

SEQ ID NO: 1316936 - DNA, 17 bp, Homo sapiens
cctgttccttcctgcag

SEQ ID NO: 1316937 - DNA, 19 bp, Homo sapiens
cctgttccttcctgcagac

SEQ ID NO: 1316938 - DNA, 22 bp, Homo sapiens
cctgttccttcctgcagacctg

SEQ ID NO: 1316939 - DNA, 13 bp, Homo sapiens
cctgttgacctgc

SEQ ID NO: 1316940 - DNA, 17 bp, Homo sapiens
cctgttgacctgcccga

SEQ ID NO: 1316941 - DNA, 13 bp, Homo sapiens
ccttaaaactagg

SEQ ID NO: 1316942 - DNA, 13 bp, Homo sapiens
ccttaaccctcaa

SEQ ID NO: 1316943 - DNA, 17 bp, Homo sapiens
ccttcactccagacaga

SEQ ID NO: 1316944 - DNA, 22 bp, Homo sapiens
ccttcatgccagtgcatgccag

SEQ ID NO: 1316945 - DNA, 13 bp, Homo sapiens
ccttcccagctct

SEQ ID NO: 1316946 - DNA, 15 bp, Homo sapiens
ccttcccctcccagc

SEQ ID NO: 1316947 - DNA, 16 bp, Homo sapiens
ccttcccctcccagcc

SEQ ID NO: 1316948 - DNA, 14 bp, Homo sapiens
ccttcctgcagacc

SEQ ID NO: 1316949 - DNA, 16 bp, Homo sapiens
ccttctaccctgggtc

SEQ ID NO: 1316950 - DNA, 17 bp, Homo sapiens
ccttctaccctgggtcc

SEQ ID NO: 1316951 - DNA, 20 bp, Homo sapiens
ccttctaccctgggtcctcg

SEQ ID NO: 1316952 - DNA, 22 bp, Homo sapiens
ccttctcacatggaatgagggt

SEQ ID NO: 1316953 - DNA, 16 bp, Homo sapiens
ccttcttgctgcccac

SEQ ID NO: 1316954 - DNA, 16 bp, Homo sapiens
ccttcttggcttcctg

SEQ ID NO: 1316955 - DNA, 23 bp, Homo sapiens
ccttgaacaacccaatctggctg

SEQ ID NO: 1316956 - DNA, 15 bp, Homo sapiens
ccttgctctctgttc

SEQ ID NO: 1316957 - DNA, 16 bp, Homo sapiens
ccttgctctctgttct

SEQ ID NO: 1316958 - DNA, 17 bp, Homo sapiens
ccttgctctctgttctc

SEQ ID NO: 1316959 - DNA, 22 bp, Homo sapiens
ccttgctctctgttctcttgct

SEQ ID NO: 1316960 - DNA, 19 bp, Homo sapiens
ccttggcccatcccgcctt

SEQ ID NO: 1316961 - DNA, 11 bp, Homo sapiens
ccttgtggtcc

SEQ ID NO: 1316962 - DNA, 22 bp, Homo sapiens
cctttagatagcagcctggctc

SEQ ID NO: 1316963 - DNA, 17 bp, Homo sapiens
cctttccaccttctcac

SEQ ID NO: 1316964 - DNA, 21 bp, Homo sapiens
cctttgcttcccttttttcct

SEQ ID NO: 1316965 - DNA, 12 bp, Homo sapiens
ccttttgctgtg

SEQ ID NO: 1316966 - DNA, 14 bp, Homo sapiens
ccttttgctgtgtg

SEQ ID NO: 1316967 - DNA, 16 bp, Homo sapiens
ccttttttcctttcca

SEQ ID NO: 1316968 - DNA, 20 bp, Homo sapiens
cgaagccacaggcctggcct

SEQ ID NO: 1316969 - DNA, 15 bp, Homo sapiens
cgagactttgtccca

SEQ ID NO: 1316970 - DNA, 18 bp, Homo sapiens
cgatccagattcccaggc

SEQ ID NO: 1316971 - DNA, 14 bp, Homo sapiens
cgattcacagcctc

SEQ ID NO: 1316972 - DNA, 15 bp, Homo sapiens
cgccatggtcaccct

SEQ ID NO: 1316973 - DNA, 17 bp, Homo sapiens
cgccatggtcaccctca

SEQ ID NO: 1316974 - DNA, 18 bp, Homo sapiens
cgccatggtcaccctcag

SEQ ID NO: 1316975 - DNA, 20 bp, Homo sapiens
cgccatggtcaccctcagga

SEQ ID NO: 1316976 - DNA, 12 bp, Homo sapiens
cgccccagggtc

SEQ ID NO: 1316977 - DNA, 13 bp, Homo sapiens
cgcccctgggact

SEQ ID NO: 1316978 - DNA, 22 bp, Homo sapiens
cgcccgtagatcatccccgagg

SEQ ID NO: 1316979 - DNA, 23 bp, Homo sapiens
cgcctggtgatgcgcagttgctg

SEQ ID NO: 1316980 - DNA, 13 bp, Homo sapiens
cgccttcatgcca

SEQ ID NO: 1316981 - DNA, 21 bp, Homo sapiens
cgccttcatgccagtgcatgc

SEQ ID NO: 1316982 - DNA, 19 bp, Homo sapiens
cgctgcgtgccatgagtcc

SEQ ID NO: 1316983 - DNA, 19 bp, Homo sapiens
cggagccccaagactctgc

SEQ ID NO: 1316984 - DNA, 18 bp, Homo sapiens
cggccaggtgcctcctga

SEQ ID NO: 1316985 - DNA, 19 bp, Homo sapiens
cggccaggtgcctcctgac

SEQ ID NO: 1316986 - DNA, 13 bp, Homo sapiens
cggcctcttctct

SEQ ID NO: 1316987 - DNA, 17 bp, Homo sapiens
cggcctcttctctcaga

SEQ ID NO: 1316988 - DNA, 12 bp, Homo sapiens
cggcctggcctt

SEQ ID NO: 1316989 - DNA, 18 bp, Homo sapiens
cggctcaggagagggcct

SEQ ID NO: 1316990 - DNA, 14 bp, Homo sapiens
cggctctgtgcccg

SEQ ID NO: 1316991 - DNA, 20 bp, Homo sapiens
cggctctgtgcccggtgcca

SEQ ID NO: 1316992 - DNA, 15 bp, Homo sapiens
cggctggctcccctg

SEQ ID NO: 1316993 - DNA, 21 bp, Homo sapiens
cggctggctcccctgcagccc

SEQ ID NO: 1316994 - DNA, 12 bp, Homo sapiens
cgggcccctgag

SEQ ID NO: 1316995 - DNA, 13 bp, Homo sapiens
cgggcccctgagc

SEQ ID NO: 1316996 - DNA, 12 bp, Homo sapiens
cgggccctgtgg

SEQ ID NO: 1316997 - DNA, 13 bp, Homo sapiens
cgggccctgtggt

SEQ ID NO: 1316998 - DNA, 14 bp, Homo sapiens
cggggcctgcaggc

SEQ ID NO: 1316999 - DNA, 18 bp, Homo sapiens
cggggcctgcaggccagt

SEQ ID NO: 1317000 - DNA, 20 bp, Homo sapiens
cgggggcaacgattcacagc

SEQ ID NO: 1317001 - DNA, 16 bp, Homo sapiens
cgggtgctcaataaac

SEQ ID NO: 1317002 - DNA, 15 bp, Homo sapiens
cgtcccctcaagccc

SEQ ID NO: 1317003 - DNA, 21 bp, Homo sapiens
cgtgatatgctgcttgtgacc

SEQ ID NO: 1317004 - DNA, 20 bp, Homo sapiens
cgtttatagcttcaggacct

SEQ ID NO: 1317005 - DNA, 12 bp, Homo sapiens
cgttttcaaaga

SEQ ID NO: 1317006 - DNA, 15 bp, Homo sapiens
ctaaaattttttcct

SEQ ID NO: 1317007 - DNA, 17 bp, Homo sapiens
ctaaagccaggaacagg

SEQ ID NO: 1317008 - DNA, 22 bp, Homo sapiens
ctaaagccaggaacagggacca

SEQ ID NO: 1317009 - DNA, 23 bp, Homo sapiens
ctaaagccaggaacagggaccag

SEQ ID NO: 1317010 - DNA, 12 bp, Homo sapiens
ctaaagcccatt

SEQ ID NO: 1317011 - DNA, 16 bp, Homo sapiens
ctaaagcccattgctg

SEQ ID NO: 1317012 - DNA, 13 bp, Homo sapiens
ctaacaggatggc

SEQ ID NO: 1317013 - DNA, 13 bp, Homo sapiens
ctaagaaaataga

SEQ ID NO: 1317014 - DNA, 12 bp, Homo sapiens
ctaataaaactg

SEQ ID NO: 1317015 - DNA, 14 bp, Homo sapiens
ctaataaaactgat

SEQ ID NO: 1317016 - DNA, 15 bp, Homo sapiens
ctaataaaactgatg

SEQ ID NO: 1317017 - DNA, 18 bp, Homo sapiens
ctaataaaactgatgtga

SEQ ID NO: 1317018 - DNA, 20 bp, Homo sapiens
ctaataaaactgatgtgaaa

SEQ ID NO: 1317019 - DNA, 11 bp, Homo sapiens
ctaataaaata

SEQ ID NO: 1317020 - DNA, 18 bp, Homo sapiens
ctaataaaatatcattca

SEQ ID NO: 1317021 - DNA, 23 bp, Homo sapiens
ctaataaaatatcattcagcaac

SEQ ID NO: 1317022 - DNA, 13 bp, Homo sapiens
ctaataaaatatt

SEQ ID NO: 1317023 - DNA, 14 bp, Homo sapiens
ctaataaaatattt

SEQ ID NO: 1317024 - DNA, 15 bp, Homo sapiens
ctaataaaatatttt

SEQ ID NO: 1317025 - DNA, 20 bp, Homo sapiens
ctaataaaatattttctgtg

SEQ ID NO: 1317026 - DNA, 23 bp, Homo sapiens
ctaataaaatattttctgtgtgt

SEQ ID NO: 1317027 - DNA, 14 bp, Homo sapiens
ctaatttgctgctg

SEQ ID NO: 1317028 - DNA, 23 bp, Homo sapiens
ctacagttgggaagtctcagcct

SEQ ID NO: 1317029 - DNA, 13 bp, Homo sapiens
ctacattctgctc

SEQ ID NO: 1317030 - DNA, 14 bp, Homo sapiens
ctaccctgggtcct

SEQ ID NO: 1317031 - DNA, 15 bp, Homo sapiens
ctaccctgggtcctc

SEQ ID NO: 1317032 - DNA, 17 bp, Homo sapiens
ctacgaagccacaggcc

SEQ ID NO: 1317033 - DNA, 16 bp, Homo sapiens
ctactaagaaaataga

SEQ ID NO: 1317034 - DNA, 22 bp, Homo sapiens
ctagaggcctgaaatcctggtt

SEQ ID NO: 1317035 - DNA, 15 bp, Homo sapiens
ctaggctggaaggag

SEQ ID NO: 1317036 - DNA, 13 bp, Homo sapiens
ctagggctgagca

SEQ ID NO: 1317037 - DNA, 22 bp, Homo sapiens
ctagggctgagcacctctcaga

SEQ ID NO: 1317038 - DNA, 14 bp, Homo sapiens
ctaggggaatgagg

SEQ ID NO: 1317039 - DNA, 19 bp, Homo sapiens
ctaggggaatgagggggct

SEQ ID NO: 1317040 - DNA, 22 bp, Homo sapiens
ctaggggaatgagggggctcag

SEQ ID NO: 1317041 - DNA, 23 bp, Homo sapiens
ctagtctgaagtctggaacactt

SEQ ID NO: 1317042 - DNA, 18 bp, Homo sapiens
ctagtcttgacctctcca

SEQ ID NO: 1317043 - DNA, 13 bp, Homo sapiens
ctagtgctgaagc

SEQ ID NO: 1317044 - DNA, 14 bp, Homo sapiens
ctagtgctgaagct

SEQ ID NO: 1317045 - DNA, 20 bp, Homo sapiens
ctagtgctgaagcttattaa

SEQ ID NO: 1317046 - DNA, 13 bp, Homo sapiens
ctatagcccctgg

SEQ ID NO: 1317047 - DNA, 16 bp, Homo sapiens
ctatagcccctggtgt

SEQ ID NO: 1317048 - DNA, 23 bp, Homo sapiens
ctatagcccctggtgtgtaaata

SEQ ID NO: 1317049 - DNA, 17 bp, Homo sapiens
ctatcctgtgaggcttt

SEQ ID NO: 1317050 - DNA, 17 bp, Homo sapiens
ctatgagttcacatgtg

SEQ ID NO: 1317051 - DNA, 18 bp, Homo sapiens
ctatgcctcacaaatgct

SEQ ID NO: 1317052 - DNA, 20 bp, Homo sapiens
ctatgcctcacaaatgctgt

SEQ ID NO: 1317053 - DNA, 11 bp, Homo sapiens
ctcaaaattat

SEQ ID NO: 1317054 - DNA, 19 bp, Homo sapiens
ctcaactctgctgagggtc

SEQ ID NO: 1317055 - DNA, 19 bp, Homo sapiens
ctcaactgagaagccaagc

SEQ ID NO: 1317056 - DNA, 21 bp, Homo sapiens
ctcaactgagaagccaagcct

SEQ ID NO: 1317057 - DNA, 22 bp, Homo sapiens
ctcaactgagaagccaagcctg

SEQ ID NO: 1317058 - DNA, 23 bp, Homo sapiens
ctcaactgagaagccaagcctgg

SEQ ID NO: 1317059 - DNA, 19 bp, Homo sapiens
ctcaagccccttctctcaa

SEQ ID NO: 1317060 - DNA, 14 bp, Homo sapiens
ctcaataaacttgt

SEQ ID NO: 1317061 - DNA, 17 bp, Homo sapiens
ctcacaacagtcttgtg

SEQ ID NO: 1317062 - DNA, 10 bp, Homo sapiens
ctcacaggac

SEQ ID NO: 1317063 - DNA, 19 bp, Homo sapiens
ctcaccagagaccaggagg

SEQ ID NO: 1317064 - DNA, 11 bp, Homo sapiens
ctcactctgct

SEQ ID NO: 1317065 - DNA, 22 bp, Homo sapiens
ctcactctgctaccttgcccca

SEQ ID NO: 1317066 - DNA, 13 bp, Homo sapiens
ctcagaagccttc

SEQ ID NO: 1317067 - DNA, 14 bp, Homo sapiens
ctcagaagccttct

SEQ ID NO: 1317068 - DNA, 18 bp, Homo sapiens
ctcagaagccttcttgct

SEQ ID NO: 1317069 - DNA, 20 bp, Homo sapiens
ctcagaagccttcttgctgc

SEQ ID NO: 1317070 - DNA, 16 bp, Homo sapiens
ctcagagcaagccttt

SEQ ID NO: 1317071 - DNA, 19 bp, Homo sapiens
ctcagcaccccactcctca

SEQ ID NO: 1317072 - DNA, 12 bp, Homo sapiens
ctcagccaccct

SEQ ID NO: 1317073 - DNA, 13 bp, Homo sapiens
ctcagccaccctt

SEQ ID NO: 1317074 - DNA, 12 bp, Homo sapiens
ctcagcctgggc

SEQ ID NO: 1317075 - DNA, 19 bp, Homo sapiens
ctcagcctgggcccctcag

SEQ ID NO: 1317076 - DNA, 21 bp, Homo sapiens
ctcagcctgggcccctcagcc

SEQ ID NO: 1317077 - DNA, 19 bp, Homo sapiens
ctcagcctgttccttcctg

SEQ ID NO: 1317078 - DNA, 24 bp, Homo sapiens
ctcagcctgttccttcctgcagac

SEQ ID NO: 1317079 - DNA, 22 bp, Homo sapiens
ctcagctgttcagattggacat

SEQ ID NO: 1317080 - DNA, 17 bp, Homo sapiens
ctcaggaacccaccctc

SEQ ID NO: 1317081 - DNA, 19 bp, Homo sapiens
ctcaggaacccaccctctc

SEQ ID NO: 1317082 - DNA, 22 bp, Homo sapiens
ctcaggaacccaccctctccac

SEQ ID NO: 1317083 - DNA, 16 bp, Homo sapiens
ctcaggagagggcctt

SEQ ID NO: 1317084 - DNA, 19 bp, Homo sapiens
ctcagtaaaagtcttctcc

SEQ ID NO: 1317085 - DNA, 21 bp, Homo sapiens
ctcagtaaaagtcttctccca

SEQ ID NO: 1317086 - DNA, 17 bp, Homo sapiens
ctcatctcagtcctcaa

SEQ ID NO: 1317087 - DNA, 15 bp, Homo sapiens
ctccagcatcccagc

SEQ ID NO: 1317088 - DNA, 18 bp, Homo sapiens
ctccagcatcccagcctc

SEQ ID NO: 1317089 - DNA, 21 bp, Homo sapiens
ctccagcatcccagcctcaga

SEQ ID NO: 1317090 - DNA, 22 bp, Homo sapiens
ctccagcatcccagcctcagaa

SEQ ID NO: 1317091 - DNA, 14 bp, Homo sapiens
ctccagcgtcctca

SEQ ID NO: 1317092 - DNA, 16 bp, Homo sapiens
ctccagcgtcctcagc

SEQ ID NO: 1317093 - DNA, 18 bp, Homo sapiens
ctccagcgtcctcagcac

SEQ ID NO: 1317094 - DNA, 20 bp, Homo sapiens
ctccagcgtcctcagcaccc

SEQ ID NO: 1317095 - DNA, 14 bp, Homo sapiens
ctccaggcttcccc

SEQ ID NO: 1317096 - DNA, 22 bp, Homo sapiens
ctccatcacccctggtggctgc

SEQ ID NO: 1317097 - DNA, 15 bp, Homo sapiens
ctcccaactcagcct

SEQ ID NO: 1317098 - DNA, 14 bp, Homo sapiens
ctcccagcacaggc

SEQ ID NO: 1317099 - DNA, 19 bp, Homo sapiens
ctcccagccctgaggggtg

SEQ ID NO: 1317100 - DNA, 12 bp, Homo sapiens
ctcccgacccca

SEQ ID NO: 1317101 - DNA, 13 bp, Homo sapiens
ctcccgaccccat

SEQ ID NO: 1317102 - DNA, 17 bp, Homo sapiens
ctcccgccccagggtct

SEQ ID NO: 1317103 - DNA, 18 bp, Homo sapiens
ctccctgttccccacagg

SEQ ID NO: 1317104 - DNA, 20 bp, Homo sapiens
ctccggccaggtgcctcctg

SEQ ID NO: 1317105 - DNA, 23 bp, Homo sapiens
ctccggccaggtgcctcctgaca

SEQ ID NO: 1317106 - DNA, 12 bp, Homo sapiens
ctccttcccagc

SEQ ID NO: 1317107 - DNA, 22 bp, Homo sapiens
aaaaagtccttgcaagaatgga

SEQ ID NO: 1317108 - DNA, 13 bp, Homo sapiens
aaaaattgtctct

SEQ ID NO: 1317109 - DNA, 17 bp, Homo sapiens
aaaacaagaaagtttcc

SEQ ID NO: 1317110 - DNA, 15 bp, Homo sapiens
aaaacatttctctct

SEQ ID NO: 1317111 - DNA, 14 bp, Homo sapiens
aaaaggagaataag

SEQ ID NO: 1317112 - DNA, 15 bp, Homo sapiens
aaaatataaaaatta

SEQ ID NO: 1317113 - DNA, 12 bp, Homo sapiens
aaaatattttct

SEQ ID NO: 1317114 - DNA, 15 bp, Homo sapiens
aaaatattttctgtg

SEQ ID NO: 1317115 - DNA, 18 bp, Homo sapiens
aaaatattttctgtgtgt

SEQ ID NO: 1317116 - DNA, 22 bp, Homo sapiens
aaaatattttctgtgtgttcct

SEQ ID NO: 1317117 - DNA, 14 bp, Homo sapiens
aaaatgtgtgtttt

SEQ ID NO: 1317118 - DNA, 14 bp, Homo sapiens
aaacagctttctgg

SEQ ID NO: 1317119 - DNA, 23 bp, Homo sapiens
aaacagctttctgggtaattcac

SEQ ID NO: 1317120 - DNA, 18 bp, Homo sapiens
aaacgtataatatgtaca

SEQ ID NO: 1317121 - DNA, 14 bp, Homo sapiens
aaactaataaaata

SEQ ID NO: 1317122 - DNA, 23 bp, Homo sapiens
aaactaataaaatattttctgtg

SEQ ID NO: 1317123 - DNA, 20 bp, Homo sapiens
aaactaggcatttgtaaata

SEQ ID NO: 1317124 - DNA, 12 bp, Homo sapiens
aaactgatgtga

SEQ ID NO: 1317125 - DNA, 13 bp, Homo sapiens
aaagcaacatcag

SEQ ID NO: 1317126 - DNA, 18 bp, Homo sapiens
aaagcaacatcagcttga

SEQ ID NO: 1317127 - DNA, 11 bp, Homo sapiens
aaagccaggaa

SEQ ID NO: 1317128 - DNA, 16 bp, Homo sapiens
aaagccaggaacaggg

SEQ ID NO: 1317129 - DNA, 19 bp, Homo sapiens
aaagccaggaacagggacc

SEQ ID NO: 1317130 - DNA, 9 bp, Homo sapiens
aaaggaaat

SEQ ID NO: 1317131 - DNA, 13 bp, Homo sapiens
aaaggagaataag

SEQ ID NO: 1317132 - DNA, 16 bp, Homo sapiens
aaaggaggagacagag

SEQ ID NO: 1317133 - DNA, 22 bp, Homo sapiens
aaagtcctgtcagttcagaaaa

SEQ ID NO: 1317134 - DNA, 15 bp, Homo sapiens
aaagtcttgtgacta

SEQ ID NO: 1317135 - DNA, 18 bp, Homo sapiens
aaagtcttgtgactagtg

SEQ ID NO: 1317136 - DNA, 13 bp, Homo sapiens
aaagttgatttct

SEQ ID NO: 1317137 - DNA, 23 bp, Homo sapiens
aaataagaattaggtttctttga

SEQ ID NO: 1317138 - DNA, 14 bp, Homo sapiens
aaataatgtacata

SEQ ID NO: 1317139 - DNA, 15 bp, Homo sapiens
aaatatcattcagca

SEQ ID NO: 1317140 - DNA, 18 bp, Homo sapiens
aaatattaaaagaaaggg

SEQ ID NO: 1317141 - DNA, 14 bp, Homo sapiens
aaatattttctgtg

SEQ ID NO: 1317142 - DNA, 16 bp, Homo sapiens
aaatattttctgtgtg

SEQ ID NO: 1317143 - DNA, 18 bp, Homo sapiens
aaatattttctgtgtgtt

SEQ ID NO: 1317144 - DNA, 19 bp, Homo sapiens
aaatattttctgtgtgttc

SEQ ID NO: 1317145 - DNA, 20 bp, Homo sapiens
aaatctttcaagttgcattc

SEQ ID NO: 1317146 - DNA, 13 bp, Homo sapiens
aaatctttctgga

SEQ ID NO: 1317147 - DNA, 23 bp, Homo sapiens
aaatgctgtggttcactgcactg

SEQ ID NO: 1317148 - DNA, 18 bp, Homo sapiens
aaattatcaagctaataa

SEQ ID NO: 1317149 - DNA, 12 bp, Homo sapiens
aaatttgtgtaa

SEQ ID NO: 1317150 - DNA, 16 bp, Homo sapiens
aacaagaaagtttccc

SEQ ID NO: 1317151 - DNA, 18 bp, Homo sapiens
aacaccatcacagcttgt

SEQ ID NO: 1317152 - DNA, 12 bp, Homo sapiens
aacactcagctg

SEQ ID NO: 1317153 - DNA, 18 bp, Homo sapiens
aacagggaccagctcccc

SEQ ID NO: 1317154 - DNA, 12 bp, Homo sapiens
aacatctctgtt

SEQ ID NO: 1317155 - DNA, 14 bp, Homo sapiens
aacatgctgtgtaa

SEQ ID NO: 1317156 - DNA, 17 bp, Homo sapiens
aaccaacaccatcacag

SEQ ID NO: 1317157 - DNA, 19 bp, Homo sapiens
aaccaacaccatcacagct

SEQ ID NO: 1317158 - DNA, 15 bp, Homo sapiens
aaccacctacccctg

SEQ ID NO: 1317159 - DNA, 14 bp, Homo sapiens
aacccaccctctcc

SEQ ID NO: 1317160 - DNA, 20 bp, Homo sapiens
aaccttctaccctgggtcct

SEQ ID NO: 1317161 - DNA, 12 bp, Homo sapiens
aacgattcacag

SEQ ID NO: 1317162 - DNA, 11 bp, Homo sapiens
aactaataaaa

SEQ ID NO: 1317163 - DNA, 12 bp, Homo sapiens
aactaataaaat

SEQ ID NO: 1317164 - DNA, 14 bp, Homo sapiens
aactaataaaatat

SEQ ID NO: 1317165 - DNA, 20 bp, Homo sapiens
aactaataaaatattttctg

SEQ ID NO: 1317166 - DNA, 18 bp, Homo sapiens
aactaggcatttgtaaat

SEQ ID NO: 1317167 - DNA, 21 bp, Homo sapiens
aactcagcctgttccttcctg

SEQ ID NO: 1317168 - DNA, 23 bp, Homo sapiens
aactcagcctgttccttcctgca

SEQ ID NO: 1317169 - DNA, 16 bp, Homo sapiens
aactccagcgtcctca

SEQ ID NO: 1317170 - DNA, 20 bp, Homo sapiens
aactccagcgtcctcagcac

SEQ ID NO: 1317171 - DNA, 21 bp, Homo sapiens
aactccagcgtcctcagcacc

SEQ ID NO: 1317172 - DNA, 15 bp, Homo sapiens
aactctgctgagggt

SEQ ID NO: 1317173 - DNA, 18 bp, Homo sapiens
aactgaggcttagaaagg

SEQ ID NO: 1317174 - DNA, 13 bp, Homo sapiens
aactgtgcttgtt

SEQ ID NO: 1317175 - DNA, 23 bp, Homo sapiens
aacttagtttgtgaattgatttt

SEQ ID NO: 1317176 - DNA, 16 bp, Homo sapiens
aagaaagagactgtgg

SEQ ID NO: 1317177 - DNA, 17 bp, Homo sapiens
aagaaagggttctgtaa

SEQ ID NO: 1317178 - DNA, 15 bp, Homo sapiens
aagaatagggcccat

SEQ ID NO: 1317179 - DNA, 21 bp, Homo sapiens
aagacactgtgcaggcccagg

SEQ ID NO: 1317180 - DNA, 13 bp, Homo sapiens
aagactctgctct

SEQ ID NO: 1317181 - DNA, 15 bp, Homo sapiens
aagagactgtgggga

SEQ ID NO: 1317182 - DNA, 22 bp, Homo sapiens
aagagactgtggggagggtcat

SEQ ID NO: 1317183 - DNA, 21 bp, Homo sapiens
aagagctttttcactctaaaa

SEQ ID NO: 1317184 - DNA, 13 bp, Homo sapiens
aagaggaggagga

SEQ ID NO: 1317185 - DNA, 14 bp, Homo sapiens
aagcaacatcagct

SEQ ID NO: 1317186 - DNA, 19 bp, Homo sapiens
aagcaaggcagaaggccag

SEQ ID NO: 1317187 - DNA, 12 bp, Homo sapiens
aagccaagcctg

SEQ ID NO: 1317188 - DNA, 13 bp, Homo sapiens
aagccaagcctgg

SEQ ID NO: 1317189 - DNA, 16 bp, Homo sapiens
aagccaagcctggagt

SEQ ID NO: 1317190 - DNA, 13 bp, Homo sapiens
aagccacaggcct

SEQ ID NO: 1317191 - DNA, 23 bp, Homo sapiens
aagccacaggcctggcctcaact

SEQ ID NO: 1317192 - DNA, 16 bp, Homo sapiens
aagccatgaccttgtg

SEQ ID NO: 1317193 - DNA, 16 bp, Homo sapiens
aagccatgagaatgtt

SEQ ID NO: 1317194 - DNA, 18 bp, Homo sapiens
aagcctcctctggagaat

SEQ ID NO: 1317195 - DNA, 16 bp, Homo sapiens
aagccttcttgctgcc

SEQ ID NO: 1317196 - DNA, 20 bp, Homo sapiens
aagcctttgacctgttcaga

SEQ ID NO: 1317197 - DNA, 18 bp, Homo sapiens
aagctaataaaatatcat

SEQ ID NO: 1317198 - DNA, 21 bp, Homo sapiens
aagctaataaaatatcattca

SEQ ID NO: 1317199 - DNA, 23 bp, Homo sapiens
aagctgcaggcacacacgccttc

SEQ ID NO: 1317200 - DNA, 19 bp, Homo sapiens
aagcttattaatgctaagg

SEQ ID NO: 1317201 - DNA, 19 bp, Homo sapiens
aaggaaacataagagcttt

SEQ ID NO: 1317202 - DNA, 20 bp, Homo sapiens
aaggcacctgcccccacagc

SEQ ID NO: 1317203 - DNA, 19 bp, Homo sapiens
aaggccacatgtgaaaacc

SEQ ID NO: 1317204 - DNA, 21 bp, Homo sapiens
aaggccaggagtaagcccaag

SEQ ID NO: 1317205 - DNA, 15 bp, Homo sapiens
aaggcccagacctgg

SEQ ID NO: 1317206 - DNA, 17 bp, Homo sapiens
aagggatgaattgtaaa

SEQ ID NO: 1317207 - DNA, 19 bp, Homo sapiens
aaggggctagggctgagca

SEQ ID NO: 1317208 - DNA, 23 bp, Homo sapiens
aaggggcttggaaccagtccgcc

SEQ ID NO: 1317209 - DNA, 17 bp, Homo sapiens
aaggttaatagcaccgg

SEQ ID NO: 1317210 - DNA, 14 bp, Homo sapiens
aagtaactgaggct

SEQ ID NO: 1317211 - DNA, 15 bp, Homo sapiens
aagtataaatttgtg

SEQ ID NO: 1317212 - DNA, 16 bp, Homo sapiens
aagtataaatttgtgt

SEQ ID NO: 1317213 - DNA, 18 bp, Homo sapiens
aagtataaatttgtgtaa

SEQ ID NO: 1317214 - DNA, 12 bp, Homo sapiens
aagtctcagcct

SEQ ID NO: 1317215 - DNA, 23 bp, Homo sapiens
aagtcttctcccaactcagcctg

SEQ ID NO: 1317216 - DNA, 19 bp, Homo sapiens
aagtcttgtgactagtgct

SEQ ID NO: 1317217 - DNA, 21 bp, Homo sapiens
aagtcttgtgactagtgctga

SEQ ID NO: 1317218 - DNA, 15 bp, Homo sapiens
aagtgaggccactga

SEQ ID NO: 1317219 - DNA, 18 bp, Homo sapiens
aagtgaggccactgaaga

SEQ ID NO: 1317220 - DNA, 11 bp, Homo sapiens
aagttaaaagt

SEQ ID NO: 1317221 - DNA, 20 bp, Homo sapiens
aagttcagcaagtagagcag

SEQ ID NO: 1317222 - DNA, 22 bp, Homo sapiens
aagttcagcaagtagagcagag

SEQ ID NO: 1317223 - DNA, 12 bp, Homo sapiens
aataaaactgat

SEQ ID NO: 1317224 - DNA, 15 bp, Homo sapiens
aataaaactgatgtg

SEQ ID NO: 1317225 - DNA, 11 bp, Homo sapiens
aataaaatatt

SEQ ID NO: 1317226 - DNA, 14 bp, Homo sapiens
aataaaatattttc

SEQ ID NO: 1317227 - DNA, 19 bp, Homo sapiens
aataaaatattttctgtgt

SEQ ID NO: 1317228 - DNA, 13 bp, Homo sapiens
aataaacttgtgc

SEQ ID NO: 1317229 - DNA, 15 bp, Homo sapiens
aataaacttgtgcct

SEQ ID NO: 1317230 - DNA, 16 bp, Homo sapiens
aataaacttgtgcctc

SEQ ID NO: 1317231 - DNA, 16 bp, Homo sapiens
aataaattaatatatt

SEQ ID NO: 1317232 - DNA, 14 bp, Homo sapiens
aataacttctaggt

SEQ ID NO: 1317233 - DNA, 14 bp, Homo sapiens
aataatgtacatag

SEQ ID NO: 1317234 - DNA, 16 bp, Homo sapiens
aatacatcttgtttct

SEQ ID NO: 1317235 - DNA, 18 bp, Homo sapiens
aatagagatgagctttct

SEQ ID NO: 1317236 - DNA, 12 bp, Homo sapiens
tcccctcaagcc

SEQ ID NO: 1317237 - DNA, 22 bp, Homo sapiens
tcccctcaagccccttctctca

SEQ ID NO: 1317238 - DNA, 17 bp, Homo sapiens
tcccctgcagccctggc

SEQ ID NO: 1317239 - DNA, 18 bp, Homo sapiens
tcccctgcagccctggcc

SEQ ID NO: 1317240 - DNA, 16 bp, Homo sapiens
tcccctggggtgcagg

SEQ ID NO: 1317241 - DNA, 18 bp, Homo sapiens
tcccctggggtgcaggcg

SEQ ID NO: 1317242 - DNA, 18 bp, Homo sapiens
tccccttcttcctggagt

SEQ ID NO: 1317243 - DNA, 16 bp, Homo sapiens
tcccgccccagggtct

SEQ ID NO: 1317244 - DNA, 19 bp, Homo sapiens
tcccgccccagggtctgaa

SEQ ID NO: 1317245 - DNA, 13 bp, Homo sapiens
tcccgccttctcc

SEQ ID NO: 1317246 - DNA, 14 bp, Homo sapiens
tcccgccttctcca

SEQ ID NO: 1317247 - DNA, 19 bp, Homo sapiens
tccggccaggtgcctcctg

SEQ ID NO: 1317248 - DNA, 17 bp, Homo sapiens
tccgggtgctcaataaa

SEQ ID NO: 1317249 - DNA, 12 bp, Homo sapiens
tcctcagcaccc

SEQ ID NO: 1317250 - DNA, 22 bp, Homo sapiens
tcctcagcaccccactcctcag

SEQ ID NO: 1317251 - DNA, 22 bp, Homo sapiens
tcctcagtaaaagtcttctccc

SEQ ID NO: 1317252 - DNA, 14 bp, Homo sapiens
tcctccatcacccc

SEQ ID NO: 1317253 - DNA, 15 bp, Homo sapiens
tcctccatcacccct

SEQ ID NO: 1317254 - DNA, 16 bp, Homo sapiens
tcctccatcacccctg

SEQ ID NO: 1317255 - DNA, 13 bp, Homo sapiens
tcctcccagcaca

SEQ ID NO: 1317256 - DNA, 14 bp, Homo sapiens
tcctcccagcacag

SEQ ID NO: 1317257 - DNA, 20 bp, Homo sapiens
tcctccctgttccccacagg

SEQ ID NO: 1317258 - DNA, 18 bp, Homo sapiens
tcctcttttgttgtttct

SEQ ID NO: 1317259 - DNA, 20 bp, Homo sapiens
tcctgaagaatctcgactct

SEQ ID NO: 1317260 - DNA, 19 bp, Homo sapiens
tcctgaggtggatttactg

SEQ ID NO: 1317261 - DNA, 20 bp, Homo sapiens
tcctgaggtggatttactga

SEQ ID NO: 1317262 - DNA, 17 bp, Homo sapiens
tcctgcagacctggctg

SEQ ID NO: 1317263 - DNA, 19 bp, Homo sapiens
tcctgcagacctggctggg

SEQ ID NO: 1317264 - DNA, 18 bp, Homo sapiens
tcctggatccaggataat

SEQ ID NO: 1317265 - DNA, 21 bp, Homo sapiens
tcctgtaaacactcagctgtt

SEQ ID NO: 1317266 - DNA, 18 bp, Homo sapiens
tccttcctgcagacctgg

SEQ ID NO: 1317267 - DNA, 22 bp, Homo sapiens
tccttcctgcagacctggctgg

SEQ ID NO: 1317268 - DNA, 10 bp, Homo sapiens
tccttgcaag

SEQ ID NO: 1317269 - DNA, 13 bp, Homo sapiens
tcctttaaaacat

SEQ ID NO: 1317270 - DNA, 15 bp, Homo sapiens
tccttttgctgtgtg

SEQ ID NO: 1317271 - DNA, 13 bp, Homo sapiens
tcgaaacctgtga

SEQ ID NO: 1317272 - DNA, 10 bp, Homo sapiens
tcgcccatga

SEQ ID NO: 1317273 - DNA, 22 bp, Homo sapiens
tcggggaataaaacatttctct

SEQ ID NO: 1317274 - DNA, 14 bp, Homo sapiens
tcgtgatatgctgc

SEQ ID NO: 1317275 - DNA, 14 bp, Homo sapiens
tcgttttcaaagat

SEQ ID NO: 1317276 - DNA, 14 bp, Homo sapiens
tctaatttcattca

SEQ ID NO: 1317277 - DNA, 15 bp, Homo sapiens
tctaatttcattcaa

SEQ ID NO: 1317278 - DNA, 14 bp, Homo sapiens
tctaatttgctgct

SEQ ID NO: 1317279 - DNA, 15 bp, Homo sapiens
tctaatttgctgctg

SEQ ID NO: 1317280 - DNA, 19 bp, Homo sapiens
tctacattctgctctgccc

SEQ ID NO: 1317281 - DNA, 23 bp, Homo sapiens
tctacattctgctctgcccatgc

SEQ ID NO: 1317282 - DNA, 15 bp, Homo sapiens
tctaccctgggtcct

SEQ ID NO: 1317283 - DNA, 21 bp, Homo sapiens
tctaccctgggtcctcgggcc

SEQ ID NO: 1317284 - DNA, 18 bp, Homo sapiens
tctacgaagccacaggcc

SEQ ID NO: 1317285 - DNA, 22 bp, Homo sapiens
tctacgaagccacaggcctggc

SEQ ID NO: 1317286 - DNA, 19 bp, Homo sapiens
tctagatctttgtgccaaa

SEQ ID NO: 1317287 - DNA, 17 bp, Homo sapiens
tctatattagtttattg

SEQ ID NO: 1317288 - DNA, 20 bp, Homo sapiens
tctcacatggaatgagggtt

SEQ ID NO: 1317289 - DNA, 14 bp, Homo sapiens
tctcagagcaagcc

SEQ ID NO: 1317290 - DNA, 13 bp, Homo sapiens
tctcagcctgggc

SEQ ID NO: 1317291 - DNA, 15 bp, Homo sapiens
tctcagcctgggccc

SEQ ID NO: 1317292 - DNA, 16 bp, Homo sapiens
tctcagggtgtcccag

SEQ ID NO: 1317293 - DNA, 17 bp, Homo sapiens
tctcagggtgtcccaga

SEQ ID NO: 1317294 - DNA, 12 bp, Homo sapiens
tctcatgccccg

SEQ ID NO: 1317295 - DNA, 18 bp, Homo sapiens
tctcatgtagaacaagaa

SEQ ID NO: 1317296 - DNA, 15 bp, Homo sapiens
tctccacacccagcc

SEQ ID NO: 1317297 - DNA, 16 bp, Homo sapiens
tctccacacccagcct

SEQ ID NO: 1317298 - DNA, 23 bp, Homo sapiens
tctccacacccagcctgtcccac

SEQ ID NO: 1317299 - DNA, 16 bp, Homo sapiens
tctccagcatcccagc

SEQ ID NO: 1317300 - DNA, 18 bp, Homo sapiens
tctccagcatcccagcct

SEQ ID NO: 1317301 - DNA, 20 bp, Homo sapiens
tctccggcctggccttttcc

SEQ ID NO: 1317302 - DNA, 21 bp, Homo sapiens
tctccggcctggccttttcca

SEQ ID NO: 1317303 - DNA, 14 bp, Homo sapiens
tctcctcgggccct

SEQ ID NO: 1317304 - DNA, 20 bp, Homo sapiens
tctcctcgggccctgtggtg

SEQ ID NO: 1317305 - DNA, 19 bp, Homo sapiens
tctcgtgatatgctgcttg

SEQ ID NO: 1317306 - DNA, 14 bp, Homo sapiens
tctctcctgtgtct

SEQ ID NO: 1317307 - DNA, 14 bp, Homo sapiens
tctctgaggcaagg

SEQ ID NO: 1317308 - DNA, 18 bp, Homo sapiens
tctctgttctcttgcttt

SEQ ID NO: 1317309 - DNA, 15 bp, Homo sapiens
tctgaagtctggaac

SEQ ID NO: 1317310 - DNA, 18 bp, Homo sapiens
tctgaagtctggaacact

SEQ ID NO: 1317311 - DNA, 19 bp, Homo sapiens
tctgaagtctggaacactt

SEQ ID NO: 1317312 - DNA, 13 bp, Homo sapiens
tctgactctggac

SEQ ID NO: 1317313 - DNA, 14 bp, Homo sapiens
tctgaggcaaggcc

SEQ ID NO: 1317314 - DNA, 16 bp, Homo sapiens
tctgaggcaaggccca

SEQ ID NO: 1317315 - DNA, 22 bp, Homo sapiens
tctgaggcaaggcccagacctg

SEQ ID NO: 1317316 - DNA, 17 bp, Homo sapiens
tctgagtagctttacac

SEQ ID NO: 1317317 - DNA, 17 bp, Homo sapiens
tctgatgcagaactttc

SEQ ID NO: 1317318 - DNA, 15 bp, Homo sapiens
tctgctaccttgccc

SEQ ID NO: 1317319 - DNA, 17 bp, Homo sapiens
tctgctaccttgcccca

SEQ ID NO: 1317320 - DNA, 21 bp, Homo sapiens
tctgctaccttgccccaaccc

SEQ ID NO: 1317321 - DNA, 12 bp, Homo sapiens
tctgctctgccc

SEQ ID NO: 1317322 - DNA, 13 bp, Homo sapiens
tctgctctgccca

SEQ ID NO: 1317323 - DNA, 17 bp, Homo sapiens
tctgctctgcccatgcc

SEQ ID NO: 1317324 - DNA, 16 bp, Homo sapiens
tctgctgagggtccag

SEQ ID NO: 1317325 - DNA, 12 bp, Homo sapiens
tctgctggctga

SEQ ID NO: 1317326 - DNA, 17 bp, Homo sapiens
tctggaccatgctgaga

SEQ ID NO: 1317327 - DNA, 23 bp, Homo sapiens
tctggaccatgctgagacatccc

SEQ ID NO: 1317328 - DNA, 22 bp, Homo sapiens
tctggactgtgggtttgtgggg

SEQ ID NO: 1317329 - DNA, 14 bp, Homo sapiens
ggacagcacacggt

SEQ ID NO: 1317330 - DNA, 19 bp, Homo sapiens
ggacataactgacttagtt

SEQ ID NO: 1317331 - DNA, 19 bp, Homo sapiens
ggacatgggtcgcccatga

SEQ ID NO: 1317332 - DNA, 14 bp, Homo sapiens
ggaccagctccccg

SEQ ID NO: 1317333 - DNA, 16 bp, Homo sapiens
ggaccatgctgagaca

SEQ ID NO: 1317334 - DNA, 16 bp, Homo sapiens
ggactaaagccaggaa

SEQ ID NO: 1317335 - DNA, 20 bp, Homo sapiens
ggacttcccccaccccagaa

SEQ ID NO: 1317336 - DNA, 16 bp, Homo sapiens
ggagagcttagggtct

SEQ ID NO: 1317337 - DNA, 18 bp, Homo sapiens
ggagatgctctctgaggc

SEQ ID NO: 1317338 - DNA, 16 bp, Homo sapiens
ggagcacatagccctg

SEQ ID NO: 1317339 - DNA, 23 bp, Homo sapiens
ggagcacatagccctgttgacct

SEQ ID NO: 1317340 - DNA, 20 bp, Homo sapiens
ggagccccaagactctgctc

SEQ ID NO: 1317341 - DNA, 14 bp, Homo sapiens
ggaggagacagagg

SEQ ID NO: 1317342 - DNA, 20 bp, Homo sapiens
ggaggagggtctagaggcct

SEQ ID NO: 1317343 - DNA, 23 bp, Homo sapiens
ggagggtcatgtacttctttatt

SEQ ID NO: 1317344 - DNA, 20 bp, Homo sapiens
ggaggtggaggttacagtga

SEQ ID NO: 1317345 - DNA, 19 bp, Homo sapiens
ggatttactgagagaaggt

SEQ ID NO: 1317346 - DNA, 20 bp, Homo sapiens
ggcaatcaataaacagcagg

SEQ ID NO: 1317347 - DNA, 13 bp, Homo sapiens
ggcaggcccagcc

SEQ ID NO: 1317348 - DNA, 17 bp, Homo sapiens
ggcaggcccagcctctg

SEQ ID NO: 1317349 - DNA, 20 bp, Homo sapiens
ggccaccccttgctctctgt

SEQ ID NO: 1317350 - DNA, 21 bp, Homo sapiens
ggcccaaattatcaagctaat

SEQ ID NO: 1317351 - DNA, 14 bp, Homo sapiens
ggcccagacctggc

SEQ ID NO: 1317352 - DNA, 19 bp, Homo sapiens
ggcccagacctggcctctg

SEQ ID NO: 1317353 - DNA, 15 bp, Homo sapiens
ggcccagcctctgcc

SEQ ID NO: 1317354 - DNA, 16 bp, Homo sapiens
ggcccagcctctgccc

SEQ ID NO: 1317355 - DNA, 17 bp, Homo sapiens
ggcccagcctctgcccc

SEQ ID NO: 1317356 - DNA, 23 bp, Homo sapiens
ggcccagcctctgccccacccat

SEQ ID NO: 1317357 - DNA, 21 bp, Homo sapiens
ggcccaggcaggcccagcctc

SEQ ID NO: 1317358 - DNA, 22 bp, Homo sapiens
ggcccaggcaggcccagcctct

SEQ ID NO: 1317359 - DNA, 19 bp, Homo sapiens
ggcccatcatggggggagc

SEQ ID NO: 1317360 - DNA, 20 bp, Homo sapiens
ggcccatcccgccttctcca

SEQ ID NO: 1317361 - DNA, 17 bp, Homo sapiens
ggcccatgggagggagc

SEQ ID NO: 1317362 - DNA, 23 bp, Homo sapiens
ggccccgcccgtagatcatcccc

SEQ ID NO: 1317363 - DNA, 19 bp, Homo sapiens
ggcccctgagcctgtgtcc

SEQ ID NO: 1317364 - DNA, 23 bp, Homo sapiens
ggcccgtggggccggggcttctg

SEQ ID NO: 1317365 - DNA, 11 bp, Homo sapiens
ggccctgccca

SEQ ID NO: 1317366 - DNA, 20 bp, Homo sapiens
ggccctgcccacacctcctg

SEQ ID NO: 1317367 - DNA, 20 bp, Homo sapiens
ggccctgtggtgctgggaga

SEQ ID NO: 1317368 - DNA, 22 bp, Homo sapiens
ggcctaataaaactgatgtgaa

SEQ ID NO: 1317369 - DNA, 15 bp, Homo sapiens
ggcctcaactgagaa

SEQ ID NO: 1317370 - DNA, 21 bp, Homo sapiens
ggcctcaactgagaagccaag

SEQ ID NO: 1317371 - DNA, 22 bp, Homo sapiens
ggcctcaactgagaagccaagc

SEQ ID NO: 1317372 - DNA, 11 bp, Homo sapiens
ggcctctgcca

SEQ ID NO: 1317373 - DNA, 17 bp, Homo sapiens
ggcctcttctctcagac

SEQ ID NO: 1317374 - DNA, 16 bp, Homo sapiens
ggcctgaaatcctggt

SEQ ID NO: 1317375 - DNA, 11 bp, Homo sapiens
ggcctgctgga

SEQ ID NO: 1317376 - DNA, 12 bp, Homo sapiens
ggcctggcctca

SEQ ID NO: 1317377 - DNA, 17 bp, Homo sapiens
ggcctgggcttccacag

SEQ ID NO: 1317378 - DNA, 20 bp, Homo sapiens
ggctagtgggtttctgacag

SEQ ID NO: 1317379 - DNA, 16 bp, Homo sapiens
ggctcaggagagggcc

SEQ ID NO: 1317380 - DNA, 18 bp, Homo sapiens
ggctcaggagagggcctt

SEQ ID NO: 1317381 - DNA, 16 bp, Homo sapiens
ggctcccctgcagccc

SEQ ID NO: 1317382 - DNA, 23 bp, Homo sapiens
ggctcctcccagcacaggcacct

SEQ ID NO: 1317383 - DNA, 22 bp, Homo sapiens
ggctctgtgcccggtgccatct

SEQ ID NO: 1317384 - DNA, 16 bp, Homo sapiens
ggctgagcacctctca

SEQ ID NO: 1317385 - DNA, 18 bp, Homo sapiens
ggctgagcacctctcaga

SEQ ID NO: 1317386 - DNA, 19 bp, Homo sapiens
ggctgcaggcaccgctggg

SEQ ID NO: 1317387 - DNA, 17 bp, Homo sapiens
ggctggaaggaggaaga

SEQ ID NO: 1317388 - DNA, 19 bp, Homo sapiens
ggctggacatgggtgggct

SEQ ID NO: 1317389 - DNA, 15 bp, Homo sapiens
ggcttcctggcgccc

SEQ ID NO: 1317390 - DNA, 19 bp, Homo sapiens
ggcttctgtgcacctgggc

SEQ ID NO: 1317391 - DNA, 15 bp, Homo sapiens
ggcttctttctgctg

SEQ ID NO: 1317392 - DNA, 13 bp, Homo sapiens
gggaaagccatga

SEQ ID NO: 1317393 - DNA, 16 bp, Homo sapiens
gggactaaagccagga

SEQ ID NO: 1317394 - DNA, 20 bp, Homo sapiens
gggaggctgactcctggtcc

SEQ ID NO: 1317395 - DNA, 21 bp, Homo sapiens
gggcaacgattcacagcctcc

SEQ ID NO: 1317396 - DNA, 13 bp, Homo sapiens
gggcccctcagcc

SEQ ID NO: 1317397 - DNA, 12 bp, Homo sapiens
gggccctgccca

SEQ ID NO: 1317398 - DNA, 14 bp, Homo sapiens
gggcctgcaggcca

SEQ ID NO: 1317399 - DNA, 16 bp, Homo sapiens
gggcctgcaggccagt

SEQ ID NO: 1317400 - DNA, 21 bp, Homo sapiens
gggccttcccctcccagccct

SEQ ID NO: 1317401 - DNA, 18 bp, Homo sapiens
gggctaaggggctagggc

SEQ ID NO: 1317402 - DNA, 18 bp, Homo sapiens
gggctcagttctggactg

SEQ ID NO: 1317403 - DNA, 19 bp, Homo sapiens
gggcttctgtgcacctggg

SEQ ID NO: 1317404 - DNA, 12 bp, Homo sapiens
ggggaatgaggg

SEQ ID NO: 1317405 - DNA, 21 bp, Homo sapiens
ggggcaacgattcacagcctc

SEQ ID NO: 1317406 - DNA, 21 bp, Homo sapiens
ggggcaccggctcaggagagg

SEQ ID NO: 1317407 - DNA, 20 bp, Homo sapiens
ggggcccaaatgctggctgg

SEQ ID NO: 1317408 - DNA, 13 bp, Homo sapiens
ggggcctgcaggc

SEQ ID NO: 1317409 - DNA, 19 bp, Homo sapiens
ggggcttctgtgcacctgg

SEQ ID NO: 1317410 - DNA, 22 bp, Homo sapiens
ggggcttctgtgcacctgggct

SEQ ID NO: 1317411 - DNA, 20 bp, Homo sapiens
gggggaacttgtagccagaa

SEQ ID NO: 1317412 - DNA, 19 bp, Homo sapiens
gggggagcaccctgagggc

SEQ ID NO: 1317413 - DNA, 19 bp, Homo sapiens
ggggtgagcgaagccccca

SEQ ID NO: 1317414 - DNA, 19 bp, Homo sapiens
gggtcctcgggcccctgag

SEQ ID NO: 1317415 - DNA, 13 bp, Homo sapiens
gggtcgcccatga

SEQ ID NO: 1317416 - DNA, 15 bp, Homo sapiens
gggtgacctccggcc

SEQ ID NO: 1317417 - DNA, 15 bp, Homo sapiens
gggtgcggggcctgc

SEQ ID NO: 1317418 - DNA, 15 bp, Homo sapiens
gggtgctcaataaac

SEQ ID NO: 1317419 - DNA, 23 bp, Homo sapiens
gggtgctcaataaacttgtgcct

SEQ ID NO: 1317420 - DNA, 13 bp, Homo sapiens
gggtgtcccagac

SEQ ID NO: 1317421 - DNA, 23 bp, Homo sapiens
ggtaaatgacatctacgaagcca

SEQ ID NO: 1317422 - DNA, 21 bp, Homo sapiens
ggtagagcaatctgggcactt

SEQ ID NO: 1317423 - DNA, 12 bp, Homo sapiens
ggtcaccctcag

SEQ ID NO: 1317424 - DNA, 20 bp, Homo sapiens
ggtcattttgactggcttgc

SEQ ID NO: 1317425 - DNA, 17 bp, Homo sapiens
ggtctcatgccccgcca

SEQ ID NO: 1317426 - DNA, 14 bp, Homo sapiens
ggtgacctctccgg

SEQ ID NO: 1317427 - DNA, 21 bp, Homo sapiens
ggtgagggtgcggggcctgca

SEQ ID NO: 1317428 - DNA, 16 bp, Homo sapiens
ggtgatgtcctgtaaa

SEQ ID NO: 1317429 - DNA, 15 bp, Homo sapiens
ggtgcggggcctgca

SEQ ID NO: 1317430 - DNA, 16 bp, Homo sapiens
ggtgcggggcctgcag

SEQ ID NO: 1317431 - DNA, 15 bp, Homo sapiens
ggtgctcaataaact

SEQ ID NO: 1317432 - DNA, 22 bp, Homo sapiens
ggtgctcaataaacttgtgcct

SEQ ID NO: 1317433 - DNA, 22 bp, Homo sapiens
ggtggatttactgagagaaggt

SEQ ID NO: 1317434 - DNA, 17 bp, Homo sapiens
ggtttgtggggggaggc

SEQ ID NO: 1317435 - DNA, 22 bp, Homo sapiens
gtagaacaagaaatctttctgg

SEQ ID NO: 1317436 - DNA, 15 bp, Homo sapiens
gtataccagagaagg

SEQ ID NO: 1317437 - DNA, 20 bp, Homo sapiens
gtatctgatgtttgttttcg

SEQ ID NO: 1317438 - DNA, 22 bp, Homo sapiens
gtatggtgacctctccggcctg

SEQ ID NO: 1317439 - DNA, 17 bp, Homo sapiens
gtcaccaggcaaccagg

SEQ ID NO: 1317440 - DNA, 20 bp, Homo sapiens
gtcacgagggtaggaccctc

SEQ ID NO: 1317441 - DNA, 14 bp, Homo sapiens
taagctgcaggcac

SEQ ID NO: 1317442 - DNA, 17 bp, Homo sapiens
taagctgtgtcctagtt

SEQ ID NO: 1317443 - DNA, 14 bp, Homo sapiens
taagggcctgctgg

SEQ ID NO: 1317444 - DNA, 15 bp, Homo sapiens
taagggcctgctgga

SEQ ID NO: 1317445 - DNA, 12 bp, Homo sapiens
taataaaactga

SEQ ID NO: 1317446 - DNA, 16 bp, Homo sapiens
taataaaatatcattc

SEQ ID NO: 1317447 - DNA, 13 bp, Homo sapiens
taataaaatattt

SEQ ID NO: 1317448 - DNA, 15 bp, Homo sapiens
taataaaatattttc

SEQ ID NO: 1317449 - DNA, 21 bp, Homo sapiens
taataaaatattttctgtgtg

SEQ ID NO: 1317450 - DNA, 20 bp, Homo sapiens
taattctgttctgatattaa

SEQ ID NO: 1317451 - DNA, 21 bp, Homo sapiens
taattctgttctgatattaat

SEQ ID NO: 1317452 - DNA, 22 bp, Homo sapiens
taattctgttctgatattaatt

SEQ ID NO: 1317453 - DNA, 15 bp, Homo sapiens
taatttggaaactaa

SEQ ID NO: 1317454 - DNA, 15 bp, Homo sapiens
tacaatcagctgctt

SEQ ID NO: 1317455 - DNA, 13 bp, Homo sapiens
tacattctgctct

SEQ ID NO: 1317456 - DNA, 15 bp, Homo sapiens
tacattctgctctgc

SEQ ID NO: 1317457 - DNA, 17 bp, Homo sapiens
tacattctgctctgccc

SEQ ID NO: 1317458 - DNA, 23 bp, Homo sapiens
taccacctcactttttcatttcc

SEQ ID NO: 1317459 - DNA, 20 bp, Homo sapiens
tacctgaatggagaatacat

SEQ ID NO: 1317460 - DNA, 12 bp, Homo sapiens
taccttgcccca

SEQ ID NO: 1317461 - DNA, 16 bp, Homo sapiens
tacgcattaagggcct

SEQ ID NO: 1317462 - DNA, 19 bp, Homo sapiens
tacgcattaagggcctgct

SEQ ID NO: 1317463 - DNA, 20 bp, Homo sapiens
tacgcattaagggcctgctg

SEQ ID NO: 1317464 - DNA, 17 bp, Homo sapiens
tacgctgcgtgccatga

SEQ ID NO: 1317465 - DNA, 19 bp, Homo sapiens
tactcatcatatacaaatg

SEQ ID NO: 1317466 - DNA, 20 bp, Homo sapiens
tactcatgactgaagggaaa

SEQ ID NO: 1317467 - DNA, 13 bp, Homo sapiens
tactgagagaagg

SEQ ID NO: 1317468 - DNA, 14 bp, Homo sapiens
tactgagagaaggt

SEQ ID NO: 1317469 - DNA, 20 bp, Homo sapiens
tacttctttattttttaact

SEQ ID NO: 1317470 - DNA, 13 bp, Homo sapiens
tactttaacatgc

SEQ ID NO: 1317471 - DNA, 19 bp, Homo sapiens
tactttaatgttggaagag

SEQ ID NO: 1317472 - DNA, 15 bp, Homo sapiens
gcccatattttactt

SEQ ID NO: 1317473 - DNA, 17 bp, Homo sapiens
gcccatcccgccttctc

SEQ ID NO: 1317474 - DNA, 17 bp, Homo sapiens
gcccatgagagcgcagc

SEQ ID NO: 1317475 - DNA, 16 bp, Homo sapiens
gcccatgggagggagc

SEQ ID NO: 1317476 - DNA, 22 bp, Homo sapiens
gccccgccatggtcaccctcag

SEQ ID NO: 1317477 - DNA, 12 bp, Homo sapiens
gcccctgagcct

SEQ ID NO: 1317478 - DNA, 13 bp, Homo sapiens
gcccctgagcctg

SEQ ID NO: 1317479 - DNA, 14 bp, Homo sapiens
gcccctgagcctgt

SEQ ID NO: 1317480 - DNA, 15 bp, Homo sapiens
gcccctgagcctgtg

SEQ ID NO: 1317481 - DNA, 17 bp, Homo sapiens
gcccctgagcctgtgtc

SEQ ID NO: 1317482 - DNA, 20 bp, Homo sapiens
gcccctgagcctgtgtcctg

SEQ ID NO: 1317483 - DNA, 23 bp, Homo sapiens
gcccctgagcctgtgtcctgaag

SEQ ID NO: 1317484 - DNA, 12 bp, Homo sapiens
gcccctgggact

SEQ ID NO: 1317485 - DNA, 12 bp, Homo sapiens
gccccttctctc

SEQ ID NO: 1317486 - DNA, 14 bp, Homo sapiens
gcccggtgccatct

SEQ ID NO: 1317487 - DNA, 17 bp, Homo sapiens
gcccggtgccatcttcc

SEQ ID NO: 1317488 - DNA, 17 bp, Homo sapiens
gcccgtagatcatcccc

SEQ ID NO: 1317489 - DNA, 23 bp, Homo sapiens
gcccgtagatcatccccgagggc

SEQ ID NO: 1317490 - DNA, 21 bp, Homo sapiens
gccctgaggggtggactaggc

SEQ ID NO: 1317491 - DNA, 14 bp, Homo sapiens
gccctgtggtgctg

SEQ ID NO: 1317492 - DNA, 15 bp, Homo sapiens
gccctgttgacctgc

SEQ ID NO: 1317493 - DNA, 13 bp, Homo sapiens
gcctaaagcccat

SEQ ID NO: 1317494 - DNA, 21 bp, Homo sapiens
gcctaaagcccattgctgcaa

SEQ ID NO: 1317495 - DNA, 15 bp, Homo sapiens
gcctaataaaactga

SEQ ID NO: 1317496 - DNA, 19 bp, Homo sapiens
gcctaataaaactgatgtg

SEQ ID NO: 1317497 - DNA, 14 bp, Homo sapiens
gcctcacaaatgct

SEQ ID NO: 1317498 - DNA, 15 bp, Homo sapiens
gcctcagaagccttc

SEQ ID NO: 1317499 - DNA, 20 bp, Homo sapiens
gcctcagaagccttcttgct

SEQ ID NO: 1317500 - DNA, 23 bp, Homo sapiens
gcctccctccgcggcgggccctg

SEQ ID NO: 1317501 - DNA, 15 bp, Homo sapiens
gcctcggctggctcc

SEQ ID NO: 1317502 - DNA, 16 bp, Homo sapiens
gcctcggctggctccc

SEQ ID NO: 1317503 - DNA, 20 bp, Homo sapiens
gcctcggctggctcccctgc

SEQ ID NO: 1317504 - DNA, 19 bp, Homo sapiens
gcctctctccactaccccg

SEQ ID NO: 1317505 - DNA, 15 bp, Homo sapiens
gcctctgccatcctc

SEQ ID NO: 1317506 - DNA, 17 bp, Homo sapiens
gcctctgccatcctccc

SEQ ID NO: 1317507 - DNA, 19 bp, Homo sapiens
gcctctgccatcctccctg

SEQ ID NO: 1317508 - DNA, 16 bp, Homo sapiens
gcctgaaatcctggtt

SEQ ID NO: 1317509 - DNA, 13 bp, Homo sapiens
gcctgccatggct

SEQ ID NO: 1317510 - DNA, 14 bp, Homo sapiens
gcctgccatggctg

SEQ ID NO: 1317511 - DNA, 12 bp, Homo sapiens
gcctggcctcaa

SEQ ID NO: 1317512 - DNA, 14 bp, Homo sapiens
gcctgtcccactgg

SEQ ID NO: 1317513 - DNA, 17 bp, Homo sapiens
gcctgtcccactggctc

SEQ ID NO: 1317514 - DNA, 19 bp, Homo sapiens
gcctgttccttcctgcaga

SEQ ID NO: 1317515 - DNA, 21 bp, Homo sapiens
gcctgttccttcctgcagacc

SEQ ID NO: 1317516 - DNA, 15 bp, Homo sapiens
gccttcatgccagtg

SEQ ID NO: 1317517 - DNA, 20 bp, Homo sapiens
gccttcatgccagtgcatgc

SEQ ID NO: 1317518 - DNA, 23 bp, Homo sapiens
gccttcatgccagtgcatgccag

SEQ ID NO: 1317519 - DNA, 19 bp, Homo sapiens
gccttcccctcccagccct

SEQ ID NO: 1317520 - DNA, 12 bp, Homo sapiens
gccttctccagg

SEQ ID NO: 1317521 - DNA, 15 bp, Homo sapiens
gccttctccaggctt

SEQ ID NO: 1317522 - DNA, 19 bp, Homo sapiens
gccttctccaggcttcccc

SEQ ID NO: 1317523 - DNA, 19 bp, Homo sapiens
gccttgaacaacccaatct

SEQ ID NO: 1317524 - DNA, 17 bp, Homo sapiens
gccttgtggtccaaata

SEQ ID NO: 1317525 - DNA, 13 bp, Homo sapiens
gcctttgacctgt

SEQ ID NO: 1317526 - DNA, 17 bp, Homo sapiens
gcctttggtaagggaag

SEQ ID NO: 1317527 - DNA, 13 bp, Homo sapiens
gcgcccctgggac

SEQ ID NO: 1317528 - DNA, 15 bp, Homo sapiens
gcgcccctgggacta

SEQ ID NO: 1317529 - DNA, 22 bp, Homo sapiens
gcgcctcaactctgctgagggt

SEQ ID NO: 1317530 - DNA, 14 bp, Homo sapiens
gcgcgtgaggcccg

SEQ ID NO: 1317531 - DNA, 20 bp, Homo sapiens
gcggggcctgcaggccagtc

SEQ ID NO: 1317532 - DNA, 12 bp, Homo sapiens
gcgtcctcagca

SEQ ID NO: 1317533 - DNA, 13 bp, Homo sapiens
gcgtcctcagcac

SEQ ID NO: 1317534 - DNA, 22 bp, Homo sapiens
gcgtcctcagcaccccactcct

SEQ ID NO: 1317535 - DNA, 19 bp, Homo sapiens
gctaataaaatatcattca

SEQ ID NO: 1317536 - DNA, 22 bp, Homo sapiens
gctaccttgccccaacccttct

SEQ ID NO: 1317537 - DNA, 18 bp, Homo sapiens
gctactgaaaaaaatgga

SEQ ID NO: 1317538 - DNA, 16 bp, Homo sapiens
gctactgacccagagg

SEQ ID NO: 1317539 - DNA, 22 bp, Homo sapiens
gctagggctgagcacctctcag

SEQ ID NO: 1317540 - DNA, 21 bp, Homo sapiens
gctatagatgggactgtgtcc

SEQ ID NO: 1317541 - DNA, 13 bp, Homo sapiens
gctcaataaactt

SEQ ID NO: 1317542 - DNA, 18 bp, Homo sapiens
gctcagatgccggagccc

SEQ ID NO: 1317543 - DNA, 16 bp, Homo sapiens
gctcccgccccagggt

SEQ ID NO: 1317544 - DNA, 18 bp, Homo sapiens
gctcccgccccagggtct

SEQ ID NO: 1317545 - DNA, 23 bp, Homo sapiens
gctcccgccccagggtctgaaag

SEQ ID NO: 1317546 - DNA, 19 bp, Homo sapiens
gctcctcccagcacaggca

SEQ ID NO: 1317547 - DNA, 22 bp, Homo sapiens
gctccttgcaaactatgagttc

SEQ ID NO: 1317548 - DNA, 16 bp, Homo sapiens
gctcgccacagtgggc

SEQ ID NO: 1317549 - DNA, 16 bp, Homo sapiens
gctctacattctgctc

SEQ ID NO: 1317550 - DNA, 17 bp, Homo sapiens
gctctacattctgctct

SEQ ID NO: 1317551 - DNA, 16 bp, Homo sapiens
gctctcctcgggccct

SEQ ID NO: 1317552 - DNA, 17 bp, Homo sapiens
gctctcctcgggccctg

SEQ ID NO: 1317553 - DNA, 18 bp, Homo sapiens
gctctcctcgggccctgt

SEQ ID NO: 1317554 - DNA, 16 bp, Homo sapiens
gctctctgaggcaagg

SEQ ID NO: 1317555 - DNA, 17 bp, Homo sapiens
gctctctgaggcaaggc

SEQ ID NO: 1317556 - DNA, 18 bp, Homo sapiens
gctctctgttctcttgct

SEQ ID NO: 1317557 - DNA, 17 bp, Homo sapiens
gctctgtgcccggtgcc

SEQ ID NO: 1317558 - DNA, 22 bp, Homo sapiens
gctctgtgcccggtgccatctt

SEQ ID NO: 1317559 - DNA, 21 bp, Homo sapiens
gctctttcttcttccacacat

SEQ ID NO: 1317560 - DNA, 21 bp, Homo sapiens
gctgaagcttattaatgctaa

SEQ ID NO: 1317561 - DNA, 14 bp, Homo sapiens
gctgactcctggtc

SEQ ID NO: 1317562 - DNA, 15 bp, Homo sapiens
gctgagggtccagaa

SEQ ID NO: 1317563 - DNA, 20 bp, Homo sapiens
gctgcaggcacacacgcctt

SEQ ID NO: 1317564 - DNA, 19 bp, Homo sapiens
gctgcgtgccatgagtcca

SEQ ID NO: 1317565 - DNA, 23 bp, Homo sapiens
gctgctttgttaccttaaaacta

SEQ ID NO: 1317566 - DNA, 20 bp, Homo sapiens
gctggaaggaaagcaaggca

SEQ ID NO: 1317567 - DNA, 18 bp, Homo sapiens
gctggaaggaggaagaat

SEQ ID NO: 1317568 - DNA, 15 bp, Homo sapiens
gctggagaaaccttc

SEQ ID NO: 1317569 - DNA, 21 bp, Homo sapiens
gctggagaaaccttcactcca

SEQ ID NO: 1317570 - DNA, 21 bp, Homo sapiens
gctggccttgtggtccaaata

SEQ ID NO: 1317571 - DNA, 13 bp, Homo sapiens
gctggctcccctg

SEQ ID NO: 1317572 - DNA, 21 bp, Homo sapiens
gctggctcccctgcagccctg

SEQ ID NO: 1317573 - DNA, 22 bp, Homo sapiens
gctggctcccctgcagccctgg

SEQ ID NO: 1317574 - DNA, 18 bp, Homo sapiens
gctgggagatgctctctg

SEQ ID NO: 1317575 - DNA, 22 bp, Homo sapiens
gctgggagatgctctctgaggc

SEQ ID NO: 1317576 - DNA, 19 bp, Homo sapiens
gctggggcttctttctgct

SEQ ID NO: 1317577 - DNA, 17 bp, Homo sapiens
gctgggttctgactctg

SEQ ID NO: 1317578 - DNA, 16 bp, Homo sapiens
gctggtaaatgacatc

SEQ ID NO: 1317579 - DNA, 19 bp, Homo sapiens
gctggtcttctcagttcat

SEQ ID NO: 1317580 - DNA, 22 bp, Homo sapiens
gctgtggttcactgcactgttc

SEQ ID NO: 1317581 - DNA, 15 bp, Homo sapiens
gctgtgtgaaatctt

SEQ ID NO: 1317582 - DNA, 18 bp, Homo sapiens
gctgtgtgaaatctttca

SEQ ID NO: 1317583 - DNA, 22 bp, Homo sapiens
gctgttgactctagtactgtga

SEQ ID NO: 1317584 - DNA, 16 bp, Homo sapiens
gcttccacagtgtgaa

SEQ ID NO: 1317585 - DNA, 23 bp, Homo sapiens
gcttcccctccctcgttttcaaa

SEQ ID NO: 1317586 - DNA, 19 bp, Homo sapiens
gcttcccttttttcctttc

SEQ ID NO: 1317587 - DNA, 15 bp, Homo sapiens
gcttcctggcgcccc

SEQ ID NO: 1317588 - DNA, 18 bp, Homo sapiens
gcttctgtgcacctgggc

SEQ ID NO: 1317589 - DNA, 15 bp, Homo sapiens
gcttctttctgctgg

SEQ ID NO: 1317590 - DNA, 18 bp, Homo sapiens
gcttgaagcaaacagttg

SEQ ID NO: 1317591 - DNA, 13 bp, Homo sapiens
ctctgtgcccggt

SEQ ID NO: 1317592 - DNA, 17 bp, Homo sapiens
ctctgtgcccggtgcca

SEQ ID NO: 1317593 - DNA, 23 bp, Homo sapiens
ctctgtgcccggtgccatcttcc

SEQ ID NO: 1317594 - DNA, 15 bp, Homo sapiens
ctctgttctcttgct

SEQ ID NO: 1317595 - DNA, 21 bp, Homo sapiens
ctctgttgctggtcttctcag

SEQ ID NO: 1317596 - DNA, 19 bp, Homo sapiens
ctctttcttcttccacaca

SEQ ID NO: 1317597 - DNA, 23 bp, Homo sapiens
ctcttttgaatgttaagaataac

SEQ ID NO: 1317598 - DNA, 14 bp, Homo sapiens
ctgaaatcctggtt

SEQ ID NO: 1317599 - DNA, 16 bp, Homo sapiens
ctgaaatcctggttcc

SEQ ID NO: 1317600 - DNA, 16 bp, Homo sapiens
ctgaaatgtgtttcct

SEQ ID NO: 1317601 - DNA, 15 bp, Homo sapiens
ctgaagaggaggagg

SEQ ID NO: 1317602 - DNA, 14 bp, Homo sapiens
ctgaagcttattaa

SEQ ID NO: 1317603 - DNA, 18 bp, Homo sapiens
ctgaagcttattaatgct

SEQ ID NO: 1317604 - DNA, 15 bp, Homo sapiens
ctgaatagagggagt

SEQ ID NO: 1317605 - DNA, 21 bp, Homo sapiens
ctgaatagagggagtagaaag

SEQ ID NO: 1317606 - DNA, 15 bp, Homo sapiens
ctgacacacctgcag

SEQ ID NO: 1317607 - DNA, 16 bp, Homo sapiens
ctgacacacctgcagc

SEQ ID NO: 1317608 - DNA, 13 bp, Homo sapiens
ctgactcctggtc

SEQ ID NO: 1317609 - DNA, 14 bp, Homo sapiens
ctgactcctggtcc

SEQ ID NO: 1317610 - DNA, 15 bp, Homo sapiens
ctgactcctggtcct

SEQ ID NO: 1317611 - DNA, 14 bp, Homo sapiens
ctgacttctgttta

SEQ ID NO: 1317612 - DNA, 14 bp, Homo sapiens
ctgagaagaggaac

SEQ ID NO: 1317613 - DNA, 18 bp, Homo sapiens
ctgagaagccaagcctgg

SEQ ID NO: 1317614 - DNA, 21 bp, Homo sapiens
ctgagaagccaagcctggagt

SEQ ID NO: 1317615 - DNA, 18 bp, Homo sapiens
ctgagacatccctcatct

SEQ ID NO: 1317616 - DNA, 11 bp, Homo sapiens
ctgagagaagg

SEQ ID NO: 1317617 - DNA, 16 bp, Homo sapiens
ctgagagaaggtgaaa

SEQ ID NO: 1317618 - DNA, 14 bp, Homo sapiens
ctgagcacctctca

SEQ ID NO: 1317619 - DNA, 16 bp, Homo sapiens
ctgagcacctctcaga

SEQ ID NO: 1317620 - DNA, 21 bp, Homo sapiens
ctgagcacctctcagagcaag

SEQ ID NO: 1317621 - DNA, 15 bp, Homo sapiens
ctgagcctgtgtcct

SEQ ID NO: 1317622 - DNA, 20 bp, Homo sapiens
ctgagcctgtgtcctgaaga

SEQ ID NO: 1317623 - DNA, 16 bp, Homo sapiens
ctgaggcaaggcccag

SEQ ID NO: 1317624 - DNA, 21 bp, Homo sapiens
ctgaggcaaggcccagacctg

SEQ ID NO: 1317625 - DNA, 12 bp, Homo sapiens
ctgaggggtgga

SEQ ID NO: 1317626 - DNA, 14 bp, Homo sapiens
ctgagggtccagaa

SEQ ID NO: 1317627 - DNA, 20 bp, Homo sapiens
ctgaggtggatttactgaga

SEQ ID NO: 1317628 - DNA, 18 bp, Homo sapiens
ctgatgcagaactttctc

SEQ ID NO: 1317629 - DNA, 19 bp, Homo sapiens
ctgatgggtggacctgtgt

SEQ ID NO: 1317630 - DNA, 13 bp, Homo sapiens
ctgatgtgaaact

SEQ ID NO: 1317631 - DNA, 16 bp, Homo sapiens
ctgatgtttgttttcg

SEQ ID NO: 1317632 - DNA, 13 bp, Homo sapiens
ctgcaactccagc

SEQ ID NO: 1317633 - DNA, 21 bp, Homo sapiens
ctgcaactccagcgtcctcag

SEQ ID NO: 1317634 - DNA, 23 bp, Homo sapiens
ctgcaactccagcgtcctcagca

SEQ ID NO: 1317635 - DNA, 13 bp, Homo sapiens
ctgcacataaact

SEQ ID NO: 1317636 - DNA, 15 bp, Homo sapiens
ctgcagacctggctg

SEQ ID NO: 1317637 - DNA, 12 bp, Homo sapiens
ctgcagccctgg

SEQ ID NO: 1317638 - DNA, 13 bp, Homo sapiens
ctgcagccctggc

SEQ ID NO: 1317639 - DNA, 17 bp, Homo sapiens
ctgcagccctggcccat

SEQ ID NO: 1317640 - DNA, 14 bp, Homo sapiens
ctgcaggcacacac

SEQ ID NO: 1317641 - DNA, 21 bp, Homo sapiens
ctgcaggcacacacgccttca

SEQ ID NO: 1317642 - DNA, 23 bp, Homo sapiens
ctgcaggcacacacgccttcatg

SEQ ID NO: 1317643 - DNA, 20 bp, Homo sapiens
ctgcaggcaccgctgggttc

SEQ ID NO: 1317644 - DNA, 23 bp, Homo sapiens
ctgccatcctccctgttccccac

SEQ ID NO: 1317645 - DNA, 15 bp, Homo sapiens
ctgccatggctgtga

SEQ ID NO: 1317646 - DNA, 23 bp, Homo sapiens
ctgcccacaacgtcccctcaagc

SEQ ID NO: 1317647 - DNA, 20 bp, Homo sapiens
ctgcccacacctcctggggc

SEQ ID NO: 1317648 - DNA, 12 bp, Homo sapiens
ctgcccatgcct

SEQ ID NO: 1317649 - DNA, 12 bp, Homo sapiens
ctgccccaccca

SEQ ID NO: 1317650 - DNA, 13 bp, Homo sapiens
ctgcccccacagc

SEQ ID NO: 1317651 - DNA, 17 bp, Homo sapiens
ctgcccccacagctcct

SEQ ID NO: 1317652 - DNA, 19 bp, Homo sapiens
ctgctactgacccagaggg

SEQ ID NO: 1317653 - DNA, 23 bp, Homo sapiens
ctgctctcctcgggccctgtggt

SEQ ID NO: 1317654 - DNA, 12 bp, Homo sapiens
ctgctctgccca

SEQ ID NO: 1317655 - DNA, 11 bp, Homo sapiens
ctgctgagggt

SEQ ID NO: 1317656 - DNA, 14 bp, Homo sapiens
ctgctgagggtcca

SEQ ID NO: 1317657 - DNA, 18 bp, Homo sapiens
ctgctggagaaaccttca

SEQ ID NO: 1317658 - DNA, 22 bp, Homo sapiens
ctgctggagaaaccttcactcc

SEQ ID NO: 1317659 - DNA, 13 bp, Homo sapiens
ctgcttgtgacct

SEQ ID NO: 1317660 - DNA, 20 bp, Homo sapiens
ctgcttgtgaccttgacttg

SEQ ID NO: 1317661 - DNA, 13 bp, Homo sapiens
ctgctttgttacc

SEQ ID NO: 1317662 - DNA, 15 bp, Homo sapiens
ctggaattgatgttt

SEQ ID NO: 1317663 - DNA, 18 bp, Homo sapiens
ctggaattgatgtttaca

SEQ ID NO: 1317664 - DNA, 14 bp, Homo sapiens
ctggaccatgctga

SEQ ID NO: 1317665 - DNA, 17 bp, Homo sapiens
ctggagaaaccttcact

SEQ ID NO: 1317666 - DNA, 18 bp, Homo sapiens
ctggagaaaccttcactc

SEQ ID NO: 1317667 - DNA, 23 bp, Homo sapiens
ctggagaaaccttcactccagac

SEQ ID NO: 1317668 - DNA, 16 bp, Homo sapiens
ctggagtaggcctggg

SEQ ID NO: 1317669 - DNA, 18 bp, Homo sapiens
ctggagtaggcctggggc

SEQ ID NO: 1317670 - DNA, 13 bp, Homo sapiens
ctggcctctgcca

SEQ ID NO: 1317671 - DNA, 16 bp, Homo sapiens
ctggccttttccattc

SEQ ID NO: 1317672 - DNA, 16 bp, Homo sapiens
ctggctcccctgcagc

SEQ ID NO: 1317673 - DNA, 12 bp, Homo sapiens
ctggctcctccc

SEQ ID NO: 1317674 - DNA, 17 bp, Homo sapiens
ctggctcctcccagcac

SEQ ID NO: 1317675 - DNA, 20 bp, Homo sapiens
ctggctgatgggtggacctg

SEQ ID NO: 1317676 - DNA, 13 bp, Homo sapiens
ctggctgggcctg

SEQ ID NO: 1317677 - DNA, 22 bp, Homo sapiens
ctggcttgctcccgccccaggg

SEQ ID NO: 1317678 - DNA, 14 bp, Homo sapiens
ctgggcccctcagc

SEQ ID NO: 1317679 - DNA, 18 bp, Homo sapiens
ctgggcctgggcttccac

SEQ ID NO: 1317680 - DNA, 19 bp, Homo sapiens
ctgggctctcgcggcctct

SEQ ID NO: 1317681 - DNA, 20 bp, Homo sapiens
ctggggcttctttctgctgg

SEQ ID NO: 1317682 - DNA, 22 bp, Homo sapiens
ctggggcttctttctgctggct

SEQ ID NO: 1317683 - DNA, 20 bp, Homo sapiens
ctgggttctgactctggacc

SEQ ID NO: 1317684 - DNA, 14 bp, Homo sapiens
ctggtcacacaagg

SEQ ID NO: 1317685 - DNA, 18 bp, Homo sapiens
ctggtcacacaaggaact

SEQ ID NO: 1317686 - DNA, 22 bp, Homo sapiens
ctggtcacacaaggaactcttg

SEQ ID NO: 1317687 - DNA, 19 bp, Homo sapiens
ctggtcctaggctggaagg

SEQ ID NO: 1317688 - DNA, 19 bp, Homo sapiens
ctggtgatgcgcagttgct

SEQ ID NO: 1317689 - DNA, 15 bp, Homo sapiens
ctggtggctgcaggc

SEQ ID NO: 1317690 - DNA, 14 bp, Homo sapiens
ctggtgtgtaaata

SEQ ID NO: 1317691 - DNA, 23 bp, Homo sapiens
ctggttttggccaccccttgctc

SEQ ID NO: 1317692 - DNA, 20 bp, Homo sapiens
ctgtataaaggtgtgctgtg

SEQ ID NO: 1317693 - DNA, 21 bp, Homo sapiens
ctgtataaaggtgtgctgtgt

SEQ ID NO: 1317694 - DNA, 15 bp, Homo sapiens
ctgtcccactggctc

SEQ ID NO: 1317695 - DNA, 16 bp, Homo sapiens
ctgtcccactggctcc

SEQ ID NO: 1317696 - DNA, 13 bp, Homo sapiens
ctgtcttcctttg

SEQ ID NO: 1317697 - DNA, 16 bp, Homo sapiens
ctgtcttcctttgctt

SEQ ID NO: 1317698 - DNA, 13 bp, Homo sapiens
ctgtgacacagac

SEQ ID NO: 1317699 - DNA, 14 bp, Homo sapiens
ctgtgatttctgtg

SEQ ID NO: 1317700 - DNA, 15 bp, Homo sapiens
ctgtgatttctgtgc

SEQ ID NO: 1317701 - DNA, 17 bp, Homo sapiens
ctgtgatttctgtgcca

SEQ ID NO: 1317702 - DNA, 19 bp, Homo sapiens
ctgtgcaggcccaggcagg

SEQ ID NO: 1317703 - DNA, 23 bp, Homo sapiens
ctgtgcaggcccaggcaggccca

SEQ ID NO: 1317704 - DNA, 18 bp, Homo sapiens
ctgtgcccggtgccatct

SEQ ID NO: 1317705 - DNA, 23 bp, Homo sapiens
ctgtgcccggtgccatcttccat

SEQ ID NO: 1317706 - DNA, 14 bp, Homo sapiens
ctgtggggagggtc

SEQ ID NO: 1317707 - DNA, 23 bp, Homo sapiens
ctgtggtgctgggagatgctctc

SEQ ID NO: 1317708 - DNA, 14 bp, Homo sapiens
ctgtggttcactgc

SEQ ID NO: 1317709 - DNA, 14 bp, Homo sapiens
ctgtgtgttcctgg

SEQ ID NO: 1317710 - DNA, 16 bp, Homo sapiens
ctgttattttcagcat

SEQ ID NO: 1317711 - DNA, 20 bp, Homo sapiens
ctgttcaggagtccaaacct

SEQ ID NO: 1317712 - DNA, 23 bp, Homo sapiens
ctgttcaggagtccaaaccttct

SEQ ID NO: 1317713 - DNA, 12 bp, Homo sapiens
ctgttccccaca

SEQ ID NO: 1317714 - DNA, 13 bp, Homo sapiens
ctgttccccacag

SEQ ID NO: 1317715 - DNA, 14 bp, Homo sapiens
ctgttccccacagg

SEQ ID NO: 1317716 - DNA, 22 bp, Homo sapiens
ctgttccttcctgcagacctgg

SEQ ID NO: 1317717 - DNA, 14 bp, Homo sapiens
ctgttctcttgctt

SEQ ID NO: 1317718 - DNA, 18 bp, Homo sapiens
ctgttctgatattaattt

SEQ ID NO: 1317719 - DNA, 14 bp, Homo sapiens
ctgttgacctgccc

SEQ ID NO: 1317720 - DNA, 20 bp, Homo sapiens
tgctgggagatgctctctga

SEQ ID NO: 1317721 - DNA, 18 bp, Homo sapiens
tgctgtcagtcttgacct

SEQ ID NO: 1317722 - DNA, 19 bp, Homo sapiens
tgctgtggttcactgcact

SEQ ID NO: 1317723 - DNA, 15 bp, Homo sapiens
tgctgtgtgaaatct

SEQ ID NO: 1317724 - DNA, 20 bp, Homo sapiens
tgctgtgtgaaatctttcaa

SEQ ID NO: 1317725 - DNA, 23 bp, Homo sapiens
tgctttaaagagtcctccttccc

SEQ ID NO: 1317726 - DNA, 17 bp, Homo sapiens
tggaaactaataaaata

SEQ ID NO: 1317727 - DNA, 19 bp, Homo sapiens
tggaaactaataaaatatt

SEQ ID NO: 1317728 - DNA, 13 bp, Homo sapiens
tggaaatattaaa

SEQ ID NO: 1317729 - DNA, 18 bp, Homo sapiens
tggaactgcaactccagc

SEQ ID NO: 1317730 - DNA, 17 bp, Homo sapiens
tggaataaggagctggg

SEQ ID NO: 1317731 - DNA, 15 bp, Homo sapiens
tggacaaagttctgt

SEQ ID NO: 1317732 - DNA, 13 bp, Homo sapiens
tggacactgtgaa

SEQ ID NO: 1317733 - DNA, 15 bp, Homo sapiens
tggaccatgctgaga

SEQ ID NO: 1317734 - DNA, 23 bp, Homo sapiens
tggacctgtgtatggtgacctct

SEQ ID NO: 1317735 - DNA, 17 bp, Homo sapiens
tggagatatgcattcaa

SEQ ID NO: 1317736 - DNA, 13 bp, Homo sapiens
tggagtaggcctg

SEQ ID NO: 1317737 - DNA, 20 bp, Homo sapiens
tggagtccagatggcaggct

SEQ ID NO: 1317738 - DNA, 21 bp, Homo sapiens
tggagtccagatggcaggcta

SEQ ID NO: 1317739 - DNA, 13 bp, Homo sapiens
tggagtttaaaaa

SEQ ID NO: 1317740 - DNA, 17 bp, Homo sapiens
tggatttactgagagaa

SEQ ID NO: 1317741 - DNA, 19 bp, Homo sapiens
tggcaataatgtcaacacc

SEQ ID NO: 1317742 - DNA, 14 bp, Homo sapiens
tggcaggctgaggc

SEQ ID NO: 1317743 - DNA, 13 bp, Homo sapiens
tggcatgcatccc

SEQ ID NO: 1317744 - DNA, 21 bp, Homo sapiens
tggccaattttagtcttgctg

SEQ ID NO: 1317745 - DNA, 18 bp, Homo sapiens
tggccaccccttgctctc

SEQ ID NO: 1317746 - DNA, 20 bp, Homo sapiens
tggcccatcccgccttctcc

SEQ ID NO: 1317747 - DNA, 22 bp, Homo sapiens
tggcctcaactgagaagccaag

SEQ ID NO: 1317748 - DNA, 16 bp, Homo sapiens
tggcctctctccacta

SEQ ID NO: 1317749 - DNA, 22 bp, Homo sapiens
tggcctctctccactaccccga

SEQ ID NO: 1317750 - DNA, 11 bp, Homo sapiens
tggcctctgcc

SEQ ID NO: 1317751 - DNA, 12 bp, Homo sapiens
tggcctctgcca

SEQ ID NO: 1317752 - DNA, 17 bp, Homo sapiens
tggcctctgccatcctc

SEQ ID NO: 1317753 - DNA, 15 bp, Homo sapiens
tggccttgtggtcca

SEQ ID NO: 1317754 - DNA, 16 bp, Homo sapiens
tggccttgtggtccaa

SEQ ID NO: 1317755 - DNA, 17 bp, Homo sapiens
tggccttttccattcgc

SEQ ID NO: 1317756 - DNA, 13 bp, Homo sapiens
tggctatagatgg

SEQ ID NO: 1317757 - DNA, 13 bp, Homo sapiens
tggctcccctgca

SEQ ID NO: 1317758 - DNA, 21 bp, Homo sapiens
tggctcccctggggtgcaggc

SEQ ID NO: 1317759 - DNA, 15 bp, Homo sapiens
tggctcctcccagca

SEQ ID NO: 1317760 - DNA, 13 bp, Homo sapiens
tggctgcaggcac

SEQ ID NO: 1317761 - DNA, 18 bp, Homo sapiens
tggctgcaggcaccgctg

SEQ ID NO: 1317762 - DNA, 23 bp, Homo sapiens
tggctggccttgtggtccaaata

SEQ ID NO: 1317763 - DNA, 20 bp, Homo sapiens
tggcttcctggcgcccccta

SEQ ID NO: 1317764 - DNA, 15 bp, Homo sapiens
tgggaaaaaggctgg

SEQ ID NO: 1317765 - DNA, 15 bp, Homo sapiens
tgggagatgctctct

SEQ ID NO: 1317766 - DNA, 16 bp, Homo sapiens
tgggagatgctctctg

SEQ ID NO: 1317767 - DNA, 19 bp, Homo sapiens
tgggagcacatagccctgt

SEQ ID NO: 1317768 - DNA, 22 bp, Homo sapiens
tgggagcacatagccctgttga

SEQ ID NO: 1317769 - DNA, 19 bp, Homo sapiens
tgggagggagctgagaaga

SEQ ID NO: 1317770 - DNA, 21 bp, Homo sapiens
tgggcccctcagccacccttg

SEQ ID NO: 1317771 - DNA, 17 bp, Homo sapiens
tggggcctaataaaact

SEQ ID NO: 1317772 - DNA, 21 bp, Homo sapiens
tggggcctttggtaagggaag

SEQ ID NO: 1317773 - DNA, 18 bp, Homo sapiens
tggggcttctttctgctg

SEQ ID NO: 1317774 - DNA, 16 bp, Homo sapiens
tggggggagcaccctg

SEQ ID NO: 1317775 - DNA, 20 bp, Homo sapiens
tggggggagcaccctgaggg

SEQ ID NO: 1317776 - DNA, 21 bp, Homo sapiens
tggggggagcaccctgagggc

SEQ ID NO: 1317777 - DNA, 11 bp, Homo sapiens
tggggggaggc

SEQ ID NO: 1317778 - DNA, 13 bp, Homo sapiens
tggggggaggctg

SEQ ID NO: 1317779 - DNA, 22 bp, Homo sapiens
tgggtcctcgggcccctgagcc

SEQ ID NO: 1317780 - DNA, 23 bp, Homo sapiens
tgggtcctcgggcccctgagcct

SEQ ID NO: 1317781 - DNA, 16 bp, Homo sapiens
tgggtcgcccatgaga

SEQ ID NO: 1317782 - DNA, 22 bp, Homo sapiens
tgggttctgactctggaccatg

SEQ ID NO: 1317783 - DNA, 17 bp, Homo sapiens
tggtaaagtgttaagga

SEQ ID NO: 1317784 - DNA, 12 bp, Homo sapiens
tggtaagggaag

SEQ ID NO: 1317785 - DNA, 20 bp, Homo sapiens
tggtaagggaagtttagatg

SEQ ID NO: 1317786 - DNA, 13 bp, Homo sapiens
tggtcacacaagg

SEQ ID NO: 1317787 - DNA, 14 bp, Homo sapiens
tggtcacacaagga

SEQ ID NO: 1317788 - DNA, 16 bp, Homo sapiens
tggtcacacaaggaac

SEQ ID NO: 1317789 - DNA, 14 bp, Homo sapiens
tggtcaccctcagg

SEQ ID NO: 1317790 - DNA, 15 bp, Homo sapiens
tggtcaccctcagga

SEQ ID NO: 1317791 - DNA, 18 bp, Homo sapiens
tggtcatctctcctgtgt

SEQ ID NO: 1317792 - DNA, 20 bp, Homo sapiens
tggtcatctctcctgtgtct

SEQ ID NO: 1317793 - DNA, 11 bp, Homo sapiens
tggtccaaata

SEQ ID NO: 1317794 - DNA, 14 bp, Homo sapiens
tggtctcagtgtta

SEQ ID NO: 1317795 - DNA, 15 bp, Homo sapiens
tggtctcatgccccg

SEQ ID NO: 1317796 - DNA, 16 bp, Homo sapiens
tggtctcatgccccgc

SEQ ID NO: 1317797 - DNA, 11 bp, Homo sapiens
tggtcttctca

SEQ ID NO: 1317798 - DNA, 22 bp, Homo sapiens
tggtgctgggagatgctctctg

SEQ ID NO: 1317799 - DNA, 15 bp, Homo sapiens
tggtggctgcaggca

SEQ ID NO: 1317800 - DNA, 21 bp, Homo sapiens
tgaacaacccaatctggctgg

SEQ ID NO: 1317801 - DNA, 22 bp, Homo sapiens
tgaacagtttatgcagtgctgc

SEQ ID NO: 1317802 - DNA, 14 bp, Homo sapiens
tgaacttaacatgc

SEQ ID NO: 1317803 - DNA, 20 bp, Homo sapiens
tgaagaaagagactgtgggg

SEQ ID NO: 1317804 - DNA, 13 bp, Homo sapiens
tgaagaaggaatc

SEQ ID NO: 1317805 - DNA, 17 bp, Homo sapiens
tgaagacactgtgcagg

SEQ ID NO: 1317806 - DNA, 20 bp, Homo sapiens
tgaagacactgtgcaggccc

SEQ ID NO: 1317807 - DNA, 21 bp, Homo sapiens
tgaagacactgtgcaggccca

SEQ ID NO: 1317808 - DNA, 21 bp, Homo sapiens
tgaagacttaactggcccaga

SEQ ID NO: 1317809 - DNA, 22 bp, Homo sapiens
tgaagacttaactggcccagaa

SEQ ID NO: 1317810 - DNA, 18 bp, Homo sapiens
tgaagaggaggaggaggg

SEQ ID NO: 1317811 - DNA, 18 bp, Homo sapiens
tgaagcttattaatgcta

SEQ ID NO: 1317812 - DNA, 19 bp, Homo sapiens
tgaagcttattaatgctaa

SEQ ID NO: 1317813 - DNA, 20 bp, Homo sapiens
tgaagcttattaatgctaag

SEQ ID NO: 1317814 - DNA, 14 bp, Homo sapiens
tgaaggcacctgcc

SEQ ID NO: 1317815 - DNA, 23 bp, Homo sapiens
tgaagtaaaaccttttttcttgc

SEQ ID NO: 1317816 - DNA, 23 bp, Homo sapiens
tgaagtgttagactatagcccct

SEQ ID NO: 1317817 - DNA, 20 bp, Homo sapiens
tgaatgaaagtcttgtgact

SEQ ID NO: 1317818 - DNA, 18 bp, Homo sapiens
tgacagcacctgagaaga

SEQ ID NO: 1317819 - DNA, 21 bp, Homo sapiens
tgacagcacctgagaagagga

SEQ ID NO: 1317820 - DNA, 17 bp, Homo sapiens
tgacagcgcacagctgc

SEQ ID NO: 1317821 - DNA, 24 bp, Homo sapiens
tgacctccggccaggtgcctcctg

SEQ ID NO: 1317822 - DNA, 14 bp, Homo sapiens
tgacctctccagca

SEQ ID NO: 1317823 - DNA, 15 bp, Homo sapiens
tgacctctccagcat

SEQ ID NO: 1317824 - DNA, 16 bp, Homo sapiens
tgacctctccagcatc

SEQ ID NO: 1317825 - DNA, 19 bp, Homo sapiens
tgacctctccagcatccca

SEQ ID NO: 1317826 - DNA, 23 bp, Homo sapiens
tgacctctccagcatcccagcct

SEQ ID NO: 1317827 - DNA, 13 bp, Homo sapiens
tgacctctccggc

SEQ ID NO: 1317828 - DNA, 19 bp, Homo sapiens
tgacctgcccgatccagat

SEQ ID NO: 1317829 - DNA, 23 bp, Homo sapiens
tgacctgcccgatccagattccc

SEQ ID NO: 1317830 - DNA, 18 bp, Homo sapiens
tgaccttgacttgccatg

SEQ ID NO: 1317831 - DNA, 15 bp, Homo sapiens
tgactagtgctgaag

SEQ ID NO: 1317832 - DNA, 16 bp, Homo sapiens
tgactataatgcctct

SEQ ID NO: 1317833 - DNA, 12 bp, Homo sapiens
tgactcctggtc

SEQ ID NO: 1317834 - DNA, 21 bp, Homo sapiens
tgactctggaccatgctgaga

SEQ ID NO: 1317835 - DNA, 14 bp, Homo sapiens
tgactgaagggaaa

SEQ ID NO: 1317836 - DNA, 18 bp, Homo sapiens
tgagaattgggactctgt

SEQ ID NO: 1317837 - DNA, 19 bp, Homo sapiens
tgagaattgggactctgtt

SEQ ID NO: 1317838 - DNA, 21 bp, Homo sapiens
tgagaattgtgttatttcact

SEQ ID NO: 1317839 - DNA, 17 bp, Homo sapiens
tgagacaaaaaggaaac

SEQ ID NO: 1317840 - DNA, 17 bp, Homo sapiens
tgagacatccctcatct

SEQ ID NO: 1317841 - DNA, 17 bp, Homo sapiens
tgagagagcagccagga

SEQ ID NO: 1317842 - DNA, 15 bp, Homo sapiens
tgagcctgtgtcctg

SEQ ID NO: 1317843 - DNA, 14 bp, Homo sapiens
tgagcgaagccccc

SEQ ID NO: 1317844 - DNA, 14 bp, Homo sapiens
tgaggcaaggccca

SEQ ID NO: 1317845 - DNA, 20 bp, Homo sapiens
tgaggcagcacgtgcacaaa

SEQ ID NO: 1317846 - DNA, 18 bp, Homo sapiens
tgaggccactgaagagga

SEQ ID NO: 1317847 - DNA, 19 bp, Homo sapiens
tgagtccatgtcctatgcc

SEQ ID NO: 1317848 - DNA, 21 bp, Homo sapiens
tgagtccatgtcctatgcctc

SEQ ID NO: 1317849 - DNA, 20 bp, Homo sapiens
tgagttcacatgtgccctgc

SEQ ID NO: 1317850 - DNA, 22 bp, Homo sapiens
tgagttcacatgtgccctgcct

SEQ ID NO: 1317851 - DNA, 23 bp, Homo sapiens
tgagttcacatgtgccctgcctt

SEQ ID NO: 1317852 - DNA, 13 bp, Homo sapiens
tgatataaacagc

SEQ ID NO: 1317853 - DNA, 22 bp, Homo sapiens
tgatattaatttatcagattgc

SEQ ID NO: 1317854 - DNA, 21 bp, Homo sapiens
tgatgataaaaggagaataag

SEQ ID NO: 1317855 - DNA, 19 bp, Homo sapiens
tgatgtcctgtaaacactc

SEQ ID NO: 1317856 - DNA, 21 bp, Homo sapiens
tgatgtcctgtaaacactcag

SEQ ID NO: 1317857 - DNA, 12 bp, Homo sapiens
tgatgtgaaact

SEQ ID NO: 1317858 - DNA, 17 bp, Homo sapiens
tgcaaaatggagaccaa

SEQ ID NO: 1317859 - DNA, 23 bp, Homo sapiens
tgcaaactatgagttcacatgtg

SEQ ID NO: 1317860 - DNA, 21 bp, Homo sapiens
tgcaaagtataaatttgtgta

SEQ ID NO: 1317861 - DNA, 19 bp, Homo sapiens
tgcaaatgcattgtgaatt

SEQ ID NO: 1317862 - DNA, 18 bp, Homo sapiens
tgcaacgctcactggttt

SEQ ID NO: 1317863 - DNA, 20 bp, Homo sapiens
tgcaactccagcgtcctcag

SEQ ID NO: 1317864 - DNA, 21 bp, Homo sapiens
tgcaactccagcgtcctcagc

SEQ ID NO: 1317865 - DNA, 22 bp, Homo sapiens
tgcaactccagcgtcctcagca

SEQ ID NO: 1317866 - DNA, 22 bp, Homo sapiens
tgcaagggatgaattgtaaaag

SEQ ID NO: 1317867 - DNA, 22 bp, Homo sapiens
tgcacatccttcttggcttcct

SEQ ID NO: 1317868 - DNA, 22 bp, Homo sapiens
tgcaccatagtatgctctgagt

SEQ ID NO: 1317869 - DNA, 20 bp, Homo sapiens
tgcagaactttctcttttga

SEQ ID NO: 1317870 - DNA, 15 bp, Homo sapiens
tgcagacctggctgg

SEQ ID NO: 1317871 - DNA, 21 bp, Homo sapiens
tgcagacctggctgggcctgg

SEQ ID NO: 1317872 - DNA, 18 bp, Homo sapiens
tgcagatgaagtaactga

SEQ ID NO: 1317873 - DNA, 22 bp, Homo sapiens
tgcagatgaagtaactgaggct

SEQ ID NO: 1317874 - DNA, 19 bp, Homo sapiens
tgcaggcacacacgccttc

SEQ ID NO: 1317875 - DNA, 22 bp, Homo sapiens
tgcaggcacacacgccttcatg

SEQ ID NO: 1317876 - DNA, 23 bp, Homo sapiens
tgcaggcacacacgccttcatgc

SEQ ID NO: 1317877 - DNA, 23 bp, Homo sapiens
tgcaggccagtcccacggctctg

SEQ ID NO: 1317878 - DNA, 20 bp, Homo sapiens
tgcaggcccaggcaggccca

SEQ ID NO: 1317879 - DNA, 23 bp, Homo sapiens
tgcaggcccaggcaggcccagcc

SEQ ID NO: 1317880 - DNA, 16 bp, Homo sapiens
tgcagtgctgctttgc

SEQ ID NO: 1317881 - DNA, 20 bp, Homo sapiens
tgcatacgcattaagggcct

SEQ ID NO: 1317882 - DNA, 19 bp, Homo sapiens
tgcatgccaggaagcacgt

SEQ ID NO: 1317883 - DNA, 16 bp, Homo sapiens
tgcattgtgaattgcc

SEQ ID NO: 1317884 - DNA, 13 bp, Homo sapiens
gacctctccggcc

SEQ ID NO: 1317885 - DNA, 15 bp, Homo sapiens
gacctggctgggcct

SEQ ID NO: 1317886 - DNA, 18 bp, Homo sapiens
gacctggctgggcctggg

SEQ ID NO: 1317887 - DNA, 15 bp, Homo sapiens
agactgtggggaggg

SEQ ID NO: 1317888 - DNA, 13 bp, Homo sapiens
agagcgcagcccg

SEQ ID NO: 1317889 - DNA, 13 bp, Homo sapiens
agagctgtacatt

SEQ ID NO: 1317890 - DNA, 21 bp, Homo sapiens
agaggaaccgttttacactgg

SEQ ID NO: 1317891 - DNA, 19 bp, Homo sapiens
agaggcctgaaatcctggt

SEQ ID NO: 1317892 - DNA, 20 bp, Homo sapiens
agaggcctgaaatcctggtt

SEQ ID NO: 1317893 - DNA, 23 bp, Homo sapiens
agaggcctgaaatcctggttcct

SEQ ID NO: 1317894 - DNA, 22 bp, Homo sapiens
agagggaggacctgttgtgttc

SEQ ID NO: 1317895 - DNA, 17 bp, Homo sapiens
agagggagtagaaagct

SEQ ID NO: 1317896 - DNA, 19 bp, Homo sapiens
agaggggaatgagggctga

SEQ ID NO: 1317897 - DNA, 18 bp, Homo sapiens
agagtcctccttcccagc

SEQ ID NO: 1317898 - DNA, 19 bp, Homo sapiens
agagtcctccttcccagct

SEQ ID NO: 1317899 - DNA, 17 bp, Homo sapiens
agataaaaaaacagctt

SEQ ID NO: 1317900 - DNA, 15 bp, Homo sapiens
agatacaatcagctg

SEQ ID NO: 1317901 - DNA, 17 bp, Homo sapiens
agatacaatcagctgct

SEQ ID NO: 1317902 - DNA, 16 bp, Homo sapiens
agatagcagcctggct

SEQ ID NO: 1317903 - DNA, 13 bp, Homo sapiens
agatatgcattca

SEQ ID NO: 1317904 - DNA, 15 bp, Homo sapiens
agatcatccccgagg

SEQ ID NO: 1317905 - DNA, 23 bp, Homo sapiens
agatctttgcaccagatactcat

SEQ ID NO: 1317906 - DNA, 14 bp, Homo sapiens
agatgaacatctct

SEQ ID NO: 1317907 - DNA, 20 bp, Homo sapiens
agatgaacatctctgttatt

SEQ ID NO: 1317908 - DNA, 13 bp, Homo sapiens
agatgaagaaaga

SEQ ID NO: 1317909 - DNA, 15 bp, Homo sapiens
agatgaagaaagaga

SEQ ID NO: 1317910 - DNA, 11 bp, Homo sapiens
agatgctctct

SEQ ID NO: 1317911 - DNA, 15 bp, Homo sapiens
agatgctctctgagg

SEQ ID NO: 1317912 - DNA, 12 bp, Homo sapiens
agattcccaggc

SEQ ID NO: 1317913 - DNA, 23 bp, Homo sapiens
agattggacataactgacttagt

SEQ ID NO: 1317914 - DNA, 19 bp, Homo sapiens
agattttaagaatggtctc

SEQ ID NO: 1317915 - DNA, 20 bp, Homo sapiens
agattttaagaatggtctca

SEQ ID NO: 1317916 - DNA, 19 bp, Homo sapiens
agcaaacctaattgcacaa

SEQ ID NO: 1317917 - DNA, 21 bp, Homo sapiens
agcaagcctttgacctgttca

SEQ ID NO: 1317918 - DNA, 17 bp, Homo sapiens
agcaagtagagcagagt

SEQ ID NO: 1317919 - DNA, 16 bp, Homo sapiens
agcacaaactgccatt

SEQ ID NO: 1317920 - DNA, 19 bp, Homo sapiens
agcacatagccctgttgac

SEQ ID NO: 1317921 - DNA, 12 bp, Homo sapiens
agcaccctgagg

SEQ ID NO: 1317922 - DNA, 14 bp, Homo sapiens
agcacctgagaaga

SEQ ID NO: 1317923 - DNA, 17 bp, Homo sapiens
agcagcctggctcccct

SEQ ID NO: 1317924 - DNA, 19 bp, Homo sapiens
agcagcctggctcccctgg

SEQ ID NO: 1317925 - DNA, 12 bp, Homo sapiens
agcatcccagcc

SEQ ID NO: 1317926 - DNA, 13 bp, Homo sapiens
agcatcccagcct

SEQ ID NO: 1317927 - DNA, 22 bp, Homo sapiens
agcatgataccaggcccaggag

SEQ ID NO: 1317928 - DNA, 15 bp, Homo sapiens
agcatgttgtagata

SEQ ID NO: 1317929 - DNA, 16 bp, Homo sapiens
agccaagcctggagta

SEQ ID NO: 1317930 - DNA, 22 bp, Homo sapiens
agccaagcctggagtaggcctg

SEQ ID NO: 1317931 - DNA, 12 bp, Homo sapiens
agccacaggcct

SEQ ID NO: 1317932 - DNA, 14 bp, Homo sapiens
agccacaggcctgg

SEQ ID NO: 1317933 - DNA, 16 bp, Homo sapiens
agccacaggcctggcc

SEQ ID NO: 1317934 - DNA, 21 bp, Homo sapiens
agccaggaacagggaccagct

SEQ ID NO: 1317935 - DNA, 23 bp, Homo sapiens
agccaggaacagggaccagctcc

SEQ ID NO: 1317936 - DNA, 20 bp, Homo sapiens
agcccaagctaagctgcagg

SEQ ID NO: 1317937 - DNA, 20 bp, Homo sapiens
agccccaagactctgctctc

SEQ ID NO: 1317938 - DNA, 21 bp, Homo sapiens
agccccaagactctgctctcc

SEQ ID NO: 1317939 - DNA, 22 bp, Homo sapiens
agcccctagatgaagaaagaga

SEQ ID NO: 1317940 - DNA, 11 bp, Homo sapiens
agccctgaggg

SEQ ID NO: 1317941 - DNA, 19 bp, Homo sapiens
agccctgaggggtggacta

SEQ ID NO: 1317942 - DNA, 13 bp, Homo sapiens
agcctcctctgga

SEQ ID NO: 1317943 - DNA, 15 bp, Homo sapiens
agcctcctctggaga

SEQ ID NO: 1317944 - DNA, 14 bp, Homo sapiens
agcctctgccccac

SEQ ID NO: 1317945 - DNA, 18 bp, Homo sapiens
agcctggagtaggcctgg

SEQ ID NO: 1317946 - DNA, 12 bp, Homo sapiens
agcctggctccc

SEQ ID NO: 1317947 - DNA, 15 bp, Homo sapiens
agcctggctcccctg

SEQ ID NO: 1317948 - DNA, 14 bp, Homo sapiens
agcctgggcccctc

SEQ ID NO: 1317949 - DNA, 18 bp, Homo sapiens
agcctgggcccctcagcc

SEQ ID NO: 1317950 - DNA, 19 bp, Homo sapiens
agcctgggcccctcagcca

SEQ ID NO: 1317951 - DNA, 15 bp, Homo sapiens
agcctgggtgacaga

SEQ ID NO: 1317952 - DNA, 14 bp, Homo sapiens
agcctgttccttcc

SEQ ID NO: 1317953 - DNA, 18 bp, Homo sapiens
agcctgttccttcctgca

SEQ ID NO: 1317954 - DNA, 23 bp, Homo sapiens
agcctgttccttcctgcagacct

SEQ ID NO: 1317955 - DNA, 23 bp, Homo sapiens
agccttcaatcaacatctcttga

SEQ ID NO: 1317956 - DNA, 18 bp, Homo sapiens
agccttcttgctgcccac

SEQ ID NO: 1317957 - DNA, 13 bp, Homo sapiens
agcctttgacctg

SEQ ID NO: 1317958 - DNA, 17 bp, Homo sapiens
agcgaagcccccactac

SEQ ID NO: 1317959 - DNA, 18 bp, Homo sapiens
agcgaagcccccactact

SEQ ID NO: 1317960 - DNA, 15 bp, Homo sapiens
agcgagactttgtcc

SEQ ID NO: 1317961 - DNA, 15 bp, Homo sapiens
agctaataaaatatc

SEQ ID NO: 1317962 - DNA, 18 bp, Homo sapiens
agctaataaaatatcatt

SEQ ID NO: 1317963 - DNA, 14 bp, Homo sapiens
agctactcatgact

SEQ ID NO: 1317964 - DNA, 21 bp, Homo sapiens
agctctacattctgctctgcc

SEQ ID NO: 1317965 - DNA, 23 bp, Homo sapiens
agctctacattctgctctgccca

SEQ ID NO: 1317966 - DNA, 15 bp, Homo sapiens
agctgaatagaggga

SEQ ID NO: 1317967 - DNA, 23 bp, Homo sapiens
agctgcaggcacacacgccttca

SEQ ID NO: 1317968 - DNA, 13 bp, Homo sapiens
agctgctttgtta

SEQ ID NO: 1317969 - DNA, 16 bp, Homo sapiens
agctgctttgttacct

SEQ ID NO: 1317970 - DNA, 20 bp, Homo sapiens
agctgctttgttaccttaaa

SEQ ID NO: 1317971 - DNA, 22 bp, Homo sapiens
agctgctttgttaccttaaaac

SEQ ID NO: 1317972 - DNA, 15 bp, Homo sapiens
agctggggcttcttt

SEQ ID NO: 1317973 - DNA, 20 bp, Homo sapiens
agctggggcttctttctgct

SEQ ID NO: 1317974 - DNA, 15 bp, Homo sapiens
agctggtcacacaag

SEQ ID NO: 1317975 - DNA, 13 bp, Homo sapiens
agctgttgactct

SEQ ID NO: 1317976 - DNA, 23 bp, Homo sapiens
agctgttgactctagtactgtga

SEQ ID NO: 1317977 - DNA, 18 bp, Homo sapiens
agcttattaatgctaagg

SEQ ID NO: 1317978 - DNA, 13 bp, Homo sapiens
agcttcaggacct

SEQ ID NO: 1317979 - DNA, 12 bp, Homo sapiens
agcttttgatgt

SEQ ID NO: 1317980 - DNA, 11 bp, Homo sapiens
aggaacaggga

SEQ ID NO: 1317981 - DNA, 19 bp, Homo sapiens
aggaacagggaccagctcc

SEQ ID NO: 1317982 - DNA, 14 bp, Homo sapiens
aggacagcacacgg

SEQ ID NO: 1317983 - DNA, 17 bp, Homo sapiens
aggaccccctccccaac

SEQ ID NO: 1317984 - DNA, 16 bp, Homo sapiens
aggacctcggggaata

SEQ ID NO: 1317985 - DNA, 21 bp, Homo sapiens
aggacctcggggaataaaaca

SEQ ID NO: 1317986 - DNA, 15 bp, Homo sapiens
aggactactcagcac

SEQ ID NO: 1317987 - DNA, 22 bp, Homo sapiens
aggactggaactgcaactccag

SEQ ID NO: 1317988 - DNA, 23 bp, Homo sapiens
aggacttcccccaccccagaaga

SEQ ID NO: 1317989 - DNA, 13 bp, Homo sapiens
aggaggagacaga

SEQ ID NO: 1317990 - DNA, 14 bp, Homo sapiens
aggaggaggagggt

SEQ ID NO: 1317991 - DNA, 14 bp, Homo sapiens
aggagtccaaacct

SEQ ID NO: 1317992 - DNA, 18 bp, Homo sapiens
aggagtccaaaccttcta

SEQ ID NO: 1317993 - DNA, 20 bp, Homo sapiens
aggatatgctttaagacaga

SEQ ID NO: 1317994 - DNA, 14 bp, Homo sapiens
aggcaaggcccaga

SEQ ID NO: 1317995 - DNA, 16 bp, Homo sapiens
aggcaaggcccagacc

SEQ ID NO: 1317996 - DNA, 22 bp, Homo sapiens
aggcaaggcccagacctggcct

SEQ ID NO: 1317997 - DNA, 16 bp, Homo sapiens
aggcacctgcccccac

SEQ ID NO: 1317998 - DNA, 23 bp, Homo sapiens
aggcacctgcccccacagctcct

SEQ ID NO: 1317999 - DNA, 14 bp, Homo sapiens
aggcagaaggccag

SEQ ID NO: 1318000 - DNA, 15 bp, Homo sapiens
aggcaggcccagcct

SEQ ID NO: 1318001 - DNA, 21 bp, Homo sapiens
aggcaggcccagcctctgccc

SEQ ID NO: 1318002 - DNA, 18 bp, Homo sapiens
aggcatcactttcctgga

SEQ ID NO: 1318003 - DNA, 12 bp, Homo sapiens
aggccactgaag

SEQ ID NO: 1318004 - DNA, 15 bp, Homo sapiens
aggccaggctcccga

SEQ ID NO: 1318005 - DNA, 23 bp, Homo sapiens
aggccaggctcccgaccccatcc

SEQ ID NO: 1318006 - DNA, 20 bp, Homo sapiens
aggccagtcccacggctctg

SEQ ID NO: 1318007 - DNA, 22 bp, Homo sapiens
aggcccaaattatcaagctaat

SEQ ID NO: 1318008 - DNA, 12 bp, Homo sapiens
aggcccagacct

SEQ ID NO: 1318009 - DNA, 17 bp, Homo sapiens
aggcccagacctggcct

SEQ ID NO: 1318010 - DNA, 19 bp, Homo sapiens
aggcccagacctggcctct

SEQ ID NO: 1318011 - DNA, 22 bp, Homo sapiens
aggcccagacctggcctctgcc

SEQ ID NO: 1318012 - DNA, 17 bp, Homo sapiens
aggcctgaaatcctggt

SEQ ID NO: 1318013 - DNA, 15 bp, Homo sapiens
aggcctggcctcaac

SEQ ID NO: 1318014 - DNA, 17 bp, Homo sapiens
aggctcccgaccccatc

SEQ ID NO: 1318015 - DNA, 15 bp, Homo sapiens
aggctgactcctggt

SEQ ID NO: 1318016 - DNA, 16 bp, Homo sapiens
aggctgactcctggtc

SEQ ID NO: 1318017 - DNA, 13 bp, Homo sapiens
aggctggaaggag

SEQ ID NO: 1318018 - DNA, 18 bp, Homo sapiens
aggctggaaggaggaaga

SEQ ID NO: 1318019 - DNA, 23 bp, Homo sapiens
aggctggtccctatgtcatgtct

SEQ ID NO: 1318020 - DNA, 22 bp, Homo sapiens
cacaattttattttttttctgt

SEQ ID NO: 1318021 - DNA, 18 bp, Homo sapiens
cacacacgccttcatgcc

SEQ ID NO: 1318022 - DNA, 14 bp, Homo sapiens
cacacccagcctgt

SEQ ID NO: 1318023 - DNA, 13 bp, Homo sapiens
cacacctcctggg

SEQ ID NO: 1318024 - DNA, 21 bp, Homo sapiens
cacagaccgcgcccctgggac

SEQ ID NO: 1318025 - DNA, 17 bp, Homo sapiens
cacagcctccgcggact

SEQ ID NO: 1318026 - DNA, 22 bp, Homo sapiens
cacaggacttcccccaccccag

SEQ ID NO: 1318027 - DNA, 16 bp, Homo sapiens
cacaggcctggcctca

SEQ ID NO: 1318028 - DNA, 17 bp, Homo sapiens
cacaggcctggcctcaa

SEQ ID NO: 1318029 - DNA, 14 bp, Homo sapiens
cacaggtcctccat

SEQ ID NO: 1318030 - DNA, 21 bp, Homo sapiens
cacatagccctgttgacctgc

SEQ ID NO: 1318031 - DNA, 21 bp, Homo sapiens
cacatccttcttggcttcctg

SEQ ID NO: 1318032 - DNA, 15 bp, Homo sapiens
cacatggaatgaggg

SEQ ID NO: 1318033 - DNA, 13 bp, Homo sapiens
cacatgtgaaaac

SEQ ID NO: 1318034 - DNA, 14 bp, Homo sapiens
cacatgtgaaaacc

SEQ ID NO: 1318035 - DNA, 17 bp, Homo sapiens
cacatttaatgaacaca

SEQ ID NO: 1318036 - DNA, 23 bp, Homo sapiens
caccaccccacccacctttgcag

SEQ ID NO: 1318037 - DNA, 23 bp, Homo sapiens
caccactgtgctcaaccagacag

SEQ ID NO: 1318038 - DNA, 22 bp, Homo sapiens
caccagtgaatgaaagtcttgt

SEQ ID NO: 1318039 - DNA, 16 bp, Homo sapiens
caccatcacagcttgt

SEQ ID NO: 1318040 - DNA, 15 bp, Homo sapiens
cacccacctttgcag

SEQ ID NO: 1318041 - DNA, 14 bp, Homo sapiens
cacccagcctgtcc

SEQ ID NO: 1318042 - DNA, 21 bp, Homo sapiens
cacccatcagtggagtccaga

SEQ ID NO: 1318043 - DNA, 12 bp, Homo sapiens
caccccacccac

SEQ ID NO: 1318044 - DNA, 14 bp, Homo sapiens
caccccacccacct

SEQ ID NO: 1318045 - DNA, 15 bp, Homo sapiens
caccccacccacctt

SEQ ID NO: 1318046 - DNA, 16 bp, Homo sapiens
caccccacccaccttt

SEQ ID NO: 1318047 - DNA, 16 bp, Homo sapiens
caccccactcctcagt

SEQ ID NO: 1318048 - DNA, 21 bp, Homo sapiens
cacccctggtggctgcaggca

SEQ ID NO: 1318049 - DNA, 22 bp, Homo sapiens
cacccctggtggctgcaggcac

SEQ ID NO: 1318050 - DNA, 11 bp, Homo sapiens
caccctgaggg

SEQ ID NO: 1318051 - DNA, 12 bp, Homo sapiens
caccctgagggc

SEQ ID NO: 1318052 - DNA, 18 bp, Homo sapiens
cacccttggtctcatgcc

SEQ ID NO: 1318053 - DNA, 20 bp, Homo sapiens
caccggggaacaatttctct

SEQ ID NO: 1318054 - DNA, 19 bp, Homo sapiens
cacctatccaccaccccac

SEQ ID NO: 1318055 - DNA, 17 bp, Homo sapiens
cacctcacactccttta

SEQ ID NO: 1318056 - DNA, 19 bp, Homo sapiens
cacctctcagagcaagcct

SEQ ID NO: 1318057 - DNA, 21 bp, Homo sapiens
cacctctcagagcaagccttt

SEQ ID NO: 1318058 - DNA, 19 bp, Homo sapiens
cacctgcagcctccctccg

SEQ ID NO: 1318059 - DNA, 20 bp, Homo sapiens
cacgagggtaggaccctcat

SEQ ID NO: 1318060 - DNA, 19 bp, Homo sapiens
cacgccttcatgccagtgc

SEQ ID NO: 1318061 - DNA, 16 bp, Homo sapiens
cacggctctgtgcccg

SEQ ID NO: 1318062 - DNA, 19 bp, Homo sapiens
cacggctctgtgcccggtg

SEQ ID NO: 1318063 - DNA, 11 bp, Homo sapiens
cactcagctgt

SEQ ID NO: 1318064 - DNA, 21 bp, Homo sapiens
cactcagctgttcagattgga

SEQ ID NO: 1318065 - DNA, 11 bp, Homo sapiens
cactgaagagg

SEQ ID NO: 1318066 - DNA, 12 bp, Homo sapiens
cactgaagagga

SEQ ID NO: 1318067 - DNA, 15 bp, Homo sapiens
cactgaagaggagga

SEQ ID NO: 1318068 - DNA, 14 bp, Homo sapiens
cactgcactgttca

SEQ ID NO: 1318069 - DNA, 15 bp, Homo sapiens
cactggatgtttctc

SEQ ID NO: 1318070 - DNA, 15 bp, Homo sapiens
cactggctcctccca

SEQ ID NO: 1318071 - DNA, 16 bp, Homo sapiens
cactggctcctcccag

SEQ ID NO: 1318072 - DNA, 19 bp, Homo sapiens
cactggctcctcccagcac

SEQ ID NO: 1318073 - DNA, 22 bp, Homo sapiens
cactggctcctcccagcacagg

SEQ ID NO: 1318074 - DNA, 24 bp, Homo sapiens
cactggctcctcccagcacaggca

SEQ ID NO: 1318075 - DNA, 14 bp, Homo sapiens
cactgtgcaggccc

SEQ ID NO: 1318076 - DNA, 16 bp, Homo sapiens
cactgtgcaggcccag

SEQ ID NO: 1318077 - DNA, 18 bp, Homo sapiens
cactgtgcaggcccaggc

SEQ ID NO: 1318078 - DNA, 20 bp, Homo sapiens
cactgtgcaggcccaggcag

SEQ ID NO: 1318079 - DNA, 14 bp, Homo sapiens
cactgttattttca

SEQ ID NO: 1318080 - DNA, 19 bp, Homo sapiens
cactgttattttcagcatg

SEQ ID NO: 1318081 - DNA, 22 bp, Homo sapiens
cactgttcaggagtccaaacct

SEQ ID NO: 1318082 - DNA, 14 bp, Homo sapiens
cacttaattctgtt

SEQ ID NO: 1318083 - DNA, 19 bp, Homo sapiens
cagaaaaaatgtgaagtct

SEQ ID NO: 1318084 - DNA, 12 bp, Homo sapiens
cagaacagctgt

SEQ ID NO: 1318085 - DNA, 13 bp, Homo sapiens
cagaacagctgtt

SEQ ID NO: 1318086 - DNA, 14 bp, Homo sapiens
cagaactttctctt

SEQ ID NO: 1318087 - DNA, 18 bp, Homo sapiens
cagaactttctcttttga

SEQ ID NO: 1318088 - DNA, 19 bp, Homo sapiens
cagaagtccttaagcagag

SEQ ID NO: 1318089 - DNA, 14 bp, Homo sapiens
cagaattcactgtc

SEQ ID NO: 1318090 - DNA, 12 bp, Homo sapiens
cagacctggcct

SEQ ID NO: 1318091 - DNA, 16 bp, Homo sapiens
cagacctggcctctgc

SEQ ID NO: 1318092 - DNA, 21 bp, Homo sapiens
cagacttttttaaacatcaaa

SEQ ID NO: 1318093 - DNA, 21 bp, Homo sapiens
cagagattattcaacagagag

SEQ ID NO: 1318094 - DNA, 12 bp, Homo sapiens
cagagcaagcct

SEQ ID NO: 1318095 - DNA, 19 bp, Homo sapiens
cagagcaagcctttgacct

SEQ ID NO: 1318096 - DNA, 15 bp, Homo sapiens
cagatgccggagccc

SEQ ID NO: 1318097 - DNA, 14 bp, Homo sapiens
cagattcccaggcc

SEQ ID NO: 1318098 - DNA, 17 bp, Homo sapiens
cagattcccaggccagg

SEQ ID NO: 1318099 - DNA, 12 bp, Homo sapiens
cagattgctttt

SEQ ID NO: 1318100 - DNA, 15 bp, Homo sapiens
cagcacaggcaccta

SEQ ID NO: 1318101 - DNA, 17 bp, Homo sapiens
cagcaccccactcctca

SEQ ID NO: 1318102 - DNA, 16 bp, Homo sapiens
cagcactgtttgaaga

SEQ ID NO: 1318103 - DNA, 22 bp, Homo sapiens
cagcatcccagcctcagaagcc

SEQ ID NO: 1318104 - DNA, 22 bp, Homo sapiens
cagccacccttggtctcatgcc

SEQ ID NO: 1318105 - DNA, 13 bp, Homo sapiens
cagccctgagggg

SEQ ID NO: 1318106 - DNA, 15 bp, Homo sapiens
cagcctcagaagcct

SEQ ID NO: 1318107 - DNA, 17 bp, Homo sapiens
cagcctcagaagccttc

SEQ ID NO: 1318108 - DNA, 23 bp, Homo sapiens
cagcctcagaagccttcttgctg

SEQ ID NO: 1318109 - DNA, 17 bp, Homo sapiens
cagcctccgcggactgg

SEQ ID NO: 1318110 - DNA, 13 bp, Homo sapiens
cagcctctgcccc

SEQ ID NO: 1318111 - DNA, 16 bp, Homo sapiens
cagcctctgccccacc

SEQ ID NO: 1318112 - DNA, 18 bp, Homo sapiens
cagcctctgccccaccca

SEQ ID NO: 1318113 - DNA, 20 bp, Homo sapiens
cagcctctgccccacccatc

SEQ ID NO: 1318114 - DNA, 22 bp, Homo sapiens
cagcctctgccccacccatcag

SEQ ID NO: 1318115 - DNA, 19 bp, Homo sapiens
cagcctggctcccctgggg

SEQ ID NO: 1318116 - DNA, 17 bp, Homo sapiens
cagcctgggcccctcag

SEQ ID NO: 1318117 - DNA, 24 bp, Homo sapiens
cagcctgggcccctcagccaccct

SEQ ID NO: 1318118 - DNA, 20 bp, Homo sapiens
cagcctgtcccactggctcc

SEQ ID NO: 1318119 - DNA, 22 bp, Homo sapiens
cagcctgttccttcctgcagac

SEQ ID NO: 1318120 - DNA, 21 bp, Homo sapiens
cagccttcaatcaacatctct

SEQ ID NO: 1318121 - DNA, 13 bp, Homo sapiens
cagcgtcctcagc

SEQ ID NO: 1318122 - DNA, 14 bp, Homo sapiens
cagcgtcctcagca

SEQ ID NO: 1318123 - DNA, 15 bp, Homo sapiens
cagcgtcctcagcac

SEQ ID NO: 1318124 - DNA, 18 bp, Homo sapiens
cagctccccgggggccaa

SEQ ID NO: 1318125 - DNA, 18 bp, Homo sapiens
cagctctacattctgctc

SEQ ID NO: 1318126 - DNA, 16 bp, Homo sapiens
cagctgctttgttacc

SEQ ID NO: 1318127 - DNA, 14 bp, Homo sapiens
cagctgttgactct

SEQ ID NO: 1318128 - DNA, 19 bp, Homo sapiens
cagctgttgactctagtac

SEQ ID NO: 1318129 - DNA, 23 bp, Homo sapiens
cagctgttgactctagtactgtg

SEQ ID NO: 1318130 - DNA, 17 bp, Homo sapiens
caggaacagggaccagc

SEQ ID NO: 1318131 - DNA, 16 bp, Homo sapiens
caggacatgtactgag

SEQ ID NO: 1318132 - DNA, 22 bp, Homo sapiens
caggagagcttagggtctcagg

SEQ ID NO: 1318133 - DNA, 23 bp, Homo sapiens
caggcacacacgccttcatgcca

SEQ ID NO: 1318134 - DNA, 16 bp, Homo sapiens
caggcaggcccagcct

SEQ ID NO: 1318135 - DNA, 20 bp, Homo sapiens
caggccagtcccacggctct

SEQ ID NO: 1318136 - DNA, 21 bp, Homo sapiens
caggccagtcccacggctctg

SEQ ID NO: 1318137 - DNA, 22 bp, Homo sapiens
caggccagtcccacggctctgt

SEQ ID NO: 1318138 - DNA, 24 bp, Homo sapiens
caggccagtcccacggctctgtgc

SEQ ID NO: 1318139 - DNA, 13 bp, Homo sapiens
caggcccaggcag

SEQ ID NO: 1318140 - DNA, 18 bp, Homo sapiens
caggcccaggcaggccca

SEQ ID NO: 1318141 - DNA, 13 bp, Homo sapiens
caggcctggcctc

SEQ ID NO: 1318142 - DNA, 15 bp, Homo sapiens
caggcctggcctcaa

SEQ ID NO: 1318143 - DNA, 16 bp, Homo sapiens
caggcctggcctcaac

SEQ ID NO: 1318144 - DNA, 17 bp, Homo sapiens
caggctacagttgggaa

SEQ ID NO: 1318145 - DNA, 14 bp, Homo sapiens
caggcttcccctcc

SEQ ID NO: 1318146 - DNA, 14 bp, Homo sapiens
cagggaccagctcc

SEQ ID NO: 1318147 - DNA, 17 bp, Homo sapiens
cagggaccagctccccg

SEQ ID NO: 1318148 - DNA, 19 bp, Homo sapiens
cagggtctgaaaggggtgt

SEQ ID NO: 1318149 - DNA, 20 bp, Homo sapiens
caggtcctccatcacccctg

SEQ ID NO: 1318150 - DNA, 15 bp, Homo sapiens
caggtgcctcctgac

SEQ ID NO: 1318151 - DNA, 17 bp, Homo sapiens
cagtaaaagtcttctcc

SEQ ID NO: 1318152 - DNA, 18 bp, Homo sapiens
ccagtgcatgccaggaag

SEQ ID NO: 1318153 - DNA, 15 bp, Homo sapiens
ccatatccgggtgct

SEQ ID NO: 1318154 - DNA, 18 bp, Homo sapiens
ccatatccgggtgctcaa

SEQ ID NO: 1318155 - DNA, 15 bp, Homo sapiens
ccatcacagcttgtt

SEQ ID NO: 1318156 - DNA, 18 bp, Homo sapiens
ccatcagtggagtccaga

SEQ ID NO: 1318157 - DNA, 22 bp, Homo sapiens
ccatcatggggggagcaccctg

SEQ ID NO: 1318158 - DNA, 15 bp, Homo sapiens
ccatccgttcattca

SEQ ID NO: 1318159 - DNA, 15 bp, Homo sapiens
ccatcttccatatcc

SEQ ID NO: 1318160 - DNA, 20 bp, Homo sapiens
ccatcttccatatccgggtg

SEQ ID NO: 1318161 - DNA, 22 bp, Homo sapiens
ccatcttccatatccgggtgct

SEQ ID NO: 1318162 - DNA, 14 bp, Homo sapiens
ccatgaaggcacct

SEQ ID NO: 1318163 - DNA, 22 bp, Homo sapiens
ccatgaaggcacctgcccccac

SEQ ID NO: 1318164 - DNA, 19 bp, Homo sapiens
ccatggctgtgacacagac

SEQ ID NO: 1318165 - DNA, 13 bp, Homo sapiens
ccatggtcaccct

SEQ ID NO: 1318166 - DNA, 15 bp, Homo sapiens
ccatggtcaccctca

SEQ ID NO: 1318167 - DNA, 17 bp, Homo sapiens
ccatggtcaccctcagg

SEQ ID NO: 1318168 - DNA, 18 bp, Homo sapiens
ccatggtcaccctcagga

SEQ ID NO: 1318169 - DNA, 15 bp, Homo sapiens
ccatgtcctatgcct

SEQ ID NO: 1318170 - DNA, 16 bp, Homo sapiens
ccatgtcctatgcctc

SEQ ID NO: 1318171 - DNA, 13 bp, Homo sapiens
ccatttctttctg

SEQ ID NO: 1318172 - DNA, 19 bp, Homo sapiens
cccaaattatcaagctaat

SEQ ID NO: 1318173 - DNA, 13 bp, Homo sapiens
cccaacccttctt

SEQ ID NO: 1318174 - DNA, 12 bp, Homo sapiens
cccaactcagcc

SEQ ID NO: 1318175 - DNA, 13 bp, Homo sapiens
cccaactcagcct

SEQ ID NO: 1318176 - DNA, 17 bp, Homo sapiens
cccaagactctgctctc

SEQ ID NO: 1318177 - DNA, 19 bp, Homo sapiens
cccaagactctgctctcct

SEQ ID NO: 1318178 - DNA, 20 bp, Homo sapiens
cccaagactctgctctcctc

SEQ ID NO: 1318179 - DNA, 14 bp, Homo sapiens
cccaatctggctgg

SEQ ID NO: 1318180 - DNA, 16 bp, Homo sapiens
cccacccacctttgca

SEQ ID NO: 1318181 - DNA, 13 bp, Homo sapiens
cccaccccagaag

SEQ ID NO: 1318182 - DNA, 13 bp, Homo sapiens
cccactgctgact

SEQ ID NO: 1318183 - DNA, 16 bp, Homo sapiens
cccactggctcctccc

SEQ ID NO: 1318184 - DNA, 11 bp, Homo sapiens
cccagacctgg

SEQ ID NO: 1318185 - DNA, 14 bp, Homo sapiens
cccagacctggcct

SEQ ID NO: 1318186 - DNA, 21 bp, Homo sapiens
cccagacctggcctctgccat

SEQ ID NO: 1318187 - DNA, 13 bp, Homo sapiens
cccagccctgagg

SEQ ID NO: 1318188 - DNA, 21 bp, Homo sapiens
cccagcctcagaagccttctt

SEQ ID NO: 1318189 - DNA, 12 bp, Homo sapiens
cccagcctctgc

SEQ ID NO: 1318190 - DNA, 15 bp, Homo sapiens
cccagcctctgcccc

SEQ ID NO: 1318191 - DNA, 16 bp, Homo sapiens
cccagcctctgcccca

SEQ ID NO: 1318192 - DNA, 14 bp, Homo sapiens
cccagcctgtccca

SEQ ID NO: 1318193 - DNA, 18 bp, Homo sapiens
cccagcctgtcccactgg

SEQ ID NO: 1318194 - DNA, 20 bp, Homo sapiens
cccagcctgtcccactggct

SEQ ID NO: 1318195 - DNA, 21 bp, Homo sapiens
cccagcctgtcccactggctc

SEQ ID NO: 1318196 - DNA, 19 bp, Homo sapiens
cccagctctacattctgct

SEQ ID NO: 1318197 - DNA, 22 bp, Homo sapiens
cccagctctacattctgctctg

SEQ ID NO: 1318198 - DNA, 17 bp, Homo sapiens
cccaggacagcacacgg

SEQ ID NO: 1318199 - DNA, 14 bp, Homo sapiens
cccaggcaaataaa

SEQ ID NO: 1318200 - DNA, 16 bp, Homo sapiens
cccaggcaaataaaat

SEQ ID NO: 1318201 - DNA, 13 bp, Homo sapiens
cccaggcaggccc

SEQ ID NO: 1318202 - DNA, 11 bp, Homo sapiens
cccaggccagg

SEQ ID NO: 1318203 - DNA, 16 bp, Homo sapiens
cccagggtctgaaagg

SEQ ID NO: 1318204 - DNA, 19 bp, Homo sapiens
cccagggtctgaaaggggt

SEQ ID NO: 1318205 - DNA, 20 bp, Homo sapiens
cccagggtctgaaaggggtg

SEQ ID NO: 1318206 - DNA, 16 bp, Homo sapiens
cccatctgccagatca

SEQ ID NO: 1318207 - DNA, 13 bp, Homo sapiens
cccatgggaggga

SEQ ID NO: 1318208 - DNA, 12 bp, Homo sapiens
ccccactcctca

SEQ ID NO: 1318209 - DNA, 22 bp, Homo sapiens
ccccaggacagcacacggtgag

SEQ ID NO: 1318210 - DNA, 14 bp, Homo sapiens
cccccacagctcct

SEQ ID NO: 1318211 - DNA, 18 bp, Homo sapiens
cccccacagctccttgca

SEQ ID NO: 1318212 - DNA, 12 bp, Homo sapiens
ccccgagggcgg

SEQ ID NO: 1318213 - DNA, 22 bp, Homo sapiens
ccccgccatggtcaccctcagg

SEQ ID NO: 1318214 - DNA, 19 bp, Homo sapiens
cccctagtccggttcttct

SEQ ID NO: 1318215 - DNA, 18 bp, Homo sapiens
cccctcaagccccttctc

SEQ ID NO: 1318216 - DNA, 19 bp, Homo sapiens
cccctgagcctgtgtcctg

SEQ ID NO: 1318217 - DNA, 20 bp, Homo sapiens
cccctgagcctgtgtcctga

SEQ ID NO: 1318218 - DNA, 23 bp, Homo sapiens
cccctgagcctgtgtcctgaaga

SEQ ID NO: 1318219 - DNA, 13 bp, Homo sapiens
cccctgcagccct

SEQ ID NO: 1318220 - DNA, 14 bp, Homo sapiens
cccctgcagccctg

SEQ ID NO: 1318221 - DNA, 20 bp, Homo sapiens
cccctggtggctgcaggcac

SEQ ID NO: 1318222 - DNA, 22 bp, Homo sapiens
ccccttctctcaatccctttgc

SEQ ID NO: 1318223 - DNA, 15 bp, Homo sapiens
ccccttgctctctgt

SEQ ID NO: 1318224 - DNA, 19 bp, Homo sapiens
cccgccatggtcaccctca

SEQ ID NO: 1318225 - DNA, 15 bp, Homo sapiens
cccgccttctccagg

SEQ ID NO: 1318226 - DNA, 13 bp, Homo sapiens
ccctcaagcccct

SEQ ID NO: 1318227 - DNA, 19 bp, Homo sapiens
ccctcaatgtgatggtatt

SEQ ID NO: 1318228 - DNA, 14 bp, Homo sapiens
ccctcagccaccct

SEQ ID NO: 1318229 - DNA, 15 bp, Homo sapiens
ccctcagccaccctt

SEQ ID NO: 1318230 - DNA, 19 bp, Homo sapiens
ccctcatctagtcttgacc

SEQ ID NO: 1318231 - DNA, 20 bp, Homo sapiens
ccctcatctagtcttgacct

SEQ ID NO: 1318232 - DNA, 15 bp, Homo sapiens
ccctccccctagtcc

SEQ ID NO: 1318233 - DNA, 19 bp, Homo sapiens
ccctccgcggcgggccctg

SEQ ID NO: 1318234 - DNA, 20 bp, Homo sapiens
ccctctccacacccagcctg

SEQ ID NO: 1318235 - DNA, 12 bp, Homo sapiens
ccctgagcctgt

SEQ ID NO: 1318236 - DNA, 13 bp, Homo sapiens
ccctgagcctgtg

SEQ ID NO: 1318237 - DNA, 15 bp, Homo sapiens
ccctgagcctgtgtc

SEQ ID NO: 1318238 - DNA, 16 bp, Homo sapiens
ccctgagcctgtgtcc

SEQ ID NO: 1318239 - DNA, 17 bp, Homo sapiens
ccctgagcctgtgtcct

SEQ ID NO: 1318240 - DNA, 14 bp, Homo sapiens
ccctgcagccctgg

SEQ ID NO: 1318241 - DNA, 17 bp, Homo sapiens
ccctgcccacacctcct

SEQ ID NO: 1318242 - DNA, 19 bp, Homo sapiens
ccctgcccacacctcctgg

SEQ ID NO: 1318243 - DNA, 21 bp, Homo sapiens
ccctgggactaaagccaggaa

SEQ ID NO: 1318244 - DNA, 14 bp, Homo sapiens
ccctgggtcctcgg

SEQ ID NO: 1318245 - DNA, 17 bp, Homo sapiens
ccctgggtcctcgggcc

SEQ ID NO: 1318246 - DNA, 18 bp, Homo sapiens
ccctgggtcctcgggccc

SEQ ID NO: 1318247 - DNA, 18 bp, Homo sapiens
ccctggtggctgcaggca

SEQ ID NO: 1318248 - DNA, 21 bp, Homo sapiens
ccctgttccccacaggtcctc

SEQ ID NO: 1318249 - DNA, 16 bp, Homo sapiens
ccctgttgacctgccc

SEQ ID NO: 1318250 - DNA, 17 bp, Homo sapiens
ccctgttgacctgcccg

SEQ ID NO: 1318251 - DNA, 15 bp, Homo sapiens
cccttacaagacctc

SEQ ID NO: 1318252 - DNA, 23 bp, Homo sapiens
cccttgctctctgttctcttgct

SEQ ID NO: 1318253 - DNA, 15 bp, Homo sapiens
cccttttttcctttc

SEQ ID NO: 1318254 - DNA, 21 bp, Homo sapiens
cccttttttcctttccacctt

SEQ ID NO: 1318255 - DNA, 18 bp, Homo sapiens
ccgatccagattcccagg

SEQ ID NO: 1318256 - DNA, 19 bp, Homo sapiens
ccgatccagattcccaggc

SEQ ID NO: 1318257 - DNA, 20 bp, Homo sapiens
ccgatccagattcccaggcc

SEQ ID NO: 1318258 - DNA, 20 bp, Homo sapiens
ccgccatggtcaccctcagg

SEQ ID NO: 1318259 - DNA, 15 bp, Homo sapiens
ccgccccagggtctg

SEQ ID NO: 1318260 - DNA, 16 bp, Homo sapiens
ccgcgcccctgggact

SEQ ID NO: 1318261 - DNA, 18 bp, Homo sapiens
ccgctgggttctgactct

SEQ ID NO: 1318262 - DNA, 20 bp, Homo sapiens
ccggagccccaagactctgc

SEQ ID NO: 1318263 - DNA, 23 bp, Homo sapiens
ccggagccccaagactctgctct

SEQ ID NO: 1318264 - DNA, 11 bp, Homo sapiens
ccggcctggcc

SEQ ID NO: 1318265 - DNA, 13 bp, Homo sapiens
ccgtcttcctcca

SEQ ID NO: 1318266 - DNA, 12 bp, Homo sapiens
cctaataaaact

SEQ ID NO: 1318267 - DNA, 14 bp, Homo sapiens
cctaataaaactga

SEQ ID NO: 1318268 - DNA, 15 bp, Homo sapiens
cctaataaaactgat

SEQ ID NO: 1318269 - DNA, 20 bp, Homo sapiens
cctatgcctcacaaatgctg

SEQ ID NO: 1318270 - DNA, 15 bp, Homo sapiens
cctcaactctgctga

SEQ ID NO: 1318271 - DNA, 20 bp, Homo sapiens
cctcaactctgctgagggtc

SEQ ID NO: 1318272 - DNA, 23 bp, Homo sapiens
cctcaactgagaagccaagcctg

SEQ ID NO: 1318273 - DNA, 17 bp, Homo sapiens
cctcaatgtgatggtat

SEQ ID NO: 1318274 - DNA, 18 bp, Homo sapiens
cctcacaaatgctgtggt

SEQ ID NO: 1318275 - DNA, 15 bp, Homo sapiens
cctcacactccttta

SEQ ID NO: 1318276 - DNA, 18 bp, Homo sapiens
cctcagaagccttcttgc

SEQ ID NO: 1318277 - DNA, 19 bp, Homo sapiens
cctcagaagccttcttgct

SEQ ID NO: 1318278 - DNA, 18 bp, Homo sapiens
cctcagatctttgcacca

SEQ ID NO: 1318279 - DNA, 13 bp, Homo sapiens
cctcagcacccca

SEQ ID NO: 1318280 - DNA, 15 bp, Homo sapiens
cctcagcaccccact

SEQ ID NO: 1318281 - DNA, 20 bp, Homo sapiens
cctcagcaccccactcctca

SEQ ID NO: 1318282 - DNA, 19 bp, Homo sapiens
cctcagccacccttggtct

SEQ ID NO: 1318283 - DNA, 16 bp, Homo sapiens
cctcaggaacccaccc

SEQ ID NO: 1318284 - DNA, 20 bp, Homo sapiens
cctcagtaaaagtcttctcc

SEQ ID NO: 1318285 - DNA, 16 bp, Homo sapiens
ctgactctggaccatg

SEQ ID NO: 1318286 - DNA, 15 bp, Homo sapiens
ctgagaagccaagcc

SEQ ID NO: 1318287 - DNA, 21 bp, Homo sapiens
ctgagaattgtgttatttcac

SEQ ID NO: 1318288 - DNA, 16 bp, Homo sapiens
ctgagacaaaaaggaa

SEQ ID NO: 1318289 - DNA, 14 bp, Homo sapiens
ctgagacatccctc

SEQ ID NO: 1318290 - DNA, 15 bp, Homo sapiens
ctgagcacctctcag

SEQ ID NO: 1318291 - DNA, 12 bp, Homo sapiens
ctgagcctgtgt

SEQ ID NO: 1318292 - DNA, 17 bp, Homo sapiens
ctgaggcaaggcccaga

SEQ ID NO: 1318293 - DNA, 22 bp, Homo sapiens
ctgaggcaaggcccagacctgg

SEQ ID NO: 1318294 - DNA, 17 bp, Homo sapiens
ctgagggtccagaagga

SEQ ID NO: 1318295 - DNA, 22 bp, Homo sapiens
ctgagtttcaacactagcattt

SEQ ID NO: 1318296 - DNA, 18 bp, Homo sapiens
ctgcaaatgcattgtgaa

SEQ ID NO: 1318297 - DNA, 12 bp, Homo sapiens
ctgcaactccag

SEQ ID NO: 1318298 - DNA, 22 bp, Homo sapiens
ctgcaactccagcgtcctcagc

SEQ ID NO: 1318299 - DNA, 12 bp, Homo sapiens
ctgcagacctgg

SEQ ID NO: 1318300 - DNA, 13 bp, Homo sapiens
ctgcagacctggc

SEQ ID NO: 1318301 - DNA, 22 bp, Homo sapiens
ctgcagacctggctgggcctgg

SEQ ID NO: 1318302 - DNA, 15 bp, Homo sapiens
ctgcagccctggccc

SEQ ID NO: 1318303 - DNA, 19 bp, Homo sapiens
ctgcagctgggaagaggag

SEQ ID NO: 1318304 - DNA, 12 bp, Homo sapiens
ctgcaggcacac

SEQ ID NO: 1318305 - DNA, 21 bp, Homo sapiens
ctgcaggccagtcccacggct

SEQ ID NO: 1318306 - DNA, 21 bp, Homo sapiens
ctgccatcctccctgttcccc

SEQ ID NO: 1318307 - DNA, 21 bp, Homo sapiens
ctgcccacaacgtcccctcaa

SEQ ID NO: 1318308 - DNA, 13 bp, Homo sapiens
ctgcccatgccta

SEQ ID NO: 1318309 - DNA, 23 bp, Homo sapiens
ctgcccccacagctccttgcaaa

SEQ ID NO: 1318310 - DNA, 14 bp, Homo sapiens
ctgcccgatccaga

SEQ ID NO: 1318311 - DNA, 16 bp, Homo sapiens
ctgcccgatccagatt

SEQ ID NO: 1318312 - DNA, 21 bp, Homo sapiens
ctgcccgatccagattcccag

SEQ ID NO: 1318313 - DNA, 14 bp, Homo sapiens
ctgctaccttgccc

SEQ ID NO: 1318314 - DNA, 17 bp, Homo sapiens
ctgctaccttgccccaa

SEQ ID NO: 1318315 - DNA, 20 bp, Homo sapiens
ctgctctcctcgggccctgt

SEQ ID NO: 1318316 - DNA, 21 bp, Homo sapiens
ctgctctcctcgggccctgtg

SEQ ID NO: 1318317 - DNA, 14 bp, Homo sapiens
ctgctctgcccatg

SEQ ID NO: 1318318 - DNA, 17 bp, Homo sapiens
ctgctctgcccatgcct

SEQ ID NO: 1318319 - DNA, 20 bp, Homo sapiens
ctgctgataatgtatatgaa

SEQ ID NO: 1318320 - DNA, 23 bp, Homo sapiens
ctgctggagaaaccttcactcca

SEQ ID NO: 1318321 - DNA, 19 bp, Homo sapiens
ctgctttgttaccttaaaa

SEQ ID NO: 1318322 - DNA, 16 bp, Homo sapiens
ctggaaggaaagcaag

SEQ ID NO: 1318323 - DNA, 22 bp, Homo sapiens
ctggaaggaaagcaaggcagaa

SEQ ID NO: 1318324 - DNA, 19 bp, Homo sapiens
ctggacactgtgaaataca

SEQ ID NO: 1318325 - DNA, 13 bp, Homo sapiens
ctggaccatgctg

SEQ ID NO: 1318326 - DNA, 15 bp, Homo sapiens
ctggaccatgctgag

SEQ ID NO: 1318327 - DNA, 21 bp, Homo sapiens
ctggagaaaccttcactccag

SEQ ID NO: 1318328 - DNA, 22 bp, Homo sapiens
ctggagaaaccttcactccaga

SEQ ID NO: 1318329 - DNA, 15 bp, Homo sapiens
ctggagaatcttaca

SEQ ID NO: 1318330 - DNA, 15 bp, Homo sapiens
ctggagtaggcctgg

SEQ ID NO: 1318331 - DNA, 17 bp, Homo sapiens
ctggagtaggcctgggg

SEQ ID NO: 1318332 - DNA, 19 bp, Homo sapiens
ctggagtaggcctggggct

SEQ ID NO: 1318333 - DNA, 13 bp, Homo sapiens
ctggatgtttctc

SEQ ID NO: 1318334 - DNA, 22 bp, Homo sapiens
ctggatgtttctcatgtagaac

SEQ ID NO: 1318335 - DNA, 20 bp, Homo sapiens
ctggcccttgggtttcctgg

SEQ ID NO: 1318336 - DNA, 18 bp, Homo sapiens
ctggcctcaactgagaag

SEQ ID NO: 1318337 - DNA, 18 bp, Homo sapiens
ctggcctctgccatcctc

SEQ ID NO: 1318338 - DNA, 21 bp, Homo sapiens
ctggcctctgccatcctccct

SEQ ID NO: 1318339 - DNA, 15 bp, Homo sapiens
ctggccttgtggtcc

SEQ ID NO: 1318340 - DNA, 15 bp, Homo sapiens
ctggctcccctgcag

SEQ ID NO: 1318341 - DNA, 21 bp, Homo sapiens
ctggctcccctgcagccctgg

SEQ ID NO: 1318342 - DNA, 13 bp, Homo sapiens
ctggctcccctgg

SEQ ID NO: 1318343 - DNA, 15 bp, Homo sapiens
ctggctcccctgggg

SEQ ID NO: 1318344 - DNA, 19 bp, Homo sapiens
ctggctgatgggtggacct

SEQ ID NO: 1318345 - DNA, 14 bp, Homo sapiens
ctggctgggcctgg

SEQ ID NO: 1318346 - DNA, 15 bp, Homo sapiens
ctggctgggcctggg

SEQ ID NO: 1318347 - DNA, 20 bp, Homo sapiens
ctggctgggcctgggcttcc

SEQ ID NO: 1318348 - DNA, 22 bp, Homo sapiens
ctgggaaagccatgaccttgtg

SEQ ID NO: 1318349 - DNA, 18 bp, Homo sapiens
ctgggactaaagccagga

SEQ ID NO: 1318350 - DNA, 20 bp, Homo sapiens
ctgggactaaagccaggaac

SEQ ID NO: 1318351 - DNA, 22 bp, Homo sapiens
ctgggactaaagccaggaacag

SEQ ID NO: 1318352 - DNA, 17 bp, Homo sapiens
ctgggagatgctctctg

SEQ ID NO: 1318353 - DNA, 18 bp, Homo sapiens
ctgggagatgctctctga

SEQ ID NO: 1318354 - DNA, 21 bp, Homo sapiens
ctgggagatgctctctgaggc

SEQ ID NO: 1318355 - DNA, 22 bp, Homo sapiens
ctgggatagtttgggggaactt

SEQ ID NO: 1318356 - DNA, 12 bp, Homo sapiens
ctgggcctgggc

SEQ ID NO: 1318357 - DNA, 22 bp, Homo sapiens
ctgggcttccacagtgtgaaga

SEQ ID NO: 1318358 - DNA, 21 bp, Homo sapiens
ctggggcttctttctgctggc

SEQ ID NO: 1318359 - DNA, 20 bp, Homo sapiens
ctggtattcctttatgtatc

SEQ ID NO: 1318360 - DNA, 17 bp, Homo sapiens
ctggtccctatgtcatg

SEQ ID NO: 1318361 - DNA, 20 bp, Homo sapiens
ctggtcctaggctggaagga

SEQ ID NO: 1318362 - DNA, 12 bp, Homo sapiens
ctggtggctgca

SEQ ID NO: 1318363 - DNA, 16 bp, Homo sapiens
ctggttcctaggggaa

SEQ ID NO: 1318364 - DNA, 15 bp, Homo sapiens
ctgtaaacactcagc

SEQ ID NO: 1318365 - DNA, 17 bp, Homo sapiens
ctgtaaacactcagctg

SEQ ID NO: 1318366 - DNA, 18 bp, Homo sapiens
ctgtaaacactcagctgt

SEQ ID NO: 1318367 - DNA, 19 bp, Homo sapiens
ctgtaaacactcagctgtt

SEQ ID NO: 1318368 - DNA, 14 bp, Homo sapiens
ctgtcccactggct

SEQ ID NO: 1318369 - DNA, 20 bp, Homo sapiens
ctgtcccactggctcctccc

SEQ ID NO: 1318370 - DNA, 22 bp, Homo sapiens
ctgtcccactggctcctcccag

SEQ ID NO: 1318371 - DNA, 14 bp, Homo sapiens
ctgtctaggaaaat

SEQ ID NO: 1318372 - DNA, 15 bp, Homo sapiens
ctgtctgttgcttca

SEQ ID NO: 1318373 - DNA, 11 bp, Homo sapiens
ctgtcttcctt

SEQ ID NO: 1318374 - DNA, 12 bp, Homo sapiens
ctgtcttccttt

SEQ ID NO: 1318375 - DNA, 17 bp, Homo sapiens
ctgtgaatccagtgaaa

SEQ ID NO: 1318376 - DNA, 12 bp, Homo sapiens
ctgtgaggcttt

SEQ ID NO: 1318377 - DNA, 14 bp, Homo sapiens
ctgtgcaggcccag

SEQ ID NO: 1318378 - DNA, 16 bp, Homo sapiens
ctgtgcaggcccaggc

SEQ ID NO: 1318379 - DNA, 21 bp, Homo sapiens
ctgtgccattttctgtaaaga

SEQ ID NO: 1318380 - DNA, 17 bp, Homo sapiens
ctgtgcccggtgccatc

SEQ ID NO: 1318381 - DNA, 19 bp, Homo sapiens
ctgtgcttgttgaatgtca

SEQ ID NO: 1318382 - DNA, 15 bp, Homo sapiens
ctgtggggagggtca

SEQ ID NO: 1318383 - DNA, 15 bp, Homo sapiens
ctgtggttcactgca

SEQ ID NO: 1318384 - DNA, 16 bp, Homo sapiens
ctgtggttcactgcac

SEQ ID NO: 1318385 - DNA, 20 bp, Homo sapiens
ctgtgtatggtgacctctcc

SEQ ID NO: 1318386 - DNA, 22 bp, Homo sapiens
ctgtgtatggtgacctctccgg

SEQ ID NO: 1318387 - DNA, 15 bp, Homo sapiens
ctgtgtgaaatcttt

SEQ ID NO: 1318388 - DNA, 12 bp, Homo sapiens
ctgtgtgttcct

SEQ ID NO: 1318389 - DNA, 13 bp, Homo sapiens
ctgtgtgttcctg

SEQ ID NO: 1318390 - DNA, 15 bp, Homo sapiens
ctgtgtgttcctggc

SEQ ID NO: 1318391 - DNA, 21 bp, Homo sapiens
ctgttatttatccctcattca

SEQ ID NO: 1318392 - DNA, 16 bp, Homo sapiens
ctgttcagattggaca

SEQ ID NO: 1318393 - DNA, 17 bp, Homo sapiens
ctgttcaggagtccaaa

SEQ ID NO: 1318394 - DNA, 22 bp, Homo sapiens
ctgttcaggagtccaaaccttc

SEQ ID NO: 1318395 - DNA, 18 bp, Homo sapiens
ctgttccccacaggtcct

SEQ ID NO: 1318396 - DNA, 14 bp, Homo sapiens
ctgttccttcctgc

SEQ ID NO: 1318397 - DNA, 20 bp, Homo sapiens
ctgttctgatattaatttat

SEQ ID NO: 1318398 - DNA, 13 bp, Homo sapiens
ctgttgacctgcc

SEQ ID NO: 1318399 - DNA, 19 bp, Homo sapiens
ctgtttagtctccttttta

SEQ ID NO: 1318400 - DNA, 15 bp, Homo sapiens
ctgtttcttgatgct

SEQ ID NO: 1318401 - DNA, 16 bp, Homo sapiens
cttaaatactttaatg

SEQ ID NO: 1318402 - DNA, 21 bp, Homo sapiens
cttaacatgctgtgtaagctg

SEQ ID NO: 1318403 - DNA, 22 bp, Homo sapiens
cttaacatgctgtgtaagctgt

SEQ ID NO: 1318404 - DNA, 17 bp, Homo sapiens
cttaactggcccagaag

SEQ ID NO: 1318405 - DNA, 18 bp, Homo sapiens
cttaactggcccagaagc

SEQ ID NO: 1318406 - DNA, 15 bp, Homo sapiens
cttaagcagaggaat

SEQ ID NO: 1318407 - DNA, 13 bp, Homo sapiens
cttaattctgttc

SEQ ID NO: 1318408 - DNA, 15 bp, Homo sapiens
cttaatttggaaact

SEQ ID NO: 1318409 - DNA, 19 bp, Homo sapiens
cttaatttggaaactaata

SEQ ID NO: 1318410 - DNA, 22 bp, Homo sapiens
cttaatttggaaactaataaaa

SEQ ID NO: 1318411 - DNA, 23 bp, Homo sapiens
cttaatttggaaactaataaaat

SEQ ID NO: 1318412 - DNA, 14 bp, Homo sapiens
cttacaagacctct

SEQ ID NO: 1318413 - DNA, 11 bp, Homo sapiens
cttagggtctc

SEQ ID NO: 1318414 - DNA, 17 bp, Homo sapiens
cttagggtctcagggtg

SEQ ID NO: 1318415 - DNA, 14 bp, Homo sapiens
cttatttaaatgac

SEQ ID NO: 1318416 - DNA, 23 bp, Homo sapiens
cttcatgccagtgcatgccagga

SEQ ID NO: 1318417 - DNA, 17 bp, Homo sapiens
gccaggagagcttaggg

SEQ ID NO: 1318418 - DNA, 20 bp, Homo sapiens
gccaggagagcttagggtct

SEQ ID NO: 1318419 - DNA, 21 bp, Homo sapiens
gccaggagagcttagggtctc

SEQ ID NO: 1318420 - DNA, 13 bp, Homo sapiens
gccagtgcatgcc

SEQ ID NO: 1318421 - DNA, 22 bp, Homo sapiens
gccatcctccctgttccccaca

SEQ ID NO: 1318422 - DNA, 23 bp, Homo sapiens
gccatcttccatatccgggtgct

SEQ ID NO: 1318423 - DNA, 17 bp, Homo sapiens
gccatgaaggcacctgc

SEQ ID NO: 1318424 - DNA, 20 bp, Homo sapiens
gccatgaaggcacctgcccc

SEQ ID NO: 1318425 - DNA, 18 bp, Homo sapiens
gccatggtcaccctcagg

SEQ ID NO: 1318426 - DNA, 17 bp, Homo sapiens
gcccaaattatcaagct

SEQ ID NO: 1318427 - DNA, 20 bp, Homo sapiens
gcccaaattatcaagctaat

SEQ ID NO: 1318428 - DNA, 22 bp, Homo sapiens
gcccaaattatcaagctaataa

SEQ ID NO: 1318429 - DNA, 21 bp, Homo sapiens
gcccaagctaagctgcaggca

SEQ ID NO: 1318430 - DNA, 14 bp, Homo sapiens
gcccacacctcctg

SEQ ID NO: 1318431 - DNA, 15 bp, Homo sapiens
gcccacacctcctgg

SEQ ID NO: 1318432 - DNA, 11 bp, Homo sapiens
gcccagacctg

SEQ ID NO: 1318433 - DNA, 13 bp, Homo sapiens
gcccagacctggc

SEQ ID NO: 1318434 - DNA, 19 bp, Homo sapiens
gcccagacctggcctctgc

SEQ ID NO: 1318435 - DNA, 10 bp, Homo sapiens
gcccagcctc

SEQ ID NO: 1318436 - DNA, 20 bp, Homo sapiens
gcccaggcaggcccagcctc

SEQ ID NO: 1318437 - DNA, 22 bp, Homo sapiens
gcccatattttacttggaaata

SEQ ID NO: 1318438 - DNA, 19 bp, Homo sapiens
gcccatcccgccttctcca

SEQ ID NO: 1318439 - DNA, 20 bp, Homo sapiens
gcccatcccgccttctccag

SEQ ID NO: 1318440 - DNA, 15 bp, Homo sapiens
gcccatgggagggag

SEQ ID NO: 1318441 - DNA, 13 bp, Homo sapiens
gccccagggtctg

SEQ ID NO: 1318442 - DNA, 15 bp, Homo sapiens
gccccagggtctgaa

SEQ ID NO: 1318443 - DNA, 13 bp, Homo sapiens
gcccccacagctc

SEQ ID NO: 1318444 - DNA, 17 bp, Homo sapiens
gcccccacagctccttg

SEQ ID NO: 1318445 - DNA, 22 bp, Homo sapiens
gcccccacagctccttgcaaac

SEQ ID NO: 1318446 - DNA, 23 bp, Homo sapiens
gcccctcagccacccttggtctc

SEQ ID NO: 1318447 - DNA, 14 bp, Homo sapiens
gcccctgggactaa

SEQ ID NO: 1318448 - DNA, 13 bp, Homo sapiens
gccccttctctca

SEQ ID NO: 1318449 - DNA, 22 bp, Homo sapiens
gcccgatccagattcccaggcc

SEQ ID NO: 1318450 - DNA, 14 bp, Homo sapiens
gcccgattctttca

SEQ ID NO: 1318451 - DNA, 18 bp, Homo sapiens
gcccggtgccatcttcca

SEQ ID NO: 1318452 - DNA, 16 bp, Homo sapiens
gcccgtagatcatccc

SEQ ID NO: 1318453 - DNA, 16 bp, Homo sapiens
gccctggcccatcatg

SEQ ID NO: 1318454 - DNA, 16 bp, Homo sapiens
gccctgtggtgctggg

SEQ ID NO: 1318455 - DNA, 16 bp, Homo sapiens
gccctgttgacctgcc

SEQ ID NO: 1318456 - DNA, 18 bp, Homo sapiens
gccctgttgacctgcccg

SEQ ID NO: 1318457 - DNA, 15 bp, Homo sapiens
gccgctgcacatcct

SEQ ID NO: 1318458 - DNA, 22 bp, Homo sapiens
gcctaataaaactgatgtgaaa

SEQ ID NO: 1318459 - DNA, 23 bp, Homo sapiens
gcctcaactgagaagccaagcct

SEQ ID NO: 1318460 - DNA, 16 bp, Homo sapiens
gcctcagaagccttct

SEQ ID NO: 1318461 - DNA, 21 bp, Homo sapiens
gcctcctgacacacctgcagc

SEQ ID NO: 1318462 - DNA, 18 bp, Homo sapiens
gcctcggctggctcccct

SEQ ID NO: 1318463 - DNA, 13 bp, Homo sapiens
gcctctctccact

SEQ ID NO: 1318464 - DNA, 17 bp, Homo sapiens
gcctctctccactaccc

SEQ ID NO: 1318465 - DNA, 22 bp, Homo sapiens
gcctctgccatcctccctgttc

SEQ ID NO: 1318466 - DNA, 16 bp, Homo sapiens
gcctcttctctcagac

SEQ ID NO: 1318467 - DNA, 19 bp, Homo sapiens
gcctgaaatcctggttcct

SEQ ID NO: 1318468 - DNA, 21 bp, Homo sapiens
gcctgcaggccagtcccacgg

SEQ ID NO: 1318469 - DNA, 16 bp, Homo sapiens
gcctgccatggctgtg

SEQ ID NO: 1318470 - DNA, 14 bp, Homo sapiens
gcctggctcccctg

SEQ ID NO: 1318471 - DNA, 17 bp, Homo sapiens
gcctggctcccctgggg

SEQ ID NO: 1318472 - DNA, 17 bp, Homo sapiens
gcctgggcccctcagcc

SEQ ID NO: 1318473 - DNA, 20 bp, Homo sapiens
gcctgggcccctcagccacc

SEQ ID NO: 1318474 - DNA, 21 bp, Homo sapiens
gcctgggcttccacagtgtga

SEQ ID NO: 1318475 - DNA, 20 bp, Homo sapiens
gcctgggtgacagagcgaga

SEQ ID NO: 1318476 - DNA, 13 bp, Homo sapiens
gcctgtcccactg

SEQ ID NO: 1318477 - DNA, 24 bp, Homo sapiens
gcctgtcccactggctcctcccag

SEQ ID NO: 1318478 - DNA, 17 bp, Homo sapiens
gcctgttccttcctgca

SEQ ID NO: 1318479 - DNA, 16 bp, Homo sapiens
gccttcatgccagtgc

SEQ ID NO: 1318480 - DNA, 17 bp, Homo sapiens
gccttcatgccagtgca

SEQ ID NO: 1318481 - DNA, 23 bp, Homo sapiens
gccttcccctcccagccctgagg

SEQ ID NO: 1318482 - DNA, 18 bp, Homo sapiens
gccttcttgctgcccaca

SEQ ID NO: 1318483 - DNA, 14 bp, Homo sapiens
gccttgtggtccaa

SEQ ID NO: 1318484 - DNA, 16 bp, Homo sapiens
gcgcagttgctgtcag

SEQ ID NO: 1318485 - DNA, 14 bp, Homo sapiens
gcgcccctgggact

SEQ ID NO: 1318486 - DNA, 15 bp, Homo sapiens
gcggcctcttctctc

SEQ ID NO: 1318487 - DNA, 16 bp, Homo sapiens
gcgggccctgcccaca

SEQ ID NO: 1318488 - DNA, 13 bp, Homo sapiens
gcggggcctgcag

SEQ ID NO: 1318489 - DNA, 23 bp, Homo sapiens
gcggggcctgcaggccagtccca

SEQ ID NO: 1318490 - DNA, 23 bp, Homo sapiens
gcgggggcaacgattcacagcct

SEQ ID NO: 1318491 - DNA, 17 bp, Homo sapiens
gcgtcctcagcacccca

SEQ ID NO: 1318492 - DNA, 18 bp, Homo sapiens
gcgtcctcagcaccccac

SEQ ID NO: 1318493 - DNA, 18 bp, Homo sapiens
gcgtgccatgagtccatg

SEQ ID NO: 1318494 - DNA, 14 bp, Homo sapiens
gctaagctgcaggc

SEQ ID NO: 1318495 - DNA, 15 bp, Homo sapiens
gctaagctgcaggca

SEQ ID NO: 1318496 - DNA, 21 bp, Homo sapiens
gctaagctgcaggcacacacg

SEQ ID NO: 1318497 - DNA, 14 bp, Homo sapiens
gctaataaaatatc

SEQ ID NO: 1318498 - DNA, 18 bp, Homo sapiens
gctaataaaatatcattc

SEQ ID NO: 1318499 - DNA, 23 bp, Homo sapiens
gctacagttgggaagtctcagcc

SEQ ID NO: 1318500 - DNA, 20 bp, Homo sapiens
gctaccttgccccaaccctt

SEQ ID NO: 1318501 - DNA, 23 bp, Homo sapiens
gctaccttgccccaacccttctt

SEQ ID NO: 1318502 - DNA, 19 bp, Homo sapiens
gctactgaaaaaaatggag

SEQ ID NO: 1318503 - DNA, 14 bp, Homo sapiens
gctactgacccaga

SEQ ID NO: 1318504 - DNA, 14 bp, Homo sapiens
gctagggctgagca

SEQ ID NO: 1318505 - DNA, 14 bp, Homo sapiens
gctcaaccagacag

SEQ ID NO: 1318506 - DNA, 12 bp, Homo sapiens
gctcaataaact

SEQ ID NO: 1318507 - DNA, 20 bp, Homo sapiens
gctcaataaacttgtgcctc

SEQ ID NO: 1318508 - DNA, 12 bp, Homo sapiens
gctcacaggact

SEQ ID NO: 1318509 - DNA, 15 bp, Homo sapiens
gctcaggagagggcc

SEQ ID NO: 1318510 - DNA, 20 bp, Homo sapiens
gctcaggagagggccttccc

SEQ ID NO: 1318511 - DNA, 13 bp, Homo sapiens
gctcctcccagca

SEQ ID NO: 1318512 - DNA, 15 bp, Homo sapiens
gctcctcccagcaca

SEQ ID NO: 1318513 - DNA, 16 bp, Homo sapiens
gctcctcccagcacag

SEQ ID NO: 1318514 - DNA, 18 bp, Homo sapiens
gctctacattctgctctg

SEQ ID NO: 1318515 - DNA, 16 bp, Homo sapiens
gctctcgcggcctctt

SEQ ID NO: 1318516 - DNA, 15 bp, Homo sapiens
gctctgcccatgcct

SEQ ID NO: 1318517 - DNA, 18 bp, Homo sapiens
gctctgtgcccggtgcca

SEQ ID NO: 1318518 - DNA, 23 bp, Homo sapiens
gctgaatagagggagtagaaagc

SEQ ID NO: 1318519 - DNA, 18 bp, Homo sapiens
gctgagacatccctcatc

SEQ ID NO: 1318520 - DNA, 22 bp, Homo sapiens
gctgagcaaagttcagcaagta

SEQ ID NO: 1318521 - DNA, 15 bp, Homo sapiens
gctgagcacctctca

SEQ ID NO: 1318522 - DNA, 16 bp, Homo sapiens
gctgagcacctctcag

SEQ ID NO: 1318523 - DNA, 18 bp, Homo sapiens
gctgattttcatgaaaat

SEQ ID NO: 1318524 - DNA, 13 bp, Homo sapiens
gctgcaggcaccg

SEQ ID NO: 1318525 - DNA, 16 bp, Homo sapiens
gctgcaggcaccgctg

SEQ ID NO: 1318526 - DNA, 22 bp, Homo sapiens
gctgcaggcaccgctgggttct

SEQ ID NO: 1318527 - DNA, 12 bp, Homo sapiens
gctgctttgtta

SEQ ID NO: 1318528 - DNA, 20 bp, Homo sapiens
gctgctttgttaccttaaaa

SEQ ID NO: 1318529 - DNA, 12 bp, Homo sapiens
gctggaaggagg

SEQ ID NO: 1318530 - DNA, 18 bp, Homo sapiens
gctggccttgtggtccaa

SEQ ID NO: 1318531 - DNA, 19 bp, Homo sapiens
gctggccttgtggtccaaa

SEQ ID NO: 1318532 - DNA, 16 bp, Homo sapiens
gctggctcccctgcag

SEQ ID NO: 1318533 - DNA, 20 bp, Homo sapiens
gctggctcccctgcagccct

SEQ ID NO: 1318534 - DNA, 21 bp, Homo sapiens
gctggctgatgggtggacctg

SEQ ID NO: 1318535 - DNA, 22 bp, Homo sapiens
gctggctggccttgtggtccaa

SEQ ID NO: 1318536 - DNA, 14 bp, Homo sapiens
gctgggttctgact

SEQ ID NO: 1318537 - DNA, 16 bp, Homo sapiens
gctgtggttcactgca

SEQ ID NO: 1318538 - DNA, 14 bp, Homo sapiens
gctgtgtgaaatct

SEQ ID NO: 1318539 - DNA, 20 bp, Homo sapiens
gctgtgtgaaatctttcaag

SEQ ID NO: 1318540 - DNA, 19 bp, Homo sapiens
gctgttcagattggacata

SEQ ID NO: 1318541 - DNA, 19 bp, Homo sapiens
gcttattaatgctaagggc

SEQ ID NO: 1318542 - DNA, 22 bp, Homo sapiens
gcttccacagtgtgaagacact

SEQ ID NO: 1318543 - DNA, 17 bp, Homo sapiens
gcttctgtgcacctggg

SEQ ID NO: 1318544 - DNA, 19 bp, Homo sapiens
gcttctttctgctggctga

SEQ ID NO: 1318545 - DNA, 20 bp, Homo sapiens
gcttctttctgctggctgat

SEQ ID NO: 1318546 - DNA, 19 bp, Homo sapiens
gcttgaccagtataaaatt

SEQ ID NO: 1318547 - DNA, 16 bp, Homo sapiens
gcttgttttggacttt

SEQ ID NO: 1318548 - DNA, 18 bp, Homo sapiens
gctttctttttaaagctt

SEQ ID NO: 1318549 - DNA, 22 bp, Homo sapiens
taagctgcaggcacacacgcct

SEQ ID NO: 1318550 - DNA, 15 bp, Homo sapiens
taaggagctggggct

SEQ ID NO: 1318551 - DNA, 13 bp, Homo sapiens
taataaaactgat

SEQ ID NO: 1318552 - DNA, 14 bp, Homo sapiens
taataaaatatttt

SEQ ID NO: 1318553 - DNA, 18 bp, Homo sapiens
taataaaatattttctgt

SEQ ID NO: 1318554 - DNA, 19 bp, Homo sapiens
taataaaatattttctgtg

SEQ ID NO: 1318555 - DNA, 20 bp, Homo sapiens
taataaaatattttctgtgt

SEQ ID NO: 1318556 - DNA, 19 bp, Homo sapiens
taattcaccaatttccttt

SEQ ID NO: 1318557 - DNA, 15 bp, Homo sapiens
taattctgttctgat

SEQ ID NO: 1318558 - DNA, 14 bp, Homo sapiens
taattgcacaacag

SEQ ID NO: 1318559 - DNA, 13 bp, Homo sapiens
taatttgctgctg

SEQ ID NO: 1318560 - DNA, 17 bp, Homo sapiens
taatttggaaactaata

SEQ ID NO: 1318561 - DNA, 22 bp, Homo sapiens
taatttggaaactaataaaata

SEQ ID NO: 1318562 - DNA, 18 bp, Homo sapiens
tacaatcagctgctttgt

SEQ ID NO: 1318563 - DNA, 20 bp, Homo sapiens
tacaatcagctgctttgtta

SEQ ID NO: 1318564 - DNA, 23 bp, Homo sapiens
tacaatcagctgctttgttacct

SEQ ID NO: 1318565 - DNA, 20 bp, Homo sapiens
tacactggatgtttctcatg

SEQ ID NO: 1318566 - DNA, 21 bp, Homo sapiens
tacactgttattttcagcatg

SEQ ID NO: 1318567 - DNA, 19 bp, Homo sapiens
tacaggacatgtactgaga

SEQ ID NO: 1318568 - DNA, 16 bp, Homo sapiens
tacagtggattgctca

SEQ ID NO: 1318569 - DNA, 20 bp, Homo sapiens
tacagttgggaagtctcagc

SEQ ID NO: 1318570 - DNA, 22 bp, Homo sapiens
tacagttgggaagtctcagcct

SEQ ID NO: 1318571 - DNA, 18 bp, Homo sapiens
tacattctgctctgccca

SEQ ID NO: 1318572 - DNA, 19 bp, Homo sapiens
tacattctgctctgcccat

SEQ ID NO: 1318573 - DNA, 20 bp, Homo sapiens
tacattctgctctgcccatg

SEQ ID NO: 1318574 - DNA, 21 bp, Homo sapiens
taccccgactatccctgcaca

SEQ ID NO: 1318575 - DNA, 12 bp, Homo sapiens
tactacaaatgg

SEQ ID NO: 1318576 - DNA, 19 bp, Homo sapiens
tactcatgactgaagggaa

SEQ ID NO: 1318577 - DNA, 21 bp, Homo sapiens
tactcatggacaaagttctgt

SEQ ID NO: 1318578 - DNA, 16 bp, Homo sapiens
tactgaaaaaaatgga

SEQ ID NO: 1318579 - DNA, 17 bp, Homo sapiens
tactgagacaaaaagga

SEQ ID NO: 1318580 - DNA, 17 bp, Homo sapiens
tacttggaaatattaaa

SEQ ID NO: 1318581 - DNA, 14 bp, Homo sapiens
tactttaacatgcc

SEQ ID NO: 1318582 - DNA, 12 bp, Homo sapiens
tagaaaaatgga

SEQ ID NO: 1318583 - DNA, 17 bp, Homo sapiens
tagaatagcatgttgta

SEQ ID NO: 1318584 - DNA, 18 bp, Homo sapiens
tagagggagtagaaagct

SEQ ID NO: 1318585 - DNA, 15 bp, Homo sapiens
tagataatactgtct

SEQ ID NO: 1318586 - DNA, 22 bp, Homo sapiens
tagataatactgtctaggaaaa

SEQ ID NO: 1318587 - DNA, 16 bp, Homo sapiens
tagatacaatcagctg

SEQ ID NO: 1318588 - DNA, 17 bp, Homo sapiens
tagatacaatcagctgc

SEQ ID NO: 1318589 - DNA, 21 bp, Homo sapiens
tagatacaatcagctgctttg

SEQ ID NO: 1318590 - DNA, 13 bp, Homo sapiens
tagatgaagaaag

SEQ ID NO: 1318591 - DNA, 20 bp, Homo sapiens
tagcccctggtgtgtaaata

SEQ ID NO: 1318592 - DNA, 13 bp, Homo sapiens
tagctcacaggac

SEQ ID NO: 1318593 - DNA, 15 bp, Homo sapiens
tagctcacaggactt

SEQ ID NO: 1318594 - DNA, 14 bp, Homo sapiens
tagcttcaggacct

SEQ ID NO: 1318595 - DNA, 14 bp, Homo sapiens
taggaccctcatga

SEQ ID NO: 1318596 - DNA, 18 bp, Homo sapiens
taggctggaaggaggaag

SEQ ID NO: 1318597 - DNA, 15 bp, Homo sapiens
tagggctgagcacct

SEQ ID NO: 1318598 - DNA, 17 bp, Homo sapiens
taggggaatgagggggc

SEQ ID NO: 1318599 - DNA, 14 bp, Homo sapiens
tagtctgaagtctg

SEQ ID NO: 1318600 - DNA, 20 bp, Homo sapiens
tagtgaaacagctttctggg

SEQ ID NO: 1318601 - DNA, 19 bp, Homo sapiens
tagtgctgaagcttattaa

SEQ ID NO: 1318602 - DNA, 22 bp, Homo sapiens
tagtgctgaagcttattaatgc

SEQ ID NO: 1318603 - DNA, 18 bp, Homo sapiens
tagtgtggttttctgttt

SEQ ID NO: 1318604 - DNA, 13 bp, Homo sapiens
tagtttaatacag

SEQ ID NO: 1318605 - DNA, 22 bp, Homo sapiens
tagtttagtgtggttttctgtt

SEQ ID NO: 1318606 - DNA, 12 bp, Homo sapiens
tataccagagaa

SEQ ID NO: 1318607 - DNA, 13 bp, Homo sapiens
tataccagagaag

SEQ ID NO: 1318608 - DNA, 16 bp, Homo sapiens
tataggagacttgtag

SEQ ID NO: 1318609 - DNA, 14 bp, Homo sapiens
tatccgggtgctca

SEQ ID NO: 1318610 - DNA, 21 bp, Homo sapiens
tatccgggtgctcaataaact

SEQ ID NO: 1318611 - DNA, 22 bp, Homo sapiens
tatccgggtgctcaataaactt

SEQ ID NO: 1318612 - DNA, 15 bp, Homo sapiens
tatctgttagatgct

SEQ ID NO: 1318613 - DNA, 20 bp, Homo sapiens
tatcttacttgcaaaatgga

SEQ ID NO: 1318614 - DNA, 17 bp, Homo sapiens
tatgaacttaacatgct

SEQ ID NO: 1318615 - DNA, 22 bp, Homo sapiens
tatgagttcacatgtgccctgc

SEQ ID NO: 1318616 - DNA, 15 bp, Homo sapiens
tatgcagtgctgctt

SEQ ID NO: 1318617 - DNA, 19 bp, Homo sapiens
tatgcctcacaaatgctgt

SEQ ID NO: 1318618 - DNA, 17 bp, Homo sapiens
tatgctgcttgtgacct

SEQ ID NO: 1318619 - DNA, 18 bp, Homo sapiens
tatgctgcttgtgacctt

SEQ ID NO: 1318620 - DNA, 20 bp, Homo sapiens
tattaaaccataagatggca

SEQ ID NO: 1318621 - DNA, 15 bp, Homo sapiens
tattactttaacatg

SEQ ID NO: 1318622 - DNA, 19 bp, Homo sapiens
tatttcatcagaacagctg

SEQ ID NO: 1318623 - DNA, 11 bp, Homo sapiens
tatttgcagtc

SEQ ID NO: 1318624 - DNA, 17 bp, Homo sapiens
tatttgcagtcatggag

SEQ ID NO: 1318625 - DNA, 23 bp, Homo sapiens
tatttgcagtcatggagaaccac

SEQ ID NO: 1318626 - DNA, 14 bp, Homo sapiens
tatttggatatctg

SEQ ID NO: 1318627 - DNA, 16 bp, Homo sapiens
tatttggatatctgtt

SEQ ID NO: 1318628 - DNA, 13 bp, Homo sapiens
tattttattaata

SEQ ID NO: 1318629 - DNA, 15 bp, Homo sapiens
tattttctgtgtgtt

SEQ ID NO: 1318630 - DNA, 18 bp, Homo sapiens
tcaaagataaatgaaata

SEQ ID NO: 1318631 - DNA, 14 bp, Homo sapiens
tcaaccagacagat

SEQ ID NO: 1318632 - DNA, 17 bp, Homo sapiens
tcaactctgctgagggt

SEQ ID NO: 1318633 - DNA, 22 bp, Homo sapiens
tcaacttatttaaatgacagca

SEQ ID NO: 1318634 - DNA, 15 bp, Homo sapiens
tcaagccccttctct

SEQ ID NO: 1318635 - DNA, 22 bp, Homo sapiens
tcaagctaataaaatatcattc

SEQ ID NO: 1318636 - DNA, 15 bp, Homo sapiens
tcaataaacttgtgc

SEQ ID NO: 1318637 - DNA, 17 bp, Homo sapiens
tcaataaacttgtgcct

SEQ ID NO: 1318638 - DNA, 18 bp, Homo sapiens
tcaataaacttgtgcctc

SEQ ID NO: 1318639 - DNA, 14 bp, Homo sapiens
tcaatcaacatctc

SEQ ID NO: 1318640 - DNA, 14 bp, Homo sapiens
tcaatgataaattt

SEQ ID NO: 1318641 - DNA, 20 bp, Homo sapiens
tcaatgataaatttaaatga

SEQ ID NO: 1318642 - DNA, 22 bp, Homo sapiens
tcaattgtagatgaacatctct

SEQ ID NO: 1318643 - DNA, 15 bp, Homo sapiens
tcacagcctccgcgg

SEQ ID NO: 1318644 - DNA, 13 bp, Homo sapiens
tcacatgtgccct

SEQ ID NO: 1318645 - DNA, 15 bp, Homo sapiens
tcacatgtgccctgc

SEQ ID NO: 1318646 - DNA, 22 bp, Homo sapiens
tcaccaatttcctttaaaacat

SEQ ID NO: 1318647 - DNA, 17 bp, Homo sapiens
tcaccagagaccaggag

SEQ ID NO: 1318648 - DNA, 18 bp, Homo sapiens
tcacccctggtggctgca

SEQ ID NO: 1318649 - DNA, 12 bp, Homo sapiens
tcaccctcagga

SEQ ID NO: 1318650 - DNA, 11 bp, Homo sapiens
tcacccttggc

SEQ ID NO: 1318651 - DNA, 13 bp, Homo sapiens
tcactctaaaaat

SEQ ID NO: 1318652 - DNA, 14 bp, Homo sapiens
tcactttcctggat

SEQ ID NO: 1318653 - DNA, 12 bp, Homo sapiens
tcagaacagctg

SEQ ID NO: 1318654 - DNA, 14 bp, Homo sapiens
tcagaagccttctt

SEQ ID NO: 1318655 - DNA, 15 bp, Homo sapiens
tcagaagccttcttg

SEQ ID NO: 1318656 - DNA, 18 bp, Homo sapiens
tcagaccgtcttcctcca

SEQ ID NO: 1318657 - DNA, 15 bp, Homo sapiens
tcagagattattcaa

SEQ ID NO: 1318658 - DNA, 13 bp, Homo sapiens
tcagagcaagcct

SEQ ID NO: 1318659 - DNA, 17 bp, Homo sapiens
tcagagcaagcctttga

SEQ ID NO: 1318660 - DNA, 22 bp, Homo sapiens
tcagatctttgcaccagatact

SEQ ID NO: 1318661 - DNA, 14 bp, Homo sapiens
tcagattgcttttg

SEQ ID NO: 1318662 - DNA, 12 bp, Homo sapiens
tcagcaccccac

SEQ ID NO: 1318663 - DNA, 18 bp, Homo sapiens
tcagcactgtttgaagat

SEQ ID NO: 1318664 - DNA, 12 bp, Homo sapiens
tcagcctgggcc

SEQ ID NO: 1318665 - DNA, 18 bp, Homo sapiens
tcagcctgggcccctcag

SEQ ID NO: 1318666 - DNA, 15 bp, Homo sapiens
tcagcctgttccttc

SEQ ID NO: 1318667 - DNA, 20 bp, Homo sapiens
tcagcctgttccttcctgca

SEQ ID NO: 1318668 - DNA, 21 bp, Homo sapiens
tcagcctgttccttcctgcag

SEQ ID NO: 1318669 - DNA, 22 bp, Homo sapiens
tcagcctgttccttcctgcaga

SEQ ID NO: 1318670 - DNA, 14 bp, Homo sapiens
tcaggaacccaccc

SEQ ID NO: 1318671 - DNA, 20 bp, Homo sapiens
tcaggaacccaccctctcca

SEQ ID NO: 1318672 - DNA, 21 bp, Homo sapiens
tcaggaacccaccctctccac

SEQ ID NO: 1318673 - DNA, 22 bp, Homo sapiens
tcaggaacccaccctctccaca

SEQ ID NO: 1318674 - DNA, 13 bp, Homo sapiens
tcaggagagggcc

SEQ ID NO: 1318675 - DNA, 16 bp, Homo sapiens
tcaggagtccaaacct

SEQ ID NO: 1318676 - DNA, 16 bp, Homo sapiens
tcagtaaaaggacctc

SEQ ID NO: 1318677 - DNA, 19 bp, Homo sapiens
tcagtcctcaaagcttttt

SEQ ID NO: 1318678 - DNA, 20 bp, Homo sapiens
tcagtgttaatactgagaaa

SEQ ID NO: 1318679 - DNA, 18 bp, Homo sapiens
tcatatacaaatgtttta

SEQ ID NO: 1318680 - DNA, 13 bp, Homo sapiens
tcatcattattat

SEQ ID NO: 1318681 - DNA, 18 bp, Homo sapiens
tcatgccagtgcatgcca

SEQ ID NO: 1318682 - DNA, 18 bp, Homo sapiens
tgccattttctgtaaaga

SEQ ID NO: 1318683 - DNA, 22 bp, Homo sapiens
tgcccatgcctaaagcccattg

SEQ ID NO: 1318684 - DNA, 16 bp, Homo sapiens
tgccccaacccttctt

SEQ ID NO: 1318685 - DNA, 17 bp, Homo sapiens
tgccccaacccttcttc

SEQ ID NO: 1318686 - DNA, 20 bp, Homo sapiens
tgccccaacccttcttcatg

SEQ ID NO: 1318687 - DNA, 16 bp, Homo sapiens
tgcccccacagctcct

SEQ ID NO: 1318688 - DNA, 20 bp, Homo sapiens
tgcccgatccagattcccag

SEQ ID NO: 1318689 - DNA, 23 bp, Homo sapiens
tgcccgatccagattcccaggcc

SEQ ID NO: 1318690 - DNA, 15 bp, Homo sapiens
tgcccggtgccatct

SEQ ID NO: 1318691 - DNA, 18 bp, Homo sapiens
tgcctaaagcccattgct

SEQ ID NO: 1318692 - DNA, 23 bp, Homo sapiens
tgcctaaagcccattgctgcaaa

SEQ ID NO: 1318693 - DNA, 14 bp, Homo sapiens
tgcctccaatgtgg

SEQ ID NO: 1318694 - DNA, 21 bp, Homo sapiens
tgcctcggctggctcccctgc

SEQ ID NO: 1318695 - DNA, 23 bp, Homo sapiens
tgcctcggctggctcccctgcag

SEQ ID NO: 1318696 - DNA, 16 bp, Homo sapiens
tgctactgacccagag

SEQ ID NO: 1318697 - DNA, 14 bp, Homo sapiens
tgctcaataaactt

SEQ ID NO: 1318698 - DNA, 16 bp, Homo sapiens
tgctcaataaacttgt

SEQ ID NO: 1318699 - DNA, 18 bp, Homo sapiens
tgctctcctcgggccctg

SEQ ID NO: 1318700 - DNA, 12 bp, Homo sapiens
tgctctctgagg

SEQ ID NO: 1318701 - DNA, 14 bp, Homo sapiens
tgctctctgttctc

SEQ ID NO: 1318702 - DNA, 18 bp, Homo sapiens
tgctctctgttctcttgc

SEQ ID NO: 1318703 - DNA, 21 bp, Homo sapiens
tgctctgagtagctttacact

SEQ ID NO: 1318704 - DNA, 18 bp, Homo sapiens
tgctgaagcttattaatg

SEQ ID NO: 1318705 - DNA, 20 bp, Homo sapiens
tgctgaagcttattaatgct

SEQ ID NO: 1318706 - DNA, 22 bp, Homo sapiens
tgctgaagcttattaatgctaa

SEQ ID NO: 1318707 - DNA, 13 bp, Homo sapiens
tgctgagggtcca

SEQ ID NO: 1318708 - DNA, 18 bp, Homo sapiens
tgctgggagatgctctct

SEQ ID NO: 1318709 - DNA, 22 bp, Homo sapiens
tgctgtggttcactgcactgtt

SEQ ID NO: 1318710 - DNA, 11 bp, Homo sapiens
tgctgtgtgaa

SEQ ID NO: 1318711 - DNA, 18 bp, Homo sapiens
tgctgtgtgaaatctttc

SEQ ID NO: 1318712 - DNA, 16 bp, Homo sapiens
tgcttcagtaaaagga

SEQ ID NO: 1318713 - DNA, 18 bp, Homo sapiens
tgcttgtgaccttgactt

SEQ ID NO: 1318714 - DNA, 19 bp, Homo sapiens
tgcttgttgaatgtcaatc

SEQ ID NO: 1318715 - DNA, 17 bp, Homo sapiens
tgctttaaagagtcctc

SEQ ID NO: 1318716 - DNA, 22 bp, Homo sapiens
tgctttaaagagtcctccttcc

SEQ ID NO: 1318717 - DNA, 20 bp, Homo sapiens
tgctttgttaccttaaaact

SEQ ID NO: 1318718 - DNA, 14 bp, Homo sapiens
tggaaaacttagtt

SEQ ID NO: 1318719 - DNA, 14 bp, Homo sapiens
tggaaactaataaa

SEQ ID NO: 1318720 - DNA, 15 bp, Homo sapiens
tggaaactaataaaa

SEQ ID NO: 1318721 - DNA, 23 bp, Homo sapiens
tggaaactaataaaatattttct

SEQ ID NO: 1318722 - DNA, 16 bp, Homo sapiens
tggaaatattaaaaga

SEQ ID NO: 1318723 - DNA, 15 bp, Homo sapiens
tggaacttccctccc

SEQ ID NO: 1318724 - DNA, 22 bp, Homo sapiens
tggaattgatgtttacatgtct

SEQ ID NO: 1318725 - DNA, 13 bp, Homo sapiens
tggacacttaatt

SEQ ID NO: 1318726 - DNA, 18 bp, Homo sapiens
tggacacttaattctgtt

SEQ ID NO: 1318727 - DNA, 20 bp, Homo sapiens
tggacacttaattctgttct

SEQ ID NO: 1318728 - DNA, 20 bp, Homo sapiens
tggacataactgacttagtt

SEQ ID NO: 1318729 - DNA, 13 bp, Homo sapiens
tggaccatgctga

SEQ ID NO: 1318730 - DNA, 12 bp, Homo sapiens
tggactttgtta

SEQ ID NO: 1318731 - DNA, 13 bp, Homo sapiens
tggagaaaccttc

SEQ ID NO: 1318732 - DNA, 20 bp, Homo sapiens
tggagaaaccttcactccag

SEQ ID NO: 1318733 - DNA, 21 bp, Homo sapiens
tggagaaaccttcactccaga

SEQ ID NO: 1318734 - DNA, 13 bp, Homo sapiens
tggatatctgtta

SEQ ID NO: 1318735 - DNA, 14 bp, Homo sapiens
tggatatctgttag

SEQ ID NO: 1318736 - DNA, 16 bp, Homo sapiens
tggatatctgttagat

SEQ ID NO: 1318737 - DNA, 15 bp, Homo sapiens
tggatgacacattta

SEQ ID NO: 1318738 - DNA, 16 bp, Homo sapiens
tggcaggctgaggcat

SEQ ID NO: 1318739 - DNA, 16 bp, Homo sapiens
tggccaccccttgctc

SEQ ID NO: 1318740 - DNA, 21 bp, Homo sapiens
tggcccatcccgccttctcca

SEQ ID NO: 1318741 - DNA, 17 bp, Homo sapiens
tggcctcaactgagaag

SEQ ID NO: 1318742 - DNA, 23 bp, Homo sapiens
tggcctcaactgagaagccaagc

SEQ ID NO: 1318743 - DNA, 14 bp, Homo sapiens
tggcctctctccac

SEQ ID NO: 1318744 - DNA, 15 bp, Homo sapiens
tggcctctctccact

SEQ ID NO: 1318745 - DNA, 21 bp, Homo sapiens
tggctcacacctgtaatccca

SEQ ID NO: 1318746 - DNA, 18 bp, Homo sapiens
tggctcccctgcagccct

SEQ ID NO: 1318747 - DNA, 16 bp, Homo sapiens
tggctcccctggggtg

SEQ ID NO: 1318748 - DNA, 11 bp, Homo sapiens
tggcttcctgg

SEQ ID NO: 1318749 - DNA, 16 bp, Homo sapiens
tggcttgctcccgccc

SEQ ID NO: 1318750 - DNA, 20 bp, Homo sapiens
tggcttgctcccgccccagg

SEQ ID NO: 1318751 - DNA, 22 bp, Homo sapiens
tggcttgctcccgccccagggt

SEQ ID NO: 1318752 - DNA, 16 bp, Homo sapiens
tgggaataaattaata

SEQ ID NO: 1318753 - DNA, 17 bp, Homo sapiens
tgggagatgctctctga

SEQ ID NO: 1318754 - DNA, 17 bp, Homo sapiens
tgggagcacatagccct

SEQ ID NO: 1318755 - DNA, 21 bp, Homo sapiens
tgggatagtttgggggaactt

SEQ ID NO: 1318756 - DNA, 14 bp, Homo sapiens
tgggcccctcagcc

SEQ ID NO: 1318757 - DNA, 17 bp, Homo sapiens
tggggacatgggtcgcc

SEQ ID NO: 1318758 - DNA, 11 bp, Homo sapiens
tggggagggtc

SEQ ID NO: 1318759 - DNA, 21 bp, Homo sapiens
tggggcctaataaaactgatg

SEQ ID NO: 1318760 - DNA, 16 bp, Homo sapiens
tggggcgcgtgaggcc

SEQ ID NO: 1318761 - DNA, 22 bp, Homo sapiens
tgggggaacttgtagccagaat

SEQ ID NO: 1318762 - DNA, 21 bp, Homo sapiens
tggggtcattttgactggctt

SEQ ID NO: 1318763 - DNA, 21 bp, Homo sapiens
tgggtgacagagcgagacttt

SEQ ID NO: 1318764 - DNA, 18 bp, Homo sapiens
tggtatttggatatctgt

SEQ ID NO: 1318765 - DNA, 13 bp, Homo sapiens
tggtcaccctcag

SEQ ID NO: 1318766 - DNA, 15 bp, Homo sapiens
tggtccaaataggca

SEQ ID NO: 1318767 - DNA, 16 bp, Homo sapiens
tggtcctaggctggaa

SEQ ID NO: 1318768 - DNA, 23 bp, Homo sapiens
tggtcctaggctggaaggaggaa

SEQ ID NO: 1318769 - DNA, 13 bp, Homo sapiens
tggtctcatgccc

SEQ ID NO: 1318770 - DNA, 14 bp, Homo sapiens
tggtctcatgcccc

SEQ ID NO: 1318771 - DNA, 20 bp, Homo sapiens
tggtgatgtacgctgcgtgc

SEQ ID NO: 1318772 - DNA, 20 bp, Homo sapiens
tggtgtcatagaatagcatg

SEQ ID NO: 1318773 - DNA, 15 bp, Homo sapiens
tggttcactgcactg

SEQ ID NO: 1318774 - DNA, 16 bp, Homo sapiens
tggttcactgcactgt

SEQ ID NO: 1318775 - DNA, 21 bp, Homo sapiens
tggttcctaggggaatgaggg

SEQ ID NO: 1318776 - DNA, 13 bp, Homo sapiens
tggttttctgttt

SEQ ID NO: 1318777 - DNA, 16 bp, Homo sapiens
tggttttggccacccc

SEQ ID NO: 1318778 - DNA, 19 bp, Homo sapiens
tggtttttcttttcttgga

SEQ ID NO: 1318779 - DNA, 16 bp, Homo sapiens
tgtaatcccaacactt

SEQ ID NO: 1318780 - DNA, 21 bp, Homo sapiens
tgtacaggacatgtactgaga

SEQ ID NO: 1318781 - DNA, 17 bp, Homo sapiens
tgtagatgaacatctct

SEQ ID NO: 1318782 - DNA, 23 bp, Homo sapiens
tgtaggctggtccctatgtcatg

SEQ ID NO: 1318783 - DNA, 17 bp, Homo sapiens
tgtatatagtataaagt

SEQ ID NO: 1318784 - DNA, 17 bp, Homo sapiens
tgtattatatgtaacta

SEQ ID NO: 1318785 - DNA, 16 bp, Homo sapiens
tgtcaacaccagaaag

SEQ ID NO: 1318786 - DNA, 20 bp, Homo sapiens
tgtcaccaggcaaccaggaa

SEQ ID NO: 1318787 - DNA, 21 bp, Homo sapiens
tgtccccccaaaattcatgtg

SEQ ID NO: 1318788 - DNA, 20 bp, Homo sapiens
tgtcctcttttgttgtttct

SEQ ID NO: 1318789 - DNA, 22 bp, Homo sapiens
tgtcctcttttgttgtttctta

SEQ ID NO: 1318790 - DNA, 23 bp, Homo sapiens
tgtcctgtaaacactcagctgtt

SEQ ID NO: 1318791 - DNA, 19 bp, Homo sapiens
tgtctgttgcttcagtaaa

SEQ ID NO: 1318792 - DNA, 19 bp, Homo sapiens
tgtcttaaatactttaatg

SEQ ID NO: 1318793 - DNA, 23 bp, Homo sapiens
tgtcttccattaagaacactaaa

SEQ ID NO: 1318794 - DNA, 14 bp, Homo sapiens
tgtctttgtccctg

SEQ ID NO: 1318795 - DNA, 14 bp, Homo sapiens
tgtgaagacactgt

SEQ ID NO: 1318796 - DNA, 17 bp, Homo sapiens
tgtgaagacactgtgca

SEQ ID NO: 1318797 - DNA, 15 bp, Homo sapiens
tgtgaattgcctgcc

SEQ ID NO: 1318798 - DNA, 17 bp, Homo sapiens
tgtgaattgcctgccat

SEQ ID NO: 1318799 - DNA, 23 bp, Homo sapiens
tgtgaattgcctgccatggctgt

SEQ ID NO: 1318800 - DNA, 14 bp, Homo sapiens
tgtgactagtgctg

SEQ ID NO: 1318801 - DNA, 17 bp, Homo sapiens
tgtgatataaacagctt

SEQ ID NO: 1318802 - DNA, 14 bp, Homo sapiens
tgtgatttctgtgc

SEQ ID NO: 1318803 - DNA, 16 bp, Homo sapiens
tgtgcaggcccaggca

SEQ ID NO: 1318804 - DNA, 19 bp, Homo sapiens
tgtgccaaacaaaatgaga

SEQ ID NO: 1318805 - DNA, 18 bp, Homo sapiens
tgtgccattttctgtaaa

SEQ ID NO: 1318806 - DNA, 17 bp, Homo sapiens
tgtgctcaaccagacag

SEQ ID NO: 1318807 - DNA, 19 bp, Homo sapiens
tgtgctcaaccagacagat

SEQ ID NO: 1318808 - DNA, 20 bp, Homo sapiens
tgtgctcaaccagacagata

SEQ ID NO: 1318809 - DNA, 21 bp, Homo sapiens
tgtgctcagaattattaatta

SEQ ID NO: 1318810 - DNA, 20 bp, Homo sapiens
tgtggacctcaccagagacc

SEQ ID NO: 1318811 - DNA, 15 bp, Homo sapiens
tgtggggagggtcat

SEQ ID NO: 1318812 - DNA, 23 bp, Homo sapiens
tgtggggggaggctgactcctgg

SEQ ID NO: 1318813 - DNA, 13 bp, Homo sapiens
tgtggtccaaata

SEQ ID NO: 1318814 - DNA, 23 bp, Homo sapiens
attaatgctaagggcaggcccaa

SEQ ID NO: 1318815 - DNA, 16 bp, Homo sapiens
attaattatcgtgtct

SEQ ID NO: 1318816 - DNA, 16 bp, Homo sapiens
attaatttatcagatt

SEQ ID NO: 1318817 - DNA, 19 bp, Homo sapiens
attacaaattaagggttaa

SEQ ID NO: 1318818 - DNA, 14 bp, Homo sapiens
attatcaagctaat

SEQ ID NO: 1318819 - DNA, 15 bp, Homo sapiens
attatcaagctaata

SEQ ID NO: 1318820 - DNA, 13 bp, Homo sapiens
attatttgcagtc

SEQ ID NO: 1318821 - DNA, 11 bp, Homo sapiens
attcacagcct

SEQ ID NO: 1318822 - DNA, 23 bp, Homo sapiens
attcaccaatttcctttaaaaca

SEQ ID NO: 1318823 - DNA, 19 bp, Homo sapiens
attcatccatccgttcatt

SEQ ID NO: 1318824 - DNA, 20 bp, Homo sapiens
attcgaaacctgtgatttct

SEQ ID NO: 1318825 - DNA, 20 bp, Homo sapiens
attctatcctgtgaggcttt

SEQ ID NO: 1318826 - DNA, 15 bp, Homo sapiens
attctgctctgccca

SEQ ID NO: 1318827 - DNA, 17 bp, Homo sapiens
attctgctctgcccatg

SEQ ID NO: 1318828 - DNA, 10 bp, Homo sapiens
attcttcaaa

SEQ ID NO: 1318829 - DNA, 13 bp, Homo sapiens
attctttcagatt

SEQ ID NO: 1318830 - DNA, 18 bp, Homo sapiens
attcttttctgaagttgt

SEQ ID NO: 1318831 - DNA, 16 bp, Homo sapiens
attgaggaaggaaatc

SEQ ID NO: 1318832 - DNA, 18 bp, Homo sapiens
attgaggtgtttgaaata

SEQ ID NO: 1318833 - DNA, 21 bp, Homo sapiens
attgcattttttaaaacaaga

SEQ ID NO: 1318834 - DNA, 21 bp, Homo sapiens
attgctgcaaatgcattgtga

SEQ ID NO: 1318835 - DNA, 19 bp, Homo sapiens
attgctttgggtaataaat

SEQ ID NO: 1318836 - DNA, 16 bp, Homo sapiens
attgtgaattgcctgc

SEQ ID NO: 1318837 - DNA, 17 bp, Homo sapiens
attgtgaattgcctgcc

SEQ ID NO: 1318838 - DNA, 21 bp, Homo sapiens
attgtgaattgcctgccatgg

SEQ ID NO: 1318839 - DNA, 17 bp, Homo sapiens
attgtgttatttcactt

SEQ ID NO: 1318840 - DNA, 13 bp, Homo sapiens
atttaaagggaat

SEQ ID NO: 1318841 - DNA, 15 bp, Homo sapiens
atttaaagggaatga

SEQ ID NO: 1318842 - DNA, 15 bp, Homo sapiens
atttaaatgacagca

SEQ ID NO: 1318843 - DNA, 12 bp, Homo sapiens
atttaatgaaca

SEQ ID NO: 1318844 - DNA, 15 bp, Homo sapiens
atttactgagagaag

SEQ ID NO: 1318845 - DNA, 17 bp, Homo sapiens
atttatccctcattcat

SEQ ID NO: 1318846 - DNA, 17 bp, Homo sapiens
atttcatcagaacagct

SEQ ID NO: 1318847 - DNA, 22 bp, Homo sapiens
atttctctcttatatgccagaa

SEQ ID NO: 1318848 - DNA, 21 bp, Homo sapiens
atttctgtgccattttctgta

SEQ ID NO: 1318849 - DNA, 17 bp, Homo sapiens
atttggaaactaataaa

SEQ ID NO: 1318850 - DNA, 18 bp, Homo sapiens
atttggaaactaataaaa

SEQ ID NO: 1318851 - DNA, 16 bp, Homo sapiens
atttggatatctgtta

SEQ ID NO: 1318852 - DNA, 15 bp, Homo sapiens
atttgtaaatattaa

SEQ ID NO: 1318853 - DNA, 23 bp, Homo sapiens
attttacttggaaatattaaaag

SEQ ID NO: 1318854 - DNA, 22 bp, Homo sapiens
attttagtcttgctgtttcttg

SEQ ID NO: 1318855 - DNA, 18 bp, Homo sapiens
attttattttttttctgt

SEQ ID NO: 1318856 - DNA, 14 bp, Homo sapiens
attttctgtgtgtt

SEQ ID NO: 1318857 - DNA, 15 bp, Homo sapiens
attttctgtgtgttc

SEQ ID NO: 1318858 - DNA, 16 bp, Homo sapiens
attttctgtgtgttcc

SEQ ID NO: 1318859 - DNA, 14 bp, Homo sapiens
attttgactggctt

SEQ ID NO: 1318860 - DNA, 15 bp, Homo sapiens
attttttaaaacaag

SEQ ID NO: 1318861 - DNA, 21 bp, Homo sapiens
attttttaacttatgtatgtg

SEQ ID NO: 1318862 - DNA, 14 bp, Homo sapiens
attttttttctgta

SEQ ID NO: 1318863 - DNA, 21 bp, Homo sapiens
caaaagttgatttcttcttca

SEQ ID NO: 1318864 - DNA, 22 bp, Homo sapiens
caaaattataggagacttgtag

SEQ ID NO: 1318865 - DNA, 15 bp, Homo sapiens
caaacctaattgcac

SEQ ID NO: 1318866 - DNA, 18 bp, Homo sapiens
caaagataaatgaaataa

SEQ ID NO: 1318867 - DNA, 21 bp, Homo sapiens
caaagtataaatttgtgtaat

SEQ ID NO: 1318868 - DNA, 21 bp, Homo sapiens
caaataaaattccctaaagcc

SEQ ID NO: 1318869 - DNA, 20 bp, Homo sapiens
caaatgctgtggttcactgc

SEQ ID NO: 1318870 - DNA, 15 bp, Homo sapiens
caaatgttttagtaa

SEQ ID NO: 1318871 - DNA, 18 bp, Homo sapiens
caaatgttttagtaaaaa

SEQ ID NO: 1318872 - DNA, 16 bp, Homo sapiens
caaattatcaagctaa

SEQ ID NO: 1318873 - DNA, 18 bp, Homo sapiens
caacaccatcacagcttg

SEQ ID NO: 1318874 - DNA, 22 bp, Homo sapiens
caacaccatcacagcttgtttt

SEQ ID NO: 1318875 - DNA, 17 bp, Homo sapiens
caacagagagggagaaa

SEQ ID NO: 1318876 - DNA, 14 bp, Homo sapiens
caacagtcttgtga

SEQ ID NO: 1318877 - DNA, 13 bp, Homo sapiens
caacatcagcttg

SEQ ID NO: 1318878 - DNA, 14 bp, Homo sapiens
caacatcagcttga

SEQ ID NO: 1318879 - DNA, 13 bp, Homo sapiens
caacgattcacag

SEQ ID NO: 1318880 - DNA, 16 bp, Homo sapiens
caacgattcacagcct

SEQ ID NO: 1318881 - DNA, 17 bp, Homo sapiens
caacgattcacagcctc

SEQ ID NO: 1318882 - DNA, 12 bp, Homo sapiens
caactcagcctg

SEQ ID NO: 1318883 - DNA, 22 bp, Homo sapiens
caactcagcctgttccttcctg

SEQ ID NO: 1318884 - DNA, 19 bp, Homo sapiens
caactccagcgtcctcagc

SEQ ID NO: 1318885 - DNA, 22 bp, Homo sapiens
caactctgctgagggtccagaa

SEQ ID NO: 1318886 - DNA, 17 bp, Homo sapiens
caacttcatctggaagt

SEQ ID NO: 1318887 - DNA, 13 bp, Homo sapiens
caagactctgctc

SEQ ID NO: 1318888 - DNA, 19 bp, Homo sapiens
caagactctgctctcctcg

SEQ ID NO: 1318889 - DNA, 14 bp, Homo sapiens
caagccccttctct

SEQ ID NO: 1318890 - DNA, 17 bp, Homo sapiens
caagccccttctctcaa

SEQ ID NO: 1318891 - DNA, 16 bp, Homo sapiens
caagcctttgacctgt

SEQ ID NO: 1318892 - DNA, 15 bp, Homo sapiens
caaggaactcttgaa

SEQ ID NO: 1318893 - DNA, 16 bp, Homo sapiens
caaggcagaaggccag

SEQ ID NO: 1318894 - DNA, 18 bp, Homo sapiens
caaggcagaaggccagga

SEQ ID NO: 1318895 - DNA, 21 bp, Homo sapiens
caaggcgcgctcagatgccgg

SEQ ID NO: 1318896 - DNA, 22 bp, Homo sapiens
caagggatgaattgtaaaagca

SEQ ID NO: 1318897 - DNA, 20 bp, Homo sapiens
caagtccccgtctgcctggc

SEQ ID NO: 1318898 - DNA, 19 bp, Homo sapiens
caagtgaaggaccccctcc

SEQ ID NO: 1318899 - DNA, 13 bp, Homo sapiens
aatagcatgttgt

SEQ ID NO: 1318900 - DNA, 16 bp, Homo sapiens
aatagcatgttgtaga

SEQ ID NO: 1318901 - DNA, 16 bp, Homo sapiens
aatatggaactgtaat

SEQ ID NO: 1318902 - DNA, 17 bp, Homo sapiens
aatattttctgtgtgtt

SEQ ID NO: 1318903 - DNA, 19 bp, Homo sapiens
aatattttctgtgtgttcc

SEQ ID NO: 1318904 - DNA, 21 bp, Homo sapiens
aatattttctgtgtgttcctg

SEQ ID NO: 1318905 - DNA, 11 bp, Homo sapiens
aatcagctgct

SEQ ID NO: 1318906 - DNA, 19 bp, Homo sapiens
aatcatatttaaagggaat

SEQ ID NO: 1318907 - DNA, 19 bp, Homo sapiens
aatcgcttgaacccaggag

SEQ ID NO: 1318908 - DNA, 19 bp, Homo sapiens
aatgaaagtcttgtgacta

SEQ ID NO: 1318909 - DNA, 17 bp, Homo sapiens
aatgataaatttaaatg

SEQ ID NO: 1318910 - DNA, 20 bp, Homo sapiens
aatgcattgtgaattgcctg

SEQ ID NO: 1318911 - DNA, 21 bp, Homo sapiens
aatgcattgtgaattgcctgc

SEQ ID NO: 1318912 - DNA, 22 bp, Homo sapiens
aatgcctctccttaaatgcttc

SEQ ID NO: 1318913 - DNA, 23 bp, Homo sapiens
aatgctggctggccttgtggtcc

SEQ ID NO: 1318914 - DNA, 20 bp, Homo sapiens
aatgtatatgaacttaacat

SEQ ID NO: 1318915 - DNA, 19 bp, Homo sapiens
aattaatatattgttttcc

SEQ ID NO: 1318916 - DNA, 16 bp, Homo sapiens
aattatcaagctaata

SEQ ID NO: 1318917 - DNA, 20 bp, Homo sapiens
aattgcattttttaaaacaa

SEQ ID NO: 1318918 - DNA, 19 bp, Homo sapiens
aattgcctgccatggctgt

SEQ ID NO: 1318919 - DNA, 20 bp, Homo sapiens
aatttatcagattgcttttg

SEQ ID NO: 1318920 - DNA, 12 bp, Homo sapiens
aatttcattcaa

SEQ ID NO: 1318921 - DNA, 12 bp, Homo sapiens
aatttgctgctg

SEQ ID NO: 1318922 - DNA, 20 bp, Homo sapiens
aatttggaaactaataaaat

SEQ ID NO: 1318923 - DNA, 21 bp, Homo sapiens
aatttggaaactaataaaata

SEQ ID NO: 1318924 - DNA, 22 bp, Homo sapiens
aatttggaaactaataaaatat

SEQ ID NO: 1318925 - DNA, 14 bp, Homo sapiens
acaaaaagcaatta

SEQ ID NO: 1318926 - DNA, 20 bp, Homo sapiens
acaaactgccattggctata

SEQ ID NO: 1318927 - DNA, 18 bp, Homo sapiens
acaaagtttatcttggcc

SEQ ID NO: 1318928 - DNA, 22 bp, Homo sapiens
acaaatgttttagtaaaaaaga

SEQ ID NO: 1318929 - DNA, 19 bp, Homo sapiens
acaagttaagattcttggt

SEQ ID NO: 1318930 - DNA, 13 bp, Homo sapiens
acaatcagctgct

SEQ ID NO: 1318931 - DNA, 18 bp, Homo sapiens
acaatcagctgctttgtt

SEQ ID NO: 1318932 - DNA, 16 bp, Homo sapiens
acaatttctctgggtg

SEQ ID NO: 1318933 - DNA, 21 bp, Homo sapiens
acacaattttattttttttct

SEQ ID NO: 1318934 - DNA, 23 bp, Homo sapiens
acacaattttattttttttctgt

SEQ ID NO: 1318935 - DNA, 15 bp, Homo sapiens
acacacgccttcatg

SEQ ID NO: 1318936 - DNA, 21 bp, Homo sapiens
acacagaccgcgcccctggga

SEQ ID NO: 1318937 - DNA, 21 bp, Homo sapiens
acaccatcacagcttgttttg

SEQ ID NO: 1318938 - DNA, 17 bp, Homo sapiens
acacctcactctgctac

SEQ ID NO: 1318939 - DNA, 14 bp, Homo sapiens
acacctcctggggc

SEQ ID NO: 1318940 - DNA, 19 bp, Homo sapiens
acacctgcagcctccctcc

SEQ ID NO: 1318941 - DNA, 19 bp, Homo sapiens
acactgtgcaggcccaggc

SEQ ID NO: 1318942 - DNA, 15 bp, Homo sapiens
acactgttattttca

SEQ ID NO: 1318943 - DNA, 21 bp, Homo sapiens
acactgttattttcagcatga

SEQ ID NO: 1318944 - DNA, 14 bp, Homo sapiens
acacttaattctgt

SEQ ID NO: 1318945 - DNA, 19 bp, Homo sapiens
acactttcctcttctatga

SEQ ID NO: 1318946 - DNA, 21 bp, Homo sapiens
acagaccgcgcccctgggact

SEQ ID NO: 1318947 - DNA, 17 bp, Homo sapiens
acagcctccgcggactg

SEQ ID NO: 1318948 - DNA, 16 bp, Homo sapiens
acagctggtcacacaa

SEQ ID NO: 1318949 - DNA, 14 bp, Homo sapiens
acaggaacacacag

SEQ ID NO: 1318950 - DNA, 12 bp, Homo sapiens
acaggcctggcc

SEQ ID NO: 1318951 - DNA, 13 bp, Homo sapiens
acaggcctggcct

SEQ ID NO: 1318952 - DNA, 17 bp, Homo sapiens
acagggaccagctcccc

SEQ ID NO: 1318953 - DNA, 15 bp, Homo sapiens
acagtcaccactgtg

SEQ ID NO: 1318954 - DNA, 24 bp, Homo sapiens
acagtgtgaagacactgtgcaggc

SEQ ID NO: 1318955 - DNA, 17 bp, Homo sapiens
acataagagctttttca

SEQ ID NO: 1318956 - DNA, 21 bp, Homo sapiens
acatagccctgttgacctgcc

SEQ ID NO: 1318957 - DNA, 19 bp, Homo sapiens
acatccttcttggcttcct

SEQ ID NO: 1318958 - DNA, 20 bp, Homo sapiens
acatctacgaagccacaggc

SEQ ID NO: 1318959 - DNA, 20 bp, Homo sapiens
acatgctgtgtaagctgtgt

SEQ ID NO: 1318960 - DNA, 16 bp, Homo sapiens
acatgggtcgcccatg

SEQ ID NO: 1318961 - DNA, 13 bp, Homo sapiens
acatgtgccctgc

SEQ ID NO: 1318962 - DNA, 13 bp, Homo sapiens
accaaattctatc

SEQ ID NO: 1318963 - DNA, 22 bp, Homo sapiens
accaacaccatcacagcttgtt

SEQ ID NO: 1318964 - DNA, 14 bp, Homo sapiens
accagctccccggg

SEQ ID NO: 1318965 - DNA, 15 bp, Homo sapiens
acccaccctctccac

SEQ ID NO: 1318966 - DNA, 13 bp, Homo sapiens
acccagcctgtcc

SEQ ID NO: 1318967 - DNA, 16 bp, Homo sapiens
acccagcctgtcccac

SEQ ID NO: 1318968 - DNA, 14 bp, Homo sapiens
accccacccacctt

SEQ ID NO: 1318969 - DNA, 17 bp, Homo sapiens
accccacccacctttgc

SEQ ID NO: 1318970 - DNA, 23 bp, Homo sapiens
accccgactatccctgcacataa

SEQ ID NO: 1318971 - DNA, 19 bp, Homo sapiens
acccctggtggctgcaggc

SEQ ID NO: 1318972 - DNA, 11 bp, Homo sapiens
accccttgctc

SEQ ID NO: 1318973 - DNA, 15 bp, Homo sapiens
agtcttgacctctcc

SEQ ID NO: 1318974 - DNA, 16 bp, Homo sapiens
agtcttgacctctcca

SEQ ID NO: 1318975 - DNA, 18 bp, Homo sapiens
agtcttgctgtttcttga

SEQ ID NO: 1318976 - DNA, 21 bp, Homo sapiens
agtcttgtgactagtgctgaa

SEQ ID NO: 1318977 - DNA, 23 bp, Homo sapiens
agtcttgtgactagtgctgaagc

SEQ ID NO: 1318978 - DNA, 16 bp, Homo sapiens
agtgaggccactgaag

SEQ ID NO: 1318979 - DNA, 16 bp, Homo sapiens
agtgattgtagtttaa

SEQ ID NO: 1318980 - DNA, 15 bp, Homo sapiens
agtgctgctttgcca

SEQ ID NO: 1318981 - DNA, 22 bp, Homo sapiens
agtggagtccagatggcaggct

SEQ ID NO: 1318982 - DNA, 20 bp, Homo sapiens
agtgtgaagacactgtgcag

SEQ ID NO: 1318983 - DNA, 22 bp, Homo sapiens
agtgtgaagacactgtgcaggc

SEQ ID NO: 1318984 - DNA, 12 bp, Homo sapiens
agtgtggttttc

SEQ ID NO: 1318985 - DNA, 16 bp, Homo sapiens
agtgtggttttctgtt

SEQ ID NO: 1318986 - DNA, 17 bp, Homo sapiens
agttatgaaaagataac

SEQ ID NO: 1318987 - DNA, 14 bp, Homo sapiens
agttcttgaacagt

SEQ ID NO: 1318988 - DNA, 16 bp, Homo sapiens
agttgggaagtctcag

SEQ ID NO: 1318989 - DNA, 19 bp, Homo sapiens
agttgggaagtctcagcct

SEQ ID NO: 1318990 - DNA, 19 bp, Homo sapiens
agtttaaaaattgtctctt

SEQ ID NO: 1318991 - DNA, 19 bp, Homo sapiens
agtttatgcagtgctgctt

SEQ ID NO: 1318992 - DNA, 15 bp, Homo sapiens
ataaaactgatgtga

SEQ ID NO: 1318993 - DNA, 12 bp, Homo sapiens
ataaacttgtgc

SEQ ID NO: 1318994 - DNA, 14 bp, Homo sapiens
ataaacttgtgcct

SEQ ID NO: 1318995 - DNA, 19 bp, Homo sapiens
ataaagccatatttagtat

SEQ ID NO: 1318996 - DNA, 19 bp, Homo sapiens
ataaaggtgtgctgtgtcc

SEQ ID NO: 1318997 - DNA, 19 bp, Homo sapiens
ataacaccaccattcacaa

SEQ ID NO: 1318998 - DNA, 19 bp, Homo sapiens
ataacttctaggtattcga

SEQ ID NO: 1318999 - DNA, 12 bp, Homo sapiens
ataatgttgtca

SEQ ID NO: 1319000 - DNA, 21 bp, Homo sapiens
atacaatcagctgctttgtta

SEQ ID NO: 1319001 - DNA, 17 bp, Homo sapiens
atacctcgttagagaat

SEQ ID NO: 1319002 - DNA, 21 bp, Homo sapiens
atacgcattaagggcctgctg

SEQ ID NO: 1319003 - DNA, 17 bp, Homo sapiens
atagagatgagctttct

SEQ ID NO: 1319004 - DNA, 17 bp, Homo sapiens
atagatgggactgtgtc

SEQ ID NO: 1319005 - DNA, 21 bp, Homo sapiens
atagcagcctggctcccctgg

SEQ ID NO: 1319006 - DNA, 14 bp, Homo sapiens
atagcccctggtgt

SEQ ID NO: 1319007 - DNA, 17 bp, Homo sapiens
atagccctgttgacctg

SEQ ID NO: 1319008 - DNA, 19 bp, Homo sapiens
atagccctgttgacctgcc

SEQ ID NO: 1319009 - DNA, 15 bp, Homo sapiens
ataggagacttgtag

SEQ ID NO: 1319010 - DNA, 20 bp, Homo sapiens
atagtttgggggaacttgta

SEQ ID NO: 1319011 - DNA, 14 bp, Homo sapiens
atatattgttttcc

SEQ ID NO: 1319012 - DNA, 21 bp, Homo sapiens
atatccgggtgctcaataaac

SEQ ID NO: 1319013 - DNA, 15 bp, Homo sapiens
atatggaactgtaat

SEQ ID NO: 1319014 - DNA, 11 bp, Homo sapiens
atattacttta

SEQ ID NO: 1319015 - DNA, 15 bp, Homo sapiens
atatttaaagggaat

SEQ ID NO: 1319016 - DNA, 13 bp, Homo sapiens
atattttctgtgt

SEQ ID NO: 1319017 - DNA, 16 bp, Homo sapiens
atattttctgtgtgtt

SEQ ID NO: 1319018 - DNA, 20 bp, Homo sapiens
atattttctgtgtgttcctg

SEQ ID NO: 1319019 - DNA, 18 bp, Homo sapiens
atcacagcttgttttgga

SEQ ID NO: 1319020 - DNA, 14 bp, Homo sapiens
atcagaacagctgt

SEQ ID NO: 1319021 - DNA, 15 bp, Homo sapiens
atcagaacagctgtt

SEQ ID NO: 1319022 - DNA, 13 bp, Homo sapiens
atcagctgctttg

SEQ ID NO: 1319023 - DNA, 14 bp, Homo sapiens
atcatcattattat

SEQ ID NO: 1319024 - DNA, 16 bp, Homo sapiens
atcatcattattatta

SEQ ID NO: 1319025 - DNA, 14 bp, Homo sapiens
atcatccccgaggg

SEQ ID NO: 1319026 - DNA, 20 bp, Homo sapiens
atccagattcccaggccagg

SEQ ID NO: 1319027 - DNA, 22 bp, Homo sapiens
atccagattcccaggccaggct

SEQ ID NO: 1319028 - DNA, 23 bp, Homo sapiens
atccatccgttcattcattcagc

SEQ ID NO: 1319029 - DNA, 13 bp, Homo sapiens
atcccagcctcag

SEQ ID NO: 1319030 - DNA, 17 bp, Homo sapiens
atcccagcctcagaagc

SEQ ID NO: 1319031 - DNA, 13 bp, Homo sapiens
atccctcattcat

SEQ ID NO: 1319032 - DNA, 12 bp, Homo sapiens
atccgggtgctc

SEQ ID NO: 1319033 - DNA, 22 bp, Homo sapiens
atcctggttcctaggggaatga

SEQ ID NO: 1319034 - DNA, 19 bp, Homo sapiens
atccttcttggcttcctgg

SEQ ID NO: 1319035 - DNA, 20 bp, Homo sapiens
atccttcttggcttcctggc

SEQ ID NO: 1319036 - DNA, 14 bp, Homo sapiens
atcgggggtgagcg

SEQ ID NO: 1319037 - DNA, 18 bp, Homo sapiens
atctacgaagccacaggc

SEQ ID NO: 1319038 - DNA, 22 bp, Homo sapiens
atctacgaagccacaggcctgg

SEQ ID NO: 1319039 - DNA, 21 bp, Homo sapiens
atctagtcttgacctctccag

SEQ ID NO: 1319040 - DNA, 22 bp, Homo sapiens
atctagtcttgacctctccagc

SEQ ID NO: 1319041 - DNA, 23 bp, Homo sapiens
atctagtcttgacctctccagca

SEQ ID NO: 1319042 - DNA, 15 bp, Homo sapiens
atctctcctgtgtct

SEQ ID NO: 1319043 - DNA, 11 bp, Homo sapiens
atctggctggt

SEQ ID NO: 1319044 - DNA, 19 bp, Homo sapiens
atcttacttgcaaaatgga

SEQ ID NO: 1319045 - DNA, 12 bp, Homo sapiens
atctttcaagtt

SEQ ID NO: 1319046 - DNA, 12 bp, Homo sapiens
atctttctggaa

SEQ ID NO: 1319047 - DNA, 18 bp, Homo sapiens
atgaaagtcttgtgacta

SEQ ID NO: 1319048 - DNA, 12 bp, Homo sapiens
atgaacagactt

SEQ ID NO: 1319049 - DNA, 16 bp, Homo sapiens
atgaacttaacatgct

SEQ ID NO: 1319050 - DNA, 13 bp, Homo sapiens
atgaacttgtctt

SEQ ID NO: 1319051 - DNA, 21 bp, Homo sapiens
gtcttctcccaactcagcctg

SEQ ID NO: 1319052 - DNA, 20 bp, Homo sapiens
gtcttgtgactagtgctgaa

SEQ ID NO: 1319053 - DNA, 13 bp, Homo sapiens
gtctttgtccctg

SEQ ID NO: 1319054 - DNA, 15 bp, Homo sapiens
gtctttgtccctgtt

SEQ ID NO: 1319055 - DNA, 22 bp, Homo sapiens
gtgaatgaaagtcttgtgacta

SEQ ID NO: 1319056 - DNA, 14 bp, Homo sapiens
gtgaattgcctgcc

SEQ ID NO: 1319057 - DNA, 16 bp, Homo sapiens
gtgaattgcctgccat

SEQ ID NO: 1319058 - DNA, 15 bp, Homo sapiens
gtgacctctccggcc

SEQ ID NO: 1319059 - DNA, 14 bp, Homo sapiens
gtgactagtgctga

SEQ ID NO: 1319060 - DNA, 17 bp, Homo sapiens
gtgactagtgctgaagc

SEQ ID NO: 1319061 - DNA, 18 bp, Homo sapiens
gtgactagtgctgaagct

SEQ ID NO: 1319062 - DNA, 20 bp, Homo sapiens
gtgagaattgggactctgtt

SEQ ID NO: 1319063 - DNA, 15 bp, Homo sapiens
gtgaggccactgaag

SEQ ID NO: 1319064 - DNA, 20 bp, Homo sapiens
gtgaggccactgaagaggag

SEQ ID NO: 1319065 - DNA, 21 bp, Homo sapiens
gtgagggtgcggggcctgcag

SEQ ID NO: 1319066 - DNA, 22 bp, Homo sapiens
gtgagggtgcggggcctgcagg

SEQ ID NO: 1319067 - DNA, 16 bp, Homo sapiens
gtgatataaacagctt

SEQ ID NO: 1319068 - DNA, 12 bp, Homo sapiens
gtgatatgctgc

SEQ ID NO: 1319069 - DNA, 18 bp, Homo sapiens
gtgatatgctgcttgtga

SEQ ID NO: 1319070 - DNA, 14 bp, Homo sapiens
gtgatgtacgctgc

SEQ ID NO: 1319071 - DNA, 16 bp, Homo sapiens
gtgcaggcccaggcag

SEQ ID NO: 1319072 - DNA, 18 bp, Homo sapiens
gtgcaggcccaggcaggc

SEQ ID NO: 1319073 - DNA, 17 bp, Homo sapiens
gtgccttaaagatacaa

SEQ ID NO: 1319074 - DNA, 14 bp, Homo sapiens
gtgcgcggactgtc

SEQ ID NO: 1319075 - DNA, 16 bp, Homo sapiens
gtgcggggcctgcagg

SEQ ID NO: 1319076 - DNA, 23 bp, Homo sapiens
gtgctcaataaacttgtgcctcc

SEQ ID NO: 1319077 - DNA, 14 bp, Homo sapiens
gtgctgaagcttat

SEQ ID NO: 1319078 - DNA, 14 bp, Homo sapiens
gtgctgggagatgc

SEQ ID NO: 1319079 - DNA, 20 bp, Homo sapiens
gtgctgggagatgctctctg

SEQ ID NO: 1319080 - DNA, 22 bp, Homo sapiens
gtgctgggagatgctctctgag

SEQ ID NO: 1319081 - DNA, 18 bp, Homo sapiens
gtgggtttgtggggggag

SEQ ID NO: 1319082 - DNA, 12 bp, Homo sapiens
gtggtccaaata

SEQ ID NO: 1319083 - DNA, 16 bp, Homo sapiens
gtggttttctgtttct

SEQ ID NO: 1319084 - DNA, 16 bp, Homo sapiens
gtggtttttcttttct

SEQ ID NO: 1319085 - DNA, 19 bp, Homo sapiens
gtgtcatagaatagcatgt

SEQ ID NO: 1319086 - DNA, 17 bp, Homo sapiens
gtgtgaagacactgtgc

SEQ ID NO: 1319087 - DNA, 22 bp, Homo sapiens
gtgtgaagacactgtgcaggcc

SEQ ID NO: 1319088 - DNA, 21 bp, Homo sapiens
gttaaagtgaggccactgaag

SEQ ID NO: 1319089 - DNA, 14 bp, Homo sapiens
gttaaatcagagat

SEQ ID NO: 1319090 - DNA, 19 bp, Homo sapiens
gttacagtgagctgagagt

SEQ ID NO: 1319091 - DNA, 14 bp, Homo sapiens
gttagaaaaatgga

SEQ ID NO: 1319092 - DNA, 11 bp, Homo sapiens
gttatgtgtct

SEQ ID NO: 1319093 - DNA, 19 bp, Homo sapiens
gttcaattatttcccccat

SEQ ID NO: 1319094 - DNA, 17 bp, Homo sapiens
gttcacatgtgccctgc

SEQ ID NO: 1319095 - DNA, 19 bp, Homo sapiens
gttcacatgtgccctgcct

SEQ ID NO: 1319096 - DNA, 22 bp, Homo sapiens
gttcactgcactgttcaggagt

SEQ ID NO: 1319097 - DNA, 19 bp, Homo sapiens
gttcagaaaaaatgtgaag

SEQ ID NO: 1319098 - DNA, 15 bp, Homo sapiens
gttcagattggacat

SEQ ID NO: 1319099 - DNA, 18 bp, Homo sapiens
gttcaggagtccaaacct

SEQ ID NO: 1319100 - DNA, 19 bp, Homo sapiens
gttccatgttttgttttct

SEQ ID NO: 1319101 - DNA, 13 bp, Homo sapiens
gttccccacaggt

SEQ ID NO: 1319102 - DNA, 18 bp, Homo sapiens
gttcctaggggaatgagg

SEQ ID NO: 1319103 - DNA, 23 bp, Homo sapiens
gttccttcctgcagacctggctg

SEQ ID NO: 1319104 - DNA, 12 bp, Homo sapiens
gttctcttgctt

SEQ ID NO: 1319105 - DNA, 15 bp, Homo sapiens
gttctcttgctttaa

SEQ ID NO: 1319106 - DNA, 14 bp, Homo sapiens
gttctgatattaat

SEQ ID NO: 1319107 - DNA, 21 bp, Homo sapiens
gttctgtaaaatggaaaactt

SEQ ID NO: 1319108 - DNA, 22 bp, Homo sapiens
gttctgtaaaatggaaaactta

SEQ ID NO: 1319109 - DNA, 19 bp, Homo sapiens
gttcttcttgtctttgtcc

SEQ ID NO: 1319110 - DNA, 17 bp, Homo sapiens
gttgggaagtctcagcc

SEQ ID NO: 1319111 - DNA, 22 bp, Homo sapiens
gttgggaagtctcagcctgggc

SEQ ID NO: 1319112 - DNA, 16 bp, Homo sapiens
gttgtagatacaatca

SEQ ID NO: 1319113 - DNA, 19 bp, Homo sapiens
gttgtagatacaatcagct

SEQ ID NO: 1319114 - DNA, 19 bp, Homo sapiens
gttgtttcttaatttggaa

SEQ ID NO: 1319115 - DNA, 22 bp, Homo sapiens
gtttaaaaattgtctcttttca

SEQ ID NO: 1319116 - DNA, 21 bp, Homo sapiens
gtttagtgtggttttctgttt

SEQ ID NO: 1319117 - DNA, 18 bp, Homo sapiens
gtttcttaatttggaaac

SEQ ID NO: 1319118 - DNA, 14 bp, Homo sapiens
gtttcttgatgctc

SEQ ID NO: 1319119 - DNA, 15 bp, Homo sapiens
gtttgaagattgcct

SEQ ID NO: 1319120 - DNA, 11 bp, Homo sapiens
gttttcaaaga

SEQ ID NO: 1319121 - DNA, 12 bp, Homo sapiens
gttttcaaagat

SEQ ID NO: 1319122 - DNA, 14 bp, Homo sapiens
gttttctgtttcta

SEQ ID NO: 1319123 - DNA, 14 bp, Homo sapiens
gttttcttgggaat

SEQ ID NO: 1319124 - DNA, 17 bp, Homo sapiens
gtttttcttttcttgga

SEQ ID NO: 1319125 - DNA, 14 bp, Homo sapiens
taaaaattgtctct

SEQ ID NO: 1319126 - DNA, 17 bp, Homo sapiens
taaaacaagaaagtttc

SEQ ID NO: 1319127 - DNA, 21 bp, Homo sapiens
taaaacagttggcatgcatcc

SEQ ID NO: 1319128 - DNA, 20 bp, Homo sapiens
taaaaccttttttcttgcta

SEQ ID NO: 1319129 - DNA, 16 bp, Homo sapiens
taaaactgatgtgaaa

SEQ ID NO: 1319130 - DNA, 20 bp, Homo sapiens
taaaagaaagggttctgtaa

SEQ ID NO: 1319131 - DNA, 23 bp, Homo sapiens
taaaagaaagggttctgtaaaat

SEQ ID NO: 1319132 - DNA, 14 bp, Homo sapiens
taaaatatcattca

SEQ ID NO: 1319133 - DNA, 12 bp, Homo sapiens
taaaatattttc

SEQ ID NO: 1319134 - DNA, 14 bp, Homo sapiens
taaaatattttctg

SEQ ID NO: 1319135 - DNA, 17 bp, Homo sapiens
taaaatattttctgtgt

SEQ ID NO: 1319136 - DNA, 20 bp, Homo sapiens
taaaatattttctgtgtgtt

SEQ ID NO: 1319137 - DNA, 21 bp, Homo sapiens
taaaatattttctgtgtgttc

SEQ ID NO: 1319138 - DNA, 22 bp, Homo sapiens
taaaatattttctgtgtgttcc

SEQ ID NO: 1319139 - DNA, 23 bp, Homo sapiens
taaaatattttctgtgtgttcct

SEQ ID NO: 1319140 - DNA, 20 bp, Homo sapiens
taaaatggaaaacttagttt

SEQ ID NO: 1319141 - DNA, 18 bp, Homo sapiens
taaaattacagtggattg

SEQ ID NO: 1319142 - DNA, 21 bp, Homo sapiens
taaaattatcacctttgtcag

SEQ ID NO: 1319143 - DNA, 19 bp, Homo sapiens
taaagagtcctccttccca

SEQ ID NO: 1319144 - DNA, 12 bp, Homo sapiens
taaagccaggaa

SEQ ID NO: 1319145 - DNA, 23 bp, Homo sapiens
taaagtcattaacaagaaacagg

SEQ ID NO: 1319146 - DNA, 19 bp, Homo sapiens
taaatatgtagataatgga

SEQ ID NO: 1319147 - DNA, 12 bp, Homo sapiens
taaatgaaataa

SEQ ID NO: 1319148 - DNA, 14 bp, Homo sapiens
taaatgacctcaga

SEQ ID NO: 1319149 - DNA, 18 bp, Homo sapiens
taaatggcctctctccac

SEQ ID NO: 1319150 - DNA, 20 bp, Homo sapiens
taaatggcctctctccacta

SEQ ID NO: 1319151 - DNA, 15 bp, Homo sapiens
taacatgctgtgtaa

SEQ ID NO: 1319152 - DNA, 18 bp, Homo sapiens
taactaatacaattcatt

SEQ ID NO: 1319153 - DNA, 21 bp, Homo sapiens
taactgtgcttgttgaatgtc

SEQ ID NO: 1319154 - DNA, 19 bp, Homo sapiens
taagaaaatagagatgagc

SEQ ID NO: 1319155 - DNA, 17 bp, Homo sapiens
taagaatggtctcagtg

SEQ ID NO: 1319156 - DNA, 19 bp, Homo sapiens
taagatggcaggtgatgtc

SEQ ID NO: 1319157 - DNA, 19 bp, Homo sapiens
gacctgttcagaaggatgg

SEQ ID NO: 1319158 - DNA, 17 bp, Homo sapiens
gactaaagccaggaaca

SEQ ID NO: 1319159 - DNA, 15 bp, Homo sapiens
gactagtgctgaagc

SEQ ID NO: 1319160 - DNA, 16 bp, Homo sapiens
gactagtgctgaagct

SEQ ID NO: 1319161 - DNA, 18 bp, Homo sapiens
gactatagcccctggtgt

SEQ ID NO: 1319162 - DNA, 22 bp, Homo sapiens
gactatagcccctggtgtgtaa

SEQ ID NO: 1319163 - DNA, 18 bp, Homo sapiens
gactctagtactgtgaat

SEQ ID NO: 1319164 - DNA, 19 bp, Homo sapiens
gactctagtactgtgaatc

SEQ ID NO: 1319165 - DNA, 19 bp, Homo sapiens
gactctcgtgatatgctgc

SEQ ID NO: 1319166 - DNA, 15 bp, Homo sapiens
gactctgctctcctc

SEQ ID NO: 1319167 - DNA, 12 bp, Homo sapiens
gactctggacca

SEQ ID NO: 1319168 - DNA, 18 bp, Homo sapiens
gactctggaccatgctga

SEQ ID NO: 1319169 - DNA, 18 bp, Homo sapiens
gactctgttgctggtctt

SEQ ID NO: 1319170 - DNA, 19 bp, Homo sapiens
gactctgttgctggtcttc

SEQ ID NO: 1319171 - DNA, 21 bp, Homo sapiens
gactgtgggtttgtgggggga

SEQ ID NO: 1319172 - DNA, 14 bp, Homo sapiens
gagaatggcctgag

SEQ ID NO: 1319173 - DNA, 17 bp, Homo sapiens
gagactgtggggagggt

SEQ ID NO: 1319174 - DNA, 18 bp, Homo sapiens
gagactgtggggagggtc

SEQ ID NO: 1319175 - DNA, 14 bp, Homo sapiens
gagacttgtagttt

SEQ ID NO: 1319176 - DNA, 19 bp, Homo sapiens
gagagcttagggtctcagg

SEQ ID NO: 1319177 - DNA, 23 bp, Homo sapiens
gagatgctctctgaggcaaggcc

SEQ ID NO: 1319178 - DNA, 18 bp, Homo sapiens
gagattattcaacagaga

SEQ ID NO: 1319179 - DNA, 23 bp, Homo sapiens
gagcaagcctttgacctgttcag

SEQ ID NO: 1319180 - DNA, 21 bp, Homo sapiens
gagcacatagccctgttgacc

SEQ ID NO: 1319181 - DNA, 15 bp, Homo sapiens
gagcaccctgagggc

SEQ ID NO: 1319182 - DNA, 14 bp, Homo sapiens
gagcacctctcaga

SEQ ID NO: 1319183 - DNA, 17 bp, Homo sapiens
gagcacctctcagagca

SEQ ID NO: 1319184 - DNA, 22 bp, Homo sapiens
gagccccaagactctgctctcc

SEQ ID NO: 1319185 - DNA, 15 bp, Homo sapiens
gagcctgtgtcctga

SEQ ID NO: 1319186 - DNA, 12 bp, Homo sapiens
gagctgagaaga

SEQ ID NO: 1319187 - DNA, 15 bp, Homo sapiens
gagctggggcttctt

SEQ ID NO: 1319188 - DNA, 17 bp, Homo sapiens
gagctggggcttctttc

SEQ ID NO: 1319189 - DNA, 16 bp, Homo sapiens
gaggaaggatgcaaag

SEQ ID NO: 1319190 - DNA, 21 bp, Homo sapiens
gaggagggtctagaggcctga

SEQ ID NO: 1319191 - DNA, 14 bp, Homo sapiens
gaggcaaggcccag

SEQ ID NO: 1319192 - DNA, 15 bp, Homo sapiens
gaggcaaggcccaga

SEQ ID NO: 1319193 - DNA, 16 bp, Homo sapiens
gaggcacagagccaaa

SEQ ID NO: 1319194 - DNA, 15 bp, Homo sapiens
gaggccactgaagag

SEQ ID NO: 1319195 - DNA, 16 bp, Homo sapiens
gaggccactgaagagg

SEQ ID NO: 1319196 - DNA, 17 bp, Homo sapiens
gaggccactgaagagga

SEQ ID NO: 1319197 - DNA, 16 bp, Homo sapiens
gagggagctgagaaga

SEQ ID NO: 1319198 - DNA, 19 bp, Homo sapiens
gaggggaatgagggctgag

SEQ ID NO: 1319199 - DNA, 21 bp, Homo sapiens
gagggggtgacctccggccag

SEQ ID NO: 1319200 - DNA, 21 bp, Homo sapiens
gagggtgcggggcctgcaggc

SEQ ID NO: 1319201 - DNA, 12 bp, Homo sapiens
gagtaagcccaa

SEQ ID NO: 1319202 - DNA, 13 bp, Homo sapiens
gagtagaaagctt

SEQ ID NO: 1319203 - DNA, 21 bp, Homo sapiens
gagtccaaaccttctaccctg

SEQ ID NO: 1319204 - DNA, 18 bp, Homo sapiens
gagtcctccttcccagct

SEQ ID NO: 1319205 - DNA, 18 bp, Homo sapiens
gagttcacatgtgccctg

SEQ ID NO: 1319206 - DNA, 18 bp, Homo sapiens
gagtttaaaaattgtctc

SEQ ID NO: 1319207 - DNA, 17 bp, Homo sapiens
gagtttacgtggagggg

SEQ ID NO: 1319208 - DNA, 14 bp, Homo sapiens
gataaatgaaataa

SEQ ID NO: 1319209 - DNA, 21 bp, Homo sapiens
gataacaccaccattcacaag

SEQ ID NO: 1319210 - DNA, 13 bp, Homo sapiens
gatacaatctggg

SEQ ID NO: 1319211 - DNA, 17 bp, Homo sapiens
gataccaggcccaggag

SEQ ID NO: 1319212 - DNA, 18 bp, Homo sapiens
gatagtgaaacagctttc

SEQ ID NO: 1319213 - DNA, 17 bp, Homo sapiens
gatatctgttagatgct

SEQ ID NO: 1319214 - DNA, 17 bp, Homo sapiens
gatatgcattcaagaga

SEQ ID NO: 1319215 - DNA, 19 bp, Homo sapiens
gatatgctgcttgtgacct

SEQ ID NO: 1319216 - DNA, 19 bp, Homo sapiens
gatcacttgatgccaggag

SEQ ID NO: 1319217 - DNA, 21 bp, Homo sapiens
gatgctctctgaggcaaggcc

SEQ ID NO: 1319218 - DNA, 14 bp, Homo sapiens
gatgggtggacctg

SEQ ID NO: 1319219 - DNA, 22 bp, Homo sapiens
gatggttattagacaattccat

SEQ ID NO: 1319220 - DNA, 14 bp, Homo sapiens
gatgtcctgtaaac

SEQ ID NO: 1319221 - DNA, 12 bp, Homo sapiens
gattcacagcct

SEQ ID NO: 1319222 - DNA, 12 bp, Homo sapiens
gattcccaggcc

SEQ ID NO: 1319223 - DNA, 16 bp, Homo sapiens
gattcccaggccaggc

SEQ ID NO: 1319224 - DNA, 23 bp, Homo sapiens
gattggacataactgacttagtt

SEQ ID NO: 1319225 - DNA, 16 bp, Homo sapiens
gcaaactatgagttca

SEQ ID NO: 1319226 - DNA, 16 bp, Homo sapiens
gcaacgattcacagcc

SEQ ID NO: 1319227 - DNA, 21 bp, Homo sapiens
gcaactccagcgtcctcagca

SEQ ID NO: 1319228 - DNA, 23 bp, Homo sapiens
gcaactccagcgtcctcagcacc

SEQ ID NO: 1319229 - DNA, 21 bp, Homo sapiens
gcacacacgccttcatgccag

SEQ ID NO: 1319230 - DNA, 13 bp, Homo sapiens
gcacacggtgagg

SEQ ID NO: 1319231 - DNA, 19 bp, Homo sapiens
gcacagcgttatgtgtctg

SEQ ID NO: 1319232 - DNA, 15 bp, Homo sapiens
gcacatagccctgtt

SEQ ID NO: 1319233 - DNA, 12 bp, Homo sapiens
gcaccctgaggg

SEQ ID NO: 1319234 - DNA, 20 bp, Homo sapiens
gcaccggctcaggagagggc

SEQ ID NO: 1319235 - DNA, 21 bp, Homo sapiens
gcaccggggaacaatttctct

SEQ ID NO: 1319236 - DNA, 20 bp, Homo sapiens
gcacctctcagagcaagcct

SEQ ID NO: 1319237 - DNA, 21 bp, Homo sapiens
gcacctctcagagcaagcctt

SEQ ID NO: 1319238 - DNA, 22 bp, Homo sapiens
gcacctctcagagcaagccttt

SEQ ID NO: 1319239 - DNA, 13 bp, Homo sapiens
gcacctgccccca

SEQ ID NO: 1319240 - DNA, 15 bp, Homo sapiens
gcacctgcccccaca

SEQ ID NO: 1319241 - DNA, 16 bp, Homo sapiens
gcactgtttgaagatt

SEQ ID NO: 1319242 - DNA, 18 bp, Homo sapiens
gcagccctggcccatcat

SEQ ID NO: 1319243 - DNA, 20 bp, Homo sapiens
gcagcctggctcccctgggg

SEQ ID NO: 1319244 - DNA, 21 bp, Homo sapiens
gcagcctggctcccctggggt

SEQ ID NO: 1319245 - DNA, 16 bp, Homo sapiens
gcaggcacacacgcct

SEQ ID NO: 1319246 - DNA, 21 bp, Homo sapiens
gcaggcacacacgccttcatg

SEQ ID NO: 1319247 - DNA, 22 bp, Homo sapiens
gcaggcaccgctgggttctgac

SEQ ID NO: 1319248 - DNA, 19 bp, Homo sapiens
gcaggccagtcccacggct

SEQ ID NO: 1319249 - DNA, 15 bp, Homo sapiens
gcaggcccagcctct

SEQ ID NO: 1319250 - DNA, 18 bp, Homo sapiens
gcaggcccaggcaggccc

SEQ ID NO: 1319251 - DNA, 22 bp, Homo sapiens
gcatacgcattaagggcctgct

SEQ ID NO: 1319252 - DNA, 23 bp, Homo sapiens
gcatcactttcctggatccagga

SEQ ID NO: 1319253 - DNA, 16 bp, Homo sapiens
gcatcccagcctcaga

SEQ ID NO: 1319254 - DNA, 22 bp, Homo sapiens
gcatcccagcctcagaagcctt

SEQ ID NO: 1319255 - DNA, 14 bp, Homo sapiens
gcattaagggcctg

SEQ ID NO: 1319256 - DNA, 18 bp, Homo sapiens
gcattaagggcctgctgg

SEQ ID NO: 1319257 - DNA, 19 bp, Homo sapiens
gcattgtgaattgcctgcc

SEQ ID NO: 1319258 - DNA, 22 bp, Homo sapiens
gcattgtgaattgcctgccatg

SEQ ID NO: 1319259 - DNA, 20 bp, Homo sapiens
gcatttgtaaatattaaacc

SEQ ID NO: 1319260 - DNA, 21 bp, Homo sapiens
gcatttgtaaatattaaacca

SEQ ID NO: 1319261 - DNA, 18 bp, Homo sapiens
gcattttttaaaacaaga

SEQ ID NO: 1319262 - DNA, 18 bp, Homo sapiens
gccaactcacccttggcc

SEQ ID NO: 1319263 - DNA, 22 bp, Homo sapiens
gccaagcctggagtaggcctgg

SEQ ID NO: 1319264 - DNA, 20 bp, Homo sapiens
gccacccttggtctcatgcc

SEQ ID NO: 1319265 - DNA, 21 bp, Homo sapiens
gccacccttggtctcatgccc

SEQ ID NO: 1319266 - DNA, 23 bp, Homo sapiens
gccacccttggtctcatgccccg

SEQ ID NO: 1319267 - DNA, 14 bp, Homo sapiens
gccaggaacaggga

SEQ ID NO: 1319268 - DNA, 21 bp, Homo sapiens
gccaggaacagggaccagctc

SEQ ID NO: 1319269 - DNA, 17 bp, Homo sapiens
gccaggagtaagcccaa

SEQ ID NO: 1319270 - DNA, 18 bp, Homo sapiens
gccaggagtaagcccaag

SEQ ID NO: 1319271 - DNA, 19 bp, Homo sapiens
gccagtcccacggctctgt

SEQ ID NO: 1319272 - DNA, 21 bp, Homo sapiens
gccagtcccacggctctgtgc

SEQ ID NO: 1319273 - DNA, 13 bp, Homo sapiens
gccatcttccata

SEQ ID NO: 1319274 - DNA, 20 bp, Homo sapiens
gccatcttccatatccgggt

SEQ ID NO: 1319275 - DNA, 16 bp, Homo sapiens
gccatgaaggcacctg

SEQ ID NO: 1319276 - DNA, 19 bp, Homo sapiens
gccatgaaggcacctgccc

SEQ ID NO: 1319277 - DNA, 19 bp, Homo sapiens
gccatgagtccatgtccta

SEQ ID NO: 1319278 - DNA, 13 bp, Homo sapiens
gccatggctgtga

SEQ ID NO: 1319279 - DNA, 15 bp, Homo sapiens
gccatggtcaccctc

SEQ ID NO: 1319280 - DNA, 19 bp, Homo sapiens
gccatggtcaccctcagga

SEQ ID NO: 1319281 - DNA, 19 bp, Homo sapiens
gcccaaattatcaagctaa

SEQ ID NO: 1319282 - DNA, 21 bp, Homo sapiens
gcccaaattatcaagctaata

SEQ ID NO: 1319283 - DNA, 14 bp, Homo sapiens
gtcagcagtggagt

SEQ ID NO: 1319284 - DNA, 22 bp, Homo sapiens
gtccaaaccttctaccctgggt

SEQ ID NO: 1319285 - DNA, 17 bp, Homo sapiens
gtccagaaggagggggt

SEQ ID NO: 1319286 - DNA, 16 bp, Homo sapiens
gtccatgtcctatgcc

SEQ ID NO: 1319287 - DNA, 15 bp, Homo sapiens
gtcccacggctctgt

SEQ ID NO: 1319288 - DNA, 14 bp, Homo sapiens
gtcccactggctcc

SEQ ID NO: 1319289 - DNA, 17 bp, Homo sapiens
gtcccactggctcctcc

SEQ ID NO: 1319290 - DNA, 23 bp, Homo sapiens
gtcccactggctcctcccagcac

SEQ ID NO: 1319291 - DNA, 16 bp, Homo sapiens
gtcccctcaagcccct

SEQ ID NO: 1319292 - DNA, 22 bp, Homo sapiens
gtcccctcaagccccttctctc

SEQ ID NO: 1319293 - DNA, 23 bp, Homo sapiens
gtcccctcaagccccttctctca

SEQ ID NO: 1319294 - DNA, 14 bp, Homo sapiens
gtccggttcttctt

SEQ ID NO: 1319295 - DNA, 16 bp, Homo sapiens
gtcctaggctggaagg

SEQ ID NO: 1319296 - DNA, 19 bp, Homo sapiens
gtcctcagcaccccactcc

SEQ ID NO: 1319297 - DNA, 20 bp, Homo sapiens
gtcctcagcaccccactcct

SEQ ID NO: 1319298 - DNA, 22 bp, Homo sapiens
gtcctcagcaccccactcctca

SEQ ID NO: 1319299 - DNA, 15 bp, Homo sapiens
gtcctccttcccagc

SEQ ID NO: 1319300 - DNA, 21 bp, Homo sapiens
gtcctcgggcccctgagcctg

SEQ ID NO: 1319301 - DNA, 11 bp, Homo sapiens
gtctcagcctg

SEQ ID NO: 1319302 - DNA, 22 bp, Homo sapiens
gtctcagcctgggcccctcagc

SEQ ID NO: 1319303 - DNA, 13 bp, Homo sapiens
gtctgtcttcctt

SEQ ID NO: 1319304 - DNA, 12 bp, Homo sapiens
gtcttctcccaa

SEQ ID NO: 1319305 - DNA, 15 bp, Homo sapiens
gtcttctcccaactc

SEQ ID NO: 1319306 - DNA, 16 bp, Homo sapiens
ctctgccatcctccct

SEQ ID NO: 1319307 - DNA, 19 bp, Homo sapiens
ctctgccatcctccctgtt

SEQ ID NO: 1319308 - DNA, 20 bp, Homo sapiens
ctctgcccatgcctaaagcc

SEQ ID NO: 1319309 - DNA, 12 bp, Homo sapiens
ctctgctctcct

SEQ ID NO: 1319310 - DNA, 16 bp, Homo sapiens
ctctgctctcctcggg

SEQ ID NO: 1319311 - DNA, 18 bp, Homo sapiens
ctctgctctcctcgggcc

SEQ ID NO: 1319312 - DNA, 20 bp, Homo sapiens
ctctgctctcctcgggccct

SEQ ID NO: 1319313 - DNA, 14 bp, Homo sapiens
ctctggaccatgct

SEQ ID NO: 1319314 - DNA, 18 bp, Homo sapiens
ctctggaccatgctgaga

SEQ ID NO: 1319315 - DNA, 17 bp, Homo sapiens
ctgtttcttgatgctca

SEQ ID NO: 1319316 - DNA, 16 bp, Homo sapiens
ctgtttttgtgagaga

SEQ ID NO: 1319317 - DNA, 21 bp, Homo sapiens
cttaaaactaggcatttgtaa

SEQ ID NO: 1319318 - DNA, 20 bp, Homo sapiens
cttaacactaccaatttccc

SEQ ID NO: 1319319 - DNA, 12 bp, Homo sapiens
cttaaccctcaa

SEQ ID NO: 1319320 - DNA, 23 bp, Homo sapiens
cttaattctgttctgatattaat

SEQ ID NO: 1319321 - DNA, 22 bp, Homo sapiens
cttagtttgtgaattgattttg

SEQ ID NO: 1319322 - DNA, 18 bp, Homo sapiens
cttatatgccagaatgta

SEQ ID NO: 1319323 - DNA, 12 bp, Homo sapiens
cttatgtatgtg

SEQ ID NO: 1319324 - DNA, 14 bp, Homo sapiens
cttattaatgctaa

SEQ ID NO: 1319325 - DNA, 15 bp, Homo sapiens
cttattaatgctaag

SEQ ID NO: 1319326 - DNA, 16 bp, Homo sapiens
cttcactccagacaga

SEQ ID NO: 1319327 - DNA, 12 bp, Homo sapiens
cttcaggacctg

SEQ ID NO: 1319328 - DNA, 22 bp, Homo sapiens
cttcatgttcaattatttcccc

SEQ ID NO: 1319329 - DNA, 16 bp, Homo sapiens
cttccatatccgggtg

SEQ ID NO: 1319330 - DNA, 20 bp, Homo sapiens
cttccatatccgggtgctca

SEQ ID NO: 1319331 - DNA, 17 bp, Homo sapiens
cttccattaagaacact

SEQ ID NO: 1319332 - DNA, 13 bp, Homo sapiens
cttcccagctcta

SEQ ID NO: 1319333 - DNA, 22 bp, Homo sapiens
cttcccagctctacattctgct

SEQ ID NO: 1319334 - DNA, 16 bp, Homo sapiens
cttcccccaccccaga

SEQ ID NO: 1319335 - DNA, 18 bp, Homo sapiens
cttcccccaccccagaag

SEQ ID NO: 1319336 - DNA, 20 bp, Homo sapiens
cttcccccaccccagaagat

SEQ ID NO: 1319337 - DNA, 16 bp, Homo sapiens
cttcccctcccagccc

SEQ ID NO: 1319338 - DNA, 22 bp, Homo sapiens
cttcccctcccagccctgaggg

SEQ ID NO: 1319339 - DNA, 18 bp, Homo sapiens
cttccctccccctagtcc

SEQ ID NO: 1319340 - DNA, 22 bp, Homo sapiens
cttcccttctctctctctcaaa

SEQ ID NO: 1319341 - DNA, 13 bp, Homo sapiens
cttcctccaaccc

SEQ ID NO: 1319342 - DNA, 13 bp, Homo sapiens
cttcctgcagacc

SEQ ID NO: 1319343 - DNA, 15 bp, Homo sapiens
cttcctggcgccccc

SEQ ID NO: 1319344 - DNA, 15 bp, Homo sapiens
cttctcccaactcag

SEQ ID NO: 1319345 - DNA, 14 bp, Homo sapiens
cttctctcaatccc

SEQ ID NO: 1319346 - DNA, 20 bp, Homo sapiens
cttctctcaatccctttgca

SEQ ID NO: 1319347 - DNA, 21 bp, Homo sapiens
cttctctcagaccgtcttcct

SEQ ID NO: 1319348 - DNA, 19 bp, Homo sapiens
cttcttgtctttgtccctg

SEQ ID NO: 1319349 - DNA, 14 bp, Homo sapiens
cttctttctgctgg

SEQ ID NO: 1319350 - DNA, 15 bp, Homo sapiens
cttctttctgctggc

SEQ ID NO: 1319351 - DNA, 23 bp, Homo sapiens
cttgaacaacccaatctggctgg

SEQ ID NO: 1319352 - DNA, 21 bp, Homo sapiens
cttgatattgaggtgtttgaa

SEQ ID NO: 1319353 - DNA, 21 bp, Homo sapiens
cttgatgaaataacacagcag

SEQ ID NO: 1319354 - DNA, 22 bp, Homo sapiens
cttgccatgaaggcacctgccc

SEQ ID NO: 1319355 - DNA, 23 bp, Homo sapiens
cttgccatgaaggcacctgcccc

SEQ ID NO: 1319356 - DNA, 16 bp, Homo sapiens
cttgccccaacccttc

SEQ ID NO: 1319357 - DNA, 22 bp, Homo sapiens
cttgctcccgccccagggtctg

SEQ ID NO: 1319358 - DNA, 14 bp, Homo sapiens
cttgctctctgttc

SEQ ID NO: 1319359 - DNA, 19 bp, Homo sapiens
cttgctctctgttctcttg

SEQ ID NO: 1319360 - DNA, 21 bp, Homo sapiens
cttgctctctgttctcttgct

SEQ ID NO: 1319361 - DNA, 21 bp, Homo sapiens
cttgctgtttcttgatgctca

SEQ ID NO: 1319362 - DNA, 18 bp, Homo sapiens
cttggaaatattaaaaga

SEQ ID NO: 1319363 - DNA, 19 bp, Homo sapiens
cttggaaccagtccgccgc

SEQ ID NO: 1319364 - DNA, 23 bp, Homo sapiens
cttggcccatcccgccttctcca

SEQ ID NO: 1319365 - DNA, 16 bp, Homo sapiens
cttggtatttggatat

SEQ ID NO: 1319366 - DNA, 15 bp, Homo sapiens
cttggtctcatgccc

SEQ ID NO: 1319367 - DNA, 19 bp, Homo sapiens
cttggtctcatgccccgcc

SEQ ID NO: 1319368 - DNA, 16 bp, Homo sapiens
cttgtctttgtccctg

SEQ ID NO: 1319369 - DNA, 21 bp, Homo sapiens
cttgtctttgtccctgttggt

SEQ ID NO: 1319370 - DNA, 16 bp, Homo sapiens
cttgtgactagtgctg

SEQ ID NO: 1319371 - DNA, 11 bp, Homo sapiens
cttgtgcctcc

SEQ ID NO: 1319372 - DNA, 18 bp, Homo sapiens
cttgtgcctccaatgtgg

SEQ ID NO: 1319373 - DNA, 14 bp, Homo sapiens
cttgtggtccaaat

SEQ ID NO: 1319374 - DNA, 15 bp, Homo sapiens
cttgtggtccaaata

SEQ ID NO: 1319375 - DNA, 20 bp, Homo sapiens
cttgttgaatgtcaatcata

SEQ ID NO: 1319376 - DNA, 23 bp, Homo sapiens
ctttaaagagtcctccttcccag

SEQ ID NO: 1319377 - DNA, 24 bp, Homo sapiens
ctttacactgcctggtactgatag

SEQ ID NO: 1319378 - DNA, 22 bp, Homo sapiens
ctttatgtatctaatttcattc

SEQ ID NO: 1319379 - DNA, 23 bp, Homo sapiens
ctttatgtatctaatttcattca

SEQ ID NO: 1319380 - DNA, 21 bp, Homo sapiens
ctttcctggatccaggataat

SEQ ID NO: 1319381 - DNA, 20 bp, Homo sapiens
ctttctggggcctaataaaa

SEQ ID NO: 1319382 - DNA, 19 bp, Homo sapiens
ctttgacagcgcacagctg

SEQ ID NO: 1319383 - DNA, 18 bp, Homo sapiens
ctttgacctgttcagaag

SEQ ID NO: 1319384 - DNA, 17 bp, Homo sapiens
ctttgtggcatgtgcct

SEQ ID NO: 1319385 - DNA, 13 bp, Homo sapiens
ctttgttacactg

SEQ ID NO: 1319386 - DNA, 21 bp, Homo sapiens
ctttgttacactgttattttc

SEQ ID NO: 1319387 - DNA, 11 bp, Homo sapiens
cttttcttgga

SEQ ID NO: 1319388 - DNA, 15 bp, Homo sapiens
cttttgatgtggtgt

SEQ ID NO: 1319389 - DNA, 19 bp, Homo sapiens
cttttttcctttccacctt

SEQ ID NO: 1319390 - DNA, 12 bp, Homo sapiens
gaaaaaaatgga

SEQ ID NO: 1319391 - DNA, 21 bp, Homo sapiens
gaaaaccaacaccatcacagc

SEQ ID NO: 1319392 - DNA, 18 bp, Homo sapiens
gaaaatagagatgagctt

SEQ ID NO: 1319393 - DNA, 16 bp, Homo sapiens
gaaaatctttcctctt

SEQ ID NO: 1319394 - DNA, 12 bp, Homo sapiens
gaaacagctttc

SEQ ID NO: 1319395 - DNA, 15 bp, Homo sapiens
gaaacagctttctgg

SEQ ID NO: 1319396 - DNA, 13 bp, Homo sapiens
gaaactaataaaa

SEQ ID NO: 1319397 - DNA, 19 bp, Homo sapiens
gaaactaataaaatatttt

SEQ ID NO: 1319398 - DNA, 20 bp, Homo sapiens
gaaactaataaaatattttc

SEQ ID NO: 1319399 - DNA, 21 bp, Homo sapiens
gaaactaataaaatattttct

SEQ ID NO: 1319400 - DNA, 18 bp, Homo sapiens
gaaactgcagctgggaag

SEQ ID NO: 1319401 - DNA, 20 bp, Homo sapiens
gaaagagactgtggggaggg

SEQ ID NO: 1319402 - DNA, 11 bp, Homo sapiens
gaaaggggtgt

SEQ ID NO: 1319403 - DNA, 20 bp, Homo sapiens
gaaagtcttgtgactagtgc

SEQ ID NO: 1319404 - DNA, 22 bp, Homo sapiens
gaaagtcttgtgactagtgctg

SEQ ID NO: 1319405 - DNA, 15 bp, Homo sapiens
gaaatattaaaagaa

SEQ ID NO: 1319406 - DNA, 14 bp, Homo sapiens
gaaatcctggttcc

SEQ ID NO: 1319407 - DNA, 15 bp, Homo sapiens
gaaatctttcaagtt

SEQ ID NO: 1319408 - DNA, 15 bp, Homo sapiens
gaaatctttctggaa

SEQ ID NO: 1319409 - DNA, 20 bp, Homo sapiens
gaacaagaaatctttctgga

SEQ ID NO: 1319410 - DNA, 14 bp, Homo sapiens
gaacaatttctctg

SEQ ID NO: 1319411 - DNA, 22 bp, Homo sapiens
gaacagctgttgactctagtac

SEQ ID NO: 1319412 - DNA, 22 bp, Homo sapiens
gaactccccttcttcctggagt

SEQ ID NO: 1319413 - DNA, 16 bp, Homo sapiens
gaacttgtagccagaa

SEQ ID NO: 1319414 - DNA, 11 bp, Homo sapiens
gaagaaagaga

SEQ ID NO: 1319415 - DNA, 15 bp, Homo sapiens
gaagaatagggccca

SEQ ID NO: 1319416 - DNA, 17 bp, Homo sapiens
gaagacactgtgcaggc

SEQ ID NO: 1319417 - DNA, 21 bp, Homo sapiens
gaagacactgtgcaggcccag

SEQ ID NO: 1319418 - DNA, 16 bp, Homo sapiens
gaagccacaggcctgg

SEQ ID NO: 1319419 - DNA, 17 bp, Homo sapiens
gaagcttattaatgcta

SEQ ID NO: 1319420 - DNA, 22 bp, Homo sapiens
gaaggtagattttaagaatggt

SEQ ID NO: 1319421 - DNA, 23 bp, Homo sapiens
gaagtaaaaccttttttcttgct

SEQ ID NO: 1319422 - DNA, 13 bp, Homo sapiens
gaatagagggagt

SEQ ID NO: 1319423 - DNA, 19 bp, Homo sapiens
gaatagggcccatgggagg

SEQ ID NO: 1319424 - DNA, 20 bp, Homo sapiens
gaatcgcttgaacccaggag

SEQ ID NO: 1319425 - DNA, 20 bp, Homo sapiens
gaatgaaagtcttgtgacta

SEQ ID NO: 1319426 - DNA, 16 bp, Homo sapiens
gaatgagggggctcag

SEQ ID NO: 1319427 - DNA, 21 bp, Homo sapiens
gaatgatttctatgaacttgt

SEQ ID NO: 1319428 - DNA, 21 bp, Homo sapiens
gaatggagaatacatcttgtt

SEQ ID NO: 1319429 - DNA, 16 bp, Homo sapiens
gaatggtctcagtgtt

SEQ ID NO: 1319430 - DNA, 16 bp, Homo sapiens
gaatgttaagaataac

SEQ ID NO: 1319431 - DNA, 23 bp, Homo sapiens
gaattgcattttttaaaacaaga

SEQ ID NO: 1319432 - DNA, 16 bp, Homo sapiens
gaattgggactctgtt

SEQ ID NO: 1319433 - DNA, 19 bp, Homo sapiens
gaattgtagataatactgt

SEQ ID NO: 1319434 - DNA, 14 bp, Homo sapiens
gacactgtgcaggc

SEQ ID NO: 1319435 - DNA, 16 bp, Homo sapiens
gacagaattcactgtc

SEQ ID NO: 1319436 - DNA, 15 bp, Homo sapiens
gacagagcgagactt

SEQ ID NO: 1319437 - DNA, 16 bp, Homo sapiens
gacagatagtgaaaca

SEQ ID NO: 1319438 - DNA, 23 bp, Homo sapiens
gacagatagtgaaacagctttct

SEQ ID NO: 1319439 - DNA, 17 bp, Homo sapiens
gacagtgcgttgcaact

SEQ ID NO: 1319440 - DNA, 20 bp, Homo sapiens
gacatctacgaagccacagg

SEQ ID NO: 1319441 - DNA, 21 bp, Homo sapiens
gacatctacgaagccacaggc

SEQ ID NO: 1319442 - DNA, 19 bp, Homo sapiens
gaccacgtctatttcatca

SEQ ID NO: 1319443 - DNA, 14 bp, Homo sapiens
gaccagctccccgg

SEQ ID NO: 1319444 - DNA, 20 bp, Homo sapiens
gacctctccagcatcccagc

SEQ ID NO: 1319445 - DNA, 22 bp, Homo sapiens
gacctctccagcatcccagcct

SEQ ID NO: 1319446 - DNA, 15 bp, Homo sapiens
cagggtctgggatga

SEQ ID NO: 1319447 - DNA, 12 bp, Homo sapiens
caggtcctccat

SEQ ID NO: 1319448 - DNA, 13 bp, Homo sapiens
caggtgccaggaa

SEQ ID NO: 1319449 - DNA, 18 bp, Homo sapiens
cagtaattacaaattaag

SEQ ID NO: 1319450 - DNA, 22 bp, Homo sapiens
cagtataaaattacagtggatt

SEQ ID NO: 1319451 - DNA, 18 bp, Homo sapiens
cagtcaccactgtgctca

SEQ ID NO: 1319452 - DNA, 13 bp, Homo sapiens
cagtcccacggct

SEQ ID NO: 1319453 - DNA, 23 bp, Homo sapiens
cagtgaaaataagccatgagaat

SEQ ID NO: 1319454 - DNA, 13 bp, Homo sapiens
cagtgcatgccag

SEQ ID NO: 1319455 - DNA, 12 bp, Homo sapiens
cagtgcgttgca

SEQ ID NO: 1319456 - DNA, 20 bp, Homo sapiens
cagtgtgaagacactgtgca

SEQ ID NO: 1319457 - DNA, 12 bp, Homo sapiens
cagttcagaaaa

SEQ ID NO: 1319458 - DNA, 21 bp, Homo sapiens
cagttgggaagtctcagcctg

SEQ ID NO: 1319459 - DNA, 23 bp, Homo sapiens
catacgcattaagggcctgctgg

SEQ ID NO: 1319460 - DNA, 14 bp, Homo sapiens
catagaatagcatg

SEQ ID NO: 1319461 - DNA, 15 bp, Homo sapiens
catagaatagcatgt

SEQ ID NO: 1319462 - DNA, 18 bp, Homo sapiens
catagaatagcatgttgt

SEQ ID NO: 1319463 - DNA, 15 bp, Homo sapiens
catagccctgttgac

SEQ ID NO: 1319464 - DNA, 19 bp, Homo sapiens
catagccctgttgacctgc

SEQ ID NO: 1319465 - DNA, 15 bp, Homo sapiens
catatccgggtgctc

SEQ ID NO: 1319466 - DNA, 18 bp, Homo sapiens
catatccgggtgctcaat

SEQ ID NO: 1319467 - DNA, 15 bp, Homo sapiens
catatttagtatacc

SEQ ID NO: 1319468 - DNA, 22 bp, Homo sapiens
catattttacttggaaatatta

SEQ ID NO: 1319469 - DNA, 23 bp, Homo sapiens
catattttacttggaaatattaa

SEQ ID NO: 1319470 - DNA, 14 bp, Homo sapiens
catcaagaatgagg

SEQ ID NO: 1319471 - DNA, 13 bp, Homo sapiens
catcacagcttgt

SEQ ID NO: 1319472 - DNA, 15 bp, Homo sapiens
catcacagcttgttt

SEQ ID NO: 1319473 - DNA, 13 bp, Homo sapiens
catcacccctggt

SEQ ID NO: 1319474 - DNA, 14 bp, Homo sapiens
catcagtggagtcc

SEQ ID NO: 1319475 - DNA, 17 bp, Homo sapiens
catcagtggagtccaga

SEQ ID NO: 1319476 - DNA, 18 bp, Homo sapiens
catccacctatccaccac

SEQ ID NO: 1319477 - DNA, 18 bp, Homo sapiens
catcccagcctcagaagc

SEQ ID NO: 1319478 - DNA, 20 bp, Homo sapiens
catcccagcctcagaagcct

SEQ ID NO: 1319479 - DNA, 23 bp, Homo sapiens
catcccagcctcagaagccttct

SEQ ID NO: 1319480 - DNA, 13 bp, Homo sapiens
catccccgagggc

SEQ ID NO: 1319481 - DNA, 16 bp, Homo sapiens
catccccgagggcggg

SEQ ID NO: 1319482 - DNA, 15 bp, Homo sapiens
catcccgccttctcc

SEQ ID NO: 1319483 - DNA, 23 bp, Homo sapiens
catcctccctgttccccacaggt

SEQ ID NO: 1319484 - DNA, 15 bp, Homo sapiens
tactttagtattcct

SEQ ID NO: 1319485 - DNA, 17 bp, Homo sapiens
tagaacaagaaatcttt

SEQ ID NO: 1319486 - DNA, 18 bp, Homo sapiens
tagaatagcatgttgtag

SEQ ID NO: 1319487 - DNA, 20 bp, Homo sapiens
tagaatagcatgttgtagat

SEQ ID NO: 1319488 - DNA, 19 bp, Homo sapiens
tagagaatggcctgagaca

SEQ ID NO: 1319489 - DNA, 12 bp, Homo sapiens
tagatacaatca

SEQ ID NO: 1319490 - DNA, 14 bp, Homo sapiens
tagatacaatcagc

SEQ ID NO: 1319491 - DNA, 22 bp, Homo sapiens
tagatacaatcagctgctttgt

SEQ ID NO: 1319492 - DNA, 15 bp, Homo sapiens
tagatagcagcctgg

SEQ ID NO: 1319493 - DNA, 20 bp, Homo sapiens
tagatagcagcctggctccc

SEQ ID NO: 1319494 - DNA, 18 bp, Homo sapiens
tagatcatccccgagggc

SEQ ID NO: 1319495 - DNA, 16 bp, Homo sapiens
tagatgctactaagaa

SEQ ID NO: 1319496 - DNA, 20 bp, Homo sapiens
tagcacagcgttatgtgtct

SEQ ID NO: 1319497 - DNA, 21 bp, Homo sapiens
tagcagcctggctcccctggg

SEQ ID NO: 1319498 - DNA, 13 bp, Homo sapiens
tagcatgttgtag

SEQ ID NO: 1319499 - DNA, 17 bp, Homo sapiens
tagggcccatgggaggg

SEQ ID NO: 1319500 - DNA, 14 bp, Homo sapiens
taggggaatgaggg

SEQ ID NO: 1319501 - DNA, 13 bp, Homo sapiens
tagggtttctgat

SEQ ID NO: 1319502 - DNA, 14 bp, Homo sapiens
tagtataccagaga

SEQ ID NO: 1319503 - DNA, 15 bp, Homo sapiens
tagtataccagagaa

SEQ ID NO: 1319504 - DNA, 18 bp, Homo sapiens
tagtataccagagaaggt

SEQ ID NO: 1319505 - DNA, 21 bp, Homo sapiens
tagtatgctctgagtagcttt

SEQ ID NO: 1319506 - DNA, 22 bp, Homo sapiens
tagtatgctctgagtagcttta

SEQ ID NO: 1319507 - DNA, 15 bp, Homo sapiens
tagtcttgacctctc

SEQ ID NO: 1319508 - DNA, 17 bp, Homo sapiens
tagtcttgctgtttctt

SEQ ID NO: 1319509 - DNA, 14 bp, Homo sapiens
tagtgaaacagctt

SEQ ID NO: 1319510 - DNA, 14 bp, Homo sapiens
tagtgctgaagctt

SEQ ID NO: 1319511 - DNA, 18 bp, Homo sapiens
tagtttagtgtggttttc

SEQ ID NO: 1319512 - DNA, 16 bp, Homo sapiens
tataaatttgtgtaat

SEQ ID NO: 1319513 - DNA, 14 bp, Homo sapiens
tataccagagaagg

SEQ ID NO: 1319514 - DNA, 19 bp, Homo sapiens
tatatgaacttaacatgct

SEQ ID NO: 1319515 - DNA, 22 bp, Homo sapiens
tatatgaacttaacatgctgtg

SEQ ID NO: 1319516 - DNA, 12 bp, Homo sapiens
tatcattcagca

SEQ ID NO: 1319517 - DNA, 14 bp, Homo sapiens
tatccaccacccca

SEQ ID NO: 1319518 - DNA, 14 bp, Homo sapiens
tatccctcattcat

SEQ ID NO: 1319519 - DNA, 16 bp, Homo sapiens
tatccgggtgctcaat

SEQ ID NO: 1319520 - DNA, 20 bp, Homo sapiens
tatccgggtgctcaataaac

SEQ ID NO: 1319521 - DNA, 14 bp, Homo sapiens
tatgaacagacttt

SEQ ID NO: 1319522 - DNA, 20 bp, Homo sapiens
tatgagttcacatgtgccct

SEQ ID NO: 1319523 - DNA, 15 bp, Homo sapiens
tatgcattcaagaga

SEQ ID NO: 1319524 - DNA, 23 bp, Homo sapiens
tatgctctgagtagctttacact

SEQ ID NO: 1319525 - DNA, 13 bp, Homo sapiens
tatgctttaagac

SEQ ID NO: 1319526 - DNA, 19 bp, Homo sapiens
tatgtatctaatttcattc

SEQ ID NO: 1319527 - DNA, 14 bp, Homo sapiens
tattactttaacat

SEQ ID NO: 1319528 - DNA, 17 bp, Homo sapiens
tattcaacagagaggga

SEQ ID NO: 1319529 - DNA, 16 bp, Homo sapiens
tattcgaaacctgtga

SEQ ID NO: 1319530 - DNA, 14 bp, Homo sapiens
tatttaaagggaat

SEQ ID NO: 1319531 - DNA, 18 bp, Homo sapiens
tatttatccctcattcat

SEQ ID NO: 1319532 - DNA, 18 bp, Homo sapiens
tatttgcagtcatggaga

SEQ ID NO: 1319533 - DNA, 21 bp, Homo sapiens
tattttacttggaaatattaa

SEQ ID NO: 1319534 - DNA, 18 bp, Homo sapiens
tattttctgtgtgttcct

SEQ ID NO: 1319535 - DNA, 14 bp, Homo sapiens
tcaaaattatagga

SEQ ID NO: 1319536 - DNA, 22 bp, Homo sapiens
tcaaaattataggagacttgta

SEQ ID NO: 1319537 - DNA, 21 bp, Homo sapiens
tcaaagaggcacagagccaaa

SEQ ID NO: 1319538 - DNA, 19 bp, Homo sapiens
tcaaagataaatgaaataa

SEQ ID NO: 1319539 - DNA, 20 bp, Homo sapiens
tcaaagataaatgaaataaa

SEQ ID NO: 1319540 - DNA, 15 bp, Homo sapiens
tcaaagctttttgaa

SEQ ID NO: 1319541 - DNA, 22 bp, Homo sapiens
tcaactctgctgagggtccaga

SEQ ID NO: 1319542 - DNA, 21 bp, Homo sapiens
tcaactgagaagccaagcctg

SEQ ID NO: 1319543 - DNA, 22 bp, Homo sapiens
tcaactgagaagccaagcctgg

SEQ ID NO: 1319544 - DNA, 19 bp, Homo sapiens
tcaagctaataaaatatca

SEQ ID NO: 1319545 - DNA, 19 bp, Homo sapiens
tcaataaacagcaggtgat

SEQ ID NO: 1319546 - DNA, 19 bp, Homo sapiens
tcaataaacttgtgcctcc

SEQ ID NO: 1319547 - DNA, 20 bp, Homo sapiens
tcaataaacttgtgcctcca

SEQ ID NO: 1319548 - DNA, 15 bp, Homo sapiens
tcaatcaacatctct

SEQ ID NO: 1319549 - DNA, 23 bp, Homo sapiens
tcaatcaacatctcttgagtgtc

SEQ ID NO: 1319550 - DNA, 21 bp, Homo sapiens
tcaatcatatttaaagggaat

SEQ ID NO: 1319551 - DNA, 19 bp, Homo sapiens
tcaatgataaatttaaatg

SEQ ID NO: 1319552 - DNA, 15 bp, Homo sapiens
tcacaacagtcttgt

SEQ ID NO: 1319553 - DNA, 18 bp, Homo sapiens
tcacatggaatgagggtt

SEQ ID NO: 1319554 - DNA, 19 bp, Homo sapiens
tcacatggaatgagggttt

SEQ ID NO: 1319555 - DNA, 14 bp, Homo sapiens
tcacatgtgccctg

SEQ ID NO: 1319556 - DNA, 17 bp, Homo sapiens
tcacatgtgccctgcct

SEQ ID NO: 1319557 - DNA, 17 bp, Homo sapiens
tcacccctggtggctgc

SEQ ID NO: 1319558 - DNA, 23 bp, Homo sapiens
tcagaaaaaatgtgaagtctact

SEQ ID NO: 1319559 - DNA, 12 bp, Homo sapiens
tcagaagccttc

SEQ ID NO: 1319560 - DNA, 16 bp, Homo sapiens
tcagaagccttcttgc

SEQ ID NO: 1319561 - DNA, 18 bp, Homo sapiens
tcagaagccttcttgctg

SEQ ID NO: 1319562 - DNA, 19 bp, Homo sapiens
tcagaagccttcttgctgc

SEQ ID NO: 1319563 - DNA, 21 bp, Homo sapiens
tcagaagccttcttgctgccc

SEQ ID NO: 1319564 - DNA, 14 bp, Homo sapiens
tcagaccgtcttcc

SEQ ID NO: 1319565 - DNA, 15 bp, Homo sapiens
tcagagcaagccttt

SEQ ID NO: 1319566 - DNA, 20 bp, Homo sapiens
tcagagcaagcctttgacct

SEQ ID NO: 1319567 - DNA, 19 bp, Homo sapiens
tcagcaagtagagcagagt

SEQ ID NO: 1319568 - DNA, 13 bp, Homo sapiens
tcagcaccccact

SEQ ID NO: 1319569 - DNA, 14 bp, Homo sapiens
tcagcaccccactc

SEQ ID NO: 1319570 - DNA, 20 bp, Homo sapiens
tcagcatgaaaatgtgtgtt

SEQ ID NO: 1319571 - DNA, 11 bp, Homo sapiens
tcagccaccct

SEQ ID NO: 1319572 - DNA, 14 bp, Homo sapiens
tcagcctgggcccc

SEQ ID NO: 1319573 - DNA, 23 bp, Homo sapiens
tcagcctgggcccctcagccacc

SEQ ID NO: 1319574 - DNA, 17 bp, Homo sapiens
tcagctgctttgttacc

SEQ ID NO: 1319575 - DNA, 15 bp, Homo sapiens
tcagctgttcagatt

SEQ ID NO: 1319576 - DNA, 14 bp, Homo sapiens
tcaggagagggcct

SEQ ID NO: 1319577 - DNA, 21 bp, Homo sapiens
tcaggagtccaaaccttctac

SEQ ID NO: 1319578 - DNA, 16 bp, Homo sapiens
tcagggtgtcccagac

SEQ ID NO: 1319579 - DNA, 18 bp, Homo sapiens
tcagtaaaagtcttctcc

SEQ ID NO: 1319580 - DNA, 18 bp, Homo sapiens
tcagtgttaatactgaga

SEQ ID NO: 1319581 - DNA, 21 bp, Homo sapiens
tcagtgttaatactgagaaaa

SEQ ID NO: 1319582 - DNA, 22 bp, Homo sapiens
tcagtgttaatactgagaaaaa

SEQ ID NO: 1319583 - DNA, 21 bp, Homo sapiens
ttgccaaataaagttaaaagt

SEQ ID NO: 1319584 - DNA, 18 bp, Homo sapiens
ttgccatgaaggcacctg

SEQ ID NO: 1319585 - DNA, 21 bp, Homo sapiens
ttgccatgaaggcacctgccc

SEQ ID NO: 1319586 - DNA, 18 bp, Homo sapiens
ttgccccaacccttcttc

SEQ ID NO: 1319587 - DNA, 12 bp, Homo sapiens
ttgcctgccatg

SEQ ID NO: 1319588 - DNA, 18 bp, Homo sapiens
ttgctcccgccccagggt

SEQ ID NO: 1319589 - DNA, 18 bp, Homo sapiens
ttgctggtcttctcagtt

SEQ ID NO: 1319590 - DNA, 21 bp, Homo sapiens
ttgcttgaagcaaacagttga

SEQ ID NO: 1319591 - DNA, 23 bp, Homo sapiens
ttgctttaaagagtcctccttcc

SEQ ID NO: 1319592 - DNA, 18 bp, Homo sapiens
ttggaaactaataaaata

SEQ ID NO: 1319593 - DNA, 19 bp, Homo sapiens
ttggacacttaattctgtt

SEQ ID NO: 1319594 - DNA, 22 bp, Homo sapiens
ttggacataactgacttagttc

SEQ ID NO: 1319595 - DNA, 15 bp, Homo sapiens
ttggcccatcccgcc

SEQ ID NO: 1319596 - DNA, 17 bp, Homo sapiens
ttgggaagtctcagcct

SEQ ID NO: 1319597 - DNA, 18 bp, Homo sapiens
ttgggaagtctcagcctg

SEQ ID NO: 1319598 - DNA, 23 bp, Homo sapiens
ttggtaagggaagtttagatgag

SEQ ID NO: 1319599 - DNA, 13 bp, Homo sapiens
ttggtcatctctc

SEQ ID NO: 1319600 - DNA, 17 bp, Homo sapiens
ttggtcatctctcctgt

SEQ ID NO: 1319601 - DNA, 15 bp, Homo sapiens
ttggtctcatgcccc

SEQ ID NO: 1319602 - DNA, 18 bp, Homo sapiens
ttgtagatacaatcagct

SEQ ID NO: 1319603 - DNA, 20 bp, Homo sapiens
ttgtagatacaatcagctgc

SEQ ID NO: 1319604 - DNA, 20 bp, Homo sapiens
ttgtagatgaacatctctgt

SEQ ID NO: 1319605 - DNA, 16 bp, Homo sapiens
ttgtcatcaccatgga

SEQ ID NO: 1319606 - DNA, 13 bp, Homo sapiens
ttgtgactagtgc

SEQ ID NO: 1319607 - DNA, 17 bp, Homo sapiens
ttgtgactagtgctgaa

SEQ ID NO: 1319608 - DNA, 21 bp, Homo sapiens
ttgtgactagtgctgaagctt

SEQ ID NO: 1319609 - DNA, 14 bp, Homo sapiens
ttgtgagagacttt

SEQ ID NO: 1319610 - DNA, 19 bp, Homo sapiens
ttgtggacctcaccagaga

SEQ ID NO: 1319611 - DNA, 14 bp, Homo sapiens
ttgtgtaatattac

SEQ ID NO: 1319612 - DNA, 22 bp, Homo sapiens
ttgttagcattttcaatgtgat

SEQ ID NO: 1319613 - DNA, 21 bp, Homo sapiens
ttgttgtttcttaatttggaa

SEQ ID NO: 1319614 - DNA, 22 bp, Homo sapiens
tttaaaacaagaaagtttcccc

SEQ ID NO: 1319615 - DNA, 11 bp, Homo sapiens
tttaacatgcc

SEQ ID NO: 1319616 - DNA, 12 bp, Homo sapiens
tttaagaatggt

SEQ ID NO: 1319617 - DNA, 16 bp, Homo sapiens
tttaagagccttcaat

SEQ ID NO: 1319618 - DNA, 19 bp, Homo sapiens
tttaatgttggaagagcat

SEQ ID NO: 1319619 - DNA, 19 bp, Homo sapiens
tttacactggatgtttctc

SEQ ID NO: 1319620 - DNA, 18 bp, Homo sapiens
tttactgagagaaggtga

SEQ ID NO: 1319621 - DNA, 19 bp, Homo sapiens
tttagatagcagcctggct

SEQ ID NO: 1319622 - DNA, 13 bp, Homo sapiens
tttagtgtggttt

SEQ ID NO: 1319623 - DNA, 14 bp, Homo sapiens
tttatcagattgct

SEQ ID NO: 1319624 - DNA, 22 bp, Homo sapiens
tttatcagattgcttttgtgca

SEQ ID NO: 1319625 - DNA, 17 bp, Homo sapiens
tttatgcagtgctgctt

SEQ ID NO: 1319626 - DNA, 23 bp, Homo sapiens
tttatgtatctaatttcattcaa

SEQ ID NO: 1319627 - DNA, 18 bp, Homo sapiens
tttcagcatgaaaatgtg

SEQ ID NO: 1319628 - DNA, 17 bp, Homo sapiens
tttcatcagaacagctg

SEQ ID NO: 1319629 - DNA, 14 bp, Homo sapiens
tttccaccttctca

SEQ ID NO: 1319630 - DNA, 15 bp, Homo sapiens
tttccttttgctgtg

SEQ ID NO: 1319631 - DNA, 15 bp, Homo sapiens
tttctatgaacttgt

SEQ ID NO: 1319632 - DNA, 22 bp, Homo sapiens
tttctggggcctaataaaactg

SEQ ID NO: 1319633 - DNA, 11 bp, Homo sapiens
tttctgtgtgt

SEQ ID NO: 1319634 - DNA, 13 bp, Homo sapiens
tttctgtgtgttc

SEQ ID NO: 1319635 - DNA, 16 bp, Homo sapiens
tttctgtgtgttcctg

SEQ ID NO: 1319636 - DNA, 17 bp, Homo sapiens
tttcttaatttggaaac

SEQ ID NO: 1319637 - DNA, 18 bp, Homo sapiens
tttcttaatttggaaact

SEQ ID NO: 1319638 - DNA, 15 bp, Homo sapiens
tttctttttaaagct

SEQ ID NO: 1319639 - DNA, 19 bp, Homo sapiens
tttgacagcgcacagctgc

SEQ ID NO: 1319640 - DNA, 18 bp, Homo sapiens
tttgagagagcagccagg

SEQ ID NO: 1319641 - DNA, 22 bp, Homo sapiens
tttgatgataaaaggagaataa

SEQ ID NO: 1319642 - DNA, 14 bp, Homo sapiens
tttgcagatgaagt

SEQ ID NO: 1319643 - DNA, 15 bp, Homo sapiens
tttggaaactaataa

SEQ ID NO: 1319644 - DNA, 16 bp, Homo sapiens
tttggaaactaataaa

SEQ ID NO: 1319645 - DNA, 17 bp, Homo sapiens
tttggaaactaataaaa

SEQ ID NO: 1319646 - DNA, 17 bp, Homo sapiens
tttggttagctcacagg

SEQ ID NO: 1319647 - DNA, 22 bp, Homo sapiens
ttttaaaacaagaaagtttccc

SEQ ID NO: 1319648 - DNA, 20 bp, Homo sapiens
aatattttctgtgtgttcct

SEQ ID NO: 1319649 - DNA, 23 bp, Homo sapiens
aatattttctgtgtgttcctggc

SEQ ID NO: 1319650 - DNA, 23 bp, Homo sapiens
aatcagagattattcaacagaga

SEQ ID NO: 1319651 - DNA, 19 bp, Homo sapiens
aatcagctgctttgttacc

SEQ ID NO: 1319652 - DNA, 17 bp, Homo sapiens
aatctcgactctcgtga

SEQ ID NO: 1319653 - DNA, 21 bp, Homo sapiens
aatgaaagtcttgtgactagt

SEQ ID NO: 1319654 - DNA, 21 bp, Homo sapiens
aatgacatctacgaagccaca

SEQ ID NO: 1319655 - DNA, 16 bp, Homo sapiens
aatgacctcagatctt

SEQ ID NO: 1319656 - DNA, 17 bp, Homo sapiens
aatgacctcagatcttt

SEQ ID NO: 1319657 - DNA, 15 bp, Homo sapiens
aatgagggggctcag

SEQ ID NO: 1319658 - DNA, 16 bp, Homo sapiens
aatgagggggctcagt

SEQ ID NO: 1319659 - DNA, 18 bp, Homo sapiens
aatgtcaacaccagaaag

SEQ ID NO: 1319660 - DNA, 15 bp, Homo sapiens
aatgtgaagtctact

SEQ ID NO: 1319661 - DNA, 16 bp, Homo sapiens
aatgtggaaaaagtaa

SEQ ID NO: 1319662 - DNA, 19 bp, Homo sapiens
aattacagtggattgctca

SEQ ID NO: 1319663 - DNA, 16 bp, Homo sapiens
aattactacaaatgga

SEQ ID NO: 1319664 - DNA, 15 bp, Homo sapiens
aattatcaagctaat

SEQ ID NO: 1319665 - DNA, 19 bp, Homo sapiens
aattatcaagctaataaaa

SEQ ID NO: 1319666 - DNA, 14 bp, Homo sapiens
aattccctaaagcc

SEQ ID NO: 1319667 - DNA, 15 bp, Homo sapiens
aattggtgtgcctta

SEQ ID NO: 1319668 - DNA, 18 bp, Homo sapiens
aattgtagataatactgt

SEQ ID NO: 1319669 - DNA, 17 bp, Homo sapiens
aatttatcagattgctt

SEQ ID NO: 1319670 - DNA, 14 bp, Homo sapiens
aatttggaaactaa

SEQ ID NO: 1319671 - DNA, 18 bp, Homo sapiens
aattttattttttttctg

SEQ ID NO: 1319672 - DNA, 13 bp, Homo sapiens
acaaagttctgta

SEQ ID NO: 1319673 - DNA, 14 bp, Homo sapiens
acaaatgctgtggt

SEQ ID NO: 1319674 - DNA, 18 bp, Homo sapiens
acaaatggatgacacatt

SEQ ID NO: 1319675 - DNA, 14 bp, Homo sapiens
acaacagtcttgtg

SEQ ID NO: 1319676 - DNA, 17 bp, Homo sapiens
acaagaaagtttcccca

SEQ ID NO: 1319677 - DNA, 21 bp, Homo sapiens
acaagaaagtttccccaccag

SEQ ID NO: 1319678 - DNA, 14 bp, Homo sapiens
acaagacctctggc

SEQ ID NO: 1319679 - DNA, 15 bp, Homo sapiens
acaagacctctggct

SEQ ID NO: 1319680 - DNA, 12 bp, Homo sapiens
acaatcagctgc

SEQ ID NO: 1319681 - DNA, 14 bp, Homo sapiens
acaatttctctggg

SEQ ID NO: 1319682 - DNA, 22 bp, Homo sapiens
acacagaccgcgcccctgggac

SEQ ID NO: 1319683 - DNA, 23 bp, Homo sapiens
acacagaccgcgcccctgggact

SEQ ID NO: 1319684 - DNA, 12 bp, Homo sapiens
acacccagcctg

SEQ ID NO: 1319685 - DNA, 20 bp, Homo sapiens
acacctcactctgctacctt

SEQ ID NO: 1319686 - DNA, 11 bp, Homo sapiens
acacctcctgg

SEQ ID NO: 1319687 - DNA, 12 bp, Homo sapiens
acactcagctgt

SEQ ID NO: 1319688 - DNA, 14 bp, Homo sapiens
acactcagctgttc

SEQ ID NO: 1319689 - DNA, 20 bp, Homo sapiens
acactcagctgttcagattg

SEQ ID NO: 1319690 - DNA, 16 bp, Homo sapiens
acactgtgcaggccca

SEQ ID NO: 1319691 - DNA, 18 bp, Homo sapiens
acactgtgcaggcccagg

SEQ ID NO: 1319692 - DNA, 22 bp, Homo sapiens
acactgtgcaggcccaggcagg

SEQ ID NO: 1319693 - DNA, 19 bp, Homo sapiens
acagaattcactgtctgtt

SEQ ID NO: 1319694 - DNA, 19 bp, Homo sapiens
acagaccgcgcccctggga

SEQ ID NO: 1319695 - DNA, 16 bp, Homo sapiens
acagcgttatgtgtct

SEQ ID NO: 1319696 - DNA, 13 bp, Homo sapiens
acagctgttgact

SEQ ID NO: 1319697 - DNA, 14 bp, Homo sapiens
acagctgttgactc

SEQ ID NO: 1319698 - DNA, 15 bp, Homo sapiens
acagcttctgagaat

SEQ ID NO: 1319699 - DNA, 19 bp, Homo sapiens
acagcttgttttggacttt

SEQ ID NO: 1319700 - DNA, 18 bp, Homo sapiens
acaggatatgctttaaga

SEQ ID NO: 1319701 - DNA, 23 bp, Homo sapiens
acaggatatgctttaagacagaa

SEQ ID NO: 1319702 - DNA, 14 bp, Homo sapiens
acagggaccagctc

SEQ ID NO: 1319703 - DNA, 21 bp, Homo sapiens
acaggtcctccatcacccctg

SEQ ID NO: 1319704 - DNA, 21 bp, Homo sapiens
acagtttatgcagtgctgctt

SEQ ID NO: 1319705 - DNA, 13 bp, Homo sapiens
acatagccctgtt

SEQ ID NO: 1319706 - DNA, 15 bp, Homo sapiens
acatagcttgagcta

SEQ ID NO: 1319707 - DNA, 21 bp, Homo sapiens
acatcagcttgaccagtataa

SEQ ID NO: 1319708 - DNA, 22 bp, Homo sapiens
acatctacgaagccacaggcct

SEQ ID NO: 1319709 - DNA, 23 bp, Homo sapiens
acatctacgaagccacaggcctg

SEQ ID NO: 1319710 - DNA, 18 bp, Homo sapiens
acatcttgtttctgagtt

SEQ ID NO: 1319711 - DNA, 15 bp, Homo sapiens
acatgtgccctgcct

SEQ ID NO: 1319712 - DNA, 12 bp, Homo sapiens
acattctgctct

SEQ ID NO: 1319713 - DNA, 13 bp, Homo sapiens
acattctgctctg

SEQ ID NO: 1319714 - DNA, 14 bp, Homo sapiens
acattctgctctgc

SEQ ID NO: 1319715 - DNA, 19 bp, Homo sapiens
acattctgctctgcccatg

SEQ ID NO: 1319716 - DNA, 21 bp, Homo sapiens
acattctgctctgcccatgcc

SEQ ID NO: 1319717 - DNA, 16 bp, Homo sapiens
acatttaatgaacaca

SEQ ID NO: 1319718 - DNA, 20 bp, Homo sapiens
acatttaatgaacacaattt

SEQ ID NO: 1319719 - DNA, 11 bp, Homo sapiens
acatttctctc

SEQ ID NO: 1319720 - DNA, 21 bp, Homo sapiens
accaccccacccacctttgca

SEQ ID NO: 1319721 - DNA, 13 bp, Homo sapiens
accacctacccct

SEQ ID NO: 1319722 - DNA, 11 bp, Homo sapiens
accagagaagg

SEQ ID NO: 1319723 - DNA, 10 bp, Homo sapiens
accagctccc

SEQ ID NO: 1319724 - DNA, 15 bp, Homo sapiens
accagctttgacccg

SEQ ID NO: 1319725 - DNA, 16 bp, Homo sapiens
accagtataaaattac

SEQ ID NO: 1319726 - DNA, 13 bp, Homo sapiens
acccaatctggct

SEQ ID NO: 1319727 - DNA, 21 bp, Homo sapiens
acccaccctctccacacccag

SEQ ID NO: 1319728 - DNA, 22 bp, Homo sapiens
acccaccctctccacacccagc

SEQ ID NO: 1319729 - DNA, 24 bp, Homo sapiens
acccagcctgtcccactggctcct

SEQ ID NO: 1319730 - DNA, 16 bp, Homo sapiens
accccacccacctttg

SEQ ID NO: 1319731 - DNA, 22 bp, Homo sapiens
accccacccacctttgcaggga

SEQ ID NO: 1319732 - DNA, 14 bp, Homo sapiens
acccctggtggctg

SEQ ID NO: 1319733 - DNA, 14 bp, Homo sapiens
accccttgctctct

SEQ ID NO: 1319734 - DNA, 11 bp, Homo sapiens
accctgagggc

SEQ ID NO: 1319735 - DNA, 14 bp, Homo sapiens
acccttcttcatgt

SEQ ID NO: 1319736 - DNA, 17 bp, Homo sapiens
acccttcttcatgttca

SEQ ID NO: 1319737 - DNA, 15 bp, Homo sapiens
accggctcaggagag

SEQ ID NO: 1319738 - DNA, 21 bp, Homo sapiens
accggctcaggagagggcctt

SEQ ID NO: 1319739 - DNA, 17 bp, Homo sapiens
acctatccaccacccca

SEQ ID NO: 1319740 - DNA, 23 bp, Homo sapiens
acctcactctgctaccttgcccc

SEQ ID NO: 1319741 - DNA, 21 bp, Homo sapiens
acctccggccaggtgcctcct

SEQ ID NO: 1319742 - DNA, 14 bp, Homo sapiens
acctcgttagagaa

SEQ ID NO: 1319743 - DNA, 22 bp, Homo sapiens
acctctcagagcaagcctttga

SEQ ID NO: 1319744 - DNA, 20 bp, Homo sapiens
acctctccagcatcccagcc

SEQ ID NO: 1319745 - DNA, 21 bp, Homo sapiens
acctctccagcatcccagcct

SEQ ID NO: 1319746 - DNA, 22 bp, Homo sapiens
acctgcaaacgcttcagttgtt

SEQ ID NO: 1319747 - DNA, 18 bp, Homo sapiens
acctgcccccacagctcc

SEQ ID NO: 1319748 - DNA, 23 bp, Homo sapiens
acctgcccccacagctccttgca

SEQ ID NO: 1319749 - DNA, 21 bp, Homo sapiens
acctggctacgtaattatact

SEQ ID NO: 1319750 - DNA, 20 bp, Homo sapiens
accttgtgcccgattctttc

SEQ ID NO: 1319751 - DNA, 12 bp, Homo sapiens
acctttgcaggg

SEQ ID NO: 1319752 - DNA, 13 bp, Homo sapiens
accttttttcttg

SEQ ID NO: 1319753 - DNA, 14 bp, Homo sapiens
acgaagccacaggc

SEQ ID NO: 1319754 - DNA, 11 bp, Homo sapiens
acgattcacag

SEQ ID NO: 1319755 - DNA, 12 bp, Homo sapiens
acgattcacagc

SEQ ID NO: 1319756 - DNA, 13 bp, Homo sapiens
acggctctgtgcc

SEQ ID NO: 1319757 - DNA, 23 bp, Homo sapiens
acggtgagggtgcggggcctgca

SEQ ID NO: 1319758 - DNA, 18 bp, Homo sapiens
acgtctatttcatcagaa

SEQ ID NO: 1319759 - DNA, 16 bp, Homo sapiens
actaaagccaggaaca

SEQ ID NO: 1319760 - DNA, 22 bp, Homo sapiens
actaaagccaggaacagggacc

SEQ ID NO: 1319761 - DNA, 12 bp, Homo sapiens
actaataaaata

SEQ ID NO: 1319762 - DNA, 15 bp, Homo sapiens
actaataaaatattt

SEQ ID NO: 1319763 - DNA, 18 bp, Homo sapiens
actaataaaatattttct

SEQ ID NO: 1319764 - DNA, 22 bp, Homo sapiens
actctcgtgatatgctgcttgt

SEQ ID NO: 1319765 - DNA, 19 bp, Homo sapiens
actctgctaccttgcccca

SEQ ID NO: 1319766 - DNA, 11 bp, Homo sapiens
actctgctctc

SEQ ID NO: 1319767 - DNA, 20 bp, Homo sapiens
actctgctctcctcgggccc

SEQ ID NO: 1319768 - DNA, 15 bp, Homo sapiens
actctgctgagggtc

SEQ ID NO: 1319769 - DNA, 14 bp, Homo sapiens
actctggaccatgc

SEQ ID NO: 1319770 - DNA, 22 bp, Homo sapiens
actctgttgctggtcttctcag

SEQ ID NO: 1319771 - DNA, 15 bp, Homo sapiens
actgaagaggaggag

SEQ ID NO: 1319772 - DNA, 12 bp, Homo sapiens
actgacccagag

SEQ ID NO: 1319773 - DNA, 17 bp, Homo sapiens
actgagaagccaagcct

SEQ ID NO: 1319774 - DNA, 14 bp, Homo sapiens
actgcaactccagc

SEQ ID NO: 1319775 - DNA, 15 bp, Homo sapiens
actgcaactccagcg

SEQ ID NO: 1319776 - DNA, 23 bp, Homo sapiens
actgcaactccagcgtcctcagc

SEQ ID NO: 1319777 - DNA, 15 bp, Homo sapiens
actgctactgaccca

SEQ ID NO: 1319778 - DNA, 21 bp, Homo sapiens
actggaactgcaactccagcg

SEQ ID NO: 1319779 - DNA, 22 bp, Homo sapiens
actggggtcattttgactggct

SEQ ID NO: 1319780 - DNA, 20 bp, Homo sapiens
actgtctgttgcttcagtaa

SEQ ID NO: 1319781 - DNA, 21 bp, Homo sapiens
actgtgctcaaccagacagat

SEQ ID NO: 1319782 - DNA, 23 bp, Homo sapiens
actgtgcttgttgaatgtcaatc

SEQ ID NO: 1319783 - DNA, 23 bp, Homo sapiens
actgtgggtttgtggggggaggc

SEQ ID NO: 1319784 - DNA, 14 bp, Homo sapiens
actgtttgaagatt

SEQ ID NO: 1319785 - DNA, 15 bp, Homo sapiens
acttaacatgctgtg

SEQ ID NO: 1319786 - DNA, 18 bp, Homo sapiens
acttaacatgctgtgtaa

SEQ ID NO: 1319787 - DNA, 18 bp, Homo sapiens
acttaactggcccagaag

SEQ ID NO: 1319788 - DNA, 15 bp, Homo sapiens
acttcatctggaagt

SEQ ID NO: 1319789 - DNA, 15 bp, Homo sapiens
acttctgtttagtct

SEQ ID NO: 1319790 - DNA, 14 bp, Homo sapiens
acttgcaaaatgga

SEQ ID NO: 1319791 - DNA, 21 bp, Homo sapiens
acttgccatgaaggcacctgc

SEQ ID NO: 1319792 - DNA, 16 bp, Homo sapiens
acttgtagtttagtgt

SEQ ID NO: 1319793 - DNA, 11 bp, Homo sapiens
acttgtgcctc

SEQ ID NO: 1319794 - DNA, 22 bp, Homo sapiens
agaaaaagtcctgtcagttcag

SEQ ID NO: 1319795 - DNA, 19 bp, Homo sapiens
agaaaatagagatgagctt

SEQ ID NO: 1319796 - DNA, 14 bp, Homo sapiens
agaaaccttcactc

SEQ ID NO: 1319797 - DNA, 18 bp, Homo sapiens
agaaaggaggagacagag

SEQ ID NO: 1319798 - DNA, 12 bp, Homo sapiens
agaaatctttct

SEQ ID NO: 1319799 - DNA, 12 bp, Homo sapiens
agaacagctgtt

SEQ ID NO: 1319800 - DNA, 13 bp, Homo sapiens
agaactttctctt

SEQ ID NO: 1319801 - DNA, 13 bp, Homo sapiens
agaagccaagcct

SEQ ID NO: 1319802 - DNA, 13 bp, Homo sapiens
agaagccttcttg

SEQ ID NO: 1319803 - DNA, 19 bp, Homo sapiens
agaaggtagattttaagaa

SEQ ID NO: 1319804 - DNA, 21 bp, Homo sapiens
agaagtccttaagcagaggaa

SEQ ID NO: 1319805 - DNA, 13 bp, Homo sapiens
agaatacatcttg

SEQ ID NO: 1319806 - DNA, 23 bp, Homo sapiens
agaatagggcccatgggagggag

SEQ ID NO: 1319807 - DNA, 13 bp, Homo sapiens
agaatcgcttgaa

SEQ ID NO: 1319808 - DNA, 17 bp, Homo sapiens
agaatgtaggctggtcc

SEQ ID NO: 1319809 - DNA, 19 bp, Homo sapiens
agaatgtaggctggtccct

SEQ ID NO: 1319810 - DNA, 17 bp, Homo sapiens
agaattaggtttctttg

SEQ ID NO: 1319811 - DNA, 22 bp, Homo sapiens
agaattcactgtctgttgcttc

SEQ ID NO: 1319812 - DNA, 19 bp, Homo sapiens
agacaattccatttctttc

SEQ ID NO: 1319813 - DNA, 22 bp, Homo sapiens
agacaattccatttctttctgg

SEQ ID NO: 1319814 - DNA, 17 bp, Homo sapiens
agacagatagtgaaaca

SEQ ID NO: 1319815 - DNA, 15 bp, Homo sapiens
agaccgcgcccctgg

SEQ ID NO: 1319816 - DNA, 17 bp, Homo sapiens
agaccgcgcccctggga

SEQ ID NO: 1319817 - DNA, 19 bp, Homo sapiens
agaccgcgcccctgggact

SEQ ID NO: 1319818 - DNA, 16 bp, Homo sapiens
agaccgtcttcctcca

SEQ ID NO: 1319819 - DNA, 17 bp, Homo sapiens
agacctggcctctgcca

SEQ ID NO: 1319820 - DNA, 19 bp, Homo sapiens
agacctggcctctgccatc

SEQ ID NO: 1319821 - DNA, 12 bp, Homo sapiens
agacctggctgg

SEQ ID NO: 1319822 - DNA, 21 bp, Homo sapiens
agacctggctgggcctgggct

SEQ ID NO: 1319823 - DNA, 15 bp, Homo sapiens
agactatagcccctg

SEQ ID NO: 1319824 - DNA, 14 bp, Homo sapiens
agactctgctctcc

SEQ ID NO: 1319825 - DNA, 19 bp, Homo sapiens
agactgtggggagggtcat

SEQ ID NO: 1319826 - DNA, 19 bp, Homo sapiens
agacttaactggcccagaa

SEQ ID NO: 1319827 - DNA, 19 bp, Homo sapiens
agagacaatagcattagaa

SEQ ID NO: 1319828 - DNA, 15 bp, Homo sapiens
agagatgagctttct

SEQ ID NO: 1319829 - DNA, 13 bp, Homo sapiens
agagattattcaa

SEQ ID NO: 1319830 - DNA, 18 bp, Homo sapiens
agagattattcaacagag

SEQ ID NO: 1319831 - DNA, 15 bp, Homo sapiens
agagcaatctgggca

SEQ ID NO: 1319832 - DNA, 12 bp, Homo sapiens
agagggccttcc

SEQ ID NO: 1319833 - DNA, 23 bp, Homo sapiens
agagggccttcccctcccagccc

SEQ ID NO: 1319834 - DNA, 19 bp, Homo sapiens
agaggttctgattttcttg

SEQ ID NO: 1319835 - DNA, 16 bp, Homo sapiens
agagtcctccttccca

SEQ ID NO: 1319836 - DNA, 18 bp, Homo sapiens
agatacaatcagctgctt

SEQ ID NO: 1319837 - DNA, 18 bp, Homo sapiens
agatatgcattcaagaga

SEQ ID NO: 1319838 - DNA, 20 bp, Homo sapiens
agatcacttgatgccaggag

SEQ ID NO: 1319839 - DNA, 22 bp, Homo sapiens
agatctttgcaccagatactca

SEQ ID NO: 1319840 - DNA, 17 bp, Homo sapiens
agatgaacatctctgtt

SEQ ID NO: 1319841 - DNA, 20 bp, Homo sapiens
agatgagctttctttttaaa

SEQ ID NO: 1319842 - DNA, 12 bp, Homo sapiens
agatgctctctg

SEQ ID NO: 1319843 - DNA, 16 bp, Homo sapiens
agatgctctctgaggc

SEQ ID NO: 1319844 - DNA, 17 bp, Homo sapiens
agattattcaacagaga

SEQ ID NO: 1319845 - DNA, 16 bp, Homo sapiens
agcaacatcagcttga

SEQ ID NO: 1319846 - DNA, 12 bp, Homo sapiens
agcaagcctttg

SEQ ID NO: 1319847 - DNA, 15 bp, Homo sapiens
agcacatagccctgt

SEQ ID NO: 1319848 - DNA, 22 bp, Homo sapiens
agcacatagccctgttgacctg

SEQ ID NO: 1319849 - DNA, 24 bp, Homo sapiens
agcacatagccctgttgacctgcc

SEQ ID NO: 1319850 - DNA, 15 bp, Homo sapiens
agcaccctgagggcg

SEQ ID NO: 1319851 - DNA, 17 bp, Homo sapiens
agcacctgagaagagga

SEQ ID NO: 1319852 - DNA, 18 bp, Homo sapiens
agcacgttcactagacta

SEQ ID NO: 1319853 - DNA, 13 bp, Homo sapiens
agcagcctggctc

SEQ ID NO: 1319854 - DNA, 15 bp, Homo sapiens
agcagcctggctccc

SEQ ID NO: 1319855 - DNA, 17 bp, Homo sapiens
agcagtggagtttaaaa

SEQ ID NO: 1319856 - DNA, 16 bp, Homo sapiens
agcatcccagcctcag

SEQ ID NO: 1319857 - DNA, 17 bp, Homo sapiens
agcatcccagcctcaga

SEQ ID NO: 1319858 - DNA, 23 bp, Homo sapiens
agcatgaggcagcacgtgcacaa

SEQ ID NO: 1319859 - DNA, 12 bp, Homo sapiens
agccaagcctgg

SEQ ID NO: 1319860 - DNA, 15 bp, Homo sapiens
agccaagcctggagt

SEQ ID NO: 1319861 - DNA, 20 bp, Homo sapiens
agccaggaacagggaccagc

SEQ ID NO: 1319862 - DNA, 14 bp, Homo sapiens
agccatgagaatgt

SEQ ID NO: 1319863 - DNA, 21 bp, Homo sapiens
agcccaagctaagctgcaggc

SEQ ID NO: 1319864 - DNA, 19 bp, Homo sapiens
agcccattgctgcaaatgc

SEQ ID NO: 1319865 - DNA, 15 bp, Homo sapiens
agccccaagactctg

SEQ ID NO: 1319866 - DNA, 14 bp, Homo sapiens
agccctgttgacct

SEQ ID NO: 1319867 - DNA, 15 bp, Homo sapiens
agcctcagaagcctt

SEQ ID NO: 1319868 - DNA, 17 bp, Homo sapiens
agcctcagaagccttct

SEQ ID NO: 1319869 - DNA, 19 bp, Homo sapiens
agcctcagaagccttcttg

SEQ ID NO: 1319870 - DNA, 20 bp, Homo sapiens
agcctcagaagccttcttgc

SEQ ID NO: 1319871 - DNA, 23 bp, Homo sapiens
agcctcagaagccttcttgctgc

SEQ ID NO: 1319872 - DNA, 19 bp, Homo sapiens
agcctctgccccacccatc

SEQ ID NO: 1319873 - DNA, 17 bp, Homo sapiens
agcctggagtaggcctg

SEQ ID NO: 1319874 - DNA, 16 bp, Homo sapiens
agcctgggcccctcag

SEQ ID NO: 1319875 - DNA, 16 bp, Homo sapiens
agcctgtcccactggc

SEQ ID NO: 1319876 - DNA, 17 bp, Homo sapiens
agcctgtcccactggct

SEQ ID NO: 1319877 - DNA, 21 bp, Homo sapiens
agcctgtcccactggctcctc

SEQ ID NO: 1319878 - DNA, 13 bp, Homo sapiens
agcctgtgtcctg

SEQ ID NO: 1319879 - DNA, 17 bp, Homo sapiens
agcctgttccttcctgc

SEQ ID NO: 1319880 - DNA, 13 bp, Homo sapiens
agccttcttgctg

SEQ ID NO: 1319881 - DNA, 17 bp, Homo sapiens
agccttcttgctgccca

SEQ ID NO: 1319882 - DNA, 12 bp, Homo sapiens
agcctttgacct

SEQ ID NO: 1319883 - DNA, 18 bp, Homo sapiens
agcctttgacctgttcag

SEQ ID NO: 1319884 - DNA, 15 bp, Homo sapiens
agcgcacagctgctc

SEQ ID NO: 1319885 - DNA, 11 bp, Homo sapiens
agcgcagcccg

SEQ ID NO: 1319886 - DNA, 21 bp, Homo sapiens
agctggtcacacaaggaactc

SEQ ID NO: 1319887 - DNA, 14 bp, Homo sapiens
agcttagggtctca

SEQ ID NO: 1319888 - DNA, 14 bp, Homo sapiens
agcttattaatgct

SEQ ID NO: 1319889 - DNA, 16 bp, Homo sapiens
agcttattaatgctaa

SEQ ID NO: 1319890 - DNA, 17 bp, Homo sapiens
agcttattaatgctaag

SEQ ID NO: 1319891 - DNA, 20 bp, Homo sapiens
agcttcaggacctggctacg

SEQ ID NO: 1319892 - DNA, 23 bp, Homo sapiens
agcttgttttggactttgttaca

SEQ ID NO: 1319893 - DNA, 22 bp, Homo sapiens
agctttctttttaaagcttttg

SEQ ID NO: 1319894 - DNA, 15 bp, Homo sapiens
agctttttgaaaacc

SEQ ID NO: 1319895 - DNA, 14 bp, Homo sapiens
aggaaaataagaat

SEQ ID NO: 1319896 - DNA, 16 bp, Homo sapiens
aggaaagcaaggcaga

SEQ ID NO: 1319897 - DNA, 14 bp, Homo sapiens
aggaacagggacca

SEQ ID NO: 1319898 - DNA, 22 bp, Homo sapiens
aggaactccccttcttcctgga

SEQ ID NO: 1319899 - DNA, 18 bp, Homo sapiens
aggaagaatagggcccat

SEQ ID NO: 1319900 - DNA, 18 bp, Homo sapiens
aggacatgtactgagaca

SEQ ID NO: 1319901 - DNA, 21 bp, Homo sapiens
aggaccctcatgatgggatga

SEQ ID NO: 1319902 - DNA, 11 bp, Homo sapiens
aggagaataag

SEQ ID NO: 1319903 - DNA, 11 bp, Homo sapiens
aggagagggcc

SEQ ID NO: 1319904 - DNA, 21 bp, Homo sapiens
aggagctggggcttctttctg

SEQ ID NO: 1319905 - DNA, 12 bp, Homo sapiens
aggaggaggagg

SEQ ID NO: 1319906 - DNA, 17 bp, Homo sapiens
aggagtaagcccaagct

SEQ ID NO: 1319907 - DNA, 15 bp, Homo sapiens
aggagtccaaacctt

SEQ ID NO: 1319908 - DNA, 15 bp, Homo sapiens
aggcaaataaaattc

SEQ ID NO: 1319909 - DNA, 13 bp, Homo sapiens
aggcaaggcccag

SEQ ID NO: 1319910 - DNA, 20 bp, Homo sapiens
aggcacacacgccttcatgc

SEQ ID NO: 1319911 - DNA, 22 bp, Homo sapiens
aggcaccgctgggttctgactc

SEQ ID NO: 1319912 - DNA, 19 bp, Homo sapiens
aggcacctgcccccacagc

SEQ ID NO: 1319913 - DNA, 15 bp, Homo sapiens
aggcagaaggccagg

SEQ ID NO: 1319914 - DNA, 23 bp, Homo sapiens
aggcaggcccagcctctgcccca

SEQ ID NO: 1319915 - DNA, 15 bp, Homo sapiens
aggcaggtgccagga

SEQ ID NO: 1319916 - DNA, 16 bp, Homo sapiens
aggcatcactttcctg

SEQ ID NO: 1319917 - DNA, 21 bp, Homo sapiens
aggcattgcctcggctggctc

SEQ ID NO: 1319918 - DNA, 20 bp, Homo sapiens
aggcatttgtaaatattaaa

SEQ ID NO: 1319919 - DNA, 15 bp, Homo sapiens
aggccacatgtgaaa

SEQ ID NO: 1319920 - DNA, 17 bp, Homo sapiens
aggccactgaagaggag

SEQ ID NO: 1319921 - DNA, 18 bp, Homo sapiens
aggccactgaagaggagg

SEQ ID NO: 1319922 - DNA, 21 bp, Homo sapiens
aggcccaaattatcaagctaa

SEQ ID NO: 1319923 - DNA, 13 bp, Homo sapiens
aggcccagacctg

SEQ ID NO: 1319924 - DNA, 15 bp, Homo sapiens
aggcccagcctctgc

SEQ ID NO: 1319925 - DNA, 16 bp, Homo sapiens
aggcccagcctctgcc

SEQ ID NO: 1319926 - DNA, 17 bp, Homo sapiens
aggcccagcctctgccc

SEQ ID NO: 1319927 - DNA, 19 bp, Homo sapiens
aggcccaggcaggcccagc

SEQ ID NO: 1319928 - DNA, 21 bp, Homo sapiens
aggcctggcctcaactgagaa

SEQ ID NO: 1319929 - DNA, 20 bp, Homo sapiens
aggcgcgctcagatgccgga

SEQ ID NO: 1319930 - DNA, 11 bp, Homo sapiens
aggctggaagg

SEQ ID NO: 1319931 - DNA, 21 bp, Homo sapiens
aggctggaaggaaagcaaggc

SEQ ID NO: 1319932 - DNA, 15 bp, Homo sapiens
aggctggaaggagga

SEQ ID NO: 1319933 - DNA, 16 bp, Homo sapiens
aggctggaaggaggaa

SEQ ID NO: 1319934 - DNA, 15 bp, Homo sapiens
agggaccagctcccc

SEQ ID NO: 1319935 - DNA, 16 bp, Homo sapiens
agggaccagctccccg

SEQ ID NO: 1319936 - DNA, 18 bp, Homo sapiens
agggaccagctccccggg

SEQ ID NO: 1319937 - DNA, 23 bp, Homo sapiens
agggaccagctccccgggggcca

SEQ ID NO: 1319938 - DNA, 21 bp, Homo sapiens
agggagaaaggaggagacaga

SEQ ID NO: 1319939 - DNA, 16 bp, Homo sapiens
agggatgaattgtaaa

SEQ ID NO: 1319940 - DNA, 18 bp, Homo sapiens
agggcccatgggagggag

SEQ ID NO: 1319941 - DNA, 13 bp, Homo sapiens
agggcctgctgga

SEQ ID NO: 1319942 - DNA, 19 bp, Homo sapiens
agggccttcccctcccagc

SEQ ID NO: 1319943 - DNA, 22 bp, Homo sapiens
agggccttcccctcccagccct

SEQ ID NO: 1319944 - DNA, 21 bp, Homo sapiens
agggcggggtgtctgtcttcc

SEQ ID NO: 1319945 - DNA, 19 bp, Homo sapiens
agggctgagcacctctcag

SEQ ID NO: 1319946 - DNA, 14 bp, Homo sapiens
aggggaatgagggg

SEQ ID NO: 1319947 - DNA, 16 bp, Homo sapiens
agggtctcagggtgtc

SEQ ID NO: 1319948 - DNA, 10 bp, Homo sapiens
agggtctgaa

SEQ ID NO: 1319949 - DNA, 15 bp, Homo sapiens
agggtctgaaagggg

SEQ ID NO: 1319950 - DNA, 17 bp, Homo sapiens
agggtctgaaaggggtg

SEQ ID NO: 1319951 - DNA, 19 bp, Homo sapiens
agggtgcggggcctgcagg

SEQ ID NO: 1319952 - DNA, 23 bp, Homo sapiens
agggtgcggggcctgcaggccag

SEQ ID NO: 1319953 - DNA, 22 bp, Homo sapiens
agggtttgagagagcagccagg

SEQ ID NO: 1319954 - DNA, 17 bp, Homo sapiens
aggtggatttactgaga

SEQ ID NO: 1319955 - DNA, 22 bp, Homo sapiens
aggtggatttactgagagaagg

SEQ ID NO: 1319956 - DNA, 17 bp, Homo sapiens
agtaaaaccttttttct

SEQ ID NO: 1319957 - DNA, 16 bp, Homo sapiens
agtaaaagtcttctcc

SEQ ID NO: 1319958 - DNA, 17 bp, Homo sapiens
agtactgtgaatccagt

SEQ ID NO: 1319959 - DNA, 17 bp, Homo sapiens
agtataaatttgtgtaa

SEQ ID NO: 1319960 - DNA, 14 bp, Homo sapiens
agtataccagagaa

SEQ ID NO: 1319961 - DNA, 15 bp, Homo sapiens
agtcattaacaagaa

SEQ ID NO: 1319962 - DNA, 23 bp, Homo sapiens
agtccaaaccttctaccctgggt

SEQ ID NO: 1319963 - DNA, 17 bp, Homo sapiens
agtccagatggcaggct

SEQ ID NO: 1319964 - DNA, 18 bp, Homo sapiens
agtccatgtcctatgcct

SEQ ID NO: 1319965 - DNA, 13 bp, Homo sapiens
agtcccacggctc

SEQ ID NO: 1319966 - DNA, 15 bp, Homo sapiens
agtcccacggctctg

SEQ ID NO: 1319967 - DNA, 16 bp, Homo sapiens
agtccccgtctgcctg

SEQ ID NO: 1319968 - DNA, 17 bp, Homo sapiens
agtccccgtctgcctgg

SEQ ID NO: 1319969 - DNA, 16 bp, Homo sapiens
agtccgccgctgcaca

SEQ ID NO: 1319970 - DNA, 19 bp, Homo sapiens
agtccggttcttcttgtct

SEQ ID NO: 1319971 - DNA, 17 bp, Homo sapiens
agtcctccttcccagct

SEQ ID NO: 1319972 - DNA, 18 bp, Homo sapiens
agtcctgtcagttcagaa

SEQ ID NO: 1319973 - DNA, 21 bp, Homo sapiens
agtccttaagcagaggaattg

SEQ ID NO: 1319974 - DNA, 16 bp, Homo sapiens
agtctactttagtatt

SEQ ID NO: 1319975 - DNA, 12 bp, Homo sapiens
agtctcagcctg

SEQ ID NO: 1319976 - DNA, 18 bp, Homo sapiens
agtctcagcctgggcccc

SEQ ID NO: 1319977 - DNA, 22 bp, Homo sapiens
agtctcagcctgggcccctcag

SEQ ID NO: 1319978 - DNA, 11 bp, Homo sapiens
agtcttctccc

SEQ ID NO: 1319979 - DNA, 21 bp, Homo sapiens
agtcttctcccaactcagcct

SEQ ID NO: 1319980 - DNA, 17 bp, Homo sapiens
agtcttgtgactagtgc

SEQ ID NO: 1319981 - DNA, 12 bp, Homo sapiens
agtgaggccact

SEQ ID NO: 1319982 - DNA, 14 bp, Homo sapiens
agtgcatgccagga

SEQ ID NO: 1319983 - DNA, 18 bp, Homo sapiens
agtgccgctcttggggac

SEQ ID NO: 1319984 - DNA, 12 bp, Homo sapiens
agtgctgaagct

SEQ ID NO: 1319985 - DNA, 13 bp, Homo sapiens
agtgctgaagctt

SEQ ID NO: 1319986 - DNA, 15 bp, Homo sapiens
agtgctgaagcttat

SEQ ID NO: 1319987 - DNA, 19 bp, Homo sapiens
agtggattgctcatctcag

SEQ ID NO: 1319988 - DNA, 15 bp, Homo sapiens
agtgggtttctgaca

SEQ ID NO: 1319989 - DNA, 16 bp, Homo sapiens
agtgttaatactgaga

SEQ ID NO: 1319990 - DNA, 23 bp, Homo sapiens
agttaaagtgaggccactgaaga

SEQ ID NO: 1319991 - DNA, 16 bp, Homo sapiens
agttaagattcttggt

SEQ ID NO: 1319992 - DNA, 18 bp, Homo sapiens
agttcacatgtgccctgc

SEQ ID NO: 1319993 - DNA, 16 bp, Homo sapiens
agttggcatgcatccc

SEQ ID NO: 1319994 - DNA, 15 bp, Homo sapiens
agtttaatacaggaa

SEQ ID NO: 1319995 - DNA, 23 bp, Homo sapiens
agtttccccaccagtgaatgaaa

SEQ ID NO: 1319996 - DNA, 22 bp, Homo sapiens
agttttcatgtgctcagaatta

SEQ ID NO: 1319997 - DNA, 22 bp, Homo sapiens
ataaaacagttggcatgcatcc

SEQ ID NO: 1319998 - DNA, 13 bp, Homo sapiens
ataaaactgatgt

SEQ ID NO: 1319999 - DNA, 16 bp, Homo sapiens
ataaaactgatgtgaa

SEQ ID NO: 1320000 - DNA, 16 bp, Homo sapiens
ataaaatatcattcag

SEQ ID NO: 1320001 - DNA, 16 bp, Homo sapiens
ataaaatattttctgt

SEQ ID NO: 1320002 - DNA, 12 bp, Homo sapiens
ataaaattacag

SEQ ID NO: 1320003 - DNA, 13 bp, Homo sapiens
ataaacagaaaat

SEQ ID NO: 1320004 - DNA, 17 bp, Homo sapiens
ataaacttgtgcctcca

SEQ ID NO: 1320005 - DNA, 20 bp, Homo sapiens
ataaacttgtgcctccaatg

SEQ ID NO: 1320006 - DNA, 18 bp, Homo sapiens
ataacaccaccattcaca

SEQ ID NO: 1320007 - DNA, 15 bp, Homo sapiens
ataactgacttagtt

SEQ ID NO: 1320008 - DNA, 16 bp, Homo sapiens
ataagccatgagaatg

SEQ ID NO: 1320009 - DNA, 18 bp, Homo sapiens
ataagccatgagaatgtt

SEQ ID NO: 1320010 - DNA, 20 bp, Homo sapiens
ataatgtcaacaccagaaag

SEQ ID NO: 1320011 - DNA, 14 bp, Homo sapiens
atacaaatgtttta

SEQ ID NO: 1320012 - DNA, 23 bp, Homo sapiens
atacagcaaacctaattgcacaa

SEQ ID NO: 1320013 - DNA, 21 bp, Homo sapiens
atacttaaaatatccactgga

SEQ ID NO: 1320014 - DNA, 19 bp, Homo sapiens
tgagttatgaaaagataac

SEQ ID NO: 1320015 - DNA, 19 bp, Homo sapiens
tgagttcacatgtgccctg

SEQ ID NO: 1320016 - DNA, 18 bp, Homo sapiens
tgataaaaggagaataag

SEQ ID NO: 1320017 - DNA, 15 bp, Homo sapiens
tgatataaacagctt

SEQ ID NO: 1320018 - DNA, 14 bp, Homo sapiens
tgatatgctgcttg

SEQ ID NO: 1320019 - DNA, 20 bp, Homo sapiens
tgatatgctgcttgtgacct

SEQ ID NO: 1320020 - DNA, 19 bp, Homo sapiens
tgatgaaataacacagcag

SEQ ID NO: 1320021 - DNA, 16 bp, Homo sapiens
tgatgcgcagttgctg

SEQ ID NO: 1320022 - DNA, 16 bp, Homo sapiens
tgatggaataaggagc

SEQ ID NO: 1320023 - DNA, 19 bp, Homo sapiens
tgatgggtggacctgtgta

SEQ ID NO: 1320024 - DNA, 12 bp, Homo sapiens
tgatgtactgta

SEQ ID NO: 1320025 - DNA, 18 bp, Homo sapiens
tgatttcttcttcattcc

SEQ ID NO: 1320026 - DNA, 12 bp, Homo sapiens
tgcaaaatggag

SEQ ID NO: 1320027 - DNA, 19 bp, Homo sapiens
tgcaaagtataaatttgtg

SEQ ID NO: 1320028 - DNA, 13 bp, Homo sapiens
tgcaactccagcg

SEQ ID NO: 1320029 - DNA, 12 bp, Homo sapiens
tgcaagaatgga

SEQ ID NO: 1320030 - DNA, 19 bp, Homo sapiens
tgcactgttcaggagtcca

SEQ ID NO: 1320031 - DNA, 20 bp, Homo sapiens
tgcagacctggctgggcctg

SEQ ID NO: 1320032 - DNA, 17 bp, Homo sapiens
tgcaggcacacacgcct

SEQ ID NO: 1320033 - DNA, 16 bp, Homo sapiens
tgcaggcaccgctggg

SEQ ID NO: 1320034 - DNA, 14 bp, Homo sapiens
tgcaggcccaggca

SEQ ID NO: 1320035 - DNA, 22 bp, Homo sapiens
tgcagtcatggagaaccaccta

SEQ ID NO: 1320036 - DNA, 15 bp, Homo sapiens
tgcattcaagagagg

SEQ ID NO: 1320037 - DNA, 18 bp, Homo sapiens
tgcattggataacaccac

SEQ ID NO: 1320038 - DNA, 22 bp, Homo sapiens
tgcattggataacaccaccatt

SEQ ID NO: 1320039 - DNA, 18 bp, Homo sapiens
tgcattgtgaattgcctg

SEQ ID NO: 1320040 - DNA, 23 bp, Homo sapiens
tgcattgtgaattgcctgccatg

SEQ ID NO: 1320041 - DNA, 14 bp, Homo sapiens
tgccatcttccata

SEQ ID NO: 1320042 - DNA, 21 bp, Homo sapiens
tgccatcttccatatccgggt

SEQ ID NO: 1320043 - DNA, 14 bp, Homo sapiens
tgccatgaaggcac

SEQ ID NO: 1320044 - DNA, 17 bp, Homo sapiens
tgccatgaaggcacctg

SEQ ID NO: 1320045 - DNA, 22 bp, Homo sapiens
tgccatgagtccatgtcctatg

SEQ ID NO: 1320046 - DNA, 23 bp, Homo sapiens
tgccatgagtccatgtcctatgc

SEQ ID NO: 1320047 - DNA, 14 bp, Homo sapiens
tgcccacaacgtcc

SEQ ID NO: 1320048 - DNA, 23 bp, Homo sapiens
tgcccacaacgtcccctcaagcc

SEQ ID NO: 1320049 - DNA, 15 bp, Homo sapiens
tgcccacacctcctg

SEQ ID NO: 1320050 - DNA, 14 bp, Homo sapiens
tgcccatgcctaaa

SEQ ID NO: 1320051 - DNA, 14 bp, Homo sapiens
tgccccacccatca

SEQ ID NO: 1320052 - DNA, 13 bp, Homo sapiens
tgccctgccttga

SEQ ID NO: 1320053 - DNA, 14 bp, Homo sapiens
tgcctaaagcccat

SEQ ID NO: 1320054 - DNA, 16 bp, Homo sapiens
tgcctaaagcccattg

SEQ ID NO: 1320055 - DNA, 17 bp, Homo sapiens
tgcctcacaaatgctgt

SEQ ID NO: 1320056 - DNA, 19 bp, Homo sapiens
tgcctcacaaatgctgtgg

SEQ ID NO: 1320057 - DNA, 14 bp, Homo sapiens
tgcctgccatggct

SEQ ID NO: 1320058 - DNA, 16 bp, Homo sapiens
tgcctgccatggctgt

SEQ ID NO: 1320059 - DNA, 18 bp, Homo sapiens
tgcctgccatggctgtga

SEQ ID NO: 1320060 - DNA, 19 bp, Homo sapiens
tgcctgccatggctgtgac

SEQ ID NO: 1320061 - DNA, 22 bp, Homo sapiens
tgccttcattgaggaaggaaat

SEQ ID NO: 1320062 - DNA, 17 bp, Homo sapiens
tgcgtgccatgagtcca

SEQ ID NO: 1320063 - DNA, 14 bp, Homo sapiens
tgctaccttgcccc

SEQ ID NO: 1320064 - DNA, 18 bp, Homo sapiens
tgctactgaaaaaaatgg

SEQ ID NO: 1320065 - DNA, 19 bp, Homo sapiens
tgctactgaaaaaaatgga

SEQ ID NO: 1320066 - DNA, 22 bp, Homo sapiens
tgctcaaccagacagatagtga

SEQ ID NO: 1320067 - DNA, 23 bp, Homo sapiens
tgctctcctcgggccctgtggtg

SEQ ID NO: 1320068 - DNA, 19 bp, Homo sapiens
tgctctctgaggcaaggcc

SEQ ID NO: 1320069 - DNA, 16 bp, Homo sapiens
tgctctgcccatgcct

SEQ ID NO: 1320070 - DNA, 17 bp, Homo sapiens
tgctctgcccatgccta

SEQ ID NO: 1320071 - DNA, 21 bp, Homo sapiens
tgctctttcttcttccacaca

SEQ ID NO: 1320072 - DNA, 17 bp, Homo sapiens
tgctgagacatccctca

SEQ ID NO: 1320073 - DNA, 11 bp, Homo sapiens
tgctgagggtc

SEQ ID NO: 1320074 - DNA, 12 bp, Homo sapiens
tgctgagggtcc

SEQ ID NO: 1320075 - DNA, 15 bp, Homo sapiens
tgctgcttgtgacct

SEQ ID NO: 1320076 - DNA, 21 bp, Homo sapiens
tgctggagaaaccttcactcc

SEQ ID NO: 1320077 - DNA, 23 bp, Homo sapiens
tgctggctgatgggtggacctgt

SEQ ID NO: 1320078 - DNA, 22 bp, Homo sapiens
tgctgggagatgctctctgagg

SEQ ID NO: 1320079 - DNA, 21 bp, Homo sapiens
tgctgtggttcactgcactgt

SEQ ID NO: 1320080 - DNA, 16 bp, Homo sapiens
tgctgtgtgaaatctt

SEQ ID NO: 1320081 - DNA, 17 bp, Homo sapiens
tgctgtgtgaaatcttt

SEQ ID NO: 1320082 - DNA, 19 bp, Homo sapiens
tgctgtgtgaaatctttca

SEQ ID NO: 1320083 - DNA, 23 bp, Homo sapiens
tgcttcccttttttcctttccac

SEQ ID NO: 1320084 - DNA, 13 bp, Homo sapiens
tgcttgtgacctt

SEQ ID NO: 1320085 - DNA, 15 bp, Homo sapiens
tgctttaagacagaa

SEQ ID NO: 1320086 - DNA, 22 bp, Homo sapiens
tgctttaagacagaattcactg

SEQ ID NO: 1320087 - DNA, 22 bp, Homo sapiens
tggaaaaagtaagaggactact

SEQ ID NO: 1320088 - DNA, 16 bp, Homo sapiens
tggaaactaataaaat

SEQ ID NO: 1320089 - DNA, 15 bp, Homo sapiens
tggaattgatgttta

SEQ ID NO: 1320090 - DNA, 17 bp, Homo sapiens
tggacacttaattctgt

SEQ ID NO: 1320091 - DNA, 14 bp, Homo sapiens
tggaccatgctgag

SEQ ID NO: 1320092 - DNA, 23 bp, Homo sapiens
tggaccatgctgagacatccctc

SEQ ID NO: 1320093 - DNA, 11 bp, Homo sapiens
tggactttgtt

SEQ ID NO: 1320094 - DNA, 14 bp, Homo sapiens
tggactttgttaca

SEQ ID NO: 1320095 - DNA, 15 bp, Homo sapiens
tggactttgttacac

SEQ ID NO: 1320096 - DNA, 22 bp, Homo sapiens
tggagaaaccttcactccagac

SEQ ID NO: 1320097 - DNA, 14 bp, Homo sapiens
tggagaaccaccta

SEQ ID NO: 1320098 - DNA, 23 bp, Homo sapiens
tggaggttacagtgagctgagag

SEQ ID NO: 1320099 - DNA, 17 bp, Homo sapiens
tggagtaggcctggggc

SEQ ID NO: 1320100 - DNA, 12 bp, Homo sapiens
tggagtgccttc

SEQ ID NO: 1320101 - DNA, 15 bp, Homo sapiens
tggataacaccacca

SEQ ID NO: 1320102 - DNA, 18 bp, Homo sapiens
tggatttactgagagaag

SEQ ID NO: 1320103 - DNA, 22 bp, Homo sapiens
tggcaggtgatgtcctgtaaac

SEQ ID NO: 1320104 - DNA, 19 bp, Homo sapiens
tggccaccccttgctctct

SEQ ID NO: 1320105 - DNA, 20 bp, Homo sapiens
tggccaccccttgctctctg

SEQ ID NO: 1320106 - DNA, 23 bp, Homo sapiens
tggcccatcccgccttctccagg

SEQ ID NO: 1320107 - DNA, 17 bp, Homo sapiens
tggcctctctccactac

SEQ ID NO: 1320108 - DNA, 18 bp, Homo sapiens
tggcctctgccatcctcc

SEQ ID NO: 1320109 - DNA, 19 bp, Homo sapiens
tggccttgtggtccaaata

SEQ ID NO: 1320110 - DNA, 12 bp, Homo sapiens
tggctcccctgc

SEQ ID NO: 1320111 - DNA, 14 bp, Homo sapiens
tggctcccctgcag

SEQ ID NO: 1320112 - DNA, 19 bp, Homo sapiens
tggctcccctgcagccctg

SEQ ID NO: 1320113 - DNA, 22 bp, Homo sapiens
tggctcccctgcagccctggcc

SEQ ID NO: 1320114 - DNA, 24 bp, Homo sapiens
tggctcccctgcagccctggccca

SEQ ID NO: 1320115 - DNA, 13 bp, Homo sapiens
tggctcccctggg

SEQ ID NO: 1320116 - DNA, 14 bp, Homo sapiens
tggctcccctgggg

SEQ ID NO: 1320117 - DNA, 15 bp, Homo sapiens
tggctcccctggggt

SEQ ID NO: 1320118 - DNA, 16 bp, Homo sapiens
tggctcctcccagcac

SEQ ID NO: 1320119 - DNA, 12 bp, Homo sapiens
tggctgcaggca

SEQ ID NO: 1320120 - DNA, 19 bp, Homo sapiens
tggctgcaggcaccgctgg

SEQ ID NO: 1320121 - DNA, 12 bp, Homo sapiens
tggcttcctggc

SEQ ID NO: 1320122 - DNA, 21 bp, Homo sapiens
tggcttgctcccgccccaggg

SEQ ID NO: 1320123 - DNA, 16 bp, Homo sapiens
tgggaagtctcagcct

SEQ ID NO: 1320124 - DNA, 21 bp, Homo sapiens
tgggactaaagccaggaacag

SEQ ID NO: 1320125 - DNA, 12 bp, Homo sapiens
tgggcccctcag

SEQ ID NO: 1320126 - DNA, 13 bp, Homo sapiens
tgggcccctcagc

SEQ ID NO: 1320127 - DNA, 15 bp, Homo sapiens
tgggcccctcagcca

SEQ ID NO: 1320128 - DNA, 15 bp, Homo sapiens
tgggctctcgcggcc

SEQ ID NO: 1320129 - DNA, 14 bp, Homo sapiens
tgggcttccacagt

SEQ ID NO: 1320130 - DNA, 13 bp, Homo sapiens
tggggcccaaatg

SEQ ID NO: 1320131 - DNA, 14 bp, Homo sapiens
tggggcccaaatgc

SEQ ID NO: 1320132 - DNA, 20 bp, Homo sapiens
tggggcctaataaaactgat

SEQ ID NO: 1320133 - DNA, 17 bp, Homo sapiens
tggggcgcgtgaggccc

SEQ ID NO: 1320134 - DNA, 14 bp, Homo sapiens
tggggcttctttct

SEQ ID NO: 1320135 - DNA, 19 bp, Homo sapiens
tggggcttctttctgctgg

SEQ ID NO: 1320136 - DNA, 23 bp, Homo sapiens
tggggcttctttctgctggctga

SEQ ID NO: 1320137 - DNA, 18 bp, Homo sapiens
tgggtcctcgggcccctg

SEQ ID NO: 1320138 - DNA, 20 bp, Homo sapiens
tgggtcctcgggcccctgag

SEQ ID NO: 1320139 - DNA, 14 bp, Homo sapiens
tgtagtttaataca

SEQ ID NO: 1320140 - DNA, 22 bp, Homo sapiens
tgtcaatcatatttaaagggaa

SEQ ID NO: 1320141 - DNA, 22 bp, Homo sapiens
tgtcccactggctcctcccagc

SEQ ID NO: 1320142 - DNA, 15 bp, Homo sapiens
tgtcccccaacttca

SEQ ID NO: 1320143 - DNA, 12 bp, Homo sapiens
tgtcctatgcct

SEQ ID NO: 1320144 - DNA, 20 bp, Homo sapiens
tgtcctgtaaacactcagct

SEQ ID NO: 1320145 - DNA, 21 bp, Homo sapiens
tgtctattatgtacaggacat

SEQ ID NO: 1320146 - DNA, 12 bp, Homo sapiens
tgtctgtcttcc

SEQ ID NO: 1320147 - DNA, 17 bp, Homo sapiens
tgtcttcctttgcttcc

SEQ ID NO: 1320148 - DNA, 13 bp, Homo sapiens
tgtctttgtccct

SEQ ID NO: 1320149 - DNA, 12 bp, Homo sapiens
tgtgaagacact

SEQ ID NO: 1320150 - DNA, 16 bp, Homo sapiens
tgtgaattgcctgcca

SEQ ID NO: 1320151 - DNA, 21 bp, Homo sapiens
tgtgacacagacggaggactg

SEQ ID NO: 1320152 - DNA, 22 bp, Homo sapiens
tgtgaccttgacttgccatgaa

SEQ ID NO: 1320153 - DNA, 15 bp, Homo sapiens
tgtgactagtgctga

SEQ ID NO: 1320154 - DNA, 19 bp, Homo sapiens
tgtgactagtgctgaagct

SEQ ID NO: 1320155 - DNA, 17 bp, Homo sapiens
tgtgatggtatttgaga

SEQ ID NO: 1320156 - DNA, 20 bp, Homo sapiens
tgtgcaggcccaggcaggcc

SEQ ID NO: 1320157 - DNA, 14 bp, Homo sapiens
tgtgctcagaatta

SEQ ID NO: 1320158 - DNA, 18 bp, Homo sapiens
tgtggacctcaccagaga

SEQ ID NO: 1320159 - DNA, 22 bp, Homo sapiens
tgtggacctcaccagagaccag

SEQ ID NO: 1320160 - DNA, 13 bp, Homo sapiens
tgtggggggaggc

SEQ ID NO: 1320161 - DNA, 23 bp, Homo sapiens
tgtggtgatgtacgctgcgtgcc

SEQ ID NO: 1320162 - DNA, 18 bp, Homo sapiens
tgtggttttctgtttcta

SEQ ID NO: 1320163 - DNA, 23 bp, Homo sapiens
tgtgtatggtgacctctccggcc

SEQ ID NO: 1320164 - DNA, 16 bp, Homo sapiens
tgtgtcttaaatactt

SEQ ID NO: 1320165 - DNA, 14 bp, Homo sapiens
tgtgtgttcctggc

SEQ ID NO: 1320166 - DNA, 13 bp, Homo sapiens
tgttaagaataac

SEQ ID NO: 1320167 - DNA, 18 bp, Homo sapiens
tgttagactatagcccct

SEQ ID NO: 1320168 - DNA, 21 bp, Homo sapiens
tgttatttatccctcattcat

SEQ ID NO: 1320169 - DNA, 20 bp, Homo sapiens
tgttccccacaggtcctcca

SEQ ID NO: 1320170 - DNA, 23 bp, Homo sapiens
tgttccccacaggtcctccatca

SEQ ID NO: 1320171 - DNA, 21 bp, Homo sapiens
tgttccttcctgcagacctgg

SEQ ID NO: 1320172 - DNA, 22 bp, Homo sapiens
tgttccttcctgcagacctggc

SEQ ID NO: 1320173 - DNA, 18 bp, Homo sapiens
tgttggtcatctctcctg

SEQ ID NO: 1320174 - DNA, 20 bp, Homo sapiens
tgttggtcatctctcctgtg

SEQ ID NO: 1320175 - DNA, 20 bp, Homo sapiens
tgttgtttcttaatttggaa

SEQ ID NO: 1320176 - DNA, 15 bp, Homo sapiens
tgtttcttaatttgg

SEQ ID NO: 1320177 - DNA, 21 bp, Homo sapiens
tgtttttttagggtttctgat

SEQ ID NO: 1320178 - DNA, 21 bp, Homo sapiens
ttaaaaaaaatcatcattatt

SEQ ID NO: 1320179 - DNA, 17 bp, Homo sapiens
ttaaaaattgtctcttt

SEQ ID NO: 1320180 - DNA, 19 bp, Homo sapiens
ttaaaactaggcatttgta

SEQ ID NO: 1320181 - DNA, 21 bp, Homo sapiens
ttaaaactaggcatttgtaaa

SEQ ID NO: 1320182 - DNA, 22 bp, Homo sapiens
ttaaaactaggcatttgtaaat

SEQ ID NO: 1320183 - DNA, 20 bp, Homo sapiens
ttaaagtgaggccactgaag

SEQ ID NO: 1320184 - DNA, 20 bp, Homo sapiens
ttaaatgacctcagatcttt

SEQ ID NO: 1320185 - DNA, 17 bp, Homo sapiens
ttaatactgagaaaaag

SEQ ID NO: 1320186 - DNA, 13 bp, Homo sapiens
ttaatgctaaggg

SEQ ID NO: 1320187 - DNA, 20 bp, Homo sapiens
ttaatttggaaactaataaa

SEQ ID NO: 1320188 - DNA, 21 bp, Homo sapiens
ttacactgttattttcagcat

SEQ ID NO: 1320189 - DNA, 14 bp, Homo sapiens
ttactgagagaagg

SEQ ID NO: 1320190 - DNA, 23 bp, Homo sapiens
ttacttgcaaaatggagaccaaa

SEQ ID NO: 1320191 - DNA, 17 bp, Homo sapiens
ttacttggaaatattaa

SEQ ID NO: 1320192 - DNA, 15 bp, Homo sapiens
ttactttaacatgcc

SEQ ID NO: 1320193 - DNA, 13 bp, Homo sapiens
ttagaaaggttaa

SEQ ID NO: 1320194 - DNA, 17 bp, Homo sapiens
ttagactatagcccctg

SEQ ID NO: 1320195 - DNA, 18 bp, Homo sapiens
ttagactatagcccctgg

SEQ ID NO: 1320196 - DNA, 15 bp, Homo sapiens
ttagggtttctgatt

SEQ ID NO: 1320197 - DNA, 16 bp, Homo sapiens
ttagtataccagagaa

SEQ ID NO: 1320198 - DNA, 20 bp, Homo sapiens
ttagtcttgctgtttcttga

SEQ ID NO: 1320199 - DNA, 14 bp, Homo sapiens
ttatagcttcagga

SEQ ID NO: 1320200 - DNA, 21 bp, Homo sapiens
ttatcttctgctctttcttct

SEQ ID NO: 1320201 - DNA, 15 bp, Homo sapiens
ttatgaaaagataac

SEQ ID NO: 1320202 - DNA, 20 bp, Homo sapiens
ttatgtatctaatttcattc

SEQ ID NO: 1320203 - DNA, 15 bp, Homo sapiens
ttattaatgctaagg

SEQ ID NO: 1320204 - DNA, 20 bp, Homo sapiens
ttattatttgcagtcatgga

SEQ ID NO: 1320205 - DNA, 21 bp, Homo sapiens
ttattctaacaaaaagcaatt

SEQ ID NO: 1320206 - DNA, 19 bp, Homo sapiens
ttatttatccctcattcat

SEQ ID NO: 1320207 - DNA, 15 bp, Homo sapiens
ttcaaacctgtgaag

SEQ ID NO: 1320208 - DNA, 17 bp, Homo sapiens
ttcaacttatttaaatg

SEQ ID NO: 1320209 - DNA, 16 bp, Homo sapiens
ttcaatcaacatctct

SEQ ID NO: 1320210 - DNA, 14 bp, Homo sapiens
ttcaattatttccc

SEQ ID NO: 1320211 - DNA, 17 bp, Homo sapiens
ttcaattatttccccca

SEQ ID NO: 1320212 - DNA, 11 bp, Homo sapiens
ttcacagcctc

SEQ ID NO: 1320213 - DNA, 14 bp, Homo sapiens
ttcacagcctccgc

SEQ ID NO: 1320214 - DNA, 15 bp, Homo sapiens
ttcacatgtgccctg

SEQ ID NO: 1320215 - DNA, 17 bp, Homo sapiens
ttcacatgtgccctgcc

SEQ ID NO: 1320216 - DNA, 22 bp, Homo sapiens
ttcaccaatttcctttaaaaca

SEQ ID NO: 1320217 - DNA, 17 bp, Homo sapiens
ttcactgtctgttgctt

SEQ ID NO: 1320218 - DNA, 19 bp, Homo sapiens
ttcagaaaaaatgtgaagt

SEQ ID NO: 1320219 - DNA, 20 bp, Homo sapiens
ttcagcaagtagagcagagt

SEQ ID NO: 1320220 - DNA, 13 bp, Homo sapiens
ttcagccttcaat

SEQ ID NO: 1320221 - DNA, 22 bp, Homo sapiens
ttcatcagaacagctgttgact

SEQ ID NO: 1320222 - DNA, 13 bp, Homo sapiens
ttcatctggaagt

SEQ ID NO: 1320223 - DNA, 23 bp, Homo sapiens
ttcatgaaaatctgccactcagg

SEQ ID NO: 1320224 - DNA, 23 bp, Homo sapiens
ttcatgagctactcatgactgaa

SEQ ID NO: 1320225 - DNA, 18 bp, Homo sapiens
ttcatgccagtgcatgcc

SEQ ID NO: 1320226 - DNA, 13 bp, Homo sapiens
ttccacacatgca

SEQ ID NO: 1320227 - DNA, 20 bp, Homo sapiens
ttccatgttttgttttcttg

SEQ ID NO: 1320228 - DNA, 18 bp, Homo sapiens
ttcccaggcaaataaaat

SEQ ID NO: 1320229 - DNA, 20 bp, Homo sapiens
ttcccaggcaaataaaattc

SEQ ID NO: 1320230 - DNA, 21 bp, Homo sapiens
ttcccctcccagccctgaggg

SEQ ID NO: 1320231 - DNA, 18 bp, Homo sapiens
ttcctaggggaatgaggg

SEQ ID NO: 1320232 - DNA, 20 bp, Homo sapiens
ttcctgaggtggatttactg

SEQ ID NO: 1320233 - DNA, 14 bp, Homo sapiens
ttccttcctgcaga

SEQ ID NO: 1320234 - DNA, 17 bp, Homo sapiens
ttccttttgctgtgtga

SEQ ID NO: 1320235 - DNA, 19 bp, Homo sapiens
ttcgaaacctgtgatttct

SEQ ID NO: 1320236 - DNA, 21 bp, Homo sapiens
ttctaaatatttatttattct

SEQ ID NO: 1320237 - DNA, 22 bp, Homo sapiens
ttctaatttgctgctgataatg

SEQ ID NO: 1320238 - DNA, 19 bp, Homo sapiens
ttctatcctgtgaggcttt

SEQ ID NO: 1320239 - DNA, 20 bp, Homo sapiens
ttctcacatggaatgagggt

SEQ ID NO: 1320240 - DNA, 12 bp, Homo sapiens
ttctccaggctt

SEQ ID NO: 1320241 - DNA, 13 bp, Homo sapiens
ttctgctggctga

SEQ ID NO: 1320242 - DNA, 23 bp, Homo sapiens
ttctggaattgatgtttacatgt

SEQ ID NO: 1320243 - DNA, 10 bp, Homo sapiens
ttctgtgtgt

SEQ ID NO: 1320244 - DNA, 13 bp, Homo sapiens
ttctgtgtgttcc

SEQ ID NO: 1320245 - DNA, 14 bp, Homo sapiens
ttctgtgtgttcct

SEQ ID NO: 1320246 - DNA, 23 bp, Homo sapiens
ttctgtttctaatttgctgctga

SEQ ID NO: 1320247 - DNA, 17 bp, Homo sapiens
ttcttaatttggaaact

SEQ ID NO: 1320248 - DNA, 22 bp, Homo sapiens
ttcttaatttggaaactaataa

SEQ ID NO: 1320249 - DNA, 14 bp, Homo sapiens
ttcttgctgcccac

SEQ ID NO: 1320250 - DNA, 15 bp, Homo sapiens
ttcttgctgcccaca

SEQ ID NO: 1320251 - DNA, 19 bp, Homo sapiens
ttcttggacacttaattct

SEQ ID NO: 1320252 - DNA, 21 bp, Homo sapiens
ttcttggacacttaattctgt

SEQ ID NO: 1320253 - DNA, 18 bp, Homo sapiens
ttgaatgttaagaataac

SEQ ID NO: 1320254 - DNA, 23 bp, Homo sapiens
ttgaattgcattttttaaaacaa

SEQ ID NO: 1320255 - DNA, 12 bp, Homo sapiens
ttgactggcttg

SEQ ID NO: 1320256 - DNA, 20 bp, Homo sapiens
ttgccatgaaggcacctgcc

SEQ ID NO: 1320257 - DNA, 13 bp, Homo sapiens
ttgcctgccatgg

SEQ ID NO: 1320258 - DNA, 23 bp, Homo sapiens
ttgctcatctcagtcctcaaagc

SEQ ID NO: 1320259 - DNA, 16 bp, Homo sapiens
ttgctctctgttctct

SEQ ID NO: 1320260 - DNA, 21 bp, Homo sapiens
ttgctctctgttctcttgctt

SEQ ID NO: 1320261 - DNA, 17 bp, Homo sapiens
ttgctgtgtgaaatctt

SEQ ID NO: 1320262 - DNA, 18 bp, Homo sapiens
ttgctgtgtgaaatcttt

SEQ ID NO: 1320263 - DNA, 12 bp, Homo sapiens
ttgcttttgtgc

SEQ ID NO: 1320264 - DNA, 15 bp, Homo sapiens
ttggaaactaataaa

SEQ ID NO: 1320265 - DNA, 17 bp, Homo sapiens
ttggaaactaataaaat

SEQ ID NO: 1320266 - DNA, 19 bp, Homo sapiens
ttggaaactaataaaatat

SEQ ID NO: 1320267 - DNA, 14 bp, Homo sapiens
ttggaaatattaaa

SEQ ID NO: 1320268 - DNA, 14 bp, Homo sapiens
ttggactttgttac

SEQ ID NO: 1320269 - DNA, 22 bp, Homo sapiens
ttggccaccccttgctctctgt

SEQ ID NO: 1320270 - DNA, 23 bp, Homo sapiens
ttggcccatcccgccttctccag

SEQ ID NO: 1320271 - DNA, 19 bp, Homo sapiens
ttgggaagtctcagcctgg

SEQ ID NO: 1320272 - DNA, 13 bp, Homo sapiens
ttggtaagggaag

SEQ ID NO: 1320273 - DNA, 20 bp, Homo sapiens
ttggtatttggatatctgtt

SEQ ID NO: 1320274 - DNA, 15 bp, Homo sapiens
gtttaatacaggaac

SEQ ID NO: 1320275 - DNA, 15 bp, Homo sapiens
gtttccccaccagtg

SEQ ID NO: 1320276 - DNA, 20 bp, Homo sapiens
gtttccccaccagtgaatga

SEQ ID NO: 1320277 - DNA, 18 bp, Homo sapiens
gtttctaatttgctgctg

SEQ ID NO: 1320278 - DNA, 15 bp, Homo sapiens
gtttcttaatttgga

SEQ ID NO: 1320279 - DNA, 14 bp, Homo sapiens
gtttctttgaagaa

SEQ ID NO: 1320280 - DNA, 22 bp, Homo sapiens
gtttgaaatatggaactgtaat

SEQ ID NO: 1320281 - DNA, 10 bp, Homo sapiens
gttttcaaag

SEQ ID NO: 1320282 - DNA, 20 bp, Homo sapiens
gtttttttagggtttctgat

SEQ ID NO: 1320283 - DNA, 22 bp, Homo sapiens
taaaaagataaaaaaacagctt

SEQ ID NO: 1320284 - DNA, 18 bp, Homo sapiens
taaaacaagaaagtttcc

SEQ ID NO: 1320285 - DNA, 14 bp, Homo sapiens
taaaacatttctct

SEQ ID NO: 1320286 - DNA, 15 bp, Homo sapiens
taaaagaaagggttc

SEQ ID NO: 1320287 - DNA, 16 bp, Homo sapiens
taaaagcaacatcagc

SEQ ID NO: 1320288 - DNA, 15 bp, Homo sapiens
taaaaggagaataag

SEQ ID NO: 1320289 - DNA, 14 bp, Homo sapiens
taaaagtcttctcc

SEQ ID NO: 1320290 - DNA, 17 bp, Homo sapiens
taaaatatcattcagca

SEQ ID NO: 1320291 - DNA, 18 bp, Homo sapiens
taaaatatcattcagcaa

SEQ ID NO: 1320292 - DNA, 15 bp, Homo sapiens
taaaatattttctgt

SEQ ID NO: 1320293 - DNA, 19 bp, Homo sapiens
taaaatattttctgtgtgt

SEQ ID NO: 1320294 - DNA, 24 bp, Homo sapiens
taaaatattttctgtgtgttcctg

SEQ ID NO: 1320295 - DNA, 12 bp, Homo sapiens
taaacactcagc

SEQ ID NO: 1320296 - DNA, 17 bp, Homo sapiens
taaacactcagctgttc

SEQ ID NO: 1320297 - DNA, 22 bp, Homo sapiens
taaacactcagctgttcagatt

SEQ ID NO: 1320298 - DNA, 13 bp, Homo sapiens
taaacttgtgcct

SEQ ID NO: 1320299 - DNA, 16 bp, Homo sapiens
taaacttgtgcctcca

SEQ ID NO: 1320300 - DNA, 22 bp, Homo sapiens
taaacttgtgcctccaatgtgg

SEQ ID NO: 1320301 - DNA, 15 bp, Homo sapiens
taaagagtcctcctt

SEQ ID NO: 1320302 - DNA, 14 bp, Homo sapiens
taaagccaggaaca

SEQ ID NO: 1320303 - DNA, 20 bp, Homo sapiens
taaaggcctctgcctcacaa

SEQ ID NO: 1320304 - DNA, 15 bp, Homo sapiens
taaataatgtacata

SEQ ID NO: 1320305 - DNA, 16 bp, Homo sapiens
taaatactttaatgtt

SEQ ID NO: 1320306 - DNA, 19 bp, Homo sapiens
taaatgacctcagatcttt

SEQ ID NO: 1320307 - DNA, 19 bp, Homo sapiens
taaatggcctctctccact

SEQ ID NO: 1320308 - DNA, 18 bp, Homo sapiens
taacatgctgtgtaagct

SEQ ID NO: 1320309 - DNA, 21 bp, Homo sapiens
taacatgctgtgtaagctgtg

SEQ ID NO: 1320310 - DNA, 22 bp, Homo sapiens
taacatgctgtgtaagctgtgt

SEQ ID NO: 1320311 - DNA, 22 bp, Homo sapiens
taaccatgatggaataaggagc

SEQ ID NO: 1320312 - DNA, 15 bp, Homo sapiens
taactgacttagttc

SEQ ID NO: 1320313 - DNA, 13 bp, Homo sapiens
taactggcccaga

SEQ ID NO: 1320314 - DNA, 15 bp, Homo sapiens
taactggcccagaag

SEQ ID NO: 1320315 - DNA, 19 bp, Homo sapiens
taagaatggtctcagtgtt

SEQ ID NO: 1320316 - DNA, 13 bp, Homo sapiens
taagattcttggt

SEQ ID NO: 1320317 - DNA, 13 bp, Homo sapiens
taagccatgagaa

SEQ ID NO: 1320318 - DNA, 17 bp, Homo sapiens
taagccatgagaatgtt

SEQ ID NO: 1320319 - DNA, 17 bp, Homo sapiens
taataaaatatcattca

SEQ ID NO: 1320320 - DNA, 17 bp, Homo sapiens
taataaaatattttctg

SEQ ID NO: 1320321 - DNA, 16 bp, Homo sapiens
taatactgagaaaaag

SEQ ID NO: 1320322 - DNA, 21 bp, Homo sapiens
taatggtgggttttttttctg

SEQ ID NO: 1320323 - DNA, 22 bp, Homo sapiens
taatgtatatgaacttaacatg

SEQ ID NO: 1320324 - DNA, 17 bp, Homo sapiens
taattcaccaatttcct

SEQ ID NO: 1320325 - DNA, 11 bp, Homo sapiens
taatttggaaa

SEQ ID NO: 1320326 - DNA, 21 bp, Homo sapiens
taatttggaaactaataaaat

SEQ ID NO: 1320327 - DNA, 13 bp, Homo sapiens
tacaatcagctgc

SEQ ID NO: 1320328 - DNA, 14 bp, Homo sapiens
tacaatcagctgct

SEQ ID NO: 1320329 - DNA, 16 bp, Homo sapiens
tacaatcagctgcttt

SEQ ID NO: 1320330 - DNA, 19 bp, Homo sapiens
tacaatcagctgctttgtt

SEQ ID NO: 1320331 - DNA, 22 bp, Homo sapiens
tacaatcagctgctttgttacc

SEQ ID NO: 1320332 - DNA, 15 bp, Homo sapiens
tacaattcattgtga

SEQ ID NO: 1320333 - DNA, 22 bp, Homo sapiens
tacacggttcaaacctgtgaag

SEQ ID NO: 1320334 - DNA, 15 bp, Homo sapiens
tacactgttattttc

SEQ ID NO: 1320335 - DNA, 22 bp, Homo sapiens
tacaggacatgtactgagacaa

SEQ ID NO: 1320336 - DNA, 15 bp, Homo sapiens
tacatcttgtttctg

SEQ ID NO: 1320337 - DNA, 16 bp, Homo sapiens
tacattctgctctgcc

SEQ ID NO: 1320338 - DNA, 13 bp, Homo sapiens
taccagagaaggt

SEQ ID NO: 1320339 - DNA, 20 bp, Homo sapiens
taccctgggtcctcgggccc

SEQ ID NO: 1320340 - DNA, 23 bp, Homo sapiens
tacctcgttagagaatggcctga

SEQ ID NO: 1320341 - DNA, 15 bp, Homo sapiens
taccttgccccaacc

SEQ ID NO: 1320342 - DNA, 16 bp, Homo sapiens
taccttgccccaaccc

SEQ ID NO: 1320343 - DNA, 20 bp, Homo sapiens
taccttgccccaacccttct

SEQ ID NO: 1320344 - DNA, 23 bp, Homo sapiens
taccttgccccaacccttcttca

SEQ ID NO: 1320345 - DNA, 17 bp, Homo sapiens
tacgaagccacaggcct

SEQ ID NO: 1320346 - DNA, 19 bp, Homo sapiens
tacgaagccacaggcctgg

SEQ ID NO: 1320347 - DNA, 21 bp, Homo sapiens
tacgcattaagggcctgctgg

SEQ ID NO: 1320348 - DNA, 14 bp, Homo sapiens
tactacaaatggat

SEQ ID NO: 1320349 - DNA, 16 bp, Homo sapiens
tactacaaatggatga

SEQ ID NO: 1320350 - DNA, 17 bp, Homo sapiens
tactacaaatggatgac

SEQ ID NO: 1320351 - DNA, 14 bp, Homo sapiens
tactgacccagagg

SEQ ID NO: 1320352 - DNA, 19 bp, Homo sapiens
tactgagacaaaaaggaaa

SEQ ID NO: 1320353 - DNA, 22 bp, Homo sapiens
tacttatttatgaacagacttt

SEQ ID NO: 1320354 - DNA, 21 bp, Homo sapiens
tacttggaaatattaaaagaa

SEQ ID NO: 1320355 - DNA, 22 bp, Homo sapiens
tagactatagcccctggtgtgt

SEQ ID NO: 1320356 - DNA, 13 bp, Homo sapiens
tagatacaatcag

SEQ ID NO: 1320357 - DNA, 19 bp, Homo sapiens
tagatacaatcagctgctt

SEQ ID NO: 1320358 - DNA, 16 bp, Homo sapiens
tagatgaagaaagaga

SEQ ID NO: 1320359 - DNA, 17 bp, Homo sapiens
tagatgggactgtgtcc

SEQ ID NO: 1320360 - DNA, 13 bp, Homo sapiens
tagattttaagaa

SEQ ID NO: 1320361 - DNA, 17 bp, Homo sapiens
tagccctgttgacctgc

SEQ ID NO: 1320362 - DNA, 18 bp, Homo sapiens
tagccctgttgacctgcc

SEQ ID NO: 1320363 - DNA, 15 bp, Homo sapiens
tagcgaatgcactca

SEQ ID NO: 1320364 - DNA, 13 bp, Homo sapiens
taggagacttgta

SEQ ID NO: 1320365 - DNA, 12 bp, Homo sapiens
taggcatttgta

SEQ ID NO: 1320366 - DNA, 13 bp, Homo sapiens
taggcctggggct

SEQ ID NO: 1320367 - DNA, 12 bp, Homo sapiens
taggctggaagg

SEQ ID NO: 1320368 - DNA, 17 bp, Homo sapiens
tagtaaaaaagagaatt

SEQ ID NO: 1320369 - DNA, 19 bp, Homo sapiens
tagtaaaaaagagaattgt

SEQ ID NO: 1320370 - DNA, 14 bp, Homo sapiens
tagtactgtgaatc

SEQ ID NO: 1320371 - DNA, 16 bp, Homo sapiens
tagtataccagagaag

SEQ ID NO: 1320372 - DNA, 16 bp, Homo sapiens
tagtcttgctgtttct

SEQ ID NO: 1320373 - DNA, 12 bp, Homo sapiens
tagtgctgaagc

SEQ ID NO: 1320374 - DNA, 18 bp, Homo sapiens
tagtgctgaagcttatta

SEQ ID NO: 1320375 - DNA, 16 bp, Homo sapiens
tagtttgggggaactt

SEQ ID NO: 1320376 - DNA, 21 bp, Homo sapiens
tataaaaattagccgggcttt

SEQ ID NO: 1320377 - DNA, 12 bp, Homo sapiens
tataaacagctt

SEQ ID NO: 1320378 - DNA, 15 bp, Homo sapiens
tataaatttgtgtaa

SEQ ID NO: 1320379 - DNA, 21 bp, Homo sapiens
tatagcccctggtgtgtaaat

SEQ ID NO: 1320380 - DNA, 17 bp, Homo sapiens
tataggagacttgtagt

SEQ ID NO: 1320381 - DNA, 13 bp, Homo sapiens
tatattgttttcc

SEQ ID NO: 1320382 - DNA, 13 bp, Homo sapiens
tatcaagctaata

SEQ ID NO: 1320383 - DNA, 23 bp, Homo sapiens
tatcaagctaataaaatatcatt

SEQ ID NO: 1320384 - DNA, 15 bp, Homo sapiens
tatcagattgctttt

SEQ ID NO: 1320385 - DNA, 17 bp, Homo sapiens
tatcagattgcttttgt

SEQ ID NO: 1320386 - DNA, 19 bp, Homo sapiens
tatccctgcacataaactc

SEQ ID NO: 1320387 - DNA, 23 bp, Homo sapiens
tatccgggtgctcaataaacttg

SEQ ID NO: 1320388 - DNA, 17 bp, Homo sapiens
tatcttctgctctttct

SEQ ID NO: 1320389 - DNA, 15 bp, Homo sapiens
tatgaacttaacatg

SEQ ID NO: 1320390 - DNA, 19 bp, Homo sapiens
tatgaacttaacatgctgt

SEQ ID NO: 1320391 - DNA, 23 bp, Homo sapiens
tatgaacttaacatgctgtgtaa

SEQ ID NO: 1320392 - DNA, 14 bp, Homo sapiens
tatgagttcacatg

SEQ ID NO: 1320393 - DNA, 19 bp, Homo sapiens
tatgagttcacatgtgccc

SEQ ID NO: 1320394 - DNA, 14 bp, Homo sapiens
tatgcagtgctgct

SEQ ID NO: 1320395 - DNA, 18 bp, Homo sapiens
tatgcattcaagagaggt

SEQ ID NO: 1320396 - DNA, 17 bp, Homo sapiens
tatggaacttccctccc

SEQ ID NO: 1320397 - DNA, 19 bp, Homo sapiens
tatggaacttccctccccc

SEQ ID NO: 1320398 - DNA, 18 bp, Homo sapiens
tatggtgacctctccggc

SEQ ID NO: 1320399 - DNA, 19 bp, Homo sapiens
tatggtgacctctccggcc

SEQ ID NO: 1320400 - DNA, 18 bp, Homo sapiens
caaactatgagttcacat

SEQ ID NO: 1320401 - DNA, 20 bp, Homo sapiens
caaagctttttgaaaaccaa

SEQ ID NO: 1320402 - DNA, 20 bp, Homo sapiens
caaagtataaatttgtgtaa

SEQ ID NO: 1320403 - DNA, 20 bp, Homo sapiens
caaagttttcatgtgctcag

SEQ ID NO: 1320404 - DNA, 13 bp, Homo sapiens
cttgctttaaaga

SEQ ID NO: 1320405 - DNA, 19 bp, Homo sapiens
cttggaaatattaaaagaa

SEQ ID NO: 1320406 - DNA, 21 bp, Homo sapiens
cttggcccatcccgccttctc

SEQ ID NO: 1320407 - DNA, 22 bp, Homo sapiens
cttggcccatcccgccttctcc

SEQ ID NO: 1320408 - DNA, 12 bp, Homo sapiens
cttggcttcctg

SEQ ID NO: 1320409 - DNA, 14 bp, Homo sapiens
cttggcttcctggc

SEQ ID NO: 1320410 - DNA, 17 bp, Homo sapiens
cttggcttcctggcgcc

SEQ ID NO: 1320411 - DNA, 15 bp, Homo sapiens
cttgggaataaatta

SEQ ID NO: 1320412 - DNA, 17 bp, Homo sapiens
cttgggaataaattaat

SEQ ID NO: 1320413 - DNA, 21 bp, Homo sapiens
cttggtatttggatatctgtt

SEQ ID NO: 1320414 - DNA, 13 bp, Homo sapiens
cttgtagccagaa

SEQ ID NO: 1320415 - DNA, 22 bp, Homo sapiens
cttgtagtttagtgtggttttc

SEQ ID NO: 1320416 - DNA, 22 bp, Homo sapiens
cttgtcaccaggcaaccaggaa

SEQ ID NO: 1320417 - DNA, 15 bp, Homo sapiens
cttgtgactagtgct

SEQ ID NO: 1320418 - DNA, 18 bp, Homo sapiens
cttgtgactagtgctgaa

SEQ ID NO: 1320419 - DNA, 14 bp, Homo sapiens
cttgttttggactt

SEQ ID NO: 1320420 - DNA, 21 bp, Homo sapiens
cttgttttggactttgttaca

SEQ ID NO: 1320421 - DNA, 21 bp, Homo sapiens
ctttaaagagtcctccttccc

SEQ ID NO: 1320422 - DNA, 12 bp, Homo sapiens
ctttaacatgcc

SEQ ID NO: 1320423 - DNA, 13 bp, Homo sapiens
ctttaagacagaa

SEQ ID NO: 1320424 - DNA, 22 bp, Homo sapiens
ctttaagacagaattcactgtc

SEQ ID NO: 1320425 - DNA, 16 bp, Homo sapiens
ctttagtattcctgta

SEQ ID NO: 1320426 - DNA, 22 bp, Homo sapiens
ctttagtattcctgtaatacta

SEQ ID NO: 1320427 - DNA, 16 bp, Homo sapiens
ctttattttttaactt

SEQ ID NO: 1320428 - DNA, 20 bp, Homo sapiens
ctttcctcttctcattacca

SEQ ID NO: 1320429 - DNA, 19 bp, Homo sapiens
ctttctggggcctaataaa

SEQ ID NO: 1320430 - DNA, 22 bp, Homo sapiens
ctttctggggcctaataaaact

SEQ ID NO: 1320431 - DNA, 14 bp, Homo sapiens
ctttgaagaaggaa

SEQ ID NO: 1320432 - DNA, 23 bp, Homo sapiens
ctttgaagaaggaatcttttata

SEQ ID NO: 1320433 - DNA, 13 bp, Homo sapiens
cttttcttggaca

SEQ ID NO: 1320434 - DNA, 14 bp, Homo sapiens
cttttcttggacac

SEQ ID NO: 1320435 - DNA, 21 bp, Homo sapiens
cttttgaatgttaagaataac

SEQ ID NO: 1320436 - DNA, 21 bp, Homo sapiens
cttttgctgtgtgaaatcttt

SEQ ID NO: 1320437 - DNA, 23 bp, Homo sapiens
cttttgctgtgtgaaatctttca

SEQ ID NO: 1320438 - DNA, 12 bp, Homo sapiens
gaaaacttagtt

SEQ ID NO: 1320439 - DNA, 13 bp, Homo sapiens
gaaaacttagttt

SEQ ID NO: 1320440 - DNA, 14 bp, Homo sapiens
gaaaatgtgtgttt

SEQ ID NO: 1320441 - DNA, 16 bp, Homo sapiens
gaaacctgtgatttct

SEQ ID NO: 1320442 - DNA, 16 bp, Homo sapiens
gaaaccttcactccag

SEQ ID NO: 1320443 - DNA, 12 bp, Homo sapiens
gaaactaataaa

SEQ ID NO: 1320444 - DNA, 15 bp, Homo sapiens
gaaactaataaaata

SEQ ID NO: 1320445 - DNA, 16 bp, Homo sapiens
gaaactaataaaatat

SEQ ID NO: 1320446 - DNA, 18 bp, Homo sapiens
gaaactaataaaatattt

SEQ ID NO: 1320447 - DNA, 18 bp, Homo sapiens
gaaactactgtatctgat

SEQ ID NO: 1320448 - DNA, 20 bp, Homo sapiens
gaaacttgatattgaggtgt

SEQ ID NO: 1320449 - DNA, 19 bp, Homo sapiens
gaaagagactgtggggagg

SEQ ID NO: 1320450 - DNA, 23 bp, Homo sapiens
gaaagagactgtggggagggtca

SEQ ID NO: 1320451 - DNA, 21 bp, Homo sapiens
gaaagtcttgtgactagtgct

SEQ ID NO: 1320452 - DNA, 20 bp, Homo sapiens
gaaagtttccccaccagtga

SEQ ID NO: 1320453 - DNA, 11 bp, Homo sapiens
gaaatattaaa

SEQ ID NO: 1320454 - DNA, 11 bp, Homo sapiens
gaacaatttct

SEQ ID NO: 1320455 - DNA, 17 bp, Homo sapiens
gaacaatttctctgggt

SEQ ID NO: 1320456 - DNA, 12 bp, Homo sapiens
gaacagctgttg

SEQ ID NO: 1320457 - DNA, 12 bp, Homo sapiens
gaacagggacca

SEQ ID NO: 1320458 - DNA, 17 bp, Homo sapiens
gaacatctctgttattt

SEQ ID NO: 1320459 - DNA, 13 bp, Homo sapiens
gaaccacctaccc

SEQ ID NO: 1320460 - DNA, 17 bp, Homo sapiens
gaacccaccctctccac

SEQ ID NO: 1320461 - DNA, 16 bp, Homo sapiens
gaactgcaactccagc

SEQ ID NO: 1320462 - DNA, 23 bp, Homo sapiens
gaactgcaactccagcgtcctca

SEQ ID NO: 1320463 - DNA, 17 bp, Homo sapiens
gaagaaagagactgtgg

SEQ ID NO: 1320464 - DNA, 22 bp, Homo sapiens
gaagaaagagactgtggggagg

SEQ ID NO: 1320465 - DNA, 23 bp, Homo sapiens
gaagaatagggcccatgggaggg

SEQ ID NO: 1320466 - DNA, 23 bp, Homo sapiens
gaagacactgtgcaggcccaggc

SEQ ID NO: 1320467 - DNA, 21 bp, Homo sapiens
gaagacttaactggcccagaa

SEQ ID NO: 1320468 - DNA, 20 bp, Homo sapiens
gaagaggagcctgtttttgt

SEQ ID NO: 1320469 - DNA, 20 bp, Homo sapiens
gaagaggttctgattttctt

SEQ ID NO: 1320470 - DNA, 16 bp, Homo sapiens
gaagcacgttcactag

SEQ ID NO: 1320471 - DNA, 12 bp, Homo sapiens
gaagccaagcct

SEQ ID NO: 1320472 - DNA, 15 bp, Homo sapiens
gaagccacaggcctg

SEQ ID NO: 1320473 - DNA, 17 bp, Homo sapiens
gaagccacaggcctggc

SEQ ID NO: 1320474 - DNA, 20 bp, Homo sapiens
gaagccttcttgctgcccac

SEQ ID NO: 1320475 - DNA, 18 bp, Homo sapiens
gaagctgattttcatgaa

SEQ ID NO: 1320476 - DNA, 14 bp, Homo sapiens
gaagcttattaatg

SEQ ID NO: 1320477 - DNA, 22 bp, Homo sapiens
gaagcttattaatgctaagggc

SEQ ID NO: 1320478 - DNA, 23 bp, Homo sapiens
gaaggagggggtgacctccggcc

SEQ ID NO: 1320479 - DNA, 14 bp, Homo sapiens
gaagtctcagcctg

SEQ ID NO: 1320480 - DNA, 21 bp, Homo sapiens
gaataactaatacaattcatt

SEQ ID NO: 1320481 - DNA, 19 bp, Homo sapiens
gaatacatcttgtttctga

SEQ ID NO: 1320482 - DNA, 23 bp, Homo sapiens
gaatgaaagtcttgtgactagtg

SEQ ID NO: 1320483 - DNA, 21 bp, Homo sapiens
gaatgagggctgagttatgaa

SEQ ID NO: 1320484 - DNA, 12 bp, Homo sapiens
gaatgagggggc

SEQ ID NO: 1320485 - DNA, 15 bp, Homo sapiens
gaatgagggggctca

SEQ ID NO: 1320486 - DNA, 19 bp, Homo sapiens
gaatgagggtttgagagag

SEQ ID NO: 1320487 - DNA, 16 bp, Homo sapiens
gaatggagaatacatc

SEQ ID NO: 1320488 - DNA, 15 bp, Homo sapiens
gaatggtctcagtgt

SEQ ID NO: 1320489 - DNA, 13 bp, Homo sapiens
gaatgtcaatcat

SEQ ID NO: 1320490 - DNA, 16 bp, Homo sapiens
gaattaggtttctttg

SEQ ID NO: 1320491 - DNA, 21 bp, Homo sapiens
gaattaggtttctttgaagaa

SEQ ID NO: 1320492 - DNA, 23 bp, Homo sapiens
gaattgattttgaggagtggttt

SEQ ID NO: 1320493 - DNA, 14 bp, Homo sapiens
gacaaagttctgta

SEQ ID NO: 1320494 - DNA, 17 bp, Homo sapiens
gacaatagcattagaaa

SEQ ID NO: 1320495 - DNA, 17 bp, Homo sapiens
gacacttaattctgttc

SEQ ID NO: 1320496 - DNA, 19 bp, Homo sapiens
gacacttaattctgttctg

SEQ ID NO: 1320497 - DNA, 20 bp, Homo sapiens
gacagagcgagactttgtcc

SEQ ID NO: 1320498 - DNA, 13 bp, Homo sapiens
gacagagggagga

SEQ ID NO: 1320499 - DNA, 13 bp, Homo sapiens
gacagcacacggt

SEQ ID NO: 1320500 - DNA, 18 bp, Homo sapiens
gacagcgcacagctgctc

SEQ ID NO: 1320501 - DNA, 20 bp, Homo sapiens
gacagctggtcacacaagga

SEQ ID NO: 1320502 - DNA, 19 bp, Homo sapiens
gacataactgacttagttc

SEQ ID NO: 1320503 - DNA, 19 bp, Homo sapiens
gacatctacgaagccacag

SEQ ID NO: 1320504 - DNA, 20 bp, Homo sapiens
gaccaaattctatcctgtga

SEQ ID NO: 1320505 - DNA, 16 bp, Homo sapiens
gaccagctccccgggg

SEQ ID NO: 1320506 - DNA, 23 bp, Homo sapiens
gaccagggacagatccagcaggc

SEQ ID NO: 1320507 - DNA, 14 bp, Homo sapiens
gaccccatccacct

SEQ ID NO: 1320508 - DNA, 22 bp, Homo sapiens
gacctccggccaggtgcctcct

SEQ ID NO: 1320509 - DNA, 15 bp, Homo sapiens
gacctctccggcctg

SEQ ID NO: 1320510 - DNA, 19 bp, Homo sapiens
gacctctccggcctggcct

SEQ ID NO: 1320511 - DNA, 13 bp, Homo sapiens
gacctggcctctg

SEQ ID NO: 1320512 - DNA, 20 bp, Homo sapiens
gacctggctgggcctgggct

SEQ ID NO: 1320513 - DNA, 15 bp, Homo sapiens
gactaaagccaggaa

SEQ ID NO: 1320514 - DNA, 16 bp, Homo sapiens
gactaaagccaggaac

SEQ ID NO: 1320515 - DNA, 23 bp, Homo sapiens
gactaaagccaggaacagggacc

SEQ ID NO: 1320516 - DNA, 21 bp, Homo sapiens
gactaggccctacacacagac

SEQ ID NO: 1320517 - DNA, 18 bp, Homo sapiens
gactagtgctgaagctta

SEQ ID NO: 1320518 - DNA, 23 bp, Homo sapiens
gactagtgctgaagcttattaat

SEQ ID NO: 1320519 - DNA, 22 bp, Homo sapiens
gactattcatcaagaatgagga

SEQ ID NO: 1320520 - DNA, 21 bp, Homo sapiens
gactctcgtgatatgctgctt

SEQ ID NO: 1320521 - DNA, 23 bp, Homo sapiens
gactctcgtgatatgctgcttgt

SEQ ID NO: 1320522 - DNA, 19 bp, Homo sapiens
gactctgctctcctcgggc

SEQ ID NO: 1320523 - DNA, 22 bp, Homo sapiens
gactctgctctcctcgggccct

SEQ ID NO: 1320524 - DNA, 17 bp, Homo sapiens
gactctggaccatgctg

SEQ ID NO: 1320525 - DNA, 13 bp, Homo sapiens
gactctgttgctg

SEQ ID NO: 1320526 - DNA, 13 bp, Homo sapiens
gactgaagggaaa

SEQ ID NO: 1320527 - DNA, 17 bp, Homo sapiens
gactggaactgcaactc

SEQ ID NO: 1320528 - DNA, 19 bp, Homo sapiens
gactgtgggtttgtggggg

SEQ ID NO: 1320529 - DNA, 15 bp, Homo sapiens
gacttaactggccca

SEQ ID NO: 1320530 - DNA, 19 bp, Homo sapiens
gacttaactggcccagaag

SEQ ID NO: 1320531 - DNA, 20 bp, Homo sapiens
gacttcccccaccccagaag

SEQ ID NO: 1320532 - DNA, 17 bp, Homo sapiens
gacttgccatgaaggca

SEQ ID NO: 1320533 - DNA, 20 bp, Homo sapiens
gacttgccatgaaggcacct

SEQ ID NO: 1320534 - DNA, 21 bp, Homo sapiens
gacttgccatgaaggcacctg

SEQ ID NO: 1320535 - DNA, 12 bp, Homo sapiens
gactttgttaca

SEQ ID NO: 1320536 - DNA, 15 bp, Homo sapiens
gactttgttacactg

SEQ ID NO: 1320537 - DNA, 19 bp, Homo sapiens
gagaaaccttcactccaga

SEQ ID NO: 1320538 - DNA, 12 bp, Homo sapiens
gagaaccaccta

SEQ ID NO: 1320539 - DNA, 17 bp, Homo sapiens
gagaattgggactctgt

SEQ ID NO: 1320540 - DNA, 16 bp, Homo sapiens
gagacatccctcatct

SEQ ID NO: 1320541 - DNA, 15 bp, Homo sapiens
gagactgtggggagg

SEQ ID NO: 1320542 - DNA, 15 bp, Homo sapiens
gagagggagaaagga

SEQ ID NO: 1320543 - DNA, 22 bp, Homo sapiens
gagatgctctctgaggcaaggc

SEQ ID NO: 1320544 - DNA, 19 bp, Homo sapiens
gagcaagcctttgacctgt

SEQ ID NO: 1320545 - DNA, 15 bp, Homo sapiens
gagcacatagccctg

SEQ ID NO: 1320546 - DNA, 23 bp, Homo sapiens
gagcacctctcagagcaagcctt

SEQ ID NO: 1320547 - DNA, 18 bp, Homo sapiens
gagccccaagactctgct

SEQ ID NO: 1320548 - DNA, 15 bp, Homo sapiens
gagcctgtttttgtg

SEQ ID NO: 1320549 - DNA, 16 bp, Homo sapiens
gagcctgtttttgtga

SEQ ID NO: 1320550 - DNA, 21 bp, Homo sapiens
gagccttcaattgtagatgaa

SEQ ID NO: 1320551 - DNA, 20 bp, Homo sapiens
gagctggggcttctttctgc

SEQ ID NO: 1320552 - DNA, 21 bp, Homo sapiens
gagctggggcttctttctgct

SEQ ID NO: 1320553 - DNA, 22 bp, Homo sapiens
gagctggggcttctttctgctg

SEQ ID NO: 1320554 - DNA, 14 bp, Homo sapiens
gaggaagaataggg

SEQ ID NO: 1320555 - DNA, 21 bp, Homo sapiens
gaggagcctgtttttgtgaga

SEQ ID NO: 1320556 - DNA, 20 bp, Homo sapiens
gaggcaaggcccagacctgg

SEQ ID NO: 1320557 - DNA, 23 bp, Homo sapiens
gaggcaaggcccagacctggcct

SEQ ID NO: 1320558 - DNA, 19 bp, Homo sapiens
gaggccactgaagaggagg

SEQ ID NO: 1320559 - DNA, 12 bp, Homo sapiens
gaggctgactcc

SEQ ID NO: 1320560 - DNA, 15 bp, Homo sapiens
gaggcttagaaaggt

SEQ ID NO: 1320561 - DNA, 18 bp, Homo sapiens
gaggggaatgagggctga

SEQ ID NO: 1320562 - DNA, 22 bp, Homo sapiens
gagggtccagaaggagggggtg

SEQ ID NO: 1320563 - DNA, 22 bp, Homo sapiens
gagggtttgagagagcagccag

SEQ ID NO: 1320564 - DNA, 18 bp, Homo sapiens
gaggtggatttactgaga

SEQ ID NO: 1320565 - DNA, 23 bp, Homo sapiens
gaggtggatttactgagagaagg

SEQ ID NO: 1320566 - DNA, 17 bp, Homo sapiens
gagtcctccttcccagc

SEQ ID NO: 1320567 - DNA, 20 bp, Homo sapiens
gagtcctccttcccagctct

SEQ ID NO: 1320568 - DNA, 21 bp, Homo sapiens
gagtggtttttcttttcttgg

SEQ ID NO: 1320569 - DNA, 19 bp, Homo sapiens
gagttcacatgtgccctgc

SEQ ID NO: 1320570 - DNA, 17 bp, Homo sapiens
gataaaaggagaataag

SEQ ID NO: 1320571 - DNA, 18 bp, Homo sapiens
gataaatgaaataaacgt

SEQ ID NO: 1320572 - DNA, 14 bp, Homo sapiens
gatacaatcagctg

SEQ ID NO: 1320573 - DNA, 16 bp, Homo sapiens
gatacaatcagctgct

SEQ ID NO: 1320574 - DNA, 17 bp, Homo sapiens
gatacaatcagctgctt

SEQ ID NO: 1320575 - DNA, 15 bp, Homo sapiens
gatagcagcctggct

SEQ ID NO: 1320576 - DNA, 22 bp, Homo sapiens
gatagcagcctggctcccctgg

SEQ ID NO: 1320577 - DNA, 19 bp, Homo sapiens
gatatgctttaagacagaa

SEQ ID NO: 1320578 - DNA, 22 bp, Homo sapiens
gatattaatttatcagattgct

SEQ ID NO: 1320579 - DNA, 17 bp, Homo sapiens
gatccagattcccaggc

SEQ ID NO: 1320580 - DNA, 18 bp, Homo sapiens
gatccagattcccaggcc

SEQ ID NO: 1320581 - DNA, 12 bp, Homo sapiens
gatgaagaaaga

SEQ ID NO: 1320582 - DNA, 13 bp, Homo sapiens
gatgaagaaagag

SEQ ID NO: 1320583 - DNA, 14 bp, Homo sapiens
gatgaagaaagaga

SEQ ID NO: 1320584 - DNA, 22 bp, Homo sapiens
gatgaagaaagagactgtgggg

SEQ ID NO: 1320585 - DNA, 22 bp, Homo sapiens
gatgacacatttaatgaacaca

SEQ ID NO: 1320586 - DNA, 15 bp, Homo sapiens
gatgagctttctttt

SEQ ID NO: 1320587 - DNA, 14 bp, Homo sapiens
gatgataaaaggag

SEQ ID NO: 1320588 - DNA, 15 bp, Homo sapiens
gatgctactaagaaa

SEQ ID NO: 1320589 - DNA, 12 bp, Homo sapiens
gatgctctctga

SEQ ID NO: 1320590 - DNA, 14 bp, Homo sapiens
gatgtttgttttcg

SEQ ID NO: 1320591 - DNA, 19 bp, Homo sapiens
gatgtttgttttcgatgag

SEQ ID NO: 1320592 - DNA, 13 bp, Homo sapiens
gattcacagcctc

SEQ ID NO: 1320593 - DNA, 15 bp, Homo sapiens
gatttctatgaactt

SEQ ID NO: 1320594 - DNA, 15 bp, Homo sapiens
gattttaagaatggt

SEQ ID NO: 1320595 - DNA, 18 bp, Homo sapiens
gattttaagaatggtctc

SEQ ID NO: 1320596 - DNA, 24 bp, Homo sapiens
gattttaagaatggtctcagtgtt

SEQ ID NO: 1320597 - DNA, 19 bp, Homo sapiens
gcaaacctaattgcacaac

SEQ ID NO: 1320598 - DNA, 12 bp, Homo sapiens
gcaactccagcg

SEQ ID NO: 1320599 - DNA, 20 bp, Homo sapiens
gcaagcctttgacctgttca

SEQ ID NO: 1320600 - DNA, 19 bp, Homo sapiens
gcacacacgccttcatgcc

SEQ ID NO: 1320601 - DNA, 23 bp, Homo sapiens
gcacacggtgagggtgcggggcc

SEQ ID NO: 1320602 - DNA, 14 bp, Homo sapiens
gcacatagccctgt

SEQ ID NO: 1320603 - DNA, 17 bp, Homo sapiens
gcacatagccctgttga

SEQ ID NO: 1320604 - DNA, 12 bp, Homo sapiens
gtaaagtgttaa

SEQ ID NO: 1320605 - DNA, 21 bp, Homo sapiens
gtaactgaggcttagaaaggt

SEQ ID NO: 1320606 - DNA, 21 bp, Homo sapiens
gtaagcccaagctaagctgca

SEQ ID NO: 1320607 - DNA, 17 bp, Homo sapiens
gtacgctgcgtgccatg

SEQ ID NO: 1320608 - DNA, 17 bp, Homo sapiens
gtagatacaatcagctg

SEQ ID NO: 1320609 - DNA, 14 bp, Homo sapiens
gtagattttaagaa

SEQ ID NO: 1320610 - DNA, 24 bp, Homo sapiens
gtaggctggtccctatgtcatgtc

SEQ ID NO: 1320611 - DNA, 22 bp, Homo sapiens
gtataattcacccaccagactt

SEQ ID NO: 1320612 - DNA, 13 bp, Homo sapiens
gtataccagagaa

SEQ ID NO: 1320613 - DNA, 16 bp, Homo sapiens
gtataccagagaaggt

SEQ ID NO: 1320614 - DNA, 13 bp, Homo sapiens
gtatgctctgagt

SEQ ID NO: 1320615 - DNA, 21 bp, Homo sapiens
gtatggtgacctctccggcct

SEQ ID NO: 1320616 - DNA, 17 bp, Homo sapiens
gtattcctttatgtatc

SEQ ID NO: 1320617 - DNA, 15 bp, Homo sapiens
gtattcgaaacctgt

SEQ ID NO: 1320618 - DNA, 22 bp, Homo sapiens
gtcaatcatatttaaagggaat

SEQ ID NO: 1320619 - DNA, 16 bp, Homo sapiens
gtcatctctcctgtgt

SEQ ID NO: 1320620 - DNA, 16 bp, Homo sapiens
gtcatggagaaccacc

SEQ ID NO: 1320621 - DNA, 18 bp, Homo sapiens
gtcatggagaaccaccta

SEQ ID NO: 1320622 - DNA, 22 bp, Homo sapiens
gtcatggagaaccacctacccc

SEQ ID NO: 1320623 - DNA, 18 bp, Homo sapiens
gtcattttgactggcttg

SEQ ID NO: 1320624 - DNA, 21 bp, Homo sapiens
gtccagaaggagggggtgacc

SEQ ID NO: 1320625 - DNA, 20 bp, Homo sapiens
gtcccacggctctgtgcccg

SEQ ID NO: 1320626 - DNA, 20 bp, Homo sapiens
gtcccactggctcctcccag

SEQ ID NO: 1320627 - DNA, 23 bp, Homo sapiens
gtcccccaacttcatctggaagt

SEQ ID NO: 1320628 - DNA, 15 bp, Homo sapiens
gtcccctcaagcccc

SEQ ID NO: 1320629 - DNA, 15 bp, Homo sapiens
gtcctatgcctcaca

SEQ ID NO: 1320630 - DNA, 15 bp, Homo sapiens
gtcctcagcacccca

SEQ ID NO: 1320631 - DNA, 19 bp, Homo sapiens
gtcctccatcacccctggt

SEQ ID NO: 1320632 - DNA, 22 bp, Homo sapiens
gtcctccatcacccctggtggc

SEQ ID NO: 1320633 - DNA, 13 bp, Homo sapiens
gtcctccttccca

SEQ ID NO: 1320634 - DNA, 16 bp, Homo sapiens
gtcctccttcccagct

SEQ ID NO: 1320635 - DNA, 18 bp, Homo sapiens
gtcctccttcccagctct

SEQ ID NO: 1320636 - DNA, 17 bp, Homo sapiens
gtcctcgggcccctgag

SEQ ID NO: 1320637 - DNA, 22 bp, Homo sapiens
gtcctcgggcccctgagcctgt

SEQ ID NO: 1320638 - DNA, 16 bp, Homo sapiens
gtccttgcaagaatgg

SEQ ID NO: 1320639 - DNA, 17 bp, Homo sapiens
gtccttgcaagaatgga

SEQ ID NO: 1320640 - DNA, 20 bp, Homo sapiens
gtctatttcatcagaacagc

SEQ ID NO: 1320641 - DNA, 14 bp, Homo sapiens
gtctcagcctgggc

SEQ ID NO: 1320642 - DNA, 15 bp, Homo sapiens
gtctcagcctgggcc

SEQ ID NO: 1320643 - DNA, 19 bp, Homo sapiens
gtctcagcctgggcccctc

SEQ ID NO: 1320644 - DNA, 21 bp, Homo sapiens
gtctgtcttcctttgcttccc

SEQ ID NO: 1320645 - DNA, 15 bp, Homo sapiens
gtcttcctccaaccc

SEQ ID NO: 1320646 - DNA, 11 bp, Homo sapiens
gtcttctccca

SEQ ID NO: 1320647 - DNA, 22 bp, Homo sapiens
gtcttctcccaactcagcctgt

SEQ ID NO: 1320648 - DNA, 23 bp, Homo sapiens
gtcttctcccaactcagcctgtt

SEQ ID NO: 1320649 - DNA, 13 bp, Homo sapiens
gtcttgtgactag

SEQ ID NO: 1320650 - DNA, 17 bp, Homo sapiens
gtctttgtccctgttgg

SEQ ID NO: 1320651 - DNA, 22 bp, Homo sapiens
gtgaaaataagccatgagaatg

SEQ ID NO: 1320652 - DNA, 11 bp, Homo sapiens
gtgactagtgc

SEQ ID NO: 1320653 - DNA, 15 bp, Homo sapiens
gtgactagtgctgaa

SEQ ID NO: 1320654 - DNA, 21 bp, Homo sapiens
gtgactagtgctgaagcttat

SEQ ID NO: 1320655 - DNA, 16 bp, Homo sapiens
gtgagaagaaagaaac

SEQ ID NO: 1320656 - DNA, 16 bp, Homo sapiens
gtgagaattgggactc

SEQ ID NO: 1320657 - DNA, 22 bp, Homo sapiens
gtgaggccactgaagaggagga

SEQ ID NO: 1320658 - DNA, 11 bp, Homo sapiens
gtgagggtgcg

SEQ ID NO: 1320659 - DNA, 17 bp, Homo sapiens
gtgatgcgcagttgctg

SEQ ID NO: 1320660 - DNA, 15 bp, Homo sapiens
gtgatgtcctgtaaa

SEQ ID NO: 1320661 - DNA, 21 bp, Homo sapiens
gtgatgtcctgtaaacactca

SEQ ID NO: 1320662 - DNA, 16 bp, Homo sapiens
gtgatttctgtgccat

SEQ ID NO: 1320663 - DNA, 12 bp, Homo sapiens
gtgcacctgggc

SEQ ID NO: 1320664 - DNA, 18 bp, Homo sapiens
gtgcattggataacacca

SEQ ID NO: 1320665 - DNA, 22 bp, Homo sapiens
gtgccattttctgtaaagatac

SEQ ID NO: 1320666 - DNA, 22 bp, Homo sapiens
gtgcctcctgacacacctgcag

SEQ ID NO: 1320667 - DNA, 12 bp, Homo sapiens
gtgcgcggactg

SEQ ID NO: 1320668 - DNA, 18 bp, Homo sapiens
gtgctcaataaacttgtg

SEQ ID NO: 1320669 - DNA, 20 bp, Homo sapiens
gtgctcaataaacttgtgcc

SEQ ID NO: 1320670 - DNA, 21 bp, Homo sapiens
gtgctgaagcttattaatgct

SEQ ID NO: 1320671 - DNA, 13 bp, Homo sapiens
gtggaaaaagtaa

SEQ ID NO: 1320672 - DNA, 18 bp, Homo sapiens
gtggacctcaccagagac

SEQ ID NO: 1320673 - DNA, 22 bp, Homo sapiens
gtggactaggccctacacacag

SEQ ID NO: 1320674 - DNA, 12 bp, Homo sapiens
gtggatttactg

SEQ ID NO: 1320675 - DNA, 15 bp, Homo sapiens
gtggatttactgaga

SEQ ID NO: 1320676 - DNA, 19 bp, Homo sapiens
gtggctgcaggcaccgctg

SEQ ID NO: 1320677 - DNA, 12 bp, Homo sapiens
gtggggggaggc

SEQ ID NO: 1320678 - DNA, 14 bp, Homo sapiens
gtggttttctgttt

SEQ ID NO: 1320679 - DNA, 17 bp, Homo sapiens
gtggttttctgtttcta

SEQ ID NO: 1320680 - DNA, 14 bp, Homo sapiens
gtgtatggtgacct

SEQ ID NO: 1320681 - DNA, 21 bp, Homo sapiens
gtgtgaagacactgtgcaggc

SEQ ID NO: 1320682 - DNA, 13 bp, Homo sapiens
gtgtgttcctggc

SEQ ID NO: 1320683 - DNA, 12 bp, Homo sapiens
gttaagaataac

SEQ ID NO: 1320684 - DNA, 22 bp, Homo sapiens
gttacactgttattttcagcat

SEQ ID NO: 1320685 - DNA, 18 bp, Homo sapiens
gttagactatagcccctg

SEQ ID NO: 1320686 - DNA, 19 bp, Homo sapiens
gttagagaatggcctgaga

SEQ ID NO: 1320687 - DNA, 14 bp, Homo sapiens
gttagatgctacta

SEQ ID NO: 1320688 - DNA, 16 bp, Homo sapiens
gttcaaacctgtgaag

SEQ ID NO: 1320689 - DNA, 20 bp, Homo sapiens
gttcagaaaaaatgtgaagt

SEQ ID NO: 1320690 - DNA, 20 bp, Homo sapiens
gttcaggagtccaaaccttc

SEQ ID NO: 1320691 - DNA, 12 bp, Homo sapiens
gttccccacagg

SEQ ID NO: 1320692 - DNA, 16 bp, Homo sapiens
gttcctaggggaatga

SEQ ID NO: 1320693 - DNA, 20 bp, Homo sapiens
gttcctaggggaatgagggg

SEQ ID NO: 1320694 - DNA, 23 bp, Homo sapiens
tcaagctaataaaatatcattca

SEQ ID NO: 1320695 - DNA, 13 bp, Homo sapiens
tcaataaacttgt

SEQ ID NO: 1320696 - DNA, 16 bp, Homo sapiens
tcaatcaacatctctt

SEQ ID NO: 1320697 - DNA, 15 bp, Homo sapiens
tcaattatttccccc

SEQ ID NO: 1320698 - DNA, 17 bp, Homo sapiens
tcacagcttgttttgga

SEQ ID NO: 1320699 - DNA, 16 bp, Homo sapiens
tcacatgtgccctgcc

SEQ ID NO: 1320700 - DNA, 20 bp, Homo sapiens
tcacatgtgccctgccttga

SEQ ID NO: 1320701 - DNA, 16 bp, Homo sapiens
tcacccaccagacttt

SEQ ID NO: 1320702 - DNA, 18 bp, Homo sapiens
tcacccttggcccatccc

SEQ ID NO: 1320703 - DNA, 22 bp, Homo sapiens
tcactctgctaccttgccccaa

SEQ ID NO: 1320704 - DNA, 15 bp, Homo sapiens
tcacttgcacagagg

SEQ ID NO: 1320705 - DNA, 13 bp, Homo sapiens
tcactttcctgga

SEQ ID NO: 1320706 - DNA, 16 bp, Homo sapiens
tcagaacagctgttga

SEQ ID NO: 1320707 - DNA, 13 bp, Homo sapiens
tcagaagccttct

SEQ ID NO: 1320708 - DNA, 20 bp, Homo sapiens
tcagaagccttcttgctgcc

SEQ ID NO: 1320709 - DNA, 16 bp, Homo sapiens
tcagaccgtcttcctc

SEQ ID NO: 1320710 - DNA, 18 bp, Homo sapiens
tcagattggacataactg

SEQ ID NO: 1320711 - DNA, 18 bp, Homo sapiens
tcagcaccccactcctca

SEQ ID NO: 1320712 - DNA, 21 bp, Homo sapiens
tcagcagtggagtttaaaaat

SEQ ID NO: 1320713 - DNA, 18 bp, Homo sapiens
tcagcatgaaaatgtgtg

SEQ ID NO: 1320714 - DNA, 23 bp, Homo sapiens
tcagccacccttggtctcatgcc

SEQ ID NO: 1320715 - DNA, 19 bp, Homo sapiens
tcagcctgggcccctcagc

SEQ ID NO: 1320716 - DNA, 20 bp, Homo sapiens
tcagcctgggcccctcagcc

SEQ ID NO: 1320717 - DNA, 22 bp, Homo sapiens
tcagcctgggcccctcagccac

SEQ ID NO: 1320718 - DNA, 22 bp, Homo sapiens
tcagccttcaatcaacatctct

SEQ ID NO: 1320719 - DNA, 15 bp, Homo sapiens
tcagctgctttgtta

SEQ ID NO: 1320720 - DNA, 20 bp, Homo sapiens
tcaggagagggccttcccct

SEQ ID NO: 1320721 - DNA, 18 bp, Homo sapiens
tcaggagtccaaaccttc

SEQ ID NO: 1320722 - DNA, 16 bp, Homo sapiens
tcagtggagtccagat

SEQ ID NO: 1320723 - DNA, 23 bp, Homo sapiens
tcagtgttaatactgagaaaaag

SEQ ID NO: 1320724 - DNA, 15 bp, Homo sapiens
tcagttcagaaaaaa

SEQ ID NO: 1320725 - DNA, 14 bp, Homo sapiens
tcgggccctgtggt

SEQ ID NO: 1320726 - DNA, 19 bp, Homo sapiens
tcggggaataaaacatttc

SEQ ID NO: 1320727 - DNA, 23 bp, Homo sapiens
tcgtgatatgctgcttgtgacct

SEQ ID NO: 1320728 - DNA, 13 bp, Homo sapiens
tcgttttcaaaga

SEQ ID NO: 1320729 - DNA, 14 bp, Homo sapiens
tctacattctgctc

SEQ ID NO: 1320730 - DNA, 16 bp, Homo sapiens
tctacattctgctctg

SEQ ID NO: 1320731 - DNA, 18 bp, Homo sapiens
tctacattctgctctgcc

SEQ ID NO: 1320732 - DNA, 9 bp, Homo sapiens
tctagaggc

SEQ ID NO: 1320733 - DNA, 13 bp, Homo sapiens
tctagtactgtga

SEQ ID NO: 1320734 - DNA, 17 bp, Homo sapiens
tctagtcttgacctctc

SEQ ID NO: 1320735 - DNA, 20 bp, Homo sapiens
tctagtcttgacctctccag

SEQ ID NO: 1320736 - DNA, 22 bp, Homo sapiens
tctagtcttgacctctccagca

SEQ ID NO: 1320737 - DNA, 21 bp, Homo sapiens
tctatttcatcagaacagctg

SEQ ID NO: 1320738 - DNA, 16 bp, Homo sapiens
tctcaatccctttgca

SEQ ID NO: 1320739 - DNA, 15 bp, Homo sapiens
tctcagagcaagcct

SEQ ID NO: 1320740 - DNA, 11 bp, Homo sapiens
tctcagcctgg

SEQ ID NO: 1320741 - DNA, 23 bp, Homo sapiens
tctcagcctgggcccctcagcca

SEQ ID NO: 1320742 - DNA, 20 bp, Homo sapiens
tctcagtgttaatactgaga

SEQ ID NO: 1320743 - DNA, 13 bp, Homo sapiens
tctccagcatccc

SEQ ID NO: 1320744 - DNA, 17 bp, Homo sapiens
tctccagcatcccagcc

SEQ ID NO: 1320745 - DNA, 19 bp, Homo sapiens
tctccagcatcccagcctc

SEQ ID NO: 1320746 - DNA, 22 bp, Homo sapiens
tctccagcatcccagcctcaga

SEQ ID NO: 1320747 - DNA, 12 bp, Homo sapiens
tctccggcctgg

SEQ ID NO: 1320748 - DNA, 16 bp, Homo sapiens
tctccggcctggcctt

SEQ ID NO: 1320749 - DNA, 17 bp, Homo sapiens
tctcctcgggccctgtg

SEQ ID NO: 1320750 - DNA, 17 bp, Homo sapiens
tctcgtgatatgctgct

SEQ ID NO: 1320751 - DNA, 17 bp, Homo sapiens
tctctcaatccctttgc

SEQ ID NO: 1320752 - DNA, 19 bp, Homo sapiens
tctctcaatccctttgcaa

SEQ ID NO: 1320753 - DNA, 16 bp, Homo sapiens
tctctctctctcaaaa

SEQ ID NO: 1320754 - DNA, 19 bp, Homo sapiens
tctctgaggcaaggcccag

SEQ ID NO: 1320755 - DNA, 17 bp, Homo sapiens
tctctgttctcttgctt

SEQ ID NO: 1320756 - DNA, 12 bp, Homo sapiens
tctgaggcaagg

SEQ ID NO: 1320757 - DNA, 17 bp, Homo sapiens
tctgaggcaaggcccag

SEQ ID NO: 1320758 - DNA, 19 bp, Homo sapiens
tctgaggcaaggcccagac

SEQ ID NO: 1320759 - DNA, 16 bp, Homo sapiens
tctgagtagctttaca

SEQ ID NO: 1320760 - DNA, 15 bp, Homo sapiens
tctgattcttcaaag

SEQ ID NO: 1320761 - DNA, 14 bp, Homo sapiens
tctgccatcctccc

SEQ ID NO: 1320762 - DNA, 15 bp, Homo sapiens
tctgccatcctccct

SEQ ID NO: 1320763 - DNA, 14 bp, Homo sapiens
aaaaagagaattgt

SEQ ID NO: 1320764 - DNA, 17 bp, Homo sapiens
aaaaatggagttgtttt

SEQ ID NO: 1320765 - DNA, 18 bp, Homo sapiens
aaaacaagaaagtttccc

SEQ ID NO: 1320766 - DNA, 14 bp, Homo sapiens
aaaacaccagcttt

SEQ ID NO: 1320767 - DNA, 20 bp, Homo sapiens
aaaacagttggcatgcatcc

SEQ ID NO: 1320768 - DNA, 21 bp, Homo sapiens
aaaacagttggcatgcatccc

SEQ ID NO: 1320769 - DNA, 14 bp, Homo sapiens
aaaaccttttttct

SEQ ID NO: 1320770 - DNA, 19 bp, Homo sapiens
aaaaccttttttcttgcta

SEQ ID NO: 1320771 - DNA, 18 bp, Homo sapiens
aaaactaggcatttgtaa

SEQ ID NO: 1320772 - DNA, 21 bp, Homo sapiens
aaaactaggcatttgtaaata

SEQ ID NO: 1320773 - DNA, 15 bp, Homo sapiens
aaaactgatgtgaaa

SEQ ID NO: 1320774 - DNA, 20 bp, Homo sapiens
aaaagagaattgtagataat

SEQ ID NO: 1320775 - DNA, 21 bp, Homo sapiens
aaaagataaaaaaacagcttt

SEQ ID NO: 1320776 - DNA, 14 bp, Homo sapiens
aaaatattttctgt

SEQ ID NO: 1320777 - DNA, 16 bp, Homo sapiens
aaacaagaaagtttcc

SEQ ID NO: 1320778 - DNA, 17 bp, Homo sapiens
aaacaagaaagtttccc

SEQ ID NO: 1320779 - DNA, 18 bp, Homo sapiens
aaacaagaaagtttcccc

SEQ ID NO: 1320780 - DNA, 14 bp, Homo sapiens
aaacactcagctgt

SEQ ID NO: 1320781 - DNA, 12 bp, Homo sapiens
aaacctgtgaag

SEQ ID NO: 1320782 - DNA, 15 bp, Homo sapiens
aaaccttctaccctg

SEQ ID NO: 1320783 - DNA, 12 bp, Homo sapiens
aaactaataaaa

SEQ ID NO: 1320784 - DNA, 19 bp, Homo sapiens
aaactaataaaatattttc

SEQ ID NO: 1320785 - DNA, 20 bp, Homo sapiens
aaactaataaaatattttct

SEQ ID NO: 1320786 - DNA, 21 bp, Homo sapiens
aaactaataaaatattttctg

SEQ ID NO: 1320787 - DNA, 12 bp, Homo sapiens
aaacttgtgcct

SEQ ID NO: 1320788 - DNA, 17 bp, Homo sapiens
aaagaaagggttctgta

SEQ ID NO: 1320789 - DNA, 16 bp, Homo sapiens
aaagaatttttggtgt

SEQ ID NO: 1320790 - DNA, 23 bp, Homo sapiens
aaagagtcctccttcccagctct

SEQ ID NO: 1320791 - DNA, 21 bp, Homo sapiens
aaagggaatgactttgaagta

SEQ ID NO: 1320792 - DNA, 18 bp, Homo sapiens
aaagtcctgtcagttcag

SEQ ID NO: 1320793 - DNA, 23 bp, Homo sapiens
aaagtccttgcaagaatggagat

SEQ ID NO: 1320794 - DNA, 19 bp, Homo sapiens
aaagtcttgtgactagtgc

SEQ ID NO: 1320795 - DNA, 19 bp, Homo sapiens
aaagtgaggccactgaaga

SEQ ID NO: 1320796 - DNA, 20 bp, Homo sapiens
aaagtgaggccactgaagag

SEQ ID NO: 1320797 - DNA, 13 bp, Homo sapiens
aaatatcattcag

SEQ ID NO: 1320798 - DNA, 15 bp, Homo sapiens
aaatattttctgtgt

SEQ ID NO: 1320799 - DNA, 20 bp, Homo sapiens
aaatattttctgtgtgttcc

SEQ ID NO: 1320800 - DNA, 13 bp, Homo sapiens
aaatctttcaagt

SEQ ID NO: 1320801 - DNA, 14 bp, Homo sapiens
aaatctttcaagtt

SEQ ID NO: 1320802 - DNA, 23 bp, Homo sapiens
aaatgcattgtgaattgcctgcc

SEQ ID NO: 1320803 - DNA, 23 bp, Homo sapiens
aaatgtgtgtttttttagggttt

SEQ ID NO: 1320804 - DNA, 18 bp, Homo sapiens
aaattataggagacttgt

SEQ ID NO: 1320805 - DNA, 19 bp, Homo sapiens
aaattatcaagctaataaa

SEQ ID NO: 1320806 - DNA, 15 bp, Homo sapiens
aaatttgtgtaatat

SEQ ID NO: 1320807 - DNA, 13 bp, Homo sapiens
aacactcagctgt

SEQ ID NO: 1320808 - DNA, 14 bp, Homo sapiens
aacactcagctgtt

SEQ ID NO: 1320809 - DNA, 22 bp, Homo sapiens
aacagaagtccttaagcagagg

SEQ ID NO: 1320810 - DNA, 15 bp, Homo sapiens
aacagggaccagctc

SEQ ID NO: 1320811 - DNA, 16 bp, Homo sapiens
aacagggaccagctcc

SEQ ID NO: 1320812 - DNA, 17 bp, Homo sapiens
aacagggaccagctccc

SEQ ID NO: 1320813 - DNA, 17 bp, Homo sapiens
aacagttggcatgcatc

SEQ ID NO: 1320814 - DNA, 22 bp, Homo sapiens
aacagtttatgcagtgctgctt

SEQ ID NO: 1320815 - DNA, 23 bp, Homo sapiens
aacagtttatgcagtgctgcttt

SEQ ID NO: 1320816 - DNA, 12 bp, Homo sapiens
aacatgccccag

SEQ ID NO: 1320817 - DNA, 19 bp, Homo sapiens
aacatgctgtgtaagctgt

SEQ ID NO: 1320818 - DNA, 21 bp, Homo sapiens
aacatgctgtgtaagctgtgt

SEQ ID NO: 1320819 - DNA, 15 bp, Homo sapiens
aacccaccctctcca

SEQ ID NO: 1320820 - DNA, 19 bp, Homo sapiens
aacgtcccctcaagcccct

SEQ ID NO: 1320821 - DNA, 22 bp, Homo sapiens
aactaataaaatattttctgtg

SEQ ID NO: 1320822 - DNA, 15 bp, Homo sapiens
aactaggcatttgta

SEQ ID NO: 1320823 - DNA, 23 bp, Homo sapiens
aactaggcatttgtaaatattaa

SEQ ID NO: 1320824 - DNA, 18 bp, Homo sapiens
aactaggctcatactcaa

SEQ ID NO: 1320825 - DNA, 12 bp, Homo sapiens
aactcacccttg

SEQ ID NO: 1320826 - DNA, 13 bp, Homo sapiens
aactgatgtgaaa

SEQ ID NO: 1320827 - DNA, 14 bp, Homo sapiens
aactgatgtgaaac

SEQ ID NO: 1320828 - DNA, 15 bp, Homo sapiens
aactgatgtgaaact

SEQ ID NO: 1320829 - DNA, 17 bp, Homo sapiens
aactgtaataacttcta

SEQ ID NO: 1320830 - DNA, 13 bp, Homo sapiens
aacttatgtatgt

SEQ ID NO: 1320831 - DNA, 15 bp, Homo sapiens
aagaaagtttcccca

SEQ ID NO: 1320832 - DNA, 9 bp, Homo sapiens
acccagcct

SEQ ID NO: 1320833 - DNA, 14 bp, Homo sapiens
accccactcctcag

SEQ ID NO: 1320834 - DNA, 13 bp, Homo sapiens
accccatccacct

SEQ ID NO: 1320835 - DNA, 15 bp, Homo sapiens
accccatccacctat

SEQ ID NO: 1320836 - DNA, 20 bp, Homo sapiens
acccccaggacagcacacgg

SEQ ID NO: 1320837 - DNA, 15 bp, Homo sapiens
acccctggtggctgc

SEQ ID NO: 1320838 - DNA, 20 bp, Homo sapiens
acccctggtggctgcaggca

SEQ ID NO: 1320839 - DNA, 20 bp, Homo sapiens
accctctccacacccagcct

SEQ ID NO: 1320840 - DNA, 22 bp, Homo sapiens
accctctccacacccagcctgt

SEQ ID NO: 1320841 - DNA, 19 bp, Homo sapiens
accgctgggttctgactct

SEQ ID NO: 1320842 - DNA, 13 bp, Homo sapiens
accgttttacact

SEQ ID NO: 1320843 - DNA, 15 bp, Homo sapiens
acctaattgcacaac

SEQ ID NO: 1320844 - DNA, 23 bp, Homo sapiens
acctaattgcacaacagagactg

SEQ ID NO: 1320845 - DNA, 18 bp, Homo sapiens
acctatgtggcatgtggt

SEQ ID NO: 1320846 - DNA, 24 bp, Homo sapiens
acctcactctgctaccttgcccca

SEQ ID NO: 1320847 - DNA, 23 bp, Homo sapiens
acctccggccaggtgcctcctga

SEQ ID NO: 1320848 - DNA, 20 bp, Homo sapiens
acctcgttagagaatggcct

SEQ ID NO: 1320849 - DNA, 19 bp, Homo sapiens
acctctcagagcaagcctt

SEQ ID NO: 1320850 - DNA, 20 bp, Homo sapiens
acctctcagagcaagccttt

SEQ ID NO: 1320851 - DNA, 18 bp, Homo sapiens
acctctccagcatcccag

SEQ ID NO: 1320852 - DNA, 19 bp, Homo sapiens
acctctccagcatcccagc

SEQ ID NO: 1320853 - DNA, 22 bp, Homo sapiens
acctctccggcctggccttttc

SEQ ID NO: 1320854 - DNA, 14 bp, Homo sapiens
acctgcagcctccc

SEQ ID NO: 1320855 - DNA, 13 bp, Homo sapiens
acctgcccccaca

SEQ ID NO: 1320856 - DNA, 16 bp, Homo sapiens
acctgcccccacagct

SEQ ID NO: 1320857 - DNA, 13 bp, Homo sapiens
acctggcctctgc

SEQ ID NO: 1320858 - DNA, 15 bp, Homo sapiens
acctggcctctgcca

SEQ ID NO: 1320859 - DNA, 16 bp, Homo sapiens
acctggctgggcctgg

SEQ ID NO: 1320860 - DNA, 18 bp, Homo sapiens
acctggctgggcctgggc

SEQ ID NO: 1320861 - DNA, 19 bp, Homo sapiens
acctgtaatcccaacactt

SEQ ID NO: 1320862 - DNA, 20 bp, Homo sapiens
acctgtaatcccaacacttt

SEQ ID NO: 1320863 - DNA, 17 bp, Homo sapiens
acctgtgatttctgtgc

SEQ ID NO: 1320864 - DNA, 20 bp, Homo sapiens
acctgtgtatggtgacctct

SEQ ID NO: 1320865 - DNA, 23 bp, Homo sapiens
acctgtgtatggtgacctctccg

SEQ ID NO: 1320866 - DNA, 15 bp, Homo sapiens
accttcactccagac

SEQ ID NO: 1320867 - DNA, 16 bp, Homo sapiens
accttgacttgccatg

SEQ ID NO: 1320868 - DNA, 17 bp, Homo sapiens
accttgacttgccatga

SEQ ID NO: 1320869 - DNA, 12 bp, Homo sapiens
accttgccccaa

SEQ ID NO: 1320870 - DNA, 20 bp, Homo sapiens
accttgccccaacccttctt

SEQ ID NO: 1320871 - DNA, 22 bp, Homo sapiens
accttgccccaacccttcttca

SEQ ID NO: 1320872 - DNA, 10 bp, Homo sapiens
acctttgcag

SEQ ID NO: 1320873 - DNA, 13 bp, Homo sapiens
acgattcacagcc

SEQ ID NO: 1320874 - DNA, 18 bp, Homo sapiens
acgcattaagggcctgct

SEQ ID NO: 1320875 - DNA, 20 bp, Homo sapiens
acgcattaagggcctgctgg

SEQ ID NO: 1320876 - DNA, 22 bp, Homo sapiens
acgcattaagggcctgctggag

SEQ ID NO: 1320877 - DNA, 14 bp, Homo sapiens
acgccttcatgcca

SEQ ID NO: 1320878 - DNA, 15 bp, Homo sapiens
acgctgcgtgccatg

SEQ ID NO: 1320879 - DNA, 15 bp, Homo sapiens
acggctctgtgcccg

SEQ ID NO: 1320880 - DNA, 14 bp, Homo sapiens
acggtgagggtgcg

SEQ ID NO: 1320881 - DNA, 18 bp, Homo sapiens
acggtgagggtgcggggc

SEQ ID NO: 1320882 - DNA, 19 bp, Homo sapiens
acgtgcacaaattcatgtg

SEQ ID NO: 1320883 - DNA, 14 bp, Homo sapiens
actaaagccaggaa

SEQ ID NO: 1320884 - DNA, 13 bp, Homo sapiens
actaataaaatat

SEQ ID NO: 1320885 - DNA, 14 bp, Homo sapiens
actaataaaatatt

SEQ ID NO: 1320886 - DNA, 20 bp, Homo sapiens
actaataaaatattttctgt

SEQ ID NO: 1320887 - DNA, 15 bp, Homo sapiens
actaatacaattcat

SEQ ID NO: 1320888 - DNA, 16 bp, Homo sapiens
actaggcatttgtaaa

SEQ ID NO: 1320889 - DNA, 14 bp, Homo sapiens
actagtgctgaagc

SEQ ID NO: 1320890 - DNA, 19 bp, Homo sapiens
actatccctgcacataaac

SEQ ID NO: 1320891 - DNA, 20 bp, Homo sapiens
actatccctgcacataaact

SEQ ID NO: 1320892 - DNA, 13 bp, Homo sapiens
actcaactaggct

SEQ ID NO: 1320893 - DNA, 19 bp, Homo sapiens
actcatgactgaagggaaa

SEQ ID NO: 1320894 - DNA, 16 bp, Homo sapiens
actccagcgtcctcag

SEQ ID NO: 1320895 - DNA, 17 bp, Homo sapiens
actccagcgtcctcagc

SEQ ID NO: 1320896 - DNA, 20 bp, Homo sapiens
actccagcgtcctcagcacc

SEQ ID NO: 1320897 - DNA, 21 bp, Homo sapiens
actcctcagtaaaagtcttct

SEQ ID NO: 1320898 - DNA, 21 bp, Homo sapiens
actctcgtgatatgctgcttg

SEQ ID NO: 1320899 - DNA, 23 bp, Homo sapiens
actctcgtgatatgctgcttgtg

SEQ ID NO: 1320900 - DNA, 19 bp, Homo sapiens
actctgctctcctcgggcc

SEQ ID NO: 1320901 - DNA, 21 bp, Homo sapiens
actctgctctcctcgggccct

SEQ ID NO: 1320902 - DNA, 20 bp, Homo sapiens
actctgctgagggtccagaa

SEQ ID NO: 1320903 - DNA, 15 bp, Homo sapiens
actctggaccatgct

SEQ ID NO: 1320904 - DNA, 19 bp, Homo sapiens
actctggaccatgctgaga

SEQ ID NO: 1320905 - DNA, 11 bp, Homo sapiens
actgaaaaaaa

SEQ ID NO: 1320906 - DNA, 14 bp, Homo sapiens
actgagaagccaag

SEQ ID NO: 1320907 - DNA, 18 bp, Homo sapiens
actgagaagccaagcctg

SEQ ID NO: 1320908 - DNA, 12 bp, Homo sapiens
actgagagaagg

SEQ ID NO: 1320909 - DNA, 16 bp, Homo sapiens
actgcaactccagcgt

SEQ ID NO: 1320910 - DNA, 19 bp, Homo sapiens
actgcactccagcctgggt

SEQ ID NO: 1320911 - DNA, 19 bp, Homo sapiens
actgctactgacccagagg

SEQ ID NO: 1320912 - DNA, 14 bp, Homo sapiens
actggcccagaagc

SEQ ID NO: 1320913 - DNA, 14 bp, Homo sapiens
actggctcctccca

SEQ ID NO: 1320914 - DNA, 17 bp, Homo sapiens
actggctcctcccagca

SEQ ID NO: 1320915 - DNA, 16 bp, Homo sapiens
actggcttgctcccgc

SEQ ID NO: 1320916 - DNA, 19 bp, Homo sapiens
actggttttggccacccct

SEQ ID NO: 1320917 - DNA, 23 bp, Homo sapiens
actggttttggccaccccttgct

SEQ ID NO: 1320918 - DNA, 15 bp, Homo sapiens
actgtgcaggcccag

SEQ ID NO: 1320919 - DNA, 17 bp, Homo sapiens
actgtgcaggcccaggc

SEQ ID NO: 1320920 - DNA, 17 bp, Homo sapiens
actgtggggagggtcat

SEQ ID NO: 1320921 - DNA, 18 bp, Homo sapiens
actgtggggagggtcatg

SEQ ID NO: 1320922 - DNA, 22 bp, Homo sapiens
actgtgggtttgtggggggagg

SEQ ID NO: 1320923 - DNA, 19 bp, Homo sapiens
actgttattttcagcatga

SEQ ID NO: 1320924 - DNA, 16 bp, Homo sapiens
acttaactggcccaga

SEQ ID NO: 1320925 - DNA, 17 bp, Homo sapiens
acttaactggcccagaa

SEQ ID NO: 1320926 - DNA, 15 bp, Homo sapiens
acttagtttgtgaat

SEQ ID NO: 1320927 - DNA, 16 bp, Homo sapiens
acttcatctggaagtt

SEQ ID NO: 1320928 - DNA, 17 bp, Homo sapiens
acttgcaaaatggagac

SEQ ID NO: 1320929 - DNA, 15 bp, Homo sapiens
acttggaaatattaa

SEQ ID NO: 1320930 - DNA, 16 bp, Homo sapiens
acttggaaatattaaa

SEQ ID NO: 1320931 - DNA, 13 bp, Homo sapiens
acttgtgactttg

SEQ ID NO: 1320932 - DNA, 17 bp, Homo sapiens
actttggctatgggtgg

SEQ ID NO: 1320933 - DNA, 18 bp, Homo sapiens
agaaaaagtcctgtcagt

SEQ ID NO: 1320934 - DNA, 21 bp, Homo sapiens
agaaagcctcctctggagaat

SEQ ID NO: 1320935 - DNA, 16 bp, Homo sapiens
agaaaggacctgcaaa

SEQ ID NO: 1320936 - DNA, 12 bp, Homo sapiens
agaaagtttccc

SEQ ID NO: 1320937 - DNA, 15 bp, Homo sapiens
agaaatctttctgga

SEQ ID NO: 1320938 - DNA, 20 bp, Homo sapiens
agaacaagaaatctttctgg

SEQ ID NO: 1320939 - DNA, 15 bp, Homo sapiens
agaacagctgttgac

SEQ ID NO: 1320940 - DNA, 14 bp, Homo sapiens
agaagccaagcctg

SEQ ID NO: 1320941 - DNA, 18 bp, Homo sapiens
agaagccttcttgctgcc

SEQ ID NO: 1320942 - DNA, 21 bp, Homo sapiens
agaagccttcttgctgcccac

SEQ ID NO: 1320943 - DNA, 22 bp, Homo sapiens
agaagctgattttcatgaaaat

SEQ ID NO: 1320944 - DNA, 23 bp, Homo sapiens
agaaggtagattttaagaatggt

SEQ ID NO: 1320945 - DNA, 21 bp, Homo sapiens
agaaggtttactttttggtgt

SEQ ID NO: 1320946 - DNA, 15 bp, Homo sapiens
agaatggtctcagtg

SEQ ID NO: 1320947 - DNA, 19 bp, Homo sapiens
agaattaggtttctttgaa

SEQ ID NO: 1320948 - DNA, 20 bp, Homo sapiens
agaattgtagataatactgt

SEQ ID NO: 1320949 - DNA, 16 bp, Homo sapiens
agacactgtgcaggcc

SEQ ID NO: 1320950 - DNA, 20 bp, Homo sapiens
agacatccctcatctagtct

SEQ ID NO: 1320951 - DNA, 21 bp, Homo sapiens
agacatccctcatctagtctt

SEQ ID NO: 1320952 - DNA, 13 bp, Homo sapiens
agaccgcgcccct

SEQ ID NO: 1320953 - DNA, 18 bp, Homo sapiens
agaccgcgcccctgggac

SEQ ID NO: 1320954 - DNA, 20 bp, Homo sapiens
agaccgcgcccctgggacta

SEQ ID NO: 1320955 - DNA, 21 bp, Homo sapiens
agaccgcgcccctgggactaa

SEQ ID NO: 1320956 - DNA, 14 bp, Homo sapiens
agaccgtcttcctc

SEQ ID NO: 1320957 - DNA, 15 bp, Homo sapiens
agacctggcctctgc

SEQ ID NO: 1320958 - DNA, 16 bp, Homo sapiens
agacctggcctctgcc

SEQ ID NO: 1320959 - DNA, 16 bp, Homo sapiens
agacctggctgggcct

SEQ ID NO: 1320960 - DNA, 22 bp, Homo sapiens
agactattcatcaagaatgagg

SEQ ID NO: 1320961 - DNA, 23 bp, Homo sapiens
agactattcatcaagaatgagga

SEQ ID NO: 1320962 - DNA, 11 bp, Homo sapiens
agactctgctc

SEQ ID NO: 1320963 - DNA, 14 bp, Homo sapiens
agactgtggggagg

SEQ ID NO: 1320964 - DNA, 22 bp, Homo sapiens
agggaaactgcagctgggaaga

SEQ ID NO: 1320965 - DNA, 13 bp, Homo sapiens
agggaccagctcc

SEQ ID NO: 1320966 - DNA, 15 bp, Homo sapiens
agggagtagaaagct

SEQ ID NO: 1320967 - DNA, 23 bp, Homo sapiens
agggagtagaaagcttctgagtt

SEQ ID NO: 1320968 - DNA, 17 bp, Homo sapiens
agggcacaatggctgga

SEQ ID NO: 1320969 - DNA, 17 bp, Homo sapiens
agggcccatgggaggga

SEQ ID NO: 1320970 - DNA, 12 bp, Homo sapiens
agggcctgctgg

SEQ ID NO: 1320971 - DNA, 16 bp, Homo sapiens
agggccttcccctccc

SEQ ID NO: 1320972 - DNA, 23 bp, Homo sapiens
agggcggggtgtctgtcttcctt

SEQ ID NO: 1320973 - DNA, 14 bp, Homo sapiens
aggggctagggctg

SEQ ID NO: 1320974 - DNA, 16 bp, Homo sapiens
agggtaggaccctcat

SEQ ID NO: 1320975 - DNA, 15 bp, Homo sapiens
agggtctgggatgaa

SEQ ID NO: 1320976 - DNA, 13 bp, Homo sapiens
aggtgcctcctga

SEQ ID NO: 1320977 - DNA, 20 bp, Homo sapiens
aggtggaggttacagtgagc

SEQ ID NO: 1320978 - DNA, 16 bp, Homo sapiens
aggttgttagaaaaat

SEQ ID NO: 1320979 - DNA, 13 bp, Homo sapiens
agtaagcccaagc

SEQ ID NO: 1320980 - DNA, 23 bp, Homo sapiens
agtataaatttgtgtaatattac

SEQ ID NO: 1320981 - DNA, 12 bp, Homo sapiens
agtcatggagaa

SEQ ID NO: 1320982 - DNA, 22 bp, Homo sapiens
agtccatgtcctatgcctcaca

SEQ ID NO: 1320983 - DNA, 19 bp, Homo sapiens
agtcccacggctctgtgcc

SEQ ID NO: 1320984 - DNA, 21 bp, Homo sapiens
agtcccacggctctgtgcccg

SEQ ID NO: 1320985 - DNA, 20 bp, Homo sapiens
agtcctcaaagctttttgaa

SEQ ID NO: 1320986 - DNA, 15 bp, Homo sapiens
agtcctccttcccag

SEQ ID NO: 1320987 - DNA, 16 bp, Homo sapiens
agtcctccttcccagc

SEQ ID NO: 1320988 - DNA, 19 bp, Homo sapiens
agtcctccttcccagctct

SEQ ID NO: 1320989 - DNA, 22 bp, Homo sapiens
agtcctgtcagttcagaaaaaa

SEQ ID NO: 1320990 - DNA, 15 bp, Homo sapiens
agtccttaagcagag

SEQ ID NO: 1320991 - DNA, 14 bp, Homo sapiens
agtctcagcctggg

SEQ ID NO: 1320992 - DNA, 17 bp, Homo sapiens
agtctcagcctgggccc

SEQ ID NO: 1320993 - DNA, 14 bp, Homo sapiens
agtctggaacactt

SEQ ID NO: 1320994 - DNA, 23 bp, Homo sapiens
agtcttctcccaactcagcctgt

SEQ ID NO: 1320995 - DNA, 18 bp, Homo sapiens
agtcttgacctctccagc

SEQ ID NO: 1320996 - DNA, 20 bp, Homo sapiens
agtgattgtagtttaataca

SEQ ID NO: 1320997 - DNA, 16 bp, Homo sapiens
agtgctgaagcttatt

SEQ ID NO: 1320998 - DNA, 21 bp, Homo sapiens
agtgctgaagcttattaatgc

SEQ ID NO: 1320999 - DNA, 22 bp, Homo sapiens
agtgctgaagcttattaatgct

SEQ ID NO: 1321000 - DNA, 15 bp, Homo sapiens
agtgttaatactgag

SEQ ID NO: 1321001 - DNA, 18 bp, Homo sapiens
agtgttaatactgagaaa

SEQ ID NO: 1321002 - DNA, 17 bp, Homo sapiens
agttaaaagtaaaagag

SEQ ID NO: 1321003 - DNA, 19 bp, Homo sapiens
agttcacatgtgccctgcc

SEQ ID NO: 1321004 - DNA, 14 bp, Homo sapiens
agttcatttcctga

SEQ ID NO: 1321005 - DNA, 21 bp, Homo sapiens
agttgctgtcagtcttgacct

SEQ ID NO: 1321006 - DNA, 23 bp, Homo sapiens
agttgctgtcagtcttgacctct

SEQ ID NO: 1321007 - DNA, 18 bp, Homo sapiens
agttgggaagtctcagcc

SEQ ID NO: 1321008 - DNA, 20 bp, Homo sapiens
agttgggaagtctcagcctg

SEQ ID NO: 1321009 - DNA, 22 bp, Homo sapiens
agtttagtgtggttttctgttt

SEQ ID NO: 1321010 - DNA, 18 bp, Homo sapiens
agtttatgcagtgctgct

SEQ ID NO: 1321011 - DNA, 19 bp, Homo sapiens
agtttcaacactagcattt

SEQ ID NO: 1321012 - DNA, 14 bp, Homo sapiens
agtttggcaggcag

SEQ ID NO: 1321013 - DNA, 14 bp, Homo sapiens
agttttcatgtgct

SEQ ID NO: 1321014 - DNA, 18 bp, Homo sapiens
ataaaaattactgtgtta

SEQ ID NO: 1321015 - DNA, 19 bp, Homo sapiens
ataaaactgatgtgaaact

SEQ ID NO: 1321016 - DNA, 13 bp, Homo sapiens
ataaaatatcatt

SEQ ID NO: 1321017 - DNA, 15 bp, Homo sapiens
ataaaatatcattca

SEQ ID NO: 1321018 - DNA, 17 bp, Homo sapiens
ataaaatatcattcagc

SEQ ID NO: 1321019 - DNA, 14 bp, Homo sapiens
ataaaatattttct

SEQ ID NO: 1321020 - DNA, 15 bp, Homo sapiens
ataaaatattttctg

SEQ ID NO: 1321021 - DNA, 18 bp, Homo sapiens
ataaaatattttctgtgt

SEQ ID NO: 1321022 - DNA, 22 bp, Homo sapiens
ataaaatattttctgtgtgttc

SEQ ID NO: 1321023 - DNA, 18 bp, Homo sapiens
ataaaattccctaaagcc

SEQ ID NO: 1321024 - DNA, 15 bp, Homo sapiens
ataaacttgtgcctc

SEQ ID NO: 1321025 - DNA, 22 bp, Homo sapiens
ataaagtcattaacaagaaaca

SEQ ID NO: 1321026 - DNA, 12 bp, Homo sapiens
ataaatgaaata

SEQ ID NO: 1321027 - DNA, 15 bp, Homo sapiens
ataaattaatatatt

SEQ ID NO: 1321028 - DNA, 15 bp, Homo sapiens
ataaatttgtgtaat

SEQ ID NO: 1321029 - DNA, 15 bp, Homo sapiens
ataacttcatgaaga

SEQ ID NO: 1321030 - DNA, 22 bp, Homo sapiens
ataagctacctgaatggagaat

SEQ ID NO: 1321031 - DNA, 12 bp, Homo sapiens
atacaatcagct

SEQ ID NO: 1321032 - DNA, 13 bp, Homo sapiens
atacaatcagctg

SEQ ID NO: 1321033 - DNA, 14 bp, Homo sapiens
atacaatcagctgc

SEQ ID NO: 1321034 - DNA, 16 bp, Homo sapiens
atacaatcagctgctt

SEQ ID NO: 1321035 - DNA, 13 bp, Homo sapiens
ataccagagaagg

SEQ ID NO: 1321036 - DNA, 14 bp, Homo sapiens
ataccagagaaggt

SEQ ID NO: 1321037 - DNA, 16 bp, Homo sapiens
ataccaggcccaggag

SEQ ID NO: 1321038 - DNA, 20 bp, Homo sapiens
atacgcattaagggcctgct

SEQ ID NO: 1321039 - DNA, 19 bp, Homo sapiens
atagagggagtagaaagct

SEQ ID NO: 1321040 - DNA, 22 bp, Homo sapiens
atagcccctggtgtgtaaataa

SEQ ID NO: 1321041 - DNA, 22 bp, Homo sapiens
atagggcccatgggagggagct

SEQ ID NO: 1321042 - DNA, 14 bp, Homo sapiens
atatgaacttaaca

SEQ ID NO: 1321043 - DNA, 18 bp, Homo sapiens
atatgctttaagacagaa

SEQ ID NO: 1321044 - DNA, 23 bp, Homo sapiens
atattaaaagaaagggttctgta

SEQ ID NO: 1321045 - DNA, 19 bp, Homo sapiens
atattaaaccataagatgg

SEQ ID NO: 1321046 - DNA, 20 bp, Homo sapiens
atattaatttatcagattgc

SEQ ID NO: 1321047 - DNA, 14 bp, Homo sapiens
atatttagtatacc

SEQ ID NO: 1321048 - DNA, 12 bp, Homo sapiens
atattttctgtg

SEQ ID NO: 1321049 - DNA, 14 bp, Homo sapiens
atattttctgtgtg

SEQ ID NO: 1321050 - DNA, 22 bp, Homo sapiens
atattttctgtgtgttcctggc

SEQ ID NO: 1321051 - DNA, 15 bp, Homo sapiens
atcaacatctcttga

SEQ ID NO: 1321052 - DNA, 15 bp, Homo sapiens
atcaatgataaattt

SEQ ID NO: 1321053 - DNA, 13 bp, Homo sapiens
atcacccctggtg

SEQ ID NO: 1321054 - DNA, 19 bp, Homo sapiens
atcacccctggtggctgca

SEQ ID NO: 1321055 - DNA, 22 bp, Homo sapiens
atcacccctggtggctgcaggc

SEQ ID NO: 1321056 - DNA, 19 bp, Homo sapiens
atcagattgcttttgtgca

SEQ ID NO: 1321057 - DNA, 12 bp, Homo sapiens
atcattcagcaa

SEQ ID NO: 1321058 - DNA, 13 bp, Homo sapiens
atcattcagcaac

SEQ ID NO: 1321059 - DNA, 16 bp, Homo sapiens
atccaccaccccaccc

SEQ ID NO: 1321060 - DNA, 20 bp, Homo sapiens
atccaccaccccacccacct

SEQ ID NO: 1321061 - DNA, 18 bp, Homo sapiens
atccacctatccaccacc

SEQ ID NO: 1321062 - DNA, 17 bp, Homo sapiens
atccagattcccaggcc

SEQ ID NO: 1321063 - DNA, 12 bp, Homo sapiens
atcccagcctca

SEQ ID NO: 1321064 - DNA, 14 bp, Homo sapiens
atcccagcctcaga

SEQ ID NO: 1321065 - DNA, 21 bp, Homo sapiens
atcccagcctcagaagccttc

SEQ ID NO: 1321066 - DNA, 22 bp, Homo sapiens
atcccagcctcagaagccttct

SEQ ID NO: 1321067 - DNA, 15 bp, Homo sapiens
atcccgccttctcca

SEQ ID NO: 1321068 - DNA, 16 bp, Homo sapiens
atccctgcacataaac

SEQ ID NO: 1321069 - DNA, 13 bp, Homo sapiens
atccctttgcaac

SEQ ID NO: 1321070 - DNA, 13 bp, Homo sapiens
atccgggtgctca

SEQ ID NO: 1321071 - DNA, 19 bp, Homo sapiens
atccgggtgctcaataaac

SEQ ID NO: 1321072 - DNA, 23 bp, Homo sapiens
atccttcttggcttcctggcgcc

SEQ ID NO: 1321073 - DNA, 19 bp, Homo sapiens
atcgggggtgagcgaagcc

SEQ ID NO: 1321074 - DNA, 21 bp, Homo sapiens
atctacgaagccacaggcctg

SEQ ID NO: 1321075 - DNA, 20 bp, Homo sapiens
atctagtctgaagtctggaa

SEQ ID NO: 1321076 - DNA, 21 bp, Homo sapiens
atctagtctgaagtctggaac

SEQ ID NO: 1321077 - DNA, 15 bp, Homo sapiens
atctagtcttgacct

SEQ ID NO: 1321078 - DNA, 18 bp, Homo sapiens
atctagtcttgacctctc

SEQ ID NO: 1321079 - DNA, 20 bp, Homo sapiens
atctagtcttgacctctcca

SEQ ID NO: 1321080 - DNA, 14 bp, Homo sapiens
atctcagtcctcaa

SEQ ID NO: 1321081 - DNA, 12 bp, Homo sapiens
atctgatgtttg

SEQ ID NO: 1321082 - DNA, 18 bp, Homo sapiens
atctgatgtttgttttcg

SEQ ID NO: 1321083 - DNA, 22 bp, Homo sapiens
atctggctggtaaatgacatct

SEQ ID NO: 1321084 - DNA, 18 bp, Homo sapiens
atctgttagatgctacta

SEQ ID NO: 1321085 - DNA, 19 bp, Homo sapiens
atctgttagatgctactaa

SEQ ID NO: 1321086 - DNA, 23 bp, Homo sapiens
atctgttagatgctactaagaaa

SEQ ID NO: 1321087 - DNA, 20 bp, Homo sapiens
atcttacttgcaaaatggag

SEQ ID NO: 1321088 - DNA, 16 bp, Homo sapiens
atcttccatatccggg

SEQ ID NO: 1321089 - DNA, 17 bp, Homo sapiens
atcttccatatccgggt

SEQ ID NO: 1321090 - DNA, 22 bp, Homo sapiens
atcttccatatccgggtgctca

SEQ ID NO: 1321091 - DNA, 16 bp, Homo sapiens
atcttggccttactgt

SEQ ID NO: 1321092 - DNA, 18 bp, Homo sapiens
atctttcctcttctcatt

SEQ ID NO: 1321093 - DNA, 19 bp, Homo sapiens
atgaaagtcttgtgactag

SEQ ID NO: 1321094 - DNA, 18 bp, Homo sapiens
atgaaataacacagcagt

SEQ ID NO: 1321095 - DNA, 13 bp, Homo sapiens
atgaacacaattt

SEQ ID NO: 1321096 - DNA, 18 bp, Homo sapiens
cagtataaaattacagtg

SEQ ID NO: 1321097 - DNA, 22 bp, Homo sapiens
cagtcccactaaggtgaccaga

SEQ ID NO: 1321098 - DNA, 22 bp, Homo sapiens
cagtgaaaataagccatgagaa

SEQ ID NO: 1321099 - DNA, 14 bp, Homo sapiens
cagtgcatgccagg

SEQ ID NO: 1321100 - DNA, 22 bp, Homo sapiens
cagtggagtccagatggcaggc

SEQ ID NO: 1321101 - DNA, 23 bp, Homo sapiens
cagtggagtccagatggcaggct

SEQ ID NO: 1321102 - DNA, 16 bp, Homo sapiens
cagtgtgaagacactg

SEQ ID NO: 1321103 - DNA, 17 bp, Homo sapiens
cagtgttaatactgaga

SEQ ID NO: 1321104 - DNA, 20 bp, Homo sapiens
cagtgttaatactgagaaaa

SEQ ID NO: 1321105 - DNA, 14 bp, Homo sapiens
cagttcagaaaaaa

SEQ ID NO: 1321106 - DNA, 14 bp, Homo sapiens
cagttcatttcctg

SEQ ID NO: 1321107 - DNA, 22 bp, Homo sapiens
cagttgctgtcagtcttgacct

SEQ ID NO: 1321108 - DNA, 17 bp, Homo sapiens
cagttgggaagtctcag

SEQ ID NO: 1321109 - DNA, 18 bp, Homo sapiens
cagttgggaagtctcagc

SEQ ID NO: 1321110 - DNA, 22 bp, Homo sapiens
cagttgggaagtctcagcctgg

SEQ ID NO: 1321111 - DNA, 23 bp, Homo sapiens
cagttgggaagtctcagcctggg

SEQ ID NO: 1321112 - DNA, 12 bp, Homo sapiens
cataagagcttt

SEQ ID NO: 1321113 - DNA, 20 bp, Homo sapiens
catacgcattaagggcctgc

SEQ ID NO: 1321114 - DNA, 21 bp, Homo sapiens
catagaatagcatgttgtaga

SEQ ID NO: 1321115 - DNA, 22 bp, Homo sapiens
catatccgggtgctcaataaac

SEQ ID NO: 1321116 - DNA, 23 bp, Homo sapiens
catatccgggtgctcaataaact

SEQ ID NO: 1321117 - DNA, 13 bp, Homo sapiens
catatttaaaggg

SEQ ID NO: 1321118 - DNA, 13 bp, Homo sapiens
catatttagtata

SEQ ID NO: 1321119 - DNA, 23 bp, Homo sapiens
catatttagtataccagagaagg

SEQ ID NO: 1321120 - DNA, 18 bp, Homo sapiens
catattttacttggaaat

SEQ ID NO: 1321121 - DNA, 19 bp, Homo sapiens
catcacccctggtggctgc

SEQ ID NO: 1321122 - DNA, 14 bp, Homo sapiens
catcagaacagctg

SEQ ID NO: 1321123 - DNA, 17 bp, Homo sapiens
catcagaacagctgttg

SEQ ID NO: 1321124 - DNA, 18 bp, Homo sapiens
catcatatacaaatgttt

SEQ ID NO: 1321125 - DNA, 21 bp, Homo sapiens
catcatggggggagcaccctg

SEQ ID NO: 1321126 - DNA, 12 bp, Homo sapiens
catcattattat

SEQ ID NO: 1321127 - DNA, 16 bp, Homo sapiens
catcccgccttctcca

SEQ ID NO: 1321128 - DNA, 19 bp, Homo sapiens
catcctccctgttccccac

SEQ ID NO: 1321129 - DNA, 19 bp, Homo sapiens
catctacgaagccacaggc

SEQ ID NO: 1321130 - DNA, 20 bp, Homo sapiens
catctacgaagccacaggcc

SEQ ID NO: 1321131 - DNA, 21 bp, Homo sapiens
catctacgaagccacaggcct

SEQ ID NO: 1321132 - DNA, 22 bp, Homo sapiens
catctagtcttgacctctccag

SEQ ID NO: 1321133 - DNA, 22 bp, Homo sapiens
catctggaagttaaagtgaggc

SEQ ID NO: 1321134 - DNA, 14 bp, Homo sapiens
catgaaggcacctg

SEQ ID NO: 1321135 - DNA, 22 bp, Homo sapiens
catgaaggcacctgcccccaca

SEQ ID NO: 1321136 - DNA, 17 bp, Homo sapiens
catgcccatattttact

SEQ ID NO: 1321137 - DNA, 16 bp, Homo sapiens
catgccccgccatggt

SEQ ID NO: 1321138 - DNA, 17 bp, Homo sapiens
catgcctaaagcccatt

SEQ ID NO: 1321139 - DNA, 17 bp, Homo sapiens
catgctgagacatccct

SEQ ID NO: 1321140 - DNA, 19 bp, Homo sapiens
catgctgagacatccctca

SEQ ID NO: 1321141 - DNA, 20 bp, Homo sapiens
catgctgagacatccctcat

SEQ ID NO: 1321142 - DNA, 13 bp, Homo sapiens
catgctgtgtaag

SEQ ID NO: 1321143 - DNA, 19 bp, Homo sapiens
catgctgtgtaagctgtgt

SEQ ID NO: 1321144 - DNA, 15 bp, Homo sapiens
catggaatgagggtt

SEQ ID NO: 1321145 - DNA, 20 bp, Homo sapiens
catggagaaccacctacccc

SEQ ID NO: 1321146 - DNA, 14 bp, Homo sapiens
catgggagggagct

SEQ ID NO: 1321147 - DNA, 21 bp, Homo sapiens
catgggtcgcccatgagagcg

SEQ ID NO: 1321148 - DNA, 21 bp, Homo sapiens
catggtcccttgtcaccaggc

SEQ ID NO: 1321149 - DNA, 20 bp, Homo sapiens
catggtgaaaccccatctct

SEQ ID NO: 1321150 - DNA, 16 bp, Homo sapiens
catgtcctatgcctca

SEQ ID NO: 1321151 - DNA, 18 bp, Homo sapiens
catgtcctatgcctcaca

SEQ ID NO: 1321152 - DNA, 23 bp, Homo sapiens
catgtcttccattaagaacacta

SEQ ID NO: 1321153 - DNA, 15 bp, Homo sapiens
catgtgccctgcctt

SEQ ID NO: 1321154 - DNA, 20 bp, Homo sapiens
catgttcaattatttccccc

SEQ ID NO: 1321155 - DNA, 13 bp, Homo sapiens
cattaacaagaaa

SEQ ID NO: 1321156 - DNA, 16 bp, Homo sapiens
cattaagggcctgctg

SEQ ID NO: 1321157 - DNA, 11 bp, Homo sapiens
cattattatta

SEQ ID NO: 1321158 - DNA, 19 bp, Homo sapiens
cattcaagagaggtgctat

SEQ ID NO: 1321159 - DNA, 17 bp, Homo sapiens
cattcagccttcaatca

SEQ ID NO: 1321160 - DNA, 16 bp, Homo sapiens
cattcatccatccgtt

SEQ ID NO: 1321161 - DNA, 21 bp, Homo sapiens
cattcatccatccgttcattc

SEQ ID NO: 1321162 - DNA, 22 bp, Homo sapiens
cattctgctctgcccatgccta

SEQ ID NO: 1321163 - DNA, 17 bp, Homo sapiens
cattgtgaattgcctgc

SEQ ID NO: 1321164 - DNA, 14 bp, Homo sapiens
catttatggaactt

SEQ ID NO: 1321165 - DNA, 22 bp, Homo sapiens
catttctctcttatatgccaga

SEQ ID NO: 1321166 - DNA, 15 bp, Homo sapiens
catttgtaaatatta

SEQ ID NO: 1321167 - DNA, 17 bp, Homo sapiens
cattttttaaaacaaga

SEQ ID NO: 1321168 - DNA, 18 bp, Homo sapiens
ccaacaccatcacagctt

SEQ ID NO: 1321169 - DNA, 20 bp, Homo sapiens
ccaacaccatcacagcttgt

SEQ ID NO: 1321170 - DNA, 21 bp, Homo sapiens
ccaacaccatcacagcttgtt

SEQ ID NO: 1321171 - DNA, 16 bp, Homo sapiens
ccaactcacccttggc

SEQ ID NO: 1321172 - DNA, 20 bp, Homo sapiens
ccaagctaagctgcaggcac

SEQ ID NO: 1321173 - DNA, 21 bp, Homo sapiens
ccaagctaagctgcaggcaca

SEQ ID NO: 1321174 - DNA, 13 bp, Homo sapiens
ccaatctggctgg

SEQ ID NO: 1321175 - DNA, 16 bp, Homo sapiens
ccacaacgtcccctca

SEQ ID NO: 1321176 - DNA, 20 bp, Homo sapiens
ccacacatgcaagggatgaa

SEQ ID NO: 1321177 - DNA, 18 bp, Homo sapiens
ccacagctccttgcaaac

SEQ ID NO: 1321178 - DNA, 12 bp, Homo sapiens
ccacaggcctgg

SEQ ID NO: 1321179 - DNA, 14 bp, Homo sapiens
ccacaggcctggcc

SEQ ID NO: 1321180 - DNA, 21 bp, Homo sapiens
ccacaggtcctccatcacccc

SEQ ID NO: 1321181 - DNA, 12 bp, Homo sapiens
ccaccaccccac

SEQ ID NO: 1321182 - DNA, 15 bp, Homo sapiens
ccacccacctttgca

SEQ ID NO: 1321183 - DNA, 16 bp, Homo sapiens
ccacccacctttgcag

SEQ ID NO: 1321184 - DNA, 20 bp, Homo sapiens
ccaccctctccacacccagc

SEQ ID NO: 1321185 - DNA, 15 bp, Homo sapiens
ccacccttggtctca

SEQ ID NO: 1321186 - DNA, 18 bp, Homo sapiens
ccacccttggtctcatgc

SEQ ID NO: 1321187 - DNA, 21 bp, Homo sapiens
ccacccttggtctcatgcccc

SEQ ID NO: 1321188 - DNA, 10 bp, Homo sapiens
ccactgaaga

SEQ ID NO: 1321189 - DNA, 11 bp, Homo sapiens
ccactgaagag

SEQ ID NO: 1321190 - DNA, 22 bp, Homo sapiens
ccactggctcctcccagcacag

SEQ ID NO: 1321191 - DNA, 14 bp, Homo sapiens
ccagaagattagca

SEQ ID NO: 1321192 - DNA, 23 bp, Homo sapiens
ccagaaggagggggtgacctccg

SEQ ID NO: 1321193 - DNA, 12 bp, Homo sapiens
ccagacctggcc

SEQ ID NO: 1321194 - DNA, 13 bp, Homo sapiens
ccagacctggcct

SEQ ID NO: 1321195 - DNA, 18 bp, Homo sapiens
ccagacctggcctctgcc

SEQ ID NO: 1321196 - DNA, 23 bp, Homo sapiens
ccagacctggcctctgccatcct

SEQ ID NO: 1321197 - DNA, 14 bp, Homo sapiens
ccagatggcaggct

SEQ ID NO: 1321198 - DNA, 19 bp, Homo sapiens
ccagattcccaggccaggc

SEQ ID NO: 1321199 - DNA, 13 bp, Homo sapiens
ccagcatcccagc

SEQ ID NO: 1321200 - DNA, 18 bp, Homo sapiens
ccagcatcccagcctcag

SEQ ID NO: 1321201 - DNA, 20 bp, Homo sapiens
ccagcatcccagcctcagaa

SEQ ID NO: 1321202 - DNA, 17 bp, Homo sapiens
ccagccattctggtatt

SEQ ID NO: 1321203 - DNA, 12 bp, Homo sapiens
ccagccctgagg

SEQ ID NO: 1321204 - DNA, 16 bp, Homo sapiens
ccagcctcagaagcct

SEQ ID NO: 1321205 - DNA, 18 bp, Homo sapiens
ccagcctcagaagccttc

SEQ ID NO: 1321206 - DNA, 19 bp, Homo sapiens
ccagcctcagaagccttct

SEQ ID NO: 1321207 - DNA, 22 bp, Homo sapiens
ccagcctcagaagccttcttgc

SEQ ID NO: 1321208 - DNA, 22 bp, Homo sapiens
ccagcctctgccccacccatca

SEQ ID NO: 1321209 - DNA, 14 bp, Homo sapiens
ccagcctgtcccac

SEQ ID NO: 1321210 - DNA, 16 bp, Homo sapiens
ccagcgtcctcagcac

SEQ ID NO: 1321211 - DNA, 22 bp, Homo sapiens
ccagcgtcctcagcaccccact

SEQ ID NO: 1321212 - DNA, 14 bp, Homo sapiens
ccagctccccgggg

SEQ ID NO: 1321213 - DNA, 20 bp, Homo sapiens
ccaggaacagggaccagctc

SEQ ID NO: 1321214 - DNA, 22 bp, Homo sapiens
ccaggagagcttagggtctcag

SEQ ID NO: 1321215 - DNA, 15 bp, Homo sapiens
ccaggagtaagccca

SEQ ID NO: 1321216 - DNA, 20 bp, Homo sapiens
ccaggagtaagcccaagcta

SEQ ID NO: 1321217 - DNA, 20 bp, Homo sapiens
ccaggataatttttaaacca

SEQ ID NO: 1321218 - DNA, 12 bp, Homo sapiens
ccaggcaggccc

SEQ ID NO: 1321219 - DNA, 18 bp, Homo sapiens
ccaggcaggcccagcctc

SEQ ID NO: 1321220 - DNA, 20 bp, Homo sapiens
ccaggcaggcccagcctctg

SEQ ID NO: 1321221 - DNA, 23 bp, Homo sapiens
ccaggcaggcccagcctctgccc

SEQ ID NO: 1321222 - DNA, 23 bp, Homo sapiens
ccaggctcccgaccccatccacc

SEQ ID NO: 1321223 - DNA, 18 bp, Homo sapiens
ccagtataaaattacagt

SEQ ID NO: 1321224 - DNA, 14 bp, Homo sapiens
ccagtcccacggct

SEQ ID NO: 1321225 - DNA, 16 bp, Homo sapiens
ccagtcccacggctct

SEQ ID NO: 1321226 - DNA, 17 bp, Homo sapiens
ccagtcccacggctctg

SEQ ID NO: 1321227 - DNA, 15 bp, Homo sapiens
ctacattctgctctg

SEQ ID NO: 1321228 - DNA, 17 bp, Homo sapiens
ctacattctgctctgcc

SEQ ID NO: 1321229 - DNA, 18 bp, Homo sapiens
ctacattctgctctgccc

SEQ ID NO: 1321230 - DNA, 12 bp, Homo sapiens
ctaccctgggtc

SEQ ID NO: 1321231 - DNA, 21 bp, Homo sapiens
ctaccttgccccaacccttct

SEQ ID NO: 1321232 - DNA, 23 bp, Homo sapiens
ctactaagaaaatagagatgagc

SEQ ID NO: 1321233 - DNA, 14 bp, Homo sapiens
ctactgacccagag

SEQ ID NO: 1321234 - DNA, 15 bp, Homo sapiens
ctactgacccagagg

SEQ ID NO: 1321235 - DNA, 17 bp, Homo sapiens
ctagatctttgtgccaa

SEQ ID NO: 1321236 - DNA, 15 bp, Homo sapiens
ctagatgaagaaaga

SEQ ID NO: 1321237 - DNA, 17 bp, Homo sapiens
ctagatgaagaaagaga

SEQ ID NO: 1321238 - DNA, 15 bp, Homo sapiens
ctagggctgagcacc

SEQ ID NO: 1321239 - DNA, 13 bp, Homo sapiens
ctaggggaatgag

SEQ ID NO: 1321240 - DNA, 14 bp, Homo sapiens
ctagtactgtgaat

SEQ ID NO: 1321241 - DNA, 19 bp, Homo sapiens
ctagtcttgacctctccag

SEQ ID NO: 1321242 - DNA, 16 bp, Homo sapiens
ctagtgctgaagctta

SEQ ID NO: 1321243 - DNA, 22 bp, Homo sapiens
ctagtgctgaagcttattaatg

SEQ ID NO: 1321244 - DNA, 14 bp, Homo sapiens
ctatccaccacccc

SEQ ID NO: 1321245 - DNA, 16 bp, Homo sapiens
ctatccaccaccccac

SEQ ID NO: 1321246 - DNA, 16 bp, Homo sapiens
ctatcgggggtgagcg

SEQ ID NO: 1321247 - DNA, 17 bp, Homo sapiens
ctatcgggggtgagcga

SEQ ID NO: 1321248 - DNA, 20 bp, Homo sapiens
ctatcgggggtgagcgaagc

SEQ ID NO: 1321249 - DNA, 20 bp, Homo sapiens
ctatgagttcacatgtgccc

SEQ ID NO: 1321250 - DNA, 23 bp, Homo sapiens
ctatgagttcacatgtgccctgc

SEQ ID NO: 1321251 - DNA, 15 bp, Homo sapiens
ctcaaccagacagat

SEQ ID NO: 1321252 - DNA, 18 bp, Homo sapiens
ctcaactctgctgagggt

SEQ ID NO: 1321253 - DNA, 20 bp, Homo sapiens
ctcaactgagaagccaagcc

SEQ ID NO: 1321254 - DNA, 14 bp, Homo sapiens
ctcaagccccttct

SEQ ID NO: 1321255 - DNA, 16 bp, Homo sapiens
ctcaagccccttctct

SEQ ID NO: 1321256 - DNA, 11 bp, Homo sapiens
ctcaataaact

SEQ ID NO: 1321257 - DNA, 17 bp, Homo sapiens
ctcaataaacttgtgcc

SEQ ID NO: 1321258 - DNA, 15 bp, Homo sapiens
ctcaatccctttgca

SEQ ID NO: 1321259 - DNA, 19 bp, Homo sapiens
ctcacccttggcccatccc

SEQ ID NO: 1321260 - DNA, 17 bp, Homo sapiens
ctcactctgctaccttg

SEQ ID NO: 1321261 - DNA, 19 bp, Homo sapiens
ctcactctgctaccttgcc

SEQ ID NO: 1321262 - DNA, 21 bp, Homo sapiens
ctcactggttttggccacccc

SEQ ID NO: 1321263 - DNA, 17 bp, Homo sapiens
ctcagaccgtcttcctc

SEQ ID NO: 1321264 - DNA, 14 bp, Homo sapiens
ctcagagcaagcct

SEQ ID NO: 1321265 - DNA, 19 bp, Homo sapiens
ctcagatgccggagcccca

SEQ ID NO: 1321266 - DNA, 20 bp, Homo sapiens
ctcagatgccggagccccaa

SEQ ID NO: 1321267 - DNA, 14 bp, Homo sapiens
ctcagcaccccact

SEQ ID NO: 1321268 - DNA, 17 bp, Homo sapiens
ctcagcaccccactcct

SEQ ID NO: 1321269 - DNA, 23 bp, Homo sapiens
ctcagcactgtttgaagattgcc

SEQ ID NO: 1321270 - DNA, 13 bp, Homo sapiens
ctcagcctgggcc

SEQ ID NO: 1321271 - DNA, 17 bp, Homo sapiens
ctcagcctgttccttcc

SEQ ID NO: 1321272 - DNA, 21 bp, Homo sapiens
ctcagcctgttccttcctgca

SEQ ID NO: 1321273 - DNA, 23 bp, Homo sapiens
ctcagcctgttccttcctgcaga

SEQ ID NO: 1321274 - DNA, 19 bp, Homo sapiens
ctcagctgttcagattgga

SEQ ID NO: 1321275 - DNA, 14 bp, Homo sapiens
ctcaggagagggcc

SEQ ID NO: 1321276 - DNA, 18 bp, Homo sapiens
ctcaggagagggccttcc

SEQ ID NO: 1321277 - DNA, 22 bp, Homo sapiens
ctcaggagagggccttcccctc

SEQ ID NO: 1321278 - DNA, 14 bp, Homo sapiens
ctcagggtgtccca

SEQ ID NO: 1321279 - DNA, 17 bp, Homo sapiens
ctcagtaaaagtcttct

SEQ ID NO: 1321280 - DNA, 20 bp, Homo sapiens
ctcagtgttaatactgagaa

SEQ ID NO: 1321281 - DNA, 19 bp, Homo sapiens
ctcatgccccgccatggtc

SEQ ID NO: 1321282 - DNA, 14 bp, Homo sapiens
ctccacacccagcc

SEQ ID NO: 1321283 - DNA, 16 bp, Homo sapiens
ctccacacccagcctg

SEQ ID NO: 1321284 - DNA, 16 bp, Homo sapiens
ctccactaccccgact

SEQ ID NO: 1321285 - DNA, 15 bp, Homo sapiens
ctccagacagacagg

SEQ ID NO: 1321286 - DNA, 12 bp, Homo sapiens
ctccagcatccc

SEQ ID NO: 1321287 - DNA, 14 bp, Homo sapiens
ctccagcatcccag

SEQ ID NO: 1321288 - DNA, 16 bp, Homo sapiens
ctccagcatcccagcc

SEQ ID NO: 1321289 - DNA, 19 bp, Homo sapiens
ctccagcatcccagcctca

SEQ ID NO: 1321290 - DNA, 17 bp, Homo sapiens
ctccagcgtcctcagca

SEQ ID NO: 1321291 - DNA, 19 bp, Homo sapiens
ctccagcgtcctcagcacc

SEQ ID NO: 1321292 - DNA, 23 bp, Homo sapiens
ctccagcgtcctcagcaccccac

SEQ ID NO: 1321293 - DNA, 18 bp, Homo sapiens
ctccaggcttcccctccc

SEQ ID NO: 1321294 - DNA, 12 bp, Homo sapiens
ctccatcacccc

SEQ ID NO: 1321295 - DNA, 17 bp, Homo sapiens
ctccatcacccctggtg

SEQ ID NO: 1321296 - DNA, 19 bp, Homo sapiens
ctccatcacccctggtggc

SEQ ID NO: 1321297 - DNA, 23 bp, Homo sapiens
ctccatcacccctggtggctgca

SEQ ID NO: 1321298 - DNA, 16 bp, Homo sapiens
ctcccaactcagcctg

SEQ ID NO: 1321299 - DNA, 14 bp, Homo sapiens
ctcccagccctgag

SEQ ID NO: 1321300 - DNA, 15 bp, Homo sapiens
ctcccagccctgagg

SEQ ID NO: 1321301 - DNA, 16 bp, Homo sapiens
ctcccagccctgaggg

SEQ ID NO: 1321302 - DNA, 13 bp, Homo sapiens
ctccccgggggcc

SEQ ID NO: 1321303 - DNA, 18 bp, Homo sapiens
ctcccctgcagccctggc

SEQ ID NO: 1321304 - DNA, 18 bp, Homo sapiens
ctcccctggggtgcaggc

SEQ ID NO: 1321305 - DNA, 18 bp, Homo sapiens
ctcccgaccccatccacc

SEQ ID NO: 1321306 - DNA, 16 bp, Homo sapiens
ctcccgccccagggtc

SEQ ID NO: 1321307 - DNA, 23 bp, Homo sapiens
ctccctgttccccacaggtcctc

SEQ ID NO: 1321308 - DNA, 19 bp, Homo sapiens
ctccggccaggtgcctcct

SEQ ID NO: 1321309 - DNA, 20 bp, Homo sapiens
ctccggcctggccttttcca

SEQ ID NO: 1321310 - DNA, 14 bp, Homo sapiens
ctcctcgggccctg

SEQ ID NO: 1321311 - DNA, 22 bp, Homo sapiens
ctcctcgggccctgtggtgctg

SEQ ID NO: 1321312 - DNA, 20 bp, Homo sapiens
ctcctgacacacctgcagcc

SEQ ID NO: 1321313 - DNA, 22 bp, Homo sapiens
ctcctggggcgcgtgaggcccg

SEQ ID NO: 1321314 - DNA, 23 bp, Homo sapiens
ctcctggggcgcgtgaggcccgt

SEQ ID NO: 1321315 - DNA, 15 bp, Homo sapiens
ctccttcccagctct

SEQ ID NO: 1321316 - DNA, 21 bp, Homo sapiens
ctcgcggcctcttctctcaga

SEQ ID NO: 1321317 - DNA, 13 bp, Homo sapiens
ctcggctggctcc

SEQ ID NO: 1321318 - DNA, 16 bp, Homo sapiens
ctcggctggctcccct

SEQ ID NO: 1321319 - DNA, 13 bp, Homo sapiens
ctcgggcccctga

SEQ ID NO: 1321320 - DNA, 14 bp, Homo sapiens
ctctacattctgct

SEQ ID NO: 1321321 - DNA, 16 bp, Homo sapiens
ctctacattctgctct

SEQ ID NO: 1321322 - DNA, 18 bp, Homo sapiens
ctctacattctgctctgc

SEQ ID NO: 1321323 - DNA, 15 bp, Homo sapiens
ctctcagagcaagcc

SEQ ID NO: 1321324 - DNA, 17 bp, Homo sapiens
ctctcagagcaagcctt

SEQ ID NO: 1321325 - DNA, 20 bp, Homo sapiens
ctctcagagcaagcctttga

SEQ ID NO: 1321326 - DNA, 19 bp, Homo sapiens
ctctccacacccagcctgt

SEQ ID NO: 1321327 - DNA, 23 bp, Homo sapiens
ctctccacacccagcctgtccca

SEQ ID NO: 1321328 - DNA, 18 bp, Homo sapiens
ctctccagcatcccagcc

SEQ ID NO: 1321329 - DNA, 20 bp, Homo sapiens
ctctccagcatcccagcctc

SEQ ID NO: 1321330 - DNA, 21 bp, Homo sapiens
ctctccagcatcccagcctca

SEQ ID NO: 1321331 - DNA, 15 bp, Homo sapiens
ctctccggcctggcc

SEQ ID NO: 1321332 - DNA, 17 bp, Homo sapiens
ctctccggcctggcctt

SEQ ID NO: 1321333 - DNA, 16 bp, Homo sapiens
ctctcctcgggccctg

SEQ ID NO: 1321334 - DNA, 15 bp, Homo sapiens
ctctcgcggcctctt

SEQ ID NO: 1321335 - DNA, 22 bp, Homo sapiens
ctctcgcggcctcttctctcag

SEQ ID NO: 1321336 - DNA, 15 bp, Homo sapiens
ctctctgaggcaagg

SEQ ID NO: 1321337 - DNA, 17 bp, Homo sapiens
ctctctgttctcttgct

SEQ ID NO: 1321338 - DNA, 21 bp, Homo sapiens
ctctgaggcaaggcccagacc

SEQ ID NO: 1321339 - DNA, 18 bp, Homo sapiens
ctctgatgcagaactttc

SEQ ID NO: 1321340 - DNA, 21 bp, Homo sapiens
ctctgccatcctccctgttcc

SEQ ID NO: 1321341 - DNA, 12 bp, Homo sapiens
ctctgcccatgc

SEQ ID NO: 1321342 - DNA, 17 bp, Homo sapiens
ctctgctaccttgcccc

SEQ ID NO: 1321343 - DNA, 13 bp, Homo sapiens
ctctgctctcctc

SEQ ID NO: 1321344 - DNA, 15 bp, Homo sapiens
ctctgctctcctcgg

SEQ ID NO: 1321345 - DNA, 21 bp, Homo sapiens
ctctgctctcctcgggccctg

SEQ ID NO: 1321346 - DNA, 23 bp, Homo sapiens
ctctgctctcctcgggccctgtg

SEQ ID NO: 1321347 - DNA, 13 bp, Homo sapiens
ctctgctgagggt

SEQ ID NO: 1321348 - DNA, 15 bp, Homo sapiens
ctctggaccatgctg

SEQ ID NO: 1321349 - DNA, 20 bp, Homo sapiens
ctctggaccatgctgagaca

SEQ ID NO: 1321350 - DNA, 20 bp, Homo sapiens
ctctgtgcccggtgccatct

SEQ ID NO: 1321351 - DNA, 14 bp, Homo sapiens
ctctgttctcttgc

SEQ ID NO: 1321352 - DNA, 13 bp, Homo sapiens
ctcttctctcaga

SEQ ID NO: 1321353 - DNA, 13 bp, Homo sapiens
ctcttttgttgtt

SEQ ID NO: 1321354 - DNA, 17 bp, Homo sapiens
ctcttttgttgtttctt

SEQ ID NO: 1321355 - DNA, 12 bp, Homo sapiens
ctgaagcttatt

SEQ ID NO: 1321356 - DNA, 16 bp, Homo sapiens
ctgaagcttattaatg

SEQ ID NO: 1321357 - DNA, 23 bp, Homo sapiens
ctgaagcttattaatgctaaggg

SEQ ID NO: 1321358 - DNA, 12 bp, Homo sapiens
ctgacccagagg

SEQ ID NO: 1321359 - DNA, 14 bp, Homo sapiens
ctgactctggacca

SEQ ID NO: 1321360 - DNA, 19 bp, Homo sapiens
gactagtgctgaagcttat

SEQ ID NO: 1321361 - DNA, 17 bp, Homo sapiens
gactattcatcaagaat

SEQ ID NO: 1321362 - DNA, 13 bp, Homo sapiens
gactcctggtcct

SEQ ID NO: 1321363 - DNA, 23 bp, Homo sapiens
gactctagtactgtgaatccagt

SEQ ID NO: 1321364 - DNA, 13 bp, Homo sapiens
gactggaactgca

SEQ ID NO: 1321365 - DNA, 23 bp, Homo sapiens
gactggggtcattttgactggct

SEQ ID NO: 1321366 - DNA, 17 bp, Homo sapiens
gactgtggggagggtca

SEQ ID NO: 1321367 - DNA, 23 bp, Homo sapiens
gacttcccccaccccagaagatt

SEQ ID NO: 1321368 - DNA, 16 bp, Homo sapiens
gacttgccatgaaggc

SEQ ID NO: 1321369 - DNA, 18 bp, Homo sapiens
gactttgagactattcat

SEQ ID NO: 1321370 - DNA, 20 bp, Homo sapiens
gagaaaggaggagacagagg

SEQ ID NO: 1321371 - DNA, 13 bp, Homo sapiens
gagaagccaagcc

SEQ ID NO: 1321372 - DNA, 18 bp, Homo sapiens
gagaagccaagcctggag

SEQ ID NO: 1321373 - DNA, 13 bp, Homo sapiens
gagaatacatctt

SEQ ID NO: 1321374 - DNA, 19 bp, Homo sapiens
gagaatacatcttgtttct

SEQ ID NO: 1321375 - DNA, 21 bp, Homo sapiens
gagaatacatcttgtttctga

SEQ ID NO: 1321376 - DNA, 23 bp, Homo sapiens
gagaatcttacagagtgattgta

SEQ ID NO: 1321377 - DNA, 23 bp, Homo sapiens
gagactattcatcaagaatgagg

SEQ ID NO: 1321378 - DNA, 14 bp, Homo sapiens
gagactgtggggag

SEQ ID NO: 1321379 - DNA, 16 bp, Homo sapiens
gagactgtggggaggg

SEQ ID NO: 1321380 - DNA, 14 bp, Homo sapiens
gagagagcagccag

SEQ ID NO: 1321381 - DNA, 11 bp, Homo sapiens
gagagggcctt

SEQ ID NO: 1321382 - DNA, 19 bp, Homo sapiens
gagagggccttcccctccc

SEQ ID NO: 1321383 - DNA, 16 bp, Homo sapiens
gagcaagcctttgacc

SEQ ID NO: 1321384 - DNA, 22 bp, Homo sapiens
gagcacatagccctgttgacct

SEQ ID NO: 1321385 - DNA, 16 bp, Homo sapiens
gagcacctctcagagc

SEQ ID NO: 1321386 - DNA, 13 bp, Homo sapiens
gagccccaagact

SEQ ID NO: 1321387 - DNA, 14 bp, Homo sapiens
gagctgagaagact

SEQ ID NO: 1321388 - DNA, 17 bp, Homo sapiens
gaggaaggatgcaaagt

SEQ ID NO: 1321389 - DNA, 15 bp, Homo sapiens
gaggagacagaggga

SEQ ID NO: 1321390 - DNA, 22 bp, Homo sapiens
gaggagacagagggaggacctg

SEQ ID NO: 1321391 - DNA, 17 bp, Homo sapiens
gaggagtggtttttctt

SEQ ID NO: 1321392 - DNA, 17 bp, Homo sapiens
gaggcaaggcccagacc

SEQ ID NO: 1321393 - DNA, 19 bp, Homo sapiens
gaggctgactcctggtcct

SEQ ID NO: 1321394 - DNA, 12 bp, Homo sapiens
gagggccttccc

SEQ ID NO: 1321395 - DNA, 16 bp, Homo sapiens
gagggccttcccctcc

SEQ ID NO: 1321396 - DNA, 21 bp, Homo sapiens
gagggccttcccctcccagcc

SEQ ID NO: 1321397 - DNA, 22 bp, Homo sapiens
gagggccttcccctcccagccc

SEQ ID NO: 1321398 - DNA, 23 bp, Homo sapiens
gagggtgcggggcctgcaggcca

SEQ ID NO: 1321399 - DNA, 22 bp, Homo sapiens
gagggtttggttagctcacagg

SEQ ID NO: 1321400 - DNA, 17 bp, Homo sapiens
gaggttccatgttttgt

SEQ ID NO: 1321401 - DNA, 15 bp, Homo sapiens
gagtccaaaccttct

SEQ ID NO: 1321402 - DNA, 17 bp, Homo sapiens
gagtccatgtcctatgc

SEQ ID NO: 1321403 - DNA, 18 bp, Homo sapiens
gagtccatgtcctatgcc

SEQ ID NO: 1321404 - DNA, 16 bp, Homo sapiens
gagtcctccttcccag

SEQ ID NO: 1321405 - DNA, 19 bp, Homo sapiens
gagtcctccttcccagctc

SEQ ID NO: 1321406 - DNA, 20 bp, Homo sapiens
gagttcacatgtgccctgcc

SEQ ID NO: 1321407 - DNA, 23 bp, Homo sapiens
gagttcacatgtgccctgccttg

SEQ ID NO: 1321408 - DNA, 16 bp, Homo sapiens
gataaaaaaacagctt

SEQ ID NO: 1321409 - DNA, 18 bp, Homo sapiens
gataacttcatgaagact

SEQ ID NO: 1321410 - DNA, 15 bp, Homo sapiens
gatacaatcagctgc

SEQ ID NO: 1321411 - DNA, 19 bp, Homo sapiens
gatacaatctgggatagtt

SEQ ID NO: 1321412 - DNA, 22 bp, Homo sapiens
gatagcgaatgcactcagggtc

SEQ ID NO: 1321413 - DNA, 20 bp, Homo sapiens
gatagtttgggggaacttgt

SEQ ID NO: 1321414 - DNA, 14 bp, Homo sapiens
gatataaacagctt

SEQ ID NO: 1321415 - DNA, 16 bp, Homo sapiens
gatgccggagccccaa

SEQ ID NO: 1321416 - DNA, 15 bp, Homo sapiens
gatgcgcagttgctg

SEQ ID NO: 1321417 - DNA, 16 bp, Homo sapiens
gatgctctctgaggca

SEQ ID NO: 1321418 - DNA, 15 bp, Homo sapiens
gatgggactgtgtcc

SEQ ID NO: 1321419 - DNA, 16 bp, Homo sapiens
gattattcaacagaga

SEQ ID NO: 1321420 - DNA, 14 bp, Homo sapiens
gattcacagcctcc

SEQ ID NO: 1321421 - DNA, 20 bp, Homo sapiens
gattcccaggccaggctccc

SEQ ID NO: 1321422 - DNA, 17 bp, Homo sapiens
gattctttcagattgct

SEQ ID NO: 1321423 - DNA, 14 bp, Homo sapiens
gattttaagaatgg

SEQ ID NO: 1321424 - DNA, 13 bp, Homo sapiens
gatttttaagagc

SEQ ID NO: 1321425 - DNA, 14 bp, Homo sapiens
gcaacgattcacag

SEQ ID NO: 1321426 - DNA, 15 bp, Homo sapiens
gcaacgattcacagc

SEQ ID NO: 1321427 - DNA, 17 bp, Homo sapiens
gcaacgattcacagcct

SEQ ID NO: 1321428 - DNA, 18 bp, Homo sapiens
gcaacgattcacagcctc

SEQ ID NO: 1321429 - DNA, 16 bp, Homo sapiens
gcaactccagcgtcct

SEQ ID NO: 1321430 - DNA, 20 bp, Homo sapiens
gcaactccagcgtcctcagc

SEQ ID NO: 1321431 - DNA, 23 bp, Homo sapiens
gcaactttctggggcctaataaa

SEQ ID NO: 1321432 - DNA, 19 bp, Homo sapiens
gcaactttttaattccata

SEQ ID NO: 1321433 - DNA, 16 bp, Homo sapiens
gcaagcctttgacctg

SEQ ID NO: 1321434 - DNA, 18 bp, Homo sapiens
gcaaggcagaaggccagg

SEQ ID NO: 1321435 - DNA, 15 bp, Homo sapiens
gcaaggcccagacct

SEQ ID NO: 1321436 - DNA, 20 bp, Homo sapiens
gcaaggcccagacctggcct

SEQ ID NO: 1321437 - DNA, 23 bp, Homo sapiens
gcaaggcccagacctggcctctg

SEQ ID NO: 1321438 - DNA, 19 bp, Homo sapiens
gcaattactacaaatggat

SEQ ID NO: 1321439 - DNA, 13 bp, Homo sapiens
gcacaggcaccta

SEQ ID NO: 1321440 - DNA, 21 bp, Homo sapiens
gcacatagccctgttgacctg

SEQ ID NO: 1321441 - DNA, 17 bp, Homo sapiens
gcaccccactcctcagt

SEQ ID NO: 1321442 - DNA, 22 bp, Homo sapiens
gcacccccaggacagcacacgg

SEQ ID NO: 1321443 - DNA, 11 bp, Homo sapiens
gcaccctgagg

SEQ ID NO: 1321444 - DNA, 14 bp, Homo sapiens
gcaccggctcagga

SEQ ID NO: 1321445 - DNA, 22 bp, Homo sapiens
gcaccggctcaggagagggcct

SEQ ID NO: 1321446 - DNA, 23 bp, Homo sapiens
gcacctgcccccacagctccttg

SEQ ID NO: 1321447 - DNA, 13 bp, Homo sapiens
gcacgtgcacaaa

SEQ ID NO: 1321448 - DNA, 18 bp, Homo sapiens
gcactgttcaggagtcca

SEQ ID NO: 1321449 - DNA, 11 bp, Homo sapiens
gcagacctggc

SEQ ID NO: 1321450 - DNA, 13 bp, Homo sapiens
gcagacctggctg

SEQ ID NO: 1321451 - DNA, 17 bp, Homo sapiens
gcagacctggctgggcc

SEQ ID NO: 1321452 - DNA, 12 bp, Homo sapiens
gcagccaggaga

SEQ ID NO: 1321453 - DNA, 14 bp, Homo sapiens
gcagcctccctccg

SEQ ID NO: 1321454 - DNA, 13 bp, Homo sapiens
gcagcctggctcc

SEQ ID NO: 1321455 - DNA, 14 bp, Homo sapiens
gcagcctggctccc

SEQ ID NO: 1321456 - DNA, 15 bp, Homo sapiens
gcagcctggctcccc

SEQ ID NO: 1321457 - DNA, 19 bp, Homo sapiens
gcagcctggctcccctggg

SEQ ID NO: 1321458 - DNA, 18 bp, Homo sapiens
gcagctggggggcaccgg

SEQ ID NO: 1321459 - DNA, 17 bp, Homo sapiens
gcaggcacacacgcctt

SEQ ID NO: 1321460 - DNA, 23 bp, Homo sapiens
gcaggccagtcccacggctctgt

SEQ ID NO: 1321461 - DNA, 13 bp, Homo sapiens
gcaggcccagcct

SEQ ID NO: 1321462 - DNA, 13 bp, Homo sapiens
gcaggcccaggca

SEQ ID NO: 1321463 - DNA, 16 bp, Homo sapiens
gcaggcccaggcaggc

SEQ ID NO: 1321464 - DNA, 17 bp, Homo sapiens
gcaggcccaggcaggcc

SEQ ID NO: 1321465 - DNA, 13 bp, Homo sapiens
gcaggctgaggca

SEQ ID NO: 1321466 - DNA, 17 bp, Homo sapiens
gcaggtgccaggaactc

SEQ ID NO: 1321467 - DNA, 21 bp, Homo sapiens
gcagtcatggagaaccaccta

SEQ ID NO: 1321468 - DNA, 17 bp, Homo sapiens
gcatcactttcctggat

SEQ ID NO: 1321469 - DNA, 19 bp, Homo sapiens
gcatcatgccaacttgtga

SEQ ID NO: 1321470 - DNA, 13 bp, Homo sapiens
gcatcccagcctc

SEQ ID NO: 1321471 - DNA, 14 bp, Homo sapiens
gcatcccagcctca

SEQ ID NO: 1321472 - DNA, 21 bp, Homo sapiens
gcatgcatcccactgctgact

SEQ ID NO: 1321473 - DNA, 18 bp, Homo sapiens
gcattgtgaattgcctgc

SEQ ID NO: 1321474 - DNA, 20 bp, Homo sapiens
gcattgtgaattgcctgcca

SEQ ID NO: 1321475 - DNA, 17 bp, Homo sapiens
gcatttgtaaatattaa

SEQ ID NO: 1321476 - DNA, 17 bp, Homo sapiens
gcattttttaaaacaag

SEQ ID NO: 1321477 - DNA, 23 bp, Homo sapiens
gccaaacaaaatgagatctcatt

SEQ ID NO: 1321478 - DNA, 19 bp, Homo sapiens
gccaaataaagttaaaagt

SEQ ID NO: 1321479 - DNA, 17 bp, Homo sapiens
gccaactcacccttggc

SEQ ID NO: 1321480 - DNA, 21 bp, Homo sapiens
gccaagcctggagtaggcctg

SEQ ID NO: 1321481 - DNA, 16 bp, Homo sapiens
gccacaggcctggcct

SEQ ID NO: 1321482 - DNA, 15 bp, Homo sapiens
gccaccccttgctct

SEQ ID NO: 1321483 - DNA, 16 bp, Homo sapiens
gccaccccttgctctc

SEQ ID NO: 1321484 - DNA, 21 bp, Homo sapiens
gccaccccttgctctctgttc

SEQ ID NO: 1321485 - DNA, 16 bp, Homo sapiens
gccacccttggtctca

SEQ ID NO: 1321486 - DNA, 22 bp, Homo sapiens
gccacccttggtctcatgcccc

SEQ ID NO: 1321487 - DNA, 18 bp, Homo sapiens
gccactgaagaggaggag

SEQ ID NO: 1321488 - DNA, 14 bp, Homo sapiens
gccagaatgccctg

SEQ ID NO: 1321489 - DNA, 15 bp, Homo sapiens
gccaggaacagggac

SEQ ID NO: 1321490 - DNA, 16 bp, Homo sapiens
gccaggaacagggacc

SEQ ID NO: 1321491 - DNA, 17 bp, Homo sapiens
gccaggaacagggacca

SEQ ID NO: 1321492 - DNA, 13 bp, Homo sapiens
gccaggagagctt

SEQ ID NO: 1321493 - DNA, 17 bp, Homo sapiens
gctttgttaccttaaaa

SEQ ID NO: 1321494 - DNA, 14 bp, Homo sapiens
gctttttgaaaacc

SEQ ID NO: 1321495 - DNA, 21 bp, Homo sapiens
ggaaactaataaaatattttc

SEQ ID NO: 1321496 - DNA, 22 bp, Homo sapiens
ggaaactaataaaatattttct

SEQ ID NO: 1321497 - DNA, 17 bp, Homo sapiens
ggaaagccatgaccttg

SEQ ID NO: 1321498 - DNA, 18 bp, Homo sapiens
ggaaagccatgaccttgt

SEQ ID NO: 1321499 - DNA, 17 bp, Homo sapiens
ggaacagggaccagctc

SEQ ID NO: 1321500 - DNA, 19 bp, Homo sapiens
ggaacagggaccagctccc

SEQ ID NO: 1321501 - DNA, 21 bp, Homo sapiens
ggaacccaccctctccacacc

SEQ ID NO: 1321502 - DNA, 21 bp, Homo sapiens
ggaactccccttcttcctgga

SEQ ID NO: 1321503 - DNA, 16 bp, Homo sapiens
ggaactgcaactccag

SEQ ID NO: 1321504 - DNA, 14 bp, Homo sapiens
ggaaggaaatctgg

SEQ ID NO: 1321505 - DNA, 12 bp, Homo sapiens
ggaataaaacat

SEQ ID NO: 1321506 - DNA, 15 bp, Homo sapiens
ggaataaaacatttc

SEQ ID NO: 1321507 - DNA, 12 bp, Homo sapiens
ggaatgaggggg

SEQ ID NO: 1321508 - DNA, 17 bp, Homo sapiens
ggaatgagggggctcag

SEQ ID NO: 1321509 - DNA, 20 bp, Homo sapiens
ggacatgggtcgcccatgag

SEQ ID NO: 1321510 - DNA, 21 bp, Homo sapiens
ggaccagctccccgggggcca

SEQ ID NO: 1321511 - DNA, 16 bp, Homo sapiens
ggacctcaccagagac

SEQ ID NO: 1321512 - DNA, 20 bp, Homo sapiens
ggacctgtgtatggtgacct

SEQ ID NO: 1321513 - DNA, 13 bp, Homo sapiens
ggactttgttaca

SEQ ID NO: 1321514 - DNA, 13 bp, Homo sapiens
ggagaaccaccta

SEQ ID NO: 1321515 - DNA, 18 bp, Homo sapiens
ggagagcttagggtctca

SEQ ID NO: 1321516 - DNA, 20 bp, Homo sapiens
ggagagcttagggtctcagg

SEQ ID NO: 1321517 - DNA, 21 bp, Homo sapiens
ggagccccaagactctgctct

SEQ ID NO: 1321518 - DNA, 22 bp, Homo sapiens
ggagccccaagactctgctctc

SEQ ID NO: 1321519 - DNA, 23 bp, Homo sapiens
ggagctggggcttctttctgctg

SEQ ID NO: 1321520 - DNA, 13 bp, Homo sapiens
ggagtccaaacct

SEQ ID NO: 1321521 - DNA, 18 bp, Homo sapiens
ggagtccaaaccttctac

SEQ ID NO: 1321522 - DNA, 17 bp, Homo sapiens
ggatgaattgtaaaagc

SEQ ID NO: 1321523 - DNA, 13 bp, Homo sapiens
ggcaaataaaatt

SEQ ID NO: 1321524 - DNA, 17 bp, Homo sapiens
ggcaacgattcacagcc

SEQ ID NO: 1321525 - DNA, 19 bp, Homo sapiens
ggcaacgattcacagcctc

SEQ ID NO: 1321526 - DNA, 18 bp, Homo sapiens
ggcacacacgccttcatg

SEQ ID NO: 1321527 - DNA, 23 bp, Homo sapiens
ggcaccgctgggttctgactctg

SEQ ID NO: 1321528 - DNA, 16 bp, Homo sapiens
ggcacctgcccccaca

SEQ ID NO: 1321529 - DNA, 18 bp, Homo sapiens
ggcacctgcccccacagc

SEQ ID NO: 1321530 - DNA, 19 bp, Homo sapiens
ggcacctgcccccacagct

SEQ ID NO: 1321531 - DNA, 13 bp, Homo sapiens
ggcagaaggccag

SEQ ID NO: 1321532 - DNA, 16 bp, Homo sapiens
ggccaactcacccttg

SEQ ID NO: 1321533 - DNA, 18 bp, Homo sapiens
ggccaccccttgctctct

SEQ ID NO: 1321534 - DNA, 14 bp, Homo sapiens
ggccactgaagagg

SEQ ID NO: 1321535 - DNA, 20 bp, Homo sapiens
ggccaggagtaagcccaagc

SEQ ID NO: 1321536 - DNA, 19 bp, Homo sapiens
ggccagtcccacggctctg

SEQ ID NO: 1321537 - DNA, 14 bp, Homo sapiens
ggccagtggcggaa

SEQ ID NO: 1321538 - DNA, 12 bp, Homo sapiens
ggcccagacctg

SEQ ID NO: 1321539 - DNA, 20 bp, Homo sapiens
ggcccagacctggcctctgc

SEQ ID NO: 1321540 - DNA, 23 bp, Homo sapiens
ggcccagacctggcctctgccat

SEQ ID NO: 1321541 - DNA, 18 bp, Homo sapiens
ggcccagcctctgcccca

SEQ ID NO: 1321542 - DNA, 18 bp, Homo sapiens
ggcccaggcaggcccagc

SEQ ID NO: 1321543 - DNA, 22 bp, Homo sapiens
ggcccatcccgccttctccagg

SEQ ID NO: 1321544 - DNA, 20 bp, Homo sapiens
ggcccatgggagggagctga

SEQ ID NO: 1321545 - DNA, 16 bp, Homo sapiens
ggcccctgagcctgtg

SEQ ID NO: 1321546 - DNA, 12 bp, Homo sapiens
ggccctgcccac

SEQ ID NO: 1321547 - DNA, 19 bp, Homo sapiens
ggcctctgccatcctccct

SEQ ID NO: 1321548 - DNA, 14 bp, Homo sapiens
ggcctgcaggccag

SEQ ID NO: 1321549 - DNA, 13 bp, Homo sapiens
ggcctgctggaga

SEQ ID NO: 1321550 - DNA, 13 bp, Homo sapiens
ggcctggcctcaa

SEQ ID NO: 1321551 - DNA, 18 bp, Homo sapiens
ggccttcccctcccagcc

SEQ ID NO: 1321552 - DNA, 14 bp, Homo sapiens
ggcgcgtgaggccc

SEQ ID NO: 1321553 - DNA, 23 bp, Homo sapiens
ggctcccctgcagccctggccca

SEQ ID NO: 1321554 - DNA, 13 bp, Homo sapiens
ggctcccctgggg

SEQ ID NO: 1321555 - DNA, 14 bp, Homo sapiens
ggctcctcccagca

SEQ ID NO: 1321556 - DNA, 12 bp, Homo sapiens
ggctctgtgccc

SEQ ID NO: 1321557 - DNA, 19 bp, Homo sapiens
ggctctgtgcccggtgcca

SEQ ID NO: 1321558 - DNA, 22 bp, Homo sapiens
ggctgagttatgaaaagataac

SEQ ID NO: 1321559 - DNA, 16 bp, Homo sapiens
ggctggaaggaggaag

SEQ ID NO: 1321560 - DNA, 20 bp, Homo sapiens
ggctggctcccctgcagccc

SEQ ID NO: 1321561 - DNA, 13 bp, Homo sapiens
ggcttctttctgc

SEQ ID NO: 1321562 - DNA, 16 bp, Homo sapiens
ggcttctttctgctgg

SEQ ID NO: 1321563 - DNA, 17 bp, Homo sapiens
ggcttctttctgctggc

SEQ ID NO: 1321564 - DNA, 21 bp, Homo sapiens
ggcttgctcccgccccagggt

SEQ ID NO: 1321565 - DNA, 22 bp, Homo sapiens
ggcttgctcccgccccagggtc

SEQ ID NO: 1321566 - DNA, 23 bp, Homo sapiens
ggcttgctcccgccccagggtct

SEQ ID NO: 1321567 - DNA, 18 bp, Homo sapiens
gggaaagccatgaccttg

SEQ ID NO: 1321568 - DNA, 14 bp, Homo sapiens
gggaagtctcagcc

SEQ ID NO: 1321569 - DNA, 15 bp, Homo sapiens
gggagatgctctctg

SEQ ID NO: 1321570 - DNA, 16 bp, Homo sapiens
gggagatgctctctga

SEQ ID NO: 1321571 - DNA, 14 bp, Homo sapiens
gggagctgagaaga

SEQ ID NO: 1321572 - DNA, 13 bp, Homo sapiens
gggaggctgactc

SEQ ID NO: 1321573 - DNA, 18 bp, Homo sapiens
gggagggagctgagaaga

SEQ ID NO: 1321574 - DNA, 22 bp, Homo sapiens
gggagggtcatgtacttcttta

SEQ ID NO: 1321575 - DNA, 16 bp, Homo sapiens
gggcaacgattcacag

SEQ ID NO: 1321576 - DNA, 18 bp, Homo sapiens
gggcaacgattcacagcc

SEQ ID NO: 1321577 - DNA, 16 bp, Homo sapiens
gggcaccggctcagga

SEQ ID NO: 1321578 - DNA, 19 bp, Homo sapiens
gggccaactcacccttggc

SEQ ID NO: 1321579 - DNA, 15 bp, Homo sapiens
gggcccatgggaggg

SEQ ID NO: 1321580 - DNA, 18 bp, Homo sapiens
gggcccatgggagggagc

SEQ ID NO: 1321581 - DNA, 12 bp, Homo sapiens
gggcctgctgga

SEQ ID NO: 1321582 - DNA, 12 bp, Homo sapiens
gggctagggctg

SEQ ID NO: 1321583 - DNA, 18 bp, Homo sapiens
gggctagtgggtttctga

SEQ ID NO: 1321584 - DNA, 18 bp, Homo sapiens
ggggccaactcacccttg

SEQ ID NO: 1321585 - DNA, 18 bp, Homo sapiens
ggggccatattcttcctg

SEQ ID NO: 1321586 - DNA, 20 bp, Homo sapiens
ggggcctaataaaactgatg

SEQ ID NO: 1321587 - DNA, 23 bp, Homo sapiens
ggggcctaataaaactgatgtga

SEQ ID NO: 1321588 - DNA, 20 bp, Homo sapiens
gggggctcagttctggactg

SEQ ID NO: 1321589 - DNA, 13 bp, Homo sapiens
gggggtgagcgaa

SEQ ID NO: 1321590 - DNA, 18 bp, Homo sapiens
ggggtgacctccggccag

SEQ ID NO: 1321591 - DNA, 14 bp, Homo sapiens
gggtcatgtacttc

SEQ ID NO: 1321592 - DNA, 19 bp, Homo sapiens
gggtgcggggcctgcaggc

SEQ ID NO: 1321593 - DNA, 14 bp, Homo sapiens
gggtgctcaataaa

SEQ ID NO: 1321594 - DNA, 14 bp, Homo sapiens
gggttctgactctg

SEQ ID NO: 1321595 - DNA, 19 bp, Homo sapiens
ggtatttggatatctgtta

SEQ ID NO: 1321596 - DNA, 19 bp, Homo sapiens
ggtcattttgactggcttg

SEQ ID NO: 1321597 - DNA, 16 bp, Homo sapiens
ggtcctaggctggaag

SEQ ID NO: 1321598 - DNA, 17 bp, Homo sapiens
ggtcctaggctggaagg

SEQ ID NO: 1321599 - DNA, 20 bp, Homo sapiens
ggtcctaggctggaaggagg

SEQ ID NO: 1321600 - DNA, 19 bp, Homo sapiens
ggtcctcgggcccctgagc

SEQ ID NO: 1321601 - DNA, 14 bp, Homo sapiens
ggtcgcccatgaga

SEQ ID NO: 1321602 - DNA, 12 bp, Homo sapiens
ggtctgaaaggg

SEQ ID NO: 1321603 - DNA, 12 bp, Homo sapiens
ggtcttctcagt

SEQ ID NO: 1321604 - DNA, 20 bp, Homo sapiens
ggtgacctccggccaggtgc

SEQ ID NO: 1321605 - DNA, 13 bp, Homo sapiens
ggtgacctctccg

SEQ ID NO: 1321606 - DNA, 15 bp, Homo sapiens
ggtgagcgaagcccc

SEQ ID NO: 1321607 - DNA, 22 bp, Homo sapiens
ggtgagggtgcggggcctgcag

SEQ ID NO: 1321608 - DNA, 17 bp, Homo sapiens
ggtgcggggcctgcagg

SEQ ID NO: 1321609 - DNA, 18 bp, Homo sapiens
ggtgcggggcctgcaggc

SEQ ID NO: 1321610 - DNA, 16 bp, Homo sapiens
ggtgctcaataaactt

SEQ ID NO: 1321611 - DNA, 21 bp, Homo sapiens
ggtgctcaataaacttgtgcc

SEQ ID NO: 1321612 - DNA, 22 bp, Homo sapiens
ggttcctaggggaatgaggggg

SEQ ID NO: 1321613 - DNA, 15 bp, Homo sapiens
ggttctgactctgga

SEQ ID NO: 1321614 - DNA, 18 bp, Homo sapiens
ggttgttagaaaaatgga

SEQ ID NO: 1321615 - DNA, 14 bp, Homo sapiens
ggtttctgattctt

SEQ ID NO: 1321616 - DNA, 20 bp, Homo sapiens
ggtttgagagagcagccagg

SEQ ID NO: 1321617 - DNA, 16 bp, Homo sapiens
ggtttgtggggggagg

SEQ ID NO: 1321618 - DNA, 17 bp, Homo sapiens
gtaaaaccttttttctt

SEQ ID NO: 1321619 - DNA, 19 bp, Homo sapiens
gtaaaagcaacatcagctt

SEQ ID NO: 1321620 - DNA, 20 bp, Homo sapiens
gtaaaatggaaaacttagtt

SEQ ID NO: 1321621 - DNA, 13 bp, Homo sapiens
gtaaatgacatct

SEQ ID NO: 1321622 - DNA, 22 bp, Homo sapiens
gtaactgtgcttgttgaatgtc

SEQ ID NO: 1321623 - DNA, 16 bp, Homo sapiens
gtacgctgcgtgccat

SEQ ID NO: 1321624 - DNA, 15 bp, Homo sapiens
gtagaggaaggatgc

SEQ ID NO: 1321625 - DNA, 15 bp, Homo sapiens
gtagatacaatcagc

SEQ ID NO: 1321626 - DNA, 19 bp, Homo sapiens
tcatgccagtgcatgccag

SEQ ID NO: 1321627 - DNA, 19 bp, Homo sapiens
tcatggggggagcaccctg

SEQ ID NO: 1321628 - DNA, 20 bp, Homo sapiens
tcatggggggagcaccctga

SEQ ID NO: 1321629 - DNA, 14 bp, Homo sapiens
tcatgtacttcttt

SEQ ID NO: 1321630 - DNA, 22 bp, Homo sapiens
tcatgttcaattatttccccca

SEQ ID NO: 1321631 - DNA, 11 bp, Homo sapiens
tccaaaccttc

SEQ ID NO: 1321632 - DNA, 23 bp, Homo sapiens
tccaaattgtttaaattcacaat

SEQ ID NO: 1321633 - DNA, 15 bp, Homo sapiens
tccacacccagcctg

SEQ ID NO: 1321634 - DNA, 16 bp, Homo sapiens
tccacacccagcctgt

SEQ ID NO: 1321635 - DNA, 19 bp, Homo sapiens
tccacacccagcctgtccc

SEQ ID NO: 1321636 - DNA, 20 bp, Homo sapiens
tccacacctcactctgctac

SEQ ID NO: 1321637 - DNA, 21 bp, Homo sapiens
tccacagtgtgaagacactgt

SEQ ID NO: 1321638 - DNA, 13 bp, Homo sapiens
tccaccaccccac

SEQ ID NO: 1321639 - DNA, 23 bp, Homo sapiens
tccaccaccccacccacctttgc

SEQ ID NO: 1321640 - DNA, 12 bp, Homo sapiens
tccaccttctca

SEQ ID NO: 1321641 - DNA, 21 bp, Homo sapiens
tccactgctactgacccagag

SEQ ID NO: 1321642 - DNA, 14 bp, Homo sapiens
tccagacagacagg

SEQ ID NO: 1321643 - DNA, 19 bp, Homo sapiens
tccagacagacagggggct

SEQ ID NO: 1321644 - DNA, 18 bp, Homo sapiens
tccagatggcaggctaca

SEQ ID NO: 1321645 - DNA, 15 bp, Homo sapiens
tccagattcccaggc

SEQ ID NO: 1321646 - DNA, 16 bp, Homo sapiens
tccagattcccaggcc

SEQ ID NO: 1321647 - DNA, 19 bp, Homo sapiens
tccagattcccaggccagg

SEQ ID NO: 1321648 - DNA, 14 bp, Homo sapiens
tccagcatcccagc

SEQ ID NO: 1321649 - DNA, 15 bp, Homo sapiens
tccagcatcccagcc

SEQ ID NO: 1321650 - DNA, 12 bp, Homo sapiens
tccagcgtcctc

SEQ ID NO: 1321651 - DNA, 14 bp, Homo sapiens
tccatatccgggtg

SEQ ID NO: 1321652 - DNA, 23 bp, Homo sapiens
tccatatccgggtgctcaataaa

SEQ ID NO: 1321653 - DNA, 23 bp, Homo sapiens
tccatcacccctggtggctgcag

SEQ ID NO: 1321654 - DNA, 14 bp, Homo sapiens
tccatgtcctatgc

SEQ ID NO: 1321655 - DNA, 13 bp, Homo sapiens
tcccaactcagcc

SEQ ID NO: 1321656 - DNA, 16 bp, Homo sapiens
tcccaactcagcctgt

SEQ ID NO: 1321657 - DNA, 17 bp, Homo sapiens
tcccaactcagcctgtt

SEQ ID NO: 1321658 - DNA, 19 bp, Homo sapiens
tcccaactcagcctgttcc

SEQ ID NO: 1321659 - DNA, 18 bp, Homo sapiens
tcccacggctctgtgccc

SEQ ID NO: 1321660 - DNA, 17 bp, Homo sapiens
tcccagaccccgacacc

SEQ ID NO: 1321661 - DNA, 24 bp, Homo sapiens
tcccagcctcagaagccttcttgc

SEQ ID NO: 1321662 - DNA, 14 bp, Homo sapiens
tcccagctctacat

SEQ ID NO: 1321663 - DNA, 14 bp, Homo sapiens
tcccaggccaggct

SEQ ID NO: 1321664 - DNA, 19 bp, Homo sapiens
tcccattttgcagatgaag

SEQ ID NO: 1321665 - DNA, 13 bp, Homo sapiens
tccccaccagtga

SEQ ID NO: 1321666 - DNA, 17 bp, Homo sapiens
tcccccatttttcccag

SEQ ID NO: 1321667 - DNA, 13 bp, Homo sapiens
tccccgagggcgg

SEQ ID NO: 1321668 - DNA, 13 bp, Homo sapiens
tcccctcaagccc

SEQ ID NO: 1321669 - DNA, 19 bp, Homo sapiens
tcccctcaagccccttctc

SEQ ID NO: 1321670 - DNA, 14 bp, Homo sapiens
tcccctcccagccc

SEQ ID NO: 1321671 - DNA, 15 bp, Homo sapiens
tcccctcccagccct

SEQ ID NO: 1321672 - DNA, 13 bp, Homo sapiens
tcccctgcagccc

SEQ ID NO: 1321673 - DNA, 13 bp, Homo sapiens
tcccgccccaggg

SEQ ID NO: 1321674 - DNA, 15 bp, Homo sapiens
tcccgccccagggtc

SEQ ID NO: 1321675 - DNA, 17 bp, Homo sapiens
tcccgccccagggtctg

SEQ ID NO: 1321676 - DNA, 18 bp, Homo sapiens
tcccgccccagggtctga

SEQ ID NO: 1321677 - DNA, 15 bp, Homo sapiens
tcccgccttctccag

SEQ ID NO: 1321678 - DNA, 15 bp, Homo sapiens
tccctccccctagtc

SEQ ID NO: 1321679 - DNA, 15 bp, Homo sapiens
tccctcgttttcaaa

SEQ ID NO: 1321680 - DNA, 18 bp, Homo sapiens
tccctgcacataaactcc

SEQ ID NO: 1321681 - DNA, 18 bp, Homo sapiens
tccctgttccccacaggt

SEQ ID NO: 1321682 - DNA, 23 bp, Homo sapiens
tccctgttccccacaggtcctcc

SEQ ID NO: 1321683 - DNA, 20 bp, Homo sapiens
tccctttgcaacgctcactg

SEQ ID NO: 1321684 - DNA, 22 bp, Homo sapiens
tccggccaggtgcctcctgaca

SEQ ID NO: 1321685 - DNA, 13 bp, Homo sapiens
tccggcctggcct

SEQ ID NO: 1321686 - DNA, 13 bp, Homo sapiens
tccgttcattcat

SEQ ID NO: 1321687 - DNA, 13 bp, Homo sapiens
tcctatgcctcac

SEQ ID NO: 1321688 - DNA, 14 bp, Homo sapiens
tcctcagcacccca

SEQ ID NO: 1321689 - DNA, 19 bp, Homo sapiens
tcctcagcaccccactcct

SEQ ID NO: 1321690 - DNA, 21 bp, Homo sapiens
tcctcagtaaaagtcttctcc

SEQ ID NO: 1321691 - DNA, 23 bp, Homo sapiens
tcctcagtaaaagtcttctccca

SEQ ID NO: 1321692 - DNA, 19 bp, Homo sapiens
tcctccatcacccctggtg

SEQ ID NO: 1321693 - DNA, 16 bp, Homo sapiens
tcctccctgttcccca

SEQ ID NO: 1321694 - DNA, 14 bp, Homo sapiens
tcctccttcccagc

SEQ ID NO: 1321695 - DNA, 14 bp, Homo sapiens
tcctcgggcccctg

SEQ ID NO: 1321696 - DNA, 18 bp, Homo sapiens
tcctcgggcccctgagcc

SEQ ID NO: 1321697 - DNA, 22 bp, Homo sapiens
tcctcgggcccctgagcctgtg

SEQ ID NO: 1321698 - DNA, 17 bp, Homo sapiens
tcctcgggccctgtggt

SEQ ID NO: 1321699 - DNA, 17 bp, Homo sapiens
tcctgacacacctgcag

SEQ ID NO: 1321700 - DNA, 14 bp, Homo sapiens
tcctgcagacctgg

SEQ ID NO: 1321701 - DNA, 18 bp, Homo sapiens
tcctgcagacctggctgg

SEQ ID NO: 1321702 - DNA, 23 bp, Homo sapiens
tcctgcagacctggctgggcctg

SEQ ID NO: 1321703 - DNA, 17 bp, Homo sapiens
tcctggggcgcgtgagg

SEQ ID NO: 1321704 - DNA, 10 bp, Homo sapiens
tcctgtaaac

SEQ ID NO: 1321705 - DNA, 20 bp, Homo sapiens
tcctgtaaacactcagctgt

SEQ ID NO: 1321706 - DNA, 19 bp, Homo sapiens
tccttcctgcagacctggc

SEQ ID NO: 1321707 - DNA, 19 bp, Homo sapiens
tccttcttggcttcctggc

SEQ ID NO: 1321708 - DNA, 19 bp, Homo sapiens
tcctttagatagcagcctg

SEQ ID NO: 1321709 - DNA, 14 bp, Homo sapiens
tcctttccaccttc

SEQ ID NO: 1321710 - DNA, 19 bp, Homo sapiens
tcctttccaccttctcaca

SEQ ID NO: 1321711 - DNA, 22 bp, Homo sapiens
tccttttgctgtgtgaaatctt

SEQ ID NO: 1321712 - DNA, 21 bp, Homo sapiens
tcgcggcctcttctctcagac

SEQ ID NO: 1321713 - DNA, 13 bp, Homo sapiens
tcggctggctccc

SEQ ID NO: 1321714 - DNA, 14 bp, Homo sapiens
tcgggcccctgagc

SEQ ID NO: 1321715 - DNA, 16 bp, Homo sapiens
tcgggcccctgagcct

SEQ ID NO: 1321716 - DNA, 21 bp, Homo sapiens
tcggggaataaaacatttctc

SEQ ID NO: 1321717 - DNA, 21 bp, Homo sapiens
tcgttagagaatggcctgaga

SEQ ID NO: 1321718 - DNA, 15 bp, Homo sapiens
tctacattctgctct

SEQ ID NO: 1321719 - DNA, 17 bp, Homo sapiens
tctacattctgctctgc

SEQ ID NO: 1321720 - DNA, 20 bp, Homo sapiens
tctacattctgctctgccca

SEQ ID NO: 1321721 - DNA, 13 bp, Homo sapiens
tctaccctgggtc

SEQ ID NO: 1321722 - DNA, 17 bp, Homo sapiens
tctacgaagccacaggc

SEQ ID NO: 1321723 - DNA, 20 bp, Homo sapiens
tctacgaagccacaggcctg

SEQ ID NO: 1321724 - DNA, 19 bp, Homo sapiens
tctagtcttgacctctcca

SEQ ID NO: 1321725 - DNA, 21 bp, Homo sapiens
tctagtcttgacctctccagc

SEQ ID NO: 1321726 - DNA, 19 bp, Homo sapiens
tctcagaccgtcttcctcc

SEQ ID NO: 1321727 - DNA, 23 bp, Homo sapiens
tctcagagcaagcctttgacctg

SEQ ID NO: 1321728 - DNA, 12 bp, Homo sapiens
tctcagcctggg

SEQ ID NO: 1321729 - DNA, 14 bp, Homo sapiens
tctcagcctgggcc

SEQ ID NO: 1321730 - DNA, 20 bp, Homo sapiens
tctcagcctgggcccctcag

SEQ ID NO: 1321731 - DNA, 21 bp, Homo sapiens
tctcagcctgggcccctcagc

SEQ ID NO: 1321732 - DNA, 18 bp, Homo sapiens
tctcagggtgtcccagac

SEQ ID NO: 1321733 - DNA, 18 bp, Homo sapiens
tctcagttcatttcctga

SEQ ID NO: 1321734 - DNA, 17 bp, Homo sapiens
tctccacacccagcctg

SEQ ID NO: 1321735 - DNA, 14 bp, Homo sapiens
tctccactaccccg

SEQ ID NO: 1321736 - DNA, 16 bp, Homo sapiens
tctcccaactcagcct

SEQ ID NO: 1321737 - DNA, 17 bp, Homo sapiens
tctcccaactcagcctg

SEQ ID NO: 1321738 - DNA, 19 bp, Homo sapiens
tctcccaactcagcctgtt

SEQ ID NO: 1321739 - DNA, 21 bp, Homo sapiens
tctcctcgggccctgtggtgc

SEQ ID NO: 1321740 - DNA, 20 bp, Homo sapiens
tctcctgtgtcttaaatact

SEQ ID NO: 1321741 - DNA, 21 bp, Homo sapiens
tctcgcggcctcttctctcag

SEQ ID NO: 1321742 - DNA, 15 bp, Homo sapiens
tctctactaaaaaat

SEQ ID NO: 1321743 - DNA, 20 bp, Homo sapiens
tctctgaggcaaggcccaga

SEQ ID NO: 1321744 - DNA, 23 bp, Homo sapiens
tctctgaggcaaggcccagacct

SEQ ID NO: 1321745 - DNA, 17 bp, Homo sapiens
tctcttatatgccagaa

SEQ ID NO: 1321746 - DNA, 21 bp, Homo sapiens
tctcttttgaatgttaagaat

SEQ ID NO: 1321747 - DNA, 14 bp, Homo sapiens
tctgactctggacc

SEQ ID NO: 1321748 - DNA, 20 bp, Homo sapiens
tctgaggcaaggcccagacc

SEQ ID NO: 1321749 - DNA, 14 bp, Homo sapiens
tctgagtagcttta

SEQ ID NO: 1321750 - DNA, 15 bp, Homo sapiens
tctgatgcagaactt

SEQ ID NO: 1321751 - DNA, 16 bp, Homo sapiens
tctgccatcctccctg

SEQ ID NO: 1321752 - DNA, 17 bp, Homo sapiens
tctgctctcctcgggcc

SEQ ID NO: 1321753 - DNA, 20 bp, Homo sapiens
tctgctctcctcgggccctg

SEQ ID NO: 1321754 - DNA, 23 bp, Homo sapiens
tctgctctttcttcttccacaca

SEQ ID NO: 1321755 - DNA, 12 bp, Homo sapiens
tctgctgagggt

SEQ ID NO: 1321756 - DNA, 13 bp, Homo sapiens
tctgctggctgat

SEQ ID NO: 1321757 - DNA, 19 bp, Homo sapiens
tctggaattgatgtttaca

SEQ ID NO: 1321758 - DNA, 21 bp, Homo sapiens
tgtggtgatgtacgctgcgtg

SEQ ID NO: 1321759 - DNA, 15 bp, Homo sapiens
tgtggttttctgttt

SEQ ID NO: 1321760 - DNA, 19 bp, Homo sapiens
tgtgtagcatgataccagg

SEQ ID NO: 1321761 - DNA, 14 bp, Homo sapiens
tgtgtcctagttct

SEQ ID NO: 1321762 - DNA, 23 bp, Homo sapiens
tgtgtgaaatctttcaagttgca

SEQ ID NO: 1321763 - DNA, 13 bp, Homo sapiens
tgtgtgttcctgg

SEQ ID NO: 1321764 - DNA, 16 bp, Homo sapiens
tgttaatactgagaaa

SEQ ID NO: 1321765 - DNA, 14 bp, Homo sapiens
tgttaccttaaaac

SEQ ID NO: 1321766 - DNA, 17 bp, Homo sapiens
tgttaccttaaaactag

SEQ ID NO: 1321767 - DNA, 20 bp, Homo sapiens
tgttaggatcaatgataaat

SEQ ID NO: 1321768 - DNA, 22 bp, Homo sapiens
tgttattttcagcatgaaaatg

SEQ ID NO: 1321769 - DNA, 18 bp, Homo sapiens
tgttcaattatttccccc

SEQ ID NO: 1321770 - DNA, 14 bp, Homo sapiens
tgttccttcctgca

SEQ ID NO: 1321771 - DNA, 15 bp, Homo sapiens
tgttccttcctgcag

SEQ ID NO: 1321772 - DNA, 23 bp, Homo sapiens
tgttccttcctgcagacctggct

SEQ ID NO: 1321773 - DNA, 13 bp, Homo sapiens
tgttctcttgctt

SEQ ID NO: 1321774 - DNA, 13 bp, Homo sapiens
tgttgacctgccc

SEQ ID NO: 1321775 - DNA, 14 bp, Homo sapiens
tgttgacctgcccg

SEQ ID NO: 1321776 - DNA, 19 bp, Homo sapiens
tgttgcttcagtaaaagga

SEQ ID NO: 1321777 - DNA, 20 bp, Homo sapiens
tgttgtagatacaatcagct

SEQ ID NO: 1321778 - DNA, 18 bp, Homo sapiens
tgtttctaatttgctgct

SEQ ID NO: 1321779 - DNA, 23 bp, Homo sapiens
tgtttcttaatttggaaactaat

SEQ ID NO: 1321780 - DNA, 22 bp, Homo sapiens
tgtttgaaatatggaactgtaa

SEQ ID NO: 1321781 - DNA, 13 bp, Homo sapiens
tgtttgaagattg

SEQ ID NO: 1321782 - DNA, 15 bp, Homo sapiens
tgttttgatgataaa

SEQ ID NO: 1321783 - DNA, 19 bp, Homo sapiens
tgttttggactttgttaca

SEQ ID NO: 1321784 - DNA, 20 bp, Homo sapiens
tgttttgggtggtaaagtgt

SEQ ID NO: 1321785 - DNA, 23 bp, Homo sapiens
ttaaaaagataaaaaaacagctt

SEQ ID NO: 1321786 - DNA, 15 bp, Homo sapiens
ttaaaaattgtctct

SEQ ID NO: 1321787 - DNA, 19 bp, Homo sapiens
ttaaaacaagaaagtttcc

SEQ ID NO: 1321788 - DNA, 20 bp, Homo sapiens
ttaaaacaagaaagtttccc

SEQ ID NO: 1321789 - DNA, 22 bp, Homo sapiens
ttaaaagaaagggttctgtaaa

SEQ ID NO: 1321790 - DNA, 23 bp, Homo sapiens
ttaaaagaaagggttctgtaaaa

SEQ ID NO: 1321791 - DNA, 17 bp, Homo sapiens
ttaaagagtcctccttc

SEQ ID NO: 1321792 - DNA, 22 bp, Homo sapiens
ttaaagagtcctccttcccagc

SEQ ID NO: 1321793 - DNA, 15 bp, Homo sapiens
ttaaagcttttgatg

SEQ ID NO: 1321794 - DNA, 17 bp, Homo sapiens
ttaaagcttttgatgtg

SEQ ID NO: 1321795 - DNA, 21 bp, Homo sapiens
ttaaagggaatgactttgaag

SEQ ID NO: 1321796 - DNA, 23 bp, Homo sapiens
ttaacatgctgtgtaagctgtgt

SEQ ID NO: 1321797 - DNA, 17 bp, Homo sapiens
ttaactggcccagaagc

SEQ ID NO: 1321798 - DNA, 14 bp, Homo sapiens
ttaagggcctgctg

SEQ ID NO: 1321799 - DNA, 15 bp, Homo sapiens
ttaagggcctgctgg

SEQ ID NO: 1321800 - DNA, 16 bp, Homo sapiens
ttaagggcctgctgga

SEQ ID NO: 1321801 - DNA, 21 bp, Homo sapiens
ttaatgctaagggcaggccca

SEQ ID NO: 1321802 - DNA, 14 bp, Homo sapiens
ttaatttatcagat

SEQ ID NO: 1321803 - DNA, 14 bp, Homo sapiens
ttaatttggaaact

SEQ ID NO: 1321804 - DNA, 16 bp, Homo sapiens
ttaatttggaaactaa

SEQ ID NO: 1321805 - DNA, 19 bp, Homo sapiens
ttacactgcctggtactga

SEQ ID NO: 1321806 - DNA, 11 bp, Homo sapiens
ttactgtgtta

SEQ ID NO: 1321807 - DNA, 18 bp, Homo sapiens
ttacttggaaatattaaa

SEQ ID NO: 1321808 - DNA, 21 bp, Homo sapiens
ttacttggaaatattaaaaga

SEQ ID NO: 1321809 - DNA, 16 bp, Homo sapiens
ttaggtttctttgaag

SEQ ID NO: 1321810 - DNA, 21 bp, Homo sapiens
ttaggtttctttgaagaagga

SEQ ID NO: 1321811 - DNA, 20 bp, Homo sapiens
ttatcaagctaataaaatat

SEQ ID NO: 1321812 - DNA, 21 bp, Homo sapiens
ttatcagattgcttttgtgca

SEQ ID NO: 1321813 - DNA, 15 bp, Homo sapiens
ttatccctcattcat

SEQ ID NO: 1321814 - DNA, 16 bp, Homo sapiens
ttatgcagtgctgctt

SEQ ID NO: 1321815 - DNA, 15 bp, Homo sapiens
ttatggaacttccct

SEQ ID NO: 1321816 - DNA, 17 bp, Homo sapiens
ttatgtttttgtactct

SEQ ID NO: 1321817 - DNA, 13 bp, Homo sapiens
ttattaatgctaa

SEQ ID NO: 1321818 - DNA, 14 bp, Homo sapiens
ttattaatgctaag

SEQ ID NO: 1321819 - DNA, 19 bp, Homo sapiens
ttatttcccccatttttcc

SEQ ID NO: 1321820 - DNA, 19 bp, Homo sapiens
ttatttgtgatgtactgta

SEQ ID NO: 1321821 - DNA, 14 bp, Homo sapiens
ttattttcagcatg

SEQ ID NO: 1321822 - DNA, 14 bp, Homo sapiens
ttcacatgtgccct

SEQ ID NO: 1321823 - DNA, 16 bp, Homo sapiens
ttcacatgtgccctgc

SEQ ID NO: 1321824 - DNA, 21 bp, Homo sapiens
ttcacatgtgccctgccttga

SEQ ID NO: 1321825 - DNA, 13 bp, Homo sapiens
ttcactgcactgt

SEQ ID NO: 1321826 - DNA, 19 bp, Homo sapiens
ttcagattggacataactg

SEQ ID NO: 1321827 - DNA, 22 bp, Homo sapiens
ttcagcatgaaaatgtgtgttt

SEQ ID NO: 1321828 - DNA, 22 bp, Homo sapiens
ttcaggagtccaaaccttctac

SEQ ID NO: 1321829 - DNA, 13 bp, Homo sapiens
ttcattcattcag

SEQ ID NO: 1321830 - DNA, 21 bp, Homo sapiens
ttccactgctactgacccaga

SEQ ID NO: 1321831 - DNA, 22 bp, Homo sapiens
ttccactgctactgacccagag

SEQ ID NO: 1321832 - DNA, 23 bp, Homo sapiens
ttccatatcaaaagttgatttct

SEQ ID NO: 1321833 - DNA, 18 bp, Homo sapiens
ttccatatccgggtgctc

SEQ ID NO: 1321834 - DNA, 19 bp, Homo sapiens
ttccatatccgggtgctca

SEQ ID NO: 1321835 - DNA, 13 bp, Homo sapiens
ttccattcgcatg

SEQ ID NO: 1321836 - DNA, 22 bp, Homo sapiens
ttcccaggcaaataaaattccc

SEQ ID NO: 1321837 - DNA, 23 bp, Homo sapiens
ttccccacaggtcctccatcacc

SEQ ID NO: 1321838 - DNA, 16 bp, Homo sapiens
ttcccccatttttccc

SEQ ID NO: 1321839 - DNA, 17 bp, Homo sapiens
ttcccctcccagccctg

SEQ ID NO: 1321840 - DNA, 20 bp, Homo sapiens
ttcccctcccagccctgagg

SEQ ID NO: 1321841 - DNA, 11 bp, Homo sapiens
ttccctaaagc

SEQ ID NO: 1321842 - DNA, 12 bp, Homo sapiens
ttccctaaagcc

SEQ ID NO: 1321843 - DNA, 19 bp, Homo sapiens
ttcctgcagacctggctgg

SEQ ID NO: 1321844 - DNA, 14 bp, Homo sapiens
ttcctggagtgcct

SEQ ID NO: 1321845 - DNA, 18 bp, Homo sapiens
ttcctggggcccaaatgc

SEQ ID NO: 1321846 - DNA, 15 bp, Homo sapiens
ttccttcctgcagac

SEQ ID NO: 1321847 - DNA, 12 bp, Homo sapiens
ttcgatgaggtt

SEQ ID NO: 1321848 - DNA, 16 bp, Homo sapiens
ttctccaggcttcccc

SEQ ID NO: 1321849 - DNA, 21 bp, Homo sapiens
ttctctcagaccgtcttcctc

SEQ ID NO: 1321850 - DNA, 22 bp, Homo sapiens
ttctctcagaccgtcttcctcc

SEQ ID NO: 1321851 - DNA, 23 bp, Homo sapiens
ttctctcagaccgtcttcctcca

SEQ ID NO: 1321852 - DNA, 13 bp, Homo sapiens
ttctgatattaat

SEQ ID NO: 1321853 - DNA, 14 bp, Homo sapiens
ttctgatattaatt

SEQ ID NO: 1321854 - DNA, 15 bp, Homo sapiens
ttctgattcttcaaa

SEQ ID NO: 1321855 - DNA, 12 bp, Homo sapiens
ttctgctctgcc

SEQ ID NO: 1321856 - DNA, 19 bp, Homo sapiens
ttctgctctgcccatgcct

SEQ ID NO: 1321857 - DNA, 22 bp, Homo sapiens
ttctggggcctaataaaactga

SEQ ID NO: 1321858 - DNA, 23 bp, Homo sapiens
ttctggggcctaataaaactgat

SEQ ID NO: 1321859 - DNA, 10 bp, Homo sapiens
ttctgtaaaa

SEQ ID NO: 1321860 - DNA, 19 bp, Homo sapiens
ttctgtaaaatggaaaact

SEQ ID NO: 1321861 - DNA, 13 bp, Homo sapiens
ttctgtaactgtg

SEQ ID NO: 1321862 - DNA, 23 bp, Homo sapiens
ttcttggacacttaattctgttc

SEQ ID NO: 1321863 - DNA, 13 bp, Homo sapiens
ttcttggcttcct

SEQ ID NO: 1321864 - DNA, 14 bp, Homo sapiens
ttcttggcttcctg

SEQ ID NO: 1321865 - DNA, 19 bp, Homo sapiens
ttcttgtctttgtccctgt

SEQ ID NO: 1321866 - DNA, 22 bp, Homo sapiens
ttctttattttttaacttatgt

SEQ ID NO: 1321867 - DNA, 12 bp, Homo sapiens
ttctttctgctg

SEQ ID NO: 1321868 - DNA, 13 bp, Homo sapiens
ttctttctgctgg

SEQ ID NO: 1321869 - DNA, 21 bp, Homo sapiens
ttgaacaacccaatctggctg

SEQ ID NO: 1321870 - DNA, 22 bp, Homo sapiens
ttgaacaacccaatctggctgg

SEQ ID NO: 1321871 - DNA, 18 bp, Homo sapiens
ttgaacccaggaggtgga

SEQ ID NO: 1321872 - DNA, 17 bp, Homo sapiens
ttgaagaaggaatcttt

SEQ ID NO: 1321873 - DNA, 16 bp, Homo sapiens
ttgaagcaaacagttg

SEQ ID NO: 1321874 - DNA, 18 bp, Homo sapiens
ttgaccagtataaaatta

SEQ ID NO: 1321875 - DNA, 21 bp, Homo sapiens
ttgacctgcccgatccagatt

SEQ ID NO: 1321876 - DNA, 23 bp, Homo sapiens
ttgacttgccatgaaggcacctg

SEQ ID NO: 1321877 - DNA, 22 bp, Homo sapiens
ttgatgataaaaggagaataag

SEQ ID NO: 1321878 - DNA, 14 bp, Homo sapiens
ttgcagatgaagta

SEQ ID NO: 1321879 - DNA, 18 bp, Homo sapiens
ttgcattttttaaaacaa

SEQ ID NO: 1321880 - DNA, 17 bp, Homo sapiens
ttgccatgaaggcacct

SEQ ID NO: 1321881 - DNA, 17 bp, Homo sapiens
ttgcctgccatggctgt

SEQ ID NO: 1321882 - DNA, 15 bp, Homo sapiens
ttgctctctgttctc

SEQ ID NO: 1321883 - DNA, 23 bp, Homo sapiens
ttgcttcccttttttcctttcca

SEQ ID NO: 1321884 - DNA, 14 bp, Homo sapiens
ttggaaactaataa

SEQ ID NO: 1321885 - DNA, 22 bp, Homo sapiens
ttggaaactaataaaatatttt

SEQ ID NO: 1321886 - DNA, 17 bp, Homo sapiens
ttggaaatattaaaaga

SEQ ID NO: 1321887 - DNA, 21 bp, Homo sapiens
ttggacataactgacttagtt

SEQ ID NO: 1321888 - DNA, 12 bp, Homo sapiens
ttggactttgtt

SEQ ID NO: 1321889 - DNA, 20 bp, Homo sapiens
ttggccaccccttgctctct

SEQ ID NO: 1321890 - DNA, 15 bp, Homo sapiens
atgaaggcttgtcag

SEQ ID NO: 1321891 - DNA, 19 bp, Homo sapiens
atgacagcacctgagaaga

SEQ ID NO: 1321892 - DNA, 15 bp, Homo sapiens
atgactgaagggaaa

SEQ ID NO: 1321893 - DNA, 16 bp, Homo sapiens
atgagttcacatgtgc

SEQ ID NO: 1321894 - DNA, 20 bp, Homo sapiens
atgatttctatgaacttgtc

SEQ ID NO: 1321895 - DNA, 13 bp, Homo sapiens
atgcaaagtataa

SEQ ID NO: 1321896 - DNA, 16 bp, Homo sapiens
atgcagtgctgctttg

SEQ ID NO: 1321897 - DNA, 17 bp, Homo sapiens
atgcatcccactgctga

SEQ ID NO: 1321898 - DNA, 20 bp, Homo sapiens
atgcattgtgaattgcctgc

SEQ ID NO: 1321899 - DNA, 23 bp, Homo sapiens
atgccaggaagcacgttcactag

SEQ ID NO: 1321900 - DNA, 22 bp, Homo sapiens
atgccctgaaactactgtatct

SEQ ID NO: 1321901 - DNA, 22 bp, Homo sapiens
atgccctgttcatgctgagcaa

SEQ ID NO: 1321902 - DNA, 21 bp, Homo sapiens
atgccggagccccaagactct

SEQ ID NO: 1321903 - DNA, 21 bp, Homo sapiens
atgcctcacaaatgctgtggt

SEQ ID NO: 1321904 - DNA, 22 bp, Homo sapiens
atgctctctgaggcaaggccca

SEQ ID NO: 1321905 - DNA, 23 bp, Homo sapiens
atgctctctgaggcaaggcccag

SEQ ID NO: 1321906 - DNA, 17 bp, Homo sapiens
atgctctgagtagcttt

SEQ ID NO: 1321907 - DNA, 21 bp, Homo sapiens
atgctgagacatccctcatct

SEQ ID NO: 1321908 - DNA, 21 bp, Homo sapiens
atgctgtggttcactgcactg

SEQ ID NO: 1321909 - DNA, 14 bp, Homo sapiens
atgctgtgtaagct

SEQ ID NO: 1321910 - DNA, 16 bp, Homo sapiens
atggaaaacttagttt

SEQ ID NO: 1321911 - DNA, 14 bp, Homo sapiens
atggaatgagggtt

SEQ ID NO: 1321912 - DNA, 17 bp, Homo sapiens
atggagaatacatcttg

SEQ ID NO: 1321913 - DNA, 22 bp, Homo sapiens
atggaggaccacgtctatttca

SEQ ID NO: 1321914 - DNA, 19 bp, Homo sapiens
atggcaggtgatgtcctgt

SEQ ID NO: 1321915 - DNA, 16 bp, Homo sapiens
atggcctctctccact

SEQ ID NO: 1321916 - DNA, 17 bp, Homo sapiens
atgggaaaaaggctgga

SEQ ID NO: 1321917 - DNA, 18 bp, Homo sapiens
atgggaaaaaggctggaa

SEQ ID NO: 1321918 - DNA, 13 bp, Homo sapiens
atgggagggagct

SEQ ID NO: 1321919 - DNA, 15 bp, Homo sapiens
atgggtcgcccatga

SEQ ID NO: 1321920 - DNA, 13 bp, Homo sapiens
atggtgacctctc

SEQ ID NO: 1321921 - DNA, 23 bp, Homo sapiens
atggtgacctctccggcctggcc

SEQ ID NO: 1321922 - DNA, 14 bp, Homo sapiens
atgtactgagacaa

SEQ ID NO: 1321923 - DNA, 18 bp, Homo sapiens
atgtactgagacaaaaag

SEQ ID NO: 1321924 - DNA, 20 bp, Homo sapiens
atgtactgagacaaaaagga

SEQ ID NO: 1321925 - DNA, 18 bp, Homo sapiens
atgtagtgccgctcttgg

SEQ ID NO: 1321926 - DNA, 19 bp, Homo sapiens
atgtatctaatttcattca

SEQ ID NO: 1321927 - DNA, 21 bp, Homo sapiens
atgtcatgtcttccattaaga

SEQ ID NO: 1321928 - DNA, 22 bp, Homo sapiens
atgtcctgtaaacactcagctg

SEQ ID NO: 1321929 - DNA, 14 bp, Homo sapiens
atgtgaaaacctgt

SEQ ID NO: 1321930 - DNA, 12 bp, Homo sapiens
atgtgccctgcc

SEQ ID NO: 1321931 - DNA, 18 bp, Homo sapiens
atgttaaccgtttcagga

SEQ ID NO: 1321932 - DNA, 15 bp, Homo sapiens
atgttgtagatacaa

SEQ ID NO: 1321933 - DNA, 19 bp, Homo sapiens
atgtttacatgtctgttgt

SEQ ID NO: 1321934 - DNA, 17 bp, Homo sapiens
atgttttagcacagcgt

SEQ ID NO: 1321935 - DNA, 17 bp, Homo sapiens
atgttttagtaaaaaag

SEQ ID NO: 1321936 - DNA, 22 bp, Homo sapiens
atgttttagtaaaaaagagaat

SEQ ID NO: 1321937 - DNA, 16 bp, Homo sapiens
atgttttgttttcttg

SEQ ID NO: 1321938 - DNA, 13 bp, Homo sapiens
attaagaacacta

SEQ ID NO: 1321939 - DNA, 14 bp, Homo sapiens
attaatgctaaggg

SEQ ID NO: 1321940 - DNA, 15 bp, Homo sapiens
attaatgctaagggc

SEQ ID NO: 1321941 - DNA, 16 bp, Homo sapiens
ccaggcaaataaaatt

SEQ ID NO: 1321942 - DNA, 18 bp, Homo sapiens
ccaggcaaataaaattcc

SEQ ID NO: 1321943 - DNA, 19 bp, Homo sapiens
ccaggcaaataaaattccc

SEQ ID NO: 1321944 - DNA, 14 bp, Homo sapiens
ccaggcaggcccag

SEQ ID NO: 1321945 - DNA, 21 bp, Homo sapiens
ccaggcaggcccagcctctgc

SEQ ID NO: 1321946 - DNA, 13 bp, Homo sapiens
ccagggtctgaaa

SEQ ID NO: 1321947 - DNA, 14 bp, Homo sapiens
ccagggtctgaaag

SEQ ID NO: 1321948 - DNA, 17 bp, Homo sapiens
ccagggtctgaaagggg

SEQ ID NO: 1321949 - DNA, 21 bp, Homo sapiens
ccagtataaaattacagtgga

SEQ ID NO: 1321950 - DNA, 15 bp, Homo sapiens
ccagtcccacggctc

SEQ ID NO: 1321951 - DNA, 22 bp, Homo sapiens
ccagtcccacggctctgtgccc

SEQ ID NO: 1321952 - DNA, 16 bp, Homo sapiens
ccagtgcatgccagga

SEQ ID NO: 1321953 - DNA, 21 bp, Homo sapiens
ccatatcaaaagttgatttct

SEQ ID NO: 1321954 - DNA, 22 bp, Homo sapiens
ccatatcaaaagttgatttctt

SEQ ID NO: 1321955 - DNA, 20 bp, Homo sapiens
ccatatccgggtgctcaata

SEQ ID NO: 1321956 - DNA, 23 bp, Homo sapiens
ccatcacccctggtggctgcagg

SEQ ID NO: 1321957 - DNA, 23 bp, Homo sapiens
ccatcatggggggagcaccctga

SEQ ID NO: 1321958 - DNA, 18 bp, Homo sapiens
ccatcccgccttctccag

SEQ ID NO: 1321959 - DNA, 23 bp, Homo sapiens
ccatgaaggcacctgcccccaca

SEQ ID NO: 1321960 - DNA, 23 bp, Homo sapiens
ccatgagaatgttttagcacagc

SEQ ID NO: 1321961 - DNA, 15 bp, Homo sapiens
ccatgagagcgcagc

SEQ ID NO: 1321962 - DNA, 18 bp, Homo sapiens
ccatgagagcgcagcccg

SEQ ID NO: 1321963 - DNA, 17 bp, Homo sapiens
ccatgagtccatgtcct

SEQ ID NO: 1321964 - DNA, 23 bp, Homo sapiens
ccatgatggaataaggagctggg

SEQ ID NO: 1321965 - DNA, 17 bp, Homo sapiens
ccatgctgagacatccc

SEQ ID NO: 1321966 - DNA, 13 bp, Homo sapiens
ccatggctgtgac

SEQ ID NO: 1321967 - DNA, 16 bp, Homo sapiens
ccatggtcaccctcag

SEQ ID NO: 1321968 - DNA, 16 bp, Homo sapiens
ccatgttttgttttct

SEQ ID NO: 1321969 - DNA, 12 bp, Homo sapiens
ccatttctttct

SEQ ID NO: 1321970 - DNA, 16 bp, Homo sapiens
cccaactcagcctgtt

SEQ ID NO: 1321971 - DNA, 17 bp, Homo sapiens
cccaacttcatctggaa

SEQ ID NO: 1321972 - DNA, 15 bp, Homo sapiens
cccaagactctgctc

SEQ ID NO: 1321973 - DNA, 18 bp, Homo sapiens
cccaagactctgctctcc

SEQ ID NO: 1321974 - DNA, 22 bp, Homo sapiens
cccacaacgtcccctcaagccc

SEQ ID NO: 1321975 - DNA, 15 bp, Homo sapiens
cccacagctccttgc

SEQ ID NO: 1321976 - DNA, 17 bp, Homo sapiens
cccacccacctttgcag

SEQ ID NO: 1321977 - DNA, 13 bp, Homo sapiens
cccaccctctcca

SEQ ID NO: 1321978 - DNA, 14 bp, Homo sapiens
cccaccctctccac

SEQ ID NO: 1321979 - DNA, 20 bp, Homo sapiens
cccaccctctccacacccag

SEQ ID NO: 1321980 - DNA, 13 bp, Homo sapiens
cccacggctctgt

SEQ ID NO: 1321981 - DNA, 20 bp, Homo sapiens
cccactggctcctcccagca

SEQ ID NO: 1321982 - DNA, 15 bp, Homo sapiens
cccagacctggcctc

SEQ ID NO: 1321983 - DNA, 17 bp, Homo sapiens
cccagacctggcctctg

SEQ ID NO: 1321984 - DNA, 19 bp, Homo sapiens
cccagacctggcctctgcc

SEQ ID NO: 1321985 - DNA, 20 bp, Homo sapiens
cccagaggggaatgagggct

SEQ ID NO: 1321986 - DNA, 23 bp, Homo sapiens
cccagaggggaatgagggctgag

SEQ ID NO: 1321987 - DNA, 16 bp, Homo sapiens
cccagcacaggcacct

SEQ ID NO: 1321988 - DNA, 17 bp, Homo sapiens
cccagccctgaggggtg

SEQ ID NO: 1321989 - DNA, 17 bp, Homo sapiens
cccagcctcagaagcct

SEQ ID NO: 1321990 - DNA, 13 bp, Homo sapiens
cccagcctctgcc

SEQ ID NO: 1321991 - DNA, 12 bp, Homo sapiens
cccagcctgtcc

SEQ ID NO: 1321992 - DNA, 23 bp, Homo sapiens
cccagcctgtcccactggctcct

SEQ ID NO: 1321993 - DNA, 24 bp, Homo sapiens
cccagctctacattctgctctgcc

SEQ ID NO: 1321994 - DNA, 15 bp, Homo sapiens
cccaggcaaataaaa

SEQ ID NO: 1321995 - DNA, 21 bp, Homo sapiens
cccaggcaaataaaattccct

SEQ ID NO: 1321996 - DNA, 22 bp, Homo sapiens
cccaggcaaataaaattcccta

SEQ ID NO: 1321997 - DNA, 17 bp, Homo sapiens
cccaggcaggcccagcc

SEQ ID NO: 1321998 - DNA, 20 bp, Homo sapiens
cccaggcaggcccagcctct

SEQ ID NO: 1321999 - DNA, 22 bp, Homo sapiens
cccaggcaggcccagcctctgc

SEQ ID NO: 1322000 - DNA, 14 bp, Homo sapiens
cccagggtctgaaa

SEQ ID NO: 1322001 - DNA, 21 bp, Homo sapiens
cccagggtctgaaaggggtgt

SEQ ID NO: 1322002 - DNA, 18 bp, Homo sapiens
cccatgcctaaagcccat

SEQ ID NO: 1322003 - DNA, 21 bp, Homo sapiens
cccatgggagggagctgagaa

SEQ ID NO: 1322004 - DNA, 23 bp, Homo sapiens
cccatgggagggagctgagaaga

SEQ ID NO: 1322005 - DNA, 21 bp, Homo sapiens
ccccaacccttcttcatgttc

SEQ ID NO: 1322006 - DNA, 17 bp, Homo sapiens
ccccaagactctgctct

SEQ ID NO: 1322007 - DNA, 18 bp, Homo sapiens
ccccaagactctgctctc

SEQ ID NO: 1322008 - DNA, 17 bp, Homo sapiens
ccccacagctccttgca

SEQ ID NO: 1322009 - DNA, 16 bp, Homo sapiens
ccccacccacctttgc

SEQ ID NO: 1322010 - DNA, 17 bp, Homo sapiens
ccccacccacctttgca

SEQ ID NO: 1322011 - DNA, 13 bp, Homo sapiens
ccccactcctcag

SEQ ID NO: 1322012 - DNA, 17 bp, Homo sapiens
ccccaggacagcacacg

SEQ ID NO: 1322013 - DNA, 12 bp, Homo sapiens
ccccagggtctg

SEQ ID NO: 1322014 - DNA, 15 bp, Homo sapiens
ccccagggtctgaaa

SEQ ID NO: 1322015 - DNA, 14 bp, Homo sapiens
cccctcccagccct

SEQ ID NO: 1322016 - DNA, 17 bp, Homo sapiens
cccctgagcctgtgtcc

SEQ ID NO: 1322017 - DNA, 22 bp, Homo sapiens
cccctgggactaaagccaggaa

SEQ ID NO: 1322018 - DNA, 14 bp, Homo sapiens
cccctggtggctgc

SEQ ID NO: 1322019 - DNA, 17 bp, Homo sapiens
cccctggtggctgcagg

SEQ ID NO: 1322020 - DNA, 19 bp, Homo sapiens
cccctggtggctgcaggca

SEQ ID NO: 1322021 - DNA, 17 bp, Homo sapiens
cccgaccccatccacct

SEQ ID NO: 1322022 - DNA, 20 bp, Homo sapiens
cccgccatggtcaccctcag

SEQ ID NO: 1322023 - DNA, 14 bp, Homo sapiens
cccgtggggccggg

SEQ ID NO: 1322024 - DNA, 23 bp, Homo sapiens
ccctaagcatggtcccttgtcac

SEQ ID NO: 1322025 - DNA, 15 bp, Homo sapiens
ccctacacacagacc

SEQ ID NO: 1322026 - DNA, 18 bp, Homo sapiens
ccctcaggaacccaccct

SEQ ID NO: 1322027 - DNA, 12 bp, Homo sapiens
ccctctccacac

SEQ ID NO: 1322028 - DNA, 13 bp, Homo sapiens
ccctctccacacc

SEQ ID NO: 1322029 - DNA, 14 bp, Homo sapiens
ccctctccacaccc

SEQ ID NO: 1322030 - DNA, 18 bp, Homo sapiens
ccctctccacacccagcc

SEQ ID NO: 1322031 - DNA, 16 bp, Homo sapiens
ccctgaaactactgta

SEQ ID NO: 1322032 - DNA, 14 bp, Homo sapiens
ccctgagcctgtgt

SEQ ID NO: 1322033 - DNA, 19 bp, Homo sapiens
ccctgagcctgtgtcctga

SEQ ID NO: 1322034 - DNA, 17 bp, Homo sapiens
ccctgcacataaactcc

SEQ ID NO: 1322035 - DNA, 13 bp, Homo sapiens
ccctgcagccctg

SEQ ID NO: 1322036 - DNA, 15 bp, Homo sapiens
ccctgcagccctggc

SEQ ID NO: 1322037 - DNA, 18 bp, Homo sapiens
ccctgcagccctggccca

SEQ ID NO: 1322038 - DNA, 23 bp, Homo sapiens
ccctgggactaaagccaggaaca

SEQ ID NO: 1322039 - DNA, 15 bp, Homo sapiens
ccctgttccccacag

SEQ ID NO: 1322040 - DNA, 16 bp, Homo sapiens
ccctgttccccacagg

SEQ ID NO: 1322041 - DNA, 20 bp, Homo sapiens
ccctgttccccacaggtcct

SEQ ID NO: 1322042 - DNA, 12 bp, Homo sapiens
ccctgttgacct

SEQ ID NO: 1322043 - DNA, 15 bp, Homo sapiens
ccctgttgacctgcc

SEQ ID NO: 1322044 - DNA, 18 bp, Homo sapiens
ccctgttgacctgcccga

SEQ ID NO: 1322045 - DNA, 19 bp, Homo sapiens
cccttgctctctgttctct

SEQ ID NO: 1322046 - DNA, 14 bp, Homo sapiens
ccgccccagggtct

SEQ ID NO: 1322047 - DNA, 14 bp, Homo sapiens
ccgccttctccagg

SEQ ID NO: 1322048 - DNA, 17 bp, Homo sapiens
ccgcgcccctgggacta

SEQ ID NO: 1322049 - DNA, 15 bp, Homo sapiens
ccgcggcgggccctg

SEQ ID NO: 1322050 - DNA, 21 bp, Homo sapiens
ccgctcttggggacatgggtc

SEQ ID NO: 1322051 - DNA, 22 bp, Homo sapiens
ccggagccccaagactctgctc

SEQ ID NO: 1322052 - DNA, 17 bp, Homo sapiens
ccggccaggtgcctcct

SEQ ID NO: 1322053 - DNA, 19 bp, Homo sapiens
ccggccaggtgcctcctga

SEQ ID NO: 1322054 - DNA, 16 bp, Homo sapiens
ccggcctggccttttc

SEQ ID NO: 1322055 - DNA, 19 bp, Homo sapiens
ccggctcaggagagggcct

SEQ ID NO: 1322056 - DNA, 20 bp, Homo sapiens
ccggctcaggagagggcctt

SEQ ID NO: 1322057 - DNA, 16 bp, Homo sapiens
ccggtgccatcttcca

SEQ ID NO: 1322058 - DNA, 17 bp, Homo sapiens
ccgtagatcatccccga

SEQ ID NO: 1322059 - DNA, 12 bp, Homo sapiens
ccgttcattcat

SEQ ID NO: 1322060 - DNA, 18 bp, Homo sapiens
cctaataaaactgatgtg

SEQ ID NO: 1322061 - DNA, 19 bp, Homo sapiens
cctaataaaactgatgtga

SEQ ID NO: 1322062 - DNA, 14 bp, Homo sapiens
cctacacacagacc

SEQ ID NO: 1322063 - DNA, 14 bp, Homo sapiens
cctaggctggaagg

SEQ ID NO: 1322064 - DNA, 22 bp, Homo sapiens
cctaggctggaaggaggaagaa

SEQ ID NO: 1322065 - DNA, 13 bp, Homo sapiens
cctaggggaatga

SEQ ID NO: 1322066 - DNA, 16 bp, Homo sapiens
cctaggggaatgaggg

SEQ ID NO: 1322067 - DNA, 23 bp, Homo sapiens
cctaggggaatgagggggctcag

SEQ ID NO: 1322068 - DNA, 18 bp, Homo sapiens
cctagtccggttcttctt

SEQ ID NO: 1322069 - DNA, 22 bp, Homo sapiens
cctagtccggttcttcttgtct

SEQ ID NO: 1322070 - DNA, 16 bp, Homo sapiens
cctatccaccacccca

SEQ ID NO: 1322071 - DNA, 18 bp, Homo sapiens
cctatccaccaccccacc

SEQ ID NO: 1322072 - DNA, 13 bp, Homo sapiens
cctatgtggcatg

SEQ ID NO: 1322073 - DNA, 13 bp, Homo sapiens
cctcaaagctttt

SEQ ID NO: 1322074 - DNA, 18 bp, Homo sapiens
cctcaactctgctgaggg

SEQ ID NO: 1322075 - DNA, 18 bp, Homo sapiens
cctcaactgagaagccaa

SEQ ID NO: 1322076 - DNA, 20 bp, Homo sapiens
cctcaactgagaagccaagc

SEQ ID NO: 1322077 - DNA, 12 bp, Homo sapiens
aggagagggcct

SEQ ID NO: 1322078 - DNA, 13 bp, Homo sapiens
aggagagggcctt

SEQ ID NO: 1322079 - DNA, 14 bp, Homo sapiens
aggaggagacagag

SEQ ID NO: 1322080 - DNA, 20 bp, Homo sapiens
aggaggtggaggttacagtg

SEQ ID NO: 1322081 - DNA, 16 bp, Homo sapiens
aggagtccaaaccttc

SEQ ID NO: 1322082 - DNA, 23 bp, Homo sapiens
aggcaaggcccagacctggcctc

SEQ ID NO: 1322083 - DNA, 23 bp, Homo sapiens
aggcaccgctgggttctgactct

SEQ ID NO: 1322084 - DNA, 13 bp, Homo sapiens
aggcacctgcccc

SEQ ID NO: 1322085 - DNA, 13 bp, Homo sapiens
aggcagaaggcca

SEQ ID NO: 1322086 - DNA, 18 bp, Homo sapiens
aggcagcacgtgcacaaa

SEQ ID NO: 1322087 - DNA, 13 bp, Homo sapiens
aggcaggcccagc

SEQ ID NO: 1322088 - DNA, 14 bp, Homo sapiens
aggccactgaagag

SEQ ID NO: 1322089 - DNA, 16 bp, Homo sapiens
aggccactgaagagga

SEQ ID NO: 1322090 - DNA, 13 bp, Homo sapiens
aggccaggctccc

SEQ ID NO: 1322091 - DNA, 17 bp, Homo sapiens
aggccagtcccacggct

SEQ ID NO: 1322092 - DNA, 14 bp, Homo sapiens
aggcccagacctgg

SEQ ID NO: 1322093 - DNA, 21 bp, Homo sapiens
aggcccagacctggcctctgc

SEQ ID NO: 1322094 - DNA, 23 bp, Homo sapiens
aggcccagacctggcctctgcca

SEQ ID NO: 1322095 - DNA, 18 bp, Homo sapiens
aggcccagcctctgcccc

SEQ ID NO: 1322096 - DNA, 14 bp, Homo sapiens
aggcccaggcaggc

SEQ ID NO: 1322097 - DNA, 18 bp, Homo sapiens
aggcccaggcaggcccag

SEQ ID NO: 1322098 - DNA, 20 bp, Homo sapiens
aggcccaggcaggcccagcc

SEQ ID NO: 1322099 - DNA, 21 bp, Homo sapiens
aggcccaggcaggcccagcct

SEQ ID NO: 1322100 - DNA, 18 bp, Homo sapiens
aggccctacacacagacc

SEQ ID NO: 1322101 - DNA, 20 bp, Homo sapiens
aggccctacacacagaccgc

SEQ ID NO: 1322102 - DNA, 13 bp, Homo sapiens
aggcctggcctca

SEQ ID NO: 1322103 - DNA, 23 bp, Homo sapiens
aggcgcctcaactctgctgaggg

SEQ ID NO: 1322104 - DNA, 19 bp, Homo sapiens
agggaaactgcagctggga

SEQ ID NO: 1322105 - DNA, 16 bp, Homo sapiens
agggcctgctggagaa

SEQ ID NO: 1322106 - DNA, 21 bp, Homo sapiens
agggccttcccctcccagccc

SEQ ID NO: 1322107 - DNA, 17 bp, Homo sapiens
aggggaatgagggggct

SEQ ID NO: 1322108 - DNA, 19 bp, Homo sapiens
aggggaatgagggggctca

SEQ ID NO: 1322109 - DNA, 20 bp, Homo sapiens
aggggaatgagggggctcag

SEQ ID NO: 1322110 - DNA, 15 bp, Homo sapiens
agggtcatgtacttc

SEQ ID NO: 1322111 - DNA, 14 bp, Homo sapiens
agggtctgaaaggg

SEQ ID NO: 1322112 - DNA, 18 bp, Homo sapiens
agggtctgaaaggggtgt

SEQ ID NO: 1322113 - DNA, 18 bp, Homo sapiens
agggtgagtttgaagagg

SEQ ID NO: 1322114 - DNA, 23 bp, Homo sapiens
agggtttggttagctcacaggac

SEQ ID NO: 1322115 - DNA, 15 bp, Homo sapiens
aggtcctccatcacc

SEQ ID NO: 1322116 - DNA, 12 bp, Homo sapiens
aggtgccaggaa

SEQ ID NO: 1322117 - DNA, 15 bp, Homo sapiens
aggtgccaggaactc

SEQ ID NO: 1322118 - DNA, 17 bp, Homo sapiens
aggttctgattttcttg

SEQ ID NO: 1322119 - DNA, 18 bp, Homo sapiens
agtaaaaaagagaattgt

SEQ ID NO: 1322120 - DNA, 17 bp, Homo sapiens
agtataaagtcattaac

SEQ ID NO: 1322121 - DNA, 14 bp, Homo sapiens
agtataaatttgtg

SEQ ID NO: 1322122 - DNA, 16 bp, Homo sapiens
agtataccagagaagg

SEQ ID NO: 1322123 - DNA, 14 bp, Homo sapiens
agtatgctctgagt

SEQ ID NO: 1322124 - DNA, 15 bp, Homo sapiens
agtatgctctgagta

SEQ ID NO: 1322125 - DNA, 17 bp, Homo sapiens
agtattcctgtaatact

SEQ ID NO: 1322126 - DNA, 19 bp, Homo sapiens
agtcatggagaaccaccta

SEQ ID NO: 1322127 - DNA, 19 bp, Homo sapiens
agtccatgtcctatgcctc

SEQ ID NO: 1322128 - DNA, 15 bp, Homo sapiens
agtcctcaaagcttt

SEQ ID NO: 1322129 - DNA, 23 bp, Homo sapiens
agtcctcaaagctttttgaaaac

SEQ ID NO: 1322130 - DNA, 14 bp, Homo sapiens
agtcctccttccca

SEQ ID NO: 1322131 - DNA, 20 bp, Homo sapiens
agtcctccttcccagctcta

SEQ ID NO: 1322132 - DNA, 11 bp, Homo sapiens
agtctcagcct

SEQ ID NO: 1322133 - DNA, 15 bp, Homo sapiens
agtctcagcctgggc

SEQ ID NO: 1322134 - DNA, 16 bp, Homo sapiens
agtcttctcccaactc

SEQ ID NO: 1322135 - DNA, 20 bp, Homo sapiens
agtcttctcccaactcagcc

SEQ ID NO: 1322136 - DNA, 10 bp, Homo sapiens
agtcttgacc

SEQ ID NO: 1322137 - DNA, 22 bp, Homo sapiens
gcttgctcccgccccagggtct

SEQ ID NO: 1322138 - DNA, 13 bp, Homo sapiens
ggaaactaataaa

SEQ ID NO: 1322139 - DNA, 18 bp, Homo sapiens
ggaaactaataaaatatt

SEQ ID NO: 1322140 - DNA, 18 bp, Homo sapiens
ggaaactgcagctgggaa

SEQ ID NO: 1322141 - DNA, 19 bp, Homo sapiens
ggaaagcaaggcagaaggc

SEQ ID NO: 1322142 - DNA, 14 bp, Homo sapiens
ggaaatattaaaag

SEQ ID NO: 1322143 - DNA, 15 bp, Homo sapiens
ggaacagggaccagc

SEQ ID NO: 1322144 - DNA, 20 bp, Homo sapiens
ggaacagggaccagctcccc

SEQ ID NO: 1322145 - DNA, 12 bp, Homo sapiens
ggaacccaccct

SEQ ID NO: 1322146 - DNA, 13 bp, Homo sapiens
ggaactgtaataa

SEQ ID NO: 1322147 - DNA, 23 bp, Homo sapiens
ggaagaatagggcccatgggagg

SEQ ID NO: 1322148 - DNA, 14 bp, Homo sapiens
ggaagaggagcctg

SEQ ID NO: 1322149 - DNA, 15 bp, Homo sapiens
ggaaggaaatctggc

SEQ ID NO: 1322150 - DNA, 13 bp, Homo sapiens
ggaaggaggaaga

SEQ ID NO: 1322151 - DNA, 14 bp, Homo sapiens
ggaagtctcagcct

SEQ ID NO: 1322152 - DNA, 19 bp, Homo sapiens
ggaatagggacagctggtc

SEQ ID NO: 1322153 - DNA, 15 bp, Homo sapiens
ggaatgatttctatg

SEQ ID NO: 1322154 - DNA, 15 bp, Homo sapiens
ctgttgctggtcttc

SEQ ID NO: 1322155 - DNA, 15 bp, Homo sapiens
gcccacaacgtcccc

SEQ ID NO: 1322156 - DNA, 21 bp, Homo sapiens
gcccacaacgtcccctcaagc

SEQ ID NO: 1322157 - DNA, 15 bp, Homo sapiens
gcccagacctggcct

SEQ ID NO: 1322158 - DNA, 17 bp, Homo sapiens
gcccagacctggcctct

SEQ ID NO: 1322159 - DNA, 20 bp, Homo sapiens
gcccagacctggcctctgcc

SEQ ID NO: 1322160 - DNA, 20 bp, Homo sapiens
gcccagcctctgccccaccc

SEQ ID NO: 1322161 - DNA, 16 bp, Homo sapiens
gcccaggcaggcccag

SEQ ID NO: 1322162 - DNA, 18 bp, Homo sapiens
gcccaggcaggcccagcc

SEQ ID NO: 1322163 - DNA, 23 bp, Homo sapiens
gcccaggcaggcccagcctctgc

SEQ ID NO: 1322164 - DNA, 20 bp, Homo sapiens
ctaccccgactatccctgca

SEQ ID NO: 1322165 - DNA, 21 bp, Homo sapiens
ctaccccgactatccctgcac

SEQ ID NO: 1322166 - DNA, 16 bp, Homo sapiens
ctaccttgccccaacc

SEQ ID NO: 1322167 - DNA, 14 bp, Homo sapiens
ctacgaagccacag

SEQ ID NO: 1322168 - DNA, 19 bp, Homo sapiens
ctacgaagccacaggcctg

SEQ ID NO: 1322169 - DNA, 21 bp, Homo sapiens
ctacgaagccacaggcctggc

SEQ ID NO: 1322170 - DNA, 22 bp, Homo sapiens
ctacgaagccacaggcctggcc

SEQ ID NO: 1322171 - DNA, 22 bp, Homo sapiens
ctactaaatggcctctctccac

SEQ ID NO: 1322172 - DNA, 15 bp, Homo sapiens
ctactcatgactgaa

SEQ ID NO: 1322173 - DNA, 18 bp, Homo sapiens
ctactgaaaaaaatggag

SEQ ID NO: 1322174 - DNA, 13 bp, Homo sapiens
ctagactcatact

SEQ ID NO: 1322175 - DNA, 16 bp, Homo sapiens
ctagatgaagaaagag

SEQ ID NO: 1322176 - DNA, 16 bp, Homo sapiens
ctaggcatttgtaaat

SEQ ID NO: 1322177 - DNA, 21 bp, Homo sapiens
ctaggcatttgtaaatattaa

SEQ ID NO: 1322178 - DNA, 22 bp, Homo sapiens
ctaggcatttgtaaatattaaa

SEQ ID NO: 1322179 - DNA, 13 bp, Homo sapiens
ctaggctggaagg

SEQ ID NO: 1322180 - DNA, 16 bp, Homo sapiens
ctaggctggaaggagg

SEQ ID NO: 1322181 - DNA, 17 bp, Homo sapiens
ctaggctggaaggagga

SEQ ID NO: 1322182 - DNA, 17 bp, Homo sapiens
ctagggctgagcacctc

SEQ ID NO: 1322183 - DNA, 18 bp, Homo sapiens
ctaggggaatgagggggc

SEQ ID NO: 1322184 - DNA, 21 bp, Homo sapiens
ctaggtattcgaaacctgtga

SEQ ID NO: 1322185 - DNA, 22 bp, Homo sapiens
ctaggtattcgaaacctgtgat

SEQ ID NO: 1322186 - DNA, 14 bp, Homo sapiens
ctagtcttgacctc

SEQ ID NO: 1322187 - DNA, 17 bp, Homo sapiens
ctagtcttgacctctcc

SEQ ID NO: 1322188 - DNA, 12 bp, Homo sapiens
ctagtgctgaag

SEQ ID NO: 1322189 - DNA, 15 bp, Homo sapiens
ctagtgctgaagctt

SEQ ID NO: 1322190 - DNA, 17 bp, Homo sapiens
ctagtgctgaagcttat

SEQ ID NO: 1322191 - DNA, 20 bp, Homo sapiens
ctatagcccctggtgtgtaa

SEQ ID NO: 1322192 - DNA, 18 bp, Homo sapiens
ctatccaccaccccaccc

SEQ ID NO: 1322193 - DNA, 22 bp, Homo sapiens
ctatcctgtgaggcttttaatt

SEQ ID NO: 1322194 - DNA, 21 bp, Homo sapiens
ctatgagttcacatgtgccct

SEQ ID NO: 1322195 - DNA, 24 bp, Homo sapiens
ctatgagttcacatgtgccctgcc

SEQ ID NO: 1322196 - DNA, 21 bp, Homo sapiens
ctatgcctcacaaatgctgtg

SEQ ID NO: 1322197 - DNA, 18 bp, Homo sapiens
ctatgtagtgccgctctt

SEQ ID NO: 1322198 - DNA, 16 bp, Homo sapiens
ctcaactctgctgagg

SEQ ID NO: 1322199 - DNA, 17 bp, Homo sapiens
ctcaactctgctgaggg

SEQ ID NO: 1322200 - DNA, 15 bp, Homo sapiens
ctcaagccccttctc

SEQ ID NO: 1322201 - DNA, 23 bp, Homo sapiens
ctcaagccccttctctcaatccc

SEQ ID NO: 1322202 - DNA, 18 bp, Homo sapiens
ctcaataaacttgtgcct

SEQ ID NO: 1322203 - DNA, 16 bp, Homo sapiens
ctcaatccctttgcaa

SEQ ID NO: 1322204 - DNA, 15 bp, Homo sapiens
ctcacaaatgctgtg

SEQ ID NO: 1322205 - DNA, 16 bp, Homo sapiens
ctcacaaatgctgtgg

SEQ ID NO: 1322206 - DNA, 14 bp, Homo sapiens
ctcacactccttta

SEQ ID NO: 1322207 - DNA, 18 bp, Homo sapiens
ctcacatggaatgagggt

SEQ ID NO: 1322208 - DNA, 16 bp, Homo sapiens
ctcaccagagaccagg

SEQ ID NO: 1322209 - DNA, 21 bp, Homo sapiens
ctcactctgctaccttgcccc

SEQ ID NO: 1322210 - DNA, 22 bp, Homo sapiens
ctcactggttttggccacccct

SEQ ID NO: 1322211 - DNA, 21 bp, Homo sapiens
ctcagaagccttcttgctgcc

SEQ ID NO: 1322212 - DNA, 16 bp, Homo sapiens
ctcagaccgtcttcct

SEQ ID NO: 1322213 - DNA, 21 bp, Homo sapiens
ctcagaccgtcttcctccaac

SEQ ID NO: 1322214 - DNA, 22 bp, Homo sapiens
ctcagaccgtcttcctccaacc

SEQ ID NO: 1322215 - DNA, 22 bp, Homo sapiens
ctcagagcaagcctttgacctg

SEQ ID NO: 1322216 - DNA, 19 bp, Homo sapiens
ctcagatctttgcaccaga

SEQ ID NO: 1322217 - DNA, 20 bp, Homo sapiens
ctcagcaccccactcctcag

SEQ ID NO: 1322218 - DNA, 24 bp, Homo sapiens
ctcagccacccttggtctcatgcc

SEQ ID NO: 1322219 - DNA, 20 bp, Homo sapiens
ctcagcctgggcccctcagc

SEQ ID NO: 1322220 - DNA, 13 bp, Homo sapiens
ctcagcctgttcc

SEQ ID NO: 1322221 - DNA, 18 bp, Homo sapiens
ctcagcctgttccttcct

SEQ ID NO: 1322222 - DNA, 22 bp, Homo sapiens
ctcagcctgttccttcctgcag

SEQ ID NO: 1322223 - DNA, 20 bp, Homo sapiens
ctcaggaacccaccctctcc

SEQ ID NO: 1322224 - DNA, 21 bp, Homo sapiens
ctcaggaacccaccctctcca

SEQ ID NO: 1322225 - DNA, 13 bp, Homo sapiens
ctcaggagagggc

SEQ ID NO: 1322226 - DNA, 15 bp, Homo sapiens
ctcaggagagggcct

SEQ ID NO: 1322227 - DNA, 20 bp, Homo sapiens
ctcagtaaaagtcttctccc

SEQ ID NO: 1322228 - DNA, 22 bp, Homo sapiens
ctcagtaaaagtcttctcccaa

SEQ ID NO: 1322229 - DNA, 22 bp, Homo sapiens
ctcagtgttaatactgagaaaa

SEQ ID NO: 1322230 - DNA, 19 bp, Homo sapiens
ctcatctagtcttgacctc

SEQ ID NO: 1322231 - DNA, 21 bp, Homo sapiens
ctcatgtagaacaagaaatct

SEQ ID NO: 1322232 - DNA, 19 bp, Homo sapiens
ctcattaccagtaaaggct

SEQ ID NO: 1322233 - DNA, 12 bp, Homo sapiens
ctccacacccag

SEQ ID NO: 1322234 - DNA, 15 bp, Homo sapiens
ctccacacccagcct

SEQ ID NO: 1322235 - DNA, 17 bp, Homo sapiens
ctccacacccagcctgt

SEQ ID NO: 1322236 - DNA, 18 bp, Homo sapiens
ctccacacccagcctgtc

SEQ ID NO: 1322237 - DNA, 17 bp, Homo sapiens
ctccagcatcccagcct

SEQ ID NO: 1322238 - DNA, 15 bp, Homo sapiens
ctccagcgtcctcag

SEQ ID NO: 1322239 - DNA, 16 bp, Homo sapiens
ctccaggcttcccctc

SEQ ID NO: 1322240 - DNA, 14 bp, Homo sapiens
ctccatcacccctg

SEQ ID NO: 1322241 - DNA, 16 bp, Homo sapiens
ctccatcacccctggt

SEQ ID NO: 1322242 - DNA, 15 bp, Homo sapiens
ctcccagcacaggca

SEQ ID NO: 1322243 - DNA, 15 bp, Homo sapiens
ctcccctgcagccct

SEQ ID NO: 1322244 - DNA, 14 bp, Homo sapiens
ctccctgttcccca

SEQ ID NO: 1322245 - DNA, 17 bp, Homo sapiens
ctccctgttccccacag

SEQ ID NO: 1322246 - DNA, 16 bp, Homo sapiens
ctccgcggcgggccct

SEQ ID NO: 1322247 - DNA, 23 bp, Homo sapiens
ctccgcggcgggccctgcccaca

SEQ ID NO: 1322248 - DNA, 18 bp, Homo sapiens
ctccggccaggtgcctcc

SEQ ID NO: 1322249 - DNA, 14 bp, Homo sapiens
ctcctcccagcaca

SEQ ID NO: 1322250 - DNA, 18 bp, Homo sapiens
ctcctcccagcacaggca

SEQ ID NO: 1322251 - DNA, 15 bp, Homo sapiens
ctcctcgggccctgt

SEQ ID NO: 1322252 - DNA, 16 bp, Homo sapiens
ctcctcgggccctgtg

SEQ ID NO: 1322253 - DNA, 19 bp, Homo sapiens
ctcctgacacacctgcagc

SEQ ID NO: 1322254 - DNA, 22 bp, Homo sapiens
ctcctgacacacctgcagcctc

SEQ ID NO: 1322255 - DNA, 13 bp, Homo sapiens
ctcctggggcgcg

SEQ ID NO: 1322256 - DNA, 15 bp, Homo sapiens
ctcctggtcctaggc

SEQ ID NO: 1322257 - DNA, 14 bp, Homo sapiens
ctccttcccagctc

SEQ ID NO: 1322258 - DNA, 14 bp, Homo sapiens
ctcggctggctccc

SEQ ID NO: 1322259 - DNA, 23 bp, Homo sapiens
ctcgggcccctgagcctgtgtcc

SEQ ID NO: 1322260 - DNA, 12 bp, Homo sapiens
ctcgggccctgt

SEQ ID NO: 1322261 - DNA, 22 bp, Homo sapiens
ctcgggccctgtggtgctggga

SEQ ID NO: 1322262 - DNA, 17 bp, Homo sapiens
ctcggggaataaaacat

SEQ ID NO: 1322263 - DNA, 17 bp, Homo sapiens
ctctacattctgctctg

SEQ ID NO: 1322264 - DNA, 16 bp, Homo sapiens
ctctcagagcaagcct

SEQ ID NO: 1322265 - DNA, 14 bp, Homo sapiens
ctctccacacccag

SEQ ID NO: 1322266 - DNA, 20 bp, Homo sapiens
ctctccacacccagcctgtc

SEQ ID NO: 1322267 - DNA, 14 bp, Homo sapiens
ctctccggcctggc

SEQ ID NO: 1322268 - DNA, 18 bp, Homo sapiens
ctctccggcctggccttt

SEQ ID NO: 1322269 - DNA, 21 bp, Homo sapiens
ctctcctcgggccctgtggtg

SEQ ID NO: 1322270 - DNA, 18 bp, Homo sapiens
ctctccttaaatgcttct

SEQ ID NO: 1322271 - DNA, 23 bp, Homo sapiens
ctctcgcggcctcttctctcaga

SEQ ID NO: 1322272 - DNA, 15 bp, Homo sapiens
ctctctcaaaattat

SEQ ID NO: 1322273 - DNA, 20 bp, Homo sapiens
ctctctgaggcaaggcccag

SEQ ID NO: 1322274 - DNA, 14 bp, Homo sapiens
ctctgaggcaaggc

SEQ ID NO: 1322275 - DNA, 16 bp, Homo sapiens
ctctgaggcaaggccc

SEQ ID NO: 1322276 - DNA, 19 bp, Homo sapiens
ctctgaggcaaggcccaga

SEQ ID NO: 1322277 - DNA, 20 bp, Homo sapiens
ctctgaggcaaggcccagac

SEQ ID NO: 1322278 - DNA, 23 bp, Homo sapiens
ctctgaggcaaggcccagacctg

SEQ ID NO: 1322279 - DNA, 17 bp, Homo sapiens
ctctgagtagctttaca

SEQ ID NO: 1322280 - DNA, 12 bp, Homo sapiens
ctctgccatcct

SEQ ID NO: 1322281 - DNA, 14 bp, Homo sapiens
ctctgccatcctcc

SEQ ID NO: 1322282 - DNA, 15 bp, Homo sapiens
ctctgccatcctccc

SEQ ID NO: 1322283 - DNA, 20 bp, Homo sapiens
cctcgttagagaatggcctg

SEQ ID NO: 1322284 - DNA, 23 bp, Homo sapiens
cctcgttagagaatggcctgaga

SEQ ID NO: 1322285 - DNA, 14 bp, Homo sapiens
cctcgttttcaaag

SEQ ID NO: 1322286 - DNA, 13 bp, Homo sapiens
cctctcagagcaa

SEQ ID NO: 1322287 - DNA, 18 bp, Homo sapiens
cctctcagagcaagcctt

SEQ ID NO: 1322288 - DNA, 21 bp, Homo sapiens
cctctcagagcaagcctttga

SEQ ID NO: 1322289 - DNA, 12 bp, Homo sapiens
cctctccacacc

SEQ ID NO: 1322290 - DNA, 15 bp, Homo sapiens
cctctccacacccag

SEQ ID NO: 1322291 - DNA, 21 bp, Homo sapiens
cctctccacacccagcctgtc

SEQ ID NO: 1322292 - DNA, 14 bp, Homo sapiens
cctctccagcatcc

SEQ ID NO: 1322293 - DNA, 16 bp, Homo sapiens
cctctccagcatccca

SEQ ID NO: 1322294 - DNA, 21 bp, Homo sapiens
cctctccagcatcccagcctc

SEQ ID NO: 1322295 - DNA, 16 bp, Homo sapiens
cctctctccactaccc

SEQ ID NO: 1322296 - DNA, 13 bp, Homo sapiens
cctctgccatcct

SEQ ID NO: 1322297 - DNA, 16 bp, Homo sapiens
cctgaaactactgtat

SEQ ID NO: 1322298 - DNA, 12 bp, Homo sapiens
cctgagacagtg

SEQ ID NO: 1322299 - DNA, 15 bp, Homo sapiens
cctgcacataaactc

SEQ ID NO: 1322300 - DNA, 17 bp, Homo sapiens
cctgcagacctggctgg

SEQ ID NO: 1322301 - DNA, 12 bp, Homo sapiens
cctgcagcctcc

SEQ ID NO: 1322302 - DNA, 20 bp, Homo sapiens
cctgcaggccagtcccacgg

SEQ ID NO: 1322303 - DNA, 15 bp, Homo sapiens
cctgcccccacagct

SEQ ID NO: 1322304 - DNA, 19 bp, Homo sapiens
cctgcccgatccagattcc

SEQ ID NO: 1322305 - DNA, 21 bp, Homo sapiens
cctgcccgatccagattccca

SEQ ID NO: 1322306 - DNA, 14 bp, Homo sapiens
cctggcctctgcca

SEQ ID NO: 1322307 - DNA, 16 bp, Homo sapiens
cctggcctctgccatc

SEQ ID NO: 1322308 - DNA, 17 bp, Homo sapiens
cctggcctctgccatcc

SEQ ID NO: 1322309 - DNA, 19 bp, Homo sapiens
cctggcctctgccatcctc

SEQ ID NO: 1322310 - DNA, 13 bp, Homo sapiens
cctggccttttcc

SEQ ID NO: 1322311 - DNA, 21 bp, Homo sapiens
cctgggactaaagccaggaac

SEQ ID NO: 1322312 - DNA, 20 bp, Homo sapiens
cctgggcccctcagccaccc

SEQ ID NO: 1322313 - DNA, 19 bp, Homo sapiens
cctgggctctcgcggcctc

SEQ ID NO: 1322314 - DNA, 13 bp, Homo sapiens
cctgggcttccac

SEQ ID NO: 1322315 - DNA, 14 bp, Homo sapiens
cctgggcttccaca

SEQ ID NO: 1322316 - DNA, 16 bp, Homo sapiens
cctgggcttccacagt

SEQ ID NO: 1322317 - DNA, 19 bp, Homo sapiens
cctggggcgcgtgaggccc

SEQ ID NO: 1322318 - DNA, 14 bp, Homo sapiens
cctggggtgcaggc

SEQ ID NO: 1322319 - DNA, 11 bp, Homo sapiens
cctgggtcctc

SEQ ID NO: 1322320 - DNA, 14 bp, Homo sapiens
cctgggtgacagag

SEQ ID NO: 1322321 - DNA, 17 bp, Homo sapiens
cctggtggctgcaggca

SEQ ID NO: 1322322 - DNA, 13 bp, Homo sapiens
cctgtcccactgg

SEQ ID NO: 1322323 - DNA, 18 bp, Homo sapiens
cctgtcccactggctcct

SEQ ID NO: 1322324 - DNA, 20 bp, Homo sapiens
cctgtgtatggtgacctctc

SEQ ID NO: 1322325 - DNA, 16 bp, Homo sapiens
cctgttccccacaggt

SEQ ID NO: 1322326 - DNA, 16 bp, Homo sapiens
cctgttccttcctgca

SEQ ID NO: 1322327 - DNA, 18 bp, Homo sapiens
cctgttccttcctgcaga

SEQ ID NO: 1322328 - DNA, 13 bp, Homo sapiens
cctgttggtttga

SEQ ID NO: 1322329 - DNA, 17 bp, Homo sapiens
ccttaagcagaggaatt

SEQ ID NO: 1322330 - DNA, 16 bp, Homo sapiens
ccttcactccagacag

SEQ ID NO: 1322331 - DNA, 17 bp, Homo sapiens
ccttcctgcagacctgg

SEQ ID NO: 1322332 - DNA, 19 bp, Homo sapiens
ccttcctgcagacctggct

SEQ ID NO: 1322333 - DNA, 14 bp, Homo sapiens
ccttctaccctggg

SEQ ID NO: 1322334 - DNA, 15 bp, Homo sapiens
ccttctaccctgggt

SEQ ID NO: 1322335 - DNA, 23 bp, Homo sapiens
ccttctaccctgggtcctcgggc

SEQ ID NO: 1322336 - DNA, 15 bp, Homo sapiens
ccttctctcaatccc

SEQ ID NO: 1322337 - DNA, 21 bp, Homo sapiens
ccttctctcaatccctttgca

SEQ ID NO: 1322338 - DNA, 20 bp, Homo sapiens
ccttcttcatgttcaattat

SEQ ID NO: 1322339 - DNA, 12 bp, Homo sapiens
ccttcttgctgc

SEQ ID NO: 1322340 - DNA, 15 bp, Homo sapiens
ccttcttgctgccca

SEQ ID NO: 1322341 - DNA, 20 bp, Homo sapiens
ccttcttggcttcctggcgc

SEQ ID NO: 1322342 - DNA, 14 bp, Homo sapiens
ccttgacttgccat

SEQ ID NO: 1322343 - DNA, 15 bp, Homo sapiens
ccttgacttgccatg

SEQ ID NO: 1322344 - DNA, 16 bp, Homo sapiens
ccttgacttgccatga

SEQ ID NO: 1322345 - DNA, 20 bp, Homo sapiens
ccttgccccaacccttcttc

SEQ ID NO: 1322346 - DNA, 23 bp, Homo sapiens
ccttgctctctgttctcttgctt

SEQ ID NO: 1322347 - DNA, 19 bp, Homo sapiens
ccttggtctcatgccccgc

SEQ ID NO: 1322348 - DNA, 13 bp, Homo sapiens
ccttgtggtccaa

SEQ ID NO: 1322349 - DNA, 17 bp, Homo sapiens
ccttgtggtccaaatag

SEQ ID NO: 1322350 - DNA, 19 bp, Homo sapiens
cctttagatagcagcctgg

SEQ ID NO: 1322351 - DNA, 16 bp, Homo sapiens
cctttccaccttctca

SEQ ID NO: 1322352 - DNA, 16 bp, Homo sapiens
cctttgacctgttcag

SEQ ID NO: 1322353 - DNA, 16 bp, Homo sapiens
cctttgcaacgctcac

SEQ ID NO: 1322354 - DNA, 16 bp, Homo sapiens
ccttttgctgtgtgaa

SEQ ID NO: 1322355 - DNA, 18 bp, Homo sapiens
ccttttttcctttccacc

SEQ ID NO: 1322356 - DNA, 13 bp, Homo sapiens
cgaagccacaggc

SEQ ID NO: 1322357 - DNA, 17 bp, Homo sapiens
cgaatgcactcagggtc

SEQ ID NO: 1322358 - DNA, 17 bp, Homo sapiens
cgatccagattcccagg

SEQ ID NO: 1322359 - DNA, 19 bp, Homo sapiens
cgatccagattcccaggcc

SEQ ID NO: 1322360 - DNA, 20 bp, Homo sapiens
cgatccagattcccaggcca

SEQ ID NO: 1322361 - DNA, 13 bp, Homo sapiens
cgattcacagcct

SEQ ID NO: 1322362 - DNA, 18 bp, Homo sapiens
cgcattaagggcctgctg

SEQ ID NO: 1322363 - DNA, 20 bp, Homo sapiens
cgcattaagggcctgctgga

SEQ ID NO: 1322364 - DNA, 21 bp, Homo sapiens
cgcccatgagagcgcagcccg

SEQ ID NO: 1322365 - DNA, 13 bp, Homo sapiens
cgccccagggtct

SEQ ID NO: 1322366 - DNA, 14 bp, Homo sapiens
cgccccagggtctg

SEQ ID NO: 1322367 - DNA, 17 bp, Homo sapiens
cgcccgtagatcatccc

SEQ ID NO: 1322368 - DNA, 21 bp, Homo sapiens
cgcccgtagatcatccccgag

SEQ ID NO: 1322369 - DNA, 13 bp, Homo sapiens
cgccttctccagg

SEQ ID NO: 1322370 - DNA, 12 bp, Homo sapiens
cgctcagatgcc

SEQ ID NO: 1322371 - DNA, 14 bp, Homo sapiens
cgctgcgtgccatg

SEQ ID NO: 1322372 - DNA, 18 bp, Homo sapiens
cgctgggttctgactctg

SEQ ID NO: 1322373 - DNA, 17 bp, Homo sapiens
cggagccccaagactct

SEQ ID NO: 1322374 - DNA, 18 bp, Homo sapiens
cggagccccaagactctg

SEQ ID NO: 1322375 - DNA, 21 bp, Homo sapiens
cggagccccaagactctgctc

SEQ ID NO: 1322376 - DNA, 17 bp, Homo sapiens
cggccaggtgcctcctg

SEQ ID NO: 1322377 - DNA, 18 bp, Homo sapiens
cggcctcttctctcagac

SEQ ID NO: 1322378 - DNA, 15 bp, Homo sapiens
cggctctgtgcccgg

SEQ ID NO: 1322379 - DNA, 17 bp, Homo sapiens
cggctctgtgcccggtg

SEQ ID NO: 1322380 - DNA, 16 bp, Homo sapiens
cggctggctcccctgc

SEQ ID NO: 1322381 - DNA, 19 bp, Homo sapiens
cggctggctcccctgcagc

SEQ ID NO: 1322382 - DNA, 18 bp, Homo sapiens
cgggcccctgagcctgtg

SEQ ID NO: 1322383 - DNA, 20 bp, Homo sapiens
cgggccctgtggtgctggga

SEQ ID NO: 1322384 - DNA, 14 bp, Homo sapiens
cgggctttgtggca

SEQ ID NO: 1322385 - DNA, 12 bp, Homo sapiens
cggtgccatctt

SEQ ID NO: 1322386 - DNA, 18 bp, Homo sapiens
cggtgccatcttccatat

SEQ ID NO: 1322387 - DNA, 20 bp, Homo sapiens
cgtagatcatccccgagggc

SEQ ID NO: 1322388 - DNA, 12 bp, Homo sapiens
cgtcccctcaag

SEQ ID NO: 1322389 - DNA, 13 bp, Homo sapiens
cgtcccctcaagc

SEQ ID NO: 1322390 - DNA, 16 bp, Homo sapiens
cgtcccctcaagcccc

SEQ ID NO: 1322391 - DNA, 18 bp, Homo sapiens
cgtcccctcaagcccctt

SEQ ID NO: 1322392 - DNA, 19 bp, Homo sapiens
cgtcccctcaagccccttc

SEQ ID NO: 1322393 - DNA, 11 bp, Homo sapiens
cgtcctcagca

SEQ ID NO: 1322394 - DNA, 14 bp, Homo sapiens
cgtcctcagcaccc

SEQ ID NO: 1322395 - DNA, 15 bp, Homo sapiens
cgtgaggcccgtggg

SEQ ID NO: 1322396 - DNA, 17 bp, Homo sapiens
cgtgatatgctgcttgt

SEQ ID NO: 1322397 - DNA, 20 bp, Homo sapiens
tgttttagtaaaaaagagaa

SEQ ID NO: 1322398 - DNA, 11 bp, Homo sapiens
tgttttcttgg

SEQ ID NO: 1322399 - DNA, 20 bp, Homo sapiens
ttaaaactaggcatttgtaa

SEQ ID NO: 1322400 - DNA, 23 bp, Homo sapiens
ttaaaactaggcatttgtaaata

SEQ ID NO: 1322401 - DNA, 21 bp, Homo sapiens
ttaaaagaaagggttctgtaa

SEQ ID NO: 1322402 - DNA, 21 bp, Homo sapiens
ttaaatgacagcacctgagaa

SEQ ID NO: 1322403 - DNA, 21 bp, Homo sapiens
ttaacagtcaccactgtgctc

SEQ ID NO: 1322404 - DNA, 16 bp, Homo sapiens
ttaacttatgtatgtg

SEQ ID NO: 1322405 - DNA, 11 bp, Homo sapiens
ttaagacagaa

SEQ ID NO: 1322406 - DNA, 12 bp, Homo sapiens
ttaagattcttg

SEQ ID NO: 1322407 - DNA, 16 bp, Homo sapiens
ttaatactgagaaaaa

SEQ ID NO: 1322408 - DNA, 14 bp, Homo sapiens
ttaatgttggaaga

SEQ ID NO: 1322409 - DNA, 22 bp, Homo sapiens
ttaattctgttctgatattaat

SEQ ID NO: 1322410 - DNA, 13 bp, Homo sapiens
ttaatttatcaga

SEQ ID NO: 1322411 - DNA, 11 bp, Homo sapiens
ttaatttggaa

SEQ ID NO: 1322412 - DNA, 22 bp, Homo sapiens
ttacactgttattttcagcatg

SEQ ID NO: 1322413 - DNA, 17 bp, Homo sapiens
ttacagtggattgctca

SEQ ID NO: 1322414 - DNA, 23 bp, Homo sapiens
ttaccttaaaactaggcatttgt

SEQ ID NO: 1322415 - DNA, 17 bp, Homo sapiens
ttactacaaatggatga

SEQ ID NO: 1322416 - DNA, 18 bp, Homo sapiens
ttactacaaatggatgac

SEQ ID NO: 1322417 - DNA, 20 bp, Homo sapiens
ttagagcaactttctggggc

SEQ ID NO: 1322418 - DNA, 12 bp, Homo sapiens
ttagatgaggtc

SEQ ID NO: 1322419 - DNA, 11 bp, Homo sapiens
ttagcacagcg

SEQ ID NO: 1322420 - DNA, 16 bp, Homo sapiens
ttattaatgctaaggg

SEQ ID NO: 1322421 - DNA, 14 bp, Homo sapiens
ttattcaacagaga

SEQ ID NO: 1322422 - DNA, 21 bp, Homo sapiens
ttcaaagataaatgaaataaa

SEQ ID NO: 1322423 - DNA, 20 bp, Homo sapiens
ttcaacttatttaaatgaca

SEQ ID NO: 1322424 - DNA, 10 bp, Homo sapiens
ttcacagcct

SEQ ID NO: 1322425 - DNA, 18 bp, Homo sapiens
ttcacatgtgccctgcct

SEQ ID NO: 1322426 - DNA, 20 bp, Homo sapiens
ttcacatgtgccctgccttg

SEQ ID NO: 1322427 - DNA, 15 bp, Homo sapiens
ttcacttgccaagtg

SEQ ID NO: 1322428 - DNA, 14 bp, Homo sapiens
ttcatctggaagtt

SEQ ID NO: 1322429 - DNA, 18 bp, Homo sapiens
ttcatgctgagcaaagtt

SEQ ID NO: 1322430 - DNA, 16 bp, Homo sapiens
ttccacagtgtgaaga

SEQ ID NO: 1322431 - DNA, 20 bp, Homo sapiens
ttccactgctactgacccag

SEQ ID NO: 1322432 - DNA, 14 bp, Homo sapiens
ttccagccattctg

SEQ ID NO: 1322433 - DNA, 20 bp, Homo sapiens
ttcccagctctacattctgc

SEQ ID NO: 1322434 - DNA, 23 bp, Homo sapiens
ttcccagctctacattctgctct

SEQ ID NO: 1322435 - DNA, 16 bp, Homo sapiens
ttcccaggcaaataaa

SEQ ID NO: 1322436 - DNA, 19 bp, Homo sapiens
ttcccaggccaggctcccg

SEQ ID NO: 1322437 - DNA, 23 bp, Homo sapiens
ttcccctccctcgttttcaaaga

SEQ ID NO: 1322438 - DNA, 13 bp, Homo sapiens
ttcctggcgcccc

SEQ ID NO: 1322439 - DNA, 17 bp, Homo sapiens
ttccttcctgcagacct

SEQ ID NO: 1322440 - DNA, 15 bp, Homo sapiens
ttctaatttgctgct

SEQ ID NO: 1322441 - DNA, 16 bp, Homo sapiens
ttctaatttgctgctg

SEQ ID NO: 1322442 - DNA, 15 bp, Homo sapiens
ttctatgaacttgtc

SEQ ID NO: 1322443 - DNA, 13 bp, Homo sapiens
ttctcagttcatt

SEQ ID NO: 1322444 - DNA, 16 bp, Homo sapiens
ttctcccaactcagcc

SEQ ID NO: 1322445 - DNA, 19 bp, Homo sapiens
ttctcccaactcagcctgt

SEQ ID NO: 1322446 - DNA, 23 bp, Homo sapiens
ttctcccaactcagcctgttcct

SEQ ID NO: 1322447 - DNA, 14 bp, Homo sapiens
ttctctcaatccct

SEQ ID NO: 1322448 - DNA, 11 bp, Homo sapiens
ttctctcagac

SEQ ID NO: 1322449 - DNA, 20 bp, Homo sapiens
ttctgacagcccatgggaat

SEQ ID NO: 1322450 - DNA, 15 bp, Homo sapiens
ttctgctctgcccat

SEQ ID NO: 1322451 - DNA, 21 bp, Homo sapiens
ttctggggcctaataaaactg

SEQ ID NO: 1322452 - DNA, 16 bp, Homo sapiens
ttctgtaaaatggaaa

SEQ ID NO: 1322453 - DNA, 15 bp, Homo sapiens
ttctgtgtgttcctg

SEQ ID NO: 1322454 - DNA, 13 bp, Homo sapiens
ttctgttctgata

SEQ ID NO: 1322455 - DNA, 14 bp, Homo sapiens
ttcttaatttggaa

SEQ ID NO: 1322456 - DNA, 20 bp, Homo sapiens
ttcttaatttggaaactaat

SEQ ID NO: 1322457 - DNA, 23 bp, Homo sapiens
ttcttaatttggaaactaataaa

SEQ ID NO: 1322458 - DNA, 11 bp, Homo sapiens
ttcttcctgga

SEQ ID NO: 1322459 - DNA, 23 bp, Homo sapiens
ttcttgctactgaaaaaaatgga

SEQ ID NO: 1322460 - DNA, 22 bp, Homo sapiens
ttcttggacacttaattctgtt

SEQ ID NO: 1322461 - DNA, 15 bp, Homo sapiens
ttcttggcttcctgg

SEQ ID NO: 1322462 - DNA, 21 bp, Homo sapiens
ttcttggtatttggatatctg

SEQ ID NO: 1322463 - DNA, 22 bp, Homo sapiens
ttcttggtatttggatatctgt

SEQ ID NO: 1322464 - DNA, 20 bp, Homo sapiens
ttctttttaaagcttttgat

SEQ ID NO: 1322465 - DNA, 24 bp, Homo sapiens
ttgaaaaccaacaccatcacagct

SEQ ID NO: 1322466 - DNA, 14 bp, Homo sapiens
ttgacctctccagc

SEQ ID NO: 1322467 - DNA, 16 bp, Homo sapiens
ttgacctctccagcat

SEQ ID NO: 1322468 - DNA, 11 bp, Homo sapiens
ttgactggctt

SEQ ID NO: 1322469 - DNA, 19 bp, Homo sapiens
tgcattgtgaattgcctgc

SEQ ID NO: 1322470 - DNA, 20 bp, Homo sapiens
tgcattgtgaattgcctgcc

SEQ ID NO: 1322471 - DNA, 24 bp, Homo sapiens
tgcattgtgaattgcctgccatgg

SEQ ID NO: 1322472 - DNA, 17 bp, Homo sapiens
tgcattttttaaaacaa

SEQ ID NO: 1322473 - DNA, 20 bp, Homo sapiens
tgccaaataaagttaaaagt

SEQ ID NO: 1322474 - DNA, 12 bp, Homo sapiens
tgccactcaggg

SEQ ID NO: 1322475 - DNA, 22 bp, Homo sapiens
tgccactcagggtctgggatga

SEQ ID NO: 1322476 - DNA, 12 bp, Homo sapiens
tgccaggaactc

SEQ ID NO: 1322477 - DNA, 14 bp, Homo sapiens
tgccagtgcatgcc

SEQ ID NO: 1322478 - DNA, 17 bp, Homo sapiens
tgccagtgcatgccagg

SEQ ID NO: 1322479 - DNA, 22 bp, Homo sapiens
tgccagtgcatgccaggaagca

SEQ ID NO: 1322480 - DNA, 11 bp, Homo sapiens
tgccatcctcc

SEQ ID NO: 1322481 - DNA, 19 bp, Homo sapiens
tgccatgagtccatgtcct

SEQ ID NO: 1322482 - DNA, 19 bp, Homo sapiens
tgcccacaacgtcccctca

SEQ ID NO: 1322483 - DNA, 12 bp, Homo sapiens
tgcccccacagc

SEQ ID NO: 1322484 - DNA, 22 bp, Homo sapiens
tgccccgccatggtcaccctca

SEQ ID NO: 1322485 - DNA, 23 bp, Homo sapiens
tgccccgccatggtcaccctcag

SEQ ID NO: 1322486 - DNA, 16 bp, Homo sapiens
tgcccggtgccatctt

SEQ ID NO: 1322487 - DNA, 18 bp, Homo sapiens
tgcccggtgccatcttcc

SEQ ID NO: 1322488 - DNA, 20 bp, Homo sapiens
tgcccggtgccatcttccat

SEQ ID NO: 1322489 - DNA, 12 bp, Homo sapiens
tgccctgccttg

SEQ ID NO: 1322490 - DNA, 20 bp, Homo sapiens
tgccggagccccaagactct

SEQ ID NO: 1322491 - DNA, 20 bp, Homo sapiens
tgcctaaagcccattgctgc

SEQ ID NO: 1322492 - DNA, 20 bp, Homo sapiens
tgcctcacaaatgctgtggt

SEQ ID NO: 1322493 - DNA, 16 bp, Homo sapiens
tgcctcggctggctcc

SEQ ID NO: 1322494 - DNA, 20 bp, Homo sapiens
tgcctcggctggctcccctg

SEQ ID NO: 1322495 - DNA, 12 bp, Homo sapiens
tgcctgccatgg

SEQ ID NO: 1322496 - DNA, 23 bp, Homo sapiens
tgcgtgccatgagtccatgtcct

SEQ ID NO: 1322497 - DNA, 15 bp, Homo sapiens
tgctaccttgcccca

SEQ ID NO: 1322498 - DNA, 14 bp, Homo sapiens
tgctactgaaaaaa

SEQ ID NO: 1322499 - DNA, 22 bp, Homo sapiens
tgctatcacatagatctagtct

SEQ ID NO: 1322500 - DNA, 15 bp, Homo sapiens
tgctcaaccagacag

SEQ ID NO: 1322501 - DNA, 13 bp, Homo sapiens
tgctcaataaact

SEQ ID NO: 1322502 - DNA, 20 bp, Homo sapiens
tgctcaataaacttgtgcct

SEQ ID NO: 1322503 - DNA, 21 bp, Homo sapiens
tgctcaataaacttgtgcctc

SEQ ID NO: 1322504 - DNA, 22 bp, Homo sapiens
tgctcaataaacttgtgcctcc

SEQ ID NO: 1322505 - DNA, 20 bp, Homo sapiens
tgctcatctcagtcctcaaa

SEQ ID NO: 1322506 - DNA, 17 bp, Homo sapiens
tgctcccgccccagggt

SEQ ID NO: 1322507 - DNA, 20 bp, Homo sapiens
tgctcccgccccagggtctg

SEQ ID NO: 1322508 - DNA, 21 bp, Homo sapiens
tgctcccgccccagggtctga

SEQ ID NO: 1322509 - DNA, 23 bp, Homo sapiens
tgctcccgccccagggtctgaaa

SEQ ID NO: 1322510 - DNA, 19 bp, Homo sapiens
tgctctcctcgggccctgt

SEQ ID NO: 1322511 - DNA, 21 bp, Homo sapiens
tgctctcctcgggccctgtgg

SEQ ID NO: 1322512 - DNA, 19 bp, Homo sapiens
tgctctctgttctcttgct

SEQ ID NO: 1322513 - DNA, 22 bp, Homo sapiens
tgctctgagtagctttacactg

SEQ ID NO: 1322514 - DNA, 14 bp, Homo sapiens
tgctgagcaaagtt

SEQ ID NO: 1322515 - DNA, 13 bp, Homo sapiens
tgctgcaaatgca

SEQ ID NO: 1322516 - DNA, 22 bp, Homo sapiens
tgctgcccacaacgtcccctca

SEQ ID NO: 1322517 - DNA, 16 bp, Homo sapiens
tgctggagaaaccttc

SEQ ID NO: 1322518 - DNA, 13 bp, Homo sapiens
caatacagtgctc

SEQ ID NO: 1322519 - DNA, 17 bp, Homo sapiens
caatcagctgctttgtt

SEQ ID NO: 1322520 - DNA, 20 bp, Homo sapiens
caatgggagcacatagccct

SEQ ID NO: 1322521 - DNA, 18 bp, Homo sapiens
caatgtgatataaacagc

SEQ ID NO: 1322522 - DNA, 20 bp, Homo sapiens
caatgtgatataaacagctt

SEQ ID NO: 1322523 - DNA, 20 bp, Homo sapiens
caatgtgatggtatttgaga

SEQ ID NO: 1322524 - DNA, 13 bp, Homo sapiens
caattatttcccc

SEQ ID NO: 1322525 - DNA, 14 bp, Homo sapiens
caatttcctttaaa

SEQ ID NO: 1322526 - DNA, 19 bp, Homo sapiens
caattttagtcttgctgtt

SEQ ID NO: 1322527 - DNA, 19 bp, Homo sapiens
caattttattttttttctg

SEQ ID NO: 1322528 - DNA, 19 bp, Homo sapiens
cacaacgtcccctcaagcc

SEQ ID NO: 1322529 - DNA, 12 bp, Homo sapiens
cacacccagcct

SEQ ID NO: 1322530 - DNA, 18 bp, Homo sapiens
cacacctgcagcctccct

SEQ ID NO: 1322531 - DNA, 14 bp, Homo sapiens
cacacgccttcatg

SEQ ID NO: 1322532 - DNA, 16 bp, Homo sapiens
cacacgccttcatgcc

SEQ ID NO: 1322533 - DNA, 19 bp, Homo sapiens
cacagaccgcgcccctggg

SEQ ID NO: 1322534 - DNA, 22 bp, Homo sapiens
cacagcgttatgtgtctgccac

SEQ ID NO: 1322535 - DNA, 14 bp, Homo sapiens
cacagctccttgca

SEQ ID NO: 1322536 - DNA, 14 bp, Homo sapiens
cacagcttgttttg

SEQ ID NO: 1322537 - DNA, 20 bp, Homo sapiens
cacagcttgttttggacttt

SEQ ID NO: 1322538 - DNA, 13 bp, Homo sapiens
cacaggcctggcc

SEQ ID NO: 1322539 - DNA, 14 bp, Homo sapiens
cacaggcctggcct

SEQ ID NO: 1322540 - DNA, 15 bp, Homo sapiens
cacaggtcctccatc

SEQ ID NO: 1322541 - DNA, 16 bp, Homo sapiens
cacaggtcctccatca

SEQ ID NO: 1322542 - DNA, 22 bp, Homo sapiens
cacatagccctgttgacctgcc

SEQ ID NO: 1322543 - DNA, 13 bp, Homo sapiens
cacatgtgccctg

SEQ ID NO: 1322544 - DNA, 17 bp, Homo sapiens
cacatgtgccctgcctt

SEQ ID NO: 1322545 - DNA, 22 bp, Homo sapiens
cacatttaatgaacacaatttt

SEQ ID NO: 1322546 - DNA, 12 bp, Homo sapiens
caccaccccacc

SEQ ID NO: 1322547 - DNA, 13 bp, Homo sapiens
caccaccccaccc

SEQ ID NO: 1322548 - DNA, 17 bp, Homo sapiens
caccaggcaaccaggaa

SEQ ID NO: 1322549 - DNA, 21 bp, Homo sapiens
caccatcacagcttgttttgg

SEQ ID NO: 1322550 - DNA, 22 bp, Homo sapiens
caccatcacagcttgttttgga

SEQ ID NO: 1322551 - DNA, 20 bp, Homo sapiens
cacccagcctgtcccactgg

SEQ ID NO: 1322552 - DNA, 20 bp, Homo sapiens
caccccacccacctttgcag

SEQ ID NO: 1322553 - DNA, 16 bp, Homo sapiens
caccccttgctctctg

SEQ ID NO: 1322554 - DNA, 20 bp, Homo sapiens
caccccttgctctctgttct

SEQ ID NO: 1322555 - DNA, 22 bp, Homo sapiens
caccctcaggaacccaccctct

SEQ ID NO: 1322556 - DNA, 20 bp, Homo sapiens
caccctctccacacccagcc

SEQ ID NO: 1322557 - DNA, 19 bp, Homo sapiens
cacctatgtggcatgtggt

SEQ ID NO: 1322558 - DNA, 16 bp, Homo sapiens
cacctcactctgctac

SEQ ID NO: 1322559 - DNA, 19 bp, Homo sapiens
cacctctatattagtttat

SEQ ID NO: 1322560 - DNA, 13 bp, Homo sapiens
cacctctcagagc

SEQ ID NO: 1322561 - DNA, 16 bp, Homo sapiens
cacctgcccccacagc

SEQ ID NO: 1322562 - DNA, 18 bp, Homo sapiens
cacctgcccccacagctc

SEQ ID NO: 1322563 - DNA, 22 bp, Homo sapiens
taataaaatattttctgtgtgt

SEQ ID NO: 1322564 - DNA, 13 bp, Homo sapiens
taatactgagaaa

SEQ ID NO: 1322565 - DNA, 15 bp, Homo sapiens
taatgaacacaattt

SEQ ID NO: 1322566 - DNA, 19 bp, Homo sapiens
taatgtcaacaccagaaag

SEQ ID NO: 1322567 - DNA, 16 bp, Homo sapiens
taattcaccaatttcc

SEQ ID NO: 1322568 - DNA, 23 bp, Homo sapiens
taattgcaccatagtatgctctg

SEQ ID NO: 1322569 - DNA, 15 bp, Homo sapiens
taatttatcagattg

SEQ ID NO: 1322570 - DNA, 13 bp, Homo sapiens
taatttcattcaa

SEQ ID NO: 1322571 - DNA, 14 bp, Homo sapiens
taatttgctgctga

SEQ ID NO: 1322572 - DNA, 19 bp, Homo sapiens
taatttggaaactaataaa

SEQ ID NO: 1322573 - DNA, 20 bp, Homo sapiens
taatttggaaactaataaaa

SEQ ID NO: 1322574 - DNA, 23 bp, Homo sapiens
taatttggaaactaataaaatat

SEQ ID NO: 1322575 - DNA, 16 bp, Homo sapiens
tacaagacctctggct

SEQ ID NO: 1322576 - DNA, 15 bp, Homo sapiens
tacacacagaccgcg

SEQ ID NO: 1322577 - DNA, 13 bp, Homo sapiens
tacactgttattt

SEQ ID NO: 1322578 - DNA, 13 bp, Homo sapiens
tacaggaacacac

SEQ ID NO: 1322579 - DNA, 16 bp, Homo sapiens
tacagtgagctgagag

SEQ ID NO: 1322580 - DNA, 22 bp, Homo sapiens
tacagtggattgctcatctcag

SEQ ID NO: 1322581 - DNA, 23 bp, Homo sapiens
tacagttgggaagtctcagcctg

SEQ ID NO: 1322582 - DNA, 14 bp, Homo sapiens
tacattctgctctg

SEQ ID NO: 1322583 - DNA, 23 bp, Homo sapiens
tacattctgctctgcccatgcct

SEQ ID NO: 1322584 - DNA, 12 bp, Homo sapiens
taccagagaagg

SEQ ID NO: 1322585 - DNA, 14 bp, Homo sapiens
taccaggcccagga

SEQ ID NO: 1322586 - DNA, 19 bp, Homo sapiens
tacccctgacttctgttta

SEQ ID NO: 1322587 - DNA, 21 bp, Homo sapiens
taccttgccccaacccttctt

SEQ ID NO: 1322588 - DNA, 17 bp, Homo sapiens
tacgcattaagggcctg

SEQ ID NO: 1322589 - DNA, 16 bp, Homo sapiens
tacgctgcgtgccatg

SEQ ID NO: 1322590 - DNA, 13 bp, Homo sapiens
tactcatgactga

SEQ ID NO: 1322591 - DNA, 13 bp, Homo sapiens
tactgacccagag

SEQ ID NO: 1322592 - DNA, 22 bp, Homo sapiens
tactgagacaaaaaggaaacat

SEQ ID NO: 1322593 - DNA, 18 bp, Homo sapiens
tactgagagaaggtgaaa

SEQ ID NO: 1322594 - DNA, 18 bp, Homo sapiens
tactgtctaggaaaataa

SEQ ID NO: 1322595 - DNA, 10 bp, Homo sapiens
tactgtgtta

SEQ ID NO: 1322596 - DNA, 15 bp, Homo sapiens
tacttgcaaaatgga

SEQ ID NO: 1322597 - DNA, 14 bp, Homo sapiens
tagaacaagaaatc

SEQ ID NO: 1322598 - DNA, 12 bp, Homo sapiens
tagaatagcatg

SEQ ID NO: 1322599 - DNA, 16 bp, Homo sapiens
tagactatagcccctg

SEQ ID NO: 1322600 - DNA, 13 bp, Homo sapiens
tagagatgagctt

SEQ ID NO: 1322601 - DNA, 16 bp, Homo sapiens
tagagatgagctttct

SEQ ID NO: 1322602 - DNA, 21 bp, Homo sapiens
tagagatgagctttcttttta

SEQ ID NO: 1322603 - DNA, 21 bp, Homo sapiens
tagaggcctgaaatcctggtt

SEQ ID NO: 1322604 - DNA, 19 bp, Homo sapiens
tagatagcagcctggctcc

SEQ ID NO: 1322605 - DNA, 21 bp, Homo sapiens
tagatcacttgatgccaggag

SEQ ID NO: 1322606 - DNA, 16 bp, Homo sapiens
tagatcatccccgagg

SEQ ID NO: 1322607 - DNA, 15 bp, Homo sapiens
tagatgaacatctct

SEQ ID NO: 1322608 - DNA, 14 bp, Homo sapiens
tagatgaagaaaga

SEQ ID NO: 1322609 - DNA, 15 bp, Homo sapiens
tagcagcctggctcc

SEQ ID NO: 1322610 - DNA, 16 bp, Homo sapiens
tagcagcctggctccc

SEQ ID NO: 1322611 - DNA, 20 bp, Homo sapiens
tagcagcctggctcccctgg

SEQ ID NO: 1322612 - DNA, 22 bp, Homo sapiens
tagcatgataccaggcccagga

SEQ ID NO: 1322613 - DNA, 15 bp, Homo sapiens
tagcatgttgtagat

SEQ ID NO: 1322614 - DNA, 12 bp, Homo sapiens
tagcccctggtg

SEQ ID NO: 1322615 - DNA, 15 bp, Homo sapiens
tagcttcaggacctg

SEQ ID NO: 1322616 - DNA, 13 bp, Homo sapiens
taggcatttgtaa

SEQ ID NO: 1322617 - DNA, 14 bp, Homo sapiens
taggcatttgtaaa

SEQ ID NO: 1322618 - DNA, 21 bp, Homo sapiens
taggcatttgtaaatattaaa

SEQ ID NO: 1322619 - DNA, 21 bp, Homo sapiens
tagggctgagcacctctcaga

SEQ ID NO: 1322620 - DNA, 21 bp, Homo sapiens
taggtgaggggatagcgaatg

SEQ ID NO: 1322621 - DNA, 17 bp, Homo sapiens
tagtataccagagaagg

SEQ ID NO: 1322622 - DNA, 19 bp, Homo sapiens
tagtataccagagaaggta

SEQ ID NO: 1322623 - DNA, 21 bp, Homo sapiens
tagtctgaagtctggaacact

SEQ ID NO: 1322624 - DNA, 19 bp, Homo sapiens
tagtcttgctgtttcttga

SEQ ID NO: 1322625 - DNA, 15 bp, Homo sapiens
tagtgaaacagcttt

SEQ ID NO: 1322626 - DNA, 15 bp, Homo sapiens
tagtgctgaagctta

SEQ ID NO: 1322627 - DNA, 17 bp, Homo sapiens
tagtgctgaagcttatt

SEQ ID NO: 1322628 - DNA, 22 bp, Homo sapiens
tagtgtggttttctgtttctaa

SEQ ID NO: 1322629 - DNA, 16 bp, Homo sapiens
tataccagagaaggta

SEQ ID NO: 1322630 - DNA, 12 bp, Homo sapiens
tatcaagctaat

SEQ ID NO: 1322631 - DNA, 15 bp, Homo sapiens
tatcaagctaataaa

SEQ ID NO: 1322632 - DNA, 14 bp, Homo sapiens
tatcagattgcttt

SEQ ID NO: 1322633 - DNA, 20 bp, Homo sapiens
tatcagattgcttttgtgca

SEQ ID NO: 1322634 - DNA, 13 bp, Homo sapiens
tatcattcagcaa

SEQ ID NO: 1322635 - DNA, 14 bp, Homo sapiens
tatcattcagcaac

SEQ ID NO: 1322636 - DNA, 12 bp, Homo sapiens
tatccaccaccc

SEQ ID NO: 1322637 - DNA, 15 bp, Homo sapiens
tatccaccaccccac

SEQ ID NO: 1322638 - DNA, 23 bp, Homo sapiens
tatccactggacactgtgaaata

SEQ ID NO: 1322639 - DNA, 17 bp, Homo sapiens
tatctaatttcattcaa

SEQ ID NO: 1322640 - DNA, 14 bp, Homo sapiens
tatgaaaagataac

SEQ ID NO: 1322641 - DNA, 14 bp, Homo sapiens
tatgaacttaacat

SEQ ID NO: 1322642 - DNA, 23 bp, Homo sapiens
tatgagttcacatgtgccctgcc

SEQ ID NO: 1322643 - DNA, 15 bp, Homo sapiens
tatggaactgtaata

SEQ ID NO: 1322644 - DNA, 22 bp, Homo sapiens
tatgtcatgtcttccattaaga

SEQ ID NO: 1322645 - DNA, 17 bp, Homo sapiens
tattaaaagaaagggtt

SEQ ID NO: 1322646 - DNA, 17 bp, Homo sapiens
tattaaaccataagatg

SEQ ID NO: 1322647 - DNA, 12 bp, Homo sapiens
tattaatgctaa

SEQ ID NO: 1322648 - DNA, 14 bp, Homo sapiens
tattaatgctaagg

SEQ ID NO: 1322649 - DNA, 12 bp, Homo sapiens
tatttaaaggga

SEQ ID NO: 1322650 - DNA, 15 bp, Homo sapiens
tatttaaagggaatg

SEQ ID NO: 1322651 - DNA, 18 bp, Homo sapiens
tatttagtataccagaga

SEQ ID NO: 1322652 - DNA, 19 bp, Homo sapiens
tatttagtataccagagaa

SEQ ID NO: 1322653 - DNA, 17 bp, Homo sapiens
tatttatccctcattca

SEQ ID NO: 1322654 - DNA, 20 bp, Homo sapiens
tatttcatcagaacagctgt

SEQ ID NO: 1322655 - DNA, 15 bp, Homo sapiens
tatttggatatctgt

SEQ ID NO: 1322656 - DNA, 12 bp, Homo sapiens
tattttctgtgt

SEQ ID NO: 1322657 - DNA, 13 bp, Homo sapiens
tattttctgtgtg

SEQ ID NO: 1322658 - DNA, 14 bp, Homo sapiens
tattttctgtgtgt

SEQ ID NO: 1322659 - DNA, 16 bp, Homo sapiens
tattttctgtgtgttc

SEQ ID NO: 1322660 - DNA, 17 bp, Homo sapiens
tattttctgtgtgttcc

SEQ ID NO: 1322661 - DNA, 20 bp, Homo sapiens
tattttctgtgtgttcctgg

SEQ ID NO: 1322662 - DNA, 21 bp, Homo sapiens
tattttctgtgtgttcctggc

SEQ ID NO: 1322663 - DNA, 13 bp, Homo sapiens
tcaaacctgtgaa

SEQ ID NO: 1322664 - DNA, 22 bp, Homo sapiens
tcaaagataaatgaaataaacg

SEQ ID NO: 1322665 - DNA, 16 bp, Homo sapiens
tcaacactagcatttt

SEQ ID NO: 1322666 - DNA, 18 bp, Homo sapiens
tcaactctgctgagggtc

SEQ ID NO: 1322667 - DNA, 14 bp, Homo sapiens
tcaactgagaagcc

SEQ ID NO: 1322668 - DNA, 17 bp, Homo sapiens
tcaactgagaagccaag

SEQ ID NO: 1322669 - DNA, 13 bp, Homo sapiens
tcaagctaataaa

SEQ ID NO: 1322670 - DNA, 14 bp, Homo sapiens
tcagttcatttcct

SEQ ID NO: 1322671 - DNA, 16 bp, Homo sapiens
tcatagaatagcatgt

SEQ ID NO: 1322672 - DNA, 21 bp, Homo sapiens
tcatagaatagcatgttgtag

SEQ ID NO: 1322673 - DNA, 22 bp, Homo sapiens
tcatagaatagcatgttgtaga

SEQ ID NO: 1322674 - DNA, 13 bp, Homo sapiens
tcatcagaacagc

SEQ ID NO: 1322675 - DNA, 18 bp, Homo sapiens
tcatcagaacagctgttg

SEQ ID NO: 1322676 - DNA, 21 bp, Homo sapiens
tcatcatatacaaatgtttta

SEQ ID NO: 1322677 - DNA, 16 bp, Homo sapiens
tcatccccgagggcgg

SEQ ID NO: 1322678 - DNA, 22 bp, Homo sapiens
tcatctagtcttgacctctcca

SEQ ID NO: 1322679 - DNA, 15 bp, Homo sapiens
tcatgaaattaccct

SEQ ID NO: 1322680 - DNA, 15 bp, Homo sapiens
tcatgactgaaggga

SEQ ID NO: 1322681 - DNA, 17 bp, Homo sapiens
tcatgccagtgcatgcc

SEQ ID NO: 1322682 - DNA, 21 bp, Homo sapiens
tcatggagaaccacctacccc

SEQ ID NO: 1322683 - DNA, 17 bp, Homo sapiens
tcattaacaagaaacag

SEQ ID NO: 1322684 - DNA, 12 bp, Homo sapiens
tcattattatta

SEQ ID NO: 1322685 - DNA, 10 bp, Homo sapiens
tcattcagca

SEQ ID NO: 1322686 - DNA, 15 bp, Homo sapiens
tcattttgactggct

SEQ ID NO: 1322687 - DNA, 14 bp, Homo sapiens
tccaccaccccacc

SEQ ID NO: 1322688 - DNA, 19 bp, Homo sapiens
tccaccaccccacccacct

SEQ ID NO: 1322689 - DNA, 19 bp, Homo sapiens
tccacctatccaccacccc

SEQ ID NO: 1322690 - DNA, 15 bp, Homo sapiens
tccagatggcaggct

SEQ ID NO: 1322691 - DNA, 13 bp, Homo sapiens
tccagattcccag

SEQ ID NO: 1322692 - DNA, 17 bp, Homo sapiens
tccagattcccaggcca

SEQ ID NO: 1322693 - DNA, 13 bp, Homo sapiens
tccagcatcccag

SEQ ID NO: 1322694 - DNA, 16 bp, Homo sapiens
tccagcatcccagcct

SEQ ID NO: 1322695 - DNA, 17 bp, Homo sapiens
tccagcatcccagcctc

SEQ ID NO: 1322696 - DNA, 18 bp, Homo sapiens
tccagcatcccagcctca

SEQ ID NO: 1322697 - DNA, 14 bp, Homo sapiens
tccagcctgggtga

SEQ ID NO: 1322698 - DNA, 16 bp, Homo sapiens
tccagcgtcctcagca

SEQ ID NO: 1322699 - DNA, 19 bp, Homo sapiens
tccagcgtcctcagcaccc

SEQ ID NO: 1322700 - DNA, 19 bp, Homo sapiens
tccagtgaaaataagccat

SEQ ID NO: 1322701 - DNA, 18 bp, Homo sapiens
tccatatccgggtgctca

SEQ ID NO: 1322702 - DNA, 19 bp, Homo sapiens
tccatatccgggtgctcaa

SEQ ID NO: 1322703 - DNA, 15 bp, Homo sapiens
tccatcacccctggt

SEQ ID NO: 1322704 - DNA, 16 bp, Homo sapiens
tccatcacccctggtg

SEQ ID NO: 1322705 - DNA, 19 bp, Homo sapiens
tccatgtcctatgcctcac

SEQ ID NO: 1322706 - DNA, 22 bp, Homo sapiens
tccatgttttgttttcttggga

SEQ ID NO: 1322707 - DNA, 15 bp, Homo sapiens
tcccaactcagcctg

SEQ ID NO: 1322708 - DNA, 20 bp, Homo sapiens
tcccaactcagcctgttcct

SEQ ID NO: 1322709 - DNA, 21 bp, Homo sapiens
tcccaactcagcctgttcctt

SEQ ID NO: 1322710 - DNA, 13 bp, Homo sapiens
tcccacggctctg

SEQ ID NO: 1322711 - DNA, 22 bp, Homo sapiens
tcccacggctctgtgcccggtg

SEQ ID NO: 1322712 - DNA, 22 bp, Homo sapiens
tcccactaaggtgaccagagtg

SEQ ID NO: 1322713 - DNA, 15 bp, Homo sapiens
tcccactggctcctc

SEQ ID NO: 1322714 - DNA, 20 bp, Homo sapiens
tcccactggctcctcccagc

SEQ ID NO: 1322715 - DNA, 23 bp, Homo sapiens
tcccactggctcctcccagcaca

SEQ ID NO: 1322716 - DNA, 19 bp, Homo sapiens
tcccagcctcagaagcctt

SEQ ID NO: 1322717 - DNA, 23 bp, Homo sapiens
tcccagctctacattctgctctg

SEQ ID NO: 1322718 - DNA, 18 bp, Homo sapiens
tcccaggcaaataaaatt

SEQ ID NO: 1322719 - DNA, 20 bp, Homo sapiens
tcccaggcaaataaaattcc

SEQ ID NO: 1322720 - DNA, 22 bp, Homo sapiens
tcccccaacttcatctggaagt

SEQ ID NO: 1322721 - DNA, 16 bp, Homo sapiens
tcccccaccccagaag

SEQ ID NO: 1322722 - DNA, 21 bp, Homo sapiens
tcccctcaagccccttctctc

SEQ ID NO: 1322723 - DNA, 20 bp, Homo sapiens
tcccctggggtgcaggcgcc

SEQ ID NO: 1322724 - DNA, 14 bp, Homo sapiens
tcccgccccagggt

SEQ ID NO: 1322725 - DNA, 17 bp, Homo sapiens
tccctatgtcatgtctt

SEQ ID NO: 1322726 - DNA, 20 bp, Homo sapiens
tccctccgcggcgggccctg

SEQ ID NO: 1322727 - DNA, 16 bp, Homo sapiens
tccctgcacataaact

SEQ ID NO: 1322728 - DNA, 13 bp, Homo sapiens
tccctgttcccca

SEQ ID NO: 1322729 - DNA, 14 bp, Homo sapiens
tccctgttccccac

SEQ ID NO: 1322730 - DNA, 17 bp, Homo sapiens
tccctgttccccacagg

SEQ ID NO: 1322731 - DNA, 15 bp, Homo sapiens
tcccttgtcaccagg

SEQ ID NO: 1322732 - DNA, 22 bp, Homo sapiens
tcccttgtcaccaggcaaccag

SEQ ID NO: 1322733 - DNA, 11 bp, Homo sapiens
tccggccaggt

SEQ ID NO: 1322734 - DNA, 20 bp, Homo sapiens
tccggccaggtgcctcctga

SEQ ID NO: 1322735 - DNA, 14 bp, Homo sapiens
tccggcctggcctt

SEQ ID NO: 1322736 - DNA, 13 bp, Homo sapiens
tccgggtgctcaa

SEQ ID NO: 1322737 - DNA, 14 bp, Homo sapiens
tccgggtgctcaat

SEQ ID NO: 1322738 - DNA, 18 bp, Homo sapiens
tccgggtgctcaataaac

SEQ ID NO: 1322739 - DNA, 19 bp, Homo sapiens
tccgggtgctcaataaact

SEQ ID NO: 1322740 - DNA, 15 bp, Homo sapiens
tcctaggctggaagg

SEQ ID NO: 1322741 - DNA, 20 bp, Homo sapiens
tcctaggctggaaggaggaa

SEQ ID NO: 1322742 - DNA, 18 bp, Homo sapiens
tcctaggggaatgagggg

SEQ ID NO: 1322743 - DNA, 16 bp, Homo sapiens
tcctcagcaccccact

SEQ ID NO: 1322744 - DNA, 17 bp, Homo sapiens
tcctcagcaccccactc

SEQ ID NO: 1322745 - DNA, 20 bp, Homo sapiens
tcctcagcaccccactcctc

SEQ ID NO: 1322746 - DNA, 21 bp, Homo sapiens
tcctcagcaccccactcctca

SEQ ID NO: 1322747 - DNA, 19 bp, Homo sapiens
tcctcagtaaaagtcttct

SEQ ID NO: 1322748 - DNA, 12 bp, Homo sapiens
tcctcccagcac

SEQ ID NO: 1322749 - DNA, 14 bp, Homo sapiens
tcctccctgttccc

SEQ ID NO: 1322750 - DNA, 12 bp, Homo sapiens
tcctccttccca

SEQ ID NO: 1322751 - DNA, 13 bp, Homo sapiens
tcctccttcccag

SEQ ID NO: 1322752 - DNA, 20 bp, Homo sapiens
tcctcgggcccctgagcctg

SEQ ID NO: 1322753 - DNA, 20 bp, Homo sapiens
tcctcttttgttgtttctta

SEQ ID NO: 1322754 - DNA, 23 bp, Homo sapiens
tcctcttttgttgtttcttaatt

SEQ ID NO: 1322755 - DNA, 22 bp, Homo sapiens
tcctgacacacctgcagcctcc

SEQ ID NO: 1322756 - DNA, 20 bp, Homo sapiens
tcctgcagacctggctgggc

SEQ ID NO: 1322757 - DNA, 21 bp, Homo sapiens
tcctgcagacctggctgggcc

SEQ ID NO: 1322758 - DNA, 22 bp, Homo sapiens
tcctgcagacctggctgggcct

SEQ ID NO: 1322759 - DNA, 11 bp, Homo sapiens
tcctggttcct

SEQ ID NO: 1322760 - DNA, 13 bp, Homo sapiens
tccttcccagctc

SEQ ID NO: 1322761 - DNA, 13 bp, Homo sapiens
tccttcctgcaga

SEQ ID NO: 1322762 - DNA, 15 bp, Homo sapiens
tccttcctgcagacc

SEQ ID NO: 1322763 - DNA, 17 bp, Homo sapiens
tccttcctgcagacctg

SEQ ID NO: 1322764 - DNA, 18 bp, Homo sapiens
tccttcttggcttcctgg

SEQ ID NO: 1322765 - DNA, 20 bp, Homo sapiens
tcctttagatagcagcctgg

SEQ ID NO: 1322766 - DNA, 17 bp, Homo sapiens
tccttttgctgtgtgaa

SEQ ID NO: 1322767 - DNA, 20 bp, Homo sapiens
tcggctggctcccctgcagc

SEQ ID NO: 1322768 - DNA, 17 bp, Homo sapiens
tcgggcccctgagcctg

SEQ ID NO: 1322769 - DNA, 11 bp, Homo sapiens
aaaaacagctt

SEQ ID NO: 1322770 - DNA, 18 bp, Homo sapiens
aaaaagtccttgcaagaa

SEQ ID NO: 1322771 - DNA, 20 bp, Homo sapiens
aaaaatgtgaagtctacttt

SEQ ID NO: 1322772 - DNA, 15 bp, Homo sapiens
aaaaattgtctcttt

SEQ ID NO: 1322773 - DNA, 18 bp, Homo sapiens
aaaacatttctctcttat

SEQ ID NO: 1322774 - DNA, 15 bp, Homo sapiens
aaaaccttttttctt

SEQ ID NO: 1322775 - DNA, 17 bp, Homo sapiens
aaaacttagtttgtgaa

SEQ ID NO: 1322776 - DNA, 17 bp, Homo sapiens
aaaagcaacatcagctt

SEQ ID NO: 1322777 - DNA, 17 bp, Homo sapiens
aaaagtcctgtcagttc

SEQ ID NO: 1322778 - DNA, 17 bp, Homo sapiens
aaaagtccttgcaagaa

SEQ ID NO: 1322779 - DNA, 20 bp, Homo sapiens
aaaagtccttgcaagaatgg

SEQ ID NO: 1322780 - DNA, 21 bp, Homo sapiens
aaaatagagatgagctttctt

SEQ ID NO: 1322781 - DNA, 16 bp, Homo sapiens
aaaatattttctgtgt

SEQ ID NO: 1322782 - DNA, 20 bp, Homo sapiens
aaaatattttctgtgtgttc

SEQ ID NO: 1322783 - DNA, 15 bp, Homo sapiens
aaaattccctaaagc

SEQ ID NO: 1322784 - DNA, 16 bp, Homo sapiens
aaaattccctaaagcc

SEQ ID NO: 1322785 - DNA, 19 bp, Homo sapiens
aaacagaaaatctttcctc

SEQ ID NO: 1322786 - DNA, 15 bp, Homo sapiens
aaacataagagcttt

SEQ ID NO: 1322787 - DNA, 20 bp, Homo sapiens
aaacctgtgatttctgtgcc

SEQ ID NO: 1322788 - DNA, 15 bp, Homo sapiens
aaaccttttttcttg

SEQ ID NO: 1322789 - DNA, 16 bp, Homo sapiens
aaacgcttcagttgtt

SEQ ID NO: 1322790 - DNA, 13 bp, Homo sapiens
aaactaataaaat

SEQ ID NO: 1322791 - DNA, 20 bp, Homo sapiens
aaactactgtatctgatgtt

SEQ ID NO: 1322792 - DNA, 14 bp, Homo sapiens
aaactgatgtgaaa

SEQ ID NO: 1322793 - DNA, 17 bp, Homo sapiens
aaactgccattggctat

SEQ ID NO: 1322794 - DNA, 15 bp, Homo sapiens
aaacttagtttgtga

SEQ ID NO: 1322795 - DNA, 14 bp, Homo sapiens
aaacttgtgcctcc

SEQ ID NO: 1322796 - DNA, 14 bp, Homo sapiens
aaagaaacttgata

SEQ ID NO: 1322797 - DNA, 15 bp, Homo sapiens
aaagaggcacagagc

SEQ ID NO: 1322798 - DNA, 17 bp, Homo sapiens
aaagagtcctccttccc

SEQ ID NO: 1322799 - DNA, 21 bp, Homo sapiens
aaagcaaggcagaaggccagg

SEQ ID NO: 1322800 - DNA, 13 bp, Homo sapiens
aaagctttttgaa

SEQ ID NO: 1322801 - DNA, 17 bp, Homo sapiens
aaagggttctgtaaaat

SEQ ID NO: 1322802 - DNA, 13 bp, Homo sapiens
aaaggtgtgctgt

SEQ ID NO: 1322803 - DNA, 12 bp, Homo sapiens
aaagtaaaagag

SEQ ID NO: 1322804 - DNA, 18 bp, Homo sapiens
aaagtataaatttgtgta

SEQ ID NO: 1322805 - DNA, 20 bp, Homo sapiens
aaagtccttgcaagaatgga

SEQ ID NO: 1322806 - DNA, 23 bp, Homo sapiens
aaagtcttctcccaactcagcct

SEQ ID NO: 1322807 - DNA, 21 bp, Homo sapiens
aaagtcttgtgactagtgctg

SEQ ID NO: 1322808 - DNA, 14 bp, Homo sapiens
aaataaacgtgcgc

SEQ ID NO: 1322809 - DNA, 17 bp, Homo sapiens
aaatatcattcagcaac

SEQ ID NO: 1322810 - DNA, 13 bp, Homo sapiens
aaatattaaaaga

SEQ ID NO: 1322811 - DNA, 13 bp, Homo sapiens
aaatattttctgt

SEQ ID NO: 1322812 - DNA, 17 bp, Homo sapiens
aaatattttctgtgtgt

SEQ ID NO: 1322813 - DNA, 19 bp, Homo sapiens
aaatctttcaagttgcatt

SEQ ID NO: 1322814 - DNA, 11 bp, Homo sapiens
aaatgctgtgg

SEQ ID NO: 1322815 - DNA, 14 bp, Homo sapiens
aaattactgtgtta

SEQ ID NO: 1322816 - DNA, 15 bp, Homo sapiens
aaattatcaagctaa

SEQ ID NO: 1322817 - DNA, 14 bp, Homo sapiens
aaattccctaaagc

SEQ ID NO: 1322818 - DNA, 15 bp, Homo sapiens
aacaagaaagtttcc

SEQ ID NO: 1322819 - DNA, 17 bp, Homo sapiens
aacaagaaatctttctg

SEQ ID NO: 1322820 - DNA, 22 bp, Homo sapiens
aacacaattttattttttttct

SEQ ID NO: 1322821 - DNA, 13 bp, Homo sapiens
aacactagcattt

SEQ ID NO: 1322822 - DNA, 14 bp, Homo sapiens
aacatcagcttgac

SEQ ID NO: 1322823 - DNA, 17 bp, Homo sapiens
aacatgctgtgtaagct

SEQ ID NO: 1322824 - DNA, 22 bp, Homo sapiens
aaccaacaccatcacagcttgt

SEQ ID NO: 1322825 - DNA, 18 bp, Homo sapiens
aacctgtgatttctgtgc

SEQ ID NO: 1322826 - DNA, 22 bp, Homo sapiens
aacctgtgatttctgtgccatt

SEQ ID NO: 1322827 - DNA, 13 bp, Homo sapiens
aacgattcacagc

SEQ ID NO: 1322828 - DNA, 15 bp, Homo sapiens
aacgattcacagcct

SEQ ID NO: 1322829 - DNA, 23 bp, Homo sapiens
aacgtcccctcaagccccttctc

SEQ ID NO: 1322830 - DNA, 19 bp, Homo sapiens
aactaataaaatattttct

SEQ ID NO: 1322831 - DNA, 16 bp, Homo sapiens
aactcagcctgttcct

SEQ ID NO: 1322832 - DNA, 17 bp, Homo sapiens
aactccagcgtcctcag

SEQ ID NO: 1322833 - DNA, 17 bp, Homo sapiens
aactgagaagccaagcc

SEQ ID NO: 1322834 - DNA, 15 bp, Homo sapiens
aactgcaactccagc

SEQ ID NO: 1322835 - DNA, 16 bp, Homo sapiens
aactgcaactccagcg

SEQ ID NO: 1322836 - DNA, 24 bp, Homo sapiens
aactgcagctgggaagaggagcct

SEQ ID NO: 1322837 - DNA, 16 bp, Homo sapiens
aactgccattggctat

SEQ ID NO: 1322838 - DNA, 13 bp, Homo sapiens
aacttaacatgct

SEQ ID NO: 1322839 - DNA, 15 bp, Homo sapiens
aacttagtttgtgaa

SEQ ID NO: 1322840 - DNA, 16 bp, Homo sapiens
aacttagtttgtgaat

SEQ ID NO: 1322841 - DNA, 16 bp, Homo sapiens
aacttcatctggaagt

SEQ ID NO: 1322842 - DNA, 13 bp, Homo sapiens
aacttccctcccc

SEQ ID NO: 1322843 - DNA, 16 bp, Homo sapiens
aacttgtagccagaat

SEQ ID NO: 1322844 - DNA, 13 bp, Homo sapiens
aacttgtgcctcc

SEQ ID NO: 1322845 - DNA, 22 bp, Homo sapiens
aagaaaatagagatgagctttc

SEQ ID NO: 1322846 - DNA, 20 bp, Homo sapiens
aagaaacttgatattgaggt

SEQ ID NO: 1322847 - DNA, 16 bp, Homo sapiens
aagaaatctttctgga

SEQ ID NO: 1322848 - DNA, 22 bp, Homo sapiens
aagaatagggcccatgggaggg

SEQ ID NO: 1322849 - DNA, 16 bp, Homo sapiens
aagaatggtctcagtg

SEQ ID NO: 1322850 - DNA, 13 bp, Homo sapiens
aagacactgtgca

SEQ ID NO: 1322851 - DNA, 19 bp, Homo sapiens
aagacactgtgcaggccca

SEQ ID NO: 1322852 - DNA, 20 bp, Homo sapiens
aagacactgtgcaggcccag

SEQ ID NO: 1322853 - DNA, 22 bp, Homo sapiens
aagacactgtgcaggcccaggc

SEQ ID NO: 1322854 - DNA, 20 bp, Homo sapiens
aagagtcctccttcccagct

SEQ ID NO: 1322855 - DNA, 17 bp, Homo sapiens
aagattcttggtatttg

SEQ ID NO: 1322856 - DNA, 17 bp, Homo sapiens
aagcatggtcccttgtc

SEQ ID NO: 1322857 - DNA, 15 bp, Homo sapiens
aagccaagcctggag

SEQ ID NO: 1322858 - DNA, 14 bp, Homo sapiens
aagccacaggcctg

SEQ ID NO: 1322859 - DNA, 15 bp, Homo sapiens
aagccacaggcctgg

SEQ ID NO: 1322860 - DNA, 15 bp, Homo sapiens
aagccaggaacaggg

SEQ ID NO: 1322861 - DNA, 20 bp, Homo sapiens
aagcccaagctaagctgcag

SEQ ID NO: 1322862 - DNA, 22 bp, Homo sapiens
aagcccaagctaagctgcaggc

SEQ ID NO: 1322863 - DNA, 14 bp, Homo sapiens
aagccttcttgctg

SEQ ID NO: 1322864 - DNA, 22 bp, Homo sapiens
aagccttcttgctgcccacaac

SEQ ID NO: 1322865 - DNA, 23 bp, Homo sapiens
aagctccagctgaatagagggag

SEQ ID NO: 1322866 - DNA, 21 bp, Homo sapiens
aagctgcaggcacacacgcct

SEQ ID NO: 1322867 - DNA, 16 bp, Homo sapiens
aagcttattaatgcta

SEQ ID NO: 1322868 - DNA, 17 bp, Homo sapiens
aagcttattaatgctaa

SEQ ID NO: 1322869 - DNA, 18 bp, Homo sapiens
aagcttattaatgctaag

SEQ ID NO: 1322870 - DNA, 14 bp, Homo sapiens
aaggaaatgtcatg

SEQ ID NO: 1322871 - DNA, 12 bp, Homo sapiens
aaggagaataag

SEQ ID NO: 1322872 - DNA, 15 bp, Homo sapiens
aaggcagaaggccag

SEQ ID NO: 1322873 - DNA, 23 bp, Homo sapiens
aaggcatcactttcctggatcca

SEQ ID NO: 1322874 - DNA, 13 bp, Homo sapiens
aaggcccagacct

SEQ ID NO: 1322875 - DNA, 18 bp, Homo sapiens
aaggcccagacctggcct

SEQ ID NO: 1322876 - DNA, 20 bp, Homo sapiens
aaggcccagacctggcctct

SEQ ID NO: 1322877 - DNA, 22 bp, Homo sapiens
aaggctcttggtatctttctgt

SEQ ID NO: 1322878 - DNA, 20 bp, Homo sapiens
aagtataaatttgtgtaata

SEQ ID NO: 1322879 - DNA, 21 bp, Homo sapiens
aagtataaatttgtgtaatat

SEQ ID NO: 1322880 - DNA, 16 bp, Homo sapiens
aagtccttaagcagag

SEQ ID NO: 1322881 - DNA, 16 bp, Homo sapiens
aagtctcagcctgggc

SEQ ID NO: 1322882 - DNA, 21 bp, Homo sapiens
aagtcttctcccaactcagcc

SEQ ID NO: 1322883 - DNA, 14 bp, Homo sapiens
aagtcttgtgacta

SEQ ID NO: 1322884 - DNA, 20 bp, Homo sapiens
aagtcttgtgactagtgctg

SEQ ID NO: 1322885 - DNA, 23 bp, Homo sapiens
aagtcttgtgactagtgctgaag

SEQ ID NO: 1322886 - DNA, 17 bp, Homo sapiens
aagttgatttcttcttc

SEQ ID NO: 1322887 - DNA, 17 bp, Homo sapiens
aagtttccccaccagtg

SEQ ID NO: 1322888 - DNA, 18 bp, Homo sapiens
aataaaactgatgtgaaa

SEQ ID NO: 1322889 - DNA, 12 bp, Homo sapiens
aataaaatatca

SEQ ID NO: 1322890 - DNA, 16 bp, Homo sapiens
aataaaatatcattca

SEQ ID NO: 1322891 - DNA, 18 bp, Homo sapiens
aataaaatatcattcagc

SEQ ID NO: 1322892 - DNA, 19 bp, Homo sapiens
aataaaatatcattcagca

SEQ ID NO: 1322893 - DNA, 20 bp, Homo sapiens
aataaaatatcattcagcaa

SEQ ID NO: 1322894 - DNA, 21 bp, Homo sapiens
aataaaatatcattcagcaac

SEQ ID NO: 1322895 - DNA, 12 bp, Homo sapiens
aataaaatattt

SEQ ID NO: 1322896 - DNA, 16 bp, Homo sapiens
aataaaatattttctg

SEQ ID NO: 1322897 - DNA, 17 bp, Homo sapiens
aataaaatattttctgt

SEQ ID NO: 1322898 - DNA, 22 bp, Homo sapiens
aataaaatattttctgtgtgtt

SEQ ID NO: 1322899 - DNA, 17 bp, Homo sapiens
aataaacttgtgcctcc

SEQ ID NO: 1322900 - DNA, 17 bp, Homo sapiens
aatacaattcattgtga

SEQ ID NO: 1322901 - DNA, 15 bp, Homo sapiens
aatagagatgagctt

SEQ ID NO: 1322902 - DNA, 19 bp, Homo sapiens
aatagagggagtagaaagc

SEQ ID NO: 1322903 - DNA, 18 bp, Homo sapiens
aatagcatgttgtagata

SEQ ID NO: 1322904 - DNA, 15 bp, Homo sapiens
aatatcattcagcaa

SEQ ID NO: 1322905 - DNA, 16 bp, Homo sapiens
aatatcattcagcaac

SEQ ID NO: 1322906 - DNA, 18 bp, Homo sapiens
aatatggaactgtaataa

SEQ ID NO: 1322907 - DNA, 12 bp, Homo sapiens
aatattaaaaga

SEQ ID NO: 1322908 - DNA, 19 bp, Homo sapiens
aatattactttaacatgcc

SEQ ID NO: 1322909 - DNA, 12 bp, Homo sapiens
aatcagctgctt

SEQ ID NO: 1322910 - DNA, 16 bp, Homo sapiens
aatcagctgctttgtt

SEQ ID NO: 1322911 - DNA, 17 bp, Homo sapiens
aatcagctgctttgtta

SEQ ID NO: 1322912 - DNA, 18 bp, Homo sapiens
aatcagctgctttgttac

SEQ ID NO: 1322913 - DNA, 23 bp, Homo sapiens
aatgaaagtcttgtgactagtgc

SEQ ID NO: 1322914 - DNA, 21 bp, Homo sapiens
aatgagatctcattaaaaggt

SEQ ID NO: 1322915 - DNA, 20 bp, Homo sapiens
aatgcctctccttaaatgct

SEQ ID NO: 1322916 - DNA, 17 bp, Homo sapiens
aatgctaagggcaggcc

SEQ ID NO: 1322917 - DNA, 18 bp, Homo sapiens
aatgctgtggttcactgc

SEQ ID NO: 1322918 - DNA, 22 bp, Homo sapiens
aatggaaaacttagtttgtgaa

SEQ ID NO: 1322919 - DNA, 16 bp, Homo sapiens
aatggcctctctccac

SEQ ID NO: 1322920 - DNA, 18 bp, Homo sapiens
aatggcctctctccacta

SEQ ID NO: 1322921 - DNA, 14 bp, Homo sapiens
aatggcctgagaca

SEQ ID NO: 1322922 - DNA, 20 bp, Homo sapiens
aatgggagcacatagccctg

SEQ ID NO: 1322923 - DNA, 19 bp, Homo sapiens
aatgtgatataaacagctt

SEQ ID NO: 1322924 - DNA, 15 bp, Homo sapiens
aatgttaagaataac

SEQ ID NO: 1322925 - DNA, 19 bp, Homo sapiens
aattaggtttctttgaaga

SEQ ID NO: 1322926 - DNA, 18 bp, Homo sapiens
aattataggagacttgta

SEQ ID NO: 1322927 - DNA, 13 bp, Homo sapiens
aattcaccaattt

SEQ ID NO: 1322928 - DNA, 15 bp, Homo sapiens
aattctatcctgtga

SEQ ID NO: 1322929 - DNA, 20 bp, Homo sapiens
aattctgttctgatattaat

SEQ ID NO: 1322930 - DNA, 21 bp, Homo sapiens
aattgcattttttaaaacaag

SEQ ID NO: 1322931 - DNA, 15 bp, Homo sapiens
aattgcctgccatgg

SEQ ID NO: 1322932 - DNA, 11 bp, Homo sapiens
aattgtaaaag

SEQ ID NO: 1322933 - DNA, 22 bp, Homo sapiens
aatttatcagattgcttttgtg

SEQ ID NO: 1322934 - DNA, 13 bp, Homo sapiens
aatttgctgctga

SEQ ID NO: 1322935 - DNA, 9 bp, Homo sapiens
aatttggaa

SEQ ID NO: 1322936 - DNA, 17 bp, Homo sapiens
aatttggaaactaataa

SEQ ID NO: 1322937 - DNA, 16 bp, Homo sapiens
aattttagtcttgctg

SEQ ID NO: 1322938 - DNA, 22 bp, Homo sapiens
acaacagagactgaaatgtgtt

SEQ ID NO: 1322939 - DNA, 19 bp, Homo sapiens
acaacccaatctggctggt

SEQ ID NO: 1322940 - DNA, 19 bp, Homo sapiens
acaacgtcccctcaagccc

SEQ ID NO: 1322941 - DNA, 19 bp, Homo sapiens
acaatcagctgctttgtta

SEQ ID NO: 1322942 - DNA, 11 bp, Homo sapiens
acacccagcct

SEQ ID NO: 1322943 - DNA, 14 bp, Homo sapiens
acacccagcctgtc

SEQ ID NO: 1322944 - DNA, 15 bp, Homo sapiens
acacccagcctgtcc

SEQ ID NO: 1322945 - DNA, 13 bp, Homo sapiens
acactggatgttt

SEQ ID NO: 1322946 - DNA, 15 bp, Homo sapiens
acactggatgtttct

SEQ ID NO: 1322947 - DNA, 15 bp, Homo sapiens
acactttcctcttct

SEQ ID NO: 1322948 - DNA, 18 bp, Homo sapiens
acactttcctcttctatg

SEQ ID NO: 1322949 - DNA, 20 bp, Homo sapiens
acagaagtccttaagcagag

SEQ ID NO: 1322950 - DNA, 16 bp, Homo sapiens
acagaattcactgtct

SEQ ID NO: 1322951 - DNA, 15 bp, Homo sapiens
acagagcgagacttt

SEQ ID NO: 1322952 - DNA, 20 bp, Homo sapiens
acagcacacggtgagggtgc

SEQ ID NO: 1322953 - DNA, 15 bp, Homo sapiens
acagctgttgactct

SEQ ID NO: 1322954 - DNA, 13 bp, Homo sapiens
acagcttctgaga

SEQ ID NO: 1322955 - DNA, 17 bp, Homo sapiens
acagcttctgagaattg

SEQ ID NO: 1322956 - DNA, 16 bp, Homo sapiens
acagcttgttttggac

SEQ ID NO: 1322957 - DNA, 22 bp, Homo sapiens
acagcttgttttggactttgtt

SEQ ID NO: 1322958 - DNA, 23 bp, Homo sapiens
acagcttgttttggactttgtta

SEQ ID NO: 1322959 - DNA, 19 bp, Homo sapiens
acaggacatgtactgagac

SEQ ID NO: 1322960 - DNA, 16 bp, Homo sapiens
acagggaccagctccc

SEQ ID NO: 1322961 - DNA, 14 bp, Homo sapiens
acaggtcctccatc

SEQ ID NO: 1322962 - DNA, 14 bp, Homo sapiens
acagtactttgaat

SEQ ID NO: 1322963 - DNA, 15 bp, Homo sapiens
acagtggattgctca

SEQ ID NO: 1322964 - DNA, 19 bp, Homo sapiens
acagttgggaagtctcagc

SEQ ID NO: 1322965 - DNA, 21 bp, Homo sapiens
acagttgggaagtctcagcct

SEQ ID NO: 1322966 - DNA, 22 bp, Homo sapiens
acagttgggaagtctcagcctg

SEQ ID NO: 1322967 - DNA, 23 bp, Homo sapiens
acagttgggaagtctcagcctgg

SEQ ID NO: 1322968 - DNA, 12 bp, Homo sapiens
acataagagctt

SEQ ID NO: 1322969 - DNA, 17 bp, Homo sapiens
acatagatctagtctga

SEQ ID NO: 1322970 - DNA, 12 bp, Homo sapiens
acatcagcttga

SEQ ID NO: 1322971 - DNA, 20 bp, Homo sapiens
acatccttcttggcttcctg

SEQ ID NO: 1322972 - DNA, 21 bp, Homo sapiens
acatccttcttggcttcctgg

SEQ ID NO: 1322973 - DNA, 23 bp, Homo sapiens
acatccttcttggcttcctggcg

SEQ ID NO: 1322974 - DNA, 14 bp, Homo sapiens
acatctcttgagtg

SEQ ID NO: 1322975 - DNA, 16 bp, Homo sapiens
acatctcttgagtgtc

SEQ ID NO: 1322976 - DNA, 14 bp, Homo sapiens
acatcttgtttctg

SEQ ID NO: 1322977 - DNA, 19 bp, Homo sapiens
acatgctgtgtaagctgtg

SEQ ID NO: 1322978 - DNA, 14 bp, Homo sapiens
acatgtgccctgcc

SEQ ID NO: 1322979 - DNA, 23 bp, Homo sapiens
acattaaaaaaaatcatcattat

SEQ ID NO: 1322980 - DNA, 15 bp, Homo sapiens
acattctgctctgcc

SEQ ID NO: 1322981 - DNA, 22 bp, Homo sapiens
acattctgctctgcccatgcct

SEQ ID NO: 1322982 - DNA, 19 bp, Homo sapiens
accaaattctatcctgtga

SEQ ID NO: 1322983 - DNA, 16 bp, Homo sapiens
accaatttcctttaaa

SEQ ID NO: 1322984 - DNA, 22 bp, Homo sapiens
accactgtgctcaaccagacag

SEQ ID NO: 1322985 - DNA, 23 bp, Homo sapiens
accagaaagcctcctctggagaa

SEQ ID NO: 1322986 - DNA, 14 bp, Homo sapiens
accatgctgagaca

SEQ ID NO: 1322987 - DNA, 11 bp, Homo sapiens
acccagcctgt

SEQ ID NO: 1322988 - DNA, 19 bp, Homo sapiens
acccagcctgtcccactgg

SEQ ID NO: 1322989 - DNA, 20 bp, Homo sapiens
acccagcctgtcccactggc

SEQ ID NO: 1322990 - DNA, 21 bp, Homo sapiens
acccagcctgtcccactggct

SEQ ID NO: 1322991 - DNA, 22 bp, Homo sapiens
acccagcctgtcccactggctc

SEQ ID NO: 1322992 - DNA, 14 bp, Homo sapiens
accccatccaccta

SEQ ID NO: 1322993 - DNA, 18 bp, Homo sapiens
accccgactatccctgca

SEQ ID NO: 1322994 - DNA, 20 bp, Homo sapiens
accccgactatccctgcaca

SEQ ID NO: 1322995 - DNA, 16 bp, Homo sapiens
acccctggtggctgca

SEQ ID NO: 1322996 - DNA, 17 bp, Homo sapiens
acccctggtggctgcag

SEQ ID NO: 1322997 - DNA, 15 bp, Homo sapiens
accccttgctctctg

SEQ ID NO: 1322998 - DNA, 16 bp, Homo sapiens
accccttgctctctgt

SEQ ID NO: 1322999 - DNA, 16 bp, Homo sapiens
accctctccacaccca

SEQ ID NO: 1323000 - DNA, 18 bp, Homo sapiens
accctctccacacccagc

SEQ ID NO: 1323001 - DNA, 19 bp, Homo sapiens
accctctccacacccagcc

SEQ ID NO: 1323002 - DNA, 19 bp, Homo sapiens
accctgggtcctcgggccc

SEQ ID NO: 1323003 - DNA, 22 bp, Homo sapiens
acccttcttcatgttcaattat

SEQ ID NO: 1323004 - DNA, 16 bp, Homo sapiens
accgcgcccctgggac

SEQ ID NO: 1323005 - DNA, 17 bp, Homo sapiens
accgcgcccctgggact

SEQ ID NO: 1323006 - DNA, 20 bp, Homo sapiens
accgctgggttctgactctg

SEQ ID NO: 1323007 - DNA, 20 bp, Homo sapiens
accggctcaggagagggcct

SEQ ID NO: 1323008 - DNA, 15 bp, Homo sapiens
accgtttcaggacca

SEQ ID NO: 1323009 - DNA, 20 bp, Homo sapiens
acctacccctgacttctgtt

SEQ ID NO: 1323010 - DNA, 15 bp, Homo sapiens
acctcactctgctac

SEQ ID NO: 1323011 - DNA, 16 bp, Homo sapiens
acctcactctgctacc

SEQ ID NO: 1323012 - DNA, 22 bp, Homo sapiens
acctccggccaggtgcctcctg

SEQ ID NO: 1323013 - DNA, 12 bp, Homo sapiens
acctcctggggc

SEQ ID NO: 1323014 - DNA, 18 bp, Homo sapiens
acctctcagagcaagcct

SEQ ID NO: 1323015 - DNA, 13 bp, Homo sapiens
acctctccggcct

SEQ ID NO: 1323016 - DNA, 17 bp, Homo sapiens
acctctccggcctggcc

SEQ ID NO: 1323017 - DNA, 18 bp, Homo sapiens
acctctccggcctggcct

SEQ ID NO: 1323018 - DNA, 20 bp, Homo sapiens
acctgaatggagaatacatc

SEQ ID NO: 1323019 - DNA, 15 bp, Homo sapiens
acctgcccccacagc

SEQ ID NO: 1323020 - DNA, 19 bp, Homo sapiens
acctgcccccacagctcct

SEQ ID NO: 1323021 - DNA, 22 bp, Homo sapiens
acctgcccccacagctccttgc

SEQ ID NO: 1323022 - DNA, 19 bp, Homo sapiens
acctggctgggcctgggct

SEQ ID NO: 1323023 - DNA, 13 bp, Homo sapiens
acctgtgatttct

SEQ ID NO: 1323024 - DNA, 12 bp, Homo sapiens
accttaaaacta

SEQ ID NO: 1323025 - DNA, 14 bp, Homo sapiens
accttcactccaga

SEQ ID NO: 1323026 - DNA, 16 bp, Homo sapiens
accttcactccagaca

SEQ ID NO: 1323027 - DNA, 15 bp, Homo sapiens
accttctaccctggg

SEQ ID NO: 1323028 - DNA, 18 bp, Homo sapiens
accttgccccaacccttc

SEQ ID NO: 1323029 - DNA, 21 bp, Homo sapiens
accttgccccaacccttcttc

SEQ ID NO: 1323030 - DNA, 16 bp, Homo sapiens
accttttttcttgcta

SEQ ID NO: 1323031 - DNA, 16 bp, Homo sapiens
acgattcacagcctcc

SEQ ID NO: 1323032 - DNA, 19 bp, Homo sapiens
acgcattaagggcctgctg

SEQ ID NO: 1323033 - DNA, 15 bp, Homo sapiens
acgccttcatgccag

SEQ ID NO: 1323034 - DNA, 16 bp, Homo sapiens
acgctgcgtgccatga

SEQ ID NO: 1323035 - DNA, 14 bp, Homo sapiens
acggctctgtgccc

SEQ ID NO: 1323036 - DNA, 20 bp, Homo sapiens
acggctctgtgcccggtgcc

SEQ ID NO: 1323037 - DNA, 24 bp, Homo sapiens
acggctctgtgcccggtgccatct

SEQ ID NO: 1323038 - DNA, 19 bp, Homo sapiens
acggttcaaacctgtgaag

SEQ ID NO: 1323039 - DNA, 15 bp, Homo sapiens
acgtcccctcaagcc

SEQ ID NO: 1323040 - DNA, 19 bp, Homo sapiens
acgttcctctccacctgca

SEQ ID NO: 1323041 - DNA, 20 bp, Homo sapiens
actaaaaaatataaaaatta

SEQ ID NO: 1323042 - DNA, 23 bp, Homo sapiens
actaaagccaggaacagggacca

SEQ ID NO: 1323043 - DNA, 16 bp, Homo sapiens
actaaatggcctctct

SEQ ID NO: 1323044 - DNA, 17 bp, Homo sapiens
actaataaaatattttc

SEQ ID NO: 1323045 - DNA, 22 bp, Homo sapiens
actaataaaatattttctgtgt

SEQ ID NO: 1323046 - DNA, 23 bp, Homo sapiens
actaataaaatattttctgtgtg

SEQ ID NO: 1323047 - DNA, 14 bp, Homo sapiens
actagcatttttgg

SEQ ID NO: 1323048 - DNA, 23 bp, Homo sapiens
actaggcatttgtaaatattaaa

SEQ ID NO: 1323049 - DNA, 15 bp, Homo sapiens
actaggctcatactc

SEQ ID NO: 1323050 - DNA, 15 bp, Homo sapiens
actagtgctgaagct

SEQ ID NO: 1323051 - DNA, 19 bp, Homo sapiens
actagtgctgaagcttatt

SEQ ID NO: 1323052 - DNA, 16 bp, Homo sapiens
actatagcccctggtg

SEQ ID NO: 1323053 - DNA, 22 bp, Homo sapiens
actatagcccctggtgtgtaaa

SEQ ID NO: 1323054 - DNA, 16 bp, Homo sapiens
actatgagttcacatg

SEQ ID NO: 1323055 - DNA, 11 bp, Homo sapiens
actcagcctgt

SEQ ID NO: 1323056 - DNA, 23 bp, Homo sapiens
actcagcctgttccttcctgcag

SEQ ID NO: 1323057 - DNA, 23 bp, Homo sapiens
actcctggtcctaggctggaagg

SEQ ID NO: 1323058 - DNA, 17 bp, Homo sapiens
actctagtactgtgaat

SEQ ID NO: 1323059 - DNA, 20 bp, Homo sapiens
actctcgtgatatgctgctt

SEQ ID NO: 1323060 - DNA, 13 bp, Homo sapiens
actctgcagactg

SEQ ID NO: 1323061 - DNA, 16 bp, Homo sapiens
actctgctaccttgcc

SEQ ID NO: 1323062 - DNA, 16 bp, Homo sapiens
actctgctctcctcgg

SEQ ID NO: 1323063 - DNA, 22 bp, Homo sapiens
actctgctctcctcgggccctg

SEQ ID NO: 1323064 - DNA, 13 bp, Homo sapiens
actctgctgaggg

SEQ ID NO: 1323065 - DNA, 20 bp, Homo sapiens
actctggaccatgctgagac

SEQ ID NO: 1323066 - DNA, 23 bp, Homo sapiens
actcttgaaggccacatgtgaaa

SEQ ID NO: 1323067 - DNA, 15 bp, Homo sapiens
actgaaaaaaatgga

SEQ ID NO: 1323068 - DNA, 16 bp, Homo sapiens
actgaaaaaaatggag

SEQ ID NO: 1323069 - DNA, 23 bp, Homo sapiens
actgaagaggaggaggagggtct

SEQ ID NO: 1323070 - DNA, 13 bp, Homo sapiens
actgacccagagg

SEQ ID NO: 1323071 - DNA, 20 bp, Homo sapiens
actgagaagccaagcctgga

SEQ ID NO: 1323072 - DNA, 13 bp, Homo sapiens
actgagagaaggt

SEQ ID NO: 1323073 - DNA, 14 bp, Homo sapiens
actgagagaaggtg

SEQ ID NO: 1323074 - DNA, 13 bp, Homo sapiens
actgatgtgaaac

SEQ ID NO: 1323075 - DNA, 18 bp, Homo sapiens
actgctactgacccagag

SEQ ID NO: 1323076 - DNA, 20 bp, Homo sapiens
actgctacttgtggacctca

SEQ ID NO: 1323077 - DNA, 20 bp, Homo sapiens
actggaactgcaactccagc

SEQ ID NO: 1323078 - DNA, 18 bp, Homo sapiens
actggatgtttctcatgt

SEQ ID NO: 1323079 - DNA, 16 bp, Homo sapiens
actggctcctcccagc

SEQ ID NO: 1323080 - DNA, 23 bp, Homo sapiens
actggctcctcccagcacaggca

SEQ ID NO: 1323081 - DNA, 23 bp, Homo sapiens
actgtatctgatgtttgttttcg

SEQ ID NO: 1323082 - DNA, 17 bp, Homo sapiens
actgtctaggaaaataa

SEQ ID NO: 1323083 - DNA, 16 bp, Homo sapiens
actgtgaaatacacta

SEQ ID NO: 1323084 - DNA, 17 bp, Homo sapiens
actgttattttcagcat

SEQ ID NO: 1323085 - DNA, 14 bp, Homo sapiens
acttaattctgttc

SEQ ID NO: 1323086 - DNA, 22 bp, Homo sapiens
acttcccccaccccagaagatt

SEQ ID NO: 1323087 - DNA, 15 bp, Homo sapiens
acttgcaaaatggag

SEQ ID NO: 1323088 - DNA, 20 bp, Homo sapiens
acttgccatgaaggcacctg

SEQ ID NO: 1323089 - DNA, 19 bp, Homo sapiens
acttggaaatattaaaaga

SEQ ID NO: 1323090 - DNA, 12 bp, Homo sapiens
acttgtgcctcc

SEQ ID NO: 1323091 - DNA, 23 bp, Homo sapiens
actttctggggcctaataaaact

SEQ ID NO: 1323092 - DNA, 19 bp, Homo sapiens
actttgaagtaaaaccttt

SEQ ID NO: 1323093 - DNA, 19 bp, Homo sapiens
actttgacagcgcacagct

SEQ ID NO: 1323094 - DNA, 15 bp, Homo sapiens
agaaaccttcactcc

SEQ ID NO: 1323095 - DNA, 24 bp, Homo sapiens
agaaagagactgtggggagggtca

SEQ ID NO: 1323096 - DNA, 19 bp, Homo sapiens
agaaagcctcctctggaga

SEQ ID NO: 1323097 - DNA, 20 bp, Homo sapiens
agaaagtttccccaccagtg

SEQ ID NO: 1323098 - DNA, 18 bp, Homo sapiens
agaacaagaaatctttct

SEQ ID NO: 1323099 - DNA, 12 bp, Homo sapiens
agaagccttctt

SEQ ID NO: 1323100 - DNA, 16 bp, Homo sapiens
agaagccttcttgctg

SEQ ID NO: 1323101 - DNA, 12 bp, Homo sapiens
agaaggtgaaat

SEQ ID NO: 1323102 - DNA, 22 bp, Homo sapiens
agaatacatcttgtttctgagt

SEQ ID NO: 1323103 - DNA, 21 bp, Homo sapiens
agaatcgcttgaacccaggag

SEQ ID NO: 1323104 - DNA, 15 bp, Homo sapiens
agaatggcctgagac

SEQ ID NO: 1323105 - DNA, 14 bp, Homo sapiens
agaatggtctcagt

SEQ ID NO: 1323106 - DNA, 16 bp, Homo sapiens
agaatggtctcagtgt

SEQ ID NO: 1323107 - DNA, 14 bp, Homo sapiens
agaattcactgtct

SEQ ID NO: 1323108 - DNA, 16 bp, Homo sapiens
agacaaaaaggaaaca

SEQ ID NO: 1323109 - DNA, 17 bp, Homo sapiens
agacactgtgcaggccc

SEQ ID NO: 1323110 - DNA, 19 bp, Homo sapiens
agacactgtgcaggcccag

SEQ ID NO: 1323111 - DNA, 15 bp, Homo sapiens
agaccgtcttcctcc

SEQ ID NO: 1323112 - DNA, 18 bp, Homo sapiens
agaccgtcttcctccaac

SEQ ID NO: 1323113 - DNA, 12 bp, Homo sapiens
agacctggcctc

SEQ ID NO: 1323114 - DNA, 22 bp, Homo sapiens
agacctggcctctgccatcctc

SEQ ID NO: 1323115 - DNA, 23 bp, Homo sapiens
agacctggcctctgccatcctcc

SEQ ID NO: 1323116 - DNA, 19 bp, Homo sapiens
agactattcatcaagaatg

SEQ ID NO: 1323117 - DNA, 20 bp, Homo sapiens
agacttaactggcccagaag

SEQ ID NO: 1323118 - DNA, 12 bp, Homo sapiens
agagcaagcctt

SEQ ID NO: 1323119 - DNA, 13 bp, Homo sapiens
agagcaagccttt

SEQ ID NO: 1323120 - DNA, 18 bp, Homo sapiens
agagcaagcctttgacct

SEQ ID NO: 1323121 - DNA, 13 bp, Homo sapiens
agagcagccagga

SEQ ID NO: 1323122 - DNA, 14 bp, Homo sapiens
agagcttagggtct

SEQ ID NO: 1323123 - DNA, 18 bp, Homo sapiens
agagcttagggtctcagg

SEQ ID NO: 1323124 - DNA, 19 bp, Homo sapiens
agaggactactcagcactg

SEQ ID NO: 1323125 - DNA, 22 bp, Homo sapiens
agaggagcctgtttttgtgaga

SEQ ID NO: 1323126 - DNA, 13 bp, Homo sapiens
agataaatgaaat

SEQ ID NO: 1323127 - DNA, 16 bp, Homo sapiens
agatacaatcagctgc

SEQ ID NO: 1323128 - DNA, 22 bp, Homo sapiens
agatactcatcatatacaaatg

SEQ ID NO: 1323129 - DNA, 19 bp, Homo sapiens
agatatgcattcaagagag

SEQ ID NO: 1323130 - DNA, 20 bp, Homo sapiens
agatctttgcaccagatact

SEQ ID NO: 1323131 - DNA, 12 bp, Homo sapiens
agatgaagaaag

SEQ ID NO: 1323132 - DNA, 16 bp, Homo sapiens
agatgagctttctttt

SEQ ID NO: 1323133 - DNA, 17 bp, Homo sapiens
agatgccggagccccaa

SEQ ID NO: 1323134 - DNA, 16 bp, Homo sapiens
agatgctactaagaaa

SEQ ID NO: 1323135 - DNA, 14 bp, Homo sapiens
agatgctctctgag

SEQ ID NO: 1323136 - DNA, 20 bp, Homo sapiens
agatgctctctgaggcaagg

SEQ ID NO: 1323137 - DNA, 21 bp, Homo sapiens
agatgctctctgaggcaaggc

SEQ ID NO: 1323138 - DNA, 22 bp, Homo sapiens
agatgctctctgaggcaaggcc

SEQ ID NO: 1323139 - DNA, 21 bp, Homo sapiens
agattagcatcccatactaga

SEQ ID NO: 1323140 - DNA, 14 bp, Homo sapiens
agattattcaacag

SEQ ID NO: 1323141 - DNA, 17 bp, Homo sapiens
agattcccaggccaggc

SEQ ID NO: 1323142 - DNA, 19 bp, Homo sapiens
agattcccaggccaggctc

SEQ ID NO: 1323143 - DNA, 20 bp, Homo sapiens
agcaaacctaattgcacaac

SEQ ID NO: 1323144 - DNA, 15 bp, Homo sapiens
agcaacatcagcttg

SEQ ID NO: 1323145 - DNA, 17 bp, Homo sapiens
agcaattactacaaatg

SEQ ID NO: 1323146 - DNA, 14 bp, Homo sapiens
agcacacggtgagg

SEQ ID NO: 1323147 - DNA, 14 bp, Homo sapiens
agcacatagccctg

SEQ ID NO: 1323148 - DNA, 12 bp, Homo sapiens
agcaccccactc

SEQ ID NO: 1323149 - DNA, 14 bp, Homo sapiens
agcaccccactcct

SEQ ID NO: 1323150 - DNA, 18 bp, Homo sapiens
agcaccccactcctcagt

SEQ ID NO: 1323151 - DNA, 23 bp, Homo sapiens
agcaccggggaacaatttctctg

SEQ ID NO: 1323152 - DNA, 13 bp, Homo sapiens
agcacctctcaga

SEQ ID NO: 1323153 - DNA, 15 bp, Homo sapiens
agcacctctcagagc

SEQ ID NO: 1323154 - DNA, 21 bp, Homo sapiens
agcacctctcagagcaagcct

SEQ ID NO: 1323155 - DNA, 22 bp, Homo sapiens
agcacctctcagagcaagcctt

SEQ ID NO: 1323156 - DNA, 14 bp, Homo sapiens
agcagcctggctcc

SEQ ID NO: 1323157 - DNA, 21 bp, Homo sapiens
agcagcctggctcccctgggg

SEQ ID NO: 1323158 - DNA, 17 bp, Homo sapiens
agcatgaaaatgtgtgt

SEQ ID NO: 1323159 - DNA, 23 bp, Homo sapiens
agcatgttgtagatacaatcagc

SEQ ID NO: 1323160 - DNA, 23 bp, Homo sapiens
agccaagcctggagtaggcctgg

SEQ ID NO: 1323161 - DNA, 13 bp, Homo sapiens
agccacaggcctg

SEQ ID NO: 1323162 - DNA, 15 bp, Homo sapiens
agccacccttggtct

SEQ ID NO: 1323163 - DNA, 19 bp, Homo sapiens
agccacccttggtctcatg

SEQ ID NO: 1323164 - DNA, 22 bp, Homo sapiens
agccacccttggtctcatgccc

SEQ ID NO: 1323165 - DNA, 16 bp, Homo sapiens
agccagaatgccctgt

SEQ ID NO: 1323166 - DNA, 17 bp, Homo sapiens
agccaggaacagggacc

SEQ ID NO: 1323167 - DNA, 22 bp, Homo sapiens
agccaggaacagggaccagctc

SEQ ID NO: 1323168 - DNA, 23 bp, Homo sapiens
agccaggagagcttagggtctca

SEQ ID NO: 1323169 - DNA, 22 bp, Homo sapiens
agcccaagctaagctgcaggca

SEQ ID NO: 1323170 - DNA, 17 bp, Homo sapiens
agccccaagactctgct

SEQ ID NO: 1323171 - DNA, 13 bp, Homo sapiens
agcccctggtgtg

SEQ ID NO: 1323172 - DNA, 14 bp, Homo sapiens
agccccttctctca

SEQ ID NO: 1323173 - DNA, 15 bp, Homo sapiens
agccccttctctcaa

SEQ ID NO: 1323174 - DNA, 20 bp, Homo sapiens
agccccttctctcaatccct

SEQ ID NO: 1323175 - DNA, 10 bp, Homo sapiens
agccctgagg

SEQ ID NO: 1323176 - DNA, 13 bp, Homo sapiens
agccctgaggggt

SEQ ID NO: 1323177 - DNA, 11 bp, Homo sapiens
agccctggccc

SEQ ID NO: 1323178 - DNA, 17 bp, Homo sapiens
agccctggcccatcatg

SEQ ID NO: 1323179 - DNA, 14 bp, Homo sapiens
agcctcagaagcct

SEQ ID NO: 1323180 - DNA, 21 bp, Homo sapiens
agcctcagaagccttcttgct

SEQ ID NO: 1323181 - DNA, 22 bp, Homo sapiens
agcctcagaagccttcttgctg

SEQ ID NO: 1323182 - DNA, 13 bp, Homo sapiens
agcctccctccgc

SEQ ID NO: 1323183 - DNA, 13 bp, Homo sapiens
agcctctgcccca

SEQ ID NO: 1323184 - DNA, 16 bp, Homo sapiens
agcctctgccccaccc

SEQ ID NO: 1323185 - DNA, 19 bp, Homo sapiens
agcctggagtaggcctggg

SEQ ID NO: 1323186 - DNA, 17 bp, Homo sapiens
agcctggctcccctggg

SEQ ID NO: 1323187 - DNA, 17 bp, Homo sapiens
agcctgggcccctcagc

SEQ ID NO: 1323188 - DNA, 20 bp, Homo sapiens
agcctgtcccactggctcct

SEQ ID NO: 1323189 - DNA, 14 bp, Homo sapiens
agcctgtgtcctga

SEQ ID NO: 1323190 - DNA, 19 bp, Homo sapiens
agcctgttccttcctgcag

SEQ ID NO: 1323191 - DNA, 22 bp, Homo sapiens
agcctgttccttcctgcagacc

SEQ ID NO: 1323192 - DNA, 24 bp, Homo sapiens
agcctgttccttcctgcagacctg

SEQ ID NO: 1323193 - DNA, 15 bp, Homo sapiens
agccttcttgctgcc

SEQ ID NO: 1323194 - DNA, 16 bp, Homo sapiens
agccttcttgctgccc

SEQ ID NO: 1323195 - DNA, 19 bp, Homo sapiens
agccttcttgctgcccaca

SEQ ID NO: 1323196 - DNA, 20 bp, Homo sapiens
agccttcttgctgcccacaa

SEQ ID NO: 1323197 - DNA, 19 bp, Homo sapiens
agcctttgacctgttcaga

SEQ ID NO: 1323198 - DNA, 15 bp, Homo sapiens
agctaagctgcaggc

SEQ ID NO: 1323199 - DNA, 16 bp, Homo sapiens
agctaataaaatatca

SEQ ID NO: 1323200 - DNA, 19 bp, Homo sapiens
agctaataaaatatcattc

SEQ ID NO: 1323201 - DNA, 22 bp, Homo sapiens
agctatttggcaggctgaggca

SEQ ID NO: 1323202 - DNA, 17 bp, Homo sapiens
agctctacattctgctc

SEQ ID NO: 1323203 - DNA, 16 bp, Homo sapiens
agctgaatagagggag

SEQ ID NO: 1323204 - DNA, 14 bp, Homo sapiens
agctgctttgttac

SEQ ID NO: 1323205 - DNA, 19 bp, Homo sapiens
agctggggcttctttctgc

SEQ ID NO: 1323206 - DNA, 21 bp, Homo sapiens
agctggggcttctttctgctg

SEQ ID NO: 1323207 - DNA, 22 bp, Homo sapiens
agctggggggcaccggctcagg

SEQ ID NO: 1323208 - DNA, 20 bp, Homo sapiens
agctgttgactctagtactg

SEQ ID NO: 1323209 - DNA, 17 bp, Homo sapiens
agcttagggtctcaggg

SEQ ID NO: 1323210 - DNA, 15 bp, Homo sapiens
agcttattaatgcta

SEQ ID NO: 1323211 - DNA, 19 bp, Homo sapiens
agcttattaatgctaaggg

SEQ ID NO: 1323212 - DNA, 22 bp, Homo sapiens
agcttattaatgctaagggcag

SEQ ID NO: 1323213 - DNA, 13 bp, Homo sapiens
agcttgttttgga

SEQ ID NO: 1323214 - DNA, 20 bp, Homo sapiens
agcttgttttggactttgtt

SEQ ID NO: 1323215 - DNA, 22 bp, Homo sapiens
agctttacactgcctggtactg

SEQ ID NO: 1323216 - DNA, 17 bp, Homo sapiens
aggaacagggaccagct

SEQ ID NO: 1323217 - DNA, 21 bp, Homo sapiens
aggacttcccccaccccagaa

SEQ ID NO: 1323218 - DNA, 17 bp, Homo sapiens
aggagaataagaaaagg

SEQ ID NO: 1323219 - DNA, 16 bp, Homo sapiens
aggagagggccttccc

SEQ ID NO: 1323220 - DNA, 15 bp, Homo sapiens
aggagggtctagagg

SEQ ID NO: 1323221 - DNA, 20 bp, Homo sapiens
aggagggtctagaggcctga

SEQ ID NO: 1323222 - DNA, 19 bp, Homo sapiens
aggagtccaaaccttctac

SEQ ID NO: 1323223 - DNA, 19 bp, Homo sapiens
aggagtggtttttcttttc

SEQ ID NO: 1323224 - DNA, 13 bp, Homo sapiens
aggatatgcttta

SEQ ID NO: 1323225 - DNA, 12 bp, Homo sapiens
aggcaaggccca

SEQ ID NO: 1323226 - DNA, 16 bp, Homo sapiens
aggcaccgctgggttc

SEQ ID NO: 1323227 - DNA, 16 bp, Homo sapiens
aggcagaaggccagga

SEQ ID NO: 1323228 - DNA, 20 bp, Homo sapiens
aggcaggcccagcctctgcc

SEQ ID NO: 1323229 - DNA, 17 bp, Homo sapiens
aggcatcactttcctgg

SEQ ID NO: 1323230 - DNA, 19 bp, Homo sapiens
aggcatttgtaaatattaa

SEQ ID NO: 1323231 - DNA, 13 bp, Homo sapiens
aggccactgaaga

SEQ ID NO: 1323232 - DNA, 20 bp, Homo sapiens
aggccactgaagaggaggag

SEQ ID NO: 1323233 - DNA, 21 bp, Homo sapiens
aggccaggagtaagcccaagc

SEQ ID NO: 1323234 - DNA, 14 bp, Homo sapiens
aggccagtcccacg

SEQ ID NO: 1323235 - DNA, 23 bp, Homo sapiens
aggcccaaattatcaagctaata

SEQ ID NO: 1323236 - DNA, 18 bp, Homo sapiens
aggcccagacctggcctc

SEQ ID NO: 1323237 - DNA, 12 bp, Homo sapiens
aggcccagcctc

SEQ ID NO: 1323238 - DNA, 13 bp, Homo sapiens
aggcccagcctct

SEQ ID NO: 1323239 - DNA, 14 bp, Homo sapiens
aggcccagcctctg

SEQ ID NO: 1323240 - DNA, 22 bp, Homo sapiens
aggcccaggcaggcccagcctc

SEQ ID NO: 1323241 - DNA, 23 bp, Homo sapiens
aggccctacacacagaccgcgcc

SEQ ID NO: 1323242 - DNA, 18 bp, Homo sapiens
aggcctctgcctcacaac

SEQ ID NO: 1323243 - DNA, 18 bp, Homo sapiens
aggcctgaaatcctggtt

SEQ ID NO: 1323244 - DNA, 16 bp, Homo sapiens
aggcctggcctcaact

SEQ ID NO: 1323245 - DNA, 16 bp, Homo sapiens
aggcgcgctcagatgc

SEQ ID NO: 1323246 - DNA, 18 bp, Homo sapiens
aggctcttggtatctttc

SEQ ID NO: 1323247 - DNA, 23 bp, Homo sapiens
aggctggaaggaaagcaaggcag

SEQ ID NO: 1323248 - DNA, 17 bp, Homo sapiens
aggctggaaggaggaag

SEQ ID NO: 1323249 - DNA, 11 bp, Homo sapiens
agggaccagct

SEQ ID NO: 1323250 - DNA, 14 bp, Homo sapiens
agggaccagctccc

SEQ ID NO: 1323251 - DNA, 20 bp, Homo sapiens
agggcaggcccaaattatca

SEQ ID NO: 1323252 - DNA, 16 bp, Homo sapiens
agggcccatgggaggg

SEQ ID NO: 1323253 - DNA, 19 bp, Homo sapiens
agggcccatgggagggagc

SEQ ID NO: 1323254 - DNA, 23 bp, Homo sapiens
agggcgggggcaacgattcacag

SEQ ID NO: 1323255 - DNA, 22 bp, Homo sapiens
agggcggggtgtctgtcttcct

SEQ ID NO: 1323256 - DNA, 20 bp, Homo sapiens
agggctgagcacctctcaga

SEQ ID NO: 1323257 - DNA, 14 bp, Homo sapiens
agggtcagcagtgg

SEQ ID NO: 1323258 - DNA, 17 bp, Homo sapiens
agggtctcagggtgtcc

SEQ ID NO: 1323259 - DNA, 11 bp, Homo sapiens
agggtctgaaa

SEQ ID NO: 1323260 - DNA, 13 bp, Homo sapiens
agggtctgaaagg

SEQ ID NO: 1323261 - DNA, 16 bp, Homo sapiens
agggtgcggggcctgc

SEQ ID NO: 1323262 - DNA, 18 bp, Homo sapiens
agggtgcggggcctgcag

SEQ ID NO: 1323263 - DNA, 11 bp, Homo sapiens
agggtttctga

SEQ ID NO: 1323264 - DNA, 22 bp, Homo sapiens
agggtttggttagctcacagga

SEQ ID NO: 1323265 - DNA, 20 bp, Homo sapiens
aggtagattttaagaatggt

SEQ ID NO: 1323266 - DNA, 13 bp, Homo sapiens
aggtcctccatca

SEQ ID NO: 1323267 - DNA, 14 bp, Homo sapiens
agtaagcccaagct

SEQ ID NO: 1323268 - DNA, 13 bp, Homo sapiens
agtactgtgaatc

SEQ ID NO: 1323269 - DNA, 14 bp, Homo sapiens
agtaggcctggggc

SEQ ID NO: 1323270 - DNA, 15 bp, Homo sapiens
agtataccagagaag

SEQ ID NO: 1323271 - DNA, 18 bp, Homo sapiens
agtcatggagaaccacct

SEQ ID NO: 1323272 - DNA, 15 bp, Homo sapiens
agtcatttgtgaatt

SEQ ID NO: 1323273 - DNA, 16 bp, Homo sapiens
agtccaaaccttctac

SEQ ID NO: 1323274 - DNA, 16 bp, Homo sapiens
agtccagatggcaggc

SEQ ID NO: 1323275 - DNA, 16 bp, Homo sapiens
agtccatgtcctatgc

SEQ ID NO: 1323276 - DNA, 14 bp, Homo sapiens
agtcccacggctct

SEQ ID NO: 1323277 - DNA, 16 bp, Homo sapiens
agtcccacggctctgt

SEQ ID NO: 1323278 - DNA, 17 bp, Homo sapiens
agtcctcaaagcttttt

SEQ ID NO: 1323279 - DNA, 19 bp, Homo sapiens
agtcctcaaagctttttga

SEQ ID NO: 1323280 - DNA, 13 bp, Homo sapiens
agtcctccttccc

SEQ ID NO: 1323281 - DNA, 18 bp, Homo sapiens
agtcctccttcccagctc

SEQ ID NO: 1323282 - DNA, 14 bp, Homo sapiens
agtccttaagcaga

SEQ ID NO: 1323283 - DNA, 13 bp, Homo sapiens
agtctcagcctgg

SEQ ID NO: 1323284 - DNA, 23 bp, Homo sapiens
agtctcagcctgggcccctcagc

SEQ ID NO: 1323285 - DNA, 16 bp, Homo sapiens
agtctgaagtctggaa

SEQ ID NO: 1323286 - DNA, 15 bp, Homo sapiens
agtcttctcccaact

SEQ ID NO: 1323287 - DNA, 22 bp, Homo sapiens
agtcttctcccaactcagcctg

SEQ ID NO: 1323288 - DNA, 19 bp, Homo sapiens
agtcttgacctctccagca

SEQ ID NO: 1323289 - DNA, 21 bp, Homo sapiens
agtcttgacctctccagcatc

SEQ ID NO: 1323290 - DNA, 22 bp, Homo sapiens
agtcttgacctctccagcatcc

SEQ ID NO: 1323291 - DNA, 20 bp, Homo sapiens
agtcttgtgactagtgctga

SEQ ID NO: 1323292 - DNA, 22 bp, Homo sapiens
agtcttgtgactagtgctgaag

SEQ ID NO: 1323293 - DNA, 12 bp, Homo sapiens
agtgagctgaga

SEQ ID NO: 1323294 - DNA, 17 bp, Homo sapiens
agtgaggccactgaaga

SEQ ID NO: 1323295 - DNA, 18 bp, Homo sapiens
agtgaggccactgaagag

SEQ ID NO: 1323296 - DNA, 16 bp, Homo sapiens
agtgccgctcttgggg

SEQ ID NO: 1323297 - DNA, 23 bp, Homo sapiens
agtgctgaagcttattaatgcta

SEQ ID NO: 1323298 - DNA, 18 bp, Homo sapiens
agtgctgctttgccaaat

SEQ ID NO: 1323299 - DNA, 13 bp, Homo sapiens
agtggagtccaga

SEQ ID NO: 1323300 - DNA, 21 bp, Homo sapiens
agtggagtccagatggcaggc

SEQ ID NO: 1323301 - DNA, 14 bp, Homo sapiens
agtgggcagtcaca

SEQ ID NO: 1323302 - DNA, 14 bp, Homo sapiens
agtgggtttctgac

SEQ ID NO: 1323303 - DNA, 17 bp, Homo sapiens
agtgtggttttctgttt

SEQ ID NO: 1323304 - DNA, 16 bp, Homo sapiens
agttcacatgtgccct

SEQ ID NO: 1323305 - DNA, 17 bp, Homo sapiens
agttcacatgtgccctg

SEQ ID NO: 1323306 - DNA, 20 bp, Homo sapiens
agttcacatgtgccctgcct

SEQ ID NO: 1323307 - DNA, 21 bp, Homo sapiens
agttcacatgtgccctgcctt

SEQ ID NO: 1323308 - DNA, 14 bp, Homo sapiens
agttcagaaaaaat

SEQ ID NO: 1323309 - DNA, 20 bp, Homo sapiens
agttcagaaaaaatgtgaag

SEQ ID NO: 1323310 - DNA, 23 bp, Homo sapiens
agttgggaagtctcagcctgggc

SEQ ID NO: 1323311 - DNA, 23 bp, Homo sapiens
agttgttttgggtggtaaagtgt

SEQ ID NO: 1323312 - DNA, 17 bp, Homo sapiens
agtttccccaccagtga

SEQ ID NO: 1323313 - DNA, 22 bp, Homo sapiens
agtttccccaccagtgaatgaa

SEQ ID NO: 1323314 - DNA, 15 bp, Homo sapiens
ataaaaaaacagctt

SEQ ID NO: 1323315 - DNA, 17 bp, Homo sapiens
ataaaactgatgtgaaa

SEQ ID NO: 1323316 - DNA, 18 bp, Homo sapiens
ataaaactgatgtgaaac

SEQ ID NO: 1323317 - DNA, 16 bp, Homo sapiens
ataaaaggagaataag

SEQ ID NO: 1323318 - DNA, 18 bp, Homo sapiens
ataaaatatcattcagca

SEQ ID NO: 1323319 - DNA, 19 bp, Homo sapiens
ataaaatatcattcagcaa

SEQ ID NO: 1323320 - DNA, 20 bp, Homo sapiens
ataaaatatcattcagcaac

SEQ ID NO: 1323321 - DNA, 20 bp, Homo sapiens
ataaaatattttctgtgtgt

SEQ ID NO: 1323322 - DNA, 21 bp, Homo sapiens
ataaaatattttctgtgtgtt

SEQ ID NO: 1323323 - DNA, 23 bp, Homo sapiens
ataaaatattttctgtgtgttcc

SEQ ID NO: 1323324 - DNA, 17 bp, Homo sapiens
ataaaattccctaaagc

SEQ ID NO: 1323325 - DNA, 17 bp, Homo sapiens
ataaacgtgcgcggact

SEQ ID NO: 1323326 - DNA, 20 bp, Homo sapiens
ataaacgtgcgcggactgtc

SEQ ID NO: 1323327 - DNA, 14 bp, Homo sapiens
ataaagttaaaagt

SEQ ID NO: 1323328 - DNA, 13 bp, Homo sapiens
ataaatgaaataa

SEQ ID NO: 1323329 - DNA, 20 bp, Homo sapiens
ataaatttgtgtaatattac

SEQ ID NO: 1323330 - DNA, 16 bp, Homo sapiens
ataactgacttagttc

SEQ ID NO: 1323331 - DNA, 21 bp, Homo sapiens
ataagctacctgaatggagaa

SEQ ID NO: 1323332 - DNA, 21 bp, Homo sapiens
ataatgtacatagagtgagaa

SEQ ID NO: 1323333 - DNA, 15 bp, Homo sapiens
atacaatcagctgct

SEQ ID NO: 1323334 - DNA, 19 bp, Homo sapiens
atacatcttgtttctgagt

SEQ ID NO: 1323335 - DNA, 18 bp, Homo sapiens
atacgcattaagggcctg

SEQ ID NO: 1323336 - DNA, 22 bp, Homo sapiens
atacgcattaagggcctgctgg

SEQ ID NO: 1323337 - DNA, 16 bp, Homo sapiens
atactgagaaaaagtc

SEQ ID NO: 1323338 - DNA, 13 bp, Homo sapiens
atagaatagcatg

SEQ ID NO: 1323339 - DNA, 22 bp, Homo sapiens
atagtatgctctgagtagcttt

SEQ ID NO: 1323340 - DNA, 15 bp, Homo sapiens
atatcattcagcaac

SEQ ID NO: 1323341 - DNA, 14 bp, Homo sapiens
atatccgggtgctc

SEQ ID NO: 1323342 - DNA, 19 bp, Homo sapiens
atatccgggtgctcaataa

SEQ ID NO: 1323343 - DNA, 15 bp, Homo sapiens
atatctgttagatgc

SEQ ID NO: 1323344 - DNA, 16 bp, Homo sapiens
atatctgttagatgct

SEQ ID NO: 1323345 - DNA, 17 bp, Homo sapiens
atatgaacttaacatgc

SEQ ID NO: 1323346 - DNA, 20 bp, Homo sapiens
atatgtcctcttttgttgtt

SEQ ID NO: 1323347 - DNA, 14 bp, Homo sapiens
atattaaaagaaag

SEQ ID NO: 1323348 - DNA, 17 bp, Homo sapiens
atattactttaacatgc

SEQ ID NO: 1323349 - DNA, 12 bp, Homo sapiens
atattgttttcc

SEQ ID NO: 1323350 - DNA, 20 bp, Homo sapiens
atatttagtataccagagaa

SEQ ID NO: 1323351 - DNA, 12 bp, Homo sapiens
atattttacttg

SEQ ID NO: 1323352 - DNA, 15 bp, Homo sapiens
atattttctgtgtgt

SEQ ID NO: 1323353 - DNA, 17 bp, Homo sapiens
atattttctgtgtgttc

SEQ ID NO: 1323354 - DNA, 19 bp, Homo sapiens
atattttctgtgtgttcct

SEQ ID NO: 1323355 - DNA, 21 bp, Homo sapiens
atattttctgtgtgttcctgg

SEQ ID NO: 1323356 - DNA, 17 bp, Homo sapiens
atcaaaagttgatttct

SEQ ID NO: 1323357 - DNA, 14 bp, Homo sapiens
atcacagcttgttt

SEQ ID NO: 1323358 - DNA, 21 bp, Homo sapiens
atcacagcttgttttggactt

SEQ ID NO: 1323359 - DNA, 18 bp, Homo sapiens
atcacccctggtggctgc

SEQ ID NO: 1323360 - DNA, 13 bp, Homo sapiens
atcagaacagctg

SEQ ID NO: 1323361 - DNA, 16 bp, Homo sapiens
atcagagattattcaa

SEQ ID NO: 1323362 - DNA, 13 bp, Homo sapiens
atcagattgcttt

SEQ ID NO: 1323363 - DNA, 18 bp, Homo sapiens
atcagattgcttttgtgc

SEQ ID NO: 1323364 - DNA, 16 bp, Homo sapiens
atcagctgctttgtta

SEQ ID NO: 1323365 - DNA, 18 bp, Homo sapiens
atcatatacaaatgtttt

SEQ ID NO: 1323366 - DNA, 15 bp, Homo sapiens
atcatcattattatt

SEQ ID NO: 1323367 - DNA, 13 bp, Homo sapiens
atccaccacccca

SEQ ID NO: 1323368 - DNA, 19 bp, Homo sapiens
atccactggacactgtgaa

SEQ ID NO: 1323369 - DNA, 20 bp, Homo sapiens
atccactggacactgtgaaa

SEQ ID NO: 1323370 - DNA, 24 bp, Homo sapiens
atccactggacactgtgaaataca

SEQ ID NO: 1323371 - DNA, 19 bp, Homo sapiens
atccagattcccaggccag

SEQ ID NO: 1323372 - DNA, 10 bp, Homo sapiens
atcccagcct

SEQ ID NO: 1323373 - DNA, 19 bp, Homo sapiens
atcccagcctcagaagcct

SEQ ID NO: 1323374 - DNA, 14 bp, Homo sapiens
atcccgccttctcc

SEQ ID NO: 1323375 - DNA, 16 bp, Homo sapiens
atcccgccttctccag

SEQ ID NO: 1323376 - DNA, 17 bp, Homo sapiens
atcccgccttctccagg

SEQ ID NO: 1323377 - DNA, 16 bp, Homo sapiens
atccctcattcatcca

SEQ ID NO: 1323378 - DNA, 15 bp, Homo sapiens
atccctttgcaacgc

SEQ ID NO: 1323379 - DNA, 19 bp, Homo sapiens
atccctttgcaacgctcac

SEQ ID NO: 1323380 - DNA, 20 bp, Homo sapiens
atccgggtgctcaataaact

SEQ ID NO: 1323381 - DNA, 23 bp, Homo sapiens
atccgggtgctcaataaacttgt

SEQ ID NO: 1323382 - DNA, 22 bp, Homo sapiens
atcctccctgttccccacaggt

SEQ ID NO: 1323383 - DNA, 17 bp, Homo sapiens
atccttcttggcttcct

SEQ ID NO: 1323384 - DNA, 18 bp, Homo sapiens
atccttcttggcttcctg

SEQ ID NO: 1323385 - DNA, 20 bp, Homo sapiens
atcgggggtgagcgaagccc

SEQ ID NO: 1323386 - DNA, 17 bp, Homo sapiens
atctaatttcattcaaa

SEQ ID NO: 1323387 - DNA, 20 bp, Homo sapiens
atctacgaagccacaggcct

SEQ ID NO: 1323388 - DNA, 22 bp, Homo sapiens
atcttacttgcaaaatggagac

SEQ ID NO: 1323389 - DNA, 19 bp, Homo sapiens
atcttccatatccgggtgc

SEQ ID NO: 1323390 - DNA, 20 bp, Homo sapiens
atcttccatatccgggtgct

SEQ ID NO: 1323391 - DNA, 17 bp, Homo sapiens
atcttggccttactgta

SEQ ID NO: 1323392 - DNA, 22 bp, Homo sapiens
atctttctggaattgatgttta

SEQ ID NO: 1323393 - DNA, 20 bp, Homo sapiens
atgaaagtcttgtgactagt

SEQ ID NO: 1323394 - DNA, 14 bp, Homo sapiens
atgaacatctctgt

SEQ ID NO: 1323395 - DNA, 18 bp, Homo sapiens
atgaacatctctgttatt

SEQ ID NO: 1323396 - DNA, 13 bp, Homo sapiens
atgaacttaacat

SEQ ID NO: 1323397 - DNA, 21 bp, Homo sapiens
atgaagacttaactggcccag

SEQ ID NO: 1323398 - DNA, 17 bp, Homo sapiens
atgaagtaactgaggct

SEQ ID NO: 1323399 - DNA, 12 bp, Homo sapiens
atgaattgtaaa

SEQ ID NO: 1323400 - DNA, 16 bp, Homo sapiens
atgacctcagatcttt

SEQ ID NO: 1323401 - DNA, 14 bp, Homo sapiens
atgactgaagggaa

SEQ ID NO: 1323402 - DNA, 11 bp, Homo sapiens
atgagaatgtt

SEQ ID NO: 1323403 - DNA, 19 bp, Homo sapiens
atgagggctgagttatgaa

SEQ ID NO: 1323404 - DNA, 19 bp, Homo sapiens
atgagggtttgagagagca

SEQ ID NO: 1323405 - DNA, 22 bp, Homo sapiens
atgagtccatgtcctatgcctc

SEQ ID NO: 1323406 - DNA, 23 bp, Homo sapiens
atgagtccatgtcctatgcctca

SEQ ID NO: 1323407 - DNA, 22 bp, Homo sapiens
atgagttcacatgtgccctgcc

SEQ ID NO: 1323408 - DNA, 19 bp, Homo sapiens
atgataaaaggagaataag

SEQ ID NO: 1323409 - DNA, 16 bp, Homo sapiens
atgataaatttaaatg

SEQ ID NO: 1323410 - DNA, 20 bp, Homo sapiens
atgcaaagtataaatttgtg

SEQ ID NO: 1323411 - DNA, 14 bp, Homo sapiens
atgcagtgctgctt

SEQ ID NO: 1323412 - DNA, 21 bp, Homo sapiens
atgcattgtgaattgcctgcc

SEQ ID NO: 1323413 - DNA, 24 bp, Homo sapiens
atgcattgtgaattgcctgccatg

SEQ ID NO: 1323414 - DNA, 15 bp, Homo sapiens
atgccagtgcatgcc

SEQ ID NO: 1323415 - DNA, 24 bp, Homo sapiens
atgccccgccatggtcaccctcag

SEQ ID NO: 1323416 - DNA, 20 bp, Homo sapiens
atgcctaaagcccattgctg

SEQ ID NO: 1323417 - DNA, 22 bp, Homo sapiens
atgcctaaagcccattgctgca

SEQ ID NO: 1323418 - DNA, 15 bp, Homo sapiens
atgcctcacaaatgc

SEQ ID NO: 1323419 - DNA, 20 bp, Homo sapiens
atgctaagggcaggcccaaa

SEQ ID NO: 1323420 - DNA, 14 bp, Homo sapiens
atgctctctgaggc

SEQ ID NO: 1323421 - DNA, 20 bp, Homo sapiens
atgctgagacatccctcatc

SEQ ID NO: 1323422 - DNA, 17 bp, Homo sapiens
atgctgcttgtgacctt

SEQ ID NO: 1323423 - DNA, 12 bp, Homo sapiens
atgctggctggc

SEQ ID NO: 1323424 - DNA, 16 bp, Homo sapiens
atgctggctggccttg

SEQ ID NO: 1323425 - DNA, 20 bp, Homo sapiens
atgctgtggttcactgcact

SEQ ID NO: 1323426 - DNA, 16 bp, Homo sapiens
atgctttaagacagaa

SEQ ID NO: 1323427 - DNA, 17 bp, Homo sapiens
atggaaaacttagtttg

SEQ ID NO: 1323428 - DNA, 15 bp, Homo sapiens
atggaactgtaataa

SEQ ID NO: 1323429 - DNA, 15 bp, Homo sapiens
atggaacttccctcc

SEQ ID NO: 1323430 - DNA, 15 bp, Homo sapiens
atggagaaccaccta

SEQ ID NO: 1323431 - DNA, 18 bp, Homo sapiens
atggctggacatgggtgg

SEQ ID NO: 1323432 - DNA, 20 bp, Homo sapiens
atggggggagcaccctgagg

SEQ ID NO: 1323433 - DNA, 21 bp, Homo sapiens
atggggggagcaccctgaggg

SEQ ID NO: 1323434 - DNA, 16 bp, Homo sapiens
atgggtggacctgtgt

SEQ ID NO: 1323435 - DNA, 15 bp, Homo sapiens
atgtacgctgcgtgc

SEQ ID NO: 1323436 - DNA, 22 bp, Homo sapiens
atgtatatgaacttaacatgct

SEQ ID NO: 1323437 - DNA, 20 bp, Homo sapiens
atgtatctaatttcattcaa

SEQ ID NO: 1323438 - DNA, 23 bp, Homo sapiens
atgtcaatcatatttaaagggaa

SEQ ID NO: 1323439 - DNA, 19 bp, Homo sapiens
atgtgtctgccacattaac

SEQ ID NO: 1323440 - DNA, 18 bp, Homo sapiens
atgttcaattatttcccc

SEQ ID NO: 1323441 - DNA, 22 bp, Homo sapiens
atgttgtagatacaatcagctg

SEQ ID NO: 1323442 - DNA, 14 bp, Homo sapiens
attaagggcctgct

SEQ ID NO: 1323443 - DNA, 15 bp, Homo sapiens
attaatttatcagat

SEQ ID NO: 1323444 - DNA, 16 bp, Homo sapiens
attaggtttctttgaa

SEQ ID NO: 1323445 - DNA, 16 bp, Homo sapiens
attatcaagctaataa

SEQ ID NO: 1323446 - DNA, 22 bp, Homo sapiens
attatcaagctaataaaatatc

SEQ ID NO: 1323447 - DNA, 23 bp, Homo sapiens
attatcaagctaataaaatatca

SEQ ID NO: 1323448 - DNA, 15 bp, Homo sapiens
attattatttgcagt

SEQ ID NO: 1323449 - DNA, 16 bp, Homo sapiens
attattcaacagagag

SEQ ID NO: 1323450 - DNA, 14 bp, Homo sapiens
attcactgtctgtt

SEQ ID NO: 1323451 - DNA, 17 bp, Homo sapiens
attcttggtatttggat

SEQ ID NO: 1323452 - DNA, 23 bp, Homo sapiens
attgatgtttacatgtctgttgt

SEQ ID NO: 1323453 - DNA, 20 bp, Homo sapiens
attgcaccatagtatgctct

SEQ ID NO: 1323454 - DNA, 18 bp, Homo sapiens
attgcattttttaaaaca

SEQ ID NO: 1323455 - DNA, 23 bp, Homo sapiens
attgcctcggctggctcccctgc

SEQ ID NO: 1323456 - DNA, 19 bp, Homo sapiens
attgcctgccatggctgtg

SEQ ID NO: 1323457 - DNA, 15 bp, Homo sapiens
attggataacaccac

SEQ ID NO: 1323458 - DNA, 14 bp, Homo sapiens
attgggactctgtt

SEQ ID NO: 1323459 - DNA, 15 bp, Homo sapiens
attgtgaattgcctg

SEQ ID NO: 1323460 - DNA, 18 bp, Homo sapiens
attgtgaattgcctgcca

SEQ ID NO: 1323461 - DNA, 20 bp, Homo sapiens
attgtgaattgcctgccatg

SEQ ID NO: 1323462 - DNA, 19 bp, Homo sapiens
atttaaagggaatgacttt

SEQ ID NO: 1323463 - DNA, 20 bp, Homo sapiens
atttagtataccagagaagg

SEQ ID NO: 1323464 - DNA, 15 bp, Homo sapiens
atttatcagattgct

SEQ ID NO: 1323465 - DNA, 18 bp, Homo sapiens
atttatccctcattcatc

SEQ ID NO: 1323466 - DNA, 9 bp, Homo sapiens
atttgcagt

SEQ ID NO: 1323467 - DNA, 12 bp, Homo sapiens
atttgctgctga

SEQ ID NO: 1323468 - DNA, 20 bp, Homo sapiens
atttggaaactaataaaata

SEQ ID NO: 1323469 - DNA, 21 bp, Homo sapiens
atttggaaactaataaaatat

SEQ ID NO: 1323470 - DNA, 17 bp, Homo sapiens
atttggatatctgttag

SEQ ID NO: 1323471 - DNA, 17 bp, Homo sapiens
atttgtgatgtactgta

SEQ ID NO: 1323472 - DNA, 15 bp, Homo sapiens
attttagtcttgctg

SEQ ID NO: 1323473 - DNA, 12 bp, Homo sapiens
attttctgtgtg

SEQ ID NO: 1323474 - DNA, 13 bp, Homo sapiens
attttctgtgtgt

SEQ ID NO: 1323475 - DNA, 18 bp, Homo sapiens
attttctgtgtgttcctg

SEQ ID NO: 1323476 - DNA, 17 bp, Homo sapiens
attttttaaaacaagaa

SEQ ID NO: 1323477 - DNA, 18 bp, Homo sapiens
attttttaacttatgtat

SEQ ID NO: 1323478 - DNA, 13 bp, Homo sapiens
caaaaaaggaaat

SEQ ID NO: 1323479 - DNA, 13 bp, Homo sapiens
caaaagtggtcag

SEQ ID NO: 1323480 - DNA, 18 bp, Homo sapiens
caaagtataaatttgtgt

SEQ ID NO: 1323481 - DNA, 19 bp, Homo sapiens
caaagtataaatttgtgta

SEQ ID NO: 1323482 - DNA, 17 bp, Homo sapiens
caaattatcaagctaat

SEQ ID NO: 1323483 - DNA, 18 bp, Homo sapiens
caacccaatctggctggt

SEQ ID NO: 1323484 - DNA, 19 bp, Homo sapiens
caacccttcttcatgttca

SEQ ID NO: 1323485 - DNA, 14 bp, Homo sapiens
caacgattcacagc

SEQ ID NO: 1323486 - DNA, 16 bp, Homo sapiens
caacgtcccctcaagc

SEQ ID NO: 1323487 - DNA, 20 bp, Homo sapiens
caacgtcccctcaagcccct

SEQ ID NO: 1323488 - DNA, 16 bp, Homo sapiens
caactcacccttggcc

SEQ ID NO: 1323489 - DNA, 19 bp, Homo sapiens
caactcacccttggcccat

SEQ ID NO: 1323490 - DNA, 21 bp, Homo sapiens
caactcagcctgttccttcct

SEQ ID NO: 1323491 - DNA, 16 bp, Homo sapiens
caactccagcgtcctc

SEQ ID NO: 1323492 - DNA, 18 bp, Homo sapiens
caactgagaagccaagcc

SEQ ID NO: 1323493 - DNA, 22 bp, Homo sapiens
caactgagaagccaagcctgga

SEQ ID NO: 1323494 - DNA, 16 bp, Homo sapiens
caacttcatctggaag

SEQ ID NO: 1323495 - DNA, 21 bp, Homo sapiens
caacttgtgactttgagacta

SEQ ID NO: 1323496 - DNA, 18 bp, Homo sapiens
caagcctggagtaggcct

SEQ ID NO: 1323497 - DNA, 20 bp, Homo sapiens
caagcctggagtaggcctgg

SEQ ID NO: 1323498 - DNA, 21 bp, Homo sapiens
caagcctggagtaggcctggg

SEQ ID NO: 1323499 - DNA, 22 bp, Homo sapiens
caagcctggagtaggcctgggg

SEQ ID NO: 1323500 - DNA, 13 bp, Homo sapiens
caagctaagctgc

SEQ ID NO: 1323501 - DNA, 18 bp, Homo sapiens
caagctaagctgcaggca

SEQ ID NO: 1323502 - DNA, 16 bp, Homo sapiens
caaggcccagacctgg

SEQ ID NO: 1323503 - DNA, 18 bp, Homo sapiens
caagtaagaataaaattg

SEQ ID NO: 1323504 - DNA, 16 bp, Homo sapiens
caataaacttgtgcct

SEQ ID NO: 1323505 - DNA, 18 bp, Homo sapiens
caataaacttgtgcctcc

SEQ ID NO: 1323506 - DNA, 13 bp, Homo sapiens
caatcagctgctt

SEQ ID NO: 1323507 - DNA, 13 bp, Homo sapiens
caatcatatttaa

SEQ ID NO: 1323508 - DNA, 18 bp, Homo sapiens
caatcatatttaaaggga

SEQ ID NO: 1323509 - DNA, 14 bp, Homo sapiens
caatccctttgcaa

SEQ ID NO: 1323510 - DNA, 21 bp, Homo sapiens
caatctgggcactttggccaa

SEQ ID NO: 1323511 - DNA, 19 bp, Homo sapiens
caatgataaatttaaatga

SEQ ID NO: 1323512 - DNA, 16 bp, Homo sapiens
caattccatttctttc

SEQ ID NO: 1323513 - DNA, 21 bp, Homo sapiens
caattgtagatgaacatctct

SEQ ID NO: 1323514 - DNA, 23 bp, Homo sapiens
caattttagtcttgctgtttctt

SEQ ID NO: 1323515 - DNA, 16 bp, Homo sapiens
cacaacgtcccctcaa

SEQ ID NO: 1323516 - DNA, 16 bp, Homo sapiens
cacaaggaactcttga

SEQ ID NO: 1323517 - DNA, 19 bp, Homo sapiens
cacaagttaagattcttgg

SEQ ID NO: 1323518 - DNA, 20 bp, Homo sapiens
cacaagttaagattcttggt

SEQ ID NO: 1323519 - DNA, 15 bp, Homo sapiens
cacacaaggaactct

SEQ ID NO: 1323520 - DNA, 15 bp, Homo sapiens
cacacatgcaaggga

SEQ ID NO: 1323521 - DNA, 20 bp, Homo sapiens
cacagaccgcgcccctggga

SEQ ID NO: 1323522 - DNA, 20 bp, Homo sapiens
cacagagccaaattggtaga

SEQ ID NO: 1323523 - DNA, 16 bp, Homo sapiens
cacagcttgttttgga

SEQ ID NO: 1323524 - DNA, 15 bp, Homo sapiens
cacaggcctggcctc

SEQ ID NO: 1323525 - DNA, 23 bp, Homo sapiens
cacagtgtgaagacactgtgcag

SEQ ID NO: 1323526 - DNA, 13 bp, Homo sapiens
cacatagccctgt

SEQ ID NO: 1323527 - DNA, 14 bp, Homo sapiens
cacatagccctgtt

SEQ ID NO: 1323528 - DNA, 20 bp, Homo sapiens
cacatccttcttggcttcct

SEQ ID NO: 1323529 - DNA, 19 bp, Homo sapiens
cacatggaatgagggtttg

SEQ ID NO: 1323530 - DNA, 14 bp, Homo sapiens
cacatgtgccctgc

SEQ ID NO: 1323531 - DNA, 17 bp, Homo sapiens
caccaccccacccacct

SEQ ID NO: 1323532 - DNA, 17 bp, Homo sapiens
cacccagcctgtcccac

SEQ ID NO: 1323533 - DNA, 22 bp, Homo sapiens
cacccagcctgtcccactggct

SEQ ID NO: 1323534 - DNA, 15 bp, Homo sapiens
caccccactcctcag

SEQ ID NO: 1323535 - DNA, 13 bp, Homo sapiens
caccccttgctct

SEQ ID NO: 1323536 - DNA, 15 bp, Homo sapiens
caccccttgctctct

SEQ ID NO: 1323537 - DNA, 15 bp, Homo sapiens
caccctctccacacc

SEQ ID NO: 1323538 - DNA, 21 bp, Homo sapiens
caccctctccacacccagcct

SEQ ID NO: 1323539 - DNA, 19 bp, Homo sapiens
cacccttggcccatcccgc

SEQ ID NO: 1323540 - DNA, 19 bp, Homo sapiens
cacccttggtctcatgccc

SEQ ID NO: 1323541 - DNA, 21 bp, Homo sapiens
caccgctgggttctgactctg

SEQ ID NO: 1323542 - DNA, 20 bp, Homo sapiens
caccggctcaggagagggcc

SEQ ID NO: 1323543 - DNA, 15 bp, Homo sapiens
cacctatgtggcatg

SEQ ID NO: 1323544 - DNA, 16 bp, Homo sapiens
cacctgcagcctccct

SEQ ID NO: 1323545 - DNA, 19 bp, Homo sapiens
cacctgcccccacagctcc

SEQ ID NO: 1323546 - DNA, 22 bp, Homo sapiens
cacctgcccccacagctccttg

SEQ ID NO: 1323547 - DNA, 14 bp, Homo sapiens
caccttctcacatg

SEQ ID NO: 1323548 - DNA, 15 bp, Homo sapiens
cacgccttcatgcca

SEQ ID NO: 1323549 - DNA, 15 bp, Homo sapiens
cacggctctgtgccc

SEQ ID NO: 1323550 - DNA, 16 bp, Homo sapiens
cacggtaaccatgatg

SEQ ID NO: 1323551 - DNA, 13 bp, Homo sapiens
cactcagctgttc

SEQ ID NO: 1323552 - DNA, 21 bp, Homo sapiens
cactcctcagtaaaagtcttc

SEQ ID NO: 1323553 - DNA, 20 bp, Homo sapiens
cactgcactccagcctgggt

SEQ ID NO: 1323554 - DNA, 20 bp, Homo sapiens
cactggctcctcccagcaca

SEQ ID NO: 1323555 - DNA, 19 bp, Homo sapiens
cactggttttggccacccc

SEQ ID NO: 1323556 - DNA, 20 bp, Homo sapiens
cactggttttggccacccct

SEQ ID NO: 1323557 - DNA, 15 bp, Homo sapiens
cactgtctgttgctt

SEQ ID NO: 1323558 - DNA, 17 bp, Homo sapiens
cactgtgcaggcccagg

SEQ ID NO: 1323559 - DNA, 23 bp, Homo sapiens
cactgtgcaggcccaggcaggcc

SEQ ID NO: 1323560 - DNA, 18 bp, Homo sapiens
cagaaagcctcctctgga

SEQ ID NO: 1323561 - DNA, 22 bp, Homo sapiens
cagaaagcctcctctggagaat

SEQ ID NO: 1323562 - DNA, 18 bp, Homo sapiens
cagaacttagcaatttcc

SEQ ID NO: 1323563 - DNA, 13 bp, Homo sapiens
cagaagccttctt

SEQ ID NO: 1323564 - DNA, 22 bp, Homo sapiens
cagaagccttcttgctgcccac

SEQ ID NO: 1323565 - DNA, 18 bp, Homo sapiens
cagaagtccttaagcaga

SEQ ID NO: 1323566 - DNA, 21 bp, Homo sapiens
cagaagtccttaagcagagga

SEQ ID NO: 1323567 - DNA, 22 bp, Homo sapiens
cagaagtccttaagcagaggaa

SEQ ID NO: 1323568 - DNA, 20 bp, Homo sapiens
cagaccgcgcccctgggact

SEQ ID NO: 1323569 - DNA, 17 bp, Homo sapiens
cagacctggcctctgcc

SEQ ID NO: 1323570 - DNA, 18 bp, Homo sapiens
cagacctggcctctgcca

SEQ ID NO: 1323571 - DNA, 20 bp, Homo sapiens
cagacctggctgggcctggg

SEQ ID NO: 1323572 - DNA, 14 bp, Homo sapiens
cagacggaggactg

SEQ ID NO: 1323573 - DNA, 20 bp, Homo sapiens
cagacggaggactggaactg

SEQ ID NO: 1323574 - DNA, 23 bp, Homo sapiens
cagagaaggtagattttaagaat

SEQ ID NO: 1323575 - DNA, 13 bp, Homo sapiens
cagagcaagcctt

SEQ ID NO: 1323576 - DNA, 14 bp, Homo sapiens
cagagcaagccttt

SEQ ID NO: 1323577 - DNA, 21 bp, Homo sapiens
cagagcaagcctttgacctgt

SEQ ID NO: 1323578 - DNA, 18 bp, Homo sapiens
cagatgccggagccccaa

SEQ ID NO: 1323579 - DNA, 16 bp, Homo sapiens
cagattcccaggccag

SEQ ID NO: 1323580 - DNA, 18 bp, Homo sapiens
cagattcccaggccaggc

SEQ ID NO: 1323581 - DNA, 21 bp, Homo sapiens
cagcaaacctaattgcacaac

SEQ ID NO: 1323582 - DNA, 14 bp, Homo sapiens
cagcatcccagcct

SEQ ID NO: 1323583 - DNA, 16 bp, Homo sapiens
cagcatgaaaatgtgt

SEQ ID NO: 1323584 - DNA, 18 bp, Homo sapiens
cagccacccttggtctca

SEQ ID NO: 1323585 - DNA, 18 bp, Homo sapiens
cagccaggagagcttagg

SEQ ID NO: 1323586 - DNA, 20 bp, Homo sapiens
cagcccctagatgaagaaag

SEQ ID NO: 1323587 - DNA, 21 bp, Homo sapiens
cagccctgaggggtggactag

SEQ ID NO: 1323588 - DNA, 22 bp, Homo sapiens
cagccctgaggggtggactagg

SEQ ID NO: 1323589 - DNA, 12 bp, Homo sapiens
cagcctctgccc

SEQ ID NO: 1323590 - DNA, 14 bp, Homo sapiens
cagcctctgcccca

SEQ ID NO: 1323591 - DNA, 14 bp, Homo sapiens
cagcctgggcccct

SEQ ID NO: 1323592 - DNA, 18 bp, Homo sapiens
cagcctgggcccctcagc

SEQ ID NO: 1323593 - DNA, 21 bp, Homo sapiens
cagcctgggcccctcagccac

SEQ ID NO: 1323594 - DNA, 21 bp, Homo sapiens
cagcctgtcccactggctcct

SEQ ID NO: 1323595 - DNA, 17 bp, Homo sapiens
cagcctgttccttcctg

SEQ ID NO: 1323596 - DNA, 20 bp, Homo sapiens
cagccttcaatcaacatctc

SEQ ID NO: 1323597 - DNA, 17 bp, Homo sapiens
cagcgtcctcagcaccc

SEQ ID NO: 1323598 - DNA, 19 bp, Homo sapiens
cagcgtcctcagcacccca

SEQ ID NO: 1323599 - DNA, 20 bp, Homo sapiens
cagcgtcctcagcaccccac

SEQ ID NO: 1323600 - DNA, 21 bp, Homo sapiens
cagcgtcctcagcaccccact

SEQ ID NO: 1323601 - DNA, 17 bp, Homo sapiens
cagctccccgggggcca

SEQ ID NO: 1323602 - DNA, 16 bp, Homo sapiens
cagctctacattctgc

SEQ ID NO: 1323603 - DNA, 19 bp, Homo sapiens
cagctctacattctgctct

SEQ ID NO: 1323604 - DNA, 18 bp, Homo sapiens
cagctgaatagagggagt

SEQ ID NO: 1323605 - DNA, 19 bp, Homo sapiens
cagctgaatagagggagta

SEQ ID NO: 1323606 - DNA, 14 bp, Homo sapiens
cagctgctttgtta

SEQ ID NO: 1323607 - DNA, 16 bp, Homo sapiens
cagcttgttttggact

SEQ ID NO: 1323608 - DNA, 23 bp, Homo sapiens
cagcttgttttggactttgttac

SEQ ID NO: 1323609 - DNA, 16 bp, Homo sapiens
caggaacagggaccag

SEQ ID NO: 1323610 - DNA, 22 bp, Homo sapiens
caggaacagggaccagctcccc

SEQ ID NO: 1323611 - DNA, 18 bp, Homo sapiens
caggacagcacacggtga

SEQ ID NO: 1323612 - DNA, 17 bp, Homo sapiens
caggacatgtactgaga

SEQ ID NO: 1323613 - DNA, 12 bp, Homo sapiens
caggagagggcc

SEQ ID NO: 1323614 - DNA, 22 bp, Homo sapiens
caggagagggccttcccctccc

SEQ ID NO: 1323615 - DNA, 18 bp, Homo sapiens
caggagtaagcccaagct

SEQ ID NO: 1323616 - DNA, 17 bp, Homo sapiens
caggagtccaaaccttc

SEQ ID NO: 1323617 - DNA, 23 bp, Homo sapiens
caggagtccaaaccttctaccct

SEQ ID NO: 1323618 - DNA, 14 bp, Homo sapiens
caggatatgcttta

SEQ ID NO: 1323619 - DNA, 13 bp, Homo sapiens
caggcaggcccag

SEQ ID NO: 1323620 - DNA, 17 bp, Homo sapiens
caggcaggcccagcctc

SEQ ID NO: 1323621 - DNA, 21 bp, Homo sapiens
caggcaggcccagcctctgcc

SEQ ID NO: 1323622 - DNA, 17 bp, Homo sapiens
caggcaggtgccaggaa

SEQ ID NO: 1323623 - DNA, 19 bp, Homo sapiens
caggcaggtgccaggaact

SEQ ID NO: 1323624 - DNA, 21 bp, Homo sapiens
caggcattgcctcggctggct

SEQ ID NO: 1323625 - DNA, 22 bp, Homo sapiens
caggcattgcctcggctggctc

SEQ ID NO: 1323626 - DNA, 13 bp, Homo sapiens
caggcccagcctc

SEQ ID NO: 1323627 - DNA, 15 bp, Homo sapiens
caggcccagcctctg

SEQ ID NO: 1323628 - DNA, 17 bp, Homo sapiens
caggcccagcctctgcc

SEQ ID NO: 1323629 - DNA, 16 bp, Homo sapiens
caggcccaggcaggcc

SEQ ID NO: 1323630 - DNA, 16 bp, Homo sapiens
caggctcccgacccca

SEQ ID NO: 1323631 - DNA, 22 bp, Homo sapiens
caggctcccgaccccatccacc

SEQ ID NO: 1323632 - DNA, 19 bp, Homo sapiens
caggctgaggcatgagaat

SEQ ID NO: 1323633 - DNA, 12 bp, Homo sapiens
caggctggccga

SEQ ID NO: 1323634 - DNA, 19 bp, Homo sapiens
cagggaccagctccccggg

SEQ ID NO: 1323635 - DNA, 15 bp, Homo sapiens
caggtgccaggaact

SEQ ID NO: 1323636 - DNA, 16 bp, Homo sapiens
caggtgccaggaactc

SEQ ID NO: 1323637 - DNA, 20 bp, Homo sapiens
caggttgttagaaaaatgga

SEQ ID NO: 1323638 - DNA, 15 bp, Homo sapiens
cagtaaaagtcttct

SEQ ID NO: 1323639 - DNA, 19 bp, Homo sapiens
cagtaaaagtcttctccca

SEQ ID NO: 1323640 - DNA, 13 bp, Homo sapiens
cagtataaaatta

SEQ ID NO: 1323641 - DNA, 22 bp, Homo sapiens
cagtcatggagaaccacctacc

SEQ ID NO: 1323642 - DNA, 21 bp, Homo sapiens
cagtcccacggctctgtgccc

SEQ ID NO: 1323643 - DNA, 22 bp, Homo sapiens
cagtcccacggctctgtgcccg

SEQ ID NO: 1323644 - DNA, 19 bp, Homo sapiens
cagtgttaatactgagaaa

SEQ ID NO: 1323645 - DNA, 20 bp, Homo sapiens
cagttgggaagtctcagcct

SEQ ID NO: 1323646 - DNA, 20 bp, Homo sapiens
cagtttatgcagtgctgctt

SEQ ID NO: 1323647 - DNA, 21 bp, Homo sapiens
catacgcattaagggcctgct

SEQ ID NO: 1323648 - DNA, 17 bp, Homo sapiens
catatccgggtgctcaa

SEQ ID NO: 1323649 - DNA, 19 bp, Homo sapiens
catatccgggtgctcaata

SEQ ID NO: 1323650 - DNA, 14 bp, Homo sapiens
catcacagcttgtt

SEQ ID NO: 1323651 - DNA, 14 bp, Homo sapiens
catcacccctggtg

SEQ ID NO: 1323652 - DNA, 22 bp, Homo sapiens
catcacccctggtggctgcagg

SEQ ID NO: 1323653 - DNA, 23 bp, Homo sapiens
catcacccctggtggctgcaggc

SEQ ID NO: 1323654 - DNA, 24 bp, Homo sapiens
catcacccctggtggctgcaggca

SEQ ID NO: 1323655 - DNA, 17 bp, Homo sapiens
catcatgccaacttgtg

SEQ ID NO: 1323656 - DNA, 23 bp, Homo sapiens
catccacctatccaccaccccac

SEQ ID NO: 1323657 - DNA, 21 bp, Homo sapiens
catcccagcctcagaagcctt

SEQ ID NO: 1323658 - DNA, 22 bp, Homo sapiens
catcccagcctcagaagccttc

SEQ ID NO: 1323659 - DNA, 14 bp, Homo sapiens
catcccgccttctc

SEQ ID NO: 1323660 - DNA, 21 bp, Homo sapiens
catcctccctgttccccacag

SEQ ID NO: 1323661 - DNA, 18 bp, Homo sapiens
catccttcttggcttcct

SEQ ID NO: 1323662 - DNA, 19 bp, Homo sapiens
catccttcttggcttcctg

SEQ ID NO: 1323663 - DNA, 20 bp, Homo sapiens
catccttcttggcttcctgg

SEQ ID NO: 1323664 - DNA, 23 bp, Homo sapiens
catctacgaagccacaggcctgg

SEQ ID NO: 1323665 - DNA, 16 bp, Homo sapiens
catctagtcttgacct

SEQ ID NO: 1323666 - DNA, 18 bp, Homo sapiens
catctagtcttgacctct

SEQ ID NO: 1323667 - DNA, 23 bp, Homo sapiens
catctagtcttgacctctccagc

SEQ ID NO: 1323668 - DNA, 16 bp, Homo sapiens
catctctcctgtgtct

SEQ ID NO: 1323669 - DNA, 13 bp, Homo sapiens
catcttccatatc

SEQ ID NO: 1323670 - DNA, 23 bp, Homo sapiens
catcttccatatccgggtgctca

SEQ ID NO: 1323671 - DNA, 15 bp, Homo sapiens
catgaaaatgtgtgt

SEQ ID NO: 1323672 - DNA, 16 bp, Homo sapiens
catgaaaatgtgtgtt

SEQ ID NO: 1323673 - DNA, 17 bp, Homo sapiens
catgaaaatgtgtgttt

SEQ ID NO: 1323674 - DNA, 19 bp, Homo sapiens
catgataccaggcccagga

SEQ ID NO: 1323675 - DNA, 14 bp, Homo sapiens
catgccaacttgtg

SEQ ID NO: 1323676 - DNA, 14 bp, Homo sapiens
catgccagtgcatg

SEQ ID NO: 1323677 - DNA, 19 bp, Homo sapiens
catgcctaaagcccattgc

SEQ ID NO: 1323678 - DNA, 20 bp, Homo sapiens
catgcctaaagcccattgct

SEQ ID NO: 1323679 - DNA, 15 bp, Homo sapiens
catgctgagacatcc

SEQ ID NO: 1323680 - DNA, 16 bp, Homo sapiens
catgctgagacatccc

SEQ ID NO: 1323681 - DNA, 12 bp, Homo sapiens
catgctgtgtaa

SEQ ID NO: 1323682 - DNA, 18 bp, Homo sapiens
catgctgtgtaagctgtg

SEQ ID NO: 1323683 - DNA, 14 bp, Homo sapiens
catggaatgagggt

SEQ ID NO: 1323684 - DNA, 14 bp, Homo sapiens
catggctgtgacac

SEQ ID NO: 1323685 - DNA, 21 bp, Homo sapiens
catggctgtgacacagacgga

SEQ ID NO: 1323686 - DNA, 12 bp, Homo sapiens
catgggagggag

SEQ ID NO: 1323687 - DNA, 20 bp, Homo sapiens
catgggagggagctgagaag

SEQ ID NO: 1323688 - DNA, 21 bp, Homo sapiens
catggggggagcaccctgagg

SEQ ID NO: 1323689 - DNA, 14 bp, Homo sapiens
catggtcaccctca

SEQ ID NO: 1323690 - DNA, 15 bp, Homo sapiens
catggtcaccctcag

SEQ ID NO: 1323691 - DNA, 16 bp, Homo sapiens
catggtcaccctcagg

SEQ ID NO: 1323692 - DNA, 16 bp, Homo sapiens
catgtactgagacaaa

SEQ ID NO: 1323693 - DNA, 22 bp, Homo sapiens
catgtagaacaagaaatctttc

SEQ ID NO: 1323694 - DNA, 17 bp, Homo sapiens
catgtgaggttaaacca

SEQ ID NO: 1323695 - DNA, 17 bp, Homo sapiens
catgtgccctgccttga

SEQ ID NO: 1323696 - DNA, 13 bp, Homo sapiens
catgttcaattat

SEQ ID NO: 1323697 - DNA, 15 bp, Homo sapiens
catgttttgttttct

SEQ ID NO: 1323698 - DNA, 23 bp, Homo sapiens
cattccatttatggaacttccct

SEQ ID NO: 1323699 - DNA, 13 bp, Homo sapiens
cattctgctctgc

SEQ ID NO: 1323700 - DNA, 14 bp, Homo sapiens
cattctgctctgcc

SEQ ID NO: 1323701 - DNA, 16 bp, Homo sapiens
cattctgctctgccca

SEQ ID NO: 1323702 - DNA, 17 bp, Homo sapiens
cattctgctctgcccat

SEQ ID NO: 1323703 - DNA, 19 bp, Homo sapiens
cattctgctctgcccatgc

SEQ ID NO: 1323704 - DNA, 13 bp, Homo sapiens
cattgctgcaaat

SEQ ID NO: 1323705 - DNA, 24 bp, Homo sapiens
cattgtgaattgcctgccatggct

SEQ ID NO: 1323706 - DNA, 16 bp, Homo sapiens
catttaatgaacacaa

SEQ ID NO: 1323707 - DNA, 17 bp, Homo sapiens
catttcctgaggtggat

SEQ ID NO: 1323708 - DNA, 16 bp, Homo sapiens
catttgtaaatattaa

SEQ ID NO: 1323709 - DNA, 20 bp, Homo sapiens
catttttcccaggcaaataa

SEQ ID NO: 1323710 - DNA, 14 bp, Homo sapiens
cattttttaaaaca

SEQ ID NO: 1323711 - DNA, 15 bp, Homo sapiens
cattttttaaaacaa

SEQ ID NO: 1323712 - DNA, 16 bp, Homo sapiens
cattttttaaaacaag

SEQ ID NO: 1323713 - DNA, 13 bp, Homo sapiens
ccaaaccttctac

SEQ ID NO: 1323714 - DNA, 16 bp, Homo sapiens
ccaaaccttctaccct

SEQ ID NO: 1323715 - DNA, 18 bp, Homo sapiens
ccaaattatcaagctaat

SEQ ID NO: 1323716 - DNA, 22 bp, Homo sapiens
ccaaattatcaagctaataaaa

SEQ ID NO: 1323717 - DNA, 14 bp, Homo sapiens
ccaacccttcttca

SEQ ID NO: 1323718 - DNA, 15 bp, Homo sapiens
ccaacccttcttcat

SEQ ID NO: 1323719 - DNA, 16 bp, Homo sapiens
ccaactcagcctgttc

SEQ ID NO: 1323720 - DNA, 18 bp, Homo sapiens
ccaagactctgctctcct

SEQ ID NO: 1323721 - DNA, 19 bp, Homo sapiens
ccaagactctgctctcctc

SEQ ID NO: 1323722 - DNA, 21 bp, Homo sapiens
ccaagcctggagtaggcctgg

SEQ ID NO: 1323723 - DNA, 17 bp, Homo sapiens
ccaagctaagctgcagg

SEQ ID NO: 1323724 - DNA, 18 bp, Homo sapiens
ccaagctaagctgcaggc

SEQ ID NO: 1323725 - DNA, 12 bp, Homo sapiens
ccacacccagcc

SEQ ID NO: 1323726 - DNA, 15 bp, Homo sapiens
ccacaggcctggcct

SEQ ID NO: 1323727 - DNA, 21 bp, Homo sapiens
ccacagtgtgaagacactgtg

SEQ ID NO: 1323728 - DNA, 14 bp, Homo sapiens
ccacccacctttgc

SEQ ID NO: 1323729 - DNA, 19 bp, Homo sapiens
ccacccacctttgcaggga

SEQ ID NO: 1323730 - DNA, 13 bp, Homo sapiens
ccaccccagaaga

SEQ ID NO: 1323731 - DNA, 15 bp, Homo sapiens
ccaccccttgctctc

SEQ ID NO: 1323732 - DNA, 19 bp, Homo sapiens
ccaccctctccacacccag

SEQ ID NO: 1323733 - DNA, 22 bp, Homo sapiens
ccaccctctccacacccagcct

SEQ ID NO: 1323734 - DNA, 17 bp, Homo sapiens
ccacggctctgtgcccg

SEQ ID NO: 1323735 - DNA, 23 bp, Homo sapiens
ccactcctcagtaaaagtcttct

SEQ ID NO: 1323736 - DNA, 15 bp, Homo sapiens
ccactggctcctccc

SEQ ID NO: 1323737 - DNA, 16 bp, Homo sapiens
ccactggctcctccca

SEQ ID NO: 1323738 - DNA, 18 bp, Homo sapiens
ccactggctcctcccagc

SEQ ID NO: 1323739 - DNA, 19 bp, Homo sapiens
ccactggctcctcccagca

SEQ ID NO: 1323740 - DNA, 20 bp, Homo sapiens
ccagacctggcctctgccat

SEQ ID NO: 1323741 - DNA, 15 bp, Homo sapiens
ccagatggcaggcta

SEQ ID NO: 1323742 - DNA, 22 bp, Homo sapiens
ccagattcccaggccaggctcc

SEQ ID NO: 1323743 - DNA, 15 bp, Homo sapiens
ccagcacaggcacct

SEQ ID NO: 1323744 - DNA, 14 bp, Homo sapiens
ccagcatcccagcc

SEQ ID NO: 1323745 - DNA, 17 bp, Homo sapiens
ccagcatcccagcctca

SEQ ID NO: 1323746 - DNA, 23 bp, Homo sapiens
ccagcatcccagcctcagaagcc

SEQ ID NO: 1323747 - DNA, 16 bp, Homo sapiens
ccagccctgaggggtg

SEQ ID NO: 1323748 - DNA, 22 bp, Homo sapiens
ccagccctgaggggtggactag

SEQ ID NO: 1323749 - DNA, 13 bp, Homo sapiens
ccagcctctgccc

SEQ ID NO: 1323750 - DNA, 14 bp, Homo sapiens
ccagcctctgcccc

SEQ ID NO: 1323751 - DNA, 15 bp, Homo sapiens
ccagcctctgcccca

SEQ ID NO: 1323752 - DNA, 16 bp, Homo sapiens
ccagcctctgccccac

SEQ ID NO: 1323753 - DNA, 17 bp, Homo sapiens
ccagcctctgccccacc

SEQ ID NO: 1323754 - DNA, 20 bp, Homo sapiens
ccagcctctgccccacccat

SEQ ID NO: 1323755 - DNA, 20 bp, Homo sapiens
ccagcctgtcccactggctc

SEQ ID NO: 1323756 - DNA, 22 bp, Homo sapiens
ccagcctgtcccactggctcct

SEQ ID NO: 1323757 - DNA, 17 bp, Homo sapiens
ccagcgtcctcagcacc

SEQ ID NO: 1323758 - DNA, 19 bp, Homo sapiens
ccagcgtcctcagcacccc

SEQ ID NO: 1323759 - DNA, 18 bp, Homo sapiens
ccagctctacattctgct

SEQ ID NO: 1323760 - DNA, 23 bp, Homo sapiens
ccagctctacattctgctctgcc

SEQ ID NO: 1323761 - DNA, 21 bp, Homo sapiens
ccaggagagcttagggtctca

SEQ ID NO: 1323762 - DNA, 16 bp, Homo sapiens
ccaggagtaagcccaa

SEQ ID NO: 1323763 - DNA, 17 bp, Homo sapiens
ccaggagtaagcccaag

SEQ ID NO: 1323764 - DNA, 13 bp, Homo sapiens
ccaggcaggccca

SEQ ID NO: 1323765 - DNA, 19 bp, Homo sapiens
ccaggcaggcccagcctct

SEQ ID NO: 1323766 - DNA, 22 bp, Homo sapiens
ccaggcaggcccagcctctgcc

SEQ ID NO: 1323767 - DNA, 12 bp, Homo sapiens
ccaggccaggct

SEQ ID NO: 1323768 - DNA, 13 bp, Homo sapiens
ccaggcccaggag

SEQ ID NO: 1323769 - DNA, 22 bp, Homo sapiens
ccaggctcccgaccccatccac

SEQ ID NO: 1323770 - DNA, 15 bp, Homo sapiens
ccagggtctgaaagg

SEQ ID NO: 1323771 - DNA, 18 bp, Homo sapiens
ccagtcccacggctctgt

SEQ ID NO: 1323772 - DNA, 23 bp, Homo sapiens
ccatatttagtataccagagaag

SEQ ID NO: 1323773 - DNA, 19 bp, Homo sapiens
ccatattttacttggaaat

SEQ ID NO: 1323774 - DNA, 16 bp, Homo sapiens
ccatcacccctggtgg

SEQ ID NO: 1323775 - DNA, 17 bp, Homo sapiens
ccatcacccctggtggc

SEQ ID NO: 1323776 - DNA, 23 bp, Homo sapiens
ccatcagtggagtccagatggca

SEQ ID NO: 1323777 - DNA, 16 bp, Homo sapiens
ccatcccgccttctcc

SEQ ID NO: 1323778 - DNA, 17 bp, Homo sapiens
ccatcttccatatccgg

SEQ ID NO: 1323779 - DNA, 18 bp, Homo sapiens
ccatcttccatatccggg

SEQ ID NO: 1323780 - DNA, 17 bp, Homo sapiens
ccatgaaggcacctgcc

SEQ ID NO: 1323781 - DNA, 22 bp, Homo sapiens
ccatgagaatgttttagcacag

SEQ ID NO: 1323782 - DNA, 18 bp, Homo sapiens
ccatgagtccatgtccta

SEQ ID NO: 1323783 - DNA, 19 bp, Homo sapiens
ccatgagtccatgtcctat

SEQ ID NO: 1323784 - DNA, 21 bp, Homo sapiens
ccatgagtccatgtcctatgc

SEQ ID NO: 1323785 - DNA, 22 bp, Homo sapiens
ccatgagtccatgtcctatgcc

SEQ ID NO: 1323786 - DNA, 16 bp, Homo sapiens
ccatgcctaaagccca

SEQ ID NO: 1323787 - DNA, 19 bp, Homo sapiens
ccatgctgagacatccctc

SEQ ID NO: 1323788 - DNA, 13 bp, Homo sapiens
ccatgggagggag

SEQ ID NO: 1323789 - DNA, 18 bp, Homo sapiens
ccatgtcctatgcctcac

SEQ ID NO: 1323790 - DNA, 15 bp, Homo sapiens
ccattgctgcaaatg

SEQ ID NO: 1323791 - DNA, 20 bp, Homo sapiens
ccatttatggaacttccctc

SEQ ID NO: 1323792 - DNA, 15 bp, Homo sapiens
ccattttctgtaaag

SEQ ID NO: 1323793 - DNA, 23 bp, Homo sapiens
ccatttttcccaggcaaataaaa

SEQ ID NO: 1323794 - DNA, 14 bp, Homo sapiens
cccaaatgctggct

SEQ ID NO: 1323795 - DNA, 20 bp, Homo sapiens
cccaaattatcaagctaata

SEQ ID NO: 1323796 - DNA, 21 bp, Homo sapiens
cccaaattatcaagctaataa

SEQ ID NO: 1323797 - DNA, 15 bp, Homo sapiens
cccaacccttcttca

SEQ ID NO: 1323798 - DNA, 15 bp, Homo sapiens
cccaactcagcctgt

SEQ ID NO: 1323799 - DNA, 21 bp, Homo sapiens
cccaactcagcctgttccttc

SEQ ID NO: 1323800 - DNA, 16 bp, Homo sapiens
cccaagactctgctct

SEQ ID NO: 1323801 - DNA, 20 bp, Homo sapiens
cccaagctaagctgcaggca

SEQ ID NO: 1323802 - DNA, 22 bp, Homo sapiens
cccaagctaagctgcaggcaca

SEQ ID NO: 1323803 - DNA, 14 bp, Homo sapiens
cccaccccagaaga

SEQ ID NO: 1323804 - DNA, 17 bp, Homo sapiens
cccaccctctccacacc

SEQ ID NO: 1323805 - DNA, 15 bp, Homo sapiens
cccacggctctgtgc

SEQ ID NO: 1323806 - DNA, 17 bp, Homo sapiens
cccacggctctgtgccc

SEQ ID NO: 1323807 - DNA, 18 bp, Homo sapiens
cccacggctctgtgcccg

SEQ ID NO: 1323808 - DNA, 19 bp, Homo sapiens
cccactggctcctcccagc

SEQ ID NO: 1323809 - DNA, 24 bp, Homo sapiens
cccactggctcctcccagcacagg

SEQ ID NO: 1323810 - DNA, 15 bp, Homo sapiens
cccagaagattagca

SEQ ID NO: 1323811 - DNA, 12 bp, Homo sapiens
cccagacctggc

SEQ ID NO: 1323812 - DNA, 14 bp, Homo sapiens
cccagcacaggcac

SEQ ID NO: 1323813 - DNA, 18 bp, Homo sapiens
cccagccctgaggggtgg

SEQ ID NO: 1323814 - DNA, 20 bp, Homo sapiens
cccagcctcagaagccttct

SEQ ID NO: 1323815 - DNA, 14 bp, Homo sapiens
cccagcctctgccc

SEQ ID NO: 1323816 - DNA, 22 bp, Homo sapiens
cccagcctgtcccactggctcc

SEQ ID NO: 1323817 - DNA, 14 bp, Homo sapiens
cccaggaggtggag

SEQ ID NO: 1323818 - DNA, 14 bp, Homo sapiens
cccaggcaggccca

SEQ ID NO: 1323819 - DNA, 19 bp, Homo sapiens
cccaggcaggcccagcctc

SEQ ID NO: 1323820 - DNA, 13 bp, Homo sapiens
cccaggccaggct

SEQ ID NO: 1323821 - DNA, 19 bp, Homo sapiens
cccatattttacttggaaa

SEQ ID NO: 1323822 - DNA, 16 bp, Homo sapiens
cccatcccgccttctc

SEQ ID NO: 1323823 - DNA, 22 bp, Homo sapiens
cccatgcctaaagcccattgct

SEQ ID NO: 1323824 - DNA, 14 bp, Homo sapiens
ccccaagactctgc

SEQ ID NO: 1323825 - DNA, 16 bp, Homo sapiens
ccccaagactctgctc

SEQ ID NO: 1323826 - DNA, 14 bp, Homo sapiens
ccccacaggtcctc

SEQ ID NO: 1323827 - DNA, 14 bp, Homo sapiens
ccccacagtcttgg

SEQ ID NO: 1323828 - DNA, 16 bp, Homo sapiens
ccccaggacagcacac

SEQ ID NO: 1323829 - DNA, 11 bp, Homo sapiens
cccccactact

SEQ ID NO: 1323830 - DNA, 17 bp, Homo sapiens
ccccgactatccctgca

SEQ ID NO: 1323831 - DNA, 19 bp, Homo sapiens
ccccgactatccctgcaca

SEQ ID NO: 1323832 - DNA, 15 bp, Homo sapiens
ccccgccatggtcac

SEQ ID NO: 1323833 - DNA, 23 bp, Homo sapiens
ccccgggggccaactcacccttg

SEQ ID NO: 1323834 - DNA, 15 bp, Homo sapiens
ccccgtctgcctggc

SEQ ID NO: 1323835 - DNA, 18 bp, Homo sapiens
cccctagatgaagaaaga

SEQ ID NO: 1323836 - DNA, 17 bp, Homo sapiens
cccctagtccggttctt

SEQ ID NO: 1323837 - DNA, 12 bp, Homo sapiens
cccctcaagccc

SEQ ID NO: 1323838 - DNA, 14 bp, Homo sapiens
cccctcaagcccct

SEQ ID NO: 1323839 - DNA, 20 bp, Homo sapiens
cccctcagccacccttggtc

SEQ ID NO: 1323840 - DNA, 13 bp, Homo sapiens
cccctcccagccc

SEQ ID NO: 1323841 - DNA, 13 bp, Homo sapiens
cccctgagcctgt

SEQ ID NO: 1323842 - DNA, 16 bp, Homo sapiens
cccctgagcctgtgtc

SEQ ID NO: 1323843 - DNA, 16 bp, Homo sapiens
cccctggggtgcaggc

SEQ ID NO: 1323844 - DNA, 18 bp, Homo sapiens
cccctggtggctgcaggc

SEQ ID NO: 1323845 - DNA, 23 bp, Homo sapiens
ccccttctctcaatccctttgca

SEQ ID NO: 1323846 - DNA, 13 bp, Homo sapiens
ccccttgctctct

SEQ ID NO: 1323847 - DNA, 14 bp, Homo sapiens
ccccttgctctctg

SEQ ID NO: 1323848 - DNA, 19 bp, Homo sapiens
cccgactatccctgcacat

SEQ ID NO: 1323849 - DNA, 18 bp, Homo sapiens
cccgatccagattcccag

SEQ ID NO: 1323850 - DNA, 21 bp, Homo sapiens
cccgatccagattcccaggcc

SEQ ID NO: 1323851 - DNA, 23 bp, Homo sapiens
cccgatccagattcccaggccag

SEQ ID NO: 1323852 - DNA, 21 bp, Homo sapiens
cccgccatggtcaccctcagg

SEQ ID NO: 1323853 - DNA, 16 bp, Homo sapiens
cccgccccagggtctg

SEQ ID NO: 1323854 - DNA, 16 bp, Homo sapiens
cccggtgccatcttcc

SEQ ID NO: 1323855 - DNA, 18 bp, Homo sapiens
ccctacacacagaccgcg

SEQ ID NO: 1323856 - DNA, 18 bp, Homo sapiens
ccctccgcggcgggccct

SEQ ID NO: 1323857 - DNA, 21 bp, Homo sapiens
ccctccgcggcgggccctgcc

SEQ ID NO: 1323858 - DNA, 16 bp, Homo sapiens
ccctctccacacccag

SEQ ID NO: 1323859 - DNA, 19 bp, Homo sapiens
ccctgaaactactgtatct

SEQ ID NO: 1323860 - DNA, 23 bp, Homo sapiens
ccctgagggcggggtgtctgtct

SEQ ID NO: 1323861 - DNA, 18 bp, Homo sapiens
ccctgcccacacctcctg

SEQ ID NO: 1323862 - DNA, 20 bp, Homo sapiens
ccctgcccacacctcctggg

SEQ ID NO: 1323863 - DNA, 21 bp, Homo sapiens
ccctggggtgcaggcgcctca

SEQ ID NO: 1323864 - DNA, 21 bp, Homo sapiens
ccctgggtcctcgggcccctg

SEQ ID NO: 1323865 - DNA, 14 bp, Homo sapiens
ccctggtggctgca

SEQ ID NO: 1323866 - DNA, 17 bp, Homo sapiens
ccctggtggctgcaggc

SEQ ID NO: 1323867 - DNA, 15 bp, Homo sapiens
ccctgtggtgctggg

SEQ ID NO: 1323868 - DNA, 13 bp, Homo sapiens
cccttgctctctg

SEQ ID NO: 1323869 - DNA, 17 bp, Homo sapiens
cccttgctctctgttct

SEQ ID NO: 1323870 - DNA, 20 bp, Homo sapiens
cccttgctctctgttctctt

SEQ ID NO: 1323871 - DNA, 20 bp, Homo sapiens
cccttggtctcatgccccgc

SEQ ID NO: 1323872 - DNA, 15 bp, Homo sapiens
ccgactatccctgca

SEQ ID NO: 1323873 - DNA, 18 bp, Homo sapiens
ccgccatggtcaccctca

SEQ ID NO: 1323874 - DNA, 19 bp, Homo sapiens
ccgccatggtcaccctcag

SEQ ID NO: 1323875 - DNA, 15 bp, Homo sapiens
ccgcgcccctgggac

SEQ ID NO: 1323876 - DNA, 17 bp, Homo sapiens
ccgctgggttctgactc

SEQ ID NO: 1323877 - DNA, 24 bp, Homo sapiens
ccggagccccaagactctgctctc

SEQ ID NO: 1323878 - DNA, 20 bp, Homo sapiens
ccggccaggtgcctcctgac

SEQ ID NO: 1323879 - DNA, 14 bp, Homo sapiens
ccggccagtggcgg

SEQ ID NO: 1323880 - DNA, 20 bp, Homo sapiens
ccggccagtggcggaagtga

SEQ ID NO: 1323881 - DNA, 12 bp, Homo sapiens
ccggcctggcct

SEQ ID NO: 1323882 - DNA, 13 bp, Homo sapiens
ccggcctggcctt

SEQ ID NO: 1323883 - DNA, 15 bp, Homo sapiens
ccgggggccaactca

SEQ ID NO: 1323884 - DNA, 17 bp, Homo sapiens
ccggtgccatcttccat

SEQ ID NO: 1323885 - DNA, 16 bp, Homo sapiens
ccggttcttcttgtct

SEQ ID NO: 1323886 - DNA, 15 bp, Homo sapiens
ccgtttcaggaccac

SEQ ID NO: 1323887 - DNA, 17 bp, Homo sapiens
cctaaagcccattgctg

SEQ ID NO: 1323888 - DNA, 16 bp, Homo sapiens
cctagatgaagaaaga

SEQ ID NO: 1323889 - DNA, 19 bp, Homo sapiens
cctaggctggaaggaggaa

SEQ ID NO: 1323890 - DNA, 22 bp, Homo sapiens
cctaggggaatgagggggctca

SEQ ID NO: 1323891 - DNA, 16 bp, Homo sapiens
cctatgtggcatgtgg

SEQ ID NO: 1323892 - DNA, 16 bp, Homo sapiens
cctcaactctgctgag

SEQ ID NO: 1323893 - DNA, 19 bp, Homo sapiens
cctcaactctgctgagggt

SEQ ID NO: 1323894 - DNA, 22 bp, Homo sapiens
cctcaactgagaagccaagcct

SEQ ID NO: 1323895 - DNA, 16 bp, Homo sapiens
cctcaagccccttctc

SEQ ID NO: 1323896 - DNA, 17 bp, Homo sapiens
cctcaagccccttctct

SEQ ID NO: 1323897 - DNA, 16 bp, Homo sapiens
cctcacaaatgctgtg

SEQ ID NO: 1323898 - DNA, 14 bp, Homo sapiens
cctcagaagccttc

SEQ ID NO: 1323899 - DNA, 15 bp, Homo sapiens
cctcagaagccttct

SEQ ID NO: 1323900 - DNA, 17 bp, Homo sapiens
cctcagaagccttcttg

SEQ ID NO: 1323901 - DNA, 14 bp, Homo sapiens
cctcagcaccccac

SEQ ID NO: 1323902 - DNA, 17 bp, Homo sapiens
cctcagccacccttggt

SEQ ID NO: 1323903 - DNA, 20 bp, Homo sapiens
cctcagccacccttggtctc

SEQ ID NO: 1323904 - DNA, 17 bp, Homo sapiens
cctcagtaaaagtcttc

SEQ ID NO: 1323905 - DNA, 18 bp, Homo sapiens
cctccatcacccctggtg

SEQ ID NO: 1323906 - DNA, 13 bp, Homo sapiens
cctcccagcacag

SEQ ID NO: 1323907 - DNA, 15 bp, Homo sapiens
cctcccagcacaggc

SEQ ID NO: 1323908 - DNA, 16 bp, Homo sapiens
cctcccagcacaggca

SEQ ID NO: 1323909 - DNA, 22 bp, Homo sapiens
cctcccagcacaggcacctatg

SEQ ID NO: 1323910 - DNA, 15 bp, Homo sapiens
cctccgcggcgggcc

SEQ ID NO: 1323911 - DNA, 18 bp, Homo sapiens
cctccgcggcgggccctg

SEQ ID NO: 1323912 - DNA, 20 bp, Homo sapiens
cctcctgacacacctgcagc

SEQ ID NO: 1323913 - DNA, 22 bp, Homo sapiens
cctcctggggcgcgtgaggccc

SEQ ID NO: 1323914 - DNA, 13 bp, Homo sapiens
cctccttcccagc

SEQ ID NO: 1323915 - DNA, 15 bp, Homo sapiens
cctccttcccagctc

SEQ ID NO: 1323916 - DNA, 16 bp, Homo sapiens
cctccttcccagctct

SEQ ID NO: 1323917 - DNA, 17 bp, Homo sapiens
cctcggctggctcccct

SEQ ID NO: 1323918 - DNA, 21 bp, Homo sapiens
cctcggctggctcccctgcag

SEQ ID NO: 1323919 - DNA, 18 bp, Homo sapiens
cctcgggcccctgagcct

SEQ ID NO: 1323920 - DNA, 16 bp, Homo sapiens
cctcgggccctgtggt

SEQ ID NO: 1323921 - DNA, 21 bp, Homo sapiens
cctcgttagagaatggcctga

SEQ ID NO: 1323922 - DNA, 13 bp, Homo sapiens
cctcgttttcaaa

SEQ ID NO: 1323923 - DNA, 12 bp, Homo sapiens
cctctcagagca

SEQ ID NO: 1323924 - DNA, 19 bp, Homo sapiens
cctctcagagcaagccttt

SEQ ID NO: 1323925 - DNA, 18 bp, Homo sapiens
cctctccacacccagcct

SEQ ID NO: 1323926 - DNA, 15 bp, Homo sapiens
cctctccagcatccc

SEQ ID NO: 1323927 - DNA, 17 bp, Homo sapiens
cctctccagcatcccag

SEQ ID NO: 1323928 - DNA, 18 bp, Homo sapiens
cctctccagcatcccagc

SEQ ID NO: 1323929 - DNA, 19 bp, Homo sapiens
cctctccagcatcccagcc

SEQ ID NO: 1323930 - DNA, 22 bp, Homo sapiens
cctctccagcatcccagcctca

SEQ ID NO: 1323931 - DNA, 15 bp, Homo sapiens
cctctccggcctggc

SEQ ID NO: 1323932 - DNA, 18 bp, Homo sapiens
cctctccggcctggcctt

SEQ ID NO: 1323933 - DNA, 23 bp, Homo sapiens
cctctccggcctggccttttcca

SEQ ID NO: 1323934 - DNA, 21 bp, Homo sapiens
cctctctccactaccccgact

SEQ ID NO: 1323935 - DNA, 14 bp, Homo sapiens
cctctgccatcctc

SEQ ID NO: 1323936 - DNA, 16 bp, Homo sapiens
cctctgccatcctccc

SEQ ID NO: 1323937 - DNA, 18 bp, Homo sapiens
cctctgccatcctccctg

SEQ ID NO: 1323938 - DNA, 22 bp, Homo sapiens
cctctgccatcctccctgttcc

SEQ ID NO: 1323939 - DNA, 15 bp, Homo sapiens
cctcttctctcagac

SEQ ID NO: 1323940 - DNA, 15 bp, Homo sapiens
cctgaaactactgta

SEQ ID NO: 1323941 - DNA, 18 bp, Homo sapiens
cctgacacacctgcagcc

SEQ ID NO: 1323942 - DNA, 15 bp, Homo sapiens
cctgagcctgtgtcc

SEQ ID NO: 1323943 - DNA, 18 bp, Homo sapiens
cctgagggcggggtgtct

SEQ ID NO: 1323944 - DNA, 22 bp, Homo sapiens
cctgagggcggggtgtctgtct

SEQ ID NO: 1323945 - DNA, 18 bp, Homo sapiens
cctgaggtggatttactg

SEQ ID NO: 1323946 - DNA, 20 bp, Homo sapiens
cctgaggtggatttactgag

SEQ ID NO: 1323947 - DNA, 21 bp, Homo sapiens
cctgaggtggatttactgaga

SEQ ID NO: 1323948 - DNA, 17 bp, Homo sapiens
cctgcacataaactccg

SEQ ID NO: 1323949 - DNA, 16 bp, Homo sapiens
cctgcagacctggctg

SEQ ID NO: 1323950 - DNA, 21 bp, Homo sapiens
cctgcagacctggctgggcct

SEQ ID NO: 1323951 - DNA, 13 bp, Homo sapiens
cctgcagccctgg

SEQ ID NO: 1323952 - DNA, 23 bp, Homo sapiens
cctgcagcctccctccgcggcgg

SEQ ID NO: 1323953 - DNA, 21 bp, Homo sapiens
cctgcaggccagtcccacggc

SEQ ID NO: 1323954 - DNA, 16 bp, Homo sapiens
cctgccatggctgtga

SEQ ID NO: 1323955 - DNA, 18 bp, Homo sapiens
cctgccatggctgtgaca

SEQ ID NO: 1323956 - DNA, 17 bp, Homo sapiens
cctgcccacacctcctg

SEQ ID NO: 1323957 - DNA, 18 bp, Homo sapiens
cctgcccacacctcctgg

SEQ ID NO: 1323958 - DNA, 17 bp, Homo sapiens
cctgcccccacagctcc

SEQ ID NO: 1323959 - DNA, 23 bp, Homo sapiens
cctgcccgatccagattcccagg

SEQ ID NO: 1323960 - DNA, 23 bp, Homo sapiens
cctgccttgaacaacccaatctg

SEQ ID NO: 1323961 - DNA, 18 bp, Homo sapiens
cctgctggagaaaccttc

SEQ ID NO: 1323962 - DNA, 17 bp, Homo sapiens
cctggagtaggcctggg

SEQ ID NO: 1323963 - DNA, 18 bp, Homo sapiens
cctggagtaggcctgggg

SEQ ID NO: 1323964 - DNA, 21 bp, Homo sapiens
cctggcaggttgttagaaaaa

SEQ ID NO: 1323965 - DNA, 20 bp, Homo sapiens
cctggcctcaactgagaagc

SEQ ID NO: 1323966 - DNA, 13 bp, Homo sapiens
cctggcctctgcc

SEQ ID NO: 1323967 - DNA, 15 bp, Homo sapiens
cctggcctctgccat

SEQ ID NO: 1323968 - DNA, 13 bp, Homo sapiens
cctggcgccccct

SEQ ID NO: 1323969 - DNA, 11 bp, Homo sapiens
cctggctcccc

SEQ ID NO: 1323970 - DNA, 17 bp, Homo sapiens
cctggctgggcctgggc

SEQ ID NO: 1323971 - DNA, 20 bp, Homo sapiens
cctggctgggcctgggcttc

SEQ ID NO: 1323972 - DNA, 20 bp, Homo sapiens
cctgggactaaagccaggaa

SEQ ID NO: 1323973 - DNA, 22 bp, Homo sapiens
cctgggactaaagccaggaaca

SEQ ID NO: 1323974 - DNA, 14 bp, Homo sapiens
cctgggcccctcag

SEQ ID NO: 1323975 - DNA, 15 bp, Homo sapiens
cctgggcccctcagc

SEQ ID NO: 1323976 - DNA, 22 bp, Homo sapiens
cctggggcgcgtgaggcccgtg

SEQ ID NO: 1323977 - DNA, 22 bp, Homo sapiens
cctgggtcctcgggcccctgag

SEQ ID NO: 1323978 - DNA, 19 bp, Homo sapiens
cctggtcctaggctggaag

SEQ ID NO: 1323979 - DNA, 12 bp, Homo sapiens
cctggtgtgtaa

SEQ ID NO: 1323980 - DNA, 14 bp, Homo sapiens
cctggtgtgtaaat

SEQ ID NO: 1323981 - DNA, 19 bp, Homo sapiens
cctgtaaacactcagctgt

SEQ ID NO: 1323982 - DNA, 20 bp, Homo sapiens
cctgtaaacactcagctgtt

SEQ ID NO: 1323983 - DNA, 16 bp, Homo sapiens
cctgtcccactggctc

SEQ ID NO: 1323984 - DNA, 17 bp, Homo sapiens
cctgtcccactggctcc

SEQ ID NO: 1323985 - DNA, 13 bp, Homo sapiens
cctgtgaggcttt

SEQ ID NO: 1323986 - DNA, 12 bp, Homo sapiens
cctgtgatttct

SEQ ID NO: 1323987 - DNA, 19 bp, Homo sapiens
cctgtgatttctgtgccat

SEQ ID NO: 1323988 - DNA, 22 bp, Homo sapiens
cctgtgtatggtgacctctccg

SEQ ID NO: 1323989 - DNA, 19 bp, Homo sapiens
cctgttccccacaggtcct

SEQ ID NO: 1323990 - DNA, 22 bp, Homo sapiens
cctgttccccacaggtcctcca

SEQ ID NO: 1323991 - DNA, 23 bp, Homo sapiens
ccttaaaactaggcatttgtaaa

SEQ ID NO: 1323992 - DNA, 17 bp, Homo sapiens
ccttcattgaggaagga

SEQ ID NO: 1323993 - DNA, 17 bp, Homo sapiens
ccttcccctcccagccc

SEQ ID NO: 1323994 - DNA, 12 bp, Homo sapiens
ccttcctgcaga

SEQ ID NO: 1323995 - DNA, 19 bp, Homo sapiens
ccttctaccctgggtcctc

SEQ ID NO: 1323996 - DNA, 14 bp, Homo sapiens
ccttcttcatgttc

SEQ ID NO: 1323997 - DNA, 17 bp, Homo sapiens
ccttcttggcttcctgg

SEQ ID NO: 1323998 - DNA, 22 bp, Homo sapiens
ccttgatgaaataacacagcag

SEQ ID NO: 1323999 - DNA, 16 bp, Homo sapiens
ccttggtctcatgccc

SEQ ID NO: 1324000 - DNA, 18 bp, Homo sapiens
ccttggtctcatgccccg

SEQ ID NO: 1324001 - DNA, 16 bp, Homo sapiens
ccttgtggtccaaata

SEQ ID NO: 1324002 - DNA, 18 bp, Homo sapiens
cctttagatagcagcctg

SEQ ID NO: 1324003 - DNA, 21 bp, Homo sapiens
cctttagatagcagcctggct

SEQ ID NO: 1324004 - DNA, 14 bp, Homo sapiens
cctttgcttccctt

SEQ ID NO: 1324005 - DNA, 21 bp, Homo sapiens
ccttttgctgtgtgaaatctt

SEQ ID NO: 1324006 - DNA, 13 bp, Homo sapiens
cctttttgcttga

SEQ ID NO: 1324007 - DNA, 14 bp, Homo sapiens
ccttttttcctttc

SEQ ID NO: 1324008 - DNA, 22 bp, Homo sapiens
cgaaacctgtgatttctgtgcc

SEQ ID NO: 1324009 - DNA, 17 bp, Homo sapiens
cgaagccacaggcctgg

SEQ ID NO: 1324010 - DNA, 22 bp, Homo sapiens
cgaagccacaggcctggcctca

SEQ ID NO: 1324011 - DNA, 14 bp, Homo sapiens
cgaagcccccacta

SEQ ID NO: 1324012 - DNA, 17 bp, Homo sapiens
cgactatccctgcacat

SEQ ID NO: 1324013 - DNA, 21 bp, Homo sapiens
cgatccagattcccaggccag

SEQ ID NO: 1324014 - DNA, 12 bp, Homo sapiens
cgattcacagcc

SEQ ID NO: 1324015 - DNA, 15 bp, Homo sapiens
cgattcacagcctcc

SEQ ID NO: 1324016 - DNA, 20 bp, Homo sapiens
cgatttttaagagccttcaa

SEQ ID NO: 1324017 - DNA, 13 bp, Homo sapiens
cgcacagctgctc

SEQ ID NO: 1324018 - DNA, 22 bp, Homo sapiens
cgcattaagggcctgctggaga

SEQ ID NO: 1324019 - DNA, 19 bp, Homo sapiens
cgccatggtcaccctcagg

SEQ ID NO: 1324020 - DNA, 18 bp, Homo sapiens
cgccttcatgccagtgca

SEQ ID NO: 1324021 - DNA, 23 bp, Homo sapiens
cgccttcatgccagtgcatgcca

SEQ ID NO: 1324022 - DNA, 14 bp, Homo sapiens
cgccttctccaggc

SEQ ID NO: 1324023 - DNA, 13 bp, Homo sapiens
cgcgcccctggga

SEQ ID NO: 1324024 - DNA, 14 bp, Homo sapiens
cgcgctcagatgcc

SEQ ID NO: 1324025 - DNA, 15 bp, Homo sapiens
cgcggcgggccctgc

SEQ ID NO: 1324026 - DNA, 13 bp, Homo sapiens
cgctcactggttt

SEQ ID NO: 1324027 - DNA, 17 bp, Homo sapiens
cgctcagatgccggagc

SEQ ID NO: 1324028 - DNA, 19 bp, Homo sapiens
cgctcagatgccggagccc

SEQ ID NO: 1324029 - DNA, 21 bp, Homo sapiens
cgctcagatgccggagcccca

SEQ ID NO: 1324030 - DNA, 15 bp, Homo sapiens
cgctgcgtgccatga

SEQ ID NO: 1324031 - DNA, 22 bp, Homo sapiens
cgctgggttctgactctggacc

SEQ ID NO: 1324032 - DNA, 18 bp, Homo sapiens
cggaggactggaactgca

SEQ ID NO: 1324033 - DNA, 19 bp, Homo sapiens
cggcctcttctctcagacc

SEQ ID NO: 1324034 - DNA, 19 bp, Homo sapiens
cggctcaggagagggcctt

SEQ ID NO: 1324035 - DNA, 22 bp, Homo sapiens
cggctctgtgcccggtgccatc

SEQ ID NO: 1324036 - DNA, 18 bp, Homo sapiens
cggctggctcccctgcag

SEQ ID NO: 1324037 - DNA, 22 bp, Homo sapiens
cggggcttctgtgcacctgggc

SEQ ID NO: 1324038 - DNA, 22 bp, Homo sapiens
cgggggcaacgattcacagcct

SEQ ID NO: 1324039 - DNA, 22 bp, Homo sapiens
cgggggccaactcacccttggc

SEQ ID NO: 1324040 - DNA, 19 bp, Homo sapiens
cggggtgtctgtcttcctt

SEQ ID NO: 1324041 - DNA, 22 bp, Homo sapiens
cggtgagggtgcggggcctgca

SEQ ID NO: 1324042 - DNA, 18 bp, Homo sapiens
cggttcaaacctgtgaag

SEQ ID NO: 1324043 - DNA, 14 bp, Homo sapiens
cgtcccctcaagcc

SEQ ID NO: 1324044 - DNA, 22 bp, Homo sapiens
cgtcctcagcaccccactcctc

SEQ ID NO: 1324045 - DNA, 19 bp, Homo sapiens
ctaaatggcctctctccac

SEQ ID NO: 1324046 - DNA, 19 bp, Homo sapiens
ctaacaaaaagcaattact

SEQ ID NO: 1324047 - DNA, 16 bp, Homo sapiens
ctaagctgcaggcaca

SEQ ID NO: 1324048 - DNA, 23 bp, Homo sapiens
ctaagctgcaggcacacacgcct

SEQ ID NO: 1324049 - DNA, 17 bp, Homo sapiens
ctaaggtgaccagagtg

SEQ ID NO: 1324050 - DNA, 11 bp, Homo sapiens
ctaataaaact

SEQ ID NO: 1324051 - DNA, 13 bp, Homo sapiens
ctaataaaactga

SEQ ID NO: 1324052 - DNA, 21 bp, Homo sapiens
ctaataaaatatcattcagca

SEQ ID NO: 1324053 - DNA, 22 bp, Homo sapiens
ctaataaaatatcattcagcaa

SEQ ID NO: 1324054 - DNA, 16 bp, Homo sapiens
ctaataaaatattttc

SEQ ID NO: 1324055 - DNA, 17 bp, Homo sapiens
ctaataaaatattttct

SEQ ID NO: 1324056 - DNA, 18 bp, Homo sapiens
ctaataaaatattttctg

SEQ ID NO: 1324057 - DNA, 19 bp, Homo sapiens
ctaataaaatattttctgt

SEQ ID NO: 1324058 - DNA, 20 bp, Homo sapiens
ctacacacagaccgcgcccc

SEQ ID NO: 1324059 - DNA, 21 bp, Homo sapiens
ctacagttgggaagtctcagc

SEQ ID NO: 1324060 - DNA, 11 bp, Homo sapiens
ctacattctgc

SEQ ID NO: 1324061 - DNA, 16 bp, Homo sapiens
ctacattctgctctgc

SEQ ID NO: 1324062 - DNA, 22 bp, Homo sapiens
ctacattctgctctgcccatgc

SEQ ID NO: 1324063 - DNA, 15 bp, Homo sapiens
ctaccccgactatcc

SEQ ID NO: 1324064 - DNA, 17 bp, Homo sapiens
ctaccccgactatccct

SEQ ID NO: 1324065 - DNA, 22 bp, Homo sapiens
ctaccccgactatccctgcaca

SEQ ID NO: 1324066 - DNA, 21 bp, Homo sapiens
ctaccctgggtcctcgggccc

SEQ ID NO: 1324067 - DNA, 14 bp, Homo sapiens
ctaccttgccccaa

SEQ ID NO: 1324068 - DNA, 15 bp, Homo sapiens
ctacgaagccacagg

SEQ ID NO: 1324069 - DNA, 18 bp, Homo sapiens
ctacgaagccacaggcct

SEQ ID NO: 1324070 - DNA, 20 bp, Homo sapiens
ctacgaagccacaggcctgg

SEQ ID NO: 1324071 - DNA, 17 bp, Homo sapiens
ctactaaaaaatataaa

SEQ ID NO: 1324072 - DNA, 17 bp, Homo sapiens
ctactgaaaaaaatgga

SEQ ID NO: 1324073 - DNA, 15 bp, Homo sapiens
ctagactcatactca

SEQ ID NO: 1324074 - DNA, 20 bp, Homo sapiens
ctagatgaagaaagagactg

SEQ ID NO: 1324075 - DNA, 11 bp, Homo sapiens
ctaggccctac

SEQ ID NO: 1324076 - DNA, 13 bp, Homo sapiens
ctaggctcatact

SEQ ID NO: 1324077 - DNA, 14 bp, Homo sapiens
ctaggctggaagga

SEQ ID NO: 1324078 - DNA, 19 bp, Homo sapiens
ctaggctggaaggaggaag

SEQ ID NO: 1324079 - DNA, 15 bp, Homo sapiens
ctagtccggttcttc

SEQ ID NO: 1324080 - DNA, 15 bp, Homo sapiens
ctagtcttgacctct

SEQ ID NO: 1324081 - DNA, 20 bp, Homo sapiens
ctagtcttgacctctccagc

SEQ ID NO: 1324082 - DNA, 21 bp, Homo sapiens
ctagtgctgaagcttattaat

SEQ ID NO: 1324083 - DNA, 17 bp, Homo sapiens
ctatagcccctggtgtg

SEQ ID NO: 1324084 - DNA, 22 bp, Homo sapiens
ctatagcccctggtgtgtaaat

SEQ ID NO: 1324085 - DNA, 19 bp, Homo sapiens
ctatccctgcacataaact

SEQ ID NO: 1324086 - DNA, 21 bp, Homo sapiens
ctatcgggggtgagcgaagcc

SEQ ID NO: 1324087 - DNA, 13 bp, Homo sapiens
ctatgaacttgtc

SEQ ID NO: 1324088 - DNA, 14 bp, Homo sapiens
ctatgtggcatgtg

SEQ ID NO: 1324089 - DNA, 23 bp, Homo sapiens
ctatttcatcagaacagctgttg

SEQ ID NO: 1324090 - DNA, 14 bp, Homo sapiens
ctcaactctgctga

SEQ ID NO: 1324091 - DNA, 18 bp, Homo sapiens
ctcaagccccttctctca

SEQ ID NO: 1324092 - DNA, 22 bp, Homo sapiens
ctcaagtccccgtctgcctggc

SEQ ID NO: 1324093 - DNA, 15 bp, Homo sapiens
ctcaataaacttgtg

SEQ ID NO: 1324094 - DNA, 19 bp, Homo sapiens
ctcaataaacttgtgcctc

SEQ ID NO: 1324095 - DNA, 20 bp, Homo sapiens
ctcaataaacttgtgcctcc

SEQ ID NO: 1324096 - DNA, 21 bp, Homo sapiens
ctcaataaacttgtgcctcca

SEQ ID NO: 1324097 - DNA, 17 bp, Homo sapiens
ctcacaaatgctgtggt

SEQ ID NO: 1324098 - DNA, 16 bp, Homo sapiens
ctcacatggaatgagg

SEQ ID NO: 1324099 - DNA, 19 bp, Homo sapiens
ctcacatggaatgagggtt

SEQ ID NO: 1324100 - DNA, 20 bp, Homo sapiens
ctcacatggaatgagggttt

SEQ ID NO: 1324101 - DNA, 12 bp, Homo sapiens
ctcacccttggc

SEQ ID NO: 1324102 - DNA, 13 bp, Homo sapiens
ctcactttttcat

SEQ ID NO: 1324103 - DNA, 15 bp, Homo sapiens
ctcagaagccttctt

SEQ ID NO: 1324104 - DNA, 15 bp, Homo sapiens
ctcagaccgtcttcc

SEQ ID NO: 1324105 - DNA, 23 bp, Homo sapiens
ctcagaccgtcttcctccaaccc

SEQ ID NO: 1324106 - DNA, 13 bp, Homo sapiens
ctcagagcaagcc

SEQ ID NO: 1324107 - DNA, 17 bp, Homo sapiens
ctcagagcaagcctttg

SEQ ID NO: 1324108 - DNA, 18 bp, Homo sapiens
ctcagagcaagcctttga

SEQ ID NO: 1324109 - DNA, 16 bp, Homo sapiens
ctcagatgccggagcc

SEQ ID NO: 1324110 - DNA, 13 bp, Homo sapiens
ctcagcaccccac

SEQ ID NO: 1324111 - DNA, 14 bp, Homo sapiens
ctcagccacccttg

SEQ ID NO: 1324112 - DNA, 14 bp, Homo sapiens
ctcagcctgttcct

SEQ ID NO: 1324113 - DNA, 16 bp, Homo sapiens
ctcaggaacccaccct

SEQ ID NO: 1324114 - DNA, 23 bp, Homo sapiens
ctcaggaacccaccctctccaca

SEQ ID NO: 1324115 - DNA, 19 bp, Homo sapiens
ctcaggagagggccttccc

SEQ ID NO: 1324116 - DNA, 20 bp, Homo sapiens
ctcaggagagggccttcccc

SEQ ID NO: 1324117 - DNA, 18 bp, Homo sapiens
ctcagtaaaagtcttctc

SEQ ID NO: 1324118 - DNA, 12 bp, Homo sapiens
ctcagtcctcaa

SEQ ID NO: 1324119 - DNA, 19 bp, Homo sapiens
ctcagtcctcaaagctttt

SEQ ID NO: 1324120 - DNA, 22 bp, Homo sapiens
ctcatctagtcttgacctctcc

SEQ ID NO: 1324121 - DNA, 18 bp, Homo sapiens
ctcatgtagaacaagaaa

SEQ ID NO: 1324122 - DNA, 13 bp, Homo sapiens
ctccacacccagc

SEQ ID NO: 1324123 - DNA, 13 bp, Homo sapiens
ctccagcatccca

SEQ ID NO: 1324124 - DNA, 20 bp, Homo sapiens
ctccagcatcccagcctcag

SEQ ID NO: 1324125 - DNA, 13 bp, Homo sapiens
ctccatcacccct

SEQ ID NO: 1324126 - DNA, 13 bp, Homo sapiens
ctcccaactcagc

SEQ ID NO: 1324127 - DNA, 14 bp, Homo sapiens
ctcccaactcagcc

SEQ ID NO: 1324128 - DNA, 17 bp, Homo sapiens
ctcccaactcagcctgt

SEQ ID NO: 1324129 - DNA, 18 bp, Homo sapiens
ctcccaactcagcctgtt

SEQ ID NO: 1324130 - DNA, 19 bp, Homo sapiens
ctcccaactcagcctgttc

SEQ ID NO: 1324131 - DNA, 18 bp, Homo sapiens
ctcccagcacaggcacct

SEQ ID NO: 1324132 - DNA, 23 bp, Homo sapiens
ctcccagcacaggcacctatgtg

SEQ ID NO: 1324133 - DNA, 18 bp, Homo sapiens
ctcccagccctgaggggt

SEQ ID NO: 1324134 - DNA, 15 bp, Homo sapiens
ctccccgggggccaa

SEQ ID NO: 1324135 - DNA, 14 bp, Homo sapiens
ctcccgccccaggg

SEQ ID NO: 1324136 - DNA, 22 bp, Homo sapiens
ctcccgccccagggtctgaaag

SEQ ID NO: 1324137 - DNA, 19 bp, Homo sapiens
ctccctgttccccacaggt

SEQ ID NO: 1324138 - DNA, 22 bp, Homo sapiens
ctccctgttccccacaggtcct

SEQ ID NO: 1324139 - DNA, 14 bp, Homo sapiens
ctccggcctggcct

SEQ ID NO: 1324140 - DNA, 16 bp, Homo sapiens
ctccggcctggccttt

SEQ ID NO: 1324141 - DNA, 19 bp, Homo sapiens
ctcctcagtaaaagtcttc

SEQ ID NO: 1324142 - DNA, 22 bp, Homo sapiens
ctcctcagtaaaagtcttctcc

SEQ ID NO: 1324143 - DNA, 23 bp, Homo sapiens
ctcctcagtaaaagtcttctccc

SEQ ID NO: 1324144 - DNA, 13 bp, Homo sapiens
ctcctcccagcac

SEQ ID NO: 1324145 - DNA, 21 bp, Homo sapiens
ctcctcccagcacaggcacct

SEQ ID NO: 1324146 - DNA, 16 bp, Homo sapiens
ctcctctggagaatct

SEQ ID NO: 1324147 - DNA, 19 bp, Homo sapiens
ctcctggggcgcgtgaggc

SEQ ID NO: 1324148 - DNA, 13 bp, Homo sapiens
ctcctggtcctag

SEQ ID NO: 1324149 - DNA, 13 bp, Homo sapiens
ctccttcccagct

SEQ ID NO: 1324150 - DNA, 21 bp, Homo sapiens
ctccttgcaaactatgagttc

SEQ ID NO: 1324151 - DNA, 21 bp, Homo sapiens
ctcggctggctcccctgcagc

SEQ ID NO: 1324152 - DNA, 16 bp, Homo sapiens
ctcgggcccctgagcc

SEQ ID NO: 1324153 - DNA, 20 bp, Homo sapiens
ctcgggcccctgagcctgtg

SEQ ID NO: 1324154 - DNA, 16 bp, Homo sapiens
ctcgggccctgtggtg

SEQ ID NO: 1324155 - DNA, 23 bp, Homo sapiens
ctcggggaataaaacatttctct

SEQ ID NO: 1324156 - DNA, 19 bp, Homo sapiens
ctcgtgatatgctgcttgt

SEQ ID NO: 1324157 - DNA, 21 bp, Homo sapiens
ctcgtgatatgctgcttgtga

SEQ ID NO: 1324158 - DNA, 20 bp, Homo sapiens
ctcgttagagaatggcctga

SEQ ID NO: 1324159 - DNA, 23 bp, Homo sapiens
ctcgttagagaatggcctgagac

SEQ ID NO: 1324160 - DNA, 14 bp, Homo sapiens
ctcgttttcaaaga

SEQ ID NO: 1324161 - DNA, 20 bp, Homo sapiens
ctctacattctgctctgccc

SEQ ID NO: 1324162 - DNA, 24 bp, Homo sapiens
ctctacattctgctctgcccatgc

SEQ ID NO: 1324163 - DNA, 14 bp, Homo sapiens
ctctagtactgtga

SEQ ID NO: 1324164 - DNA, 13 bp, Homo sapiens
ctctcagagcaag

SEQ ID NO: 1324165 - DNA, 22 bp, Homo sapiens
ctctcagagcaagcctttgacc

SEQ ID NO: 1324166 - DNA, 15 bp, Homo sapiens
ctctccacacccagc

SEQ ID NO: 1324167 - DNA, 16 bp, Homo sapiens
ctctccacacccagcc

SEQ ID NO: 1324168 - DNA, 17 bp, Homo sapiens
ctctccacacccagcct

SEQ ID NO: 1324169 - DNA, 18 bp, Homo sapiens
ctctccacacccagcctg

SEQ ID NO: 1324170 - DNA, 15 bp, Homo sapiens
ctctccagcatccca

SEQ ID NO: 1324171 - DNA, 13 bp, Homo sapiens
ctctcctgtgtct

SEQ ID NO: 1324172 - DNA, 16 bp, Homo sapiens
ctctcgtgatatgctg

SEQ ID NO: 1324173 - DNA, 23 bp, Homo sapiens
ctctcgtgatatgctgcttgtga

SEQ ID NO: 1324174 - DNA, 12 bp, Homo sapiens
ctctctccacta

SEQ ID NO: 1324175 - DNA, 14 bp, Homo sapiens
ctctctccactacc

SEQ ID NO: 1324176 - DNA, 12 bp, Homo sapiens
ctctctgaggca

SEQ ID NO: 1324177 - DNA, 18 bp, Homo sapiens
ctctctgaggcaaggccc

SEQ ID NO: 1324178 - DNA, 19 bp, Homo sapiens
ctctctgaggcaaggccca

SEQ ID NO: 1324179 - DNA, 22 bp, Homo sapiens
ctctctgaggcaaggcccagac

SEQ ID NO: 1324180 - DNA, 13 bp, Homo sapiens
ctctctgttctct

SEQ ID NO: 1324181 - DNA, 18 bp, Homo sapiens
ctctctgttctcttgctt

SEQ ID NO: 1324182 - DNA, 20 bp, Homo sapiens
ctctctgttctcttgcttta

SEQ ID NO: 1324183 - DNA, 14 bp, Homo sapiens
ctctgagtagcttt

SEQ ID NO: 1324184 - DNA, 14 bp, Homo sapiens
ctctgcccatgcct

SEQ ID NO: 1324185 - DNA, 15 bp, Homo sapiens
ctctgcccatgccta

SEQ ID NO: 1324186 - DNA, 19 bp, Homo sapiens
ctctgcccatgcctaaagc

SEQ ID NO: 1324187 - DNA, 11 bp, Homo sapiens
ctctgctctcc

SEQ ID NO: 1324188 - DNA, 14 bp, Homo sapiens
ctctgctgagggtc

SEQ ID NO: 1324189 - DNA, 17 bp, Homo sapiens
ctctgctgagggtccag

SEQ ID NO: 1324190 - DNA, 21 bp, Homo sapiens
ctctgtgcccggtgccatctt

SEQ ID NO: 1324191 - DNA, 23 bp, Homo sapiens
ctctgttatttatccctcattca

SEQ ID NO: 1324192 - DNA, 18 bp, Homo sapiens
ctctgttctcttgcttta

SEQ ID NO: 1324193 - DNA, 11 bp, Homo sapiens
ctctgttgctg

SEQ ID NO: 1324194 - DNA, 23 bp, Homo sapiens
ctcttctctcagaccgtcttcct

SEQ ID NO: 1324195 - DNA, 21 bp, Homo sapiens
ctcttgctttaaagagtcctc

SEQ ID NO: 1324196 - DNA, 17 bp, Homo sapiens
ctgaaactactgtatct

SEQ ID NO: 1324197 - DNA, 13 bp, Homo sapiens
ctgaaatcctggt

SEQ ID NO: 1324198 - DNA, 15 bp, Homo sapiens
ctgaaatcctggttc

SEQ ID NO: 1324199 - DNA, 17 bp, Homo sapiens
ctgaaatcctggttcct

SEQ ID NO: 1324200 - DNA, 14 bp, Homo sapiens
ctgaagaggaggag

SEQ ID NO: 1324201 - DNA, 17 bp, Homo sapiens
ctgaagcttattaatgc

SEQ ID NO: 1324202 - DNA, 16 bp, Homo sapiens
ctgaataccagtggag

SEQ ID NO: 1324203 - DNA, 21 bp, Homo sapiens
ctgacacacctgcagcctccc

SEQ ID NO: 1324204 - DNA, 23 bp, Homo sapiens
ctgacacacctgcagcctccctc

SEQ ID NO: 1324205 - DNA, 23 bp, Homo sapiens
ctgagaagaggaaccgttttaca

SEQ ID NO: 1324206 - DNA, 12 bp, Homo sapiens
ctgagaattgtg

SEQ ID NO: 1324207 - DNA, 17 bp, Homo sapiens
ctgagacatccctcatc

SEQ ID NO: 1324208 - DNA, 20 bp, Homo sapiens
ctgagagaaggtgaaataaa

SEQ ID NO: 1324209 - DNA, 23 bp, Homo sapiens
ctgagagtgccccactgcactcc

SEQ ID NO: 1324210 - DNA, 12 bp, Homo sapiens
ctgagcacctct

SEQ ID NO: 1324211 - DNA, 18 bp, Homo sapiens
ctgagcacctctcagagc

SEQ ID NO: 1324212 - DNA, 19 bp, Homo sapiens
ctgagcacctctcagagca

SEQ ID NO: 1324213 - DNA, 16 bp, Homo sapiens
ctgagcctgtgtcctg

SEQ ID NO: 1324214 - DNA, 20 bp, Homo sapiens
ctgaggcaaggcccagacct

SEQ ID NO: 1324215 - DNA, 20 bp, Homo sapiens
ctgagttatgaaaagataac

SEQ ID NO: 1324216 - DNA, 20 bp, Homo sapiens
ctgagtttacgtggaggggt

SEQ ID NO: 1324217 - DNA, 14 bp, Homo sapiens
ctgatgcagaactt

SEQ ID NO: 1324218 - DNA, 12 bp, Homo sapiens
ctgatgtgaaac

SEQ ID NO: 1324219 - DNA, 14 bp, Homo sapiens
ctgcaactccagcg

SEQ ID NO: 1324220 - DNA, 19 bp, Homo sapiens
ctgcaactccagcgtcctc

SEQ ID NO: 1324221 - DNA, 14 bp, Homo sapiens
ctgcacataaactc

SEQ ID NO: 1324222 - DNA, 20 bp, Homo sapiens
ctgcactccagcctgggtga

SEQ ID NO: 1324223 - DNA, 14 bp, Homo sapiens
ctgcagacctggct

SEQ ID NO: 1324224 - DNA, 19 bp, Homo sapiens
ctgcagacctggctgggcc

SEQ ID NO: 1324225 - DNA, 20 bp, Homo sapiens
ctgcagacctggctgggcct

SEQ ID NO: 1324226 - DNA, 21 bp, Homo sapiens
ctgcagacctggctgggcctg

SEQ ID NO: 1324227 - DNA, 13 bp, Homo sapiens
ctgcagctgggaa

SEQ ID NO: 1324228 - DNA, 15 bp, Homo sapiens
ctgcagctgggaaga

SEQ ID NO: 1324229 - DNA, 18 bp, Homo sapiens
ctgcagctgggaagagga

SEQ ID NO: 1324230 - DNA, 17 bp, Homo sapiens
ctgcaggcacacacgcc

SEQ ID NO: 1324231 - DNA, 20 bp, Homo sapiens
ctgcaggcacacacgccttc

SEQ ID NO: 1324232 - DNA, 13 bp, Homo sapiens
ctgcaggcaccgc

SEQ ID NO: 1324233 - DNA, 13 bp, Homo sapiens
ctgcaggccagtc

SEQ ID NO: 1324234 - DNA, 23 bp, Homo sapiens
ctgcaggccagtcccacggctct

SEQ ID NO: 1324235 - DNA, 13 bp, Homo sapiens
ctgccatcctccc

SEQ ID NO: 1324236 - DNA, 14 bp, Homo sapiens
ctgccattggctat

SEQ ID NO: 1324237 - DNA, 20 bp, Homo sapiens
ctgcccacaacgtcccctca

SEQ ID NO: 1324238 - DNA, 12 bp, Homo sapiens
ctgcccccacag

SEQ ID NO: 1324239 - DNA, 14 bp, Homo sapiens
ctgcccccacagct

SEQ ID NO: 1324240 - DNA, 15 bp, Homo sapiens
ctgcccccacagctc

SEQ ID NO: 1324241 - DNA, 21 bp, Homo sapiens
ctgcccccacagctccttgca

SEQ ID NO: 1324242 - DNA, 23 bp, Homo sapiens
ctgcccgatccagattcccaggc

SEQ ID NO: 1324243 - DNA, 13 bp, Homo sapiens
ctgcgtgccatga

SEQ ID NO: 1324244 - DNA, 18 bp, Homo sapiens
ctgcgtgccatgagtcca

SEQ ID NO: 1324245 - DNA, 17 bp, Homo sapiens
ctgctactgacccagag

SEQ ID NO: 1324246 - DNA, 13 bp, Homo sapiens
ctgctctcctcgg

SEQ ID NO: 1324247 - DNA, 17 bp, Homo sapiens
ctgctctcctcgggccc

SEQ ID NO: 1324248 - DNA, 19 bp, Homo sapiens
ctgctctcctcgggccctg

SEQ ID NO: 1324249 - DNA, 16 bp, Homo sapiens
ctgctctgcccatgcc

SEQ ID NO: 1324250 - DNA, 18 bp, Homo sapiens
ctgctctgcccatgccta

SEQ ID NO: 1324251 - DNA, 23 bp, Homo sapiens
ctgctctgcccatgcctaaagcc

SEQ ID NO: 1324252 - DNA, 17 bp, Homo sapiens
ctgctctttcttcttcc

SEQ ID NO: 1324253 - DNA, 12 bp, Homo sapiens
ctgctgagggtc

SEQ ID NO: 1324254 - DNA, 16 bp, Homo sapiens
ctgctgagggtccaga

SEQ ID NO: 1324255 - DNA, 17 bp, Homo sapiens
ctgctggagaaaccttc

SEQ ID NO: 1324256 - DNA, 19 bp, Homo sapiens
ctgctggagaaaccttcac

SEQ ID NO: 1324257 - DNA, 15 bp, Homo sapiens
ctgcttgtgaccttg

SEQ ID NO: 1324258 - DNA, 21 bp, Homo sapiens
ctgcttgtgaccttgacttgc

SEQ ID NO: 1324259 - DNA, 14 bp, Homo sapiens
ctggaaggaaagca

SEQ ID NO: 1324260 - DNA, 13 bp, Homo sapiens
ctggaaggaggaa

SEQ ID NO: 1324261 - DNA, 14 bp, Homo sapiens
ctggaaggaggaag

SEQ ID NO: 1324262 - DNA, 20 bp, Homo sapiens
ctggaattgatgtttacatg

SEQ ID NO: 1324263 - DNA, 16 bp, Homo sapiens
ctggaccatgctgaga

SEQ ID NO: 1324264 - DNA, 12 bp, Homo sapiens
ctggcccagaag

SEQ ID NO: 1324265 - DNA, 13 bp, Homo sapiens
ctggcccagaagc

SEQ ID NO: 1324266 - DNA, 12 bp, Homo sapiens
ctggcctctgcc

SEQ ID NO: 1324267 - DNA, 15 bp, Homo sapiens
ctggcctctgccatc

SEQ ID NO: 1324268 - DNA, 20 bp, Homo sapiens
ctggccttgtggtccaaata

SEQ ID NO: 1324269 - DNA, 13 bp, Homo sapiens
ctggctcccctgc

SEQ ID NO: 1324270 - DNA, 14 bp, Homo sapiens
ctggctcccctggg

SEQ ID NO: 1324271 - DNA, 16 bp, Homo sapiens
ctggctcctcccagca

SEQ ID NO: 1324272 - DNA, 20 bp, Homo sapiens
ctggctggtaaatgacatct

SEQ ID NO: 1324273 - DNA, 19 bp, Homo sapiens
ctgggaaagccatgacctt

SEQ ID NO: 1324274 - DNA, 16 bp, Homo sapiens
ctgggagatgctctct

SEQ ID NO: 1324275 - DNA, 20 bp, Homo sapiens
ctgggagatgctctctgagg

SEQ ID NO: 1324276 - DNA, 16 bp, Homo sapiens
ctgggcactttggcca

SEQ ID NO: 1324277 - DNA, 20 bp, Homo sapiens
ctgggctctcgcggcctctt

SEQ ID NO: 1324278 - DNA, 15 bp, Homo sapiens
ctgggcttccacagt

SEQ ID NO: 1324279 - DNA, 19 bp, Homo sapiens
ctggggcttctttctgctg

SEQ ID NO: 1324280 - DNA, 20 bp, Homo sapiens
ctgggtcctcgggcccctga

SEQ ID NO: 1324281 - DNA, 22 bp, Homo sapiens
ctgggtcctcgggcccctgagc

SEQ ID NO: 1324282 - DNA, 16 bp, Homo sapiens
ctggtaaatgacatct

SEQ ID NO: 1324283 - DNA, 13 bp, Homo sapiens
ctggtcacacaag

SEQ ID NO: 1324284 - DNA, 21 bp, Homo sapiens
ctggtgatgcgcagttgctgt

SEQ ID NO: 1324285 - DNA, 14 bp, Homo sapiens
ctggtggctgcagg

SEQ ID NO: 1324286 - DNA, 16 bp, Homo sapiens
ctggtggctgcaggca

SEQ ID NO: 1324287 - DNA, 19 bp, Homo sapiens
ctgtaaagatacaagtaag

SEQ ID NO: 1324288 - DNA, 19 bp, Homo sapiens
ctgtataaaggtgtgctgt

SEQ ID NO: 1324289 - DNA, 14 bp, Homo sapiens
ctgtatatagtata

SEQ ID NO: 1324290 - DNA, 18 bp, Homo sapiens
ctgtcacttgcacagagg

SEQ ID NO: 1324291 - DNA, 23 bp, Homo sapiens
ctgtcccactggctcctcccagc

SEQ ID NO: 1324292 - DNA, 19 bp, Homo sapiens
ctgtcttcctttgcttccc

SEQ ID NO: 1324293 - DNA, 16 bp, Homo sapiens
ctgtgatttctgtgcc

SEQ ID NO: 1324294 - DNA, 17 bp, Homo sapiens
ctgtgcaggcccaggca

SEQ ID NO: 1324295 - DNA, 18 bp, Homo sapiens
ctgtgcaggcccaggcag

SEQ ID NO: 1324296 - DNA, 19 bp, Homo sapiens
ctgtgcccggtgccatctt

SEQ ID NO: 1324297 - DNA, 13 bp, Homo sapiens
ctgtggggagggt

SEQ ID NO: 1324298 - DNA, 22 bp, Homo sapiens
ctgtggggagggtcatgtactt

SEQ ID NO: 1324299 - DNA, 22 bp, Homo sapiens
ctgtgggtttgtggggggaggc

SEQ ID NO: 1324300 - DNA, 18 bp, Homo sapiens
ctgtggttcactgcactg

SEQ ID NO: 1324301 - DNA, 19 bp, Homo sapiens
ctgtggttcactgcactgt

SEQ ID NO: 1324302 - DNA, 23 bp, Homo sapiens
ctgtggttcactgcactgttcag

SEQ ID NO: 1324303 - DNA, 14 bp, Homo sapiens
ctgtgtaagctgtg

SEQ ID NO: 1324304 - DNA, 19 bp, Homo sapiens
ctgtgtatggtgacctctc

SEQ ID NO: 1324305 - DNA, 23 bp, Homo sapiens
ctgtgtatggtgacctctccggc

SEQ ID NO: 1324306 - DNA, 17 bp, Homo sapiens
ctgtgtgaaatctttca

SEQ ID NO: 1324307 - DNA, 20 bp, Homo sapiens
ctgttagatgctactaagaa

SEQ ID NO: 1324308 - DNA, 21 bp, Homo sapiens
ctgttcaggagtccaaacctt

SEQ ID NO: 1324309 - DNA, 21 bp, Homo sapiens
ctgttccccacaggtcctcca

SEQ ID NO: 1324310 - DNA, 15 bp, Homo sapiens
ctgttccttcctgca

SEQ ID NO: 1324311 - DNA, 16 bp, Homo sapiens
ctgttccttcctgcag

SEQ ID NO: 1324312 - DNA, 18 bp, Homo sapiens
ctgttccttcctgcagac

SEQ ID NO: 1324313 - DNA, 20 bp, Homo sapiens
ctgttccttcctgcagacct

SEQ ID NO: 1324314 - DNA, 21 bp, Homo sapiens
ctgttccttcctgcagacctg

SEQ ID NO: 1324315 - DNA, 13 bp, Homo sapiens
ctgttctcttgct

SEQ ID NO: 1324316 - DNA, 15 bp, Homo sapiens
ctgttctcttgcttt

SEQ ID NO: 1324317 - DNA, 17 bp, Homo sapiens
ctgttctcttgctttaa

SEQ ID NO: 1324318 - DNA, 16 bp, Homo sapiens
ctgttgacctgcccga

SEQ ID NO: 1324319 - DNA, 24 bp, Homo sapiens
ctgttgttggtcatctctcctgtg

SEQ ID NO: 1324320 - DNA, 20 bp, Homo sapiens
ctgtttctaatttgctgctg

SEQ ID NO: 1324321 - DNA, 23 bp, Homo sapiens
cttaaaactaggcatttgtaaat

SEQ ID NO: 1324322 - DNA, 11 bp, Homo sapiens
cttaacatgct

SEQ ID NO: 1324323 - DNA, 13 bp, Homo sapiens
cttaacatgctgt

SEQ ID NO: 1324324 - DNA, 16 bp, Homo sapiens
cttaactggcccagaa

SEQ ID NO: 1324325 - DNA, 16 bp, Homo sapiens
cttaagcagaggaatt

SEQ ID NO: 1324326 - DNA, 12 bp, Homo sapiens
cttaattctgtt

SEQ ID NO: 1324327 - DNA, 22 bp, Homo sapiens
cttaattctgttctgatattaa

SEQ ID NO: 1324328 - DNA, 12 bp, Homo sapiens
cttaatttggaa

SEQ ID NO: 1324329 - DNA, 13 bp, Homo sapiens
cttaatttggaaa

SEQ ID NO: 1324330 - DNA, 18 bp, Homo sapiens
cttaatttggaaactaat

SEQ ID NO: 1324331 - DNA, 20 bp, Homo sapiens
cttaatttggaaactaataa

SEQ ID NO: 1324332 - DNA, 18 bp, Homo sapiens
cttcagtaaaaggacctc

SEQ ID NO: 1324333 - DNA, 14 bp, Homo sapiens
cttcatctggaagt

SEQ ID NO: 1324334 - DNA, 21 bp, Homo sapiens
cttccacagtgtgaagacact

SEQ ID NO: 1324335 - DNA, 17 bp, Homo sapiens
cttccatatccgggtgc

SEQ ID NO: 1324336 - DNA, 18 bp, Homo sapiens
cttcccacaaagaatata

SEQ ID NO: 1324337 - DNA, 13 bp, Homo sapiens
cttcccctcccag

SEQ ID NO: 1324338 - DNA, 23 bp, Homo sapiens
cttcccctcccagccctgagggg

SEQ ID NO: 1324339 - DNA, 15 bp, Homo sapiens
cttcctgcagacctg

SEQ ID NO: 1324340 - DNA, 19 bp, Homo sapiens
cttcctgcagacctggctg

SEQ ID NO: 1324341 - DNA, 15 bp, Homo sapiens
cttcctttgcttccc

SEQ ID NO: 1324342 - DNA, 14 bp, Homo sapiens
cttctaccctgggt

SEQ ID NO: 1324343 - DNA, 22 bp, Homo sapiens
cttctaggtattcgaaacctgt

SEQ ID NO: 1324344 - DNA, 21 bp, Homo sapiens
cttctcacatggaatgagggt

SEQ ID NO: 1324345 - DNA, 16 bp, Homo sapiens
cttctcccaactcagc

SEQ ID NO: 1324346 - DNA, 18 bp, Homo sapiens
cttctcccaactcagcct

SEQ ID NO: 1324347 - DNA, 20 bp, Homo sapiens
cttctcccaactcagcctgt

SEQ ID NO: 1324348 - DNA, 12 bp, Homo sapiens
cttctctcagac

SEQ ID NO: 1324349 - DNA, 23 bp, Homo sapiens
cttctctctctctcaaaattata

SEQ ID NO: 1324350 - DNA, 21 bp, Homo sapiens
cttctgtgcacctgggctctc

SEQ ID NO: 1324351 - DNA, 13 bp, Homo sapiens
cttcttcatgttc

SEQ ID NO: 1324352 - DNA, 12 bp, Homo sapiens
cttcttcctgga

SEQ ID NO: 1324353 - DNA, 14 bp, Homo sapiens
cttcttgctgccca

SEQ ID NO: 1324354 - DNA, 14 bp, Homo sapiens
cttcttggcttcct

SEQ ID NO: 1324355 - DNA, 17 bp, Homo sapiens
cttcttggcttcctggc

SEQ ID NO: 1324356 - DNA, 18 bp, Homo sapiens
cttcttgtctttgtccct

SEQ ID NO: 1324357 - DNA, 17 bp, Homo sapiens
cttctttctgctggctg

SEQ ID NO: 1324358 - DNA, 16 bp, Homo sapiens
cttgaacccaggaggt

SEQ ID NO: 1324359 - DNA, 14 bp, Homo sapiens
cttgacctctccag

SEQ ID NO: 1324360 - DNA, 16 bp, Homo sapiens
cttgacctctccagca

SEQ ID NO: 1324361 - DNA, 14 bp, Homo sapiens
cttgacttgccatg

SEQ ID NO: 1324362 - DNA, 15 bp, Homo sapiens
cttgacttgccatga

SEQ ID NO: 1324363 - DNA, 12 bp, Homo sapiens
cttgcaaaatgg

SEQ ID NO: 1324364 - DNA, 13 bp, Homo sapiens
cttgcaaaatgga

SEQ ID NO: 1324365 - DNA, 23 bp, Homo sapiens
cttgctcccgccccagggtctga

SEQ ID NO: 1324366 - DNA, 22 bp, Homo sapiens
cttgctctctgttctcttgctt

SEQ ID NO: 1324367 - DNA, 13 bp, Homo sapiens
cttgctgtttctt

SEQ ID NO: 1324368 - DNA, 15 bp, Homo sapiens
cttggaaatattaaa

SEQ ID NO: 1324369 - DNA, 15 bp, Homo sapiens
cttgggtttcctggt

SEQ ID NO: 1324370 - DNA, 15 bp, Homo sapiens
cttggtatctttctg

SEQ ID NO: 1324371 - DNA, 16 bp, Homo sapiens
cttggtctcatgcccc

SEQ ID NO: 1324372 - DNA, 15 bp, Homo sapiens
cttgtagccagaatg

SEQ ID NO: 1324373 - DNA, 22 bp, Homo sapiens
cttgtgaccttgacttgccatg

SEQ ID NO: 1324374 - DNA, 17 bp, Homo sapiens
cttgtgactagtgctga

SEQ ID NO: 1324375 - DNA, 22 bp, Homo sapiens
cttgtgactagtgctgaagctt

SEQ ID NO: 1324376 - DNA, 17 bp, Homo sapiens
ctttaatgttggaagag

SEQ ID NO: 1324377 - DNA, 20 bp, Homo sapiens
ctttagatagcagcctggct

SEQ ID NO: 1324378 - DNA, 23 bp, Homo sapiens
ctttagatagcagcctggctccc

SEQ ID NO: 1324379 - DNA, 21 bp, Homo sapiens
ctttatgtatctaatttcatt

SEQ ID NO: 1324380 - DNA, 14 bp, Homo sapiens
ctttcaagttgcat

SEQ ID NO: 1324381 - DNA, 15 bp, Homo sapiens
ctttccaccttctca

SEQ ID NO: 1324382 - DNA, 23 bp, Homo sapiens
ctttctggggcctaataaaactg

SEQ ID NO: 1324383 - DNA, 11 bp, Homo sapiens
ctttgaagaag

SEQ ID NO: 1324384 - DNA, 19 bp, Homo sapiens
ctttgaagaaggaatcttt

SEQ ID NO: 1324385 - DNA, 22 bp, Homo sapiens
ctttgacagcgcacagctgctc

SEQ ID NO: 1324386 - DNA, 15 bp, Homo sapiens
ctttgacctgttcag

SEQ ID NO: 1324387 - DNA, 17 bp, Homo sapiens
ctttgcaacgctcactg

SEQ ID NO: 1324388 - DNA, 19 bp, Homo sapiens
ctttgttaccttaaaacta

SEQ ID NO: 1324389 - DNA, 12 bp, Homo sapiens
cttttgctgtgt

SEQ ID NO: 1324390 - DNA, 13 bp, Homo sapiens
cttttgctgtgtg

SEQ ID NO: 1324391 - DNA, 17 bp, Homo sapiens
cttttgttgtttcttaa

SEQ ID NO: 1324392 - DNA, 23 bp, Homo sapiens
ctttttaaagcttttgatgtggt

SEQ ID NO: 1324393 - DNA, 18 bp, Homo sapiens
cttttttcctttccacct

SEQ ID NO: 1324394 - DNA, 21 bp, Homo sapiens
gaaaaagtcctgtcagttcag

SEQ ID NO: 1324395 - DNA, 15 bp, Homo sapiens
gaaaaccaacaccat

SEQ ID NO: 1324396 - DNA, 20 bp, Homo sapiens
gaaagcctcctctggagaat

SEQ ID NO: 1324397 - DNA, 19 bp, Homo sapiens
gaaagtcttgtgactagtg

SEQ ID NO: 1324398 - DNA, 23 bp, Homo sapiens
gaaagtttccccaccagtgaatg

SEQ ID NO: 1324399 - DNA, 21 bp, Homo sapiens
gaaataaacgtgcgcggactg

SEQ ID NO: 1324400 - DNA, 15 bp, Homo sapiens
gaaatcctggttcct

SEQ ID NO: 1324401 - DNA, 13 bp, Homo sapiens
gaaatctggccct

SEQ ID NO: 1324402 - DNA, 20 bp, Homo sapiens
gaacaacccaatctggctgg

SEQ ID NO: 1324403 - DNA, 15 bp, Homo sapiens
gaacaatttctctgg

SEQ ID NO: 1324404 - DNA, 21 bp, Homo sapiens
gaacactttcctcttctatga

SEQ ID NO: 1324405 - DNA, 15 bp, Homo sapiens
gaacagggaccagct

SEQ ID NO: 1324406 - DNA, 17 bp, Homo sapiens
gaacagggaccagctcc

SEQ ID NO: 1324407 - DNA, 14 bp, Homo sapiens
gaaccacctacccc

SEQ ID NO: 1324408 - DNA, 22 bp, Homo sapiens
gaacttaacatgctgtgtaagc

SEQ ID NO: 1324409 - DNA, 14 bp, Homo sapiens
gaacttccctcccc

SEQ ID NO: 1324410 - DNA, 15 bp, Homo sapiens
gaacttgtagccaga

SEQ ID NO: 1324411 - DNA, 15 bp, Homo sapiens
gaagacactgtgcag

SEQ ID NO: 1324412 - DNA, 18 bp, Homo sapiens
gaagacttaactggccca

SEQ ID NO: 1324413 - DNA, 22 bp, Homo sapiens
gaagacttaactggcccagaag

SEQ ID NO: 1324414 - DNA, 23 bp, Homo sapiens
gaagacttaactggcccagaagc

SEQ ID NO: 1324415 - DNA, 13 bp, Homo sapiens
gaagattgcctct

SEQ ID NO: 1324416 - DNA, 13 bp, Homo sapiens
gaagccaagcctg

SEQ ID NO: 1324417 - DNA, 13 bp, Homo sapiens
gaagccacaggcc

SEQ ID NO: 1324418 - DNA, 15 bp, Homo sapiens
gaagccttcttgctg

SEQ ID NO: 1324419 - DNA, 15 bp, Homo sapiens
gaagcttattaatgc

SEQ ID NO: 1324420 - DNA, 16 bp, Homo sapiens
gaagcttattaatgct

SEQ ID NO: 1324421 - DNA, 20 bp, Homo sapiens
gaagcttattaatgctaagg

SEQ ID NO: 1324422 - DNA, 21 bp, Homo sapiens
gaagcttattaatgctaaggg

SEQ ID NO: 1324423 - DNA, 23 bp, Homo sapiens
gaagcttattaatgctaagggca

SEQ ID NO: 1324424 - DNA, 13 bp, Homo sapiens
gaagtctcagcct

SEQ ID NO: 1324425 - DNA, 14 bp, Homo sapiens
gaagtttagatgag

SEQ ID NO: 1324426 - DNA, 17 bp, Homo sapiens
gaatacatcttgtttct

SEQ ID NO: 1324427 - DNA, 18 bp, Homo sapiens
gaatagcatgttgtagat

SEQ ID NO: 1324428 - DNA, 21 bp, Homo sapiens
gaatgaaagtcttgtgactag

SEQ ID NO: 1324429 - DNA, 17 bp, Homo sapiens
gaatgagggggctcagt

SEQ ID NO: 1324430 - DNA, 15 bp, Homo sapiens
gaatgagggtttgag

SEQ ID NO: 1324431 - DNA, 15 bp, Homo sapiens
gaatggcctgagaca

SEQ ID NO: 1324432 - DNA, 20 bp, Homo sapiens
gaatgttttagcacagcgtt

SEQ ID NO: 1324433 - DNA, 15 bp, Homo sapiens
gaattgcctgccatg

SEQ ID NO: 1324434 - DNA, 23 bp, Homo sapiens
gaattgtaaaagcaacatcagct

SEQ ID NO: 1324435 - DNA, 18 bp, Homo sapiens
gacactgtgaaatacact

SEQ ID NO: 1324436 - DNA, 22 bp, Homo sapiens
gacactgtgcaggcccaggcag

SEQ ID NO: 1324437 - DNA, 15 bp, Homo sapiens
gacagaattcactgt

SEQ ID NO: 1324438 - DNA, 15 bp, Homo sapiens
gacagcgcacagctg

SEQ ID NO: 1324439 - DNA, 22 bp, Homo sapiens
gacatctacgaagccacaggcc

SEQ ID NO: 1324440 - DNA, 23 bp, Homo sapiens
gacatctacgaagccacaggcct

SEQ ID NO: 1324441 - DNA, 21 bp, Homo sapiens
gacatgggtcgcccatgagag

SEQ ID NO: 1324442 - DNA, 13 bp, Homo sapiens
gaccagctccccg

SEQ ID NO: 1324443 - DNA, 15 bp, Homo sapiens
gaccatgctgagaca

SEQ ID NO: 1324444 - DNA, 15 bp, Homo sapiens
gaccgcgcccctggg

SEQ ID NO: 1324445 - DNA, 18 bp, Homo sapiens
gaccgcgcccctgggact

SEQ ID NO: 1324446 - DNA, 12 bp, Homo sapiens
gaccgtcttcct

SEQ ID NO: 1324447 - DNA, 15 bp, Homo sapiens
gacctctccagcatc

SEQ ID NO: 1324448 - DNA, 21 bp, Homo sapiens
gacctctccagcatcccagcc

SEQ ID NO: 1324449 - DNA, 23 bp, Homo sapiens
gacctctccagcatcccagcctc

SEQ ID NO: 1324450 - DNA, 17 bp, Homo sapiens
gacctctccggcctggc

SEQ ID NO: 1324451 - DNA, 22 bp, Homo sapiens
gacctctccggcctggcctttt

SEQ ID NO: 1324452 - DNA, 16 bp, Homo sapiens
gacctggctgggcctg

SEQ ID NO: 1324453 - DNA, 12 bp, Homo sapiens
gactagtgctga

SEQ ID NO: 1324454 - DNA, 13 bp, Homo sapiens
gactagtgctgaa

SEQ ID NO: 1324455 - DNA, 17 bp, Homo sapiens
gactagtgctgaagctt

SEQ ID NO: 1324456 - DNA, 23 bp, Homo sapiens
gactatagcccctggtgtgtaaa

SEQ ID NO: 1324457 - DNA, 12 bp, Homo sapiens
gactctgctctc

SEQ ID NO: 1324458 - DNA, 16 bp, Homo sapiens
gactctgctctcctcg

SEQ ID NO: 1324459 - DNA, 23 bp, Homo sapiens
gactctgctctcctcgggccctg

SEQ ID NO: 1324460 - DNA, 16 bp, Homo sapiens
gactctggaccatgct

SEQ ID NO: 1324461 - DNA, 10 bp, Homo sapiens
gactggcttg

SEQ ID NO: 1324462 - DNA, 23 bp, Homo sapiens
gactggcttgctcccgccccagg

SEQ ID NO: 1324463 - DNA, 23 bp, Homo sapiens
gactgtgtccccccaaaattcat

SEQ ID NO: 1324464 - DNA, 14 bp, Homo sapiens
gagaagccaagcct

SEQ ID NO: 1324465 - DNA, 15 bp, Homo sapiens
gagaagccaagcctg

SEQ ID NO: 1324466 - DNA, 23 bp, Homo sapiens
gagaatacatcttgtttctgagt

SEQ ID NO: 1324467 - DNA, 17 bp, Homo sapiens
gagaatggcctgagaca

SEQ ID NO: 1324468 - DNA, 16 bp, Homo sapiens
gagaattgtagataat

SEQ ID NO: 1324469 - DNA, 18 bp, Homo sapiens
gagacatccctcatctag

SEQ ID NO: 1324470 - DNA, 14 bp, Homo sapiens
gagagcagccagga

SEQ ID NO: 1324471 - DNA, 14 bp, Homo sapiens
gagagcgcagcccg

SEQ ID NO: 1324472 - DNA, 13 bp, Homo sapiens
gagatatgcattc

SEQ ID NO: 1324473 - DNA, 12 bp, Homo sapiens
gagatgctctct

SEQ ID NO: 1324474 - DNA, 15 bp, Homo sapiens
gagatgctctctgag

SEQ ID NO: 1324475 - DNA, 12 bp, Homo sapiens
gagcaagccttt

SEQ ID NO: 1324476 - DNA, 16 bp, Homo sapiens
gagcacatagccctgt

SEQ ID NO: 1324477 - DNA, 13 bp, Homo sapiens
gagcaccctgagg

SEQ ID NO: 1324478 - DNA, 14 bp, Homo sapiens
gagcaccctgaggg

SEQ ID NO: 1324479 - DNA, 12 bp, Homo sapiens
gagcacctctca

SEQ ID NO: 1324480 - DNA, 22 bp, Homo sapiens
gagcacctctcagagcaagcct

SEQ ID NO: 1324481 - DNA, 14 bp, Homo sapiens
gagcagccaggaga

SEQ ID NO: 1324482 - DNA, 19 bp, Homo sapiens
gagccccaagactctgctc

SEQ ID NO: 1324483 - DNA, 20 bp, Homo sapiens
gagccccaagactctgctct

SEQ ID NO: 1324484 - DNA, 18 bp, Homo sapiens
gagcctgtgtcctgaaga

SEQ ID NO: 1324485 - DNA, 12 bp, Homo sapiens
gagcgcagcccg

SEQ ID NO: 1324486 - DNA, 13 bp, Homo sapiens
gagcttagggtct

SEQ ID NO: 1324487 - DNA, 17 bp, Homo sapiens
gagcttagggtctcagg

SEQ ID NO: 1324488 - DNA, 14 bp, Homo sapiens
gagctttttcactc

SEQ ID NO: 1324489 - DNA, 19 bp, Homo sapiens
gaggcaaggcccagacctg

SEQ ID NO: 1324490 - DNA, 20 bp, Homo sapiens
gaggcccgtggggccggggc

SEQ ID NO: 1324491 - DNA, 18 bp, Homo sapiens
gaggcctgaaatcctggt

SEQ ID NO: 1324492 - DNA, 22 bp, Homo sapiens
gaggcctgaaatcctggttcct

SEQ ID NO: 1324493 - DNA, 15 bp, Homo sapiens
gaggctgactcctgg

SEQ ID NO: 1324494 - DNA, 16 bp, Homo sapiens
gaggctgactcctggt

SEQ ID NO: 1324495 - DNA, 12 bp, Homo sapiens
gagggagctgag

SEQ ID NO: 1324496 - DNA, 15 bp, Homo sapiens
gagggagctgagaag

SEQ ID NO: 1324497 - DNA, 23 bp, Homo sapiens
gagggccttcccctcccagccct

SEQ ID NO: 1324498 - DNA, 14 bp, Homo sapiens
gaggggaatgaggg

SEQ ID NO: 1324499 - DNA, 21 bp, Homo sapiens
gagggtcatgtacttctttat

SEQ ID NO: 1324500 - DNA, 17 bp, Homo sapiens
gagggtctagaggcctg

SEQ ID NO: 1324501 - DNA, 18 bp, Homo sapiens
gagggtgcggggcctgca

SEQ ID NO: 1324502 - DNA, 17 bp, Homo sapiens
gagtccagatggcaggc

SEQ ID NO: 1324503 - DNA, 15 bp, Homo sapiens
gagtcctccttccca

SEQ ID NO: 1324504 - DNA, 23 bp, Homo sapiens
gagtcctccttcccagctctaca

SEQ ID NO: 1324505 - DNA, 19 bp, Homo sapiens
gagtgccccactgcactcc

SEQ ID NO: 1324506 - DNA, 17 bp, Homo sapiens
gagttcacatgtgccct

SEQ ID NO: 1324507 - DNA, 13 bp, Homo sapiens
gagtttgaagagg

SEQ ID NO: 1324508 - DNA, 14 bp, Homo sapiens
gagtttgaagaggt

SEQ ID NO: 1324509 - DNA, 18 bp, Homo sapiens
gatatgcattcaagagag

SEQ ID NO: 1324510 - DNA, 16 bp, Homo sapiens
gatatgctttaagaca

SEQ ID NO: 1324511 - DNA, 12 bp, Homo sapiens
gatcatccccga

SEQ ID NO: 1324512 - DNA, 14 bp, Homo sapiens
gatcatccccgagg

SEQ ID NO: 1324513 - DNA, 18 bp, Homo sapiens
gatcatccccgagggcgg

SEQ ID NO: 1324514 - DNA, 15 bp, Homo sapiens
gatccagattcccag

SEQ ID NO: 1324515 - DNA, 19 bp, Homo sapiens
gatccagattcccaggcca

SEQ ID NO: 1324516 - DNA, 20 bp, Homo sapiens
gatccagattcccaggccag

SEQ ID NO: 1324517 - DNA, 22 bp, Homo sapiens
gatgaattgtaaaagcaacatc

SEQ ID NO: 1324518 - DNA, 16 bp, Homo sapiens
gatgagctttcttttt

SEQ ID NO: 1324519 - DNA, 20 bp, Homo sapiens
gatgataaaaggagaataag

SEQ ID NO: 1324520 - DNA, 12 bp, Homo sapiens
gatgcagaactt

SEQ ID NO: 1324521 - DNA, 22 bp, Homo sapiens
gatgcagaactttctcttttga

SEQ ID NO: 1324522 - DNA, 20 bp, Homo sapiens
gatgctctctgaggcaaggc

SEQ ID NO: 1324523 - DNA, 22 bp, Homo sapiens
gatgctctctgaggcaaggccc

SEQ ID NO: 1324524 - DNA, 22 bp, Homo sapiens
gattcacagcctccgcggactg

SEQ ID NO: 1324525 - DNA, 14 bp, Homo sapiens
gattcccaggccag

SEQ ID NO: 1324526 - DNA, 15 bp, Homo sapiens
gattcccaggccagg

SEQ ID NO: 1324527 - DNA, 18 bp, Homo sapiens
gattcccaggccaggctc

SEQ ID NO: 1324528 - DNA, 17 bp, Homo sapiens
gatttactgagagaagg

SEQ ID NO: 1324529 - DNA, 23 bp, Homo sapiens
gatttctgtgccattttctgtaa

SEQ ID NO: 1324530 - DNA, 19 bp, Homo sapiens
gcaacgattcacagcctcc

SEQ ID NO: 1324531 - DNA, 13 bp, Homo sapiens
gcaacgctcactg

SEQ ID NO: 1324532 - DNA, 22 bp, Homo sapiens
gcaactccagcgtcctcagcac

SEQ ID NO: 1324533 - DNA, 15 bp, Homo sapiens
gcaaggcagaaggcc

SEQ ID NO: 1324534 - DNA, 16 bp, Homo sapiens
gcaaggcccagacctg

SEQ ID NO: 1324535 - DNA, 14 bp, Homo sapiens
gcacagctgctctg

SEQ ID NO: 1324536 - DNA, 13 bp, Homo sapiens
gcacatagccctg

SEQ ID NO: 1324537 - DNA, 22 bp, Homo sapiens
gcacatccttcttggcttcctg

SEQ ID NO: 1324538 - DNA, 23 bp, Homo sapiens
gcacatccttcttggcttcctgg

SEQ ID NO: 1324539 - DNA, 13 bp, Homo sapiens
gcaccccactcct

SEQ ID NO: 1324540 - DNA, 15 bp, Homo sapiens
gcaccctgagggcgg

SEQ ID NO: 1324541 - DNA, 21 bp, Homo sapiens
gcaccgctgggttctgactct

SEQ ID NO: 1324542 - DNA, 22 bp, Homo sapiens
gcaccggggaacaatttctctg

SEQ ID NO: 1324543 - DNA, 12 bp, Homo sapiens
gcacctctcaga

SEQ ID NO: 1324544 - DNA, 17 bp, Homo sapiens
gcacctgcccccacagc

SEQ ID NO: 1324545 - DNA, 15 bp, Homo sapiens
gcagaactttctctt

SEQ ID NO: 1324546 - DNA, 19 bp, Homo sapiens
gcagaactttctcttttga

SEQ ID NO: 1324547 - DNA, 14 bp, Homo sapiens
gcagacctggctgg

SEQ ID NO: 1324548 - DNA, 23 bp, Homo sapiens
gcagaggaattggtgtgccttaa

SEQ ID NO: 1324549 - DNA, 21 bp, Homo sapiens
gcagccaggagagcttagggt

SEQ ID NO: 1324550 - DNA, 14 bp, Homo sapiens
gcagccctggccca

SEQ ID NO: 1324551 - DNA, 10 bp, Homo sapiens
gcaggccagt

SEQ ID NO: 1324552 - DNA, 17 bp, Homo sapiens
gcaggcccagcctctgc

SEQ ID NO: 1324553 - DNA, 18 bp, Homo sapiens
gcaggcccagcctctgcc

SEQ ID NO: 1324554 - DNA, 19 bp, Homo sapiens
gcaggcccagcctctgccc

SEQ ID NO: 1324555 - DNA, 21 bp, Homo sapiens
gcaggcccagcctctgcccca

SEQ ID NO: 1324556 - DNA, 21 bp, Homo sapiens
gcaggcccaggcaggcccagc

SEQ ID NO: 1324557 - DNA, 19 bp, Homo sapiens
gcatcccagcctcagaagc

SEQ ID NO: 1324558 - DNA, 16 bp, Homo sapiens
gcattaagggcctgct

SEQ ID NO: 1324559 - DNA, 19 bp, Homo sapiens
gcattaagggcctgctgga

SEQ ID NO: 1324560 - DNA, 21 bp, Homo sapiens
gcattgcctcggctggctccc

SEQ ID NO: 1324561 - DNA, 23 bp, Homo sapiens
gcattgtgaattgcctgccatgg

SEQ ID NO: 1324562 - DNA, 13 bp, Homo sapiens
gcatttgtaaata

SEQ ID NO: 1324563 - DNA, 15 bp, Homo sapiens
gccaactcacccttg

SEQ ID NO: 1324564 - DNA, 12 bp, Homo sapiens
gccacaggcctg

SEQ ID NO: 1324565 - DNA, 14 bp, Homo sapiens
gccacaggcctggc

SEQ ID NO: 1324566 - DNA, 17 bp, Homo sapiens
gccacaggcctggcctc

SEQ ID NO: 1324567 - DNA, 18 bp, Homo sapiens
gccacaggcctggcctca

SEQ ID NO: 1324568 - DNA, 19 bp, Homo sapiens
gccacatgtgaaaacctgt

SEQ ID NO: 1324569 - DNA, 17 bp, Homo sapiens
gccaccccttgctctct

SEQ ID NO: 1324570 - DNA, 18 bp, Homo sapiens
gccaccccttgctctctg

SEQ ID NO: 1324571 - DNA, 13 bp, Homo sapiens
gccactgaagagg

SEQ ID NO: 1324572 - DNA, 19 bp, Homo sapiens
gccagaatgtaggctggtc

SEQ ID NO: 1324573 - DNA, 21 bp, Homo sapiens
gccagcccctagatgaagaaa

SEQ ID NO: 1324574 - DNA, 22 bp, Homo sapiens
gccagcccctagatgaagaaag

SEQ ID NO: 1324575 - DNA, 13 bp, Homo sapiens
gccaggaagcacg

SEQ ID NO: 1324576 - DNA, 14 bp, Homo sapiens
gccaggagtaagcc

SEQ ID NO: 1324577 - DNA, 19 bp, Homo sapiens
gccaggagtaagcccaagc

SEQ ID NO: 1324578 - DNA, 16 bp, Homo sapiens
gccaggtgcctcctga

SEQ ID NO: 1324579 - DNA, 14 bp, Homo sapiens
gccagtcccacggc

SEQ ID NO: 1324580 - DNA, 22 bp, Homo sapiens
gccagtcccacggctctgtgcc

SEQ ID NO: 1324581 - DNA, 24 bp, Homo sapiens
gccagtcccacggctctgtgcccg

SEQ ID NO: 1324582 - DNA, 23 bp, Homo sapiens
gccatatttagtataccagagaa

SEQ ID NO: 1324583 - DNA, 13 bp, Homo sapiens
gccatcctccctg

SEQ ID NO: 1324584 - DNA, 20 bp, Homo sapiens
gccatgagaatgttttagca

SEQ ID NO: 1324585 - DNA, 22 bp, Homo sapiens
gccatgagaatgttttagcaca

SEQ ID NO: 1324586 - DNA, 16 bp, Homo sapiens
gccatgagtccatgtc

SEQ ID NO: 1324587 - DNA, 16 bp, Homo sapiens
gccatggtcaccctca

SEQ ID NO: 1324588 - DNA, 17 bp, Homo sapiens
gccatggtcaccctcag

SEQ ID NO: 1324589 - DNA, 22 bp, Homo sapiens
gcccacaacgtcccctcaagcc

SEQ ID NO: 1324590 - DNA, 14 bp, Homo sapiens
gcccagacctggcc

SEQ ID NO: 1324591 - DNA, 16 bp, Homo sapiens
gcccagacctggcctc

SEQ ID NO: 1324592 - DNA, 21 bp, Homo sapiens
gcccagacctggcctctgcca

SEQ ID NO: 1324593 - DNA, 12 bp, Homo sapiens
gcccagcctctg

SEQ ID NO: 1324594 - DNA, 14 bp, Homo sapiens
gcccagcctctgcc

SEQ ID NO: 1324595 - DNA, 15 bp, Homo sapiens
gcccagcctctgccc

SEQ ID NO: 1324596 - DNA, 16 bp, Homo sapiens
gcccagcctctgcccc

SEQ ID NO: 1324597 - DNA, 13 bp, Homo sapiens
gcccaggcaggcc

SEQ ID NO: 1324598 - DNA, 14 bp, Homo sapiens
gcccaggcaggccc

SEQ ID NO: 1324599 - DNA, 17 bp, Homo sapiens
gcccaggcaggcccagc

SEQ ID NO: 1324600 - DNA, 21 bp, Homo sapiens
gcccaggcaggcccagcctct

SEQ ID NO: 1324601 - DNA, 20 bp, Homo sapiens
gcccatattttacttggaaa

SEQ ID NO: 1324602 - DNA, 18 bp, Homo sapiens
gcccatcccgccttctcc

SEQ ID NO: 1324603 - DNA, 21 bp, Homo sapiens
gcccatcccgccttctccagg

SEQ ID NO: 1324604 - DNA, 16 bp, Homo sapiens
gcccatgcctaaagcc

SEQ ID NO: 1324605 - DNA, 15 bp, Homo sapiens
gcccattgctgcaaa

SEQ ID NO: 1324606 - DNA, 14 bp, Homo sapiens
gccccaacccttct

SEQ ID NO: 1324607 - DNA, 15 bp, Homo sapiens
gccccaacccttctt

SEQ ID NO: 1324608 - DNA, 16 bp, Homo sapiens
gccccaacccttcttc

SEQ ID NO: 1324609 - DNA, 17 bp, Homo sapiens
gccccaagactctgctc

SEQ ID NO: 1324610 - DNA, 18 bp, Homo sapiens
gccccaagactctgctct

SEQ ID NO: 1324611 - DNA, 20 bp, Homo sapiens
gccccaagactctgctctcc

SEQ ID NO: 1324612 - DNA, 22 bp, Homo sapiens
gccccaagactctgctctcctc

SEQ ID NO: 1324613 - DNA, 12 bp, Homo sapiens
gccccagggtct

SEQ ID NO: 1324614 - DNA, 14 bp, Homo sapiens
gccccagggtctga

SEQ ID NO: 1324615 - DNA, 17 bp, Homo sapiens
gccccagggtctgaaag

SEQ ID NO: 1324616 - DNA, 18 bp, Homo sapiens
gccccagggtctgaaagg

SEQ ID NO: 1324617 - DNA, 12 bp, Homo sapiens
gcccccacagct

SEQ ID NO: 1324618 - DNA, 23 bp, Homo sapiens
gccccgcccgtagatcatccccg

SEQ ID NO: 1324619 - DNA, 19 bp, Homo sapiens
gcccctagatgaagaaaga

SEQ ID NO: 1324620 - DNA, 21 bp, Homo sapiens
gcccctagatgaagaaagaga

SEQ ID NO: 1324621 - DNA, 17 bp, Homo sapiens
gcccctcagccaccctt

SEQ ID NO: 1324622 - DNA, 23 bp, Homo sapiens
gcccctgggactaaagccaggaa

SEQ ID NO: 1324623 - DNA, 15 bp, Homo sapiens
gcccggtgccatctt

SEQ ID NO: 1324624 - DNA, 22 bp, Homo sapiens
gccctacacacagaccgcgccc

SEQ ID NO: 1324625 - DNA, 14 bp, Homo sapiens
gccctgaggggtgg

SEQ ID NO: 1324626 - DNA, 13 bp, Homo sapiens
gccctgcccacac

SEQ ID NO: 1324627 - DNA, 20 bp, Homo sapiens
gccctgcccacacctcctgg

SEQ ID NO: 1324628 - DNA, 17 bp, Homo sapiens
gccctgtggtgctggga

SEQ ID NO: 1324629 - DNA, 17 bp, Homo sapiens
gccctgttgacctgccc

SEQ ID NO: 1324630 - DNA, 18 bp, Homo sapiens
gcccttgggtttcctggt

SEQ ID NO: 1324631 - DNA, 19 bp, Homo sapiens
gccggagccccaagactct

SEQ ID NO: 1324632 - DNA, 21 bp, Homo sapiens
gccggggcttctgtgcacctg

SEQ ID NO: 1324633 - DNA, 13 bp, Homo sapiens
gcctaataaaact

SEQ ID NO: 1324634 - DNA, 16 bp, Homo sapiens
gcctaataaaactgat

SEQ ID NO: 1324635 - DNA, 18 bp, Homo sapiens
gcctaataaaactgatgt

SEQ ID NO: 1324636 - DNA, 22 bp, Homo sapiens
gcctcaactctgctgagggtcc

SEQ ID NO: 1324637 - DNA, 23 bp, Homo sapiens
gcctcaactctgctgagggtcca

SEQ ID NO: 1324638 - DNA, 21 bp, Homo sapiens
gcctcaactgagaagccaagc

SEQ ID NO: 1324639 - DNA, 22 bp, Homo sapiens
gcctcaactgagaagccaagcc

SEQ ID NO: 1324640 - DNA, 16 bp, Homo sapiens
gcctcacaaatgctgt

SEQ ID NO: 1324641 - DNA, 17 bp, Homo sapiens
gcctcacaaatgctgtg

SEQ ID NO: 1324642 - DNA, 17 bp, Homo sapiens
gcctcagaagccttctt

SEQ ID NO: 1324643 - DNA, 18 bp, Homo sapiens
gcctcagaagccttcttg

SEQ ID NO: 1324644 - DNA, 18 bp, Homo sapiens
gcctccgcggactggggt

SEQ ID NO: 1324645 - DNA, 20 bp, Homo sapiens
gcctcctgacacacctgcag

SEQ ID NO: 1324646 - DNA, 23 bp, Homo sapiens
gcctcctgacacacctgcagcct

SEQ ID NO: 1324647 - DNA, 17 bp, Homo sapiens
gcctcggctggctcccc

SEQ ID NO: 1324648 - DNA, 14 bp, Homo sapiens
gcctctccttaaat

SEQ ID NO: 1324649 - DNA, 12 bp, Homo sapiens
gcctctgccatc

SEQ ID NO: 1324650 - DNA, 20 bp, Homo sapiens
gcctctgccatcctccctgt

SEQ ID NO: 1324651 - DNA, 12 bp, Homo sapiens
gcctctgcccca

SEQ ID NO: 1324652 - DNA, 15 bp, Homo sapiens
gcctctgccccaccc

SEQ ID NO: 1324653 - DNA, 16 bp, Homo sapiens
gcctctgccccaccca

SEQ ID NO: 1324654 - DNA, 15 bp, Homo sapiens
gcctcttctctcaga

SEQ ID NO: 1324655 - DNA, 13 bp, Homo sapiens
gcctgcaggccag

SEQ ID NO: 1324656 - DNA, 16 bp, Homo sapiens
gcctgcaggccagtcc

SEQ ID NO: 1324657 - DNA, 19 bp, Homo sapiens
gcctgctggagaaaccttc

SEQ ID NO: 1324658 - DNA, 20 bp, Homo sapiens
gcctgctggagaaaccttca

SEQ ID NO: 1324659 - DNA, 16 bp, Homo sapiens
gcctggagtaggcctg

SEQ ID NO: 1324660 - DNA, 18 bp, Homo sapiens
gcctggagtaggcctggg

SEQ ID NO: 1324661 - DNA, 19 bp, Homo sapiens
gcctggagtaggcctgggg

SEQ ID NO: 1324662 - DNA, 21 bp, Homo sapiens
gcctggcctcaactgagaagc

SEQ ID NO: 1324663 - DNA, 13 bp, Homo sapiens
gcctggctcccct

SEQ ID NO: 1324664 - DNA, 23 bp, Homo sapiens
gcctgggcccctcagccaccctt

SEQ ID NO: 1324665 - DNA, 15 bp, Homo sapiens
gcctgggtgacagag

SEQ ID NO: 1324666 - DNA, 22 bp, Homo sapiens
gcctggtgatgcgcagttgctg

SEQ ID NO: 1324667 - DNA, 16 bp, Homo sapiens
gcctgtcccactggct

SEQ ID NO: 1324668 - DNA, 19 bp, Homo sapiens
gcctgtcccactggctcct

SEQ ID NO: 1324669 - DNA, 16 bp, Homo sapiens
gcctgtgtcctgaaga

SEQ ID NO: 1324670 - DNA, 22 bp, Homo sapiens
gccttcattgaggaaggaaatc

SEQ ID NO: 1324671 - DNA, 13 bp, Homo sapiens
gccttcccctccc

SEQ ID NO: 1324672 - DNA, 13 bp, Homo sapiens
gccttcttgctgc

SEQ ID NO: 1324673 - DNA, 16 bp, Homo sapiens
gccttcttgctgccca

SEQ ID NO: 1324674 - DNA, 23 bp, Homo sapiens
gccttgaacaacccaatctggct

SEQ ID NO: 1324675 - DNA, 15 bp, Homo sapiens
gcctttgacctgttc

SEQ ID NO: 1324676 - DNA, 15 bp, Homo sapiens
gcgaatgcactcagg

SEQ ID NO: 1324677 - DNA, 14 bp, Homo sapiens
gcgcacagctgctc

SEQ ID NO: 1324678 - DNA, 12 bp, Homo sapiens
gcgcccctggga

SEQ ID NO: 1324679 - DNA, 13 bp, Homo sapiens
gcgctcagatgcc

SEQ ID NO: 1324680 - DNA, 19 bp, Homo sapiens
gcgctcagatgccggagcc

SEQ ID NO: 1324681 - DNA, 22 bp, Homo sapiens
gcggcaatcaataaacagcagg

SEQ ID NO: 1324682 - DNA, 17 bp, Homo sapiens
gctaataaaatatcatt

SEQ ID NO: 1324683 - DNA, 20 bp, Homo sapiens
gctaataaaatatcattcag

SEQ ID NO: 1324684 - DNA, 21 bp, Homo sapiens
gctaataaaatatcattcagc

SEQ ID NO: 1324685 - DNA, 14 bp, Homo sapiens
gctacagttgggaa

SEQ ID NO: 1324686 - DNA, 13 bp, Homo sapiens
gctaccttgcccc

SEQ ID NO: 1324687 - DNA, 14 bp, Homo sapiens
gctaccttgcccca

SEQ ID NO: 1324688 - DNA, 23 bp, Homo sapiens
gctcactggttttggccacccct

SEQ ID NO: 1324689 - DNA, 16 bp, Homo sapiens
gctcaggagagggcct

SEQ ID NO: 1324690 - DNA, 17 bp, Homo sapiens
gctcaggagagggcctt

SEQ ID NO: 1324691 - DNA, 22 bp, Homo sapiens
gctcaggagagggccttcccct

SEQ ID NO: 1324692 - DNA, 13 bp, Homo sapiens
gctccaagcacaa

SEQ ID NO: 1324693 - DNA, 19 bp, Homo sapiens
gctcccctgcagccctggc

SEQ ID NO: 1324694 - DNA, 18 bp, Homo sapiens
gctcccgaccccatccac

SEQ ID NO: 1324695 - DNA, 17 bp, Homo sapiens
gctcccgccccagggtc

SEQ ID NO: 1324696 - DNA, 22 bp, Homo sapiens
gctcccgccccagggtctgaaa

SEQ ID NO: 1324697 - DNA, 18 bp, Homo sapiens
gctcctcccagcacaggc

SEQ ID NO: 1324698 - DNA, 19 bp, Homo sapiens
gctctacattctgctctgc

SEQ ID NO: 1324699 - DNA, 20 bp, Homo sapiens
gctctacattctgctctgcc

SEQ ID NO: 1324700 - DNA, 20 bp, Homo sapiens
gctctcctcgggccctgtgg

SEQ ID NO: 1324701 - DNA, 18 bp, Homo sapiens
gctctctgaggcaaggcc

SEQ ID NO: 1324702 - DNA, 21 bp, Homo sapiens
gctctctgaggcaaggcccag

SEQ ID NO: 1324703 - DNA, 13 bp, Homo sapiens
gctctctgttctc

SEQ ID NO: 1324704 - DNA, 18 bp, Homo sapiens
gctctgagtagctttaca

SEQ ID NO: 1324705 - DNA, 17 bp, Homo sapiens
gctctgatgcagaactt

SEQ ID NO: 1324706 - DNA, 19 bp, Homo sapiens
gctctgatgcagaactttc

SEQ ID NO: 1324707 - DNA, 13 bp, Homo sapiens
gctctgcccatgc

SEQ ID NO: 1324708 - DNA, 16 bp, Homo sapiens
gctctgtgcccggtgc

SEQ ID NO: 1324709 - DNA, 21 bp, Homo sapiens
gctctgtgcccggtgccatct

SEQ ID NO: 1324710 - DNA, 10 bp, Homo sapiens
gctctttctt

SEQ ID NO: 1324711 - DNA, 22 bp, Homo sapiens
gctgactataatgcctctcctt

SEQ ID NO: 1324712 - DNA, 17 bp, Homo sapiens
gctgagcacctctcaga

SEQ ID NO: 1324713 - DNA, 16 bp, Homo sapiens
gctgaggcatgagaat

SEQ ID NO: 1324714 - DNA, 20 bp, Homo sapiens
gctgaggcatgagaatcgct

SEQ ID NO: 1324715 - DNA, 17 bp, Homo sapiens
gctgatgggtggacctg

SEQ ID NO: 1324716 - DNA, 22 bp, Homo sapiens
gctgattttcatgaaaatctgc

SEQ ID NO: 1324717 - DNA, 18 bp, Homo sapiens
gctgcaggcacacacgcc

SEQ ID NO: 1324718 - DNA, 15 bp, Homo sapiens
gctgcgtgccatgag

SEQ ID NO: 1324719 - DNA, 19 bp, Homo sapiens
gctgcttgtgaccttgact

SEQ ID NO: 1324720 - DNA, 19 bp, Homo sapiens
gctgctttgttaccttaaa

SEQ ID NO: 1324721 - DNA, 14 bp, Homo sapiens
gctggctcccctgc

SEQ ID NO: 1324722 - DNA, 17 bp, Homo sapiens
gctggctcccctgcagc

SEQ ID NO: 1324723 - DNA, 16 bp, Homo sapiens
gctgggagatgctctc

SEQ ID NO: 1324724 - DNA, 17 bp, Homo sapiens
gctgggagatgctctct

SEQ ID NO: 1324725 - DNA, 23 bp, Homo sapiens
gctgggagatgctctctgaggca

SEQ ID NO: 1324726 - DNA, 19 bp, Homo sapiens
gctgggcctgggcttccac

SEQ ID NO: 1324727 - DNA, 22 bp, Homo sapiens
gctgggcctgggcttccacagt

SEQ ID NO: 1324728 - DNA, 15 bp, Homo sapiens
gctggtaaatgacat

SEQ ID NO: 1324729 - DNA, 15 bp, Homo sapiens
gctggtcacacaagg

SEQ ID NO: 1324730 - DNA, 15 bp, Homo sapiens
gctgtggttcactgc

SEQ ID NO: 1324731 - DNA, 19 bp, Homo sapiens
gctgtggttcactgcactg

SEQ ID NO: 1324732 - DNA, 16 bp, Homo sapiens
gctgtgtgaaatcttt

SEQ ID NO: 1324733 - DNA, 13 bp, Homo sapiens
gctgtttcttgat

SEQ ID NO: 1324734 - DNA, 15 bp, Homo sapiens
gcttagggtctcagg

SEQ ID NO: 1324735 - DNA, 16 bp, Homo sapiens
gcttagggtctcaggg

SEQ ID NO: 1324736 - DNA, 16 bp, Homo sapiens
gcttattaatgctaag

SEQ ID NO: 1324737 - DNA, 13 bp, Homo sapiens
gcttcaggacctg

SEQ ID NO: 1324738 - DNA, 19 bp, Homo sapiens
gcttcagtaaaaggacctc

SEQ ID NO: 1324739 - DNA, 16 bp, Homo sapiens
gcttcccttttttcct

SEQ ID NO: 1324740 - DNA, 14 bp, Homo sapiens
gcttctgagaattg

SEQ ID NO: 1324741 - DNA, 16 bp, Homo sapiens
gcttctgtgcacctgg

SEQ ID NO: 1324742 - DNA, 18 bp, Homo sapiens
gcttctttctgctggctg

SEQ ID NO: 1324743 - DNA, 20 bp, Homo sapiens
gcttgctcccgccccagggt

SEQ ID NO: 1324744 - DNA, 21 bp, Homo sapiens
gcttgctcccgccccagggtc

SEQ ID NO: 1324745 - DNA, 23 bp, Homo sapiens
gcttgtgaccttgacttgccatg

SEQ ID NO: 1324746 - DNA, 22 bp, Homo sapiens
gctttctttttaaagcttttga

SEQ ID NO: 1324747 - DNA, 19 bp, Homo sapiens
gctttgttaccttaaaact

SEQ ID NO: 1324748 - DNA, 16 bp, Homo sapiens
gcttttaattgcacca

SEQ ID NO: 1324749 - DNA, 15 bp, Homo sapiens
ggaaatattaaaaga

SEQ ID NO: 1324750 - DNA, 15 bp, Homo sapiens
ggaacactttcctct

SEQ ID NO: 1324751 - DNA, 14 bp, Homo sapiens
ggaacagggaccag

SEQ ID NO: 1324752 - DNA, 18 bp, Homo sapiens
ggaacccaccctctccac

SEQ ID NO: 1324753 - DNA, 18 bp, Homo sapiens
ggaactgcaactccagcg

SEQ ID NO: 1324754 - DNA, 17 bp, Homo sapiens
ggaacttgtagccagaa

SEQ ID NO: 1324755 - DNA, 18 bp, Homo sapiens
ggaaggaaatctggccct

SEQ ID NO: 1324756 - DNA, 16 bp, Homo sapiens
ggaagtctcagcctgg

SEQ ID NO: 1324757 - DNA, 16 bp, Homo sapiens
ggacagcacacggtga

SEQ ID NO: 1324758 - DNA, 13 bp, Homo sapiens
ggaccagctcccc

SEQ ID NO: 1324759 - DNA, 18 bp, Homo sapiens
ggactaaagccaggaaca

SEQ ID NO: 1324760 - DNA, 22 bp, Homo sapiens
ggacttcccccaccccagaaga

SEQ ID NO: 1324761 - DNA, 23 bp, Homo sapiens
ggacttcccccaccccagaagat

SEQ ID NO: 1324762 - DNA, 12 bp, Homo sapiens
ggactttgttac

SEQ ID NO: 1324763 - DNA, 16 bp, Homo sapiens
ggagaataagaaaagg

SEQ ID NO: 1324764 - DNA, 20 bp, Homo sapiens
ggagacagagggaggacctg

SEQ ID NO: 1324765 - DNA, 19 bp, Homo sapiens
ggagatgctctctgaggca

SEQ ID NO: 1324766 - DNA, 13 bp, Homo sapiens
ggagcaccctgag

SEQ ID NO: 1324767 - DNA, 14 bp, Homo sapiens
ggagcaccctgagg

SEQ ID NO: 1324768 - DNA, 16 bp, Homo sapiens
ggagcaccctgagggc

SEQ ID NO: 1324769 - DNA, 14 bp, Homo sapiens
ggaggaagaatagg

SEQ ID NO: 1324770 - DNA, 14 bp, Homo sapiens
ggaggctgactcct

SEQ ID NO: 1324771 - DNA, 19 bp, Homo sapiens
ggagggtctagaggcctga

SEQ ID NO: 1324772 - DNA, 14 bp, Homo sapiens
ggagtaggcctggg

SEQ ID NO: 1324773 - DNA, 17 bp, Homo sapiens
ggatatagtagccatga

SEQ ID NO: 1324774 - DNA, 17 bp, Homo sapiens
ggatatctgttagatgc

SEQ ID NO: 1324775 - DNA, 17 bp, Homo sapiens
ggatatgctttaagaca

SEQ ID NO: 1324776 - DNA, 20 bp, Homo sapiens
ggatgaattgtaaaagcaac

SEQ ID NO: 1324777 - DNA, 18 bp, Homo sapiens
ggatttactgagagaagg

SEQ ID NO: 1324778 - DNA, 17 bp, Homo sapiens
ggcaaataaaattccct

SEQ ID NO: 1324779 - DNA, 17 bp, Homo sapiens
ggcaaggcccagacctg

SEQ ID NO: 1324780 - DNA, 18 bp, Homo sapiens
ggcaaggcccagacctgg

SEQ ID NO: 1324781 - DNA, 18 bp, Homo sapiens
ggcacctatgtggcatgt

SEQ ID NO: 1324782 - DNA, 21 bp, Homo sapiens
ggcacctatgtggcatgtggt

SEQ ID NO: 1324783 - DNA, 22 bp, Homo sapiens
ggcacctgcccccacagctcct

SEQ ID NO: 1324784 - DNA, 14 bp, Homo sapiens
ggcaggcccagcct

SEQ ID NO: 1324785 - DNA, 19 bp, Homo sapiens
ggcaggcccagcctctgcc

SEQ ID NO: 1324786 - DNA, 17 bp, Homo sapiens
ggcaggctacagttggg

SEQ ID NO: 1324787 - DNA, 17 bp, Homo sapiens
ggcatcatcaataaaac

SEQ ID NO: 1324788 - DNA, 22 bp, Homo sapiens
ggcatttgtaaatattaaacca

SEQ ID NO: 1324789 - DNA, 16 bp, Homo sapiens
ggccaccccttgctct

SEQ ID NO: 1324790 - DNA, 12 bp, Homo sapiens
ggccactgaaga

SEQ ID NO: 1324791 - DNA, 17 bp, Homo sapiens
ggccaggagtaagccca

SEQ ID NO: 1324792 - DNA, 21 bp, Homo sapiens
ggccaggagtaagcccaagct

SEQ ID NO: 1324793 - DNA, 14 bp, Homo sapiens
ggccaggtgcctcc

SEQ ID NO: 1324794 - DNA, 23 bp, Homo sapiens
ggcccaaattatcaagctaataa

SEQ ID NO: 1324795 - DNA, 17 bp, Homo sapiens
ggcccagacctggcctc

SEQ ID NO: 1324796 - DNA, 18 bp, Homo sapiens
ggcccagacctggcctct

SEQ ID NO: 1324797 - DNA, 12 bp, Homo sapiens
ggcccagcctct

SEQ ID NO: 1324798 - DNA, 14 bp, Homo sapiens
ggcccagcctctgc

SEQ ID NO: 1324799 - DNA, 14 bp, Homo sapiens
ggcccaggcaggcc

SEQ ID NO: 1324800 - DNA, 16 bp, Homo sapiens
ggcccaggcaggccca

SEQ ID NO: 1324801 - DNA, 17 bp, Homo sapiens
ggcccaggcaggcccag

SEQ ID NO: 1324802 - DNA, 14 bp, Homo sapiens
ggcccatcatgggg

SEQ ID NO: 1324803 - DNA, 17 bp, Homo sapiens
ggcccatcccgccttct

SEQ ID NO: 1324804 - DNA, 23 bp, Homo sapiens
ggcccatcccgccttctccaggc

SEQ ID NO: 1324805 - DNA, 12 bp, Homo sapiens
ggcccctcagcc

SEQ ID NO: 1324806 - DNA, 15 bp, Homo sapiens
ggcccctcagccacc

SEQ ID NO: 1324807 - DNA, 15 bp, Homo sapiens
ggcccctgagcctgt

SEQ ID NO: 1324808 - DNA, 15 bp, Homo sapiens
ggccctgtggtgctg

SEQ ID NO: 1324809 - DNA, 13 bp, Homo sapiens
ggcctaataaaac

SEQ ID NO: 1324810 - DNA, 23 bp, Homo sapiens
ggcctaataaaactgatgtgaaa

SEQ ID NO: 1324811 - DNA, 16 bp, Homo sapiens
ggcctctctccactac

SEQ ID NO: 1324812 - DNA, 16 bp, Homo sapiens
ggcctctgccatcctc

SEQ ID NO: 1324813 - DNA, 16 bp, Homo sapiens
ggcctcttctctcaga

SEQ ID NO: 1324814 - DNA, 16 bp, Homo sapiens
ggcctgggcttccaca

SEQ ID NO: 1324815 - DNA, 20 bp, Homo sapiens
ggccttcccctcccagccct

SEQ ID NO: 1324816 - DNA, 14 bp, Homo sapiens
ggccttgtggtcca

SEQ ID NO: 1324817 - DNA, 18 bp, Homo sapiens
ggccttgtggtccaaata

SEQ ID NO: 1324818 - DNA, 22 bp, Homo sapiens
ggcgcctcaactctgctgaggg

SEQ ID NO: 1324819 - DNA, 23 bp, Homo sapiens
ggcgcctcaactctgctgagggt

SEQ ID NO: 1324820 - DNA, 18 bp, Homo sapiens
ggcgcgtgaggcccgtgg

SEQ ID NO: 1324821 - DNA, 23 bp, Homo sapiens
ggctacagttgggaagtctcagc

SEQ ID NO: 1324822 - DNA, 17 bp, Homo sapiens
ggctcaggagagggcct

SEQ ID NO: 1324823 - DNA, 18 bp, Homo sapiens
ggctcccctgcagccctg

SEQ ID NO: 1324824 - DNA, 12 bp, Homo sapiens
ggctcccctggg

SEQ ID NO: 1324825 - DNA, 19 bp, Homo sapiens
ggctcccgaccccatccac

SEQ ID NO: 1324826 - DNA, 13 bp, Homo sapiens
ggctcctcccagc

SEQ ID NO: 1324827 - DNA, 13 bp, Homo sapiens
ggctctgtgcccg

SEQ ID NO: 1324828 - DNA, 15 bp, Homo sapiens
ggctcttggtatctt

SEQ ID NO: 1324829 - DNA, 18 bp, Homo sapiens
ggctgatgggtggacctg

SEQ ID NO: 1324830 - DNA, 14 bp, Homo sapiens
ggctgcaggcaccg

SEQ ID NO: 1324831 - DNA, 14 bp, Homo sapiens
ggctggaaggagga

SEQ ID NO: 1324832 - DNA, 14 bp, Homo sapiens
ggctggctcccctg

SEQ ID NO: 1324833 - DNA, 15 bp, Homo sapiens
ggctggctcccctgc

SEQ ID NO: 1324834 - DNA, 16 bp, Homo sapiens
ggctggctcccctgca

SEQ ID NO: 1324835 - DNA, 18 bp, Homo sapiens
ggctggctcccctgcagc

SEQ ID NO: 1324836 - DNA, 21 bp, Homo sapiens
ggctggctcccctgcagccct

SEQ ID NO: 1324837 - DNA, 21 bp, Homo sapiens
ggctgggcctgggcttccaca

SEQ ID NO: 1324838 - DNA, 10 bp, Homo sapiens
ggcttcctgg

SEQ ID NO: 1324839 - DNA, 11 bp, Homo sapiens
ggcttcctggc

SEQ ID NO: 1324840 - DNA, 14 bp, Homo sapiens
ggcttcctggcgcc

SEQ ID NO: 1324841 - DNA, 22 bp, Homo sapiens
ggcttctgtgcacctgggctct

SEQ ID NO: 1324842 - DNA, 19 bp, Homo sapiens
ggcttgctcccgccccagg

SEQ ID NO: 1324843 - DNA, 20 bp, Homo sapiens
ggctttgtggcatgtgcctg

SEQ ID NO: 1324844 - DNA, 18 bp, Homo sapiens
gggaacttgtagccagaa

SEQ ID NO: 1324845 - DNA, 12 bp, Homo sapiens
gggaatgagggg

SEQ ID NO: 1324846 - DNA, 22 bp, Homo sapiens
gggacatgggtcgcccatgaga

SEQ ID NO: 1324847 - DNA, 12 bp, Homo sapiens
gggaccagctcc

SEQ ID NO: 1324848 - DNA, 13 bp, Homo sapiens
gggaccagctccc

SEQ ID NO: 1324849 - DNA, 14 bp, Homo sapiens
gggaccagctcccc

SEQ ID NO: 1324850 - DNA, 17 bp, Homo sapiens
gggactaaagccaggaa

SEQ ID NO: 1324851 - DNA, 21 bp, Homo sapiens
gggatagtttgggggaacttg

SEQ ID NO: 1324852 - DNA, 12 bp, Homo sapiens
gggcccctcagc

SEQ ID NO: 1324853 - DNA, 16 bp, Homo sapiens
gggcctaataaaactg

SEQ ID NO: 1324854 - DNA, 15 bp, Homo sapiens
gggcctgcaggccag

SEQ ID NO: 1324855 - DNA, 16 bp, Homo sapiens
gggctctgatgcagaa

SEQ ID NO: 1324856 - DNA, 14 bp, Homo sapiens
gggcttccacagtg

SEQ ID NO: 1324857 - DNA, 16 bp, Homo sapiens
gggcttccacagtgtg

SEQ ID NO: 1324858 - DNA, 14 bp, Homo sapiens
ggggaatgaggggg

SEQ ID NO: 1324859 - DNA, 20 bp, Homo sapiens
ggggaatgagggggctcagt

SEQ ID NO: 1324860 - DNA, 22 bp, Homo sapiens
ggggagggtcatgtacttcttt

SEQ ID NO: 1324861 - DNA, 16 bp, Homo sapiens
ggggcaccggctcagg

SEQ ID NO: 1324862 - DNA, 17 bp, Homo sapiens
ggggcctgcaggccagt

SEQ ID NO: 1324863 - DNA, 21 bp, Homo sapiens
ggggcttctgtgcacctgggc

SEQ ID NO: 1324864 - DNA, 22 bp, Homo sapiens
ggggcttctttctgctggctga

SEQ ID NO: 1324865 - DNA, 18 bp, Homo sapiens
gggggagcaccctgaggg

SEQ ID NO: 1324866 - DNA, 10 bp, Homo sapiens
ggggggaggc

SEQ ID NO: 1324867 - DNA, 12 bp, Homo sapiens
gggggtgagcga

SEQ ID NO: 1324868 - DNA, 19 bp, Homo sapiens
gggggtgagcgaagccccc

SEQ ID NO: 1324869 - DNA, 12 bp, Homo sapiens
gggtcctcgggc

SEQ ID NO: 1324870 - DNA, 22 bp, Homo sapiens
gggtctcagggtgtcccagacc

SEQ ID NO: 1324871 - DNA, 18 bp, Homo sapiens
gggtgcggggcctgcagg

SEQ ID NO: 1324872 - DNA, 17 bp, Homo sapiens
gggtgtcccagaccccg

SEQ ID NO: 1324873 - DNA, 18 bp, Homo sapiens
gggtgtctgtcttccttt

SEQ ID NO: 1324874 - DNA, 15 bp, Homo sapiens
gggttctgtaaaatg

SEQ ID NO: 1324875 - DNA, 22 bp, Homo sapiens
gggttctgtaaaatggaaaact

SEQ ID NO: 1324876 - DNA, 21 bp, Homo sapiens
gggtttgagagagcagccagg

SEQ ID NO: 1324877 - DNA, 16 bp, Homo sapiens
ggtaattcaccaattt

SEQ ID NO: 1324878 - DNA, 20 bp, Homo sapiens
ggtagattttaagaatggtc

SEQ ID NO: 1324879 - DNA, 14 bp, Homo sapiens
ggtcctaggctgga

SEQ ID NO: 1324880 - DNA, 19 bp, Homo sapiens
ggtcctccatcacccctgg

SEQ ID NO: 1324881 - DNA, 16 bp, Homo sapiens
ggtcctcgggcccctg

SEQ ID NO: 1324882 - DNA, 18 bp, Homo sapiens
ggtcgcccatgagagcgc

SEQ ID NO: 1324883 - DNA, 18 bp, Homo sapiens
ggtctcagggtgtcccag

SEQ ID NO: 1324884 - DNA, 14 bp, Homo sapiens
ggtctgaaaggggt

SEQ ID NO: 1324885 - DNA, 13 bp, Homo sapiens
ggtcttctcagtt

SEQ ID NO: 1324886 - DNA, 18 bp, Homo sapiens
ggtgacctccggccaggt

SEQ ID NO: 1324887 - DNA, 13 bp, Homo sapiens
ggtgagcgaagcc

SEQ ID NO: 1324888 - DNA, 13 bp, Homo sapiens
ggtgcaggcgcct

SEQ ID NO: 1324889 - DNA, 23 bp, Homo sapiens
ggtgctcaataaacttgtgcctc

SEQ ID NO: 1324890 - DNA, 21 bp, Homo sapiens
ggtgctgggagatgctctctg

SEQ ID NO: 1324891 - DNA, 16 bp, Homo sapiens
ggtgtcccagaccccg

SEQ ID NO: 1324892 - DNA, 23 bp, Homo sapiens
ggttcttcttgtctttgtccctg

SEQ ID NO: 1324893 - DNA, 12 bp, Homo sapiens
ggttttctgttt

SEQ ID NO: 1324894 - DNA, 17 bp, Homo sapiens
gtaaaagcaacatcagc

SEQ ID NO: 1324895 - DNA, 18 bp, Homo sapiens
gtaaaagcaacatcagct

SEQ ID NO: 1324896 - DNA, 13 bp, Homo sapiens
gtaaaatggaaaa

SEQ ID NO: 1324897 - DNA, 15 bp, Homo sapiens
gtaaacactcagctg

SEQ ID NO: 1324898 - DNA, 12 bp, Homo sapiens
gtaaatattaaa

SEQ ID NO: 1324899 - DNA, 20 bp, Homo sapiens
gtaattcaccaatttccttt

SEQ ID NO: 1324900 - DNA, 20 bp, Homo sapiens
gtacaggacatgtactgaga

SEQ ID NO: 1324901 - DNA, 11 bp, Homo sapiens
gtactgtgaat

SEQ ID NO: 1324902 - DNA, 18 bp, Homo sapiens
gtagatcatccccgaggg

SEQ ID NO: 1324903 - DNA, 19 bp, Homo sapiens
gtagatcatccccgagggc

SEQ ID NO: 1324904 - DNA, 18 bp, Homo sapiens
gtagattttaagaatggt

SEQ ID NO: 1324905 - DNA, 16 bp, Homo sapiens
gtataaagtcattaac

SEQ ID NO: 1324906 - DNA, 18 bp, Homo sapiens
gtattcgaaacctgtgat

SEQ ID NO: 1324907 - DNA, 22 bp, Homo sapiens
gtcaccctcaggaacccaccct

SEQ ID NO: 1324908 - DNA, 15 bp, Homo sapiens
gtcatgtacttcttt

SEQ ID NO: 1324909 - DNA, 16 bp, Homo sapiens
gtcattttgactggct

SEQ ID NO: 1324910 - DNA, 15 bp, Homo sapiens
gtccagatggcaggc

SEQ ID NO: 1324911 - DNA, 14 bp, Homo sapiens
gtccatgtcctatg

SEQ ID NO: 1324912 - DNA, 18 bp, Homo sapiens
gtccatgtcctatgcctc

SEQ ID NO: 1324913 - DNA, 19 bp, Homo sapiens
gtccatgtcctatgcctca

SEQ ID NO: 1324914 - DNA, 13 bp, Homo sapiens
gtcccctcaagcc

SEQ ID NO: 1324915 - DNA, 17 bp, Homo sapiens
gtcctaggctggaagga

SEQ ID NO: 1324916 - DNA, 22 bp, Homo sapiens
gtcctaggctggaaggaggaag

SEQ ID NO: 1324917 - DNA, 17 bp, Homo sapiens
gtcctccatcacccctg

SEQ ID NO: 1324918 - DNA, 17 bp, Homo sapiens
gtcctccttcccagctc

SEQ ID NO: 1324919 - DNA, 21 bp, Homo sapiens
gtcctccttcccagctctaca

SEQ ID NO: 1324920 - DNA, 20 bp, Homo sapiens
gtcctcgggcccctgagcct

SEQ ID NO: 1324921 - DNA, 21 bp, Homo sapiens
gtcctgtaaacactcagctgt

SEQ ID NO: 1324922 - DNA, 17 bp, Homo sapiens
gtccttaagcagaggaa

SEQ ID NO: 1324923 - DNA, 22 bp, Homo sapiens
gtctatttcatcagaacagctg

SEQ ID NO: 1324924 - DNA, 12 bp, Homo sapiens
gtctcagcctgg

SEQ ID NO: 1324925 - DNA, 21 bp, Homo sapiens
gtctcagcctgggcccctcag

SEQ ID NO: 1324926 - DNA, 23 bp, Homo sapiens
gtctcagcctgggcccctcagcc

SEQ ID NO: 1324927 - DNA, 13 bp, Homo sapiens
gtctgaaaggggt

SEQ ID NO: 1324928 - DNA, 15 bp, Homo sapiens
gtctgaaaggggtgt

SEQ ID NO: 1324929 - DNA, 19 bp, Homo sapiens
gtcttcctttgcttccctt

SEQ ID NO: 1324930 - DNA, 19 bp, Homo sapiens
gtcttctcccaactcagcc

SEQ ID NO: 1324931 - DNA, 20 bp, Homo sapiens
gtcttctcccaactcagcct

SEQ ID NO: 1324932 - DNA, 19 bp, Homo sapiens
gtcttgtgactagtgctga

SEQ ID NO: 1324933 - DNA, 17 bp, Homo sapiens
gtgaattgcctgccatg

SEQ ID NO: 1324934 - DNA, 19 bp, Homo sapiens
gtgacctccggccaggtgc

SEQ ID NO: 1324935 - DNA, 21 bp, Homo sapiens
gtgacctctccggcctggcct

SEQ ID NO: 1324936 - DNA, 18 bp, Homo sapiens
gtgaccttgacttgccat

SEQ ID NO: 1324937 - DNA, 22 bp, Homo sapiens
gtgactagtgctgaagcttatt

SEQ ID NO: 1324938 - DNA, 18 bp, Homo sapiens
gtgagaattgggactctg

SEQ ID NO: 1324939 - DNA, 13 bp, Homo sapiens
gtgagcgaagccc

SEQ ID NO: 1324940 - DNA, 14 bp, Homo sapiens
gtgatatgctgctt

SEQ ID NO: 1324941 - DNA, 15 bp, Homo sapiens
gtgatgcgcagttgc

SEQ ID NO: 1324942 - DNA, 19 bp, Homo sapiens
gtgatgtacgctgcgtgcc

SEQ ID NO: 1324943 - DNA, 19 bp, Homo sapiens
gtgatgtcctgtaaacact

SEQ ID NO: 1324944 - DNA, 12 bp, Homo sapiens
gtgcaggcccag

SEQ ID NO: 1324945 - DNA, 19 bp, Homo sapiens
gtgcaggcccaggcaggcc

SEQ ID NO: 1324946 - DNA, 12 bp, Homo sapiens
gtgccctgcctt

SEQ ID NO: 1324947 - DNA, 20 bp, Homo sapiens
gtgcggggcctgcaggccag

SEQ ID NO: 1324948 - DNA, 13 bp, Homo sapiens
gtgctcaataaac

SEQ ID NO: 1324949 - DNA, 14 bp, Homo sapiens
gtgctcaataaact

SEQ ID NO: 1324950 - DNA, 15 bp, Homo sapiens
gtgctcaataaactt

SEQ ID NO: 1324951 - DNA, 19 bp, Homo sapiens
gtgctcaataaacttgtgc

SEQ ID NO: 1324952 - DNA, 21 bp, Homo sapiens
gtgctcaataaacttgtgcct

SEQ ID NO: 1324953 - DNA, 22 bp, Homo sapiens
gtgctcaataaacttgtgcctc

SEQ ID NO: 1324954 - DNA, 18 bp, Homo sapiens
gtgctgggagatgctctc

SEQ ID NO: 1324955 - DNA, 20 bp, Homo sapiens
gtggactaggccctacacac

SEQ ID NO: 1324956 - DNA, 21 bp, Homo sapiens
gtggagtccagatggcaggct

SEQ ID NO: 1324957 - DNA, 22 bp, Homo sapiens
gtggagtccagatggcaggcta

SEQ ID NO: 1324958 - DNA, 14 bp, Homo sapiens
gtggattgctcatc

SEQ ID NO: 1324959 - DNA, 13 bp, Homo sapiens
gtggatttactga

SEQ ID NO: 1324960 - DNA, 21 bp, Homo sapiens
gtggctgcaggcaccgctggg

SEQ ID NO: 1324961 - DNA, 19 bp, Homo sapiens
gtgggtttgtggggggagg

SEQ ID NO: 1324962 - DNA, 14 bp, Homo sapiens
gtgtaatattactt

SEQ ID NO: 1324963 - DNA, 21 bp, Homo sapiens
gtgtcctgaagaatctcgact

SEQ ID NO: 1324964 - DNA, 23 bp, Homo sapiens
gtgtgaagacactgtgcaggccc

SEQ ID NO: 1324965 - DNA, 11 bp, Homo sapiens
gtgtgttcctg

SEQ ID NO: 1324966 - DNA, 12 bp, Homo sapiens
gtgtgttcctgg

SEQ ID NO: 1324967 - DNA, 21 bp, Homo sapiens
gtgttagactatagcccctgg

SEQ ID NO: 1324968 - DNA, 11 bp, Homo sapiens
gtgttcctggc

SEQ ID NO: 1324969 - DNA, 22 bp, Homo sapiens
gttaaagtgaggccactgaaga

SEQ ID NO: 1324970 - DNA, 13 bp, Homo sapiens
gttaatactgaga

SEQ ID NO: 1324971 - DNA, 17 bp, Homo sapiens
gttcaattatttccccc

SEQ ID NO: 1324972 - DNA, 15 bp, Homo sapiens
gttcacatgtgccct

SEQ ID NO: 1324973 - DNA, 14 bp, Homo sapiens
gttcattcattcag

SEQ ID NO: 1324974 - DNA, 17 bp, Homo sapiens
gttccccacaggtcctc

SEQ ID NO: 1324975 - DNA, 20 bp, Homo sapiens
gttccccacaggtcctccat

SEQ ID NO: 1324976 - DNA, 20 bp, Homo sapiens
gttccttcctgcagacctgg

SEQ ID NO: 1324977 - DNA, 21 bp, Homo sapiens
gttctgactctggaccatgct

SEQ ID NO: 1324978 - DNA, 22 bp, Homo sapiens
gttctgactctggaccatgctg

SEQ ID NO: 1324979 - DNA, 23 bp, Homo sapiens
gttctgactctggaccatgctga

SEQ ID NO: 1324980 - DNA, 14 bp, Homo sapiens
gttgatttcttctt

SEQ ID NO: 1324981 - DNA, 13 bp, Homo sapiens
gttgcttcagtaa

SEQ ID NO: 1324982 - DNA, 12 bp, Homo sapiens
gttggcatgcat

SEQ ID NO: 1324983 - DNA, 20 bp, Homo sapiens
gttgggaagtctcagcctgg

SEQ ID NO: 1324984 - DNA, 20 bp, Homo sapiens
gttggtcatctctcctgtgt

SEQ ID NO: 1324985 - DNA, 23 bp, Homo sapiens
gttggtcatctctcctgtgtctt

SEQ ID NO: 1324986 - DNA, 18 bp, Homo sapiens
gttgtagatacaatcagc

SEQ ID NO: 1324987 - DNA, 17 bp, Homo sapiens
gtttaaaaattgtctct

SEQ ID NO: 1324988 - DNA, 18 bp, Homo sapiens
gtttatgcagtgctgctt

SEQ ID NO: 1324989 - DNA, 17 bp, Homo sapiens
gtttccccaccagtgaa

SEQ ID NO: 1324990 - DNA, 17 bp, Homo sapiens
gtttctaatttgctgct

SEQ ID NO: 1324991 - DNA, 12 bp, Homo sapiens
gtttctcatgta

SEQ ID NO: 1324992 - DNA, 19 bp, Homo sapiens
gttttacactggatgtttc

SEQ ID NO: 1324993 - DNA, 22 bp, Homo sapiens
gttttcgatgaggttccatgtt

SEQ ID NO: 1324994 - DNA, 14 bp, Homo sapiens
taaaaaaacagctt

SEQ ID NO: 1324995 - DNA, 23 bp, Homo sapiens
taaaaagtccttgcaagaatgga

SEQ ID NO: 1324996 - DNA, 19 bp, Homo sapiens
taaaacaagaaagtttccc

SEQ ID NO: 1324997 - DNA, 22 bp, Homo sapiens
taaaaccttttttcttgctact

SEQ ID NO: 1324998 - DNA, 21 bp, Homo sapiens
taaaactaggcatttgtaaat

SEQ ID NO: 1324999 - DNA, 14 bp, Homo sapiens
taaaactgatgtga

SEQ ID NO: 1325000 - DNA, 19 bp, Homo sapiens
taaaagcaacatcagcttg

SEQ ID NO: 1325001 - DNA, 15 bp, Homo sapiens
taaaatatcattcag

SEQ ID NO: 1325002 - DNA, 16 bp, Homo sapiens
taaaatatcattcagc

SEQ ID NO: 1325003 - DNA, 19 bp, Homo sapiens
taaaatatcattcagcaac

SEQ ID NO: 1325004 - DNA, 16 bp, Homo sapiens
taaaatattttctgtg

SEQ ID NO: 1325005 - DNA, 18 bp, Homo sapiens
taaaatattttctgtgtg

SEQ ID NO: 1325006 - DNA, 14 bp, Homo sapiens
taaacactcagctg

SEQ ID NO: 1325007 - DNA, 15 bp, Homo sapiens
taaacactcagctgt

SEQ ID NO: 1325008 - DNA, 14 bp, Homo sapiens
taaacttgtgcctc

SEQ ID NO: 1325009 - DNA, 17 bp, Homo sapiens
taaagagtcctccttcc

SEQ ID NO: 1325010 - DNA, 22 bp, Homo sapiens
taaagagtcctccttcccagct

SEQ ID NO: 1325011 - DNA, 13 bp, Homo sapiens
taaagccaggaac

SEQ ID NO: 1325012 - DNA, 15 bp, Homo sapiens
taaagccaggaacag

SEQ ID NO: 1325013 - DNA, 22 bp, Homo sapiens
taaagccaggaacagggaccag

SEQ ID NO: 1325014 - DNA, 16 bp, Homo sapiens
taaagcttttgatgtg

SEQ ID NO: 1325015 - DNA, 21 bp, Homo sapiens
taaagtgaggccactgaagag

SEQ ID NO: 1325016 - DNA, 23 bp, Homo sapiens
taaagtgaggccactgaagagga

SEQ ID NO: 1325017 - DNA, 17 bp, Homo sapiens
taaagtgttaaggaata

SEQ ID NO: 1325018 - DNA, 21 bp, Homo sapiens
taaatcgcatcatgccaactt

SEQ ID NO: 1325019 - DNA, 15 bp, Homo sapiens
taaatgaaataaacg

SEQ ID NO: 1325020 - DNA, 16 bp, Homo sapiens
taaatttgtgtaatat

SEQ ID NO: 1325021 - DNA, 18 bp, Homo sapiens
taacaggatggctgggta

SEQ ID NO: 1325022 - DNA, 20 bp, Homo sapiens
taacatgcccatattttact

SEQ ID NO: 1325023 - DNA, 13 bp, Homo sapiens
taacatgctgtgt

SEQ ID NO: 1325024 - DNA, 15 bp, Homo sapiens
taacttatgtatgtg

SEQ ID NO: 1325025 - DNA, 14 bp, Homo sapiens
taagaaaaggcatc

SEQ ID NO: 1325026 - DNA, 18 bp, Homo sapiens
taagaattaggtttcttt

SEQ ID NO: 1325027 - DNA, 14 bp, Homo sapiens
taagattcttggta

SEQ ID NO: 1325028 - DNA, 20 bp, Homo sapiens
taagattcttggtatttgga

SEQ ID NO: 1325029 - DNA, 11 bp, Homo sapiens
taataaaactg

SEQ ID NO: 1325030 - DNA, 15 bp, Homo sapiens
taataaaactgatgt

SEQ ID NO: 1325031 - DNA, 19 bp, Homo sapiens
taataaaactgatgtgaaa

SEQ ID NO: 1325032 - DNA, 12 bp, Homo sapiens
taataaaatatc

SEQ ID NO: 1325033 - DNA, 15 bp, Homo sapiens
taataaaatatcatt

SEQ ID NO: 1325034 - DNA, 18 bp, Homo sapiens
taataaaatatcattcag

SEQ ID NO: 1325035 - DNA, 20 bp, Homo sapiens
taataaaatatcattcagca

SEQ ID NO: 1325036 - DNA, 21 bp, Homo sapiens
taataaaatatcattcagcaa

SEQ ID NO: 1325037 - DNA, 12 bp, Homo sapiens
taataaaatatt

SEQ ID NO: 1325038 - DNA, 17 bp, Homo sapiens
tctgccatcctccctgt

SEQ ID NO: 1325039 - DNA, 13 bp, Homo sapiens
tctgcccatgcct

SEQ ID NO: 1325040 - DNA, 14 bp, Homo sapiens
tctgcccatgccta

SEQ ID NO: 1325041 - DNA, 22 bp, Homo sapiens
tctgcccatgcctaaagcccat

SEQ ID NO: 1325042 - DNA, 12 bp, Homo sapiens
tctgccccaccc

SEQ ID NO: 1325043 - DNA, 14 bp, Homo sapiens
tctgctaccttgcc

SEQ ID NO: 1325044 - DNA, 16 bp, Homo sapiens
tctgctctgcccatgc

SEQ ID NO: 1325045 - DNA, 16 bp, Homo sapiens
tctgctggctgatggg

SEQ ID NO: 1325046 - DNA, 14 bp, Homo sapiens
tctggaccatgctg

SEQ ID NO: 1325047 - DNA, 16 bp, Homo sapiens
tctggagaatcttaca

SEQ ID NO: 1325048 - DNA, 21 bp, Homo sapiens
tctggggcctaataaaactga

SEQ ID NO: 1325049 - DNA, 23 bp, Homo sapiens
tctggggcctaataaaactgatg

SEQ ID NO: 1325050 - DNA, 16 bp, Homo sapiens
tctgtgcacctgggct

SEQ ID NO: 1325051 - DNA, 12 bp, Homo sapiens
tctgttctgata

SEQ ID NO: 1325052 - DNA, 14 bp, Homo sapiens
tctgttgctggtct

SEQ ID NO: 1325053 - DNA, 22 bp, Homo sapiens
tcttaatttggaaactaataaa

SEQ ID NO: 1325054 - DNA, 13 bp, Homo sapiens
tcttccacacatg

SEQ ID NO: 1325055 - DNA, 22 bp, Homo sapiens
tcttccatatccgggtgctcaa

SEQ ID NO: 1325056 - DNA, 20 bp, Homo sapiens
tcttctcccaactcagcctg

SEQ ID NO: 1325057 - DNA, 16 bp, Homo sapiens
tcttctgctctttctt

SEQ ID NO: 1325058 - DNA, 18 bp, Homo sapiens
tcttctgctctttcttct

SEQ ID NO: 1325059 - DNA, 22 bp, Homo sapiens
tcttctgctctttcttcttcca

SEQ ID NO: 1325060 - DNA, 13 bp, Homo sapiens
tcttgctgtttct

SEQ ID NO: 1325061 - DNA, 19 bp, Homo sapiens
tcttggacacttaattctg

SEQ ID NO: 1325062 - DNA, 14 bp, Homo sapiens
tcttggcttcctgg

SEQ ID NO: 1325063 - DNA, 19 bp, Homo sapiens
tcttggcttcctggcgccc

SEQ ID NO: 1325064 - DNA, 22 bp, Homo sapiens
tcttggtatttggatatctgtt

SEQ ID NO: 1325065 - DNA, 14 bp, Homo sapiens
tcttgtgaggccct

SEQ ID NO: 1325066 - DNA, 12 bp, Homo sapiens
tctttctgctgg

SEQ ID NO: 1325067 - DNA, 13 bp, Homo sapiens
tctttctgctggc

SEQ ID NO: 1325068 - DNA, 15 bp, Homo sapiens
tctttctgctggctg

SEQ ID NO: 1325069 - DNA, 17 bp, Homo sapiens
tctttctgctggctgat

SEQ ID NO: 1325070 - DNA, 10 bp, Homo sapiens
tctttctgga

SEQ ID NO: 1325071 - DNA, 13 bp, Homo sapiens
tctttgtccctgt

SEQ ID NO: 1325072 - DNA, 22 bp, Homo sapiens
tcttttgaatgttaagaataac

SEQ ID NO: 1325073 - DNA, 18 bp, Homo sapiens
tcttttgttgtttcttaa

SEQ ID NO: 1325074 - DNA, 13 bp, Homo sapiens
tctttttaaagct

SEQ ID NO: 1325075 - DNA, 18 bp, Homo sapiens
tgaaaaccaacaccatca

SEQ ID NO: 1325076 - DNA, 14 bp, Homo sapiens
tgaaaataagccat

SEQ ID NO: 1325077 - DNA, 18 bp, Homo sapiens
tgaaaataagccatgaga

SEQ ID NO: 1325078 - DNA, 19 bp, Homo sapiens
tgaaaataagccatgagaa

SEQ ID NO: 1325079 - DNA, 20 bp, Homo sapiens
tgaaaataagccatgagaat

SEQ ID NO: 1325080 - DNA, 18 bp, Homo sapiens
tgaaagtcttgtgactag

SEQ ID NO: 1325081 - DNA, 20 bp, Homo sapiens
tgaaagtcttgtgactagtg

SEQ ID NO: 1325082 - DNA, 14 bp, Homo sapiens
tgaaataaacgtgc

SEQ ID NO: 1325083 - DNA, 17 bp, Homo sapiens
tgaaataacacagcagt

SEQ ID NO: 1325084 - DNA, 12 bp, Homo sapiens
tgaacccaggag

SEQ ID NO: 1325085 - DNA, 12 bp, Homo sapiens
tgaacttaacat

SEQ ID NO: 1325086 - DNA, 15 bp, Homo sapiens
tgaacttaacatgct

SEQ ID NO: 1325087 - DNA, 11 bp, Homo sapiens
tgaagaaagag

SEQ ID NO: 1325088 - DNA, 21 bp, Homo sapiens
tgaagaaagagactgtgggga

SEQ ID NO: 1325089 - DNA, 15 bp, Homo sapiens
tgaagcaaacagttg

SEQ ID NO: 1325090 - DNA, 20 bp, Homo sapiens
tgaagcaaacagttgacaat

SEQ ID NO: 1325091 - DNA, 21 bp, Homo sapiens
tgaaggcacctgcccccacag

SEQ ID NO: 1325092 - DNA, 22 bp, Homo sapiens
tgaaggcacctgcccccacagc

SEQ ID NO: 1325093 - DNA, 16 bp, Homo sapiens
tgaagtctggaacact

SEQ ID NO: 1325094 - DNA, 21 bp, Homo sapiens
tgaatgaaagtcttgtgacta

SEQ ID NO: 1325095 - DNA, 17 bp, Homo sapiens
tgaatgttaagaataac

SEQ ID NO: 1325096 - DNA, 13 bp, Homo sapiens
tgaattgattttg

SEQ ID NO: 1325097 - DNA, 17 bp, Homo sapiens
tgaattgcctgccatgg

SEQ ID NO: 1325098 - DNA, 19 bp, Homo sapiens
tgacagcccatgggaatgc

SEQ ID NO: 1325099 - DNA, 19 bp, Homo sapiens
tgacagcgcacagctgctc

SEQ ID NO: 1325100 - DNA, 21 bp, Homo sapiens
tgacatctacgaagccacagg

SEQ ID NO: 1325101 - DNA, 23 bp, Homo sapiens
tgacatctacgaagccacaggcc

SEQ ID NO: 1325102 - DNA, 20 bp, Homo sapiens
tgacctctccagcatcccag

SEQ ID NO: 1325103 - DNA, 21 bp, Homo sapiens
tgacctctccagcatcccagc

SEQ ID NO: 1325104 - DNA, 22 bp, Homo sapiens
tgacctctccagcatcccagcc

SEQ ID NO: 1325105 - DNA, 16 bp, Homo sapiens
tgacctctccggcctg

SEQ ID NO: 1325106 - DNA, 18 bp, Homo sapiens
tgacctctccggcctggc

SEQ ID NO: 1325107 - DNA, 21 bp, Homo sapiens
tgacctctccggcctggcctt

SEQ ID NO: 1325108 - DNA, 13 bp, Homo sapiens
tgacctgttcaga

SEQ ID NO: 1325109 - DNA, 19 bp, Homo sapiens
tgaccttgacttgccatga

SEQ ID NO: 1325110 - DNA, 13 bp, Homo sapiens
tgactagtgctga

SEQ ID NO: 1325111 - DNA, 12 bp, Homo sapiens
tgactggcttgc

SEQ ID NO: 1325112 - DNA, 18 bp, Homo sapiens
tgactggcttgctcccgc

SEQ ID NO: 1325113 - DNA, 20 bp, Homo sapiens
tgagaaaaagtcctgtcagt

SEQ ID NO: 1325114 - DNA, 16 bp, Homo sapiens
tgagaagccaagcctg

SEQ ID NO: 1325115 - DNA, 15 bp, Homo sapiens
tgagacaaaaaggaa

SEQ ID NO: 1325116 - DNA, 15 bp, Homo sapiens
tgagagaaggtgaaa

SEQ ID NO: 1325117 - DNA, 16 bp, Homo sapiens
tgagagaaggtgaaat

SEQ ID NO: 1325118 - DNA, 15 bp, Homo sapiens
tgagcacctctcaga

SEQ ID NO: 1325119 - DNA, 21 bp, Homo sapiens
tgagcacctctcagagcaagc

SEQ ID NO: 1325120 - DNA, 13 bp, Homo sapiens
tgaggaaggaaat

SEQ ID NO: 1325121 - DNA, 20 bp, Homo sapiens
tgaggaaggaaatctggccc

SEQ ID NO: 1325122 - DNA, 16 bp, Homo sapiens
tgaggcaaggcccaga

SEQ ID NO: 1325123 - DNA, 23 bp, Homo sapiens
tgaggcaaggcccagacctggcc

SEQ ID NO: 1325124 - DNA, 16 bp, Homo sapiens
tgaggccactgaagag

SEQ ID NO: 1325125 - DNA, 13 bp, Homo sapiens
tgagggggctcag

SEQ ID NO: 1325126 - DNA, 14 bp, Homo sapiens
tgagggggctcagt

SEQ ID NO: 1325127 - DNA, 11 bp, Homo sapiens
tgaggggtgga

SEQ ID NO: 1325128 - DNA, 16 bp, Homo sapiens
tgagggtttgagagag

SEQ ID NO: 1325129 - DNA, 19 bp, Homo sapiens
tgaggtggatttactgaga

SEQ ID NO: 1325130 - DNA, 12 bp, Homo sapiens
tgagtgtctatt

SEQ ID NO: 1325131 - DNA, 16 bp, Homo sapiens
tgagttcacatgtgcc

SEQ ID NO: 1325132 - DNA, 18 bp, Homo sapiens
tgatatgctgcttgtgac

SEQ ID NO: 1325133 - DNA, 18 bp, Homo sapiens
tgatattgaggtgtttga

SEQ ID NO: 1325134 - DNA, 21 bp, Homo sapiens
tgatgtacgctgcgtgccatg

SEQ ID NO: 1325135 - DNA, 15 bp, Homo sapiens
tgatgtcctgtaaac

SEQ ID NO: 1325136 - DNA, 12 bp, Homo sapiens
tgatgtttacat

SEQ ID NO: 1325137 - DNA, 15 bp, Homo sapiens
tgatgtttgttttcg

SEQ ID NO: 1325138 - DNA, 12 bp, Homo sapiens
tgatttctgtgc

SEQ ID NO: 1325139 - DNA, 15 bp, Homo sapiens
tgatttctgtgccat

SEQ ID NO: 1325140 - DNA, 13 bp, Homo sapiens
tgatttcttcttc

SEQ ID NO: 1325141 - DNA, 17 bp, Homo sapiens
tgcaaactatgagttca

SEQ ID NO: 1325142 - DNA, 20 bp, Homo sapiens
tgcaactttttaattccata

SEQ ID NO: 1325143 - DNA, 22 bp, Homo sapiens
tgcactcagggtcagcagtgga

SEQ ID NO: 1325144 - DNA, 14 bp, Homo sapiens
tgcagacctggctg

SEQ ID NO: 1325145 - DNA, 17 bp, Homo sapiens
tgcagctgggaagagga

SEQ ID NO: 1325146 - DNA, 15 bp, Homo sapiens
tgcaggcaccgctgg

SEQ ID NO: 1325147 - DNA, 21 bp, Homo sapiens
tgcaggcaccgctgggttctg

SEQ ID NO: 1325148 - DNA, 17 bp, Homo sapiens
tgcaggcccaggcaggc

SEQ ID NO: 1325149 - DNA, 18 bp, Homo sapiens
tgcaggcccaggcaggcc

SEQ ID NO: 1325150 - DNA, 19 bp, Homo sapiens
tgcattttttaaaacaaga

SEQ ID NO: 1325151 - DNA, 18 bp, Homo sapiens
tgccagtgcatgccagga

SEQ ID NO: 1325152 - DNA, 21 bp, Homo sapiens
tgccagtgcatgccaggaagc

SEQ ID NO: 1325153 - DNA, 16 bp, Homo sapiens
tgccatgaaggcacct

SEQ ID NO: 1325154 - DNA, 19 bp, Homo sapiens
tgccatgaaggcacctgcc

SEQ ID NO: 1325155 - DNA, 21 bp, Homo sapiens
tgccatgaaggcacctgcccc

SEQ ID NO: 1325156 - DNA, 13 bp, Homo sapiens
tgccatgagtcca

SEQ ID NO: 1325157 - DNA, 12 bp, Homo sapiens
tgccatggctgt

SEQ ID NO: 1325158 - DNA, 16 bp, Homo sapiens
tgcccacacctcctgg

SEQ ID NO: 1325159 - DNA, 17 bp, Homo sapiens
tgcccacacctcctggg

SEQ ID NO: 1325160 - DNA, 13 bp, Homo sapiens
tgcccccacagct

SEQ ID NO: 1325161 - DNA, 19 bp, Homo sapiens
tgcccccacagctccttgc

SEQ ID NO: 1325162 - DNA, 13 bp, Homo sapiens
tgccccgccatgg

SEQ ID NO: 1325163 - DNA, 15 bp, Homo sapiens
tgccccgccatggtc

SEQ ID NO: 1325164 - DNA, 16 bp, Homo sapiens
tgcccgatccagattc

SEQ ID NO: 1325165 - DNA, 17 bp, Homo sapiens
tgccctgaaactactgt

SEQ ID NO: 1325166 - DNA, 21 bp, Homo sapiens
tgccctgaaactactgtatct

SEQ ID NO: 1325167 - DNA, 22 bp, Homo sapiens
tgccctgccttgaacaacccaa

SEQ ID NO: 1325168 - DNA, 22 bp, Homo sapiens
tgccggagccccaagactctgc

SEQ ID NO: 1325169 - DNA, 19 bp, Homo sapiens
tgcctaaagcccattgctg

SEQ ID NO: 1325170 - DNA, 22 bp, Homo sapiens
tgcctcctgacacacctgcagc

SEQ ID NO: 1325171 - DNA, 15 bp, Homo sapiens
tgcctgccatggctg

SEQ ID NO: 1325172 - DNA, 17 bp, Homo sapiens
tgcctgccatggctgtg

SEQ ID NO: 1325173 - DNA, 13 bp, Homo sapiens
tgcgcagttgctg

SEQ ID NO: 1325174 - DNA, 13 bp, Homo sapiens
tgcgcggactgtc

SEQ ID NO: 1325175 - DNA, 12 bp, Homo sapiens
tgctcaataaac

SEQ ID NO: 1325176 - DNA, 18 bp, Homo sapiens
tgctcaataaacttgtgc

SEQ ID NO: 1325177 - DNA, 19 bp, Homo sapiens
tgctcaataaacttgtgcc

SEQ ID NO: 1325178 - DNA, 23 bp, Homo sapiens
tgctcatctcagtcctcaaagct

SEQ ID NO: 1325179 - DNA, 18 bp, Homo sapiens
tgctcccgccccagggtc

SEQ ID NO: 1325180 - DNA, 19 bp, Homo sapiens
tgctcccgccccagggtct

SEQ ID NO: 1325181 - DNA, 22 bp, Homo sapiens
tgctcccgccccagggtctgaa

SEQ ID NO: 1325182 - DNA, 17 bp, Homo sapiens
tgctctcctcgggccct

SEQ ID NO: 1325183 - DNA, 14 bp, Homo sapiens
tgctctctgaggca

SEQ ID NO: 1325184 - DNA, 16 bp, Homo sapiens
tgctctctgaggcaag

SEQ ID NO: 1325185 - DNA, 22 bp, Homo sapiens
tgctctctgaggcaaggcccag

SEQ ID NO: 1325186 - DNA, 21 bp, Homo sapiens
tgctctctgttctcttgcttt

SEQ ID NO: 1325187 - DNA, 13 bp, Homo sapiens
tgctctgcccatg

SEQ ID NO: 1325188 - DNA, 14 bp, Homo sapiens
tgctctgcccatgc

SEQ ID NO: 1325189 - DNA, 13 bp, Homo sapiens
tgctgaagcttat

SEQ ID NO: 1325190 - DNA, 19 bp, Homo sapiens
tgctgaagcttattaatgc

SEQ ID NO: 1325191 - DNA, 21 bp, Homo sapiens
tgctgaagcttattaatgcta

SEQ ID NO: 1325192 - DNA, 23 bp, Homo sapiens
tgctgaagcttattaatgctaag

SEQ ID NO: 1325193 - DNA, 15 bp, Homo sapiens
tgctgagacatccct

SEQ ID NO: 1325194 - DNA, 19 bp, Homo sapiens
tgctgagacatccctcatc

SEQ ID NO: 1325195 - DNA, 14 bp, Homo sapiens
tgctgcttgtgacc

SEQ ID NO: 1325196 - DNA, 16 bp, Homo sapiens
tgctgcttgtgacctt

SEQ ID NO: 1325197 - DNA, 19 bp, Homo sapiens
tgctgcttgtgaccttgac

SEQ ID NO: 1325198 - DNA, 22 bp, Homo sapiens
tgctggctgatgggtggacctg

SEQ ID NO: 1325199 - DNA, 23 bp, Homo sapiens
tgctgggagatgctctctgaggc

SEQ ID NO: 1325200 - DNA, 16 bp, Homo sapiens
tgctgtggttcactgc

SEQ ID NO: 1325201 - DNA, 10 bp, Homo sapiens
tgctgtgtga

SEQ ID NO: 1325202 - DNA, 20 bp, Homo sapiens
tgcttcccttttttcctttc

SEQ ID NO: 1325203 - DNA, 19 bp, Homo sapiens
tgcttgaagcaaacagttg

SEQ ID NO: 1325204 - DNA, 20 bp, Homo sapiens
tgcttgaagcaaacagttga

SEQ ID NO: 1325205 - DNA, 18 bp, Homo sapiens
tgctttgttaccttaaaa

SEQ ID NO: 1325206 - DNA, 21 bp, Homo sapiens
tgctttgttaccttaaaacta

SEQ ID NO: 1325207 - DNA, 16 bp, Homo sapiens
tggaaaacttagtttg

SEQ ID NO: 1325208 - DNA, 20 bp, Homo sapiens
tggaaaacttagtttgtgaa

SEQ ID NO: 1325209 - DNA, 13 bp, Homo sapiens
tggaaactaataa

SEQ ID NO: 1325210 - DNA, 21 bp, Homo sapiens
tggaaactaataaaatatttt

SEQ ID NO: 1325211 - DNA, 22 bp, Homo sapiens
tggaaactaataaaatattttc

SEQ ID NO: 1325212 - DNA, 21 bp, Homo sapiens
tggaacactttcctcttctat

SEQ ID NO: 1325213 - DNA, 19 bp, Homo sapiens
tggaactgcaactccagcg

SEQ ID NO: 1325214 - DNA, 18 bp, Homo sapiens
tggaagttaaagtgaggc

SEQ ID NO: 1325215 - DNA, 19 bp, Homo sapiens
tggaataaggagctggggc

SEQ ID NO: 1325216 - DNA, 13 bp, Homo sapiens
tggaatgagggtt

SEQ ID NO: 1325217 - DNA, 17 bp, Homo sapiens
tggaccatgctgagaca

SEQ ID NO: 1325218 - DNA, 22 bp, Homo sapiens
tggactttgttacactgttatt

SEQ ID NO: 1325219 - DNA, 22 bp, Homo sapiens
tggagatatgcattcaagagag

SEQ ID NO: 1325220 - DNA, 18 bp, Homo sapiens
tggatatctgttagatgc

SEQ ID NO: 1325221 - DNA, 18 bp, Homo sapiens
tggatgacacatttaatg

SEQ ID NO: 1325222 - DNA, 20 bp, Homo sapiens
tggatgacacatttaatgaa

SEQ ID NO: 1325223 - DNA, 19 bp, Homo sapiens
tggatttactgagagaagg

SEQ ID NO: 1325224 - DNA, 21 bp, Homo sapiens
tggatttactgagagaaggtg

SEQ ID NO: 1325225 - DNA, 18 bp, Homo sapiens
tggcaggctacagttggg

SEQ ID NO: 1325226 - DNA, 22 bp, Homo sapiens
tggcaggctgaggcatgagaat

SEQ ID NO: 1325227 - DNA, 22 bp, Homo sapiens
tggccaccccttgctctctgtt

SEQ ID NO: 1325228 - DNA, 12 bp, Homo sapiens
tggcccagaagc

SEQ ID NO: 1325229 - DNA, 13 bp, Homo sapiens
tggcctctgccat

SEQ ID NO: 1325230 - DNA, 12 bp, Homo sapiens
tggcctgagaca

SEQ ID NO: 1325231 - DNA, 17 bp, Homo sapiens
tggcctgagacagtgcg

SEQ ID NO: 1325232 - DNA, 21 bp, Homo sapiens
tggccttgtggtccaaatagg

SEQ ID NO: 1325233 - DNA, 15 bp, Homo sapiens
tggctcccctgcagc

SEQ ID NO: 1325234 - DNA, 17 bp, Homo sapiens
tggctcccctgcagccc

SEQ ID NO: 1325235 - DNA, 12 bp, Homo sapiens
tggctcccctgg

SEQ ID NO: 1325236 - DNA, 14 bp, Homo sapiens
tggctcctcccagc

SEQ ID NO: 1325237 - DNA, 20 bp, Homo sapiens
tggctgatgggtggacctgt

SEQ ID NO: 1325238 - DNA, 22 bp, Homo sapiens
tggctgatgggtggacctgtgt

SEQ ID NO: 1325239 - DNA, 16 bp, Homo sapiens
tggctgggcctgggct

SEQ ID NO: 1325240 - DNA, 23 bp, Homo sapiens
tggctgtttgttttgatgataaa

SEQ ID NO: 1325241 - DNA, 18 bp, Homo sapiens
tggcttcctggcgccccc

SEQ ID NO: 1325242 - DNA, 23 bp, Homo sapiens
tggcttgctcccgccccagggtc

SEQ ID NO: 1325243 - DNA, 18 bp, Homo sapiens
tgggaagtctcagcctgg

SEQ ID NO: 1325244 - DNA, 19 bp, Homo sapiens
tgggaataaattaatatat

SEQ ID NO: 1325245 - DNA, 17 bp, Homo sapiens
tgggactaaagccagga

SEQ ID NO: 1325246 - DNA, 18 bp, Homo sapiens
tgggactaaagccaggaa

SEQ ID NO: 1325247 - DNA, 22 bp, Homo sapiens
tgggactaaagccaggaacagg

SEQ ID NO: 1325248 - DNA, 18 bp, Homo sapiens
tgggagcacatagccctg

SEQ ID NO: 1325249 - DNA, 12 bp, Homo sapiens
tgggagggagct

SEQ ID NO: 1325250 - DNA, 22 bp, Homo sapiens
tggggcctaataaaactgatgt

SEQ ID NO: 1325251 - DNA, 23 bp, Homo sapiens
tggggcctaataaaactgatgtg

SEQ ID NO: 1325252 - DNA, 15 bp, Homo sapiens
tggggcgcgtgaggc

SEQ ID NO: 1325253 - DNA, 20 bp, Homo sapiens
tggggcttctttctgctggc

SEQ ID NO: 1325254 - DNA, 14 bp, Homo sapiens
tgggggaacttgta

SEQ ID NO: 1325255 - DNA, 20 bp, Homo sapiens
tggggtcattttgactggct

SEQ ID NO: 1325256 - DNA, 15 bp, Homo sapiens
tgggttctgactctg

SEQ ID NO: 1325257 - DNA, 20 bp, Homo sapiens
tggtaaagtgttaaggaata

SEQ ID NO: 1325258 - DNA, 18 bp, Homo sapiens
tggtcctaggctggaagg

SEQ ID NO: 1325259 - DNA, 19 bp, Homo sapiens
tggtcctaggctggaagga

SEQ ID NO: 1325260 - DNA, 16 bp, Homo sapiens
tggtctcagtgttaat

SEQ ID NO: 1325261 - DNA, 14 bp, Homo sapiens
tggtcttctcagtt

SEQ ID NO: 1325262 - DNA, 14 bp, Homo sapiens
tggtgacctctccg

SEQ ID NO: 1325263 - DNA, 21 bp, Homo sapiens
tggtgatgtacgctgcgtgcc

SEQ ID NO: 1325264 - DNA, 18 bp, Homo sapiens
tggtgctgggagatgctc

SEQ ID NO: 1325265 - DNA, 21 bp, Homo sapiens
tggtgctgggagatgctctct

SEQ ID NO: 1325266 - DNA, 16 bp, Homo sapiens
tggtttttcttttctt

SEQ ID NO: 1325267 - DNA, 18 bp, Homo sapiens
tgtaaaagcaacatcagc

SEQ ID NO: 1325268 - DNA, 18 bp, Homo sapiens
tgtaaacactcagctgtt

SEQ ID NO: 1325269 - DNA, 12 bp, Homo sapiens
tgtaataatgga

SEQ ID NO: 1325270 - DNA, 19 bp, Homo sapiens
tgtaatattactttaacat

SEQ ID NO: 1325271 - DNA, 17 bp, Homo sapiens
tgtaatcccagctattt

SEQ ID NO: 1325272 - DNA, 22 bp, Homo sapiens
tgtacaggacatgtactgagac

SEQ ID NO: 1325273 - DNA, 20 bp, Homo sapiens
tgtagatacaatcagctgct

SEQ ID NO: 1325274 - DNA, 17 bp, Homo sapiens
tgtagtgccgctcttgg

SEQ ID NO: 1325275 - DNA, 19 bp, Homo sapiens
tgtataaaggtgtgctgtg

SEQ ID NO: 1325276 - DNA, 19 bp, Homo sapiens
tgtatctaatttcattcaa

SEQ ID NO: 1325277 - DNA, 13 bp, Homo sapiens
tgtcaacaccaga

SEQ ID NO: 1325278 - DNA, 17 bp, Homo sapiens
tgtcaagtgtcagtaag

SEQ ID NO: 1325279 - DNA, 17 bp, Homo sapiens
tgtcacttgcacagagg

SEQ ID NO: 1325280 - DNA, 23 bp, Homo sapiens
tgtcagttcagaaaaaatgtgaa

SEQ ID NO: 1325281 - DNA, 21 bp, Homo sapiens
tgtcatagaatagcatgttgt

SEQ ID NO: 1325282 - DNA, 22 bp, Homo sapiens
tgtcccaaaacaaaataggtga

SEQ ID NO: 1325283 - DNA, 15 bp, Homo sapiens
tgtcccactggctcc

SEQ ID NO: 1325284 - DNA, 16 bp, Homo sapiens
tgtcccactggctcct

SEQ ID NO: 1325285 - DNA, 20 bp, Homo sapiens
tgtcccactggctcctccca

SEQ ID NO: 1325286 - DNA, 16 bp, Homo sapiens
tgtcctatgcctcaca

SEQ ID NO: 1325287 - DNA, 22 bp, Homo sapiens
tgtcctgtaaacactcagctgt

SEQ ID NO: 1325288 - DNA, 18 bp, Homo sapiens
tgtctgccacattaacta

SEQ ID NO: 1325289 - DNA, 15 bp, Homo sapiens
tgtctttgtccctgt

SEQ ID NO: 1325290 - DNA, 14 bp, Homo sapiens
tgtgaacagaagtc

SEQ ID NO: 1325291 - DNA, 21 bp, Homo sapiens
tgtgaagacactgtgcaggcc

SEQ ID NO: 1325292 - DNA, 22 bp, Homo sapiens
tgtgaagacactgtgcaggccc

SEQ ID NO: 1325293 - DNA, 19 bp, Homo sapiens
tgtgaattgcctgccatgg

SEQ ID NO: 1325294 - DNA, 23 bp, Homo sapiens
tgtgacacagacggaggactgga

SEQ ID NO: 1325295 - DNA, 16 bp, Homo sapiens
tgtgactagtgctgaa

SEQ ID NO: 1325296 - DNA, 20 bp, Homo sapiens
tgtgactagtgctgaagctt

SEQ ID NO: 1325297 - DNA, 22 bp, Homo sapiens
tgtgactagtgctgaagcttat

SEQ ID NO: 1325298 - DNA, 13 bp, Homo sapiens
tgtgcaggcccag

SEQ ID NO: 1325299 - DNA, 17 bp, Homo sapiens
tgtgcaggcccaggcag

SEQ ID NO: 1325300 - DNA, 16 bp, Homo sapiens
tgtgccattttctgta

SEQ ID NO: 1325301 - DNA, 19 bp, Homo sapiens
tgtgccattttctgtaaag

SEQ ID NO: 1325302 - DNA, 13 bp, Homo sapiens
tgtgccctgcctt

SEQ ID NO: 1325303 - DNA, 16 bp, Homo sapiens
tgtgccctgccttgaa

SEQ ID NO: 1325304 - DNA, 21 bp, Homo sapiens
tgtgcttgttgaatgtcaatc

SEQ ID NO: 1325305 - DNA, 14 bp, Homo sapiens
tgtggtccaaatag

SEQ ID NO: 1325306 - DNA, 23 bp, Homo sapiens
tgtggtgctgggagatgctctct

SEQ ID NO: 1325307 - DNA, 23 bp, Homo sapiens
tgtgtaatattactttaacatgc

SEQ ID NO: 1325308 - DNA, 17 bp, Homo sapiens
tgtgtagcatgatacca

SEQ ID NO: 1325309 - DNA, 14 bp, Homo sapiens
tgtgtatggtgacc

SEQ ID NO: 1325310 - DNA, 16 bp, Homo sapiens
tgtgtctgccacatta

SEQ ID NO: 1325311 - DNA, 19 bp, Homo sapiens
tgtgtgaaatctttcaagt

SEQ ID NO: 1325312 - DNA, 12 bp, Homo sapiens
tgtgtgttcctg

SEQ ID NO: 1325313 - DNA, 11 bp, Homo sapiens
tgtgttcctgg

SEQ ID NO: 1325314 - DNA, 12 bp, Homo sapiens
tgtgttcctggc

SEQ ID NO: 1325315 - DNA, 20 bp, Homo sapiens
tgttaaccgtttcaggacca

SEQ ID NO: 1325316 - DNA, 14 bp, Homo sapiens
tgttaatactgaga

SEQ ID NO: 1325317 - DNA, 15 bp, Homo sapiens
tgttaatactgagaa

SEQ ID NO: 1325318 - DNA, 12 bp, Homo sapiens
tgttaccttaaa

SEQ ID NO: 1325319 - DNA, 15 bp, Homo sapiens
tgttagactatagcc

SEQ ID NO: 1325320 - DNA, 22 bp, Homo sapiens
tgttatttatccctcattcatc

SEQ ID NO: 1325321 - DNA, 15 bp, Homo sapiens
tgttattttcagcat

SEQ ID NO: 1325322 - DNA, 17 bp, Homo sapiens
tgttccttcctgcagac

SEQ ID NO: 1325323 - DNA, 20 bp, Homo sapiens
tgttccttcctgcagacctg

SEQ ID NO: 1325324 - DNA, 15 bp, Homo sapiens
tgttctgatattaat

SEQ ID NO: 1325325 - DNA, 22 bp, Homo sapiens
tgttgactctagtactgtgaat

SEQ ID NO: 1325326 - DNA, 13 bp, Homo sapiens
tgttggaagagca

SEQ ID NO: 1325327 - DNA, 21 bp, Homo sapiens
tgttggtcatctctcctgtgt

SEQ ID NO: 1325328 - DNA, 21 bp, Homo sapiens
tgttgtagatacaatcagctg

SEQ ID NO: 1325329 - DNA, 22 bp, Homo sapiens
tgttgtagatacaatcagctgc

SEQ ID NO: 1325330 - DNA, 16 bp, Homo sapiens
tgtttcttaatttgga

SEQ ID NO: 1325331 - DNA, 17 bp, Homo sapiens
tgttttggactttgtta

SEQ ID NO: 1325332 - DNA, 11 bp, Homo sapiens
ttaaaacaaga

SEQ ID NO: 1325333 - DNA, 20 bp, Homo sapiens
ttaaaagaaagggttctgta

SEQ ID NO: 1325334 - DNA, 15 bp, Homo sapiens
ttaaaagtaaaagag

SEQ ID NO: 1325335 - DNA, 19 bp, Homo sapiens
ttaaagagtcctccttccc

SEQ ID NO: 1325336 - DNA, 14 bp, Homo sapiens
ttaacatgctgtgt

SEQ ID NO: 1325337 - DNA, 15 bp, Homo sapiens
ttaaccgtttcagga

SEQ ID NO: 1325338 - DNA, 14 bp, Homo sapiens
ttaactggcccaga

SEQ ID NO: 1325339 - DNA, 16 bp, Homo sapiens
ttaactggcccagaag

SEQ ID NO: 1325340 - DNA, 17 bp, Homo sapiens
ttaagaatggtctcagt

SEQ ID NO: 1325341 - DNA, 16 bp, Homo sapiens
ttaatacaggaacaca

SEQ ID NO: 1325342 - DNA, 14 bp, Homo sapiens
ttaatactgagaaa

SEQ ID NO: 1325343 - DNA, 22 bp, Homo sapiens
ttacaaattaagggttaaatca

SEQ ID NO: 1325344 - DNA, 23 bp, Homo sapiens
ttacactgttattttcagcatga

SEQ ID NO: 1325345 - DNA, 17 bp, Homo sapiens
ttagatgctactaagaa

SEQ ID NO: 1325346 - DNA, 18 bp, Homo sapiens
ttagtataccagagaagg

SEQ ID NO: 1325347 - DNA, 18 bp, Homo sapiens
ttagtgtggttttctgtt

SEQ ID NO: 1325348 - DNA, 19 bp, Homo sapiens
ttagtgtggttttctgttt

SEQ ID NO: 1325349 - DNA, 13 bp, Homo sapiens
ttatcaagctaat

SEQ ID NO: 1325350 - DNA, 19 bp, Homo sapiens
ttatcttggccttactgta

SEQ ID NO: 1325351 - DNA, 15 bp, Homo sapiens
ttatgcagtgctgct

SEQ ID NO: 1325352 - DNA, 18 bp, Homo sapiens
ttatgtttttgtactctg

SEQ ID NO: 1325353 - DNA, 19 bp, Homo sapiens
ttattctaacaaaaagcaa

SEQ ID NO: 1325354 - DNA, 16 bp, Homo sapiens
ttattttttttctgta

SEQ ID NO: 1325355 - DNA, 16 bp, Homo sapiens
ttcaacactagcattt

SEQ ID NO: 1325356 - DNA, 14 bp, Homo sapiens
ttcaagttgcattc

SEQ ID NO: 1325357 - DNA, 22 bp, Homo sapiens
ttcaatgtgatataaacagctt

SEQ ID NO: 1325358 - DNA, 15 bp, Homo sapiens
ttcacaagttaagat

SEQ ID NO: 1325359 - DNA, 13 bp, Homo sapiens
ttcacatgtgccc

SEQ ID NO: 1325360 - DNA, 15 bp, Homo sapiens
ttcagattggacata

SEQ ID NO: 1325361 - DNA, 18 bp, Homo sapiens
ttcagccttcaatcaaca

SEQ ID NO: 1325362 - DNA, 19 bp, Homo sapiens
ttcaggagtccaaaccttc

SEQ ID NO: 1325363 - DNA, 22 bp, Homo sapiens
ttcagtaaaaggacctcgggga

SEQ ID NO: 1325364 - DNA, 16 bp, Homo sapiens
ttcatcagaacagctg

SEQ ID NO: 1325365 - DNA, 23 bp, Homo sapiens
ttccactgctactgacccagagg

SEQ ID NO: 1325366 - DNA, 15 bp, Homo sapiens
ttccatatccgggtg

SEQ ID NO: 1325367 - DNA, 20 bp, Homo sapiens
ttccatatccgggtgctcaa

SEQ ID NO: 1325368 - DNA, 23 bp, Homo sapiens
ttccatatccgggtgctcaataa

SEQ ID NO: 1325369 - DNA, 19 bp, Homo sapiens
ttcccaggcaaataaaatt

SEQ ID NO: 1325370 - DNA, 13 bp, Homo sapiens
ttccccacaggtc

SEQ ID NO: 1325371 - DNA, 15 bp, Homo sapiens
ttccccacaggtcct

SEQ ID NO: 1325372 - DNA, 21 bp, Homo sapiens
ttccccaccagtgaatgaaag

SEQ ID NO: 1325373 - DNA, 14 bp, Homo sapiens
ttcctggcgccccc

SEQ ID NO: 1325374 - DNA, 23 bp, Homo sapiens
ttccttcctgcagacctggctgg

SEQ ID NO: 1325375 - DNA, 15 bp, Homo sapiens
ttccttttgctgtgt

SEQ ID NO: 1325376 - DNA, 17 bp, Homo sapiens
ttctaatttgctgctga

SEQ ID NO: 1325377 - DNA, 23 bp, Homo sapiens
ttctcatgtagaacaagaaatct

SEQ ID NO: 1325378 - DNA, 17 bp, Homo sapiens
ttctcccaactcagcct

SEQ ID NO: 1325379 - DNA, 18 bp, Homo sapiens
ttctcccaactcagcctg

SEQ ID NO: 1325380 - DNA, 20 bp, Homo sapiens
ttctcccaactcagcctgtt

SEQ ID NO: 1325381 - DNA, 21 bp, Homo sapiens
ttctctctctctcaaaattat

SEQ ID NO: 1325382 - DNA, 16 bp, Homo sapiens
ttctctgggtgagaat

SEQ ID NO: 1325383 - DNA, 16 bp, Homo sapiens
ttctgactctggacca

SEQ ID NO: 1325384 - DNA, 13 bp, Homo sapiens
ttctgctctgccc

SEQ ID NO: 1325385 - DNA, 14 bp, Homo sapiens
ttctgctggctgat

SEQ ID NO: 1325386 - DNA, 14 bp, Homo sapiens
ttctgggtaattca

SEQ ID NO: 1325387 - DNA, 11 bp, Homo sapiens
ttctgtaaaat

SEQ ID NO: 1325388 - DNA, 14 bp, Homo sapiens
ttctgtgcacctgg

SEQ ID NO: 1325389 - DNA, 19 bp, Homo sapiens
ttctgtgccattttctgta

SEQ ID NO: 1325390 - DNA, 16 bp, Homo sapiens
ttctgtgtgttcctgg

SEQ ID NO: 1325391 - DNA, 17 bp, Homo sapiens
ttctgtgtgttcctggc

SEQ ID NO: 1325392 - DNA, 21 bp, Homo sapiens
ttctgtttctaatttgctgct

SEQ ID NO: 1325393 - DNA, 15 bp, Homo sapiens
ttcttcatgttcaat

SEQ ID NO: 1325394 - DNA, 17 bp, Homo sapiens
ttcttggacacttaatt

SEQ ID NO: 1325395 - DNA, 17 bp, Homo sapiens
ttcttgtctttgtccct

SEQ ID NO: 1325396 - DNA, 20 bp, Homo sapiens
ttgaaatatggaactgtaat

SEQ ID NO: 1325397 - DNA, 16 bp, Homo sapiens
ttgaatgtcaatcata

SEQ ID NO: 1325398 - DNA, 19 bp, Homo sapiens
ttgaccagtataaaattac

SEQ ID NO: 1325399 - DNA, 21 bp, Homo sapiens
ttgactctagtactgtgaatc

SEQ ID NO: 1325400 - DNA, 16 bp, Homo sapiens
ttgagagagcagccag

SEQ ID NO: 1325401 - DNA, 16 bp, Homo sapiens
ttgaggagtggttttt

SEQ ID NO: 1325402 - DNA, 13 bp, Homo sapiens
ttgcaagaatgga

SEQ ID NO: 1325403 - DNA, 22 bp, Homo sapiens
ttgccaaataaagttaaaagta

SEQ ID NO: 1325404 - DNA, 17 bp, Homo sapiens
ttgccccaacccttctt

SEQ ID NO: 1325405 - DNA, 19 bp, Homo sapiens
ttgctcccgccccagggtc

SEQ ID NO: 1325406 - DNA, 21 bp, Homo sapiens
ttgctcccgccccagggtctg

SEQ ID NO: 1325407 - DNA, 12 bp, Homo sapiens
ttgctctctgtt

SEQ ID NO: 1325408 - DNA, 17 bp, Homo sapiens
ttgctgctgataatgta

SEQ ID NO: 1325409 - DNA, 20 bp, Homo sapiens
ttgctgtgtgaaatctttca

SEQ ID NO: 1325410 - DNA, 21 bp, Homo sapiens
ttgctgtgtgaaatctttcaa

SEQ ID NO: 1325411 - DNA, 17 bp, Homo sapiens
ttgcttcagtaaaagga

SEQ ID NO: 1325412 - DNA, 16 bp, Homo sapiens
ttggaaactaataaaa

SEQ ID NO: 1325413 - DNA, 20 bp, Homo sapiens
ttggaaactaataaaatatt

SEQ ID NO: 1325414 - DNA, 23 bp, Homo sapiens
ttggaaactaataaaatattttc

SEQ ID NO: 1325415 - DNA, 18 bp, Homo sapiens
ttggacacttaattctgt

SEQ ID NO: 1325416 - DNA, 22 bp, Homo sapiens
ttggataacaccaccattcaca

SEQ ID NO: 1325417 - DNA, 23 bp, Homo sapiens
ttggccaattttagtcttgctgt

SEQ ID NO: 1325418 - DNA, 17 bp, Homo sapiens
ttggccaccccttgctc

SEQ ID NO: 1325419 - DNA, 21 bp, Homo sapiens
ttggcccatcccgccttctcc

SEQ ID NO: 1325420 - DNA, 13 bp, Homo sapiens
ttggcttcctggc

SEQ ID NO: 1325421 - DNA, 21 bp, Homo sapiens
ttggcttcctggcgcccccta

SEQ ID NO: 1325422 - DNA, 17 bp, Homo sapiens
ttgggcagctggggggc

SEQ ID NO: 1325423 - DNA, 17 bp, Homo sapiens
ttggtctcatgccccgc

SEQ ID NO: 1325424 - DNA, 13 bp, Homo sapiens
ttggtgtgcctta

SEQ ID NO: 1325425 - DNA, 17 bp, Homo sapiens
ttggttagctcacagga

SEQ ID NO: 1325426 - DNA, 20 bp, Homo sapiens
ttgtgaacagaagtccttaa

SEQ ID NO: 1325427 - DNA, 16 bp, Homo sapiens
ttgtgaattgcctgcc

SEQ ID NO: 1325428 - DNA, 23 bp, Homo sapiens
ttgtgaattgcctgccatggctg

SEQ ID NO: 1325429 - DNA, 17 bp, Homo sapiens
ttgtgaccttgacttgc

SEQ ID NO: 1325430 - DNA, 22 bp, Homo sapiens
ttgtgactagtgctgaagctta

SEQ ID NO: 1325431 - DNA, 18 bp, Homo sapiens
ttgtgccaaacaaaatga

SEQ ID NO: 1325432 - DNA, 11 bp, Homo sapiens
ttgtggtccaa

SEQ ID NO: 1325433 - DNA, 18 bp, Homo sapiens
ttgtgtaatattacttta

SEQ ID NO: 1325434 - DNA, 12 bp, Homo sapiens
tttaaagggaat

SEQ ID NO: 1325435 - DNA, 17 bp, Homo sapiens
tttaacttatgtatgtg

SEQ ID NO: 1325436 - DNA, 20 bp, Homo sapiens
tttaagaatggtctcagtgt

SEQ ID NO: 1325437 - DNA, 15 bp, Homo sapiens
tttactgagagaagg

SEQ ID NO: 1325438 - DNA, 19 bp, Homo sapiens
tttagtataccagagaagg

SEQ ID NO: 1325439 - DNA, 23 bp, Homo sapiens
tttatcagattgcttttgtgcat

SEQ ID NO: 1325440 - DNA, 17 bp, Homo sapiens
tttcccaggcaaataaa

SEQ ID NO: 1325441 - DNA, 18 bp, Homo sapiens
tttccttttgctgtgtga

SEQ ID NO: 1325442 - DNA, 14 bp, Homo sapiens
tttctaatttgctg

SEQ ID NO: 1325443 - DNA, 22 bp, Homo sapiens
tttctgggtaattcaccaattt

SEQ ID NO: 1325444 - DNA, 20 bp, Homo sapiens
tttctgtgccattttctgta

SEQ ID NO: 1325445 - DNA, 21 bp, Homo sapiens
tttcttcttccacacatgcaa

SEQ ID NO: 1325446 - DNA, 19 bp, Homo sapiens
tttgaaatatggaactgta

SEQ ID NO: 1325447 - DNA, 23 bp, Homo sapiens
tttgaaatatggaactgtaataa

SEQ ID NO: 1325448 - DNA, 18 bp, Homo sapiens
tttgaatgttaagaataa

SEQ ID NO: 1325449 - DNA, 19 bp, Homo sapiens
tttgaatgttaagaataac

SEQ ID NO: 1325450 - DNA, 19 bp, Homo sapiens
tttgaggagtggtttttct

SEQ ID NO: 1325451 - DNA, 23 bp, Homo sapiens
tttgatgataaaaggagaataag

SEQ ID NO: 1325452 - DNA, 14 bp, Homo sapiens
tttgcaacgctcac

SEQ ID NO: 1325453 - DNA, 16 bp, Homo sapiens
tttgctgtgtgaaatc

SEQ ID NO: 1325454 - DNA, 18 bp, Homo sapiens
tttgctgtgtgaaatctt

SEQ ID NO: 1325455 - DNA, 21 bp, Homo sapiens
tttgctgtgtgaaatctttca

SEQ ID NO: 1325456 - DNA, 20 bp, Homo sapiens
tttggaaactaataaaatat

SEQ ID NO: 1325457 - DNA, 12 bp, Homo sapiens
tttgggtggtaa

SEQ ID NO: 1325458 - DNA, 16 bp, Homo sapiens
tttgtgatgtactgta

SEQ ID NO: 1325459 - DNA, 23 bp, Homo sapiens
tttgtgtaatattactttaacat

SEQ ID NO: 1325460 - DNA, 15 bp, Homo sapiens
tttgttttcgatgag

SEQ ID NO: 1325461 - DNA, 21 bp, Homo sapiens
ttttaaataaaaattactgtg

SEQ ID NO: 1325462 - DNA, 20 bp, Homo sapiens
ttttaagaatggtctcagtg

SEQ ID NO: 1325463 - DNA, 12 bp, Homo sapiens
ttttacactgga

SEQ ID NO: 1325464 - DNA, 22 bp, Homo sapiens
ttttagtcttgctgtttcttga

SEQ ID NO: 1325465 - DNA, 18 bp, Homo sapiens
ttttattttttttctgta

SEQ ID NO: 1325466 - DNA, 14 bp, Homo sapiens
ttttccttttgctg

SEQ ID NO: 1325467 - DNA, 16 bp, Homo sapiens
ttttccttttgctgtg

SEQ ID NO: 1325468 - DNA, 14 bp, Homo sapiens
ttttctgaagttgt

SEQ ID NO: 1325469 - DNA, 15 bp, Homo sapiens
ttttctgtgtgttcc

SEQ ID NO: 1325470 - DNA, 17 bp, Homo sapiens
ttttctgtgtgttcctg

SEQ ID NO: 1325471 - DNA, 19 bp, Homo sapiens
ttttctgtgtgttcctggc

SEQ ID NO: 1325472 - DNA, 12 bp, Homo sapiens
ttttgactggct

SEQ ID NO: 1325473 - DNA, 13 bp, Homo sapiens
ttttgttgtttct

SEQ ID NO: 1325474 - DNA, 23 bp, Homo sapiens
tttttaaataaaaattactgtgt

SEQ ID NO: 1325475 - DNA, 12 bp, Homo sapiens
tttttccttttg

SEQ ID NO: 1325476 - DNA, 18 bp, Homo sapiens
tttttctgtaactgtgct

SEQ ID NO: 1325477 - DNA, 18 bp, Homo sapiens
ttttttagggtttctgat

SEQ ID NO: 1325478 - DNA, 16 bp, Homo sapiens
ttttttccttttgctg

SEQ ID NO: 1325479 - DNA, 12 bp, Homo sapiens
actctgctctcc

SEQ ID NO: 1325480 - DNA, 14 bp, Homo sapiens
actctgctctcctc

SEQ ID NO: 1325481 - DNA, 14 bp, Homo sapiens
actctgctgagggt

SEQ ID NO: 1325482 - DNA, 17 bp, Homo sapiens
actctggaccatgctga

SEQ ID NO: 1325483 - DNA, 14 bp, Homo sapiens
actgaagaggagga

SEQ ID NO: 1325484 - DNA, 16 bp, Homo sapiens
actgacccagagggga

SEQ ID NO: 1325485 - DNA, 21 bp, Homo sapiens
actgagaagccaagcctggag

SEQ ID NO: 1325486 - DNA, 22 bp, Homo sapiens
actgagacaaaaaggaaacata

SEQ ID NO: 1325487 - DNA, 12 bp, Homo sapiens
actgatgtgaaa

SEQ ID NO: 1325488 - DNA, 14 bp, Homo sapiens
actgatgtgaaact

SEQ ID NO: 1325489 - DNA, 17 bp, Homo sapiens
actgctactgacccaga

SEQ ID NO: 1325490 - DNA, 12 bp, Homo sapiens
actggcccagaa

SEQ ID NO: 1325491 - DNA, 18 bp, Homo sapiens
actggctcctcccagcac

SEQ ID NO: 1325492 - DNA, 19 bp, Homo sapiens
actggctcctcccagcaca

SEQ ID NO: 1325493 - DNA, 23 bp, Homo sapiens
actggcttgctcccgccccaggg

SEQ ID NO: 1325494 - DNA, 23 bp, Homo sapiens
actggggtcattttgactggctt

SEQ ID NO: 1325495 - DNA, 15 bp, Homo sapiens
actgtaataacttct

SEQ ID NO: 1325496 - DNA, 18 bp, Homo sapiens
actgtgcaggcccaggca

SEQ ID NO: 1325497 - DNA, 21 bp, Homo sapiens
actgtgcaggcccaggcaggc

SEQ ID NO: 1325498 - DNA, 21 bp, Homo sapiens
actgtgggtttgtggggggag

SEQ ID NO: 1325499 - DNA, 22 bp, Homo sapiens
actgttcaggagtccaaacctt

SEQ ID NO: 1325500 - DNA, 13 bp, Homo sapiens
acttaattctgtt

SEQ ID NO: 1325501 - DNA, 12 bp, Homo sapiens
acttatgtatgt

SEQ ID NO: 1325502 - DNA, 19 bp, Homo sapiens
acttctttattttttaact

SEQ ID NO: 1325503 - DNA, 23 bp, Homo sapiens
actttgaattttagcacattgca

SEQ ID NO: 1325504 - DNA, 21 bp, Homo sapiens
actttgacagcgcacagctgc

SEQ ID NO: 1325505 - DNA, 14 bp, Homo sapiens
agaaaaagtcctgt

SEQ ID NO: 1325506 - DNA, 22 bp, Homo sapiens
agaaaccttcactccagacaga

SEQ ID NO: 1325507 - DNA, 14 bp, Homo sapiens
agaaacttgatatt

SEQ ID NO: 1325508 - DNA, 16 bp, Homo sapiens
agaaagagactgtggg

SEQ ID NO: 1325509 - DNA, 21 bp, Homo sapiens
agaaagagactgtggggaggg

SEQ ID NO: 1325510 - DNA, 16 bp, Homo sapiens
agaaagcctcctctgg

SEQ ID NO: 1325511 - DNA, 17 bp, Homo sapiens
agaaagcttctgagttt

SEQ ID NO: 1325512 - DNA, 19 bp, Homo sapiens
agaaagggttctgtaaaat

SEQ ID NO: 1325513 - DNA, 23 bp, Homo sapiens
agaagaggaaccgttttacactg

SEQ ID NO: 1325514 - DNA, 15 bp, Homo sapiens
agaagccttcttgct

SEQ ID NO: 1325515 - DNA, 15 bp, Homo sapiens
agaatagcatgttgt

SEQ ID NO: 1325516 - DNA, 17 bp, Homo sapiens
agaatggtctcagtgtt

SEQ ID NO: 1325517 - DNA, 20 bp, Homo sapiens
agaatggtctcagtgttaat

SEQ ID NO: 1325518 - DNA, 22 bp, Homo sapiens
agaattaggtttctttgaagaa

SEQ ID NO: 1325519 - DNA, 24 bp, Homo sapiens
agaattgggactctgttgctggtc

SEQ ID NO: 1325520 - DNA, 15 bp, Homo sapiens
agacactgtgcaggc

SEQ ID NO: 1325521 - DNA, 24 bp, Homo sapiens
agacagaattcactgtctgttgct

SEQ ID NO: 1325522 - DNA, 13 bp, Homo sapiens
agaccgtcttcct

SEQ ID NO: 1325523 - DNA, 17 bp, Homo sapiens
agacctggctgggcctg

SEQ ID NO: 1325524 - DNA, 13 bp, Homo sapiens
agactctgctctc

SEQ ID NO: 1325525 - DNA, 16 bp, Homo sapiens
agactgtggggagggt

SEQ ID NO: 1325526 - DNA, 22 bp, Homo sapiens
agacttaactggcccagaagct

SEQ ID NO: 1325527 - DNA, 23 bp, Homo sapiens
agacttaactggcccagaagctg

SEQ ID NO: 1325528 - DNA, 21 bp, Homo sapiens
agagaaggtagattttaagaa

SEQ ID NO: 1325529 - DNA, 15 bp, Homo sapiens
agagactgtggggag

SEQ ID NO: 1325530 - DNA, 23 bp, Homo sapiens
agagagggagaaaggaggagaca

SEQ ID NO: 1325531 - DNA, 14 bp, Homo sapiens
agagatgagctttc

SEQ ID NO: 1325532 - DNA, 17 bp, Homo sapiens
agaggaaccgttttaca

SEQ ID NO: 1325533 - DNA, 14 bp, Homo sapiens
agaggaggaggagg

SEQ ID NO: 1325534 - DNA, 21 bp, Homo sapiens
agagtcctccttcccagctct

SEQ ID NO: 1325535 - DNA, 18 bp, Homo sapiens
agataaaaaaacagcttt

SEQ ID NO: 1325536 - DNA, 21 bp, Homo sapiens
agatacaatcagctgctttgt

SEQ ID NO: 1325537 - DNA, 23 bp, Homo sapiens
agatagcagcctggctcccctgg

SEQ ID NO: 1325538 - DNA, 14 bp, Homo sapiens
agatatgcattcaa

SEQ ID NO: 1325539 - DNA, 16 bp, Homo sapiens
agatcacttgatgcca

SEQ ID NO: 1325540 - DNA, 13 bp, Homo sapiens
agatgaacatctc

SEQ ID NO: 1325541 - DNA, 16 bp, Homo sapiens
agatgaacatctctgt

SEQ ID NO: 1325542 - DNA, 14 bp, Homo sapiens
agatgaagaaagag

SEQ ID NO: 1325543 - DNA, 18 bp, Homo sapiens
agatgccggagccccaag

SEQ ID NO: 1325544 - DNA, 20 bp, Homo sapiens
agatgccggagccccaagac

SEQ ID NO: 1325545 - DNA, 16 bp, Homo sapiens
agatgggactgtgtcc

SEQ ID NO: 1325546 - DNA, 14 bp, Homo sapiens
agattcccaggcca

SEQ ID NO: 1325547 - DNA, 19 bp, Homo sapiens
agcaaggcagaaggccagg

SEQ ID NO: 1325548 - DNA, 16 bp, Homo sapiens
agcaagtagagcagag

SEQ ID NO: 1325549 - DNA, 20 bp, Homo sapiens
agcaattactacaaatggat

SEQ ID NO: 1325550 - DNA, 18 bp, Homo sapiens
agcacacggtgagggtgc

SEQ ID NO: 1325551 - DNA, 17 bp, Homo sapiens
agcacatagccctgttg

SEQ ID NO: 1325552 - DNA, 13 bp, Homo sapiens
agcaccctgaggg

SEQ ID NO: 1325553 - DNA, 14 bp, Homo sapiens
agcaccctgagggc

SEQ ID NO: 1325554 - DNA, 14 bp, Homo sapiens
agcagccaggagag

SEQ ID NO: 1325555 - DNA, 14 bp, Homo sapiens
agcatcccagcctc

SEQ ID NO: 1325556 - DNA, 22 bp, Homo sapiens
agcatcccagcctcagaagcct

SEQ ID NO: 1325557 - DNA, 17 bp, Homo sapiens
agccacaggcctggcct

SEQ ID NO: 1325558 - DNA, 18 bp, Homo sapiens
agccacaggcctggcctc

SEQ ID NO: 1325559 - DNA, 18 bp, Homo sapiens
agccaggaacagggacca

SEQ ID NO: 1325560 - DNA, 15 bp, Homo sapiens
agcccaagctaagct

SEQ ID NO: 1325561 - DNA, 18 bp, Homo sapiens
agccccaagactctgctc

SEQ ID NO: 1325562 - DNA, 19 bp, Homo sapiens
agccccaagactctgctct

SEQ ID NO: 1325563 - DNA, 20 bp, Homo sapiens
agcccctagatgaagaaaga

SEQ ID NO: 1325564 - DNA, 21 bp, Homo sapiens
agcccctagatgaagaaagag

SEQ ID NO: 1325565 - DNA, 14 bp, Homo sapiens
agccctgaggggtg

SEQ ID NO: 1325566 - DNA, 16 bp, Homo sapiens
agccctgaggggtgga

SEQ ID NO: 1325567 - DNA, 16 bp, Homo sapiens
agccctgttgacctgc

SEQ ID NO: 1325568 - DNA, 19 bp, Homo sapiens
agccctgttgacctgcccg

SEQ ID NO: 1325569 - DNA, 16 bp, Homo sapiens
agcctcagaagccttc

SEQ ID NO: 1325570 - DNA, 16 bp, Homo sapiens
agcctggagtaggcct

SEQ ID NO: 1325571 - DNA, 16 bp, Homo sapiens
agcctggctcccctgg

SEQ ID NO: 1325572 - DNA, 22 bp, Homo sapiens
agcctgtcccactggctcctcc

SEQ ID NO: 1325573 - DNA, 12 bp, Homo sapiens
agcctgtgtcct

SEQ ID NO: 1325574 - DNA, 17 bp, Homo sapiens
agcctgtgtcctgaaga

SEQ ID NO: 1325575 - DNA, 16 bp, Homo sapiens
agcctgttccttcctg

SEQ ID NO: 1325576 - DNA, 20 bp, Homo sapiens
agcctgttccttcctgcaga

SEQ ID NO: 1325577 - DNA, 21 bp, Homo sapiens
agcctgttccttcctgcagac

SEQ ID NO: 1325578 - DNA, 13 bp, Homo sapiens
agcgcacagctgc

SEQ ID NO: 1325579 - DNA, 14 bp, Homo sapiens
agcgcacagctgct

SEQ ID NO: 1325580 - DNA, 13 bp, Homo sapiens
agcgtcctcagca

SEQ ID NO: 1325581 - DNA, 19 bp, Homo sapiens
agcgtcctcagcaccccac

SEQ ID NO: 1325582 - DNA, 18 bp, Homo sapiens
agctaagctgcaggcaca

SEQ ID NO: 1325583 - DNA, 14 bp, Homo sapiens
agctaataaaatat

SEQ ID NO: 1325584 - DNA, 17 bp, Homo sapiens
agctaataaaatatcat

SEQ ID NO: 1325585 - DNA, 20 bp, Homo sapiens
agctaataaaatatcattca

SEQ ID NO: 1325586 - DNA, 23 bp, Homo sapiens
agctaataaaatatcattcagca

SEQ ID NO: 1325587 - DNA, 12 bp, Homo sapiens
agctcacaggac

SEQ ID NO: 1325588 - DNA, 14 bp, Homo sapiens
agctctacattctg

SEQ ID NO: 1325589 - DNA, 15 bp, Homo sapiens
agctctacattctgc

SEQ ID NO: 1325590 - DNA, 18 bp, Homo sapiens
agctctacattctgctct

SEQ ID NO: 1325591 - DNA, 19 bp, Homo sapiens
agctctacattctgctctg

SEQ ID NO: 1325592 - DNA, 20 bp, Homo sapiens
agctctacattctgctctgc

SEQ ID NO: 1325593 - DNA, 11 bp, Homo sapiens
agctgagaaga

SEQ ID NO: 1325594 - DNA, 23 bp, Homo sapiens
agctgattttcatgaaaatctgc

SEQ ID NO: 1325595 - DNA, 20 bp, Homo sapiens
agctgcaggcacacacgcct

SEQ ID NO: 1325596 - DNA, 17 bp, Homo sapiens
agctgctttgttacctt

SEQ ID NO: 1325597 - DNA, 14 bp, Homo sapiens
agctggggcttctt

SEQ ID NO: 1325598 - DNA, 24 bp, Homo sapiens
agctggggggcaccggctcaggag

SEQ ID NO: 1325599 - DNA, 23 bp, Homo sapiens
agctgtgtcctagttcttgaaca

SEQ ID NO: 1325600 - DNA, 21 bp, Homo sapiens
agctgttgactctagtactgt

SEQ ID NO: 1325601 - DNA, 16 bp, Homo sapiens
agcttagggtctcagg

SEQ ID NO: 1325602 - DNA, 18 bp, Homo sapiens
agcttagggtctcagggt

SEQ ID NO: 1325603 - DNA, 21 bp, Homo sapiens
agcttattaatgctaagggca

SEQ ID NO: 1325604 - DNA, 19 bp, Homo sapiens
agcttgttttggactttgt

SEQ ID NO: 1325605 - DNA, 21 bp, Homo sapiens
agcttgttttggactttgtta

SEQ ID NO: 1325606 - DNA, 12 bp, Homo sapiens
agctttcttttt

SEQ ID NO: 1325607 - DNA, 21 bp, Homo sapiens
aggaaagcaaggcagaaggcc

SEQ ID NO: 1325608 - DNA, 11 bp, Homo sapiens
aggaaatctgg

SEQ ID NO: 1325609 - DNA, 21 bp, Homo sapiens
aggaactccccttcttcctgg

SEQ ID NO: 1325610 - DNA, 17 bp, Homo sapiens
aggaagaatagggccca

SEQ ID NO: 1325611 - DNA, 23 bp, Homo sapiens
aggacctcggggaataaaacatt

SEQ ID NO: 1325612 - DNA, 13 bp, Homo sapiens
aggacctgcaaac

SEQ ID NO: 1325613 - DNA, 22 bp, Homo sapiens
aggacttcccccaccccagaag

SEQ ID NO: 1325614 - DNA, 14 bp, Homo sapiens
aggagacttgtagt

SEQ ID NO: 1325615 - DNA, 21 bp, Homo sapiens
cctcaactgagaagccaagcc

SEQ ID NO: 1325616 - DNA, 11 bp, Homo sapiens
cctcaagcccc

SEQ ID NO: 1325617 - DNA, 12 bp, Homo sapiens
cctcaagcccct

SEQ ID NO: 1325618 - DNA, 18 bp, Homo sapiens
cctcaagccccttctctc

SEQ ID NO: 1325619 - DNA, 22 bp, Homo sapiens
cctcactctgctaccttgcccc

SEQ ID NO: 1325620 - DNA, 23 bp, Homo sapiens
cctcactctgctaccttgcccca

SEQ ID NO: 1325621 - DNA, 16 bp, Homo sapiens
cctcagaagccttctt

SEQ ID NO: 1325622 - DNA, 16 bp, Homo sapiens
cctcagcaccccactc

SEQ ID NO: 1325623 - DNA, 18 bp, Homo sapiens
cctcagcaccccactcct

SEQ ID NO: 1325624 - DNA, 21 bp, Homo sapiens
cctcagcaccccactcctcag

SEQ ID NO: 1325625 - DNA, 14 bp, Homo sapiens
cctcagccaccctt

SEQ ID NO: 1325626 - DNA, 17 bp, Homo sapiens
cctcaggaacccaccct

SEQ ID NO: 1325627 - DNA, 20 bp, Homo sapiens
cctcaggaacccaccctctc

SEQ ID NO: 1325628 - DNA, 21 bp, Homo sapiens
cctcaggaacccaccctctcc

SEQ ID NO: 1325629 - DNA, 24 bp, Homo sapiens
cctcaggaacccaccctctccaca

SEQ ID NO: 1325630 - DNA, 22 bp, Homo sapiens
cctcagtaaaagtcttctccca

SEQ ID NO: 1325631 - DNA, 14 bp, Homo sapiens
cctcatctagtctt

SEQ ID NO: 1325632 - DNA, 18 bp, Homo sapiens
cctcatctagtcttgacc

SEQ ID NO: 1325633 - DNA, 21 bp, Homo sapiens
cctcatctagtcttgacctct

SEQ ID NO: 1325634 - DNA, 23 bp, Homo sapiens
cctccatcacccctggtggctgc

SEQ ID NO: 1325635 - DNA, 15 bp, Homo sapiens
cctccctgttcccca

SEQ ID NO: 1325636 - DNA, 23 bp, Homo sapiens
cctccctgttccccacaggtcct

SEQ ID NO: 1325637 - DNA, 14 bp, Homo sapiens
cctccttcccagct

SEQ ID NO: 1325638 - DNA, 17 bp, Homo sapiens
cctcgggccctgtggtg

SEQ ID NO: 1325639 - DNA, 21 bp, Homo sapiens
catccttcttggcttcctggc

SEQ ID NO: 1325640 - DNA, 18 bp, Homo sapiens
catctacgaagccacagg

SEQ ID NO: 1325641 - DNA, 22 bp, Homo sapiens
catctacgaagccacaggcctg

SEQ ID NO: 1325642 - DNA, 22 bp, Homo sapiens
catctcagtcctcaaagctttt

SEQ ID NO: 1325643 - DNA, 19 bp, Homo sapiens
catctcttgagtgtctatt

SEQ ID NO: 1325644 - DNA, 20 bp, Homo sapiens
catcttccatatccgggtgc

SEQ ID NO: 1325645 - DNA, 22 bp, Homo sapiens
catgagaatgttttagcacagc

SEQ ID NO: 1325646 - DNA, 18 bp, Homo sapiens
catgagagcgcagcccgc

SEQ ID NO: 1325647 - DNA, 20 bp, Homo sapiens
catgataccaggcccaggag

SEQ ID NO: 1325648 - DNA, 23 bp, Homo sapiens
catgcaagggatgaattgtaaaa

SEQ ID NO: 1325649 - DNA, 16 bp, Homo sapiens
catgccagtgcatgcc

SEQ ID NO: 1325650 - DNA, 22 bp, Homo sapiens
catgccagtgcatgccaggaag

SEQ ID NO: 1325651 - DNA, 17 bp, Homo sapiens
catgccccagcccaccc

SEQ ID NO: 1325652 - DNA, 15 bp, Homo sapiens
catgcctaaagccca

SEQ ID NO: 1325653 - DNA, 23 bp, Homo sapiens
catggggggagcaccctgagggc

SEQ ID NO: 1325654 - DNA, 15 bp, Homo sapiens
catgggtcgcccatg

SEQ ID NO: 1325655 - DNA, 19 bp, Homo sapiens
catgggtcgcccatgagag

SEQ ID NO: 1325656 - DNA, 12 bp, Homo sapiens
catgtactgaga

SEQ ID NO: 1325657 - DNA, 14 bp, Homo sapiens
catgtacttcttta

SEQ ID NO: 1325658 - DNA, 17 bp, Homo sapiens
catgtacttctttattt

SEQ ID NO: 1325659 - DNA, 16 bp, Homo sapiens
catgtagaacaagaaa

SEQ ID NO: 1325660 - DNA, 21 bp, Homo sapiens
catgtagaacaagaaatcttt

SEQ ID NO: 1325661 - DNA, 14 bp, Homo sapiens
catgtgccctgcct

SEQ ID NO: 1325662 - DNA, 23 bp, Homo sapiens
catgttgtagatacaatcagctg

SEQ ID NO: 1325663 - DNA, 14 bp, Homo sapiens
catgttttgttttc

SEQ ID NO: 1325664 - DNA, 14 bp, Homo sapiens
cattaagggcctgc

SEQ ID NO: 1325665 - DNA, 18 bp, Homo sapiens
cattaagggcctgctgga

SEQ ID NO: 1325666 - DNA, 19 bp, Homo sapiens
cattcaaacctcacaacag

SEQ ID NO: 1325667 - DNA, 15 bp, Homo sapiens
cattcagccttcaat

SEQ ID NO: 1325668 - DNA, 15 bp, Homo sapiens
cattctgctctgccc

SEQ ID NO: 1325669 - DNA, 16 bp, Homo sapiens
cattgaggaaggaaat

SEQ ID NO: 1325670 - DNA, 20 bp, Homo sapiens
cattgcctcggctggctccc

SEQ ID NO: 1325671 - DNA, 16 bp, Homo sapiens
cattgtgaattgcctg

SEQ ID NO: 1325672 - DNA, 19 bp, Homo sapiens
cattgtgaattgcctgcca

SEQ ID NO: 1325673 - DNA, 20 bp, Homo sapiens
cattgtgaattgcctgccat

SEQ ID NO: 1325674 - DNA, 14 bp, Homo sapiens
catttgtaaatatt

SEQ ID NO: 1325675 - DNA, 14 bp, Homo sapiens
cattttgactggct

SEQ ID NO: 1325676 - DNA, 18 bp, Homo sapiens
ccaaataaagttaaaagt

SEQ ID NO: 1325677 - DNA, 19 bp, Homo sapiens
ccaaattatcaagctaata

SEQ ID NO: 1325678 - DNA, 22 bp, Homo sapiens
ccaacaccatcacagcttgttt

SEQ ID NO: 1325679 - DNA, 16 bp, Homo sapiens
ccaacccttcttcatg

SEQ ID NO: 1325680 - DNA, 13 bp, Homo sapiens
ccaactcagcctg

SEQ ID NO: 1325681 - DNA, 18 bp, Homo sapiens
ccaactcagcctgttcct

SEQ ID NO: 1325682 - DNA, 19 bp, Homo sapiens
ccaactcagcctgttcctt

SEQ ID NO: 1325683 - DNA, 15 bp, Homo sapiens
ccaagactctgctct

SEQ ID NO: 1325684 - DNA, 19 bp, Homo sapiens
ccaagctaagctgcaggca

SEQ ID NO: 1325685 - DNA, 14 bp, Homo sapiens
ccacacatgcaagg

SEQ ID NO: 1325686 - DNA, 13 bp, Homo sapiens
ccacacccagcct

SEQ ID NO: 1325687 - DNA, 15 bp, Homo sapiens
ccacacccagcctgt

SEQ ID NO: 1325688 - DNA, 13 bp, Homo sapiens
ccacacctcctgg

SEQ ID NO: 1325689 - DNA, 14 bp, Homo sapiens
ccacacctcctggg

SEQ ID NO: 1325690 - DNA, 14 bp, Homo sapiens
ccacagctccttgc

SEQ ID NO: 1325691 - DNA, 15 bp, Homo sapiens
ccacagctccttgca

SEQ ID NO: 1325692 - DNA, 18 bp, Homo sapiens
ccacaggtcctccatcac

SEQ ID NO: 1325693 - DNA, 15 bp, Homo sapiens
ccaccaccccaccca

SEQ ID NO: 1325694 - DNA, 16 bp, Homo sapiens
ccaccaccccacccac

SEQ ID NO: 1325695 - DNA, 12 bp, Homo sapiens
ccaccccttgct

SEQ ID NO: 1325696 - DNA, 16 bp, Homo sapiens
ccaccccttgctctct

SEQ ID NO: 1325697 - DNA, 21 bp, Homo sapiens
ccaccccttgctctctgttct

SEQ ID NO: 1325698 - DNA, 12 bp, Homo sapiens
ccaccctctcca

SEQ ID NO: 1325699 - DNA, 13 bp, Homo sapiens
ccaccctctccac

SEQ ID NO: 1325700 - DNA, 21 bp, Homo sapiens
ccaccctctccacacccagcc

SEQ ID NO: 1325701 - DNA, 14 bp, Homo sapiens
ccacccttggtctc

SEQ ID NO: 1325702 - DNA, 19 bp, Homo sapiens
ccacccttggtctcatgcc

SEQ ID NO: 1325703 - DNA, 11 bp, Homo sapiens
ccacctttgca

SEQ ID NO: 1325704 - DNA, 16 bp, Homo sapiens
ccacggctctgtgccc

SEQ ID NO: 1325705 - DNA, 19 bp, Homo sapiens
ccacggctctgtgcccggt

SEQ ID NO: 1325706 - DNA, 23 bp, Homo sapiens
ccacgtctatttcatcagaacag

SEQ ID NO: 1325707 - DNA, 13 bp, Homo sapiens
ccactggctcctc

SEQ ID NO: 1325708 - DNA, 12 bp, Homo sapiens
ccagacagacag

SEQ ID NO: 1325709 - DNA, 16 bp, Homo sapiens
ccagaccccgacaccg

SEQ ID NO: 1325710 - DNA, 15 bp, Homo sapiens
ccagacctggcctct

SEQ ID NO: 1325711 - DNA, 17 bp, Homo sapiens
ccagacctggcctctgc

SEQ ID NO: 1325712 - DNA, 19 bp, Homo sapiens
ccagatcaccaatctagat

SEQ ID NO: 1325713 - DNA, 13 bp, Homo sapiens
ccagattcccagg

SEQ ID NO: 1325714 - DNA, 16 bp, Homo sapiens
ccagattcccaggcca

SEQ ID NO: 1325715 - DNA, 17 bp, Homo sapiens
ccagattcccaggccag

SEQ ID NO: 1325716 - DNA, 15 bp, Homo sapiens
ccagcatcccagcct

SEQ ID NO: 1325717 - DNA, 16 bp, Homo sapiens
ccagcatcccagcctc

SEQ ID NO: 1325718 - DNA, 19 bp, Homo sapiens
ccagcatcccagcctcaga

SEQ ID NO: 1325719 - DNA, 14 bp, Homo sapiens
ccagccctgagggg

SEQ ID NO: 1325720 - DNA, 14 bp, Homo sapiens
ccagcctcagaagc

SEQ ID NO: 1325721 - DNA, 17 bp, Homo sapiens
ccagcctcagaagcctt

SEQ ID NO: 1325722 - DNA, 12 bp, Homo sapiens
ccagcctctgcc

SEQ ID NO: 1325723 - DNA, 18 bp, Homo sapiens
ccagcctgtcccactggc

SEQ ID NO: 1325724 - DNA, 23 bp, Homo sapiens
ccagcctgtcccactggctcctc

SEQ ID NO: 1325725 - DNA, 14 bp, Homo sapiens
ccagcgtcctcagc

SEQ ID NO: 1325726 - DNA, 19 bp, Homo sapiens
ccagctctacattctgctc

SEQ ID NO: 1325727 - DNA, 20 bp, Homo sapiens
ccagctctacattctgctct

SEQ ID NO: 1325728 - DNA, 21 bp, Homo sapiens
ccagctctacattctgctctg

SEQ ID NO: 1325729 - DNA, 22 bp, Homo sapiens
ccagctctacattctgctctgc

SEQ ID NO: 1325730 - DNA, 11 bp, Homo sapiens
ccaggaacagg

SEQ ID NO: 1325731 - DNA, 15 bp, Homo sapiens
ccaggaacagggacc

SEQ ID NO: 1325732 - DNA, 18 bp, Homo sapiens
ccaggaacagggaccagc

SEQ ID NO: 1325733 - DNA, 19 bp, Homo sapiens
ccaggaacagggaccagct

SEQ ID NO: 1325734 - DNA, 21 bp, Homo sapiens
ccaggaacagggaccagctcc

SEQ ID NO: 1325735 - DNA, 22 bp, Homo sapiens
ccaggaacagggaccagctccc

SEQ ID NO: 1325736 - DNA, 19 bp, Homo sapiens
ccaggaagcacgttcacta

SEQ ID NO: 1325737 - DNA, 18 bp, Homo sapiens
ccaggagtaagcccaagc

SEQ ID NO: 1325738 - DNA, 20 bp, Homo sapiens
cacctgcccccacagctcct

SEQ ID NO: 1325739 - DNA, 18 bp, Homo sapiens
cacggtaaccatgatgga

SEQ ID NO: 1325740 - DNA, 23 bp, Homo sapiens
cactcctttagatagcagcctgg

SEQ ID NO: 1325741 - DNA, 16 bp, Homo sapiens
cactgaagaggaggag

SEQ ID NO: 1325742 - DNA, 16 bp, Homo sapiens
cactgcactccagcct

SEQ ID NO: 1325743 - DNA, 15 bp, Homo sapiens
cactgcactgttcag

SEQ ID NO: 1325744 - DNA, 19 bp, Homo sapiens
cactgctactgacccagag

SEQ ID NO: 1325745 - DNA, 14 bp, Homo sapiens
cactggatgtttct

SEQ ID NO: 1325746 - DNA, 17 bp, Homo sapiens
cactggatgtttctcat

SEQ ID NO: 1325747 - DNA, 12 bp, Homo sapiens
cactggctcctc

SEQ ID NO: 1325748 - DNA, 13 bp, Homo sapiens
cactggctcctcc

SEQ ID NO: 1325749 - DNA, 18 bp, Homo sapiens
cactggctcctcccagca

SEQ ID NO: 1325750 - DNA, 13 bp, Homo sapiens
cactgtgcaggcc

SEQ ID NO: 1325751 - DNA, 15 bp, Homo sapiens
cacttaattctgttc

SEQ ID NO: 1325752 - DNA, 18 bp, Homo sapiens
cacttgatgccaggagtt

SEQ ID NO: 1325753 - DNA, 18 bp, Homo sapiens
cagaagccttcttgctgc

SEQ ID NO: 1325754 - DNA, 23 bp, Homo sapiens
cagaagccttcttgctgcccaca

SEQ ID NO: 1325755 - DNA, 11 bp, Homo sapiens
cagaaggccag

SEQ ID NO: 1325756 - DNA, 12 bp, Homo sapiens
cagaaggccagg

SEQ ID NO: 1325757 - DNA, 23 bp, Homo sapiens
cagaaggccaggagtaagcccaa

SEQ ID NO: 1325758 - DNA, 16 bp, Homo sapiens
cagaatgtaggctggt

SEQ ID NO: 1325759 - DNA, 18 bp, Homo sapiens
cagacagatagtgaaaca

SEQ ID NO: 1325760 - DNA, 13 bp, Homo sapiens
cagaccgcgcccc

SEQ ID NO: 1325761 - DNA, 15 bp, Homo sapiens
cagaccgtcttcctc

SEQ ID NO: 1325762 - DNA, 19 bp, Homo sapiens
cagaccgtcttcctccaac

SEQ ID NO: 1325763 - DNA, 20 bp, Homo sapiens
cagaccgtcttcctccaacc

SEQ ID NO: 1325764 - DNA, 13 bp, Homo sapiens
cagacctggcctc

SEQ ID NO: 1325765 - DNA, 13 bp, Homo sapiens
cagacctggctgg

SEQ ID NO: 1325766 - DNA, 19 bp, Homo sapiens
cagacctggctgggcctgg

SEQ ID NO: 1325767 - DNA, 15 bp, Homo sapiens
cagagcaagcctttg

SEQ ID NO: 1325768 - DNA, 17 bp, Homo sapiens
cagagcaagcctttgac

SEQ ID NO: 1325769 - DNA, 18 bp, Homo sapiens
cagagccaaattggtaga

SEQ ID NO: 1325770 - DNA, 15 bp, Homo sapiens
cagaggggaatgagg

SEQ ID NO: 1325771 - DNA, 22 bp, Homo sapiens
cagagtgggctccaagcacaaa

SEQ ID NO: 1325772 - DNA, 20 bp, Homo sapiens
cagatactcatcatatacaa

SEQ ID NO: 1325773 - DNA, 22 bp, Homo sapiens
cagatgaagtaactgaggctta

SEQ ID NO: 1325774 - DNA, 21 bp, Homo sapiens
cagatgccggagccccaagac

SEQ ID NO: 1325775 - DNA, 13 bp, Homo sapiens
cagatggcaggct

SEQ ID NO: 1325776 - DNA, 16 bp, Homo sapiens
cagatggcaggctaca

SEQ ID NO: 1325777 - DNA, 17 bp, Homo sapiens
cagatggcaggctacag

SEQ ID NO: 1325778 - DNA, 20 bp, Homo sapiens
cagattcccaggccaggctc

SEQ ID NO: 1325779 - DNA, 13 bp, Homo sapiens
cagcaccccactc

SEQ ID NO: 1325780 - DNA, 15 bp, Homo sapiens
cagcaccccactcct

SEQ ID NO: 1325781 - DNA, 18 bp, Homo sapiens
cagcacctgagaagagga

SEQ ID NO: 1325782 - DNA, 13 bp, Homo sapiens
cagcatcccagcc

SEQ ID NO: 1325783 - DNA, 17 bp, Homo sapiens
cagcatcccagcctcag

SEQ ID NO: 1325784 - DNA, 21 bp, Homo sapiens
cagccacccttggtctcatgc

SEQ ID NO: 1325785 - DNA, 15 bp, Homo sapiens
cagccaggagagctt

SEQ ID NO: 1325786 - DNA, 23 bp, Homo sapiens
cagccaggagagcttagggtctc

SEQ ID NO: 1325787 - DNA, 12 bp, Homo sapiens
cagccctggccc

SEQ ID NO: 1325788 - DNA, 14 bp, Homo sapiens
cagcctcagaagcc

SEQ ID NO: 1325789 - DNA, 18 bp, Homo sapiens
cagcctcagaagccttct

SEQ ID NO: 1325790 - DNA, 22 bp, Homo sapiens
cagcctcagaagccttcttgct

SEQ ID NO: 1325791 - DNA, 13 bp, Homo sapiens
cagcctggctccc

SEQ ID NO: 1325792 - DNA, 19 bp, Homo sapiens
cagcctgggcccctcagcc

SEQ ID NO: 1325793 - DNA, 22 bp, Homo sapiens
cagcctgggcccctcagccacc

SEQ ID NO: 1325794 - DNA, 17 bp, Homo sapiens
cagcctgtcccactggc

SEQ ID NO: 1325795 - DNA, 19 bp, Homo sapiens
cagcctgtcccactggctc

SEQ ID NO: 1325796 - DNA, 19 bp, Homo sapiens
cagcctgttccttcctgca

SEQ ID NO: 1325797 - DNA, 20 bp, Homo sapiens
cagcctgttccttcctgcag

SEQ ID NO: 1325798 - DNA, 21 bp, Homo sapiens
cagcctgttccttcctgcaga

SEQ ID NO: 1325799 - DNA, 13 bp, Homo sapiens
cagcgcacagctg

SEQ ID NO: 1325800 - DNA, 18 bp, Homo sapiens
cagcgtcctcagcacccc

SEQ ID NO: 1325801 - DNA, 15 bp, Homo sapiens
cagctctacattctg

SEQ ID NO: 1325802 - DNA, 22 bp, Homo sapiens
cagctctacattctgctctgcc

SEQ ID NO: 1325803 - DNA, 20 bp, Homo sapiens
cagctgttcagattggacat

SEQ ID NO: 1325804 - DNA, 21 bp, Homo sapiens
cagcttgttttggactttgtt

SEQ ID NO: 1325805 - DNA, 23 bp, Homo sapiens
caggaacagggaccagctccccg

SEQ ID NO: 1325806 - DNA, 19 bp, Homo sapiens
caggaacccaccctctcca

SEQ ID NO: 1325807 - DNA, 23 bp, Homo sapiens
caggaactccccttcttcctgga

SEQ ID NO: 1325808 - DNA, 16 bp, Homo sapiens
caggacagcacacggt

SEQ ID NO: 1325809 - DNA, 23 bp, Homo sapiens
caggacttcccccaccccagaag

SEQ ID NO: 1325810 - DNA, 13 bp, Homo sapiens
caggagtaagccc

SEQ ID NO: 1325811 - DNA, 15 bp, Homo sapiens
caggagtaagcccaa

SEQ ID NO: 1325812 - DNA, 20 bp, Homo sapiens
caggagtccaaaccttctac

SEQ ID NO: 1325813 - DNA, 16 bp, Homo sapiens
caggcaaataaaattc

SEQ ID NO: 1325814 - DNA, 16 bp, Homo sapiens
caggcacacacgcctt

SEQ ID NO: 1325815 - DNA, 20 bp, Homo sapiens
caggcaggcccagcctctgc

SEQ ID NO: 1325816 - DNA, 20 bp, Homo sapiens
caggcaggtgccaggaactc

SEQ ID NO: 1325817 - DNA, 18 bp, Homo sapiens
caggccagtcccacggct

SEQ ID NO: 1325818 - DNA, 19 bp, Homo sapiens
caggccagtcccacggctc

SEQ ID NO: 1325819 - DNA, 20 bp, Homo sapiens
caggcccagcctctgcccca

SEQ ID NO: 1325820 - DNA, 15 bp, Homo sapiens
caggcccaggcaggc

SEQ ID NO: 1325821 - DNA, 17 bp, Homo sapiens
caggcccaggcaggccc

SEQ ID NO: 1325822 - DNA, 20 bp, Homo sapiens
caggcccaggcaggcccagc

SEQ ID NO: 1325823 - DNA, 21 bp, Homo sapiens
caggcccaggcaggcccagcc

SEQ ID NO: 1325824 - DNA, 18 bp, Homo sapiens
caggctcccgaccccatc

SEQ ID NO: 1325825 - DNA, 15 bp, Homo sapiens
caggcttcccctccc

SEQ ID NO: 1325826 - DNA, 13 bp, Homo sapiens
cagggaccagctc

SEQ ID NO: 1325827 - DNA, 18 bp, Homo sapiens
cagggaccagctccccgg

SEQ ID NO: 1325828 - DNA, 12 bp, Homo sapiens
cagggtctgaaa

SEQ ID NO: 1325829 - DNA, 13 bp, Homo sapiens
accccttgctctc

SEQ ID NO: 1325830 - DNA, 18 bp, Homo sapiens
accccttgctctctgttc

SEQ ID NO: 1325831 - DNA, 24 bp, Homo sapiens
accccttgctctctgttctcttgc

SEQ ID NO: 1325832 - DNA, 18 bp, Homo sapiens
accctcaggaacccaccc

SEQ ID NO: 1325833 - DNA, 21 bp, Homo sapiens
accctctccacacccagcctg

SEQ ID NO: 1325834 - DNA, 18 bp, Homo sapiens
accctgggtcctcgggcc

SEQ ID NO: 1325835 - DNA, 17 bp, Homo sapiens
acccttggcccatcccg

SEQ ID NO: 1325836 - DNA, 22 bp, Homo sapiens
acccttggcccatcccgccttc

SEQ ID NO: 1325837 - DNA, 17 bp, Homo sapiens
acccttggtctcatgcc

SEQ ID NO: 1325838 - DNA, 18 bp, Homo sapiens
acccttggtctcatgccc

SEQ ID NO: 1325839 - DNA, 21 bp, Homo sapiens
acccttggtctcatgccccgc

SEQ ID NO: 1325840 - DNA, 15 bp, Homo sapiens
accgcgcccctggga

SEQ ID NO: 1325841 - DNA, 19 bp, Homo sapiens
accggctcaggagagggcc

SEQ ID NO: 1325842 - DNA, 12 bp, Homo sapiens
acctcacaacag

SEQ ID NO: 1325843 - DNA, 16 bp, Homo sapiens
acctcacactccttta

SEQ ID NO: 1325844 - DNA, 20 bp, Homo sapiens
acctccggccaggtgcctcc

SEQ ID NO: 1325845 - DNA, 23 bp, Homo sapiens
acctctccagcatcccagcctca

SEQ ID NO: 1325846 - DNA, 24 bp, Homo sapiens
acctctccagcatcccagcctcag

SEQ ID NO: 1325847 - DNA, 19 bp, Homo sapiens
acctctgcctttgtggtga

SEQ ID NO: 1325848 - DNA, 14 bp, Homo sapiens
acctgaatggagaa

SEQ ID NO: 1325849 - DNA, 17 bp, Homo sapiens
acctgcagcctccctcc

SEQ ID NO: 1325850 - DNA, 14 bp, Homo sapiens
acctgcccccacag

SEQ ID NO: 1325851 - DNA, 14 bp, Homo sapiens
acctggcctctgcc

SEQ ID NO: 1325852 - DNA, 19 bp, Homo sapiens
acctggcctctgccatcct

SEQ ID NO: 1325853 - DNA, 11 bp, Homo sapiens
acctggctacg

SEQ ID NO: 1325854 - DNA, 17 bp, Homo sapiens
acctggctgggcctggg

SEQ ID NO: 1325855 - DNA, 21 bp, Homo sapiens
acctgggctctcgcggcctct

SEQ ID NO: 1325856 - DNA, 16 bp, Homo sapiens
accttctaccctgggt

SEQ ID NO: 1325857 - DNA, 22 bp, Homo sapiens
accttctaccctgggtcctcgg

SEQ ID NO: 1325858 - DNA, 23 bp, Homo sapiens
accttctcacatggaatgagggt

SEQ ID NO: 1325859 - DNA, 14 bp, Homo sapiens
accttgccccaacc

SEQ ID NO: 1325860 - DNA, 15 bp, Homo sapiens
acgaagccacaggcc

SEQ ID NO: 1325861 - DNA, 14 bp, Homo sapiens
acgattcacagcct

SEQ ID NO: 1325862 - DNA, 16 bp, Homo sapiens
acgcattaagggcctg

SEQ ID NO: 1325863 - DNA, 21 bp, Homo sapiens
acgcattaagggcctgctgga

SEQ ID NO: 1325864 - DNA, 22 bp, Homo sapiens
acgctgcgtgccatgagtccat

SEQ ID NO: 1325865 - DNA, 21 bp, Homo sapiens
acgtctatttcatcagaacag

SEQ ID NO: 1325866 - DNA, 22 bp, Homo sapiens
acgtctatttcatcagaacagc

SEQ ID NO: 1325867 - DNA, 22 bp, Homo sapiens
actaaatggcctctctccacta

SEQ ID NO: 1325868 - DNA, 20 bp, Homo sapiens
actaacaaagttttcatgtg

SEQ ID NO: 1325869 - DNA, 16 bp, Homo sapiens
actaataaaatatttt

SEQ ID NO: 1325870 - DNA, 19 bp, Homo sapiens
actaataaaatattttctg

SEQ ID NO: 1325871 - DNA, 20 bp, Homo sapiens
actaccccgactatccctgc

SEQ ID NO: 1325872 - DNA, 21 bp, Homo sapiens
actaccccgactatccctgca

SEQ ID NO: 1325873 - DNA, 14 bp, Homo sapiens
actactgtatctga

SEQ ID NO: 1325874 - DNA, 16 bp, Homo sapiens
actagtgctgaagctt

SEQ ID NO: 1325875 - DNA, 18 bp, Homo sapiens
actagtgctgaagcttat

SEQ ID NO: 1325876 - DNA, 17 bp, Homo sapiens
actatagcccctggtgt

SEQ ID NO: 1325877 - DNA, 23 bp, Homo sapiens
actatagcccctggtgtgtaaat

SEQ ID NO: 1325878 - DNA, 20 bp, Homo sapiens
actatgagttcacatgtgcc

SEQ ID NO: 1325879 - DNA, 13 bp, Homo sapiens
actcacccttggc

SEQ ID NO: 1325880 - DNA, 14 bp, Homo sapiens
actcacccttggcc

SEQ ID NO: 1325881 - DNA, 12 bp, Homo sapiens
actcagcctgtt

SEQ ID NO: 1325882 - DNA, 19 bp, Homo sapiens
actcagggtctgggatgaa

SEQ ID NO: 1325883 - DNA, 22 bp, Homo sapiens
actcatggacaaagttctgtat

SEQ ID NO: 1325884 - DNA, 20 bp, Homo sapiens
actccagcctgggtgacaga

SEQ ID NO: 1325885 - DNA, 21 bp, Homo sapiens
actccagcctgggtgacagag

SEQ ID NO: 1325886 - DNA, 15 bp, Homo sapiens
actccagcgtcctca

SEQ ID NO: 1325887 - DNA, 21 bp, Homo sapiens
actcccattttgcagatgaag

SEQ ID NO: 1325888 - DNA, 16 bp, Homo sapiens
actcctggtcctaggc

SEQ ID NO: 1325889 - DNA, 22 bp, Homo sapiens
actcctggtcctaggctggaag

SEQ ID NO: 1325890 - DNA, 12 bp, Homo sapiens
tggtggtatctg

SEQ ID NO: 1325891 - DNA, 21 bp, Homo sapiens
tggttattagacaattccatt

SEQ ID NO: 1325892 - DNA, 15 bp, Homo sapiens
tggtttgaagtgtta

SEQ ID NO: 1325893 - DNA, 22 bp, Homo sapiens
tgtaaaatggaaaacttagttt

SEQ ID NO: 1325894 - DNA, 17 bp, Homo sapiens
tgtaaacactcagctgt

SEQ ID NO: 1325895 - DNA, 18 bp, Homo sapiens
tgtaacctgggaaagcca

SEQ ID NO: 1325896 - DNA, 16 bp, Homo sapiens
tgtaagctgtgtccta

SEQ ID NO: 1325897 - DNA, 19 bp, Homo sapiens
tgtacaggacatgtactga

SEQ ID NO: 1325898 - DNA, 23 bp, Homo sapiens
tgtacatagagtgagaagaaaga

SEQ ID NO: 1325899 - DNA, 19 bp, Homo sapiens
tgtactgagacaaaaagga

SEQ ID NO: 1325900 - DNA, 14 bp, Homo sapiens
tgtagataatactg

SEQ ID NO: 1325901 - DNA, 22 bp, Homo sapiens
tgtagataatactgtctaggaa

SEQ ID NO: 1325902 - DNA, 21 bp, Homo sapiens
tgtagatacaatcagctgctt

SEQ ID NO: 1325903 - DNA, 13 bp, Homo sapiens
tgtagatgaacat

SEQ ID NO: 1325904 - DNA, 20 bp, Homo sapiens
tgtagatgaacatctctgtt

SEQ ID NO: 1325905 - DNA, 21 bp, Homo sapiens
tgtaggctggtccctatgtca

SEQ ID NO: 1325906 - DNA, 18 bp, Homo sapiens
tgtatatgaacttaacat

SEQ ID NO: 1325907 - DNA, 16 bp, Homo sapiens
tgtcagttcagaaaaa

SEQ ID NO: 1325908 - DNA, 16 bp, Homo sapiens
tgtcatcaccatggaa

SEQ ID NO: 1325909 - DNA, 14 bp, Homo sapiens
tgtcccactggctc

SEQ ID NO: 1325910 - DNA, 17 bp, Homo sapiens
tgtcccactggctcctc

SEQ ID NO: 1325911 - DNA, 15 bp, Homo sapiens
tgtcctgtaaacact

SEQ ID NO: 1325912 - DNA, 16 bp, Homo sapiens
tgtctgccacattaac

SEQ ID NO: 1325913 - DNA, 14 bp, Homo sapiens
tgtctgtcttcctt

SEQ ID NO: 1325914 - DNA, 16 bp, Homo sapiens
tgtcttccattaagaa

SEQ ID NO: 1325915 - DNA, 14 bp, Homo sapiens
tgtgaaatctttca

SEQ ID NO: 1325916 - DNA, 15 bp, Homo sapiens
tgtgaaatctttcaa

SEQ ID NO: 1325917 - DNA, 18 bp, Homo sapiens
tgtgaaatctttcaagtt

SEQ ID NO: 1325918 - DNA, 15 bp, Homo sapiens
tgtgaagacactgtg

SEQ ID NO: 1325919 - DNA, 23 bp, Homo sapiens
tgtgaagacactgtgcaggccca

SEQ ID NO: 1325920 - DNA, 14 bp, Homo sapiens
tgtgaattgcctgc

SEQ ID NO: 1325921 - DNA, 17 bp, Homo sapiens
tgtgactagtgctgaag

SEQ ID NO: 1325922 - DNA, 23 bp, Homo sapiens
tgtgactagtgctgaagcttatt

SEQ ID NO: 1325923 - DNA, 17 bp, Homo sapiens
tgtgatttctgtgccat

SEQ ID NO: 1325924 - DNA, 15 bp, Homo sapiens
tgtgcacctgggctc

SEQ ID NO: 1325925 - DNA, 14 bp, Homo sapiens
tgtgcccggtgcca

SEQ ID NO: 1325926 - DNA, 16 bp, Homo sapiens
tgtgcccggtgccatc

SEQ ID NO: 1325927 - DNA, 22 bp, Homo sapiens
tgtgcccggtgccatcttccat

SEQ ID NO: 1325928 - DNA, 16 bp, Homo sapiens
tgtgcctgtaatccca

SEQ ID NO: 1325929 - DNA, 21 bp, Homo sapiens
tgtggggagggtcatgtactt

SEQ ID NO: 1325930 - DNA, 14 bp, Homo sapiens
tgtggttcactgca

SEQ ID NO: 1325931 - DNA, 22 bp, Homo sapiens
tgtggttcactgcactgttcag

SEQ ID NO: 1325932 - DNA, 13 bp, Homo sapiens
tgtgtaatattac

SEQ ID NO: 1325933 - DNA, 15 bp, Homo sapiens
tgtgtccaccgttgt

SEQ ID NO: 1325934 - DNA, 11 bp, Homo sapiens
tgtgtgttcct

SEQ ID NO: 1325935 - DNA, 18 bp, Homo sapiens
tgtgttccagccattctg

SEQ ID NO: 1325936 - DNA, 13 bp, Homo sapiens
tgttaccttaaaa

SEQ ID NO: 1325937 - DNA, 20 bp, Homo sapiens
tgttagactatagcccctgg

SEQ ID NO: 1325938 - DNA, 23 bp, Homo sapiens
tgttcaggagtccaaaccttcta

SEQ ID NO: 1325939 - DNA, 10 bp, Homo sapiens
tgttcctggc

SEQ ID NO: 1325940 - DNA, 13 bp, Homo sapiens
tgttccttcctgc

SEQ ID NO: 1325941 - DNA, 16 bp, Homo sapiens
tgttccttcctgcaga

SEQ ID NO: 1325942 - DNA, 19 bp, Homo sapiens
tgttccttcctgcagacct

SEQ ID NO: 1325943 - DNA, 21 bp, Homo sapiens
tgttctcttgctttaaagagt

SEQ ID NO: 1325944 - DNA, 19 bp, Homo sapiens
tgttgactctagtactgtg

SEQ ID NO: 1325945 - DNA, 18 bp, Homo sapiens
tgttgcttcagtaaaagg

SEQ ID NO: 1325946 - DNA, 16 bp, Homo sapiens
tgttttagcacagcgt

SEQ ID NO: 1325947 - DNA, 16 bp, Homo sapiens
tctgggatgaaggctt

SEQ ID NO: 1325948 - DNA, 19 bp, Homo sapiens
tctggggcctaataaaact

SEQ ID NO: 1325949 - DNA, 14 bp, Homo sapiens
tctgtcttcctttg

SEQ ID NO: 1325950 - DNA, 14 bp, Homo sapiens
tctgtgcacctggg

SEQ ID NO: 1325951 - DNA, 21 bp, Homo sapiens
tctgtgccattttctgtaaag

SEQ ID NO: 1325952 - DNA, 15 bp, Homo sapiens
tctgtgtgttcctgg

SEQ ID NO: 1325953 - DNA, 16 bp, Homo sapiens
tctgtgtgttcctggc

SEQ ID NO: 1325954 - DNA, 14 bp, Homo sapiens
tctgttagatgcta

SEQ ID NO: 1325955 - DNA, 23 bp, Homo sapiens
tctgttctgatattaatttatca

SEQ ID NO: 1325956 - DNA, 17 bp, Homo sapiens
tcttaatttggaaacta

SEQ ID NO: 1325957 - DNA, 18 bp, Homo sapiens
tcttaatttggaaactaa

SEQ ID NO: 1325958 - DNA, 18 bp, Homo sapiens
tcttacttgcaaaatgga

SEQ ID NO: 1325959 - DNA, 16 bp, Homo sapiens
tcttctcccaactcag

SEQ ID NO: 1325960 - DNA, 18 bp, Homo sapiens
tcttcttccacacatgca

SEQ ID NO: 1325961 - DNA, 19 bp, Homo sapiens
tcttcttgtctttgtccct

SEQ ID NO: 1325962 - DNA, 21 bp, Homo sapiens
tcttcttgtctttgtccctgt

SEQ ID NO: 1325963 - DNA, 18 bp, Homo sapiens
tcttgacctctccagcat

SEQ ID NO: 1325964 - DNA, 22 bp, Homo sapiens
tcttgacctctccagcatccca

SEQ ID NO: 1325965 - DNA, 15 bp, Homo sapiens
tcttgacctctgcct

SEQ ID NO: 1325966 - DNA, 14 bp, Homo sapiens
tcttgagtgtctat

SEQ ID NO: 1325967 - DNA, 22 bp, Homo sapiens
tcttgatgctcacctctatatt

SEQ ID NO: 1325968 - DNA, 15 bp, Homo sapiens
tcttgctgtttcttg

SEQ ID NO: 1325969 - DNA, 16 bp, Homo sapiens
tcttgctgtttcttga

SEQ ID NO: 1325970 - DNA, 18 bp, Homo sapiens
tcttggacacttaattct

SEQ ID NO: 1325971 - DNA, 21 bp, Homo sapiens
tcttggacacttaattctgtt

SEQ ID NO: 1325972 - DNA, 16 bp, Homo sapiens
tcttggccttactgta

SEQ ID NO: 1325973 - DNA, 13 bp, Homo sapiens
tcttggcttcctg

SEQ ID NO: 1325974 - DNA, 16 bp, Homo sapiens
tcttgtctttgtccct

SEQ ID NO: 1325975 - DNA, 14 bp, Homo sapiens
tcttgtgactagtg

SEQ ID NO: 1325976 - DNA, 19 bp, Homo sapiens
tcttgtgactagtgctgaa

SEQ ID NO: 1325977 - DNA, 21 bp, Homo sapiens
tcttgtgactagtgctgaagc

SEQ ID NO: 1325978 - DNA, 23 bp, Homo sapiens
tcttgtgactagtgctgaagctt

SEQ ID NO: 1325979 - DNA, 12 bp, Homo sapiens
tcttgtttctga

SEQ ID NO: 1325980 - DNA, 14 bp, Homo sapiens
tcttgtttctgagt

SEQ ID NO: 1325981 - DNA, 16 bp, Homo sapiens
tctttctgctggctga

SEQ ID NO: 1325982 - DNA, 22 bp, Homo sapiens
tctttctggaattgatgtttac

SEQ ID NO: 1325983 - DNA, 22 bp, Homo sapiens
tctttgcaccagatactcatca

SEQ ID NO: 1325984 - DNA, 14 bp, Homo sapiens
tctttgtccctgtt

SEQ ID NO: 1325985 - DNA, 13 bp, Homo sapiens
tcttttcttggac

SEQ ID NO: 1325986 - DNA, 15 bp, Homo sapiens
tcttttgttgtttct

SEQ ID NO: 1325987 - DNA, 15 bp, Homo sapiens
tgaaaacctgtcact

SEQ ID NO: 1325988 - DNA, 21 bp, Homo sapiens
tgaaagtcttgtgactagtgc

SEQ ID NO: 1325989 - DNA, 20 bp, Homo sapiens
tgaaatatggaactgtaata

SEQ ID NO: 1325990 - DNA, 16 bp, Homo sapiens
tgaaatcctggttcct

SEQ ID NO: 1325991 - DNA, 19 bp, Homo sapiens
cgtgccatgagtccatgtc

SEQ ID NO: 1325992 - DNA, 13 bp, Homo sapiens
cgtttcaggacca

SEQ ID NO: 1325993 - DNA, 23 bp, Homo sapiens
cgttttcaaagataaatgaaata

SEQ ID NO: 1325994 - DNA, 13 bp, Homo sapiens
ctaaagccaggaa

SEQ ID NO: 1325995 - DNA, 15 bp, Homo sapiens
ctaaagccaggaaca

SEQ ID NO: 1325996 - DNA, 15 bp, Homo sapiens
ctaaagcccattgct

SEQ ID NO: 1325997 - DNA, 17 bp, Homo sapiens
ctaaagcccattgctgc

SEQ ID NO: 1325998 - DNA, 19 bp, Homo sapiens
ctaaagcccattgctgcaa

SEQ ID NO: 1325999 - DNA, 13 bp, Homo sapiens
ctaagctgcaggc

SEQ ID NO: 1326000 - DNA, 16 bp, Homo sapiens
ctaataaaactgatgt

SEQ ID NO: 1326001 - DNA, 16 bp, Homo sapiens
ctaataaaatatcatt

SEQ ID NO: 1326002 - DNA, 22 bp, Homo sapiens
ctaataaaatattttctgtgtg

SEQ ID NO: 1326003 - DNA, 15 bp, Homo sapiens
ctaatttcattcaaa

SEQ ID NO: 1326004 - DNA, 22 bp, Homo sapiens
ctacagttgggaagtctcagcc

SEQ ID NO: 1326005 - DNA, 12 bp, Homo sapiens
ctacattctgct

SEQ ID NO: 1326006 - DNA, 14 bp, Homo sapiens
ctacattctgctct

SEQ ID NO: 1326007 - DNA, 19 bp, Homo sapiens
ctacattctgctctgccca

SEQ ID NO: 1326008 - DNA, 14 bp, Homo sapiens
tcagttcagaaaaa

SEQ ID NO: 1326009 - DNA, 12 bp, Homo sapiens
tcatagaatagc

SEQ ID NO: 1326010 - DNA, 18 bp, Homo sapiens
tcatagaatagcatgttg

SEQ ID NO: 1326011 - DNA, 15 bp, Homo sapiens
tcatcagaacagctg

SEQ ID NO: 1326012 - DNA, 16 bp, Homo sapiens
tcatcagaacagctgt

SEQ ID NO: 1326013 - DNA, 17 bp, Homo sapiens
tcatctagtcttgacct

SEQ ID NO: 1326014 - DNA, 16 bp, Homo sapiens
tcatctcagtcctcaa

SEQ ID NO: 1326015 - DNA, 13 bp, Homo sapiens
tcatctggaagtt

SEQ ID NO: 1326016 - DNA, 21 bp, Homo sapiens
tcatgaagacttaactggccc

SEQ ID NO: 1326017 - DNA, 17 bp, Homo sapiens
tcatgactgaagggaaa

SEQ ID NO: 1326018 - DNA, 14 bp, Homo sapiens
tcatgccagtgcat

SEQ ID NO: 1326019 - DNA, 17 bp, Homo sapiens
tcatggacaaagttctg

SEQ ID NO: 1326020 - DNA, 22 bp, Homo sapiens
tcatgtagaacaagaaatcttt

SEQ ID NO: 1326021 - DNA, 16 bp, Homo sapiens
tcattttgactggctt

SEQ ID NO: 1326022 - DNA, 22 bp, Homo sapiens
tccaaaccttctaccctgggtc

SEQ ID NO: 1326023 - DNA, 21 bp, Homo sapiens
tccacacccagcctgtcccac

SEQ ID NO: 1326024 - DNA, 20 bp, Homo sapiens
tccacagtgtgaagacactg

SEQ ID NO: 1326025 - DNA, 23 bp, Homo sapiens
tccacagtgtgaagacactgtgc

SEQ ID NO: 1326026 - DNA, 15 bp, Homo sapiens
tccactggacactgt

SEQ ID NO: 1326027 - DNA, 18 bp, Homo sapiens
tccagattcccaggccag

SEQ ID NO: 1326028 - DNA, 19 bp, Homo sapiens
tccagcatcccagcctcag

SEQ ID NO: 1326029 - DNA, 20 bp, Homo sapiens
tccatatccgggtgctcaat

SEQ ID NO: 1326030 - DNA, 18 bp, Homo sapiens
tccatgtcctatgcctca

SEQ ID NO: 1326031 - DNA, 15 bp, Homo sapiens
tccattaagaacact

SEQ ID NO: 1326032 - DNA, 14 bp, Homo sapiens
tcccaactcagcct

SEQ ID NO: 1326033 - DNA, 19 bp, Homo sapiens
tcccactggctcctcccag

SEQ ID NO: 1326034 - DNA, 13 bp, Homo sapiens
tcccagcacaggc

SEQ ID NO: 1326035 - DNA, 14 bp, Homo sapiens
tcccagcacaggca

SEQ ID NO: 1326036 - DNA, 16 bp, Homo sapiens
tcccagccctgagggg

SEQ ID NO: 1326037 - DNA, 12 bp, Homo sapiens
tcccagcctcag

SEQ ID NO: 1326038 - DNA, 17 bp, Homo sapiens
tcccagcctcagaagcc

SEQ ID NO: 1326039 - DNA, 23 bp, Homo sapiens
tcccagcctcagaagccttcttg

SEQ ID NO: 1326040 - DNA, 20 bp, Homo sapiens
tcccagctctacattctgct

SEQ ID NO: 1326041 - DNA, 21 bp, Homo sapiens
tccccaccagtgaatgaaagt

SEQ ID NO: 1326042 - DNA, 17 bp, Homo sapiens
tcccccaccccagaaga

SEQ ID NO: 1326043 - DNA, 21 bp, Homo sapiens
tccccctagtccggttcttct

SEQ ID NO: 1326044 - DNA, 22 bp, Homo sapiens
tccccgggggccaactcaccct

SEQ ID NO: 1326045 - DNA, 21 bp, Homo sapiens
ttttacactggatgtttctca

SEQ ID NO: 1326046 - DNA, 11 bp, Homo sapiens
ttttcaaagat

SEQ ID NO: 1326047 - DNA, 11 bp, Homo sapiens
ttttctgtgtg

SEQ ID NO: 1326048 - DNA, 12 bp, Homo sapiens
ttttctgtgtgt

SEQ ID NO: 1326049 - DNA, 14 bp, Homo sapiens
ttttgactggcttg

SEQ ID NO: 1326050 - DNA, 19 bp, Homo sapiens
ttttgctgtgtgaaatctt

SEQ ID NO: 1326051 - DNA, 22 bp, Homo sapiens
ttttggccaccccttgctctct

SEQ ID NO: 1326052 - DNA, 14 bp, Homo sapiens
ttttgtgcattgga

SEQ ID NO: 1326053 - DNA, 23 bp, Homo sapiens
ttttgttgtttcttaatttggaa

SEQ ID NO: 1326054 - DNA, 23 bp, Homo sapiens
tttttcccaggcaaataaaattc

SEQ ID NO: 1326055 - DNA, 12 bp, Homo sapiens
tttttgaaaacc

SEQ ID NO: 1326056 - DNA, 19 bp, Homo sapiens
ttttttaacttatgtatgt

SEQ ID NO: 1326057 - DNA, 22 bp, Homo sapiens
aaaaagtcctgtcagttcagaa

SEQ ID NO: 1326058 - DNA, 14 bp, Homo sapiens
aaaaattgtctctt

SEQ ID NO: 1326059 - DNA, 18 bp, Homo sapiens
aaaaattgtctcttttca

SEQ ID NO: 1326060 - DNA, 21 bp, Homo sapiens
aaaagcaattactacaaatgg

SEQ ID NO: 1326061 - DNA, 20 bp, Homo sapiens
aaaagtcttctcccaactca

SEQ ID NO: 1326062 - DNA, 17 bp, Homo sapiens
aaaatagagatgagctt

SEQ ID NO: 1326063 - DNA, 13 bp, Homo sapiens
aaaatatcattca

SEQ ID NO: 1326064 - DNA, 14 bp, Homo sapiens
aaaatatcattcag

SEQ ID NO: 1326065 - DNA, 16 bp, Homo sapiens
aaaatatcattcagca

SEQ ID NO: 1326066 - DNA, 13 bp, Homo sapiens
aaaatattttctg

SEQ ID NO: 1326067 - DNA, 17 bp, Homo sapiens
aaaatattttctgtgtg

SEQ ID NO: 1326068 - DNA, 19 bp, Homo sapiens
aaaatattttctgtgtgtt

SEQ ID NO: 1326069 - DNA, 21 bp, Homo sapiens
aaaatattttctgtgtgttcc

SEQ ID NO: 1326070 - DNA, 23 bp, Homo sapiens
aaaatattttctgtgtgttcctg

SEQ ID NO: 1326071 - DNA, 15 bp, Homo sapiens
aaacaagaaagtttc

SEQ ID NO: 1326072 - DNA, 15 bp, Homo sapiens
aaacactcagctgtt

SEQ ID NO: 1326073 - DNA, 16 bp, Homo sapiens
aaacactcagctgttc

SEQ ID NO: 1326074 - DNA, 13 bp, Homo sapiens
aaacagctttctg

SEQ ID NO: 1326075 - DNA, 22 bp, Homo sapiens
aaacataagctacctgaatgga

SEQ ID NO: 1326076 - DNA, 13 bp, Homo sapiens
aaaccaacaccat

SEQ ID NO: 1326077 - DNA, 21 bp, Homo sapiens
aaacctgtgatttctgtgcca

SEQ ID NO: 1326078 - DNA, 20 bp, Homo sapiens
aaaccttttttcttgctact

SEQ ID NO: 1326079 - DNA, 15 bp, Homo sapiens
aaacgtgcgcggact

SEQ ID NO: 1326080 - DNA, 18 bp, Homo sapiens
aaactaataaaatatttt

SEQ ID NO: 1326081 - DNA, 22 bp, Homo sapiens
aaactaataaaatattttctgt

SEQ ID NO: 1326082 - DNA, 17 bp, Homo sapiens
aaactaggcatttgtaa

SEQ ID NO: 1326083 - DNA, 19 bp, Homo sapiens
aaactaggcatttgtaaat

SEQ ID NO: 1326084 - DNA, 15 bp, Homo sapiens
aaactgatgtgaaac

SEQ ID NO: 1326085 - DNA, 16 bp, Homo sapiens
aaacttagtttgtgaa

SEQ ID NO: 1326086 - DNA, 13 bp, Homo sapiens
aaacttgtgcctc

SEQ ID NO: 1326087 - DNA, 20 bp, Homo sapiens
aaagagactgtggggagggt

SEQ ID NO: 1326088 - DNA, 11 bp, Homo sapiens
aaagagtcctc

SEQ ID NO: 1326089 - DNA, 21 bp, Homo sapiens
aaagataacttcatgaagact

SEQ ID NO: 1326090 - DNA, 13 bp, Homo sapiens
aaagccaggaaca

SEQ ID NO: 1326091 - DNA, 15 bp, Homo sapiens
aaagccaggaacagg

SEQ ID NO: 1326092 - DNA, 18 bp, Homo sapiens
aaagtcattaacaagaaa

SEQ ID NO: 1326093 - DNA, 12 bp, Homo sapiens
aaagtcttctcc

SEQ ID NO: 1326094 - DNA, 22 bp, Homo sapiens
aaagtcttctcccaactcagcc

SEQ ID NO: 1326095 - DNA, 22 bp, Homo sapiens
aaagtcttgtgactagtgctga

SEQ ID NO: 1326096 - DNA, 23 bp, Homo sapiens
aaagtcttgtgactagtgctgaa

SEQ ID NO: 1326097 - DNA, 12 bp, Homo sapiens
aaagttaaaagt

SEQ ID NO: 1326098 - DNA, 22 bp, Homo sapiens
aaagtttccccaccagtgaatg

SEQ ID NO: 1326099 - DNA, 12 bp, Homo sapiens
aaataaaattcc

SEQ ID NO: 1326100 - DNA, 19 bp, Homo sapiens
aaatagagatgagctttct

SEQ ID NO: 1326101 - DNA, 14 bp, Homo sapiens
aaatatcattcagc

SEQ ID NO: 1326102 - DNA, 16 bp, Homo sapiens
aaatatcattcagcaa

SEQ ID NO: 1326103 - DNA, 18 bp, Homo sapiens
aaatatggaactgtaata

SEQ ID NO: 1326104 - DNA, 19 bp, Homo sapiens
aaatatggaactgtaataa

SEQ ID NO: 1326105 - DNA, 18 bp, Homo sapiens
aaatatttatttattcta

SEQ ID NO: 1326106 - DNA, 21 bp, Homo sapiens
aaatattttctgtgtgttcct

SEQ ID NO: 1326107 - DNA, 22 bp, Homo sapiens
aaatattttctgtgtgttcctg

SEQ ID NO: 1326108 - DNA, 23 bp, Homo sapiens
aaatattttctgtgtgttcctgg

SEQ ID NO: 1326109 - DNA, 16 bp, Homo sapiens
aaattatcaagctaat

SEQ ID NO: 1326110 - DNA, 17 bp, Homo sapiens
aaattatcaagctaata

SEQ ID NO: 1326111 - DNA, 20 bp, Homo sapiens
aaattatcaagctaataaaa

SEQ ID NO: 1326112 - DNA, 15 bp, Homo sapiens
aaattccctaaagcc

SEQ ID NO: 1326113 - DNA, 12 bp, Homo sapiens
aacaccagaaag

SEQ ID NO: 1326114 - DNA, 14 bp, Homo sapiens
aacactagcatttt

SEQ ID NO: 1326115 - DNA, 15 bp, Homo sapiens
aacagctgttgactc

SEQ ID NO: 1326116 - DNA, 15 bp, Homo sapiens
aacagtcaccactgt

SEQ ID NO: 1326117 - DNA, 21 bp, Homo sapiens
aaccagacagatagtgaaaca

SEQ ID NO: 1326118 - DNA, 22 bp, Homo sapiens
aaccccatctctactaaaaaat

SEQ ID NO: 1326119 - DNA, 16 bp, Homo sapiens
aacccttcttcatgtt

SEQ ID NO: 1326120 - DNA, 17 bp, Homo sapiens
aaccttctaccctgggt

SEQ ID NO: 1326121 - DNA, 17 bp, Homo sapiens
aacgattcacagcctcc

SEQ ID NO: 1326122 - DNA, 10 bp, Homo sapiens
aactaataaa

SEQ ID NO: 1326123 - DNA, 13 bp, Homo sapiens
aactaataaaata

SEQ ID NO: 1326124 - DNA, 16 bp, Homo sapiens
aactaataaaatattt

SEQ ID NO: 1326125 - DNA, 21 bp, Homo sapiens
aactaataaaatattttctgt

SEQ ID NO: 1326126 - DNA, 23 bp, Homo sapiens
aactaataaaatattttctgtgt

SEQ ID NO: 1326127 - DNA, 17 bp, Homo sapiens
aactaggcatttgtaaa

SEQ ID NO: 1326128 - DNA, 14 bp, Homo sapiens
aactcacccttggc

SEQ ID NO: 1326129 - DNA, 12 bp, Homo sapiens
aactcagcctgt

SEQ ID NO: 1326130 - DNA, 14 bp, Homo sapiens
aactccagcgtcct

SEQ ID NO: 1326131 - DNA, 18 bp, Homo sapiens
aactccagcgtcctcagc

SEQ ID NO: 1326132 - DNA, 21 bp, Homo sapiens
aactctgctgagggtccagaa

SEQ ID NO: 1326133 - DNA, 18 bp, Homo sapiens
aactgagaagccaagcct

SEQ ID NO: 1326134 - DNA, 20 bp, Homo sapiens
aactgagaagccaagcctgg

SEQ ID NO: 1326135 - DNA, 12 bp, Homo sapiens
aacttaacatgc

SEQ ID NO: 1326136 - DNA, 15 bp, Homo sapiens
aacttaacatgctgt

SEQ ID NO: 1326137 - DNA, 14 bp, Homo sapiens
aacttatgtatgtg

SEQ ID NO: 1326138 - DNA, 14 bp, Homo sapiens
aacttccctccccc

SEQ ID NO: 1326139 - DNA, 15 bp, Homo sapiens
aacttgtagccagaa

SEQ ID NO: 1326140 - DNA, 12 bp, Homo sapiens
aacttgtgcctc

SEQ ID NO: 1326141 - DNA, 13 bp, Homo sapiens
aagaaagtttccc

SEQ ID NO: 1326142 - DNA, 23 bp, Homo sapiens
aagaaagtttccccaccagtgaa

SEQ ID NO: 1326143 - DNA, 17 bp, Homo sapiens
aagaaatctttctggaa

SEQ ID NO: 1326144 - DNA, 17 bp, Homo sapiens
aagaatggtctcagtgt

SEQ ID NO: 1326145 - DNA, 17 bp, Homo sapiens
aagaattaggtttcttt

SEQ ID NO: 1326146 - DNA, 14 bp, Homo sapiens
aagactctgctctc

SEQ ID NO: 1326147 - DNA, 16 bp, Homo sapiens
aagagactgtggggag

SEQ ID NO: 1326148 - DNA, 18 bp, Homo sapiens
aagagactgtggggaggg

SEQ ID NO: 1326149 - DNA, 14 bp, Homo sapiens
aagagtcctccttc

SEQ ID NO: 1326150 - DNA, 12 bp, Homo sapiens
aagccaggaaca

SEQ ID NO: 1326151 - DNA, 18 bp, Homo sapiens
aagccaggaacagggacc

SEQ ID NO: 1326152 - DNA, 20 bp, Homo sapiens
aagccaggaacagggaccag

SEQ ID NO: 1326153 - DNA, 14 bp, Homo sapiens
aagccatgagaatg

SEQ ID NO: 1326154 - DNA, 13 bp, Homo sapiens
aagccccttctct

SEQ ID NO: 1326155 - DNA, 21 bp, Homo sapiens
aagccccttctctcaatccct

SEQ ID NO: 1326156 - DNA, 18 bp, Homo sapiens
aagcctggagtaggcctg

SEQ ID NO: 1326157 - DNA, 21 bp, Homo sapiens
aagcctggagtaggcctgggg

SEQ ID NO: 1326158 - DNA, 22 bp, Homo sapiens
aagctgcaggcacacacgcctt

SEQ ID NO: 1326159 - DNA, 15 bp, Homo sapiens
aagcttattaatgct

SEQ ID NO: 1326160 - DNA, 23 bp, Homo sapiens
aaggacctcggggaataaaacat

SEQ ID NO: 1326161 - DNA, 16 bp, Homo sapiens
aaggcacctgccccca

SEQ ID NO: 1326162 - DNA, 21 bp, Homo sapiens
aaggcacctgcccccacagct

SEQ ID NO: 1326163 - DNA, 17 bp, Homo sapiens
aaggcatcactttcctg

SEQ ID NO: 1326164 - DNA, 22 bp, Homo sapiens
aaggccaggagtaagcccaagc

SEQ ID NO: 1326165 - DNA, 17 bp, Homo sapiens
aaggcccagacctggcc

SEQ ID NO: 1326166 - DNA, 23 bp, Homo sapiens
aaggcccagacctggcctctgcc

SEQ ID NO: 1326167 - DNA, 18 bp, Homo sapiens
aagtaaaaccttttttct

SEQ ID NO: 1326168 - DNA, 18 bp, Homo sapiens
aagtcctgtcagttcaga

SEQ ID NO: 1326169 - DNA, 14 bp, Homo sapiens
aagtctcagcctgg

SEQ ID NO: 1326170 - DNA, 22 bp, Homo sapiens
aagtcttgtgactagtgctgaa

SEQ ID NO: 1326171 - DNA, 20 bp, Homo sapiens
aagtgaccgcacctcacact

SEQ ID NO: 1326172 - DNA, 21 bp, Homo sapiens
aagtgaggccactgaagagga

SEQ ID NO: 1326173 - DNA, 21 bp, Homo sapiens
aagtgttagactatagcccct

SEQ ID NO: 1326174 - DNA, 14 bp, Homo sapiens
aataaaatatcatt

SEQ ID NO: 1326175 - DNA, 15 bp, Homo sapiens
aataaaatatcattc

SEQ ID NO: 1326176 - DNA, 18 bp, Homo sapiens
aataaaatattttctgtg

SEQ ID NO: 1326177 - DNA, 18 bp, Homo sapiens
aataaaattccctaaagc

SEQ ID NO: 1326178 - DNA, 19 bp, Homo sapiens
aataaaattccctaaagcc

SEQ ID NO: 1326179 - DNA, 15 bp, Homo sapiens
aataaagttaaaagt

SEQ ID NO: 1326180 - DNA, 21 bp, Homo sapiens
aataaattaatatattgtttt

SEQ ID NO: 1326181 - DNA, 15 bp, Homo sapiens
aataactaatacaat

SEQ ID NO: 1326182 - DNA, 11 bp, Homo sapiens
aatacaggaac

SEQ ID NO: 1326183 - DNA, 14 bp, Homo sapiens
aatactgagaaaaa

SEQ ID NO: 1326184 - DNA, 16 bp, Homo sapiens
aatactgagaaaaagt

SEQ ID NO: 1326185 - DNA, 19 bp, Homo sapiens
aatagggcccatgggaggg

SEQ ID NO: 1326186 - DNA, 20 bp, Homo sapiens
aatagggcccatgggaggga

SEQ ID NO: 1326187 - DNA, 13 bp, Homo sapiens
aatattaaaagaa

SEQ ID NO: 1326188 - DNA, 16 bp, Homo sapiens
aatattactttaacat

SEQ ID NO: 1326189 - DNA, 13 bp, Homo sapiens
aatattttctgtg

SEQ ID NO: 1326190 - DNA, 18 bp, Homo sapiens
aatattttctgtgtgttc

SEQ ID NO: 1326191 - DNA, 21 bp, Homo sapiens
actaataaaatattttctgtg

SEQ ID NO: 1326192 - DNA, 15 bp, Homo sapiens
actactgtatctgat

SEQ ID NO: 1326193 - DNA, 19 bp, Homo sapiens
actactgtatctgatgttt

SEQ ID NO: 1326194 - DNA, 15 bp, Homo sapiens
actagactcatactc

SEQ ID NO: 1326195 - DNA, 21 bp, Homo sapiens
actaggccctacacacagacc

SEQ ID NO: 1326196 - DNA, 17 bp, Homo sapiens
actagtgctgaagctta

SEQ ID NO: 1326197 - DNA, 15 bp, Homo sapiens
actatagcccctggt

SEQ ID NO: 1326198 - DNA, 22 bp, Homo sapiens
actatgagttcacatgtgccct

SEQ ID NO: 1326199 - DNA, 13 bp, Homo sapiens
actcagcctgttc

SEQ ID NO: 1326200 - DNA, 21 bp, Homo sapiens
actcagcctgttccttcctgc

SEQ ID NO: 1326201 - DNA, 22 bp, Homo sapiens
actcagcctgttccttcctgca

SEQ ID NO: 1326202 - DNA, 18 bp, Homo sapiens
actccagcgtcctcagca

SEQ ID NO: 1326203 - DNA, 19 bp, Homo sapiens
actccagcgtcctcagcac

SEQ ID NO: 1326204 - DNA, 21 bp, Homo sapiens
actccagcgtcctcagcaccc

SEQ ID NO: 1326205 - DNA, 20 bp, Homo sapiens
actcctcagtaaaagtcttc

SEQ ID NO: 1326206 - DNA, 19 bp, Homo sapiens
atagagatgagctttcttt

SEQ ID NO: 1326207 - DNA, 15 bp, Homo sapiens
atagcagcctggctc

SEQ ID NO: 1326208 - DNA, 16 bp, Homo sapiens
atagccctgttgacct

SEQ ID NO: 1326209 - DNA, 16 bp, Homo sapiens
atagtgaaacagcttt

SEQ ID NO: 1326210 - DNA, 13 bp, Homo sapiens
atataaacagctt

SEQ ID NO: 1326211 - DNA, 13 bp, Homo sapiens
atatcattcagca

SEQ ID NO: 1326212 - DNA, 14 bp, Homo sapiens
atatcattcagcaa

SEQ ID NO: 1326213 - DNA, 22 bp, Homo sapiens
atatccgggtgctcaataaact

SEQ ID NO: 1326214 - DNA, 19 bp, Homo sapiens
atatctgttagatgctact

SEQ ID NO: 1326215 - DNA, 13 bp, Homo sapiens
atatgcattcaag

SEQ ID NO: 1326216 - DNA, 15 bp, Homo sapiens
atatgcattcaagag

SEQ ID NO: 1326217 - DNA, 16 bp, Homo sapiens
atatgctgcttgtgac

SEQ ID NO: 1326218 - DNA, 22 bp, Homo sapiens
atattcttcctggggcccaaat

SEQ ID NO: 1326219 - DNA, 13 bp, Homo sapiens
atcaagctaataa

SEQ ID NO: 1326220 - DNA, 15 bp, Homo sapiens
atcaagctaataaaa

SEQ ID NO: 1326221 - DNA, 23 bp, Homo sapiens
atcagagattattcaacagagag

SEQ ID NO: 1326222 - DNA, 14 bp, Homo sapiens
atcagattgctttt

SEQ ID NO: 1326223 - DNA, 15 bp, Homo sapiens
atcagattgcttttg

SEQ ID NO: 1326224 - DNA, 23 bp, Homo sapiens
atcagcgccggcctccagaactt

SEQ ID NO: 1326225 - DNA, 19 bp, Homo sapiens
atcagctgctttgttacct

SEQ ID NO: 1326226 - DNA, 24 bp, Homo sapiens
atcatggggggagcaccctgaggg

SEQ ID NO: 1326227 - DNA, 14 bp, Homo sapiens
atccaccaccccac

SEQ ID NO: 1326228 - DNA, 16 bp, Homo sapiens
atccagattcccaggc

SEQ ID NO: 1326229 - DNA, 21 bp, Homo sapiens
atccagattcccaggccaggc

SEQ ID NO: 1326230 - DNA, 23 bp, Homo sapiens
atcccagcctcagaagccttctt

SEQ ID NO: 1326231 - DNA, 16 bp, Homo sapiens
atccccgagggcgggg

SEQ ID NO: 1326232 - DNA, 22 bp, Homo sapiens
atccctcatctagtcttgacct

SEQ ID NO: 1326233 - DNA, 17 bp, Homo sapiens
atccctgcacataaact

SEQ ID NO: 1326234 - DNA, 18 bp, Homo sapiens
atccctgcacataaactc

SEQ ID NO: 1326235 - DNA, 18 bp, Homo sapiens
atccgttcattcattcag

SEQ ID NO: 1326236 - DNA, 21 bp, Homo sapiens
atcctccctgttccccacagg

SEQ ID NO: 1326237 - DNA, 23 bp, Homo sapiens
atcctggttcctaggggaatgag

SEQ ID NO: 1326238 - DNA, 22 bp, Homo sapiens
atcgggggtgagcgaagccccc

SEQ ID NO: 1326239 - DNA, 15 bp, Homo sapiens
atctaatttcattca

SEQ ID NO: 1326240 - DNA, 16 bp, Homo sapiens
atctaatttcattcaa

SEQ ID NO: 1326241 - DNA, 19 bp, Homo sapiens
atctacgaagccacaggcc

SEQ ID NO: 1326242 - DNA, 21 bp, Homo sapiens
atctagatctttgtgccaaac

SEQ ID NO: 1326243 - DNA, 19 bp, Homo sapiens
atctcagggcacaatggct

SEQ ID NO: 1326244 - DNA, 12 bp, Homo sapiens
atctctgttatt

SEQ ID NO: 1326245 - DNA, 21 bp, Homo sapiens
atctgatgtttgttttcgatg

SEQ ID NO: 1326246 - DNA, 10 bp, Homo sapiens
atctggaagt

SEQ ID NO: 1326247 - DNA, 17 bp, Homo sapiens
atctgttagatgctact

SEQ ID NO: 1326248 - DNA, 22 bp, Homo sapiens
atcttacagagtgattgtagtt

SEQ ID NO: 1326249 - DNA, 11 bp, Homo sapiens
atctttctgga

SEQ ID NO: 1326250 - DNA, 15 bp, Homo sapiens
atgaacatctctgtt

SEQ ID NO: 1326251 - DNA, 20 bp, Homo sapiens
atgaacttaacatgctgtgt

SEQ ID NO: 1326252 - DNA, 11 bp, Homo sapiens
atgaagaaaga

SEQ ID NO: 1326253 - DNA, 17 bp, Homo sapiens
atgaaggcacctgcccc

SEQ ID NO: 1326254 - DNA, 23 bp, Homo sapiens
atgaaggcacctgcccccacagc

SEQ ID NO: 1326255 - DNA, 19 bp, Homo sapiens
atgacacatttaatgaaca

SEQ ID NO: 1326256 - DNA, 22 bp, Homo sapiens
atgcattgtgaattgcctgcca

SEQ ID NO: 1326257 - DNA, 23 bp, Homo sapiens
atgccccgccatggtcaccctca

SEQ ID NO: 1326258 - DNA, 22 bp, Homo sapiens
atgccctttcttgaattgcatt

SEQ ID NO: 1326259 - DNA, 15 bp, Homo sapiens
atgcctaaagcccat

SEQ ID NO: 1326260 - DNA, 23 bp, Homo sapiens
atgctctgagtagctttacactg

SEQ ID NO: 1326261 - DNA, 11 bp, Homo sapiens
atgctgagaca

SEQ ID NO: 1326262 - DNA, 18 bp, Homo sapiens
atgctgagacatccctca

SEQ ID NO: 1326263 - DNA, 19 bp, Homo sapiens
atgctgagacatccctcat

SEQ ID NO: 1326264 - DNA, 23 bp, Homo sapiens
atgctggctggccttgtggtcca

SEQ ID NO: 1326265 - DNA, 17 bp, Homo sapiens
atgctgtggttcactgc

SEQ ID NO: 1326266 - DNA, 18 bp, Homo sapiens
atgctgtggttcactgca

SEQ ID NO: 1326267 - DNA, 15 bp, Homo sapiens
atggaaaacttagtt

SEQ ID NO: 1326268 - DNA, 13 bp, Homo sapiens
atggaactgtaat

SEQ ID NO: 1326269 - DNA, 13 bp, Homo sapiens
atggaatgagggt

SEQ ID NO: 1326270 - DNA, 17 bp, Homo sapiens
atggacaaagttctgta

SEQ ID NO: 1326271 - DNA, 18 bp, Homo sapiens
atggcctctctccactac

SEQ ID NO: 1326272 - DNA, 21 bp, Homo sapiens
atggggcctttggtaagggaa

SEQ ID NO: 1326273 - DNA, 22 bp, Homo sapiens
atggggggagcaccctgagggc

SEQ ID NO: 1326274 - DNA, 17 bp, Homo sapiens
atgggtcgcccatgaga

SEQ ID NO: 1326275 - DNA, 22 bp, Homo sapiens
atgggtcgcccatgagagcgca

SEQ ID NO: 1326276 - DNA, 13 bp, Homo sapiens
atggtatttgaga

SEQ ID NO: 1326277 - DNA, 12 bp, Homo sapiens
atggtgacctct

SEQ ID NO: 1326278 - DNA, 14 bp, Homo sapiens
atggtgacctctcc

SEQ ID NO: 1326279 - DNA, 18 bp, Homo sapiens
atggtgacctctccggcc

SEQ ID NO: 1326280 - DNA, 21 bp, Homo sapiens
atggtgacctctccggcctgg

SEQ ID NO: 1326281 - DNA, 17 bp, Homo sapiens
atgtactgagacaaaaa

SEQ ID NO: 1326282 - DNA, 22 bp, Homo sapiens
atgtactgagacaaaaaggaaa

SEQ ID NO: 1326283 - DNA, 15 bp, Homo sapiens
atgtacttctttatt

SEQ ID NO: 1326284 - DNA, 22 bp, Homo sapiens
atgtagaacaagaaatctttct

SEQ ID NO: 1326285 - DNA, 13 bp, Homo sapiens
atgtcatgtcttc

SEQ ID NO: 1326286 - DNA, 13 bp, Homo sapiens
atgtcctgtaaac

SEQ ID NO: 1326287 - DNA, 23 bp, Homo sapiens
atgtcctgtaaacactcagctgt

SEQ ID NO: 1326288 - DNA, 19 bp, Homo sapiens
atgtgatataaacagcttc

SEQ ID NO: 1326289 - DNA, 14 bp, Homo sapiens
atgtgccctgcctt

SEQ ID NO: 1326290 - DNA, 15 bp, Homo sapiens
atgtgccctgccttg

SEQ ID NO: 1326291 - DNA, 21 bp, Homo sapiens
atgttgtagatacaatcagct

SEQ ID NO: 1326292 - DNA, 18 bp, Homo sapiens
atgtttttgtactctgca

SEQ ID NO: 1326293 - DNA, 19 bp, Homo sapiens
attaatttatcagattgct

SEQ ID NO: 1326294 - DNA, 15 bp, Homo sapiens
attactttaacatgc

SEQ ID NO: 1326295 - DNA, 19 bp, Homo sapiens
attaggtttctttgaagaa

SEQ ID NO: 1326296 - DNA, 17 bp, Homo sapiens
attataaacagaaaatc

SEQ ID NO: 1326297 - DNA, 13 bp, Homo sapiens
attatcaagctaa

SEQ ID NO: 1326298 - DNA, 17 bp, Homo sapiens
attatcaagctaataaa

SEQ ID NO: 1326299 - DNA, 19 bp, Homo sapiens
attcaacagagagggagaa

SEQ ID NO: 1326300 - DNA, 19 bp, Homo sapiens
attcacaagttaagattct

SEQ ID NO: 1326301 - DNA, 23 bp, Homo sapiens
attcacaagttaagattcttggt

SEQ ID NO: 1326302 - DNA, 13 bp, Homo sapiens
attcacagcctcc

SEQ ID NO: 1326303 - DNA, 20 bp, Homo sapiens
attcacagcctccgcggact

SEQ ID NO: 1326304 - DNA, 22 bp, Homo sapiens
attcacagcctccgcggactgg

SEQ ID NO: 1326305 - DNA, 17 bp, Homo sapiens
attcaccaatttccttt

SEQ ID NO: 1326306 - DNA, 16 bp, Homo sapiens
attcagccttcaatca

SEQ ID NO: 1326307 - DNA, 19 bp, Homo sapiens
attcattgtgaacagaagt

SEQ ID NO: 1326308 - DNA, 20 bp, Homo sapiens
attcattgtgaacagaagtc

SEQ ID NO: 1326309 - DNA, 18 bp, Homo sapiens
attcccaggccaggctcc

SEQ ID NO: 1326310 - DNA, 14 bp, Homo sapiens
attctgctctgccc

SEQ ID NO: 1326311 - DNA, 16 bp, Homo sapiens
attctgctctgcccat

SEQ ID NO: 1326312 - DNA, 20 bp, Homo sapiens
attctgctctgcccatgcct

SEQ ID NO: 1326313 - DNA, 19 bp, Homo sapiens
attctgttctgatattaat

SEQ ID NO: 1326314 - DNA, 13 bp, Homo sapiens
attgatgtttaca

SEQ ID NO: 1326315 - DNA, 19 bp, Homo sapiens
attgatgtttacatgtctg

SEQ ID NO: 1326316 - DNA, 19 bp, Homo sapiens
attgcctcggctggctccc

SEQ ID NO: 1326317 - DNA, 16 bp, Homo sapiens
attgcctgccatggct

SEQ ID NO: 1326318 - DNA, 18 bp, Homo sapiens
attgcctgccatggctgt

SEQ ID NO: 1326319 - DNA, 15 bp, Homo sapiens
attggtgtgccttaa

SEQ ID NO: 1326320 - DNA, 21 bp, Homo sapiens
attgtagatgaacatctctgt

SEQ ID NO: 1326321 - DNA, 13 bp, Homo sapiens
atttactgagaga

SEQ ID NO: 1326322 - DNA, 21 bp, Homo sapiens
atttactgagagaaggtgaaa

SEQ ID NO: 1326323 - DNA, 18 bp, Homo sapiens
atttagtataccagagaa

SEQ ID NO: 1326324 - DNA, 19 bp, Homo sapiens
atttcatcagaacagctgt

SEQ ID NO: 1326325 - DNA, 10 bp, Homo sapiens
atttgcagtc

SEQ ID NO: 1326326 - DNA, 16 bp, Homo sapiens
atttggaaactaataa

SEQ ID NO: 1326327 - DNA, 22 bp, Homo sapiens
atttggaaactaataaaatatt

SEQ ID NO: 1326328 - DNA, 23 bp, Homo sapiens
atttggaaactaataaaatattt

SEQ ID NO: 1326329 - DNA, 16 bp, Homo sapiens
attttacttggaaata

SEQ ID NO: 1326330 - DNA, 13 bp, Homo sapiens
attttctgtaaag

SEQ ID NO: 1326331 - DNA, 11 bp, Homo sapiens
attttctgtgt

SEQ ID NO: 1326332 - DNA, 20 bp, Homo sapiens
attttctgtgtgttcctggc

SEQ ID NO: 1326333 - DNA, 19 bp, Homo sapiens
atttttcccaggcaaataa

SEQ ID NO: 1326334 - DNA, 20 bp, Homo sapiens
atttttggcttactcatgga

SEQ ID NO: 1326335 - DNA, 19 bp, Homo sapiens
caaaagttgatttcttctt

SEQ ID NO: 1326336 - DNA, 21 bp, Homo sapiens
caaaattataggagacttgta

SEQ ID NO: 1326337 - DNA, 13 bp, Homo sapiens
caaaattcatgtg

SEQ ID NO: 1326338 - DNA, 17 bp, Homo sapiens
caaataaaattccctaa

SEQ ID NO: 1326339 - DNA, 19 bp, Homo sapiens
caaataaagttaaaagtaa

SEQ ID NO: 1326340 - DNA, 22 bp, Homo sapiens
caaatgctgtggttcactgcac

SEQ ID NO: 1326341 - DNA, 18 bp, Homo sapiens
caaattatcaagctaata

SEQ ID NO: 1326342 - DNA, 20 bp, Homo sapiens
caaattatcaagctaataaa

SEQ ID NO: 1326343 - DNA, 21 bp, Homo sapiens
caaattatcaagctaataaaa

SEQ ID NO: 1326344 - DNA, 13 bp, Homo sapiens
caacaccagaaag

SEQ ID NO: 1326345 - DNA, 15 bp, Homo sapiens
caacatcagcttgac

SEQ ID NO: 1326346 - DNA, 13 bp, Homo sapiens
caacatctcttga

SEQ ID NO: 1326347 - DNA, 14 bp, Homo sapiens
caacatctcttgag

SEQ ID NO: 1326348 - DNA, 18 bp, Homo sapiens
caacatctcttgagtgtc

SEQ ID NO: 1326349 - DNA, 16 bp, Homo sapiens
caacccaatctggctg

SEQ ID NO: 1326350 - DNA, 17 bp, Homo sapiens
caacccaatctggctgg

SEQ ID NO: 1326351 - DNA, 18 bp, Homo sapiens
caacgtcccctcaagccc

SEQ ID NO: 1326352 - DNA, 19 bp, Homo sapiens
caacgtcccctcaagcccc

SEQ ID NO: 1326353 - DNA, 11 bp, Homo sapiens
caactcagcct

SEQ ID NO: 1326354 - DNA, 14 bp, Homo sapiens
caactcagcctgtt

SEQ ID NO: 1326355 - DNA, 17 bp, Homo sapiens
caactccagcgtcctca

SEQ ID NO: 1326356 - DNA, 15 bp, Homo sapiens
caactctgctgaggg

SEQ ID NO: 1326357 - DNA, 16 bp, Homo sapiens
caactctgctgagggt

SEQ ID NO: 1326358 - DNA, 17 bp, Homo sapiens
caactgagaagccaagc

SEQ ID NO: 1326359 - DNA, 19 bp, Homo sapiens
caactgagaagccaagcct

SEQ ID NO: 1326360 - DNA, 16 bp, Homo sapiens
caacttatttaaatga

SEQ ID NO: 1326361 - DNA, 13 bp, Homo sapiens
caagaaagtttcc

SEQ ID NO: 1326362 - DNA, 14 bp, Homo sapiens
caagaaagtttccc

SEQ ID NO: 1326363 - DNA, 14 bp, Homo sapiens
caagactctgctct

SEQ ID NO: 1326364 - DNA, 15 bp, Homo sapiens
caagactctgctctc

SEQ ID NO: 1326365 - DNA, 18 bp, Homo sapiens
caagactctgctctcctc

SEQ ID NO: 1326366 - DNA, 15 bp, Homo sapiens
caagccccttctctc

SEQ ID NO: 1326367 - DNA, 19 bp, Homo sapiens
caagcctttgacctgttca

SEQ ID NO: 1326368 - DNA, 14 bp, Homo sapiens
caagctaagctgca

SEQ ID NO: 1326369 - DNA, 17 bp, Homo sapiens
caagctaagctgcaggc

SEQ ID NO: 1326370 - DNA, 19 bp, Homo sapiens
caagctaagctgcaggcac

SEQ ID NO: 1326371 - DNA, 16 bp, Homo sapiens
caagctaataaaatat

SEQ ID NO: 1326372 - DNA, 17 bp, Homo sapiens
caagctaataaaatatc

SEQ ID NO: 1326373 - DNA, 19 bp, Homo sapiens
caagctaataaaatatcat

SEQ ID NO: 1326374 - DNA, 23 bp, Homo sapiens
caagctaataaaatatcattcag

SEQ ID NO: 1326375 - DNA, 14 bp, Homo sapiens
caaggcccagacct

SEQ ID NO: 1326376 - DNA, 15 bp, Homo sapiens
caaggcccagacctg

SEQ ID NO: 1326377 - DNA, 22 bp, Homo sapiens
caaggcccagacctggcctctg

SEQ ID NO: 1326378 - DNA, 19 bp, Homo sapiens
caaggcgcgctcagatgcc

SEQ ID NO: 1326379 - DNA, 18 bp, Homo sapiens
caatagcattagaaataa

SEQ ID NO: 1326380 - DNA, 19 bp, Homo sapiens
caatgggagcacatagccc

SEQ ID NO: 1326381 - DNA, 17 bp, Homo sapiens
caattttagtcttgctg

SEQ ID NO: 1326382 - DNA, 14 bp, Homo sapiens
cacaacgtcccctc

SEQ ID NO: 1326383 - DNA, 17 bp, Homo sapiens
cacaagttaagattctt

SEQ ID NO: 1326384 - DNA, 22 bp, Homo sapiens
cacaattgaattagttttttct

SEQ ID NO: 1326385 - DNA, 21 bp, Homo sapiens
cacaattttattttttttctg

SEQ ID NO: 1326386 - DNA, 21 bp, Homo sapiens
cacacagaccgcgcccctggg

SEQ ID NO: 1326387 - DNA, 13 bp, Homo sapiens
cacacccagcctg

SEQ ID NO: 1326388 - DNA, 15 bp, Homo sapiens
cacacccagcctgtc

SEQ ID NO: 1326389 - DNA, 17 bp, Homo sapiens
cacacgccttcatgcca

SEQ ID NO: 1326390 - DNA, 21 bp, Homo sapiens
cacacgccttcatgccagtgc

SEQ ID NO: 1326391 - DNA, 16 bp, Homo sapiens
cacagaccgcgcccct

SEQ ID NO: 1326392 - DNA, 22 bp, Homo sapiens
cacagacggaggactggaactg

SEQ ID NO: 1326393 - DNA, 18 bp, Homo sapiens
cacagctgctctgtgacc

SEQ ID NO: 1326394 - DNA, 13 bp, Homo sapiens
cacaggtcctcca

SEQ ID NO: 1326395 - DNA, 21 bp, Homo sapiens
cacaggtcctccatcacccct

SEQ ID NO: 1326396 - DNA, 22 bp, Homo sapiens
cacaggtcctccatcacccctg

SEQ ID NO: 1326397 - DNA, 23 bp, Homo sapiens
cacaggtcctccatcacccctgg

SEQ ID NO: 1326398 - DNA, 16 bp, Homo sapiens
cacataaactccgttt

SEQ ID NO: 1326399 - DNA, 16 bp, Homo sapiens
cacatagccctgttga

SEQ ID NO: 1326400 - DNA, 22 bp, Homo sapiens
cacatccttcttggcttcctgg

SEQ ID NO: 1326401 - DNA, 23 bp, Homo sapiens
cacatccttcttggcttcctggc

SEQ ID NO: 1326402 - DNA, 17 bp, Homo sapiens
cacatggaatgagggtt

SEQ ID NO: 1326403 - DNA, 15 bp, Homo sapiens
cacatgtgccctgcc

SEQ ID NO: 1326404 - DNA, 16 bp, Homo sapiens
cacatgtgccctgcct

SEQ ID NO: 1326405 - DNA, 18 bp, Homo sapiens
caccactgtgctcaacca

SEQ ID NO: 1326406 - DNA, 21 bp, Homo sapiens
caccagaaagcctcctctgga

SEQ ID NO: 1326407 - DNA, 20 bp, Homo sapiens
caccagtgaatgaaagtctt

SEQ ID NO: 1326408 - DNA, 15 bp, Homo sapiens
caccatcacagcttg

SEQ ID NO: 1326409 - DNA, 14 bp, Homo sapiens
cacccacctttgca

SEQ ID NO: 1326410 - DNA, 13 bp, Homo sapiens
cacccagcctgtc

SEQ ID NO: 1326411 - DNA, 15 bp, Homo sapiens
cacccagcctgtccc

SEQ ID NO: 1326412 - DNA, 23 bp, Homo sapiens
cacccatcagtggagtccagatg

SEQ ID NO: 1326413 - DNA, 20 bp, Homo sapiens
cacccctggtggctgcaggc

SEQ ID NO: 1326414 - DNA, 12 bp, Homo sapiens
caccccttgctc

SEQ ID NO: 1326415 - DNA, 16 bp, Homo sapiens
caccctctccacaccc

SEQ ID NO: 1326416 - DNA, 19 bp, Homo sapiens
caccctctccacacccagc

SEQ ID NO: 1326417 - DNA, 23 bp, Homo sapiens
caccctctccacacccagcctgt

SEQ ID NO: 1326418 - DNA, 16 bp, Homo sapiens
cacccttggtctcatg

SEQ ID NO: 1326419 - DNA, 22 bp, Homo sapiens
cacccttggtctcatgccccgc

SEQ ID NO: 1326420 - DNA, 15 bp, Homo sapiens
caccgctgggttctg

SEQ ID NO: 1326421 - DNA, 20 bp, Homo sapiens
caccgctgggttctgactct

SEQ ID NO: 1326422 - DNA, 16 bp, Homo sapiens
cacctacccctgactt

SEQ ID NO: 1326423 - DNA, 14 bp, Homo sapiens
cacctcacactcct

SEQ ID NO: 1326424 - DNA, 20 bp, Homo sapiens
cacctctcagagcaagcctt

SEQ ID NO: 1326425 - DNA, 15 bp, Homo sapiens
cacctgcccccacag

SEQ ID NO: 1326426 - DNA, 17 bp, Homo sapiens
cacctgcccccacagct

SEQ ID NO: 1326427 - DNA, 23 bp, Homo sapiens
cacctgcccccacagctccttgc

SEQ ID NO: 1326428 - DNA, 24 bp, Homo sapiens
cacctgcccccacagctccttgca

SEQ ID NO: 1326429 - DNA, 14 bp, Homo sapiens
cacgccttcatgcc

SEQ ID NO: 1326430 - DNA, 14 bp, Homo sapiens
cacggctctgtgcc

SEQ ID NO: 1326431 - DNA, 19 bp, Homo sapiens
cacgtctatttcatcagaa

SEQ ID NO: 1326432 - DNA, 23 bp, Homo sapiens
cacgtctatttcatcagaacagc

SEQ ID NO: 1326433 - DNA, 22 bp, Homo sapiens
cactaccccgactatccctgca

SEQ ID NO: 1326434 - DNA, 12 bp, Homo sapiens
cactcagctgtt

SEQ ID NO: 1326435 - DNA, 22 bp, Homo sapiens
cactcctcagtaaaagtcttct

SEQ ID NO: 1326436 - DNA, 13 bp, Homo sapiens
cactgaagaggag

SEQ ID NO: 1326437 - DNA, 17 bp, Homo sapiens
cactgctactgacccag

SEQ ID NO: 1326438 - DNA, 16 bp, Homo sapiens
cactggatgtttctca

SEQ ID NO: 1326439 - DNA, 17 bp, Homo sapiens
cactggctcctcccagc

SEQ ID NO: 1326440 - DNA, 21 bp, Homo sapiens
cactggttttggccacccctt

SEQ ID NO: 1326441 - DNA, 14 bp, Homo sapiens
cactgtgaaataca

SEQ ID NO: 1326442 - DNA, 15 bp, Homo sapiens
cactgtgcaggccca

SEQ ID NO: 1326443 - DNA, 19 bp, Homo sapiens
cactgtgcaggcccaggca

SEQ ID NO: 1326444 - DNA, 13 bp, Homo sapiens
cacttaattctgt

SEQ ID NO: 1326445 - DNA, 20 bp, Homo sapiens
cagaacagctgttgactcta

SEQ ID NO: 1326446 - DNA, 19 bp, Homo sapiens
cagaactttctcttttgaa

SEQ ID NO: 1326447 - DNA, 14 bp, Homo sapiens
cagaagccttcttg

SEQ ID NO: 1326448 - DNA, 17 bp, Homo sapiens
cagaagccttcttgctg

SEQ ID NO: 1326449 - DNA, 21 bp, Homo sapiens
cagaagccttcttgctgccca

SEQ ID NO: 1326450 - DNA, 20 bp, Homo sapiens
cagaagctgattttcatgaa

SEQ ID NO: 1326451 - DNA, 12 bp, Homo sapiens
cagaatgccctg

SEQ ID NO: 1326452 - DNA, 19 bp, Homo sapiens
cagaccccgacaccggcca

SEQ ID NO: 1326453 - DNA, 14 bp, Homo sapiens
cagaccgcgcccct

SEQ ID NO: 1326454 - DNA, 17 bp, Homo sapiens
cagaccgcgcccctggg

SEQ ID NO: 1326455 - DNA, 18 bp, Homo sapiens
cagaccgcgcccctggga

SEQ ID NO: 1326456 - DNA, 19 bp, Homo sapiens
cagaccgcgcccctgggac

SEQ ID NO: 1326457 - DNA, 14 bp, Homo sapiens
cagacctggcctct

SEQ ID NO: 1326458 - DNA, 15 bp, Homo sapiens
cagacctggcctctg

SEQ ID NO: 1326459 - DNA, 12 bp, Homo sapiens
cagacctggctg

SEQ ID NO: 1326460 - DNA, 17 bp, Homo sapiens
cagacctggctgggcct

SEQ ID NO: 1326461 - DNA, 22 bp, Homo sapiens
cagagaaggtagattttaagaa

SEQ ID NO: 1326462 - DNA, 20 bp, Homo sapiens
cagagagggagaaaggagga

SEQ ID NO: 1326463 - DNA, 15 bp, Homo sapiens
cagagggaggacctg

SEQ ID NO: 1326464 - DNA, 19 bp, Homo sapiens
cagagtgattgtagtttaa

SEQ ID NO: 1326465 - DNA, 23 bp, Homo sapiens
cagatctttgcaccagatactca

SEQ ID NO: 1326466 - DNA, 14 bp, Homo sapiens
cagatgccggagcc

SEQ ID NO: 1326467 - DNA, 17 bp, Homo sapiens
cagattgcttttgtgca

SEQ ID NO: 1326468 - DNA, 17 bp, Homo sapiens
cagcaagtagagcagag

SEQ ID NO: 1326469 - DNA, 14 bp, Homo sapiens
cagcacacggtgag

SEQ ID NO: 1326470 - DNA, 14 bp, Homo sapiens
cagcacaggcacct

SEQ ID NO: 1326471 - DNA, 19 bp, Homo sapiens
cagcaccccactcctcagt

SEQ ID NO: 1326472 - DNA, 15 bp, Homo sapiens
cagcatcccagcctc

SEQ ID NO: 1326473 - DNA, 16 bp, Homo sapiens
cagcatcccagcctca

SEQ ID NO: 1326474 - DNA, 18 bp, Homo sapiens
cagcatcccagcctcaga

SEQ ID NO: 1326475 - DNA, 13 bp, Homo sapiens
tgggtgacagagc

SEQ ID NO: 1326476 - DNA, 13 bp, Homo sapiens
tggtaagggaagt

SEQ ID NO: 1326477 - DNA, 17 bp, Homo sapiens
tggtgtcatagaatagc

SEQ ID NO: 1326478 - DNA, 17 bp, Homo sapiens
tggttagctcacaggac

SEQ ID NO: 1326479 - DNA, 19 bp, Homo sapiens
tgtaaaagcaacatcagct

SEQ ID NO: 1326480 - DNA, 22 bp, Homo sapiens
tgtaaaagcaacatcagcttga

SEQ ID NO: 1326481 - DNA, 13 bp, Homo sapiens
tgtaaatattaaa

SEQ ID NO: 1326482 - DNA, 18 bp, Homo sapiens
tgtacatagagtgagaag

SEQ ID NO: 1326483 - DNA, 19 bp, Homo sapiens
tgtacgctgcgtgccatga

SEQ ID NO: 1326484 - DNA, 19 bp, Homo sapiens
tgtacttctttatttttta

SEQ ID NO: 1326485 - DNA, 18 bp, Homo sapiens
tgtagatacaatcagctg

SEQ ID NO: 1326486 - DNA, 19 bp, Homo sapiens
tgtagatacaatcagctgc

SEQ ID NO: 1326487 - DNA, 21 bp, Homo sapiens
agctaataaaatatcattcag

SEQ ID NO: 1326488 - DNA, 22 bp, Homo sapiens
agctctacattctgctctgccc

SEQ ID NO: 1326489 - DNA, 13 bp, Homo sapiens
agctgagaagact

SEQ ID NO: 1326490 - DNA, 21 bp, Homo sapiens
agctgagaagactcaagtccc

SEQ ID NO: 1326491 - DNA, 21 bp, Homo sapiens
agctgagagtgccccactgca

SEQ ID NO: 1326492 - DNA, 18 bp, Homo sapiens
agctgcaggcacacacgc

SEQ ID NO: 1326493 - DNA, 19 bp, Homo sapiens
agctgcaggcacacacgcc

SEQ ID NO: 1326494 - DNA, 21 bp, Homo sapiens
agctgctttgttaccttaaaa

SEQ ID NO: 1326495 - DNA, 23 bp, Homo sapiens
agctggggcttctttctgctggc

SEQ ID NO: 1326496 - DNA, 18 bp, Homo sapiens
gttccttcctgcagacct

SEQ ID NO: 1326497 - DNA, 19 bp, Homo sapiens
gttccttcctgcagacctg

SEQ ID NO: 1326498 - DNA, 22 bp, Homo sapiens
gttccttcctgcagacctggct

SEQ ID NO: 1326499 - DNA, 21 bp, Homo sapiens
gttcttcttgtctttgtccct

SEQ ID NO: 1326500 - DNA, 23 bp, Homo sapiens
gttcttcttgtctttgtccctgt

SEQ ID NO: 1326501 - DNA, 15 bp, Homo sapiens
gttgatttcttcttc

SEQ ID NO: 1326502 - DNA, 14 bp, Homo sapiens
gttggcatgcatcc

SEQ ID NO: 1326503 - DNA, 18 bp, Homo sapiens
gttgggaagtctcagcct

SEQ ID NO: 1326504 - DNA, 18 bp, Homo sapiens
gttggtcatctctcctgt

SEQ ID NO: 1326505 - DNA, 21 bp, Homo sapiens
gttgtagatacaatcagctgc

SEQ ID NO: 1326506 - DNA, 20 bp, Homo sapiens
gttgtttcttaatttggaaa

SEQ ID NO: 1326507 - DNA, 14 bp, Homo sapiens
tcgaaacctgtgat

SEQ ID NO: 1326508 - DNA, 23 bp, Homo sapiens
tcgcatgaacaatgggagcacat

SEQ ID NO: 1326509 - DNA, 22 bp, Homo sapiens
tcgcccatgagagcgcagcccg

SEQ ID NO: 1326510 - DNA, 17 bp, Homo sapiens
tcggctggctcccctgc

SEQ ID NO: 1326511 - DNA, 18 bp, Homo sapiens
tcggctggctcccctgca

SEQ ID NO: 1326512 - DNA, 19 bp, Homo sapiens
tcggctggctcccctgcag

SEQ ID NO: 1326513 - DNA, 21 bp, Homo sapiens
tcggctggctcccctgcagcc

SEQ ID NO: 1326514 - DNA, 20 bp, Homo sapiens
tcgggggtgagcgaagcccc

SEQ ID NO: 1326515 - DNA, 18 bp, Homo sapiens
tcgtgatatgctgcttgt

SEQ ID NO: 1326516 - DNA, 12 bp, Homo sapiens
tcgttttcaaag

SEQ ID NO: 1326517 - DNA, 18 bp, Homo sapiens
tctaacaaaaagcaatta

SEQ ID NO: 1326518 - DNA, 18 bp, Homo sapiens
tctacagcttctgagaat

SEQ ID NO: 1326519 - DNA, 13 bp, Homo sapiens
tctacattctgct

SEQ ID NO: 1326520 - DNA, 19 bp, Homo sapiens
tctaccctgggtcctcggg

SEQ ID NO: 1326521 - DNA, 15 bp, Homo sapiens
tctacgaagccacag

SEQ ID NO: 1326522 - DNA, 16 bp, Homo sapiens
tctacgaagccacagg

SEQ ID NO: 1326523 - DNA, 19 bp, Homo sapiens
tctacgaagccacaggcct

SEQ ID NO: 1326524 - DNA, 21 bp, Homo sapiens
tctacgaagccacaggcctgg

SEQ ID NO: 1326525 - DNA, 24 bp, Homo sapiens
tctacgaagccacaggcctggcct

SEQ ID NO: 1326526 - DNA, 19 bp, Homo sapiens
tctagaggcctgaaatcct

SEQ ID NO: 1326527 - DNA, 21 bp, Homo sapiens
tctagaggcctgaaatcctgg

SEQ ID NO: 1326528 - DNA, 23 bp, Homo sapiens
tctagaggcctgaaatcctggtt

SEQ ID NO: 1326529 - DNA, 14 bp, Homo sapiens
tctagtactgtgaa

SEQ ID NO: 1326530 - DNA, 15 bp, Homo sapiens
tctagtactgtgaat

SEQ ID NO: 1326531 - DNA, 15 bp, Homo sapiens
tctatttcatcagaa

SEQ ID NO: 1326532 - DNA, 22 bp, Homo sapiens
tctcacatggaatgagggtttg

SEQ ID NO: 1326533 - DNA, 16 bp, Homo sapiens
tctcagagcaagcctt

SEQ ID NO: 1326534 - DNA, 17 bp, Homo sapiens
tctcagagcaagccttt

SEQ ID NO: 1326535 - DNA, 22 bp, Homo sapiens
tctcagagcaagcctttgacct

SEQ ID NO: 1326536 - DNA, 22 bp, Homo sapiens
tctcagcctgggcccctcagcc

SEQ ID NO: 1326537 - DNA, 23 bp, Homo sapiens
tctcagtgttaatactgagaaaa

SEQ ID NO: 1326538 - DNA, 21 bp, Homo sapiens
tctcagttcatttcctgaggt

SEQ ID NO: 1326539 - DNA, 15 bp, Homo sapiens
tctcatgtagaacaa

SEQ ID NO: 1326540 - DNA, 13 bp, Homo sapiens
tctccacacccag

SEQ ID NO: 1326541 - DNA, 18 bp, Homo sapiens
tctccacacccagcctgt

SEQ ID NO: 1326542 - DNA, 19 bp, Homo sapiens
tctccacacccagcctgtc

SEQ ID NO: 1326543 - DNA, 15 bp, Homo sapiens
tctccagcatcccag

SEQ ID NO: 1326544 - DNA, 15 bp, Homo sapiens
tctcccaactcagcc

SEQ ID NO: 1326545 - DNA, 18 bp, Homo sapiens
tctcccaactcagcctgt

SEQ ID NO: 1326546 - DNA, 22 bp, Homo sapiens
tctcccaactcagcctgttcct

SEQ ID NO: 1326547 - DNA, 14 bp, Homo sapiens
tctccggcctggcc

SEQ ID NO: 1326548 - DNA, 15 bp, Homo sapiens
tctccggcctggcct

SEQ ID NO: 1326549 - DNA, 16 bp, Homo sapiens
tctcctcgggccctgt

SEQ ID NO: 1326550 - DNA, 22 bp, Homo sapiens
tctcctcgggccctgtggtgct

SEQ ID NO: 1326551 - DNA, 14 bp, Homo sapiens
tctcctgtgtctta

SEQ ID NO: 1326552 - DNA, 16 bp, Homo sapiens
tctctgttctcttgct

SEQ ID NO: 1326553 - DNA, 20 bp, Homo sapiens
tctgaagtctggaacacttt

SEQ ID NO: 1326554 - DNA, 23 bp, Homo sapiens
tctgaggcaaggcccagacctgg

SEQ ID NO: 1326555 - DNA, 22 bp, Homo sapiens
tctgatattaatttatcagatt

SEQ ID NO: 1326556 - DNA, 14 bp, Homo sapiens
tctgatgcagaact

SEQ ID NO: 1326557 - DNA, 12 bp, Homo sapiens
tctgcccatgcc

SEQ ID NO: 1326558 - DNA, 21 bp, Homo sapiens
tctgcccatgcctaaagccca

SEQ ID NO: 1326559 - DNA, 16 bp, Homo sapiens
tctgccccacccatca

SEQ ID NO: 1326560 - DNA, 19 bp, Homo sapiens
tctgctctcctcgggccct

SEQ ID NO: 1326561 - DNA, 21 bp, Homo sapiens
tctgctctcctcgggccctgt

SEQ ID NO: 1326562 - DNA, 14 bp, Homo sapiens
tctgctctgcccat

SEQ ID NO: 1326563 - DNA, 19 bp, Homo sapiens
tctgctctgcccatgccta

SEQ ID NO: 1326564 - DNA, 20 bp, Homo sapiens
tctggggcctaataaaactg

SEQ ID NO: 1326565 - DNA, 13 bp, Homo sapiens
tctgtgcacctgg

SEQ ID NO: 1326566 - DNA, 12 bp, Homo sapiens
tctgtgtgttcc

SEQ ID NO: 1326567 - DNA, 13 bp, Homo sapiens
tctgtgtgttcct

SEQ ID NO: 1326568 - DNA, 15 bp, Homo sapiens
tctgttctcttgctt

SEQ ID NO: 1326569 - DNA, 16 bp, Homo sapiens
tctgttctgatattaa

SEQ ID NO: 1326570 - DNA, 12 bp, Homo sapiens
tcttaatttgga

SEQ ID NO: 1326571 - DNA, 16 bp, Homo sapiens
tcttaatttggaaact

SEQ ID NO: 1326572 - DNA, 18 bp, Homo sapiens
tcttccatatccgggtgc

SEQ ID NO: 1326573 - DNA, 23 bp, Homo sapiens
tcttccatatccgggtgctcaat

SEQ ID NO: 1326574 - DNA, 18 bp, Homo sapiens
tcttctcccaactcagcc

SEQ ID NO: 1326575 - DNA, 13 bp, Homo sapiens
tcttctctcagac

SEQ ID NO: 1326576 - DNA, 14 bp, Homo sapiens
tcttcttcattcca

SEQ ID NO: 1326577 - DNA, 12 bp, Homo sapiens
tcttgacctctc

SEQ ID NO: 1326578 - DNA, 14 bp, Homo sapiens
tcttgacctctcca

SEQ ID NO: 1326579 - DNA, 15 bp, Homo sapiens
tcttgacctctccag

SEQ ID NO: 1326580 - DNA, 18 bp, Homo sapiens
tcttggcttcctggcgcc

SEQ ID NO: 1326581 - DNA, 15 bp, Homo sapiens
tcttgggatctcagg

SEQ ID NO: 1326582 - DNA, 18 bp, Homo sapiens
tcttgtgactagtgctga

SEQ ID NO: 1326583 - DNA, 12 bp, Homo sapiens
tcttttcttgga

SEQ ID NO: 1326584 - DNA, 16 bp, Homo sapiens
tgaaaacctgtcactt

SEQ ID NO: 1326585 - DNA, 17 bp, Homo sapiens
tgaaacagctttctggg

SEQ ID NO: 1326586 - DNA, 18 bp, Homo sapiens
tgaaacagctttctgggt

SEQ ID NO: 1326587 - DNA, 21 bp, Homo sapiens
tgaaactactgtatctgatgt

SEQ ID NO: 1326588 - DNA, 23 bp, Homo sapiens
tgaaactactgtatctgatgttt

SEQ ID NO: 1326589 - DNA, 17 bp, Homo sapiens
tgaaagtcttgtgacta

SEQ ID NO: 1326590 - DNA, 22 bp, Homo sapiens
tgaaagtcttgtgactagtgct

SEQ ID NO: 1326591 - DNA, 19 bp, Homo sapiens
tgaaatatggaactgtaat

SEQ ID NO: 1326592 - DNA, 16 bp, Homo sapiens
tgaaatctttcaagtt

SEQ ID NO: 1326593 - DNA, 12 bp, Homo sapiens
tgaaattaccct

SEQ ID NO: 1326594 - DNA, 23 bp, Homo sapiens
tgaacaatgggagcacatagccc

SEQ ID NO: 1326595 - DNA, 19 bp, Homo sapiens
tgaagaaagagactgtggg

SEQ ID NO: 1326596 - DNA, 22 bp, Homo sapiens
tgaagacactgtgcaggcccag

SEQ ID NO: 1326597 - DNA, 23 bp, Homo sapiens
tgaagacactgtgcaggcccagg

SEQ ID NO: 1326598 - DNA, 19 bp, Homo sapiens
tgaagacttaactggccca

SEQ ID NO: 1326599 - DNA, 15 bp, Homo sapiens
tgaagaggaggagga

SEQ ID NO: 1326600 - DNA, 22 bp, Homo sapiens
tgaagaggttctgattttcttg

SEQ ID NO: 1326601 - DNA, 17 bp, Homo sapiens
tgaagcttattaatgct

SEQ ID NO: 1326602 - DNA, 22 bp, Homo sapiens
tgaagcttattaatgctaaggg

SEQ ID NO: 1326603 - DNA, 18 bp, Homo sapiens
tgaagggaaactgcagct

SEQ ID NO: 1326604 - DNA, 22 bp, Homo sapiens
tgaagtaaaaccttttttcttg

SEQ ID NO: 1326605 - DNA, 23 bp, Homo sapiens
tgaatgaaagtcttgtgactagt

SEQ ID NO: 1326606 - DNA, 18 bp, Homo sapiens
tgaatgtcaatcatattt

SEQ ID NO: 1326607 - DNA, 21 bp, Homo sapiens
tgaattgcattttttaaaaca

SEQ ID NO: 1326608 - DNA, 15 bp, Homo sapiens
tgaattgcctgccat

SEQ ID NO: 1326609 - DNA, 20 bp, Homo sapiens
tgaattgcctgccatggctg

SEQ ID NO: 1326610 - DNA, 24 bp, Homo sapiens
tgacatctacgaagccacaggcct

SEQ ID NO: 1326611 - DNA, 11 bp, Homo sapiens
tgacccagagg

SEQ ID NO: 1326612 - DNA, 13 bp, Homo sapiens
tgacctctccagc

SEQ ID NO: 1326613 - DNA, 17 bp, Homo sapiens
tgacctctccagcatcc

SEQ ID NO: 1326614 - DNA, 15 bp, Homo sapiens
tgacctctccggcct

SEQ ID NO: 1326615 - DNA, 17 bp, Homo sapiens
tgacctctccggcctgg

SEQ ID NO: 1326616 - DNA, 19 bp, Homo sapiens
tgacctctccggcctggcc

SEQ ID NO: 1326617 - DNA, 14 bp, Homo sapiens
tgactagtgctgaa

SEQ ID NO: 1326618 - DNA, 17 bp, Homo sapiens
tgactagtgctgaagct

SEQ ID NO: 1326619 - DNA, 18 bp, Homo sapiens
tgactagtgctgaagctt

SEQ ID NO: 1326620 - DNA, 19 bp, Homo sapiens
tgactctagtactgtgaat

SEQ ID NO: 1326621 - DNA, 23 bp, Homo sapiens
tgactctagtactgtgaatccag

SEQ ID NO: 1326622 - DNA, 17 bp, Homo sapiens
tgactctggaccatgct

SEQ ID NO: 1326623 - DNA, 18 bp, Homo sapiens
tgactctggaccatgctg

SEQ ID NO: 1326624 - DNA, 19 bp, Homo sapiens
tgactctggaccatgctga

SEQ ID NO: 1326625 - DNA, 22 bp, Homo sapiens
tgacttgccatgaaggcacctg

SEQ ID NO: 1326626 - DNA, 15 bp, Homo sapiens
tgagaagccaagcct

SEQ ID NO: 1326627 - DNA, 17 bp, Homo sapiens
tgagaagccaagcctgg

SEQ ID NO: 1326628 - DNA, 23 bp, Homo sapiens
tgagaattgggactctgttgctg

SEQ ID NO: 1326629 - DNA, 18 bp, Homo sapiens
tgagacaaaaaggaaaca

SEQ ID NO: 1326630 - DNA, 12 bp, Homo sapiens
tgagcctgtgtc

SEQ ID NO: 1326631 - DNA, 18 bp, Homo sapiens
tgagcctgtgtcctgaag

SEQ ID NO: 1326632 - DNA, 19 bp, Homo sapiens
tgagctttctttttaaagc

SEQ ID NO: 1326633 - DNA, 15 bp, Homo sapiens
tgaggcaaggcccag

SEQ ID NO: 1326634 - DNA, 19 bp, Homo sapiens
tgaggcaaggcccagacct

SEQ ID NO: 1326635 - DNA, 20 bp, Homo sapiens
tgaggcatgagaatcgcttg

SEQ ID NO: 1326636 - DNA, 14 bp, Homo sapiens
tgaggccactgaag

SEQ ID NO: 1326637 - DNA, 22 bp, Homo sapiens
tgaggccactgaagaggaggag

SEQ ID NO: 1326638 - DNA, 13 bp, Homo sapiens
tgaggcttagaaa

SEQ ID NO: 1326639 - DNA, 16 bp, Homo sapiens
tgagggcggggtgtct

SEQ ID NO: 1326640 - DNA, 19 bp, Homo sapiens
tgagggggctcagttctgg

SEQ ID NO: 1326641 - DNA, 17 bp, Homo sapiens
tgagtagctttacactg

SEQ ID NO: 1326642 - DNA, 22 bp, Homo sapiens
tatggtgacctctccggcctgg

SEQ ID NO: 1326643 - DNA, 14 bp, Homo sapiens
tatgtactacatga

SEQ ID NO: 1326644 - DNA, 22 bp, Homo sapiens
tatgtatctaatttcattcaaa

SEQ ID NO: 1326645 - DNA, 13 bp, Homo sapiens
tattaatgctaag

SEQ ID NO: 1326646 - DNA, 15 bp, Homo sapiens
tattaatgctaaggg

SEQ ID NO: 1326647 - DNA, 17 bp, Homo sapiens
tattactttaacatgcc

SEQ ID NO: 1326648 - DNA, 18 bp, Homo sapiens
tattatcttacttgcaaa

SEQ ID NO: 1326649 - DNA, 17 bp, Homo sapiens
tattcgaaacctgtgat

SEQ ID NO: 1326650 - DNA, 23 bp, Homo sapiens
tattcgaaacctgtgatttctgt

SEQ ID NO: 1326651 - DNA, 11 bp, Homo sapiens
tattttctgtg

SEQ ID NO: 1326652 - DNA, 19 bp, Homo sapiens
tattttctgtgtgttcctg

SEQ ID NO: 1326653 - DNA, 21 bp, Homo sapiens
tcaaaagttgatttcttcttc

SEQ ID NO: 1326654 - DNA, 15 bp, Homo sapiens
tcaacagagagggag

SEQ ID NO: 1326655 - DNA, 21 bp, Homo sapiens
tcaacagagagggagaaagga

SEQ ID NO: 1326656 - DNA, 22 bp, Homo sapiens
tcaacatctcttgagtgtctat

SEQ ID NO: 1326657 - DNA, 23 bp, Homo sapiens
tcaacatctcttgagtgtctatt

SEQ ID NO: 1326658 - DNA, 15 bp, Homo sapiens
tcaactctgctgagg

SEQ ID NO: 1326659 - DNA, 19 bp, Homo sapiens
tcaactgagaagccaagcc

SEQ ID NO: 1326660 - DNA, 20 bp, Homo sapiens
tcaactgagaagccaagcct

SEQ ID NO: 1326661 - DNA, 16 bp, Homo sapiens
tcaagccccttctctc

SEQ ID NO: 1326662 - DNA, 20 bp, Homo sapiens
tcaagctaataaaatatcat

SEQ ID NO: 1326663 - DNA, 15 bp, Homo sapiens
tcaataaacagcagg

SEQ ID NO: 1326664 - DNA, 13 bp, Homo sapiens
tcaatcaacatct

SEQ ID NO: 1326665 - DNA, 14 bp, Homo sapiens
tcaatccctttgca

SEQ ID NO: 1326666 - DNA, 21 bp, Homo sapiens
tcaatgtgatataaacagctt

SEQ ID NO: 1326667 - DNA, 17 bp, Homo sapiens
tcaattatttcccccat

SEQ ID NO: 1326668 - DNA, 21 bp, Homo sapiens
tcaattgtagatgaacatctc

SEQ ID NO: 1326669 - DNA, 16 bp, Homo sapiens
tcacaaatgctgtggt

SEQ ID NO: 1326670 - DNA, 22 bp, Homo sapiens
tcacaagttaagattcttggta

SEQ ID NO: 1326671 - DNA, 18 bp, Homo sapiens
tcacatgtgccctgcctt

SEQ ID NO: 1326672 - DNA, 19 bp, Homo sapiens
tcacatgtgccctgccttg

SEQ ID NO: 1326673 - DNA, 12 bp, Homo sapiens
tcacccctggtg

SEQ ID NO: 1326674 - DNA, 14 bp, Homo sapiens
tcacccctggtggc

SEQ ID NO: 1326675 - DNA, 19 bp, Homo sapiens
tcacccctggtggctgcag

SEQ ID NO: 1326676 - DNA, 20 bp, Homo sapiens
tcacccctggtggctgcagg

SEQ ID NO: 1326677 - DNA, 23 bp, Homo sapiens
tcacgagggtaggaccctcatga

SEQ ID NO: 1326678 - DNA, 14 bp, Homo sapiens
tcactctgctacct

SEQ ID NO: 1326679 - DNA, 21 bp, Homo sapiens
tcactggttttggccacccct

SEQ ID NO: 1326680 - DNA, 16 bp, Homo sapiens
tcagaaaaaatgtgaa

SEQ ID NO: 1326681 - DNA, 14 bp, Homo sapiens
tcagaacagctgtt

SEQ ID NO: 1326682 - DNA, 17 bp, Homo sapiens
tcagaagccttcttgct

SEQ ID NO: 1326683 - DNA, 22 bp, Homo sapiens
tcagaagccttcttgctgccca

SEQ ID NO: 1326684 - DNA, 14 bp, Homo sapiens
tcagagcaagcctt

SEQ ID NO: 1326685 - DNA, 13 bp, Homo sapiens
tcagatctttgca

SEQ ID NO: 1326686 - DNA, 23 bp, Homo sapiens
tcagatctttgcaccagatactc

SEQ ID NO: 1326687 - DNA, 18 bp, Homo sapiens
tcagcctgttccttcctg

SEQ ID NO: 1326688 - DNA, 23 bp, Homo sapiens
tcagcctgttccttcctgcagac

SEQ ID NO: 1326689 - DNA, 16 bp, Homo sapiens
tcagctgctttgttac

SEQ ID NO: 1326690 - DNA, 15 bp, Homo sapiens
tcaggagagggcctt

SEQ ID NO: 1326691 - DNA, 15 bp, Homo sapiens
tcagtaaaagtcttc

SEQ ID NO: 1326692 - DNA, 16 bp, Homo sapiens
tcagtaaaagtcttct

SEQ ID NO: 1326693 - DNA, 20 bp, Homo sapiens
tcagtaaaagtcttctccca

SEQ ID NO: 1326694 - DNA, 15 bp, Homo sapiens
tcagtggagtccaga

SEQ ID NO: 1326695 - DNA, 19 bp, Homo sapiens
tcagtgttaatactgagaa

SEQ ID NO: 1326696 - DNA, 13 bp, Homo sapiens
tcagttcagaaaa

SEQ ID NO: 1326697 - DNA, 15 bp, Homo sapiens
tcagttcatttcctg

SEQ ID NO: 1326698 - DNA, 14 bp, Homo sapiens
tcatcaagaatgag

SEQ ID NO: 1326699 - DNA, 13 bp, Homo sapiens
tcatcaataaaac

SEQ ID NO: 1326700 - DNA, 21 bp, Homo sapiens
tcatcagaacagctgttgact

SEQ ID NO: 1326701 - DNA, 14 bp, Homo sapiens
tcatcattattatt

SEQ ID NO: 1326702 - DNA, 24 bp, Homo sapiens
tcatctagtcttgacctctccagc

SEQ ID NO: 1326703 - DNA, 12 bp, Homo sapiens
tcatctggaagt

SEQ ID NO: 1326704 - DNA, 15 bp, Homo sapiens
tcatgccccgccatg

SEQ ID NO: 1326705 - DNA, 13 bp, Homo sapiens
tcatgctgagcaa

SEQ ID NO: 1326706 - DNA, 20 bp, Homo sapiens
tcatggacaaagttctgtat

SEQ ID NO: 1326707 - DNA, 17 bp, Homo sapiens
tcatggagaaccaccta

SEQ ID NO: 1326708 - DNA, 22 bp, Homo sapiens
tcatggggggagcaccctgagg

SEQ ID NO: 1326709 - DNA, 11 bp, Homo sapiens
tcatgtacttc

SEQ ID NO: 1326710 - DNA, 14 bp, Homo sapiens
tcatgtagaacaag

SEQ ID NO: 1326711 - DNA, 20 bp, Homo sapiens
tcatgtcttccattaagaac

SEQ ID NO: 1326712 - DNA, 12 bp, Homo sapiens
tcattcattcag

SEQ ID NO: 1326713 - DNA, 14 bp, Homo sapiens
tcattgtgaacaga

SEQ ID NO: 1326714 - DNA, 17 bp, Homo sapiens
tcattttgactggcttg

SEQ ID NO: 1326715 - DNA, 13 bp, Homo sapiens
tccacacccagcc

SEQ ID NO: 1326716 - DNA, 14 bp, Homo sapiens
tccacacccagcct

SEQ ID NO: 1326717 - DNA, 17 bp, Homo sapiens
tccacacccagcctgtc

SEQ ID NO: 1326718 - DNA, 15 bp, Homo sapiens
tccaccaccccaccc

SEQ ID NO: 1326719 - DNA, 20 bp, Homo sapiens
tccacctatccaccacccca

SEQ ID NO: 1326720 - DNA, 14 bp, Homo sapiens
tccaccttctcaca

SEQ ID NO: 1326721 - DNA, 15 bp, Homo sapiens
tccaccttctcacat

SEQ ID NO: 1326722 - DNA, 20 bp, Homo sapiens
tccactgctactgacccaga

SEQ ID NO: 1326723 - DNA, 14 bp, Homo sapiens
tccagatggcaggc

SEQ ID NO: 1326724 - DNA, 20 bp, Homo sapiens
tccagattcccaggccaggc

SEQ ID NO: 1326725 - DNA, 12 bp, Homo sapiens
tccagcatccca

SEQ ID NO: 1326726 - DNA, 20 bp, Homo sapiens
tccagcatcccagcctcaga

SEQ ID NO: 1326727 - DNA, 17 bp, Homo sapiens
tccagcctgggtgacag

SEQ ID NO: 1326728 - DNA, 18 bp, Homo sapiens
tccagcctgggtgacaga

SEQ ID NO: 1326729 - DNA, 13 bp, Homo sapiens
tccagcgtcctca

SEQ ID NO: 1326730 - DNA, 14 bp, Homo sapiens
tccagcgtcctcag

SEQ ID NO: 1326731 - DNA, 15 bp, Homo sapiens
tccagcgtcctcagc

SEQ ID NO: 1326732 - DNA, 22 bp, Homo sapiens
tccagcgtcctcagcaccccac

SEQ ID NO: 1326733 - DNA, 14 bp, Homo sapiens
tccaggcttcccct

SEQ ID NO: 1326734 - DNA, 16 bp, Homo sapiens
tccatatccgggtgct

SEQ ID NO: 1326735 - DNA, 22 bp, Homo sapiens
tccatatccgggtgctcaataa

SEQ ID NO: 1326736 - DNA, 17 bp, Homo sapiens
tccatgttttgttttct

SEQ ID NO: 1326737 - DNA, 23 bp, Homo sapiens
tcccaactcagcctgttccttcc

SEQ ID NO: 1326738 - DNA, 19 bp, Homo sapiens
tcccacggctctgtgcccg

SEQ ID NO: 1326739 - DNA, 21 bp, Homo sapiens
tcccactggctcctcccagca

SEQ ID NO: 1326740 - DNA, 17 bp, Homo sapiens
tcccagcacaggcacct

SEQ ID NO: 1326741 - DNA, 14 bp, Homo sapiens
tcccagccctgagg

SEQ ID NO: 1326742 - DNA, 19 bp, Homo sapiens
tcccagccctgaggggtgg

SEQ ID NO: 1326743 - DNA, 13 bp, Homo sapiens
tcccagcctcaga

SEQ ID NO: 1326744 - DNA, 18 bp, Homo sapiens
tcccagcctcagaagcct

SEQ ID NO: 1326745 - DNA, 20 bp, Homo sapiens
tcccagcctcagaagccttc

SEQ ID NO: 1326746 - DNA, 19 bp, Homo sapiens
tcccagctctacattctgc

SEQ ID NO: 1326747 - DNA, 22 bp, Homo sapiens
tcccagctctacattctgctct

SEQ ID NO: 1326748 - DNA, 15 bp, Homo sapiens
tcccaggcaaataaa

SEQ ID NO: 1326749 - DNA, 19 bp, Homo sapiens
tcccctcccagccctgagg

SEQ ID NO: 1326750 - DNA, 19 bp, Homo sapiens
tcccgccttctccaggctt

SEQ ID NO: 1326751 - DNA, 21 bp, Homo sapiens
tccctcatctagtcttgacct

SEQ ID NO: 1326752 - DNA, 17 bp, Homo sapiens
tccctcgttttcaaaga

SEQ ID NO: 1326753 - DNA, 18 bp, Homo sapiens
tccctcgttttcaaagat

SEQ ID NO: 1326754 - DNA, 15 bp, Homo sapiens
tccctgttccccaca

SEQ ID NO: 1326755 - DNA, 16 bp, Homo sapiens
tccctgttccccacag

SEQ ID NO: 1326756 - DNA, 17 bp, Homo sapiens
tcctccatcacccctgg

SEQ ID NO: 1326757 - DNA, 16 bp, Homo sapiens
tcctcccagcacaggc

SEQ ID NO: 1326758 - DNA, 15 bp, Homo sapiens
tcctccttcccagct

SEQ ID NO: 1326759 - DNA, 19 bp, Homo sapiens
tcctcgggcccctgagcct

SEQ ID NO: 1326760 - DNA, 14 bp, Homo sapiens
tcctcgggccctgt

SEQ ID NO: 1326761 - DNA, 21 bp, Homo sapiens
tcctcgggccctgtggtgctg

SEQ ID NO: 1326762 - DNA, 22 bp, Homo sapiens
tcctcttttgttgtttcttaat

SEQ ID NO: 1326763 - DNA, 21 bp, Homo sapiens
tcctgacacacctgcagcctc

SEQ ID NO: 1326764 - DNA, 12 bp, Homo sapiens
tcctgcagacct

SEQ ID NO: 1326765 - DNA, 13 bp, Homo sapiens
tcctgcagacctg

SEQ ID NO: 1326766 - DNA, 16 bp, Homo sapiens
tcctgcagacctggct

SEQ ID NO: 1326767 - DNA, 22 bp, Homo sapiens
tcctggggcccaaatgctggct

SEQ ID NO: 1326768 - DNA, 23 bp, Homo sapiens
tcctggtcctaggctggaaggag

SEQ ID NO: 1326769 - DNA, 20 bp, Homo sapiens
tcctgtgaggcttttaattg

SEQ ID NO: 1326770 - DNA, 14 bp, Homo sapiens
tccttaagcagagg

SEQ ID NO: 1326771 - DNA, 16 bp, Homo sapiens
tccttaagcagaggaa

SEQ ID NO: 1326772 - DNA, 12 bp, Homo sapiens
tccttcccagct

SEQ ID NO: 1326773 - DNA, 14 bp, Homo sapiens
tccttcccagctct

SEQ ID NO: 1326774 - DNA, 16 bp, Homo sapiens
tccttcctgcagacct

SEQ ID NO: 1326775 - DNA, 20 bp, Homo sapiens
tccttcctgcagacctggct

SEQ ID NO: 1326776 - DNA, 17 bp, Homo sapiens
tccttcttggcttcctg

SEQ ID NO: 1326777 - DNA, 22 bp, Homo sapiens
tcctttagatagcagcctggct

SEQ ID NO: 1326778 - DNA, 19 bp, Homo sapiens
cagcatcccagcctcagaa

SEQ ID NO: 1326779 - DNA, 12 bp, Homo sapiens
cagcatgaaaat

SEQ ID NO: 1326780 - DNA, 11 bp, Homo sapiens
cagccctgagg

SEQ ID NO: 1326781 - DNA, 12 bp, Homo sapiens
cagccctgaggg

SEQ ID NO: 1326782 - DNA, 16 bp, Homo sapiens
cagccctgaggggtgg

SEQ ID NO: 1326783 - DNA, 18 bp, Homo sapiens
cagccctggcccatcatg

SEQ ID NO: 1326784 - DNA, 16 bp, Homo sapiens
cagcctcagaagcctt

SEQ ID NO: 1326785 - DNA, 17 bp, Homo sapiens
cagcctctgccccaccc

SEQ ID NO: 1326786 - DNA, 15 bp, Homo sapiens
cagcctggctcccct

SEQ ID NO: 1326787 - DNA, 17 bp, Homo sapiens
cagcctggctcccctgg

SEQ ID NO: 1326788 - DNA, 18 bp, Homo sapiens
cagcctggctcccctggg

SEQ ID NO: 1326789 - DNA, 20 bp, Homo sapiens
cagcctgggcccctcagcca

SEQ ID NO: 1326790 - DNA, 14 bp, Homo sapiens
cagcctgtcccact

SEQ ID NO: 1326791 - DNA, 16 bp, Homo sapiens
cagcctgtcccactgg

SEQ ID NO: 1326792 - DNA, 18 bp, Homo sapiens
cagcctgtcccactggct

SEQ ID NO: 1326793 - DNA, 22 bp, Homo sapiens
cagcctgtcccactggctcctc

SEQ ID NO: 1326794 - DNA, 18 bp, Homo sapiens
cagcctgttccttcctgc

SEQ ID NO: 1326795 - DNA, 22 bp, Homo sapiens
cagccttcaatcaacatctctt

SEQ ID NO: 1326796 - DNA, 15 bp, Homo sapiens
cagcgcacagctgct

SEQ ID NO: 1326797 - DNA, 23 bp, Homo sapiens
cagctatttggcaggctgaggca

SEQ ID NO: 1326798 - DNA, 20 bp, Homo sapiens
cagctctacattctgctctg

SEQ ID NO: 1326799 - DNA, 21 bp, Homo sapiens
cagctctacattctgctctgc

SEQ ID NO: 1326800 - DNA, 17 bp, Homo sapiens
cagctgaatagagggag

SEQ ID NO: 1326801 - DNA, 15 bp, Homo sapiens
cagctgctttgttac

SEQ ID NO: 1326802 - DNA, 22 bp, Homo sapiens
cagctgctttgttaccttaaaa

SEQ ID NO: 1326803 - DNA, 19 bp, Homo sapiens
cagctgttcagattggaca

SEQ ID NO: 1326804 - DNA, 22 bp, Homo sapiens
cagcttgttttggactttgtta

SEQ ID NO: 1326805 - DNA, 13 bp, Homo sapiens
cagctttgacccg

SEQ ID NO: 1326806 - DNA, 14 bp, Homo sapiens
caggaacacacagg

SEQ ID NO: 1326807 - DNA, 13 bp, Homo sapiens
caggaacagggac

SEQ ID NO: 1326808 - DNA, 14 bp, Homo sapiens
caggaacagggacc

SEQ ID NO: 1326809 - DNA, 15 bp, Homo sapiens
caggaacagggacca

SEQ ID NO: 1326810 - DNA, 19 bp, Homo sapiens
caggaacagggaccagctc

SEQ ID NO: 1326811 - DNA, 15 bp, Homo sapiens
caggaacccaccctc

SEQ ID NO: 1326812 - DNA, 18 bp, Homo sapiens
caggaacccaccctctcc

SEQ ID NO: 1326813 - DNA, 13 bp, Homo sapiens
caggacagcacac

SEQ ID NO: 1326814 - DNA, 15 bp, Homo sapiens
caggagagcttaggg

SEQ ID NO: 1326815 - DNA, 16 bp, Homo sapiens
caggagagcttagggt

SEQ ID NO: 1326816 - DNA, 18 bp, Homo sapiens
caggagagcttagggtct

SEQ ID NO: 1326817 - DNA, 13 bp, Homo sapiens
caggagagggcct

SEQ ID NO: 1326818 - DNA, 17 bp, Homo sapiens
caggagagggccttccc

SEQ ID NO: 1326819 - DNA, 20 bp, Homo sapiens
caggagatcagtaattacaa

SEQ ID NO: 1326820 - DNA, 20 bp, Homo sapiens
caggaggtggaggttacagt

SEQ ID NO: 1326821 - DNA, 23 bp, Homo sapiens
caggagtaagcccaagctaagct

SEQ ID NO: 1326822 - DNA, 15 bp, Homo sapiens
caggagtccaaacct

SEQ ID NO: 1326823 - DNA, 22 bp, Homo sapiens
caggatatgctttaagacagaa

SEQ ID NO: 1326824 - DNA, 17 bp, Homo sapiens
caggcaaccaggaaact

SEQ ID NO: 1326825 - DNA, 13 bp, Homo sapiens
caggcaccgctgg

SEQ ID NO: 1326826 - DNA, 15 bp, Homo sapiens
caggcaggcccagcc

SEQ ID NO: 1326827 - DNA, 18 bp, Homo sapiens
caggcaggcccagcctct

SEQ ID NO: 1326828 - DNA, 19 bp, Homo sapiens
caggcaggcccagcctctg

SEQ ID NO: 1326829 - DNA, 21 bp, Homo sapiens
caggccaggctcccgacccca

SEQ ID NO: 1326830 - DNA, 17 bp, Homo sapiens
caggccagtcccacggc

SEQ ID NO: 1326831 - DNA, 23 bp, Homo sapiens
caggcccaaattatcaagctaat

SEQ ID NO: 1326832 - DNA, 16 bp, Homo sapiens
caggcccagcctctgc

SEQ ID NO: 1326833 - DNA, 12 bp, Homo sapiens
caggcccaggca

SEQ ID NO: 1326834 - DNA, 14 bp, Homo sapiens
caggcccaggcagg

SEQ ID NO: 1326835 - DNA, 22 bp, Homo sapiens
caggcccaggcaggcccagcct

SEQ ID NO: 1326836 - DNA, 12 bp, Homo sapiens
caggcctggcct

SEQ ID NO: 1326837 - DNA, 14 bp, Homo sapiens
caggcctggcctca

SEQ ID NO: 1326838 - DNA, 20 bp, Homo sapiens
caggctcccgaccccatcca

SEQ ID NO: 1326839 - DNA, 15 bp, Homo sapiens
cagggaccagctccc

SEQ ID NO: 1326840 - DNA, 16 bp, Homo sapiens
cagggaccagctcccc

SEQ ID NO: 1326841 - DNA, 21 bp, Homo sapiens
caggtagatcacttgatgcca

SEQ ID NO: 1326842 - DNA, 16 bp, Homo sapiens
cagtaattacaaatta

SEQ ID NO: 1326843 - DNA, 14 bp, Homo sapiens
cagtcccacggctc

SEQ ID NO: 1326844 - DNA, 16 bp, Homo sapiens
cagtcccacggctctg

SEQ ID NO: 1326845 - DNA, 17 bp, Homo sapiens
cagtcccacggctctgt

SEQ ID NO: 1326846 - DNA, 20 bp, Homo sapiens
cagtcccacggctctgtgcc

SEQ ID NO: 1326847 - DNA, 18 bp, Homo sapiens
cagtggagtccagatggc

SEQ ID NO: 1326848 - DNA, 19 bp, Homo sapiens
cagttgggaagtctcagcc

SEQ ID NO: 1326849 - DNA, 19 bp, Homo sapiens
cataactgacttagttctt

SEQ ID NO: 1326850 - DNA, 22 bp, Homo sapiens
catacgcattaagggcctgctg

SEQ ID NO: 1326851 - DNA, 16 bp, Homo sapiens
catagaatagcatgtt

SEQ ID NO: 1326852 - DNA, 23 bp, Homo sapiens
catagagtgagaagaaagaaact

SEQ ID NO: 1326853 - DNA, 20 bp, Homo sapiens
catagccctgttgacctgcc

SEQ ID NO: 1326854 - DNA, 20 bp, Homo sapiens
catatcaaaagttgatttct

SEQ ID NO: 1326855 - DNA, 14 bp, Homo sapiens
catatccgggtgct

SEQ ID NO: 1326856 - DNA, 16 bp, Homo sapiens
catatccgggtgctca

SEQ ID NO: 1326857 - DNA, 14 bp, Homo sapiens
catatttaaaggga

SEQ ID NO: 1326858 - DNA, 21 bp, Homo sapiens
catatttagtataccagagaa

SEQ ID NO: 1326859 - DNA, 18 bp, Homo sapiens
catcaagaatgaggatat

SEQ ID NO: 1326860 - DNA, 20 bp, Homo sapiens
catcacccctggtggctgca

SEQ ID NO: 1326861 - DNA, 15 bp, Homo sapiens
catcactttcctgga

SEQ ID NO: 1326862 - DNA, 21 bp, Homo sapiens
catcactttcctggatccagg

SEQ ID NO: 1326863 - DNA, 12 bp, Homo sapiens
catcagaacagc

SEQ ID NO: 1326864 - DNA, 20 bp, Homo sapiens
catcagtggagtccagatgg

SEQ ID NO: 1326865 - DNA, 16 bp, Homo sapiens
catcccactgctgact

SEQ ID NO: 1326866 - DNA, 12 bp, Homo sapiens
catcccagcctc

SEQ ID NO: 1326867 - DNA, 14 bp, Homo sapiens
catcccagcctcag

SEQ ID NO: 1326868 - DNA, 15 bp, Homo sapiens
catcccagcctcaga

SEQ ID NO: 1326869 - DNA, 16 bp, Homo sapiens
catcccagcctcagaa

SEQ ID NO: 1326870 - DNA, 17 bp, Homo sapiens
catcccgccttctccag

SEQ ID NO: 1326871 - DNA, 19 bp, Homo sapiens
catccctcatctagtcttg

SEQ ID NO: 1326872 - DNA, 14 bp, Homo sapiens
catcctccctgttc

SEQ ID NO: 1326873 - DNA, 22 bp, Homo sapiens
catccttcttggcttcctggcg

SEQ ID NO: 1326874 - DNA, 13 bp, Homo sapiens
catctacgaagcc

SEQ ID NO: 1326875 - DNA, 14 bp, Homo sapiens
catctacgaagcca

SEQ ID NO: 1326876 - DNA, 16 bp, Homo sapiens
catctacgaagccaca

SEQ ID NO: 1326877 - DNA, 17 bp, Homo sapiens
catctacgaagccacag

SEQ ID NO: 1326878 - DNA, 20 bp, Homo sapiens
catctagtcttgacctctcc

SEQ ID NO: 1326879 - DNA, 16 bp, Homo sapiens
catctcagtcctcaaa

SEQ ID NO: 1326880 - DNA, 21 bp, Homo sapiens
gcacatccttcttggcttcct

SEQ ID NO: 1326881 - DNA, 13 bp, Homo sapiens
gcaccctgagggc

SEQ ID NO: 1326882 - DNA, 14 bp, Homo sapiens
gcacctctcagagc

SEQ ID NO: 1326883 - DNA, 12 bp, Homo sapiens
gcacctgccccc

SEQ ID NO: 1326884 - DNA, 16 bp, Homo sapiens
gcacctgcccccacag

SEQ ID NO: 1326885 - DNA, 18 bp, Homo sapiens
gcacctgcccccacagct

SEQ ID NO: 1326886 - DNA, 19 bp, Homo sapiens
gcacctgcccccacagctc

SEQ ID NO: 1326887 - DNA, 23 bp, Homo sapiens
gcactttgacagcgcacagctgc

SEQ ID NO: 1326888 - DNA, 15 bp, Homo sapiens
gcagacctggctggg

SEQ ID NO: 1326889 - DNA, 17 bp, Homo sapiens
gcagccctggcccatca

SEQ ID NO: 1326890 - DNA, 12 bp, Homo sapiens
gcagcctggctc

SEQ ID NO: 1326891 - DNA, 17 bp, Homo sapiens
gcagcctggctcccctg

SEQ ID NO: 1326892 - DNA, 18 bp, Homo sapiens
gcagctgggaagaggagc

SEQ ID NO: 1326893 - DNA, 21 bp, Homo sapiens
gcagctggggggcaccggctc

SEQ ID NO: 1326894 - DNA, 18 bp, Homo sapiens
gcaggcacacacgccttc

SEQ ID NO: 1326895 - DNA, 22 bp, Homo sapiens
gcaggcacacacgccttcatgc

SEQ ID NO: 1326896 - DNA, 23 bp, Homo sapiens
gcaggcattgcctcggctggctc

SEQ ID NO: 1326897 - DNA, 20 bp, Homo sapiens
gcaggccagtcccacggctc

SEQ ID NO: 1326898 - DNA, 22 bp, Homo sapiens
gcaggcccaaattatcaagcta

SEQ ID NO: 1326899 - DNA, 14 bp, Homo sapiens
gcaggcccagcctc

SEQ ID NO: 1326900 - DNA, 16 bp, Homo sapiens
gcaggcccagcctctg

SEQ ID NO: 1326901 - DNA, 23 bp, Homo sapiens
gcaggcccaggcaggcccagcct

SEQ ID NO: 1326902 - DNA, 23 bp, Homo sapiens
gcatacgcattaagggcctgctg

SEQ ID NO: 1326903 - DNA, 22 bp, Homo sapiens
gcatcactttcctggatccagg

SEQ ID NO: 1326904 - DNA, 23 bp, Homo sapiens
gcatcatcaataaaacagttggc

SEQ ID NO: 1326905 - DNA, 12 bp, Homo sapiens
gcatcccagcct

SEQ ID NO: 1326906 - DNA, 15 bp, Homo sapiens
gcatcccagcctcag

SEQ ID NO: 1326907 - DNA, 23 bp, Homo sapiens
gcatcccagcctcagaagccttc

SEQ ID NO: 1326908 - DNA, 21 bp, Homo sapiens
gcatgaacaatgggagcacat

SEQ ID NO: 1326909 - DNA, 17 bp, Homo sapiens
gcattaagggcctgctg

SEQ ID NO: 1326910 - DNA, 21 bp, Homo sapiens
gcattgtgaattgcctgccat

SEQ ID NO: 1326911 - DNA, 18 bp, Homo sapiens
gcatttgtaaatattaaa

SEQ ID NO: 1326912 - DNA, 15 bp, Homo sapiens
gcattttttaaaaca

SEQ ID NO: 1326913 - DNA, 16 bp, Homo sapiens
gcattttttaaaacaa

SEQ ID NO: 1326914 - DNA, 14 bp, Homo sapiens
gccaagcctggagt

SEQ ID NO: 1326915 - DNA, 20 bp, Homo sapiens
gccaagcctggagtaggcct

SEQ ID NO: 1326916 - DNA, 15 bp, Homo sapiens
gccacaggcctggcc

SEQ ID NO: 1326917 - DNA, 19 bp, Homo sapiens
gccacaggcctggcctcaa

SEQ ID NO: 1326918 - DNA, 20 bp, Homo sapiens
gccaccccttgctctctgtt

SEQ ID NO: 1326919 - DNA, 18 bp, Homo sapiens
gccacccttggtctcatg

SEQ ID NO: 1326920 - DNA, 18 bp, Homo sapiens
gccaggaacagggaccag

SEQ ID NO: 1326921 - DNA, 20 bp, Homo sapiens
gccaggaacagggaccagct

SEQ ID NO: 1326922 - DNA, 22 bp, Homo sapiens
gccaggaacagggaccagctcc

SEQ ID NO: 1326923 - DNA, 23 bp, Homo sapiens
gccaggaacagggaccagctccc

SEQ ID NO: 1326924 - DNA, 11 bp, Homo sapiens
gccaggaactc

SEQ ID NO: 1326925 - DNA, 20 bp, Homo sapiens
gccaggagtaagcccaagct

SEQ ID NO: 1326926 - DNA, 15 bp, Homo sapiens
gccaggtgcctcctg

SEQ ID NO: 1326927 - DNA, 15 bp, Homo sapiens
gccagtcccacggct

SEQ ID NO: 1326928 - DNA, 18 bp, Homo sapiens
gccagtcccacggctctg

SEQ ID NO: 1326929 - DNA, 23 bp, Homo sapiens
gccagtcccacggctctgtgccc

SEQ ID NO: 1326930 - DNA, 19 bp, Homo sapiens
gccatcctccctgttcccc

SEQ ID NO: 1326931 - DNA, 18 bp, Homo sapiens
gccatgagtccatgtcct

SEQ ID NO: 1326932 - DNA, 21 bp, Homo sapiens
gccatggctgtgacacagacg

SEQ ID NO: 1326933 - DNA, 15 bp, Homo sapiens
gccattctggtattc

SEQ ID NO: 1326934 - DNA, 15 bp, Homo sapiens
gcccaaatgctggct

SEQ ID NO: 1326935 - DNA, 23 bp, Homo sapiens
gcccaaattatcaagctaataaa

SEQ ID NO: 1326936 - DNA, 14 bp, Homo sapiens
gcccaagctaagct

SEQ ID NO: 1326937 - DNA, 20 bp, Homo sapiens
gcccaagctaagctgcaggc

SEQ ID NO: 1326938 - DNA, 20 bp, Homo sapiens
gcccacaacgtcccctcaag

SEQ ID NO: 1326939 - DNA, 15 bp, Homo sapiens
gctactgacccagag

SEQ ID NO: 1326940 - DNA, 17 bp, Homo sapiens
gctcaataaacttgtgc

SEQ ID NO: 1326941 - DNA, 19 bp, Homo sapiens
gctcaataaacttgtgcct

SEQ ID NO: 1326942 - DNA, 21 bp, Homo sapiens
gctcaataaacttgtgcctcc

SEQ ID NO: 1326943 - DNA, 22 bp, Homo sapiens
gctcaataaacttgtgcctcca

SEQ ID NO: 1326944 - DNA, 15 bp, Homo sapiens
gctcccctgcagccc

SEQ ID NO: 1326945 - DNA, 16 bp, Homo sapiens
gctcccctgcagccct

SEQ ID NO: 1326946 - DNA, 17 bp, Homo sapiens
gctcccctgcagccctg

SEQ ID NO: 1326947 - DNA, 15 bp, Homo sapiens
gctcccgccccaggg

SEQ ID NO: 1326948 - DNA, 12 bp, Homo sapiens
gctcctcccagc

SEQ ID NO: 1326949 - DNA, 22 bp, Homo sapiens
gctcctcccagcacaggcacct

SEQ ID NO: 1326950 - DNA, 22 bp, Homo sapiens
gctctacattctgctctgccca

SEQ ID NO: 1326951 - DNA, 14 bp, Homo sapiens
gctctcctcgggcc

SEQ ID NO: 1326952 - DNA, 13 bp, Homo sapiens
gctctctgaggca

SEQ ID NO: 1326953 - DNA, 14 bp, Homo sapiens
gctctgcccatgcc

SEQ ID NO: 1326954 - DNA, 16 bp, Homo sapiens
gctctgcccatgccta

SEQ ID NO: 1326955 - DNA, 22 bp, Homo sapiens
gctgaagcttattaatgctaag

SEQ ID NO: 1326956 - DNA, 13 bp, Homo sapiens
gctgactcctggt

SEQ ID NO: 1326957 - DNA, 15 bp, Homo sapiens
gctgactcctggtcc

SEQ ID NO: 1326958 - DNA, 16 bp, Homo sapiens
gctgactcctggtcct

SEQ ID NO: 1326959 - DNA, 12 bp, Homo sapiens
gctgagaagact

SEQ ID NO: 1326960 - DNA, 12 bp, Homo sapiens
gctgagacatcc

SEQ ID NO: 1326961 - DNA, 15 bp, Homo sapiens
gctgagacatccctc

SEQ ID NO: 1326962 - DNA, 16 bp, Homo sapiens
gctgagacatccctca

SEQ ID NO: 1326963 - DNA, 18 bp, Homo sapiens
gctgagcacctctcagag

SEQ ID NO: 1326964 - DNA, 19 bp, Homo sapiens
gctgagcacctctcagagc

SEQ ID NO: 1326965 - DNA, 22 bp, Homo sapiens
gctgataatgtatatgaactta

SEQ ID NO: 1326966 - DNA, 19 bp, Homo sapiens
gctgcaaatgcattgtgaa

SEQ ID NO: 1326967 - DNA, 22 bp, Homo sapiens
gctgcaggcacacacgccttca

SEQ ID NO: 1326968 - DNA, 24 bp, Homo sapiens
gctgcaggcacacacgccttcatg

SEQ ID NO: 1326969 - DNA, 14 bp, Homo sapiens
gctgcgtgccatga

SEQ ID NO: 1326970 - DNA, 22 bp, Homo sapiens
gctgctttgttaccttaaaact

SEQ ID NO: 1326971 - DNA, 16 bp, Homo sapiens
gctggaaggaggaaga

SEQ ID NO: 1326972 - DNA, 16 bp, Homo sapiens
gctggagaaaccttca

SEQ ID NO: 1326973 - DNA, 18 bp, Homo sapiens
gctggctcccctgcagcc

SEQ ID NO: 1326974 - DNA, 22 bp, Homo sapiens
gctggctgatgggtggacctgt

SEQ ID NO: 1326975 - DNA, 13 bp, Homo sapiens
gctgggcctgggc

SEQ ID NO: 1326976 - DNA, 18 bp, Homo sapiens
gctggggggcaccggctc

SEQ ID NO: 1326977 - DNA, 18 bp, Homo sapiens
gctggtcacacaaggaac

SEQ ID NO: 1326978 - DNA, 18 bp, Homo sapiens
gctgtggttcactgcact

SEQ ID NO: 1326979 - DNA, 9 bp, Homo sapiens
gctgtgtga

SEQ ID NO: 1326980 - DNA, 15 bp, Homo sapiens
gcttattaatgctaa

SEQ ID NO: 1326981 - DNA, 20 bp, Homo sapiens
gcttattaatgctaagggca

SEQ ID NO: 1326982 - DNA, 15 bp, Homo sapiens
gcttctagggaccag

SEQ ID NO: 1326983 - DNA, 14 bp, Homo sapiens
gcttctttctgctg

SEQ ID NO: 1326984 - DNA, 16 bp, Homo sapiens
gcttctttctgctggc

SEQ ID NO: 1326985 - DNA, 13 bp, Homo sapiens
gcttgtgaccttg

SEQ ID NO: 1326986 - DNA, 17 bp, Homo sapiens
ggaaactaataaaatat

SEQ ID NO: 1326987 - DNA, 23 bp, Homo sapiens
ggaaactgcagctgggaagagga

SEQ ID NO: 1326988 - DNA, 12 bp, Homo sapiens
ggaaagccatga

SEQ ID NO: 1326989 - DNA, 12 bp, Homo sapiens
ggaaatattaaa

SEQ ID NO: 1326990 - DNA, 17 bp, Homo sapiens
aagaataactaatacaa

SEQ ID NO: 1326991 - DNA, 15 bp, Homo sapiens
aagaatggtctcagt

SEQ ID NO: 1326992 - DNA, 21 bp, Homo sapiens
aagacttaactggcccagaag

SEQ ID NO: 1326993 - DNA, 21 bp, Homo sapiens
aagagaattgtagataatact

SEQ ID NO: 1326994 - DNA, 16 bp, Homo sapiens
aagaggaggaggaggg

SEQ ID NO: 1326995 - DNA, 17 bp, Homo sapiens
aagagtcctccttccca

SEQ ID NO: 1326996 - DNA, 18 bp, Homo sapiens
aagataaaaaaacagctt

SEQ ID NO: 1326997 - DNA, 17 bp, Homo sapiens
aagccacaggcctggcc

SEQ ID NO: 1326998 - DNA, 18 bp, Homo sapiens
aagccacaggcctggcct

SEQ ID NO: 1326999 - DNA, 19 bp, Homo sapiens
aagccacaggcctggcctc

SEQ ID NO: 1327000 - DNA, 14 bp, Homo sapiens
aagccaggaacagg

SEQ ID NO: 1327001 - DNA, 14 bp, Homo sapiens
aagcccccactact

SEQ ID NO: 1327002 - DNA, 12 bp, Homo sapiens
aagccccttctc

SEQ ID NO: 1327003 - DNA, 15 bp, Homo sapiens
aagccccttctctca

SEQ ID NO: 1327004 - DNA, 16 bp, Homo sapiens
aagccccttctctcaa

SEQ ID NO: 1327005 - DNA, 13 bp, Homo sapiens
aagccttcttgct

SEQ ID NO: 1327006 - DNA, 16 bp, Homo sapiens
aagctaagctgcaggc

SEQ ID NO: 1327007 - DNA, 17 bp, Homo sapiens
aagctaataaaatatca

SEQ ID NO: 1327008 - DNA, 20 bp, Homo sapiens
aagctaataaaatatcattc

SEQ ID NO: 1327009 - DNA, 19 bp, Homo sapiens
aagctgattttcatgaaaa

SEQ ID NO: 1327010 - DNA, 14 bp, Homo sapiens
aagcttattaatgc

SEQ ID NO: 1327011 - DNA, 20 bp, Homo sapiens
aagcttattaatgctaaggg

SEQ ID NO: 1327012 - DNA, 13 bp, Homo sapiens
aagctttttgaaa

SEQ ID NO: 1327013 - DNA, 18 bp, Homo sapiens
aaggaaacataagagctt

SEQ ID NO: 1327014 - DNA, 16 bp, Homo sapiens
aaggaaagcaaggcag

SEQ ID NO: 1327015 - DNA, 15 bp, Homo sapiens
aaggaggagacagag

SEQ ID NO: 1327016 - DNA, 22 bp, Homo sapiens
aagggcaggcccaaattatcaa

SEQ ID NO: 1327017 - DNA, 13 bp, Homo sapiens
aagggcctgctgg

SEQ ID NO: 1327018 - DNA, 16 bp, Homo sapiens
aagggcctgctggaga

SEQ ID NO: 1327019 - DNA, 16 bp, Homo sapiens
aagggttctgtaaaat

SEQ ID NO: 1327020 - DNA, 21 bp, Homo sapiens
aaggtagattttaagaatggt

SEQ ID NO: 1327021 - DNA, 16 bp, Homo sapiens
aagtctactttagtat

SEQ ID NO: 1327022 - DNA, 13 bp, Homo sapiens
aagtctcagcctg

SEQ ID NO: 1327023 - DNA, 22 bp, Homo sapiens
aagtctcagcctgggcccctca

SEQ ID NO: 1327024 - DNA, 18 bp, Homo sapiens
aagtcttctcccaactca

SEQ ID NO: 1327025 - DNA, 22 bp, Homo sapiens
aagtcttctcccaactcagcct

SEQ ID NO: 1327026 - DNA, 16 bp, Homo sapiens
aagtgaggccactgaa

SEQ ID NO: 1327027 - DNA, 16 bp, Homo sapiens
aagttaagattcttgg

SEQ ID NO: 1327028 - DNA, 19 bp, Homo sapiens
aataaaactgatgtgaaac

SEQ ID NO: 1327029 - DNA, 17 bp, Homo sapiens
aataaaatatcattcag

SEQ ID NO: 1327030 - DNA, 15 bp, Homo sapiens
aataaaatattttct

SEQ ID NO: 1327031 - DNA, 20 bp, Homo sapiens
aataaaatattttctgtgtg

SEQ ID NO: 1327032 - DNA, 23 bp, Homo sapiens
aataaaatattttctgtgtgttc

SEQ ID NO: 1327033 - DNA, 17 bp, Homo sapiens
aataaaattgacttaaa

SEQ ID NO: 1327034 - DNA, 19 bp, Homo sapiens
aataaacgtgcgcggactg

SEQ ID NO: 1327035 - DNA, 22 bp, Homo sapiens
aataagaattaggtttctttga

SEQ ID NO: 1327036 - DNA, 19 bp, Homo sapiens
aatagagatgagctttctt

SEQ ID NO: 1327037 - DNA, 21 bp, Homo sapiens
aatagagggagtagaaagctt

SEQ ID NO: 1327038 - DNA, 15 bp, Homo sapiens
aatagcatgttgtag

SEQ ID NO: 1327039 - DNA, 17 bp, Homo sapiens
aatagcatgttgtagat

SEQ ID NO: 1327040 - DNA, 15 bp, Homo sapiens
aatatattgttttcc

SEQ ID NO: 1327041 - DNA, 13 bp, Homo sapiens
aatatcattcagc

SEQ ID NO: 1327042 - DNA, 14 bp, Homo sapiens
aatatcattcagca

SEQ ID NO: 1327043 - DNA, 14 bp, Homo sapiens
aatattttctgtgt

SEQ ID NO: 1327044 - DNA, 15 bp, Homo sapiens
aatattttctgtgtg

SEQ ID NO: 1327045 - DNA, 16 bp, Homo sapiens
aatattttctgtgtgt

SEQ ID NO: 1327046 - DNA, 22 bp, Homo sapiens
aatattttctgtgtgttcctgg

SEQ ID NO: 1327047 - DNA, 13 bp, Homo sapiens
aatcagctgcttt

SEQ ID NO: 1327048 - DNA, 15 bp, Homo sapiens
aatcatcattattat

SEQ ID NO: 1327049 - DNA, 12 bp, Homo sapiens
aatcctggttcc

SEQ ID NO: 1327050 - DNA, 15 bp, Homo sapiens
aatcttacagagtga

SEQ ID NO: 1327051 - DNA, 22 bp, Homo sapiens
aatctttctggaattgatgttt

SEQ ID NO: 1327052 - DNA, 20 bp, Homo sapiens
aatgaaagtcttgtgactag

SEQ ID NO: 1327053 - DNA, 22 bp, Homo sapiens
aatgcattgtgaattgcctgcc

SEQ ID NO: 1327054 - DNA, 20 bp, Homo sapiens
aatgctggctggccttgtgg

SEQ ID NO: 1327055 - DNA, 22 bp, Homo sapiens
aatgctgtggttcactgcactg

SEQ ID NO: 1327056 - DNA, 17 bp, Homo sapiens
aatggaaaacttagttt

SEQ ID NO: 1327057 - DNA, 16 bp, Homo sapiens
aatggactatccatta

SEQ ID NO: 1327058 - DNA, 17 bp, Homo sapiens
aatgggctctgccctca

SEQ ID NO: 1327059 - DNA, 21 bp, Homo sapiens
aattaagggttaaatcagaga

SEQ ID NO: 1327060 - DNA, 18 bp, Homo sapiens
aattccatttctttctgg

SEQ ID NO: 1327061 - DNA, 16 bp, Homo sapiens
aatttggaaactaata

SEQ ID NO: 1327062 - DNA, 18 bp, Homo sapiens
aatttggaaactaataaa

SEQ ID NO: 1327063 - DNA, 23 bp, Homo sapiens
aatttggaaactaataaaatatt

SEQ ID NO: 1327064 - DNA, 17 bp, Homo sapiens
aatttgtgtaatattac

SEQ ID NO: 1327065 - DNA, 20 bp, Homo sapiens
aattttattttttttctgta

SEQ ID NO: 1327066 - DNA, 12 bp, Homo sapiens
acaaaaaaggaa

SEQ ID NO: 1327067 - DNA, 17 bp, Homo sapiens
acaacgtcccctcaagc

SEQ ID NO: 1327068 - DNA, 15 bp, Homo sapiens
acaagaaagtttccc

SEQ ID NO: 1327069 - DNA, 15 bp, Homo sapiens
acaagttaagattct

SEQ ID NO: 1327070 - DNA, 14 bp, Homo sapiens
acaatcagctgctt

SEQ ID NO: 1327071 - DNA, 13 bp, Homo sapiens
acaatcatgtaca

SEQ ID NO: 1327072 - DNA, 22 bp, Homo sapiens
acaccagaaagcctcctctgga

SEQ ID NO: 1327073 - DNA, 19 bp, Homo sapiens
acaccatcacagcttgttt

SEQ ID NO: 1327074 - DNA, 13 bp, Homo sapiens
acacccagcctgt

SEQ ID NO: 1327075 - DNA, 18 bp, Homo sapiens
acacctcactctgctacc

SEQ ID NO: 1327076 - DNA, 14 bp, Homo sapiens
acacgccttcatgc

SEQ ID NO: 1327077 - DNA, 21 bp, Homo sapiens
acacgccttcatgccagtgca

SEQ ID NO: 1327078 - DNA, 16 bp, Homo sapiens
acacggtgagggtgcg

SEQ ID NO: 1327079 - DNA, 22 bp, Homo sapiens
acactagcatttttggcttact

SEQ ID NO: 1327080 - DNA, 13 bp, Homo sapiens
acactcagctgtt

SEQ ID NO: 1327081 - DNA, 15 bp, Homo sapiens
acactgcctggtact

SEQ ID NO: 1327082 - DNA, 18 bp, Homo sapiens
acactggatgtttctcat

SEQ ID NO: 1327083 - DNA, 17 bp, Homo sapiens
acactgtgcaggcccag

SEQ ID NO: 1327084 - DNA, 20 bp, Homo sapiens
acactgtgcaggcccaggca

SEQ ID NO: 1327085 - DNA, 16 bp, Homo sapiens
acacttaattctgttc

SEQ ID NO: 1327086 - DNA, 18 bp, Homo sapiens
acagaccgcgcccctggg

SEQ ID NO: 1327087 - DNA, 20 bp, Homo sapiens
acagaccgcgcccctgggac

SEQ ID NO: 1327088 - DNA, 15 bp, Homo sapiens
acagagggaggacct

SEQ ID NO: 1327089 - DNA, 18 bp, Homo sapiens
acagcacacggtgagggt

SEQ ID NO: 1327090 - DNA, 15 bp, Homo sapiens
acagcacctgagaag

SEQ ID NO: 1327091 - DNA, 17 bp, Homo sapiens
acagcacctgagaagag

SEQ ID NO: 1327092 - DNA, 14 bp, Homo sapiens
acaggcctggcctc

SEQ ID NO: 1327093 - DNA, 15 bp, Homo sapiens
acaggcctggcctca

SEQ ID NO: 1327094 - DNA, 15 bp, Homo sapiens
acagggaccagctcc

SEQ ID NO: 1327095 - DNA, 20 bp, Homo sapiens
acagttgggaagtctcagcc

SEQ ID NO: 1327096 - DNA, 17 bp, Homo sapiens
acagtttatgcagtgct

SEQ ID NO: 1327097 - DNA, 19 bp, Homo sapiens
acagtttatgcagtgctgc

SEQ ID NO: 1327098 - DNA, 18 bp, Homo sapiens
acataactgacttagttc

SEQ ID NO: 1327099 - DNA, 14 bp, Homo sapiens
acatagccctgttg

SEQ ID NO: 1327100 - DNA, 20 bp, Homo sapiens
acatagccctgttgacctgc

SEQ ID NO: 1327101 - DNA, 23 bp, Homo sapiens
acatcaaataattgaagagacaa

SEQ ID NO: 1327102 - DNA, 22 bp, Homo sapiens
acatccttcttggcttcctggc

SEQ ID NO: 1327103 - DNA, 15 bp, Homo sapiens
acatctacgaagcca

SEQ ID NO: 1327104 - DNA, 18 bp, Homo sapiens
acatctacgaagccacag

SEQ ID NO: 1327105 - DNA, 13 bp, Homo sapiens
acatcttgtttct

SEQ ID NO: 1327106 - DNA, 15 bp, Homo sapiens
acatcttgtttctga

SEQ ID NO: 1327107 - DNA, 16 bp, Homo sapiens
acatcttgtttctgag

SEQ ID NO: 1327108 - DNA, 21 bp, Homo sapiens
acatgctgtgtaagctgtgtc

SEQ ID NO: 1327109 - DNA, 19 bp, Homo sapiens
acatggaatgagggtttga

SEQ ID NO: 1327110 - DNA, 17 bp, Homo sapiens
acattctgctctgccca

SEQ ID NO: 1327111 - DNA, 11 bp, Homo sapiens
accaacaccat

SEQ ID NO: 1327112 - DNA, 16 bp, Homo sapiens
accaacaccatcacag

SEQ ID NO: 1327113 - DNA, 21 bp, Homo sapiens
accaacaccatcacagcttgt

SEQ ID NO: 1327114 - DNA, 23 bp, Homo sapiens
accacgtctatttcatcagaaca

SEQ ID NO: 1327115 - DNA, 23 bp, Homo sapiens
accactgtgctcaaccagacaga

SEQ ID NO: 1327116 - DNA, 18 bp, Homo sapiens
accagacttttttaaaca

SEQ ID NO: 1327117 - DNA, 13 bp, Homo sapiens
accagagaccagg

SEQ ID NO: 1327118 - DNA, 15 bp, Homo sapiens
accatcacagcttgt

SEQ ID NO: 1327119 - DNA, 16 bp, Homo sapiens
accatcacagcttgtt

SEQ ID NO: 1327120 - DNA, 21 bp, Homo sapiens
accatgctgagacatccctca

SEQ ID NO: 1327121 - DNA, 15 bp, Homo sapiens
acccaatctggctgg

SEQ ID NO: 1327122 - DNA, 13 bp, Homo sapiens
acccaccctctcc

SEQ ID NO: 1327123 - DNA, 15 bp, Homo sapiens
atgaagaaagagact

SEQ ID NO: 1327124 - DNA, 19 bp, Homo sapiens
atgaagaaagagactgtgg

SEQ ID NO: 1327125 - DNA, 23 bp, Homo sapiens
atgaagacttaactggcccagaa

SEQ ID NO: 1327126 - DNA, 14 bp, Homo sapiens
atgaaggcacctgc

SEQ ID NO: 1327127 - DNA, 15 bp, Homo sapiens
atgacacatttaatg

SEQ ID NO: 1327128 - DNA, 23 bp, Homo sapiens
atgacagcacctgagaagaggaa

SEQ ID NO: 1327129 - DNA, 22 bp, Homo sapiens
atgacatctacgaagccacagg

SEQ ID NO: 1327130 - DNA, 14 bp, Homo sapiens
atgactttgaagta

SEQ ID NO: 1327131 - DNA, 20 bp, Homo sapiens
atgaggcagcacgtgcacaa

SEQ ID NO: 1327132 - DNA, 14 bp, Homo sapiens
atgagggggctcag

SEQ ID NO: 1327133 - DNA, 15 bp, Homo sapiens
atgagggggctcagt

SEQ ID NO: 1327134 - DNA, 21 bp, Homo sapiens
atgagttcacatgtgccctgc

SEQ ID NO: 1327135 - DNA, 17 bp, Homo sapiens
atgataaatttaaatga

SEQ ID NO: 1327136 - DNA, 20 bp, Homo sapiens
atgataccaggcccaggaga

SEQ ID NO: 1327137 - DNA, 13 bp, Homo sapiens
atgcactcagggt

SEQ ID NO: 1327138 - DNA, 17 bp, Homo sapiens
atgcagaactttctctt

SEQ ID NO: 1327139 - DNA, 22 bp, Homo sapiens
atgcatacgcattaagggcctg

SEQ ID NO: 1327140 - DNA, 18 bp, Homo sapiens
atgccagtgcatgccagg

SEQ ID NO: 1327141 - DNA, 21 bp, Homo sapiens
atgccccgccatggtcaccct

SEQ ID NO: 1327142 - DNA, 15 bp, Homo sapiens
atgcgcagttgctgt

SEQ ID NO: 1327143 - DNA, 21 bp, Homo sapiens
atgctctctgaggcaaggccc

SEQ ID NO: 1327144 - DNA, 16 bp, Homo sapiens
atgctgcttgtgacct

SEQ ID NO: 1327145 - DNA, 21 bp, Homo sapiens
atggaaaacttagtttgtgaa

SEQ ID NO: 1327146 - DNA, 16 bp, Homo sapiens
atggacaaagttctgt

SEQ ID NO: 1327147 - DNA, 20 bp, Homo sapiens
atggagatatgcattcaaga

SEQ ID NO: 1327148 - DNA, 15 bp, Homo sapiens
atggcctctctccac

SEQ ID NO: 1327149 - DNA, 16 bp, Homo sapiens
atggtctcagtgttaa

SEQ ID NO: 1327150 - DNA, 19 bp, Homo sapiens
atgtacatagagtgagaag

SEQ ID NO: 1327151 - DNA, 18 bp, Homo sapiens
atgtatctaatttcattc

SEQ ID NO: 1327152 - DNA, 13 bp, Homo sapiens
atgtcaacaccag

SEQ ID NO: 1327153 - DNA, 22 bp, Homo sapiens
atgtcatgtcttccattaagaa

SEQ ID NO: 1327154 - DNA, 18 bp, Homo sapiens
atgtgatataaacagctt

SEQ ID NO: 1327155 - DNA, 13 bp, Homo sapiens
atgtgccctgcct

SEQ ID NO: 1327156 - DNA, 14 bp, Homo sapiens
atgttaagaataac

SEQ ID NO: 1327157 - DNA, 12 bp, Homo sapiens
atgttcaattat

SEQ ID NO: 1327158 - DNA, 16 bp, Homo sapiens
atgtttacatgtctgt

SEQ ID NO: 1327159 - DNA, 20 bp, Homo sapiens
attaagaacactaaaaagtc

SEQ ID NO: 1327160 - DNA, 15 bp, Homo sapiens
attaagggcctgctg

SEQ ID NO: 1327161 - DNA, 16 bp, Homo sapiens
attactacaaatggat

SEQ ID NO: 1327162 - DNA, 15 bp, Homo sapiens
attactcccattttg

SEQ ID NO: 1327163 - DNA, 18 bp, Homo sapiens
attactcccattttgcag

SEQ ID NO: 1327164 - DNA, 16 bp, Homo sapiens
attactttaacatgcc

SEQ ID NO: 1327165 - DNA, 22 bp, Homo sapiens
attatcttacttgcaaaatgga

SEQ ID NO: 1327166 - DNA, 14 bp, Homo sapiens
attcaacagagagg

SEQ ID NO: 1327167 - DNA, 21 bp, Homo sapiens
attcacaagttaagattcttg

SEQ ID NO: 1327168 - DNA, 12 bp, Homo sapiens
attcacagcctc

SEQ ID NO: 1327169 - DNA, 14 bp, Homo sapiens
attcacagcctccg

SEQ ID NO: 1327170 - DNA, 20 bp, Homo sapiens
attcatccatccgttcattc

SEQ ID NO: 1327171 - DNA, 16 bp, Homo sapiens
attctaacaaaaagca

SEQ ID NO: 1327172 - DNA, 23 bp, Homo sapiens
attctaacaaaaagcaattacta

SEQ ID NO: 1327173 - DNA, 13 bp, Homo sapiens
attctgctctgcc

SEQ ID NO: 1327174 - DNA, 18 bp, Homo sapiens
attctgctctgcccatgc

SEQ ID NO: 1327175 - DNA, 13 bp, Homo sapiens
attctgttctgat

SEQ ID NO: 1327176 - DNA, 17 bp, Homo sapiens
attgatgtttacatgtc

SEQ ID NO: 1327177 - DNA, 19 bp, Homo sapiens
attgcattttttaaaacaa

SEQ ID NO: 1327178 - DNA, 20 bp, Homo sapiens
attgcattttttaaaacaag

SEQ ID NO: 1327179 - DNA, 22 bp, Homo sapiens
attgctcatctcagtcctcaaa

SEQ ID NO: 1327180 - DNA, 14 bp, Homo sapiens
attgctgcaaatgc

SEQ ID NO: 1327181 - DNA, 14 bp, Homo sapiens
attgcttttgtgca

SEQ ID NO: 1327182 - DNA, 15 bp, Homo sapiens
attgcttttgtgcat

SEQ ID NO: 1327183 - DNA, 20 bp, Homo sapiens
attgcttttgtgcattggat

SEQ ID NO: 1327184 - DNA, 14 bp, Homo sapiens
attggtagaggaag

SEQ ID NO: 1327185 - DNA, 17 bp, Homo sapiens
attgtagataatactgt

SEQ ID NO: 1327186 - DNA, 14 bp, Homo sapiens
attgtagatgaaca

SEQ ID NO: 1327187 - DNA, 21 bp, Homo sapiens
attgtgaacagaagtccttaa

SEQ ID NO: 1327188 - DNA, 21 bp, Homo sapiens
attgttaggatcaatgataaa

SEQ ID NO: 1327189 - DNA, 16 bp, Homo sapiens
atttactgagagaagg

SEQ ID NO: 1327190 - DNA, 16 bp, Homo sapiens
atttatccctcattca

SEQ ID NO: 1327191 - DNA, 20 bp, Homo sapiens
atttcccccatttttcccag

SEQ ID NO: 1327192 - DNA, 22 bp, Homo sapiens
atttcctgaggtggatttactg

SEQ ID NO: 1327193 - DNA, 23 bp, Homo sapiens
atttctgtgccattttctgtaaa

SEQ ID NO: 1327194 - DNA, 15 bp, Homo sapiens
atttggaaactaata

SEQ ID NO: 1327195 - DNA, 19 bp, Homo sapiens
atttggaaactaataaaat

SEQ ID NO: 1327196 - DNA, 14 bp, Homo sapiens
attttcaatgtgat

SEQ ID NO: 1327197 - DNA, 18 bp, Homo sapiens
attttcagcatgaaaatg

SEQ ID NO: 1327198 - DNA, 23 bp, Homo sapiens
attttcagcatgaaaatgtgtgt

SEQ ID NO: 1327199 - DNA, 17 bp, Homo sapiens
attttctgtgtgttcct

SEQ ID NO: 1327200 - DNA, 19 bp, Homo sapiens
attttctgtgtgttcctgg

SEQ ID NO: 1327201 - DNA, 11 bp, Homo sapiens
caaaaaaggaa

SEQ ID NO: 1327202 - DNA, 13 bp, Homo sapiens
caaaaagcaatta

SEQ ID NO: 1327203 - DNA, 13 bp, Homo sapiens
caaaacaaaatag

SEQ ID NO: 1327204 - DNA, 15 bp, Homo sapiens
caaaagttgatttct

SEQ ID NO: 1327205 - DNA, 20 bp, Homo sapiens
caaaatgagatctcattaaa

SEQ ID NO: 1327206 - DNA, 18 bp, Homo sapiens
caaacaaaaaaggaaatg

SEQ ID NO: 1327207 - DNA, 13 bp, Homo sapiens
caaacctgtgaag

SEQ ID NO: 1327208 - DNA, 18 bp, Homo sapiens
caaagaggcacagagcca

SEQ ID NO: 1327209 - DNA, 14 bp, Homo sapiens
caaagctttttgaa

SEQ ID NO: 1327210 - DNA, 18 bp, Homo sapiens
caaataaagttaaaagta

SEQ ID NO: 1327211 - DNA, 21 bp, Homo sapiens
caaataggcatcatcaataaa

SEQ ID NO: 1327212 - DNA, 22 bp, Homo sapiens
caaatggatgacacatttaatg

SEQ ID NO: 1327213 - DNA, 15 bp, Homo sapiens
caacagagagggaga

SEQ ID NO: 1327214 - DNA, 12 bp, Homo sapiens
caacatcagctt

SEQ ID NO: 1327215 - DNA, 13 bp, Homo sapiens
caaccagacagat

SEQ ID NO: 1327216 - DNA, 14 bp, Homo sapiens
caaccaggaaactg

SEQ ID NO: 1327217 - DNA, 15 bp, Homo sapiens
caacgattcacagcc

SEQ ID NO: 1327218 - DNA, 14 bp, Homo sapiens
caacgtcccctcaa

SEQ ID NO: 1327219 - DNA, 22 bp, Homo sapiens
caactcacccttggcccatccc

SEQ ID NO: 1327220 - DNA, 13 bp, Homo sapiens
caactcagcctgt

SEQ ID NO: 1327221 - DNA, 16 bp, Homo sapiens
caactcagcctgttcc

SEQ ID NO: 1327222 - DNA, 17 bp, Homo sapiens
caactcagcctgttcct

SEQ ID NO: 1327223 - DNA, 18 bp, Homo sapiens
caactccagcgtcctcag

SEQ ID NO: 1327224 - DNA, 21 bp, Homo sapiens
caactctgctgagggtccaga

SEQ ID NO: 1327225 - DNA, 16 bp, Homo sapiens
caactgagaagccaag

SEQ ID NO: 1327226 - DNA, 20 bp, Homo sapiens
caactttttaattccatatc

SEQ ID NO: 1327227 - DNA, 14 bp, Homo sapiens
caagaaacaggata

SEQ ID NO: 1327228 - DNA, 16 bp, Homo sapiens
caagccccttctctca

SEQ ID NO: 1327229 - DNA, 18 bp, Homo sapiens
caagccccttctctcaat

SEQ ID NO: 1327230 - DNA, 19 bp, Homo sapiens
caagcctggagtaggcctg

SEQ ID NO: 1327231 - DNA, 16 bp, Homo sapiens
caagctaagctgcagg

SEQ ID NO: 1327232 - DNA, 21 bp, Homo sapiens
caagctaataaaatatcattc

SEQ ID NO: 1327233 - DNA, 22 bp, Homo sapiens
caagctaataaaatatcattca

SEQ ID NO: 1327234 - DNA, 17 bp, Homo sapiens
caaggcagaaggccagg

SEQ ID NO: 1327235 - DNA, 18 bp, Homo sapiens
caaggcaggtagatcact

SEQ ID NO: 1327236 - DNA, 19 bp, Homo sapiens
caaggcccagacctggcct

SEQ ID NO: 1327237 - DNA, 16 bp, Homo sapiens
caagtacagtactttg

SEQ ID NO: 1327238 - DNA, 13 bp, Homo sapiens
caagttaagattc

SEQ ID NO: 1327239 - DNA, 15 bp, Homo sapiens
caagttaagattctt

SEQ ID NO: 1327240 - DNA, 12 bp, Homo sapiens
caataaacttgt

SEQ ID NO: 1327241 - DNA, 17 bp, Homo sapiens
caataaacttgtgcctc

SEQ ID NO: 1327242 - DNA, 19 bp, Homo sapiens
caataaacttgtgcctcca

SEQ ID NO: 1327243 - DNA, 14 bp, Homo sapiens
caatcaacatctct

SEQ ID NO: 1327244 - DNA, 21 bp, Homo sapiens
caatcaataaacagcaggtga

SEQ ID NO: 1327245 - DNA, 11 bp, Homo sapiens
caatcagctgc

SEQ ID NO: 1327246 - DNA, 18 bp, Homo sapiens
caatcagctgctttgtta

SEQ ID NO: 1327247 - DNA, 17 bp, Homo sapiens
caatctggctggtaaat

SEQ ID NO: 1327248 - DNA, 18 bp, Homo sapiens
caatctggctggtaaatg

SEQ ID NO: 1327249 - DNA, 19 bp, Homo sapiens
caatctggggaaataataa

SEQ ID NO: 1327250 - DNA, 20 bp, Homo sapiens
caatgataaatttaaatgac

SEQ ID NO: 1327251 - DNA, 22 bp, Homo sapiens
caatgtgatataaacagcttct

SEQ ID NO: 1327252 - DNA, 18 bp, Homo sapiens
caattactacaaatggat

SEQ ID NO: 1327253 - DNA, 21 bp, Homo sapiens
caattactacaaatggatgac

SEQ ID NO: 1327254 - DNA, 15 bp, Homo sapiens
caattatttccccca

SEQ ID NO: 1327255 - DNA, 21 bp, Homo sapiens
cacaaatgctgtggttcactg

SEQ ID NO: 1327256 - DNA, 22 bp, Homo sapiens
cctcatctagtcttgacctctc

SEQ ID NO: 1327257 - DNA, 13 bp, Homo sapiens
cctccatcacccc

SEQ ID NO: 1327258 - DNA, 14 bp, Homo sapiens
cctccatcacccct

SEQ ID NO: 1327259 - DNA, 16 bp, Homo sapiens
cctcccagccctgagg

SEQ ID NO: 1327260 - DNA, 19 bp, Homo sapiens
cctccctgttccccacagg

SEQ ID NO: 1327261 - DNA, 20 bp, Homo sapiens
cctccctgttccccacaggt

SEQ ID NO: 1327262 - DNA, 24 bp, Homo sapiens
cctccctgttccccacaggtcctc

SEQ ID NO: 1327263 - DNA, 21 bp, Homo sapiens
cctcctggggcgcgtgaggcc

SEQ ID NO: 1327264 - DNA, 14 bp, Homo sapiens
cctcggctggctcc

SEQ ID NO: 1327265 - DNA, 18 bp, Homo sapiens
cctcggctggctcccctg

SEQ ID NO: 1327266 - DNA, 19 bp, Homo sapiens
cctcggctggctcccctgc

SEQ ID NO: 1327267 - DNA, 13 bp, Homo sapiens
cctcgggcccctg

SEQ ID NO: 1327268 - DNA, 17 bp, Homo sapiens
cctcgggcccctgagcc

SEQ ID NO: 1327269 - DNA, 19 bp, Homo sapiens
cctcgggccctgtggtgct

SEQ ID NO: 1327270 - DNA, 22 bp, Homo sapiens
cctcgttagagaatggcctgag

SEQ ID NO: 1327271 - DNA, 17 bp, Homo sapiens
cctctcagagcaagcct

SEQ ID NO: 1327272 - DNA, 20 bp, Homo sapiens
cctctcagagcaagcctttg

SEQ ID NO: 1327273 - DNA, 22 bp, Homo sapiens
cctctcagagcaagcctttgac

SEQ ID NO: 1327274 - DNA, 17 bp, Homo sapiens
cctctccacacccagcc

SEQ ID NO: 1327275 - DNA, 20 bp, Homo sapiens
cctctccagcatcccagcct

SEQ ID NO: 1327276 - DNA, 17 bp, Homo sapiens
cctctccggcctggcct

SEQ ID NO: 1327277 - DNA, 13 bp, Homo sapiens
cctctctccacta

SEQ ID NO: 1327278 - DNA, 15 bp, Homo sapiens
cctctgccatcctcc

SEQ ID NO: 1327279 - DNA, 14 bp, Homo sapiens
cctcttctctcaga

SEQ ID NO: 1327280 - DNA, 15 bp, Homo sapiens
cctgaaatcctggtt

SEQ ID NO: 1327281 - DNA, 19 bp, Homo sapiens
cctgaagaatctcgactct

SEQ ID NO: 1327282 - DNA, 15 bp, Homo sapiens
cctgacttctgttta

SEQ ID NO: 1327283 - DNA, 12 bp, Homo sapiens
cctgagaagagg

SEQ ID NO: 1327284 - DNA, 15 bp, Homo sapiens
cctgagacagtgcgt

SEQ ID NO: 1327285 - DNA, 19 bp, Homo sapiens
cctgagacagtgcgttgca

SEQ ID NO: 1327286 - DNA, 13 bp, Homo sapiens
cctgcacataaac

SEQ ID NO: 1327287 - DNA, 14 bp, Homo sapiens
cctgcacataaact

SEQ ID NO: 1327288 - DNA, 13 bp, Homo sapiens
cctgcagacctgg

SEQ ID NO: 1327289 - DNA, 15 bp, Homo sapiens
cctgcagacctggct

SEQ ID NO: 1327290 - DNA, 17 bp, Homo sapiens
cctgcagccctggccca

SEQ ID NO: 1327291 - DNA, 14 bp, Homo sapiens
cctgcagcctccct

SEQ ID NO: 1327292 - DNA, 16 bp, Homo sapiens
cctgcagcctccctcc

SEQ ID NO: 1327293 - DNA, 15 bp, Homo sapiens
cctgcaggccagtcc

SEQ ID NO: 1327294 - DNA, 12 bp, Homo sapiens
cctgccatggct

SEQ ID NO: 1327295 - DNA, 14 bp, Homo sapiens
cctgcccccacagc

SEQ ID NO: 1327296 - DNA, 16 bp, Homo sapiens
cctgcccccacagctc

SEQ ID NO: 1327297 - DNA, 22 bp, Homo sapiens
cctgcccccacagctccttgca

SEQ ID NO: 1327298 - DNA, 22 bp, Homo sapiens
cctgcccgatccagattcccag

SEQ ID NO: 1327299 - DNA, 15 bp, Homo sapiens
cctggagtaggcctg

SEQ ID NO: 1327300 - DNA, 16 bp, Homo sapiens
cctggagtaggcctgg

SEQ ID NO: 1327301 - DNA, 12 bp, Homo sapiens
cctggcctctgc

SEQ ID NO: 1327302 - DNA, 16 bp, Homo sapiens
cctggctcccctgggg

SEQ ID NO: 1327303 - DNA, 16 bp, Homo sapiens
cctggctgggcctggg

SEQ ID NO: 1327304 - DNA, 12 bp, Homo sapiens
cctgggcccctc

SEQ ID NO: 1327305 - DNA, 22 bp, Homo sapiens
cctgggcttccacagtgtgaag

SEQ ID NO: 1327306 - DNA, 16 bp, Homo sapiens
cctggggcccaaatgc

SEQ ID NO: 1327307 - DNA, 15 bp, Homo sapiens
cctggtggctgcagg

SEQ ID NO: 1327308 - DNA, 18 bp, Homo sapiens
cctggtggctgcaggcac

SEQ ID NO: 1327309 - DNA, 13 bp, Homo sapiens
cctgtaaacactc

SEQ ID NO: 1327310 - DNA, 16 bp, Homo sapiens
cctgtaaacactcagc

SEQ ID NO: 1327311 - DNA, 19 bp, Homo sapiens
cctgtcacttgcacagagg

SEQ ID NO: 1327312 - DNA, 15 bp, Homo sapiens
cctgtcccactggct

SEQ ID NO: 1327313 - DNA, 23 bp, Homo sapiens
cctgtcccactggctcctcccag

SEQ ID NO: 1327314 - DNA, 21 bp, Homo sapiens
cctgtgaagaaaggacctgca

SEQ ID NO: 1327315 - DNA, 15 bp, Homo sapiens
cctgtgatttctgtg

SEQ ID NO: 1327316 - DNA, 17 bp, Homo sapiens
cctgtgatttctgtgcc

SEQ ID NO: 1327317 - DNA, 22 bp, Homo sapiens
cctgtggtgctgggagatgctc

SEQ ID NO: 1327318 - DNA, 23 bp, Homo sapiens
cctgtggtgctgggagatgctct

SEQ ID NO: 1327319 - DNA, 21 bp, Homo sapiens
cctgtgtatggtgacctctcc

SEQ ID NO: 1327320 - DNA, 20 bp, Homo sapiens
cctgttccccacaggtcctc

SEQ ID NO: 1327321 - DNA, 21 bp, Homo sapiens
cctgttccttcctgcagacct

SEQ ID NO: 1327322 - DNA, 14 bp, Homo sapiens
cctgttgacctgcc

SEQ ID NO: 1327323 - DNA, 16 bp, Homo sapiens
cctgttggtttgaagt

SEQ ID NO: 1327324 - DNA, 18 bp, Homo sapiens
cctgttgtgttccagcca

SEQ ID NO: 1327325 - DNA, 13 bp, Homo sapiens
ccttcatgccagt

SEQ ID NO: 1327326 - DNA, 13 bp, Homo sapiens
ccttcctgcagac

SEQ ID NO: 1327327 - DNA, 15 bp, Homo sapiens
ccttcctgcagacct

SEQ ID NO: 1327328 - DNA, 20 bp, Homo sapiens
ccttcctgcagacctggctg

SEQ ID NO: 1327329 - DNA, 21 bp, Homo sapiens
ccttcctgcagacctggctgg

SEQ ID NO: 1327330 - DNA, 17 bp, Homo sapiens
ccttctctcaatccctt

SEQ ID NO: 1327331 - DNA, 15 bp, Homo sapiens
ccttcttcatgttca

SEQ ID NO: 1327332 - DNA, 15 bp, Homo sapiens
ccttcttggcttcct

SEQ ID NO: 1327333 - DNA, 18 bp, Homo sapiens
ccttcttggcttcctggc

SEQ ID NO: 1327334 - DNA, 13 bp, Homo sapiens
ccttgctctctgt

SEQ ID NO: 1327335 - DNA, 18 bp, Homo sapiens
ccttgctctctgttctct

SEQ ID NO: 1327336 - DNA, 13 bp, Homo sapiens
ccttgtgcccgat

SEQ ID NO: 1327337 - DNA, 13 bp, Homo sapiens
cctttccaccttc

SEQ ID NO: 1327338 - DNA, 18 bp, Homo sapiens
cctttccaccttctcaca

SEQ ID NO: 1327339 - DNA, 15 bp, Homo sapiens
ccttttgctgtgtga

SEQ ID NO: 1327340 - DNA, 19 bp, Homo sapiens
cgactctcgtgatatgctg

SEQ ID NO: 1327341 - DNA, 13 bp, Homo sapiens
cgatttttaagag

SEQ ID NO: 1327342 - DNA, 17 bp, Homo sapiens
cgcattaagggcctgct

SEQ ID NO: 1327343 - DNA, 19 bp, Homo sapiens
cgcattaagggcctgctgg

SEQ ID NO: 1327344 - DNA, 19 bp, Homo sapiens
cgcccatgagagcgcagcc

SEQ ID NO: 1327345 - DNA, 20 bp, Homo sapiens
cgcccatgagagcgcagccc

SEQ ID NO: 1327346 - DNA, 11 bp, Homo sapiens
cgccccagggt

SEQ ID NO: 1327347 - DNA, 18 bp, Homo sapiens
cgcccgtagatcatcccc

SEQ ID NO: 1327348 - DNA, 15 bp, Homo sapiens
cgcgcccctgggact

SEQ ID NO: 1327349 - DNA, 20 bp, Homo sapiens
cgcgctcagatgccggagcc

SEQ ID NO: 1327350 - DNA, 20 bp, Homo sapiens
cgcggcctcttctctcagac

SEQ ID NO: 1327351 - DNA, 21 bp, Homo sapiens
cgctcactggttttggccacc

SEQ ID NO: 1327352 - DNA, 22 bp, Homo sapiens
cgctcagatgccggagccccaa

SEQ ID NO: 1327353 - DNA, 20 bp, Homo sapiens
cgctgggttctgactctgga

SEQ ID NO: 1327354 - DNA, 22 bp, Homo sapiens
cggagccccaagactctgctct

SEQ ID NO: 1327355 - DNA, 16 bp, Homo sapiens
cggccaggtgcctcct

SEQ ID NO: 1327356 - DNA, 17 bp, Homo sapiens
cggctcaggagagggcc

SEQ ID NO: 1327357 - DNA, 22 bp, Homo sapiens
cggctcaggagagggccttccc

SEQ ID NO: 1327358 - DNA, 12 bp, Homo sapiens
cggctctgtgcc

SEQ ID NO: 1327359 - DNA, 13 bp, Homo sapiens
cggctctgtgccc

SEQ ID NO: 1327360 - DNA, 16 bp, Homo sapiens
cgggcccctgagcctg

SEQ ID NO: 1327361 - DNA, 13 bp, Homo sapiens
cggggcctgcagg

SEQ ID NO: 1327362 - DNA, 17 bp, Homo sapiens
cggggcctgcaggccag

SEQ ID NO: 1327363 - DNA, 21 bp, Homo sapiens
cgggggccaactcacccttgg

SEQ ID NO: 1327364 - DNA, 21 bp, Homo sapiens
cggggtgtctgtcttcctttg

SEQ ID NO: 1327365 - DNA, 21 bp, Homo sapiens
cgggtgctcaataaacttgtg

SEQ ID NO: 1327366 - DNA, 18 bp, Homo sapiens
cgtagatcatccccgagg

SEQ ID NO: 1327367 - DNA, 17 bp, Homo sapiens
cgtcctcagcaccccac

SEQ ID NO: 1327368 - DNA, 21 bp, Homo sapiens
cgtcctcagcaccccactcct

SEQ ID NO: 1327369 - DNA, 14 bp, Homo sapiens
cgttcattcattca

SEQ ID NO: 1327370 - DNA, 13 bp, Homo sapiens
cgttttcaaagat

SEQ ID NO: 1327371 - DNA, 16 bp, Homo sapiens
ctaaaccgttgagttt

SEQ ID NO: 1327372 - DNA, 21 bp, Homo sapiens
ctaaagccaggaacagggacc

SEQ ID NO: 1327373 - DNA, 20 bp, Homo sapiens
ctaaatggcctctctccact

SEQ ID NO: 1327374 - DNA, 21 bp, Homo sapiens
ctaaatggcctctctccacta

SEQ ID NO: 1327375 - DNA, 22 bp, Homo sapiens
ctaaggggctagggctgagcac

SEQ ID NO: 1327376 - DNA, 12 bp, Homo sapiens
ctaataaaatat

SEQ ID NO: 1327377 - DNA, 13 bp, Homo sapiens
ctaataaaatatc

SEQ ID NO: 1327378 - DNA, 14 bp, Homo sapiens
ctaataaaatatca

SEQ ID NO: 1327379 - DNA, 15 bp, Homo sapiens
ctaataaaatatcat

SEQ ID NO: 1327380 - DNA, 17 bp, Homo sapiens
ctaataaaatatcattc

SEQ ID NO: 1327381 - DNA, 19 bp, Homo sapiens
ctaataaaatatcattcag

SEQ ID NO: 1327382 - DNA, 20 bp, Homo sapiens
ctaataaaatatcattcagc

SEQ ID NO: 1327383 - DNA, 21 bp, Homo sapiens
ctaataaaatattttctgtgt

SEQ ID NO: 1327384 - DNA, 14 bp, Homo sapiens
ctaatttcattcaa

SEQ ID NO: 1327385 - DNA, 12 bp, Homo sapiens
ctacaaatggat

SEQ ID NO: 1327386 - DNA, 23 bp, Homo sapiens
ctacacacagaccgcgcccctgg

SEQ ID NO: 1327387 - DNA, 23 bp, Homo sapiens
ctacacggttcaaacctgtgaag

SEQ ID NO: 1327388 - DNA, 20 bp, Homo sapiens
ctacagttgggaagtctcag

SEQ ID NO: 1327389 - DNA, 22 bp, Homo sapiens
cttccatatccgggtgctcaat

SEQ ID NO: 1327390 - DNA, 19 bp, Homo sapiens
cttcccctcccagccctga

SEQ ID NO: 1327391 - DNA, 15 bp, Homo sapiens
cttctctcaatccct

SEQ ID NO: 1327392 - DNA, 21 bp, Homo sapiens
cttctctcaatccctttgcaa

SEQ ID NO: 1327393 - DNA, 18 bp, Homo sapiens
cttctgtgcacctgggct

SEQ ID NO: 1327394 - DNA, 13 bp, Homo sapiens
cttcttcattcca

SEQ ID NO: 1327395 - DNA, 12 bp, Homo sapiens
cttcttgctgcc

SEQ ID NO: 1327396 - DNA, 12 bp, Homo sapiens
cttctttctgct

SEQ ID NO: 1327397 - DNA, 13 bp, Homo sapiens
cttctttctgctg

SEQ ID NO: 1327398 - DNA, 21 bp, Homo sapiens
cttgaacaacccaatctggct

SEQ ID NO: 1327399 - DNA, 22 bp, Homo sapiens
cttgaacaacccaatctggctg

SEQ ID NO: 1327400 - DNA, 20 bp, Homo sapiens
cttgaattgcattttttaaa

SEQ ID NO: 1327401 - DNA, 24 bp, Homo sapiens
cttgacttgccatgaaggcacctg

SEQ ID NO: 1327402 - DNA, 22 bp, Homo sapiens
cttgatgaaataacacagcagt

SEQ ID NO: 1327403 - DNA, 20 bp, Homo sapiens
cttgccatgaaggcacctgc

SEQ ID NO: 1327404 - DNA, 17 bp, Homo sapiens
cttgctactgaaaaaaa

SEQ ID NO: 1327405 - DNA, 18 bp, Homo sapiens
cttgctcccgccccaggg

SEQ ID NO: 1327406 - DNA, 19 bp, Homo sapiens
cttgctcccgccccagggt

SEQ ID NO: 1327407 - DNA, 21 bp, Homo sapiens
cttgctcccgccccagggtct

SEQ ID NO: 1327408 - DNA, 12 bp, Homo sapiens
cttgctctctgt

SEQ ID NO: 1327409 - DNA, 20 bp, Homo sapiens
cttgctctctgttctcttgc

SEQ ID NO: 1327410 - DNA, 12 bp, Homo sapiens
cttgctgcccac

SEQ ID NO: 1327411 - DNA, 21 bp, Homo sapiens
cttgctttaaagagtcctcct

SEQ ID NO: 1327412 - DNA, 23 bp, Homo sapiens
cttgctttaaagagtcctccttc

SEQ ID NO: 1327413 - DNA, 14 bp, Homo sapiens
cttggaaatattaa

SEQ ID NO: 1327414 - DNA, 21 bp, Homo sapiens
cttggacacttaattctgttc

SEQ ID NO: 1327415 - DNA, 13 bp, Homo sapiens
cttggcttcctgg

SEQ ID NO: 1327416 - DNA, 14 bp, Homo sapiens
cttgtgactagtgc

SEQ ID NO: 1327417 - DNA, 19 bp, Homo sapiens
cttgtgactagtgctgaag

SEQ ID NO: 1327418 - DNA, 20 bp, Homo sapiens
cttgtgactagtgctgaagc

SEQ ID NO: 1327419 - DNA, 20 bp, Homo sapiens
cttgtggacctcaccagaga

SEQ ID NO: 1327420 - DNA, 13 bp, Homo sapiens
cttgttgaatgtc

SEQ ID NO: 1327421 - DNA, 13 bp, Homo sapiens
cttgtttctgagt

SEQ ID NO: 1327422 - DNA, 15 bp, Homo sapiens
cttgtttctgagttt

SEQ ID NO: 1327423 - DNA, 19 bp, Homo sapiens
cttgttttggactttgtta

SEQ ID NO: 1327424 - DNA, 17 bp, Homo sapiens
ctttaaagagtcctcct

SEQ ID NO: 1327425 - DNA, 22 bp, Homo sapiens
ctttaaagagtcctccttccca

SEQ ID NO: 1327426 - DNA, 15 bp, Homo sapiens
ctttctgctggctga

SEQ ID NO: 1327427 - DNA, 16 bp, Homo sapiens
ctttcttcttccacac

SEQ ID NO: 1327428 - DNA, 16 bp, Homo sapiens
ctttgaagaaggaatc

SEQ ID NO: 1327429 - DNA, 20 bp, Homo sapiens
ctttgacagcgcacagctgc

SEQ ID NO: 1327430 - DNA, 18 bp, Homo sapiens
ctttgcaccagatactca

SEQ ID NO: 1327431 - DNA, 16 bp, Homo sapiens
ctttgttaccttaaaa

SEQ ID NO: 1327432 - DNA, 20 bp, Homo sapiens
cttttcttggacacttaatt

SEQ ID NO: 1327433 - DNA, 14 bp, Homo sapiens
cttttgctgtgtga

SEQ ID NO: 1327434 - DNA, 15 bp, Homo sapiens
cttttgttgtttctt

SEQ ID NO: 1327435 - DNA, 14 bp, Homo sapiens
cttttttcttgcta

SEQ ID NO: 1327436 - DNA, 14 bp, Homo sapiens
gaaaacctgtcact

SEQ ID NO: 1327437 - DNA, 19 bp, Homo sapiens
gaaaataagccatgagaat

SEQ ID NO: 1327438 - DNA, 19 bp, Homo sapiens
gaaaatctgccactcaggg

SEQ ID NO: 1327439 - DNA, 15 bp, Homo sapiens
gaaaatgtgtgtttt

SEQ ID NO: 1327440 - DNA, 18 bp, Homo sapiens
gaaacagctttctgggta

SEQ ID NO: 1327441 - DNA, 17 bp, Homo sapiens
gaaacaggatatgcttt

SEQ ID NO: 1327442 - DNA, 14 bp, Homo sapiens
gaaactaataaaat

SEQ ID NO: 1327443 - DNA, 17 bp, Homo sapiens
gaaactaataaaatatt

SEQ ID NO: 1327444 - DNA, 22 bp, Homo sapiens
gaaactaataaaatattttctg

SEQ ID NO: 1327445 - DNA, 23 bp, Homo sapiens
gaaactaataaaatattttctgt

SEQ ID NO: 1327446 - DNA, 15 bp, Homo sapiens
gaaagagactgtggg

SEQ ID NO: 1327447 - DNA, 19 bp, Homo sapiens
gaaagcctcctctggagaa

SEQ ID NO: 1327448 - DNA, 16 bp, Homo sapiens
gaaaggacctgcaaac

SEQ ID NO: 1327449 - DNA, 17 bp, Homo sapiens
gaaagggttctgtaaaa

SEQ ID NO: 1327450 - DNA, 11 bp, Homo sapiens
gaaagtttccc

SEQ ID NO: 1327451 - DNA, 17 bp, Homo sapiens
gaaataacacagcagtt

SEQ ID NO: 1327452 - DNA, 19 bp, Homo sapiens
gaaatagtcatttgtgaat

SEQ ID NO: 1327453 - DNA, 20 bp, Homo sapiens
gaaatagtcatttgtgaatt

SEQ ID NO: 1327454 - DNA, 13 bp, Homo sapiens
gaaatctttctgg

SEQ ID NO: 1327455 - DNA, 17 bp, Homo sapiens
gaacaagaaatctttct

SEQ ID NO: 1327456 - DNA, 13 bp, Homo sapiens
gaacacacagggc

SEQ ID NO: 1327457 - DNA, 17 bp, Homo sapiens
gaacagctgttgactct

SEQ ID NO: 1327458 - DNA, 14 bp, Homo sapiens
gaacagggaccagc

SEQ ID NO: 1327459 - DNA, 18 bp, Homo sapiens
gaacagggaccagctccc

SEQ ID NO: 1327460 - DNA, 23 bp, Homo sapiens
gaacagtttatgcagtgctgctt

SEQ ID NO: 1327461 - DNA, 14 bp, Homo sapiens
gaacccaccctctc

SEQ ID NO: 1327462 - DNA, 15 bp, Homo sapiens
gaacccaccctctcc

SEQ ID NO: 1327463 - DNA, 16 bp, Homo sapiens
gaacccaccctctcca

SEQ ID NO: 1327464 - DNA, 22 bp, Homo sapiens
gaacccaccctctccacaccca

SEQ ID NO: 1327465 - DNA, 18 bp, Homo sapiens
gaactgcaactccagcgt

SEQ ID NO: 1327466 - DNA, 20 bp, Homo sapiens
gaacttaacatgctgtgtaa

SEQ ID NO: 1327467 - DNA, 13 bp, Homo sapiens
gaacttccctccc

SEQ ID NO: 1327468 - DNA, 13 bp, Homo sapiens
gaagaaagagact

SEQ ID NO: 1327469 - DNA, 19 bp, Homo sapiens
gaagacttaactggcccag

SEQ ID NO: 1327470 - DNA, 14 bp, Homo sapiens
gaagccaagcctgg

SEQ ID NO: 1327471 - DNA, 15 bp, Homo sapiens
gaagccaagcctgga

SEQ ID NO: 1327472 - DNA, 14 bp, Homo sapiens
gaagccacaggcct

SEQ ID NO: 1327473 - DNA, 18 bp, Homo sapiens
gaagccacaggcctggcc

SEQ ID NO: 1327474 - DNA, 19 bp, Homo sapiens
gaagccacaggcctggcct

SEQ ID NO: 1327475 - DNA, 18 bp, Homo sapiens
gaagccttcttgctgccc

SEQ ID NO: 1327476 - DNA, 19 bp, Homo sapiens
gaagcttattaatgctaag

SEQ ID NO: 1327477 - DNA, 18 bp, Homo sapiens
gaaggaaagcaaggcaga

SEQ ID NO: 1327478 - DNA, 22 bp, Homo sapiens
gaaggcacctgcccccacagct

SEQ ID NO: 1327479 - DNA, 22 bp, Homo sapiens
gaaggccaggagtaagcccaag

SEQ ID NO: 1327480 - DNA, 18 bp, Homo sapiens
gaagtccttaagcagagg

SEQ ID NO: 1327481 - DNA, 12 bp, Homo sapiens
gaagtctcagcc

SEQ ID NO: 1327482 - DNA, 15 bp, Homo sapiens
gaagtctcagcctgg

SEQ ID NO: 1327483 - DNA, 16 bp, Homo sapiens
gaataaaacatttctc

SEQ ID NO: 1327484 - DNA, 18 bp, Homo sapiens
gaataaaacatttctctc

SEQ ID NO: 1327485 - DNA, 23 bp, Homo sapiens
gaatagagggagtagaaagcttc

SEQ ID NO: 1327486 - DNA, 21 bp, Homo sapiens
gaatagggcccatgggaggga

SEQ ID NO: 1327487 - DNA, 21 bp, Homo sapiens
gaatcttacagagtgattgta

SEQ ID NO: 1327488 - DNA, 14 bp, Homo sapiens
gaatgatttctatg

SEQ ID NO: 1327489 - DNA, 16 bp, Homo sapiens
gaatgatttctatgaa

SEQ ID NO: 1327490 - DNA, 20 bp, Homo sapiens
gaatgatttctatgaacttg

SEQ ID NO: 1327491 - DNA, 15 bp, Homo sapiens
gaatgccctgaaact

SEQ ID NO: 1327492 - DNA, 18 bp, Homo sapiens
gaatggagatatgcattc

SEQ ID NO: 1327493 - DNA, 14 bp, Homo sapiens
gaatggtctcagtg

SEQ ID NO: 1327494 - DNA, 17 bp, Homo sapiens
gaatgttttagcacagc

SEQ ID NO: 1327495 - DNA, 15 bp, Homo sapiens
gaattaggtttcttt

SEQ ID NO: 1327496 - DNA, 21 bp, Homo sapiens
gaattgcattttttaaaacaa

SEQ ID NO: 1327497 - DNA, 12 bp, Homo sapiens
gaattgcctgcc

SEQ ID NO: 1327498 - DNA, 13 bp, Homo sapiens
gacaaaaaggaaa

SEQ ID NO: 1327499 - DNA, 15 bp, Homo sapiens
gacaaagttctgtat

SEQ ID NO: 1327500 - DNA, 17 bp, Homo sapiens
gacaattccatttcttt

SEQ ID NO: 1327501 - DNA, 19 bp, Homo sapiens
gacacatttaatgaacaca

SEQ ID NO: 1327502 - DNA, 13 bp, Homo sapiens
gacactgtgaaat

SEQ ID NO: 1327503 - DNA, 15 bp, Homo sapiens
gacactgtgcaggcc

SEQ ID NO: 1327504 - DNA, 17 bp, Homo sapiens
gacactgtgcaggccca

SEQ ID NO: 1327505 - DNA, 18 bp, Homo sapiens
gacactgtgcaggcccag

SEQ ID NO: 1327506 - DNA, 21 bp, Homo sapiens
gacactgtgcaggcccaggca

SEQ ID NO: 1327507 - DNA, 22 bp, Homo sapiens
gacagcacacggtgagggtgcg

SEQ ID NO: 1327508 - DNA, 12 bp, Homo sapiens
gacagctggtca

SEQ ID NO: 1327509 - DNA, 23 bp, Homo sapiens
gacatgggtcgcccatgagagcg

SEQ ID NO: 1327510 - DNA, 16 bp, Homo sapiens
gacatgtactgagaca

SEQ ID NO: 1327511 - DNA, 21 bp, Homo sapiens
gaccatgctgagacatccctc

SEQ ID NO: 1327512 - DNA, 22 bp, Homo sapiens
gaccccatccacctatccacca

SEQ ID NO: 1327513 - DNA, 16 bp, Homo sapiens
gaccgcgcccctggga

SEQ ID NO: 1327514 - DNA, 17 bp, Homo sapiens
gaccgcgcccctgggac

SEQ ID NO: 1327515 - DNA, 14 bp, Homo sapiens
gacctggcctctgc

SEQ ID NO: 1327516 - DNA, 15 bp, Homo sapiens
gacctggcctctgcc

SEQ ID NO: 1327517 - DNA, 16 bp, Homo sapiens
gacctggcctctgcca

SEQ ID NO: 1327518 - DNA, 11 bp, Homo sapiens
gacctggctgg

SEQ ID NO: 1327519 - DNA, 19 bp, Homo sapiens
gacctggctgggcctgggc

SEQ ID NO: 1327520 - DNA, 18 bp, Homo sapiens
gaccttgacttgccatga

SEQ ID NO: 1327521 - DNA, 14 bp, Homo sapiens
gactagtgctgaag

SEQ ID NO: 1327522 - DNA, 20 bp, Homo sapiens
gtagatacaatcagctgctt

SEQ ID NO: 1327523 - DNA, 19 bp, Homo sapiens
gtaggcctggggctatgca

SEQ ID NO: 1327524 - DNA, 18 bp, Homo sapiens
gtatctaatttcattcaa

SEQ ID NO: 1327525 - DNA, 19 bp, Homo sapiens
gtatctgatgtttgttttc

SEQ ID NO: 1327526 - DNA, 12 bp, Homo sapiens
gtatggtgacct

SEQ ID NO: 1327527 - DNA, 17 bp, Homo sapiens
gtattcgaaacctgtga

SEQ ID NO: 1327528 - DNA, 16 bp, Homo sapiens
gtatttggatatctgt

SEQ ID NO: 1327529 - DNA, 16 bp, Homo sapiens
gtcaacaccagaaagc

SEQ ID NO: 1327530 - DNA, 21 bp, Homo sapiens
gtcaaggcgcgctcagatgcc

SEQ ID NO: 1327531 - DNA, 12 bp, Homo sapiens
gtcaccctcagg

SEQ ID NO: 1327532 - DNA, 13 bp, Homo sapiens
gtcagttcagaaa

SEQ ID NO: 1327533 - DNA, 18 bp, Homo sapiens
gtcatctctcctgtgtct

SEQ ID NO: 1327534 - DNA, 17 bp, Homo sapiens
gtcattttgactggctt

SEQ ID NO: 1327535 - DNA, 16 bp, Homo sapiens
gtccaaaccttctacc

SEQ ID NO: 1327536 - DNA, 16 bp, Homo sapiens
gtccagatggcaggct

SEQ ID NO: 1327537 - DNA, 15 bp, Homo sapiens
gtccatgtcctatgc

SEQ ID NO: 1327538 - DNA, 14 bp, Homo sapiens
gtcccacggctctg

SEQ ID NO: 1327539 - DNA, 17 bp, Homo sapiens
gtcccacggctctgtgc

SEQ ID NO: 1327540 - DNA, 18 bp, Homo sapiens
gtcccacggctctgtgcc

SEQ ID NO: 1327541 - DNA, 19 bp, Homo sapiens
gtcccacggctctgtgccc

SEQ ID NO: 1327542 - DNA, 23 bp, Homo sapiens
gtcccactaaggtgaccagagtg

SEQ ID NO: 1327543 - DNA, 22 bp, Homo sapiens
gtcccactggctcctcccagca

SEQ ID NO: 1327544 - DNA, 18 bp, Homo sapiens
gtcccctcaagccccttc

SEQ ID NO: 1327545 - DNA, 18 bp, Homo sapiens
gtcctcagcaccccactc

SEQ ID NO: 1327546 - DNA, 23 bp, Homo sapiens
gtcctcagcaccccactcctcag

SEQ ID NO: 1327547 - DNA, 16 bp, Homo sapiens
gtcctccatcacccct

SEQ ID NO: 1327548 - DNA, 15 bp, Homo sapiens
gtcctcgggcccctg

SEQ ID NO: 1327549 - DNA, 19 bp, Homo sapiens
gtcctcgggcccctgagcc

SEQ ID NO: 1327550 - DNA, 14 bp, Homo sapiens
gtcctgtaaacact

SEQ ID NO: 1327551 - DNA, 16 bp, Homo sapiens
gtcctgtaaacactca

SEQ ID NO: 1327552 - DNA, 24 bp, Homo sapiens
gtctcagcctgggcccctcagcca

SEQ ID NO: 1327553 - DNA, 14 bp, Homo sapiens
gtctgtcttccttt

SEQ ID NO: 1327554 - DNA, 14 bp, Homo sapiens
gtcttctcccaact

SEQ ID NO: 1327555 - DNA, 15 bp, Homo sapiens
gtcttgacctctcca

SEQ ID NO: 1327556 - DNA, 18 bp, Homo sapiens
gtcttgacctctccagca

SEQ ID NO: 1327557 - DNA, 21 bp, Homo sapiens
gtcttgtgactagtgctgaag

SEQ ID NO: 1327558 - DNA, 15 bp, Homo sapiens
gtgaaatctttcaag

SEQ ID NO: 1327559 - DNA, 16 bp, Homo sapiens
gtgaaatctttcaagt

SEQ ID NO: 1327560 - DNA, 23 bp, Homo sapiens
gtgaagacactgtgcaggcccag

SEQ ID NO: 1327561 - DNA, 17 bp, Homo sapiens
gtgacctctccggcctg

SEQ ID NO: 1327562 - DNA, 22 bp, Homo sapiens
gtgacctctccggcctggcctt

SEQ ID NO: 1327563 - DNA, 20 bp, Homo sapiens
gtgaccttgacttgccatga

SEQ ID NO: 1327564 - DNA, 13 bp, Homo sapiens
gtgactagtgctg

SEQ ID NO: 1327565 - DNA, 17 bp, Homo sapiens
gtgagaagaaagaaact

SEQ ID NO: 1327566 - DNA, 16 bp, Homo sapiens
gtgaggccactgaaga

SEQ ID NO: 1327567 - DNA, 21 bp, Homo sapiens
gtgaggccactgaagaggagg

SEQ ID NO: 1327568 - DNA, 23 bp, Homo sapiens
gtgaggccactgaagaggaggag

SEQ ID NO: 1327569 - DNA, 23 bp, Homo sapiens
gtgcatgccaggaagcacgttca

SEQ ID NO: 1327570 - DNA, 14 bp, Homo sapiens
gtgccatcttccat

SEQ ID NO: 1327571 - DNA, 18 bp, Homo sapiens
gtgccatcttccatatcc

SEQ ID NO: 1327572 - DNA, 16 bp, Homo sapiens
gtgcccggtgccatct

SEQ ID NO: 1327573 - DNA, 18 bp, Homo sapiens
gtgcccggtgccatcttc

SEQ ID NO: 1327574 - DNA, 20 bp, Homo sapiens
gtgcccggtgccatcttcca

SEQ ID NO: 1327575 - DNA, 14 bp, Homo sapiens
gtgcggggcctgca

SEQ ID NO: 1327576 - DNA, 17 bp, Homo sapiens
gtgcggggcctgcaggc

SEQ ID NO: 1327577 - DNA, 19 bp, Homo sapiens
gtgcggggcctgcaggcca

SEQ ID NO: 1327578 - DNA, 16 bp, Homo sapiens
gtgctcaaccagacag

SEQ ID NO: 1327579 - DNA, 15 bp, Homo sapiens
gtgctgaagcttatt

SEQ ID NO: 1327580 - DNA, 16 bp, Homo sapiens
gtgctgggagatgctc

SEQ ID NO: 1327581 - DNA, 20 bp, Homo sapiens
gtggatttactgagagaagg

SEQ ID NO: 1327582 - DNA, 21 bp, Homo sapiens
gtggatttactgagagaaggt

SEQ ID NO: 1327583 - DNA, 19 bp, Homo sapiens
gtggctcgatttttaagag

SEQ ID NO: 1327584 - DNA, 13 bp, Homo sapiens
gtggggagggtca

SEQ ID NO: 1327585 - DNA, 22 bp, Homo sapiens
gtggggccggggcttctgtgca

SEQ ID NO: 1327586 - DNA, 21 bp, Homo sapiens
gtggtaaagtgttaaggaata

SEQ ID NO: 1327587 - DNA, 12 bp, Homo sapiens
gtgtaatattac

SEQ ID NO: 1327588 - DNA, 23 bp, Homo sapiens
gtgtacagaatttttcttcatta

SEQ ID NO: 1327589 - DNA, 13 bp, Homo sapiens
gtgtgaagacact

SEQ ID NO: 1327590 - DNA, 19 bp, Homo sapiens
gtgtgaagacactgtgcag

SEQ ID NO: 1327591 - DNA, 19 bp, Homo sapiens
gtgtgtaaataatgtacat

SEQ ID NO: 1327592 - DNA, 16 bp, Homo sapiens
gtgttaatactgagaa

SEQ ID NO: 1327593 - DNA, 15 bp, Homo sapiens
gttagagaatggcct

SEQ ID NO: 1327594 - DNA, 15 bp, Homo sapiens
gttagctcacaggac

SEQ ID NO: 1327595 - DNA, 15 bp, Homo sapiens
gttattttcagcatg

SEQ ID NO: 1327596 - DNA, 18 bp, Homo sapiens
gttcaattatttccccca

SEQ ID NO: 1327597 - DNA, 21 bp, Homo sapiens
gttcacatgtgccctgccttg

SEQ ID NO: 1327598 - DNA, 13 bp, Homo sapiens
gttcactgcactg

SEQ ID NO: 1327599 - DNA, 20 bp, Homo sapiens
gttcagcaagtagagcagag

SEQ ID NO: 1327600 - DNA, 19 bp, Homo sapiens
gttcatgctgagcaaagtt

SEQ ID NO: 1327601 - DNA, 13 bp, Homo sapiens
gttccatgttttg

SEQ ID NO: 1327602 - DNA, 14 bp, Homo sapiens
gttccccacaggtc

SEQ ID NO: 1327603 - DNA, 22 bp, Homo sapiens
gttcctaggggaatgagggggc

SEQ ID NO: 1327604 - DNA, 13 bp, Homo sapiens
gttccttcctgca

SEQ ID NO: 1327605 - DNA, 15 bp, Homo sapiens
gttccttcctgcaga

SEQ ID NO: 1327606 - DNA, 24 bp, Homo sapiens
gttccttcctgcagacctggctgg

SEQ ID NO: 1327607 - DNA, 15 bp, Homo sapiens
gttctgactctggac

SEQ ID NO: 1327608 - DNA, 19 bp, Homo sapiens
gttgactctagtactgtga

SEQ ID NO: 1327609 - DNA, 21 bp, Homo sapiens
gttgactctagtactgtgaat

SEQ ID NO: 1327610 - DNA, 22 bp, Homo sapiens
gttgactctagtactgtgaatc

SEQ ID NO: 1327611 - DNA, 17 bp, Homo sapiens
gttgctgtcagtcttga

SEQ ID NO: 1327612 - DNA, 22 bp, Homo sapiens
gtttacatgtctgttgttggtc

SEQ ID NO: 1327613 - DNA, 17 bp, Homo sapiens
gtttatagcttcaggac

SEQ ID NO: 1327614 - DNA, 15 bp, Homo sapiens
gtttatgcagtgctg

SEQ ID NO: 1327615 - DNA, 17 bp, Homo sapiens
gtttatgcagtgctgct

SEQ ID NO: 1327616 - DNA, 16 bp, Homo sapiens
gtttcttaatttggaa

SEQ ID NO: 1327617 - DNA, 14 bp, Homo sapiens
gtttgggggaactt

SEQ ID NO: 1327618 - DNA, 22 bp, Homo sapiens
gtttggttagctcacaggactt

SEQ ID NO: 1327619 - DNA, 15 bp, Homo sapiens
gttttggccacccct

SEQ ID NO: 1327620 - DNA, 22 bp, Homo sapiens
gttttggccaccccttgctctc

SEQ ID NO: 1327621 - DNA, 20 bp, Homo sapiens
gtttttcttttcttggacac

SEQ ID NO: 1327622 - DNA, 17 bp, Homo sapiens
taaaaattactgtgtta

SEQ ID NO: 1327623 - DNA, 20 bp, Homo sapiens
taaaacaagaaagtttcccc

SEQ ID NO: 1327624 - DNA, 22 bp, Homo sapiens
taaaacagttggcatgcatccc

SEQ ID NO: 1327625 - DNA, 17 bp, Homo sapiens
taaaacatttctctctt

SEQ ID NO: 1327626 - DNA, 18 bp, Homo sapiens
taaaaccttttttcttgc

SEQ ID NO: 1327627 - DNA, 19 bp, Homo sapiens
taaaactaggcatttgtaa

SEQ ID NO: 1327628 - DNA, 18 bp, Homo sapiens
taaaactgatgtgaaact

SEQ ID NO: 1327629 - DNA, 18 bp, Homo sapiens
taaaagcaacatcagctt

SEQ ID NO: 1327630 - DNA, 20 bp, Homo sapiens
taaaagcaacatcagcttga

SEQ ID NO: 1327631 - DNA, 13 bp, Homo sapiens
taaaatattttct

SEQ ID NO: 1327632 - DNA, 16 bp, Homo sapiens
taaacactcagctgtt

SEQ ID NO: 1327633 - DNA, 15 bp, Homo sapiens
taaacttgtgcctcc

SEQ ID NO: 1327634 - DNA, 21 bp, Homo sapiens
taaagagtcctccttcccagc

SEQ ID NO: 1327635 - DNA, 23 bp, Homo sapiens
taaagccaggaacagggaccagc

SEQ ID NO: 1327636 - DNA, 15 bp, Homo sapiens
taaaggcctctgcct

SEQ ID NO: 1327637 - DNA, 23 bp, Homo sapiens
taaaggcctctgcctcacaacat

SEQ ID NO: 1327638 - DNA, 19 bp, Homo sapiens
taaagtcattaacaagaaa

SEQ ID NO: 1327639 - DNA, 19 bp, Homo sapiens
taaagtgaggccactgaag

SEQ ID NO: 1327640 - DNA, 21 bp, Homo sapiens
taaattaatatattgttttcc

SEQ ID NO: 1327641 - DNA, 12 bp, Homo sapiens
taaatttaaatg

SEQ ID NO: 1327642 - DNA, 23 bp, Homo sapiens
taaatttgtgtaatattacttta

SEQ ID NO: 1327643 - DNA, 16 bp, Homo sapiens
taacaaaaagcaatta

SEQ ID NO: 1327644 - DNA, 14 bp, Homo sapiens
taacatgctgtgta

SEQ ID NO: 1327645 - DNA, 18 bp, Homo sapiens
taactgacttagttcttc

SEQ ID NO: 1327646 - DNA, 20 bp, Homo sapiens
taactgaggcttagaaaggt

SEQ ID NO: 1327647 - DNA, 14 bp, Homo sapiens
taactggcccagaa

SEQ ID NO: 1327648 - DNA, 16 bp, Homo sapiens
taactggcccagaagc

SEQ ID NO: 1327649 - DNA, 21 bp, Homo sapiens
taagaaaatagagatgagctt

SEQ ID NO: 1327650 - DNA, 14 bp, Homo sapiens
taagccatgagaat

SEQ ID NO: 1327651 - DNA, 22 bp, Homo sapiens
taagcccaagctaagctgcagg

SEQ ID NO: 1327652 - DNA, 23 bp, Homo sapiens
taagcccaagctaagctgcaggc

SEQ ID NO: 1327653 - DNA, 21 bp, Homo sapiens
tctggaattgatgtttacatg

SEQ ID NO: 1327654 - DNA, 22 bp, Homo sapiens
tctggcccttgggtttcctggt

SEQ ID NO: 1327655 - DNA, 13 bp, Homo sapiens
tctgggtgagaat

SEQ ID NO: 1327656 - DNA, 16 bp, Homo sapiens
tctgtaaaatggaaaa

SEQ ID NO: 1327657 - DNA, 18 bp, Homo sapiens
tctgtacatctctactta

SEQ ID NO: 1327658 - DNA, 12 bp, Homo sapiens
tctgtcttcctt

SEQ ID NO: 1327659 - DNA, 18 bp, Homo sapiens
tctgtgccattttctgta

SEQ ID NO: 1327660 - DNA, 14 bp, Homo sapiens
tctgtgtgttcctg

SEQ ID NO: 1327661 - DNA, 13 bp, Homo sapiens
tctgttagatgct

SEQ ID NO: 1327662 - DNA, 23 bp, Homo sapiens
tctgttatttatccctcattcat

SEQ ID NO: 1327663 - DNA, 22 bp, Homo sapiens
tctgttgctggtcttctcagtt

SEQ ID NO: 1327664 - DNA, 13 bp, Homo sapiens
tcttaatttggaa

SEQ ID NO: 1327665 - DNA, 19 bp, Homo sapiens
tcttaatttggaaactaat

SEQ ID NO: 1327666 - DNA, 17 bp, Homo sapiens
tcttacttgcaaaatgg

SEQ ID NO: 1327667 - DNA, 19 bp, Homo sapiens
tcttacttgcaaaatggag

SEQ ID NO: 1327668 - DNA, 16 bp, Homo sapiens
tcttcatgttcaatta

SEQ ID NO: 1327669 - DNA, 15 bp, Homo sapiens
tcttccacacatgca

SEQ ID NO: 1327670 - DNA, 19 bp, Homo sapiens
tcttctcagttcatttcct

SEQ ID NO: 1327671 - DNA, 14 bp, Homo sapiens
tcttctcccaactc

SEQ ID NO: 1327672 - DNA, 12 bp, Homo sapiens
tcttctctcaga

SEQ ID NO: 1327673 - DNA, 13 bp, Homo sapiens
tcttcttgtcttt

SEQ ID NO: 1327674 - DNA, 22 bp, Homo sapiens
tcttgaaggccacatgtgaaaa

SEQ ID NO: 1327675 - DNA, 16 bp, Homo sapiens
tcttgacctctccagc

SEQ ID NO: 1327676 - DNA, 16 bp, Homo sapiens
tcttgctactgaaaaa

SEQ ID NO: 1327677 - DNA, 18 bp, Homo sapiens
tcttgctactgaaaaaaa

SEQ ID NO: 1327678 - DNA, 13 bp, Homo sapiens
tcttgctgcccac

SEQ ID NO: 1327679 - DNA, 22 bp, Homo sapiens
tcttgctgtttcttgatgctca

SEQ ID NO: 1327680 - DNA, 17 bp, Homo sapiens
tcttggcaataatgtca

SEQ ID NO: 1327681 - DNA, 15 bp, Homo sapiens
tcttggcttcctggc

SEQ ID NO: 1327682 - DNA, 14 bp, Homo sapiens
tcttggtatttgga

SEQ ID NO: 1327683 - DNA, 17 bp, Homo sapiens
tcttgtctttgtccctg

SEQ ID NO: 1327684 - DNA, 11 bp, Homo sapiens
tcttgtgacta

SEQ ID NO: 1327685 - DNA, 16 bp, Homo sapiens
tcttgtgactagtgct

SEQ ID NO: 1327686 - DNA, 22 bp, Homo sapiens
tcttgtgactagtgctgaagct

SEQ ID NO: 1327687 - DNA, 15 bp, Homo sapiens
tctttcaagttgcat

SEQ ID NO: 1327688 - DNA, 18 bp, Homo sapiens
tctttcttcttccacaca

SEQ ID NO: 1327689 - DNA, 20 bp, Homo sapiens
tctttgaagaaggaatcttt

SEQ ID NO: 1327690 - DNA, 16 bp, Homo sapiens
tcttttgaatgttaag

SEQ ID NO: 1327691 - DNA, 14 bp, Homo sapiens
tgaaaaaaatggag

SEQ ID NO: 1327692 - DNA, 14 bp, Homo sapiens
tgaaaatgtgtgtt

SEQ ID NO: 1327693 - DNA, 16 bp, Homo sapiens
tgaaaccccatctcta

SEQ ID NO: 1327694 - DNA, 18 bp, Homo sapiens
tgaaaccccatctctact

SEQ ID NO: 1327695 - DNA, 12 bp, Homo sapiens
tgaaaggggtgt

SEQ ID NO: 1327696 - DNA, 23 bp, Homo sapiens
tgaaagtcttgtgactagtgctg

SEQ ID NO: 1327697 - DNA, 15 bp, Homo sapiens
tgaaatatggaactg

SEQ ID NO: 1327698 - DNA, 14 bp, Homo sapiens
tgaaatctttcaag

SEQ ID NO: 1327699 - DNA, 22 bp, Homo sapiens
tgaacaacccaatctggctggt

SEQ ID NO: 1327700 - DNA, 17 bp, Homo sapiens
tgaacttaacatgctgt

SEQ ID NO: 1327701 - DNA, 19 bp, Homo sapiens
tgaacttaacatgctgtgt

SEQ ID NO: 1327702 - DNA, 21 bp, Homo sapiens
tgaacttaacatgctgtgtaa

SEQ ID NO: 1327703 - DNA, 15 bp, Homo sapiens
tgaagaaagagactg

SEQ ID NO: 1327704 - DNA, 23 bp, Homo sapiens
tgaagacttaactggcccagaag

SEQ ID NO: 1327705 - DNA, 16 bp, Homo sapiens
tgaagcttattaatgc

SEQ ID NO: 1327706 - DNA, 23 bp, Homo sapiens
tgaagcttattaatgctaagggc

SEQ ID NO: 1327707 - DNA, 15 bp, Homo sapiens
tgaaggcacctgccc

SEQ ID NO: 1327708 - DNA, 23 bp, Homo sapiens
tgaaggcacctgcccccacagct

SEQ ID NO: 1327709 - DNA, 17 bp, Homo sapiens
tgaagtgttagactata

SEQ ID NO: 1327710 - DNA, 22 bp, Homo sapiens
tgaatagagggagtagaaagct

SEQ ID NO: 1327711 - DNA, 23 bp, Homo sapiens
tgaatagagggagtagaaagctt

SEQ ID NO: 1327712 - DNA, 12 bp, Homo sapiens
tgaatggagaat

SEQ ID NO: 1327713 - DNA, 22 bp, Homo sapiens
tgaattgcattttttaaaacaa

SEQ ID NO: 1327714 - DNA, 13 bp, Homo sapiens
tgaattgcctgcc

SEQ ID NO: 1327715 - DNA, 16 bp, Homo sapiens
tgaattgcctgccatg

SEQ ID NO: 1327716 - DNA, 15 bp, Homo sapiens
tgaattgtaaaagca

SEQ ID NO: 1327717 - DNA, 21 bp, Homo sapiens
tgaattgtaaaagcaacatca

SEQ ID NO: 1327718 - DNA, 17 bp, Homo sapiens
tgacagcacctgagaag

SEQ ID NO: 1327719 - DNA, 17 bp, Homo sapiens
tgacagcccatgggaat

SEQ ID NO: 1327720 - DNA, 16 bp, Homo sapiens
tgacagcgcacagctg

SEQ ID NO: 1327721 - DNA, 22 bp, Homo sapiens
tgacatctacgaagccacaggc

SEQ ID NO: 1327722 - DNA, 18 bp, Homo sapiens
tgaccagtataaaattac

SEQ ID NO: 1327723 - DNA, 18 bp, Homo sapiens
tgacccagaggggaatga

SEQ ID NO: 1327724 - DNA, 15 bp, Homo sapiens
tgacctccggccagg

SEQ ID NO: 1327725 - DNA, 19 bp, Homo sapiens
tgacctccggccaggtgcc

SEQ ID NO: 1327726 - DNA, 21 bp, Homo sapiens
tgactagtgctgaagcttatt

SEQ ID NO: 1327727 - DNA, 22 bp, Homo sapiens
tgactagtgctgaagcttatta

SEQ ID NO: 1327728 - DNA, 14 bp, Homo sapiens
tgactcctggtcct

SEQ ID NO: 1327729 - DNA, 21 bp, Homo sapiens
tgactggcttgctcccgcccc

SEQ ID NO: 1327730 - DNA, 24 bp, Homo sapiens
tgacttgccatgaaggcacctgcc

SEQ ID NO: 1327731 - DNA, 16 bp, Homo sapiens
tgagaagaaagaaact

SEQ ID NO: 1327732 - DNA, 23 bp, Homo sapiens
tgagaagaggaaccgttttacac

SEQ ID NO: 1327733 - DNA, 22 bp, Homo sapiens
tgagaattgggactctgttgct

SEQ ID NO: 1327734 - DNA, 16 bp, Homo sapiens
tgagacaaaaaggaaa

SEQ ID NO: 1327735 - DNA, 16 bp, Homo sapiens
tgagagagcagccagg

SEQ ID NO: 1327736 - DNA, 15 bp, Homo sapiens
tgagagcgcagcccg

SEQ ID NO: 1327737 - DNA, 16 bp, Homo sapiens
tgagagcgcagcccgc

SEQ ID NO: 1327738 - DNA, 16 bp, Homo sapiens
tgagcacctctcagag

SEQ ID NO: 1327739 - DNA, 17 bp, Homo sapiens
tgaggatatagtagcca

SEQ ID NO: 1327740 - DNA, 21 bp, Homo sapiens
tgaggcaaggcccagacctgg

SEQ ID NO: 1327741 - DNA, 15 bp, Homo sapiens
tgaggccactgaaga

SEQ ID NO: 1327742 - DNA, 20 bp, Homo sapiens
tgagggtgcggggcctgcag

SEQ ID NO: 1327743 - DNA, 21 bp, Homo sapiens
tgagggtgcggggcctgcagg

SEQ ID NO: 1327744 - DNA, 22 bp, Homo sapiens
tgagggtgcggggcctgcaggc

SEQ ID NO: 1327745 - DNA, 14 bp, Homo sapiens
tgagtccatgtcct

SEQ ID NO: 1327746 - DNA, 15 bp, Homo sapiens
tgagtccatgtccta

SEQ ID NO: 1327747 - DNA, 16 bp, Homo sapiens
tgagtccccttacaag

SEQ ID NO: 1327748 - DNA, 15 bp, Homo sapiens
tgagttcacatgtgc

SEQ ID NO: 1327749 - DNA, 15 bp, Homo sapiens
tgataaaaggagaat

SEQ ID NO: 1327750 - DNA, 18 bp, Homo sapiens
tgataccaggcccaggag

SEQ ID NO: 1327751 - DNA, 19 bp, Homo sapiens
tgatatgctgcttgtgacc

SEQ ID NO: 1327752 - DNA, 23 bp, Homo sapiens
tgatattgaggtgtttgaaatat

SEQ ID NO: 1327753 - DNA, 19 bp, Homo sapiens
tgatgcagaactttctctt

SEQ ID NO: 1327754 - DNA, 18 bp, Homo sapiens
tgatgtacgctgcgtgcc

SEQ ID NO: 1327755 - DNA, 13 bp, Homo sapiens
tgatgtttacatg

SEQ ID NO: 1327756 - DNA, 17 bp, Homo sapiens
tgatgtttacatgtctg

SEQ ID NO: 1327757 - DNA, 12 bp, Homo sapiens
tgatttcttctt

SEQ ID NO: 1327758 - DNA, 22 bp, Homo sapiens
tgcaaagtataaatttgtgtaa

SEQ ID NO: 1327759 - DNA, 18 bp, Homo sapiens
tgcaactccagcgtcctc

SEQ ID NO: 1327760 - DNA, 19 bp, Homo sapiens
tgcaactccagcgtcctca

SEQ ID NO: 1327761 - DNA, 18 bp, Homo sapiens
tgcaagaatggagatatg

SEQ ID NO: 1327762 - DNA, 12 bp, Homo sapiens
tgcacataaact

SEQ ID NO: 1327763 - DNA, 20 bp, Homo sapiens
tgcaccatagtatgctctga

SEQ ID NO: 1327764 - DNA, 17 bp, Homo sapiens
tgcactccagcctgggt

SEQ ID NO: 1327765 - DNA, 16 bp, Homo sapiens
tgcagacctggctggg

SEQ ID NO: 1327766 - DNA, 18 bp, Homo sapiens
tgcagacctggctgggcc

SEQ ID NO: 1327767 - DNA, 19 bp, Homo sapiens
tgcagacctggctgggcct

SEQ ID NO: 1327768 - DNA, 22 bp, Homo sapiens
tgcagacctggctgggcctggg

SEQ ID NO: 1327769 - DNA, 13 bp, Homo sapiens
tgcagccctggcc

SEQ ID NO: 1327770 - DNA, 14 bp, Homo sapiens
tgcaggccagtccc

SEQ ID NO: 1327771 - DNA, 20 bp, Homo sapiens
tgcaggccagtcccacggct

SEQ ID NO: 1327772 - DNA, 15 bp, Homo sapiens
tgcaggcccaggcag

SEQ ID NO: 1327773 - DNA, 13 bp, Homo sapiens
tgcagtgctgctt

SEQ ID NO: 1327774 - DNA, 12 bp, Homo sapiens
tgcatcagttct

SEQ ID NO: 1327775 - DNA, 13 bp, Homo sapiens
tgcattcaagaga

SEQ ID NO: 1327776 - DNA, 15 bp, Homo sapiens
tgcattttttaaaac

SEQ ID NO: 1327777 - DNA, 13 bp, Homo sapiens
tgccaacttgtga

SEQ ID NO: 1327778 - DNA, 23 bp, Homo sapiens
tgccactcagggtctgggatgaa

SEQ ID NO: 1327779 - DNA, 15 bp, Homo sapiens
tgccatcctccctgt

SEQ ID NO: 1327780 - DNA, 18 bp, Homo sapiens
tgccatgaaggcacctgc

SEQ ID NO: 1327781 - DNA, 20 bp, Homo sapiens
tgccatgaaggcacctgccc

SEQ ID NO: 1327782 - DNA, 18 bp, Homo sapiens
tgccatgagtccatgtcc

SEQ ID NO: 1327783 - DNA, 20 bp, Homo sapiens
tgccatggctgtgacacaga

SEQ ID NO: 1327784 - DNA, 17 bp, Homo sapiens
tgccattttctgtaaag

SEQ ID NO: 1327785 - DNA, 11 bp, Homo sapiens
ttggcttcctg

SEQ ID NO: 1327786 - DNA, 16 bp, Homo sapiens
ttggcttcctggcgcc

SEQ ID NO: 1327787 - DNA, 20 bp, Homo sapiens
ttgtaaaagcaacatcagct

SEQ ID NO: 1327788 - DNA, 22 bp, Homo sapiens
ttgtagatacaatcagctgctt

SEQ ID NO: 1327789 - DNA, 21 bp, Homo sapiens
ttgtagatgaacatctctgtt

SEQ ID NO: 1327790 - DNA, 19 bp, Homo sapiens
ttgtcaccaggcaaccagg

SEQ ID NO: 1327791 - DNA, 16 bp, Homo sapiens
ttgtcagaccataaga

SEQ ID NO: 1327792 - DNA, 15 bp, Homo sapiens
ttgtgaacagaagtc

SEQ ID NO: 1327793 - DNA, 18 bp, Homo sapiens
ttgtgaattgcctgccat

SEQ ID NO: 1327794 - DNA, 16 bp, Homo sapiens
ttgtgactagtgctga

SEQ ID NO: 1327795 - DNA, 14 bp, Homo sapiens
ttgtggtccaaata

SEQ ID NO: 1327796 - DNA, 15 bp, Homo sapiens
ttgtggtccaaatag

SEQ ID NO: 1327797 - DNA, 24 bp, Homo sapiens
ttgttaccttaaaactaggcattt

SEQ ID NO: 1327798 - DNA, 17 bp, Homo sapiens
ttgtttcttaatttgga

SEQ ID NO: 1327799 - DNA, 21 bp, Homo sapiens
ttgttttgatgataaaaggag

SEQ ID NO: 1327800 - DNA, 17 bp, Homo sapiens
tttaaaaattgtctctt

SEQ ID NO: 1327801 - DNA, 15 bp, Homo sapiens
tttaaaacaagaaag

SEQ ID NO: 1327802 - DNA, 20 bp, Homo sapiens
tttaaaacaagaaagtttcc

SEQ ID NO: 1327803 - DNA, 21 bp, Homo sapiens
tttaaaacaagaaagtttccc

SEQ ID NO: 1327804 - DNA, 16 bp, Homo sapiens
tttaatacaggaacac

SEQ ID NO: 1327805 - DNA, 22 bp, Homo sapiens
tttactgagagaaggtgaaata

SEQ ID NO: 1327806 - DNA, 14 bp, Homo sapiens
tttacttggaaata

SEQ ID NO: 1327807 - DNA, 16 bp, Homo sapiens
tttatgcagtgctgct

SEQ ID NO: 1327808 - DNA, 19 bp, Homo sapiens
tttatgcagtgctgctttg

SEQ ID NO: 1327809 - DNA, 23 bp, Homo sapiens
tttcaatgtgatataaacagctt

SEQ ID NO: 1327810 - DNA, 24 bp, Homo sapiens
tttcatcagaacagctgttgactc

SEQ ID NO: 1327811 - DNA, 12 bp, Homo sapiens
tttcatgtgctc

SEQ ID NO: 1327812 - DNA, 20 bp, Homo sapiens
tttcctggttccactgctac

SEQ ID NO: 1327813 - DNA, 16 bp, Homo sapiens
tttctaatttgctgct

SEQ ID NO: 1327814 - DNA, 14 bp, Homo sapiens
tttctgctggctga

SEQ ID NO: 1327815 - DNA, 15 bp, Homo sapiens
tttctgctggctgat

SEQ ID NO: 1327816 - DNA, 22 bp, Homo sapiens
tttctggaattgatgtttacat

SEQ ID NO: 1327817 - DNA, 11 bp, Homo sapiens
tttctgtaaag

SEQ ID NO: 1327818 - DNA, 10 bp, Homo sapiens
tttctgtgtg

SEQ ID NO: 1327819 - DNA, 20 bp, Homo sapiens
tttctgtttctaatttgctg

SEQ ID NO: 1327820 - DNA, 14 bp, Homo sapiens
tttcttaatttgga

SEQ ID NO: 1327821 - DNA, 15 bp, Homo sapiens
tttcttaatttggaa

SEQ ID NO: 1327822 - DNA, 21 bp, Homo sapiens
tttcttggacacttaattctg

SEQ ID NO: 1327823 - DNA, 20 bp, Homo sapiens
tttgaaaaccaacaccatca

SEQ ID NO: 1327824 - DNA, 22 bp, Homo sapiens
tttgaaaaccaacaccatcaca

SEQ ID NO: 1327825 - DNA, 22 bp, Homo sapiens
tttgaaatatggaactgtaata

SEQ ID NO: 1327826 - DNA, 18 bp, Homo sapiens
tttgacagcgcacagctg

SEQ ID NO: 1327827 - DNA, 15 bp, Homo sapiens
tttgaggagtggttt

SEQ ID NO: 1327828 - DNA, 13 bp, Homo sapiens
tttggaaactaat

SEQ ID NO: 1327829 - DNA, 15 bp, Homo sapiens
tttggactttgttac

SEQ ID NO: 1327830 - DNA, 21 bp, Homo sapiens
tttggatatctgttagatgct

SEQ ID NO: 1327831 - DNA, 18 bp, Homo sapiens
tttgttaccttaaaacta

SEQ ID NO: 1327832 - DNA, 22 bp, Homo sapiens
tttgttgtttcttaatttggaa

SEQ ID NO: 1327833 - DNA, 18 bp, Homo sapiens
ttttaacttatgtatgtg

SEQ ID NO: 1327834 - DNA, 13 bp, Homo sapiens
ttttacttggaaa

SEQ ID NO: 1327835 - DNA, 16 bp, Homo sapiens
ttttctgtgtgttcct

SEQ ID NO: 1327836 - DNA, 11 bp, Homo sapiens
ttttcttttct

SEQ ID NO: 1327837 - DNA, 13 bp, Homo sapiens
ttttgactggctt

SEQ ID NO: 1327838 - DNA, 23 bp, Homo sapiens
ttttgctgtgtgaaatctttcaa

SEQ ID NO: 1327839 - DNA, 15 bp, Homo sapiens
ttttggactttgtta

SEQ ID NO: 1327840 - DNA, 15 bp, Homo sapiens
ttacaaacatgtggt

SEQ ID NO: 1327841 - DNA, 18 bp, Homo sapiens
ttagctcccctccaacct

SEQ ID NO: 1327842 - DNA, 16 bp, Homo sapiens
ttatagccgaaatgat

SEQ ID NO: 1327843 - DNA, 21 bp, Homo sapiens
ttatgatgtgggtcaaggaat

SEQ ID NO: 1327844 - DNA, 17 bp, Homo sapiens
ttcaagttaaattttat

SEQ ID NO: 1327845 - DNA, 20 bp, Homo sapiens
ttcaatggtttgcaaggaag

SEQ ID NO: 1327846 - DNA, 22 bp, Homo sapiens
ttcaatggtttgcaaggaagcc

SEQ ID NO: 1327847 - DNA, 20 bp, Homo sapiens
ttcacccctccctttctccc

SEQ ID NO: 1327848 - DNA, 16 bp, Homo sapiens
ttcagtgaaagcatca

SEQ ID NO: 1327849 - DNA, 21 bp, Homo sapiens
ttcatctgctctccttcctgg

SEQ ID NO: 1327850 - DNA, 14 bp, Homo sapiens
ttcatttttttcca

SEQ ID NO: 1327851 - DNA, 17 bp, Homo sapiens
ttcatttttttccaggc

SEQ ID NO: 1327852 - DNA, 15 bp, Homo sapiens
ttcccctcctccact

SEQ ID NO: 1327853 - DNA, 16 bp, Homo sapiens
ttctcatttcacccct

SEQ ID NO: 1327854 - DNA, 18 bp, Homo sapiens
ttctcccctgcccccagg

SEQ ID NO: 1327855 - DNA, 21 bp, Homo sapiens
ttctcccctgcccccaggact

SEQ ID NO: 1327856 - DNA, 23 bp, Homo sapiens
ttctcccctgcccccaggactgg

SEQ ID NO: 1327857 - DNA, 19 bp, Homo sapiens
ttctgaaaattaacactgc

SEQ ID NO: 1327858 - DNA, 18 bp, Homo sapiens
ttcttgcctctgtcccct

SEQ ID NO: 1327859 - DNA, 15 bp, Homo sapiens
ttgaatataaacact

SEQ ID NO: 1327860 - DNA, 16 bp, Homo sapiens
ttgaatataaacacta

SEQ ID NO: 1327861 - DNA, 16 bp, Homo sapiens
ttgacagaacactgtc

SEQ ID NO: 1327862 - DNA, 12 bp, Homo sapiens
ttgattctcctt

SEQ ID NO: 1327863 - DNA, 20 bp, Homo sapiens
ttgcctctgtccccttctct

SEQ ID NO: 1327864 - DNA, 16 bp, Homo sapiens
ttggctcacactgaga

SEQ ID NO: 1327865 - DNA, 17 bp, Homo sapiens
ttggctcacactgagaa

SEQ ID NO: 1327866 - DNA, 17 bp, Homo sapiens
ttgtagcatcctcttta

SEQ ID NO: 1327867 - DNA, 14 bp, Homo sapiens
ttgttcccctcctc

SEQ ID NO: 1327868 - DNA, 15 bp, Homo sapiens
ttgttcccctcctcc

SEQ ID NO: 1327869 - DNA, 24 bp, Homo sapiens
tttaactcaatattttccatgaaa

SEQ ID NO: 1327870 - DNA, 15 bp, Homo sapiens
tttcacccctccctt

SEQ ID NO: 1327871 - DNA, 17 bp, Homo sapiens
tttcagtgaaagcatca

SEQ ID NO: 1327872 - DNA, 11 bp, Homo sapiens
tttcatctgct

SEQ ID NO: 1327873 - DNA, 22 bp, Homo sapiens
tttcatctgctctccttcctgg

SEQ ID NO: 1327874 - DNA, 15 bp, Homo sapiens
tttcatttttttcca

SEQ ID NO: 1327875 - DNA, 20 bp, Homo sapiens
tttcatttttttccaggctg

SEQ ID NO: 1327876 - DNA, 13 bp, Homo sapiens
tttccaagagctg

SEQ ID NO: 1327877 - DNA, 17 bp, Homo sapiens
tttccatgaaaatgcaa

SEQ ID NO: 1327878 - DNA, 14 bp, Homo sapiens
tttctcccctgccc

SEQ ID NO: 1327879 - DNA, 20 bp, Homo sapiens
tttctcccctgcccccagga

SEQ ID NO: 1327880 - DNA, 23 bp, Homo sapiens
tttctcccctgcccccaggactg

SEQ ID NO: 1327881 - DNA, 18 bp, Homo sapiens
tttcttgcctctgtcccc

SEQ ID NO: 1327882 - DNA, 18 bp, Homo sapiens
tttgatagtattgtgcat

SEQ ID NO: 1327883 - DNA, 12 bp, Homo sapiens
tttgattctcct

SEQ ID NO: 1327884 - DNA, 13 bp, Homo sapiens
tttgattctcctt

SEQ ID NO: 1327885 - DNA, 22 bp, Homo sapiens
tttgctaactagcttggaaact

SEQ ID NO: 1327886 - DNA, 13 bp, Homo sapiens
ttttaattaaata

SEQ ID NO: 1327887 - DNA, 13 bp, Homo sapiens
ttttccaggctgg

SEQ ID NO: 1327888 - DNA, 18 bp, Homo sapiens
ttttcttgcctctgtccc

SEQ ID NO: 1327889 - DNA, 14 bp, Homo sapiens
ttttggttttgttc

SEQ ID NO: 1327890 - DNA, 20 bp, Homo sapiens
ttttggttttgttcccctcc

SEQ ID NO: 1327891 - DNA, 19 bp, Homo sapiens
ctcgagaactttcattttt

SEQ ID NO: 1327892 - DNA, 17 bp, Homo sapiens
ctctcatctcttagctc

SEQ ID NO: 1327893 - DNA, 16 bp, Homo sapiens
ctctcccccaccccct

SEQ ID NO: 1327894 - DNA, 19 bp, Homo sapiens
ctctgaatttgagatacaa

SEQ ID NO: 1327895 - DNA, 17 bp, Homo sapiens
ctctgtgagactcgaga

SEQ ID NO: 1327896 - DNA, 18 bp, Homo sapiens
ctcttagctcccctccaa

SEQ ID NO: 1327897 - DNA, 11 bp, Homo sapiens
ctcttctcatt

SEQ ID NO: 1327898 - DNA, 15 bp, Homo sapiens
ctcttctcatttcac

SEQ ID NO: 1327899 - DNA, 16 bp, Homo sapiens
ctgaaaattaacactg

SEQ ID NO: 1327900 - DNA, 19 bp, Homo sapiens
ctgagaatgtaagaactac

SEQ ID NO: 1327901 - DNA, 21 bp, Homo sapiens
ctgagatttcatctgctctcc

SEQ ID NO: 1327902 - DNA, 14 bp, Homo sapiens
ctgagcgctcctgc

SEQ ID NO: 1327903 - DNA, 18 bp, Homo sapiens
ctgaggaagaacggggct

SEQ ID NO: 1327904 - DNA, 21 bp, Homo sapiens
ctgagttggtgttgacatgtg

SEQ ID NO: 1327905 - DNA, 16 bp, Homo sapiens
ctgcccccaggactgg

SEQ ID NO: 1327906 - DNA, 18 bp, Homo sapiens
ctgcccccaggactgggc

SEQ ID NO: 1327907 - DNA, 19 bp, Homo sapiens
ctgcccccaggactgggcc

SEQ ID NO: 1327908 - DNA, 18 bp, Homo sapiens
ctgcctccagggctggac

SEQ ID NO: 1327909 - DNA, 13 bp, Homo sapiens
ctgctctccttcc

SEQ ID NO: 1327910 - DNA, 16 bp, Homo sapiens
ctgctctccttcctgg

SEQ ID NO: 1327911 - DNA, 17 bp, Homo sapiens
ctgctctccttcctgga

SEQ ID NO: 1327912 - DNA, 19 bp, Homo sapiens
ctgctctccttcctggagc

SEQ ID NO: 1327913 - DNA, 20 bp, Homo sapiens
ctgctctccttcctggagcc

SEQ ID NO: 1327914 - DNA, 18 bp, Homo sapiens
ctggccgcgccaaataat

SEQ ID NO: 1327915 - DNA, 21 bp, Homo sapiens
ctggttcggatttggggtgga

SEQ ID NO: 1327916 - DNA, 15 bp, Homo sapiens
ctggttctcatcttt

SEQ ID NO: 1327917 - DNA, 20 bp, Homo sapiens
ctggttctcatctttcttga

SEQ ID NO: 1327918 - DNA, 19 bp, Homo sapiens
ctgtccccttctctcatct

SEQ ID NO: 1327919 - DNA, 22 bp, Homo sapiens
ctgtccccttctctcatctctt

SEQ ID NO: 1327920 - DNA, 20 bp, Homo sapiens
ctgtgagactcgagaacttt

SEQ ID NO: 1327921 - DNA, 14 bp, Homo sapiens
cttactccaggaga

SEQ ID NO: 1327922 - DNA, 17 bp, Homo sapiens
cttcagccctcacccct

SEQ ID NO: 1327923 - DNA, 19 bp, Homo sapiens
cttcagccctcacccctgg

SEQ ID NO: 1327924 - DNA, 17 bp, Homo sapiens
cttcctggagcccagag

SEQ ID NO: 1327925 - DNA, 14 bp, Homo sapiens
cttctcatttcacc

SEQ ID NO: 1327926 - DNA, 15 bp, Homo sapiens
cttctcatttcaccc

SEQ ID NO: 1327927 - DNA, 18 bp, Homo sapiens
cttctcatttcacccctc

SEQ ID NO: 1327928 - DNA, 16 bp, Homo sapiens
cttctctcatctctta

SEQ ID NO: 1327929 - DNA, 14 bp, Homo sapiens
cttgacagaacact

SEQ ID NO: 1327930 - DNA, 23 bp, Homo sapiens
cttgatcaacatcttttcttgcc

SEQ ID NO: 1327931 - DNA, 14 bp, Homo sapiens
cttgcattgcagag

SEQ ID NO: 1327932 - DNA, 19 bp, Homo sapiens
cttgcctctgtccccttct

SEQ ID NO: 1327933 - DNA, 17 bp, Homo sapiens
cttgggtcccagggaag

SEQ ID NO: 1327934 - DNA, 20 bp, Homo sapiens
cttgtctcccagctcagggc

SEQ ID NO: 1327935 - DNA, 20 bp, Homo sapiens
ctttcaatggtttgcaagga

SEQ ID NO: 1327936 - DNA, 15 bp, Homo sapiens
ctttcatttttttcc

SEQ ID NO: 1327937 - DNA, 16 bp, Homo sapiens
ctttcatttttttcca

SEQ ID NO: 1327938 - DNA, 20 bp, Homo sapiens
ctttcatttttttccaggct

SEQ ID NO: 1327939 - DNA, 18 bp, Homo sapiens
ctttctcccctgccccca

SEQ ID NO: 1327940 - DNA, 23 bp, Homo sapiens
ctttctcccctgcccccaggact

SEQ ID NO: 1327941 - DNA, 24 bp, Homo sapiens
ctttctcccctgcccccaggactg

SEQ ID NO: 1327942 - DNA, 14 bp, Homo sapiens
ctttggcagagttc

SEQ ID NO: 1327943 - DNA, 21 bp, Homo sapiens
gaaaccattatgaagaagaga

SEQ ID NO: 1327944 - DNA, 22 bp, Homo sapiens
gaacggggctcttctcatttca

SEQ ID NO: 1327945 - DNA, 22 bp, Homo sapiens
gaactacaaacaaaatttctat

SEQ ID NO: 1327946 - DNA, 12 bp, Homo sapiens
gaactttcattt

SEQ ID NO: 1327947 - DNA, 13 bp, Homo sapiens
gaactttcatttt

SEQ ID NO: 1327948 - DNA, 23 bp, Homo sapiens
gaactttcatttttttccaggct

SEQ ID NO: 1327949 - DNA, 16 bp, Homo sapiens
gaagccacaggcctga

SEQ ID NO: 1327950 - DNA, 17 bp, Homo sapiens
gaaggcagcaggtggca

SEQ ID NO: 1327951 - DNA, 19 bp, Homo sapiens
gaagggggtggtgtctcca

SEQ ID NO: 1327952 - DNA, 14 bp, Homo sapiens
gaatataaacacta

SEQ ID NO: 1327953 - DNA, 18 bp, Homo sapiens
gaatgtaagaactacaaa

SEQ ID NO: 1327954 - DNA, 18 bp, Homo sapiens
gaattaagttagggaatg

SEQ ID NO: 1327955 - DNA, 13 bp, Homo sapiens
gacagaagaaggc

SEQ ID NO: 1327956 - DNA, 16 bp, Homo sapiens
gactcgagaactttca

SEQ ID NO: 1327957 - DNA, 14 bp, Homo sapiens
gactgaggcctgag

SEQ ID NO: 1327958 - DNA, 15 bp, Homo sapiens
gagaactttcatttt

SEQ ID NO: 1327959 - DNA, 17 bp, Homo sapiens
gagaagccacaggcctg

SEQ ID NO: 1327960 - DNA, 20 bp, Homo sapiens
gagaagccacaggcctgaga

SEQ ID NO: 1327961 - DNA, 20 bp, Homo sapiens
gagatttcatctgctctcct

SEQ ID NO: 1327962 - DNA, 22 bp, Homo sapiens
gagcgctcctgccgcagagctg

SEQ ID NO: 1327963 - DNA, 23 bp, Homo sapiens
gagcgctcctgccgcagagctgg

SEQ ID NO: 1327964 - DNA, 14 bp, Homo sapiens
gagctcaggacact

SEQ ID NO: 1327965 - DNA, 20 bp, Homo sapiens
gaggcctgagcgctcctgcc

SEQ ID NO: 1327966 - DNA, 19 bp, Homo sapiens
gagggcagcagaagggggt

SEQ ID NO: 1327967 - DNA, 22 bp, Homo sapiens
gagggcagcagaagggggtggt

SEQ ID NO: 1327968 - DNA, 20 bp, Homo sapiens
gagtagaaagacagagctgg

SEQ ID NO: 1327969 - DNA, 22 bp, Homo sapiens
gagtagaaagacagagctggga

SEQ ID NO: 1327970 - DNA, 16 bp, Homo sapiens
gatagtattgtgcata

SEQ ID NO: 1327971 - DNA, 14 bp, Homo sapiens
gatcaacatctttt

SEQ ID NO: 1327972 - DNA, 17 bp, Homo sapiens
gatcaacatcttttctt

SEQ ID NO: 1327973 - DNA, 21 bp, Homo sapiens
gattattttctacacatacat

SEQ ID NO: 1327974 - DNA, 11 bp, Homo sapiens
gattctccttc

SEQ ID NO: 1327975 - DNA, 12 bp, Homo sapiens
gattctccttca

SEQ ID NO: 1327976 - DNA, 13 bp, Homo sapiens
gattctccttcag

SEQ ID NO: 1327977 - DNA, 17 bp, Homo sapiens
gattctccttcagccct

SEQ ID NO: 1327978 - DNA, 18 bp, Homo sapiens
gattctccttcagccctc

SEQ ID NO: 1327979 - DNA, 18 bp, Homo sapiens
gattggctcacactgaga

SEQ ID NO: 1327980 - DNA, 17 bp, Homo sapiens
gatttcatctgctctcc

SEQ ID NO: 1327981 - DNA, 21 bp, Homo sapiens
gatttcatctgctctccttcc

SEQ ID NO: 1327982 - DNA, 13 bp, Homo sapiens
gatttggggtgga

SEQ ID NO: 1327983 - DNA, 22 bp, Homo sapiens
gattttggttttgttcccctcc

SEQ ID NO: 1327984 - DNA, 13 bp, Homo sapiens
gcaagtcagggtt

SEQ ID NO: 1327985 - DNA, 11 bp, Homo sapiens
gcactgaggaa

SEQ ID NO: 1327986 - DNA, 18 bp, Homo sapiens
gcactgaggaagaacggg

SEQ ID NO: 1327987 - DNA, 12 bp, Homo sapiens
gccacaggcctg

SEQ ID NO: 1327988 - DNA, 23 bp, Homo sapiens
gccacaggcctgagatttcatct

SEQ ID NO: 1327989 - DNA, 23 bp, Homo sapiens
gccacttctgggtggggcagtgg

SEQ ID NO: 1327990 - DNA, 19 bp, Homo sapiens
gccagtgatgctaaaggtt

SEQ ID NO: 1327991 - DNA, 20 bp, Homo sapiens
gccagtgatgctaaaggttg

SEQ ID NO: 1327992 - DNA, 18 bp, Homo sapiens
gccatggacagaagaagg

SEQ ID NO: 1327993 - DNA, 18 bp, Homo sapiens
gccctcacccctggttct

SEQ ID NO: 1327994 - DNA, 22 bp, Homo sapiens
gccctcacccctggttctcatc

SEQ ID NO: 1327995 - DNA, 12 bp, Homo sapiens
gcctccagggct

SEQ ID NO: 1327996 - DNA, 14 bp, Homo sapiens
gcctccagggctgg

SEQ ID NO: 1327997 - DNA, 19 bp, Homo sapiens
gcctccagggctggactga

SEQ ID NO: 1327998 - DNA, 21 bp, Homo sapiens
gcctctgtccccttctctcat

SEQ ID NO: 1327999 - DNA, 22 bp, Homo sapiens
gcctgagcgctcctgccgcaga

SEQ ID NO: 1328000 - DNA, 23 bp, Homo sapiens
gcctgagcgctcctgccgcagag

SEQ ID NO: 1328001 - DNA, 11 bp, Homo sapiens
gcctgcctcca

SEQ ID NO: 1328002 - DNA, 16 bp, Homo sapiens
gccttttatttcttaa

SEQ ID NO: 1328003 - DNA, 18 bp, Homo sapiens
gcgccaaataatgtctct

SEQ ID NO: 1328004 - DNA, 15 bp, Homo sapiens
gctaaagcccagaga

SEQ ID NO: 1328005 - DNA, 16 bp, Homo sapiens
gctaaagcccagagac

SEQ ID NO: 1328006 - DNA, 21 bp, Homo sapiens
gctaactagcttggaaactgg

SEQ ID NO: 1328007 - DNA, 16 bp, Homo sapiens
gctacccgcagagttc

SEQ ID NO: 1328008 - DNA, 22 bp, Homo sapiens
gctatttttatttgtttgtgca

SEQ ID NO: 1328009 - DNA, 12 bp, Homo sapiens
gctctccttcct

SEQ ID NO: 1328010 - DNA, 14 bp, Homo sapiens
gctcttctcatttc

SEQ ID NO: 1328011 - DNA, 22 bp, Homo sapiens
gctcttctcatttcacccctcc

SEQ ID NO: 1328012 - DNA, 15 bp, Homo sapiens
gctgaggcaattcta

SEQ ID NO: 1328013 - DNA, 13 bp, Homo sapiens
gctgagttggtgt

SEQ ID NO: 1328014 - DNA, 17 bp, Homo sapiens
gctggactgaggcctga

SEQ ID NO: 1328015 - DNA, 18 bp, Homo sapiens
gctggactgaggcctgag

SEQ ID NO: 1328016 - DNA, 19 bp, Homo sapiens
gctggactgaggcctgagc

SEQ ID NO: 1328017 - DNA, 21 bp, Homo sapiens
gctggttcggatttggggtgg

SEQ ID NO: 1328018 - DNA, 21 bp, Homo sapiens
ggaaaggggcaggccagagct

SEQ ID NO: 1328019 - DNA, 21 bp, Homo sapiens
ggaagttttgtggaggagctc

SEQ ID NO: 1328020 - DNA, 20 bp, Homo sapiens
ggaattcatctctctttaat

SEQ ID NO: 1328021 - DNA, 13 bp, Homo sapiens
ggatgcagcatta

SEQ ID NO: 1328022 - DNA, 18 bp, Homo sapiens
ggcagcagaagggggtgg

SEQ ID NO: 1328023 - DNA, 21 bp, Homo sapiens
ggccacttctgggtggggcag

SEQ ID NO: 1328024 - DNA, 22 bp, Homo sapiens
ggcctgagatttcatctgctct

SEQ ID NO: 1328025 - DNA, 18 bp, Homo sapiens
ggcctgagcgctcctgcc

SEQ ID NO: 1328026 - DNA, 13 bp, Homo sapiens
ggctcttctcatt

SEQ ID NO: 1328027 - DNA, 13 bp, Homo sapiens
ggctggactgagg

SEQ ID NO: 1328028 - DNA, 16 bp, Homo sapiens
ggctggactgaggcct

SEQ ID NO: 1328029 - DNA, 15 bp, Homo sapiens
gggctcttctcattt

SEQ ID NO: 1328030 - DNA, 14 bp, Homo sapiens
gggctggactgagg

SEQ ID NO: 1328031 - DNA, 15 bp, Homo sapiens
gggctggactgaggc

SEQ ID NO: 1328032 - DNA, 20 bp, Homo sapiens
ggttcggatttggggtggat

SEQ ID NO: 1328033 - DNA, 14 bp, Homo sapiens
ggttttgttcccct

SEQ ID NO: 1328034 - DNA, 12 bp, Homo sapiens
gtataatatttt

SEQ ID NO: 1328035 - DNA, 15 bp, Homo sapiens
gtataatatttttaa

SEQ ID NO: 1328036 - DNA, 22 bp, Homo sapiens
gtattttatctttgattctcct

SEQ ID NO: 1328037 - DNA, 18 bp, Homo sapiens
gtccccttctctcatctc

SEQ ID NO: 1328038 - DNA, 16 bp, Homo sapiens
gtctccaaccccccag

SEQ ID NO: 1328039 - DNA, 17 bp, Homo sapiens
gtctccaaccccccagc

SEQ ID NO: 1328040 - DNA, 15 bp, Homo sapiens
gtctctgtgagactc

SEQ ID NO: 1328041 - DNA, 20 bp, Homo sapiens
gtgagactcgagaactttca

SEQ ID NO: 1328042 - DNA, 23 bp, Homo sapiens
gtgctgagttggtgttgacatgt

SEQ ID NO: 1328043 - DNA, 17 bp, Homo sapiens
gtggagaagccacaggc

SEQ ID NO: 1328044 - DNA, 20 bp, Homo sapiens
gtggaggagctcaggacact

SEQ ID NO: 1328045 - DNA, 22 bp, Homo sapiens
gtggtgtggagaagccacaggc

SEQ ID NO: 1328046 - DNA, 13 bp, Homo sapiens
gtgtctccaaccc

SEQ ID NO: 1328047 - DNA, 18 bp, Homo sapiens
gtgtctccaaccccccag

SEQ ID NO: 1328048 - DNA, 21 bp, Homo sapiens
gtgtctccaaccccccagcac

SEQ ID NO: 1328049 - DNA, 11 bp, Homo sapiens
gttctcatctt

SEQ ID NO: 1328050 - DNA, 13 bp, Homo sapiens
gtttgcaaggaag

SEQ ID NO: 1328051 - DNA, 15 bp, Homo sapiens
gttttgttcccctcc

SEQ ID NO: 1328052 - DNA, 17 bp, Homo sapiens
gttttgttcccctcctc

SEQ ID NO: 1328053 - DNA, 20 bp, Homo sapiens
gttttgttcccctcctccac

SEQ ID NO: 1328054 - DNA, 18 bp, Homo sapiens
taaacaatatcagacttt

SEQ ID NO: 1328055 - DNA, 18 bp, Homo sapiens
taaagaaaatctctgtga

SEQ ID NO: 1328056 - DNA, 14 bp, Homo sapiens
taatataaagttgg

SEQ ID NO: 1328057 - DNA, 14 bp, Homo sapiens
taatatttttaatt

SEQ ID NO: 1328058 - DNA, 15 bp, Homo sapiens
taatatttttaatta

SEQ ID NO: 1328059 - DNA, 21 bp, Homo sapiens
taattaaataaaaatctgtgg

SEQ ID NO: 1328060 - DNA, 18 bp, Homo sapiens
tacacaccttatatttac

SEQ ID NO: 1328061 - DNA, 14 bp, Homo sapiens
tagctcccctccaa

SEQ ID NO: 1328062 - DNA, 15 bp, Homo sapiens
tagcttggaaactgg

SEQ ID NO: 1328063 - DNA, 20 bp, Homo sapiens
tagcttggaaactggatgag

SEQ ID NO: 1328064 - DNA, 14 bp, Homo sapiens
tataaacactatat

SEQ ID NO: 1328065 - DNA, 17 bp, Homo sapiens
tatctttgattctcctt

SEQ ID NO: 1328066 - DNA, 18 bp, Homo sapiens
tatctttgattctccttc

SEQ ID NO: 1328067 - DNA, 22 bp, Homo sapiens
tatttgttaatggtttgaatat

SEQ ID NO: 1328068 - DNA, 17 bp, Homo sapiens
tcaatggtttgcaagga

SEQ ID NO: 1328069 - DNA, 19 bp, Homo sapiens
tcacactgagaatgtaaga

SEQ ID NO: 1328070 - DNA, 20 bp, Homo sapiens
tcacactgagaatgtaagaa

SEQ ID NO: 1328071 - DNA, 14 bp, Homo sapiens
tcacccctcccttt

SEQ ID NO: 1328072 - DNA, 20 bp, Homo sapiens
tcacccctccctttctcccc

SEQ ID NO: 1328073 - DNA, 19 bp, Homo sapiens
tcacccctggttctcatct

SEQ ID NO: 1328074 - DNA, 21 bp, Homo sapiens
tcacccctggttctcatcttt

SEQ ID NO: 1328075 - DNA, 18 bp, Homo sapiens
tcagctccactttcagtg

SEQ ID NO: 1328076 - DNA, 20 bp, Homo sapiens
tcatctcttagctcccctcc

SEQ ID NO: 1328077 - DNA, 21 bp, Homo sapiens
tcatctcttagctcccctcca

SEQ ID NO: 1328078 - DNA, 15 bp, Homo sapiens
tcatctgctctcctt

SEQ ID NO: 1328079 - DNA, 21 bp, Homo sapiens
tcatctgctctccttcctgga

SEQ ID NO: 1328080 - DNA, 13 bp, Homo sapiens
tcatctttcttga

SEQ ID NO: 1328081 - DNA, 14 bp, Homo sapiens
tcatttcacccctc

SEQ ID NO: 1328082 - DNA, 15 bp, Homo sapiens
tcatttcacccctcc

SEQ ID NO: 1328083 - DNA, 23 bp, Homo sapiens
tcatttcacccctccctttctcc

SEQ ID NO: 1328084 - DNA, 14 bp, Homo sapiens
tccaaccccccagc

SEQ ID NO: 1328085 - DNA, 17 bp, Homo sapiens
tccaaccccccagcact

SEQ ID NO: 1328086 - DNA, 21 bp, Homo sapiens
tccaaccccccagcactgagg

SEQ ID NO: 1328087 - DNA, 22 bp, Homo sapiens
tccaaccccccagcactgagga

SEQ ID NO: 1328088 - DNA, 13 bp, Homo sapiens
tccactctccccc

SEQ ID NO: 1328089 - DNA, 22 bp, Homo sapiens
tccactctcccccaccccctcc

SEQ ID NO: 1328090 - DNA, 11 bp, Homo sapiens
tccaggctggt

SEQ ID NO: 1328091 - DNA, 14 bp, Homo sapiens
tccagggctggact

SEQ ID NO: 1328092 - DNA, 17 bp, Homo sapiens
tccagggctggactgag

SEQ ID NO: 1328093 - DNA, 15 bp, Homo sapiens
tccatgaaaatgcaa

SEQ ID NO: 1328094 - DNA, 16 bp, Homo sapiens
tccatgaaaatgcaac

SEQ ID NO: 1328095 - DNA, 20 bp, Homo sapiens
tcccagattggctcacactg

SEQ ID NO: 1328096 - DNA, 15 bp, Homo sapiens
tccccgccctttttt

SEQ ID NO: 1328097 - DNA, 13 bp, Homo sapiens
tcccctgccccca

SEQ ID NO: 1328098 - DNA, 14 bp, Homo sapiens
tcccctgcccccag

SEQ ID NO: 1328099 - DNA, 15 bp, Homo sapiens
tcccctgcccccagg

SEQ ID NO: 1328100 - DNA, 19 bp, Homo sapiens
tcctccactctcccccacc

SEQ ID NO: 1328101 - DNA, 15 bp, Homo sapiens
tcctgccgcagagct

SEQ ID NO: 1328102 - DNA, 17 bp, Homo sapiens
tcctgccgcagagctgg

SEQ ID NO: 1328103 - DNA, 18 bp, Homo sapiens
tcctggagcccagaggag

SEQ ID NO: 1328104 - DNA, 22 bp, Homo sapiens
tcctggagcccagaggagggca

SEQ ID NO: 1328105 - DNA, 13 bp, Homo sapiens
tccttcagccctc

SEQ ID NO: 1328106 - DNA, 17 bp, Homo sapiens
tctcatctcttagctcc

SEQ ID NO: 1328107 - DNA, 12 bp, Homo sapiens
tctcatctttct

SEQ ID NO: 1328108 - DNA, 16 bp, Homo sapiens
tctcatttcacccctc

SEQ ID NO: 1328109 - DNA, 17 bp, Homo sapiens
tctcatttcacccctcc

SEQ ID NO: 1328110 - DNA, 18 bp, Homo sapiens
tctccaaccccccagcac

SEQ ID NO: 1328111 - DNA, 21 bp, Homo sapiens
tctccaaccccccagcactga

SEQ ID NO: 1328112 - DNA, 23 bp, Homo sapiens
tctccaaccccccagcactgagg

SEQ ID NO: 1328113 - DNA, 12 bp, Homo sapiens
tctcccctgccc

SEQ ID NO: 1328114 - DNA, 14 bp, Homo sapiens
tctcccctgccccc

SEQ ID NO: 1328115 - DNA, 16 bp, Homo sapiens
tctcccctgcccccag

SEQ ID NO: 1328116 - DNA, 21 bp, Homo sapiens
tctcccctgcccccaggactg

SEQ ID NO: 1328117 - DNA, 23 bp, Homo sapiens
tctcccctgcccccaggactggg

SEQ ID NO: 1328118 - DNA, 20 bp, Homo sapiens
tctccttcagccctcacccc

SEQ ID NO: 1328119 - DNA, 14 bp, Homo sapiens
tctctcatctctta

SEQ ID NO: 1328120 - DNA, 19 bp, Homo sapiens
tctctcatctcttagctcc

SEQ ID NO: 1328121 - DNA, 16 bp, Homo sapiens
tctcttagctcccctc

SEQ ID NO: 1328122 - DNA, 17 bp, Homo sapiens
tctcttagctcccctcc

SEQ ID NO: 1328123 - DNA, 19 bp, Homo sapiens
tctcttagctcccctccaa

SEQ ID NO: 1328124 - DNA, 13 bp, Homo sapiens
tctgctctccttc

SEQ ID NO: 1328125 - DNA, 14 bp, Homo sapiens
tctgctctccttcc

SEQ ID NO: 1328126 - DNA, 21 bp, Homo sapiens
tctgtgagactcgagaacttt

SEQ ID NO: 1328127 - DNA, 14 bp, Homo sapiens
tcttagctcccctc

SEQ ID NO: 1328128 - DNA, 15 bp, Homo sapiens
tcttctcatttcacc

SEQ ID NO: 1328129 - DNA, 22 bp, Homo sapiens
tcttgcctctgtccccttctct

SEQ ID NO: 1328130 - DNA, 20 bp, Homo sapiens
tgaaaatgcaacaacatgta

SEQ ID NO: 1328131 - DNA, 15 bp, Homo sapiens
aaaatttctattaaa

SEQ ID NO: 1328132 - DNA, 15 bp, Homo sapiens
aaacaaaatttctat

SEQ ID NO: 1328133 - DNA, 22 bp, Homo sapiens
aaactgagatccttccttttga

SEQ ID NO: 1328134 - DNA, 16 bp, Homo sapiens
aaagcatcacttggga

SEQ ID NO: 1328135 - DNA, 14 bp, Homo sapiens
aaatctacagtaca

SEQ ID NO: 1328136 - DNA, 12 bp, Homo sapiens
aaattaacactg

SEQ ID NO: 1328137 - DNA, 20 bp, Homo sapiens
aacactatatggcagtgtct

SEQ ID NO: 1328138 - DNA, 14 bp, Homo sapiens
aacactgcttgtgt

SEQ ID NO: 1328139 - DNA, 18 bp, Homo sapiens
aacagccactacattact

SEQ ID NO: 1328140 - DNA, 15 bp, Homo sapiens
aacatcttttcttgc

SEQ ID NO: 1328141 - DNA, 20 bp, Homo sapiens
aactcaatattttccatgaa

SEQ ID NO: 1328142 - DNA, 22 bp, Homo sapiens
aactggtattttatctttgatt

SEQ ID NO: 1328143 - DNA, 17 bp, Homo sapiens
aagaacggggctcttct

SEQ ID NO: 1328144 - DNA, 22 bp, Homo sapiens
aagaacggggctcttctcattt

SEQ ID NO: 1328145 - DNA, 17 bp, Homo sapiens
aagaaggaaaaggcagg

SEQ ID NO: 1328146 - DNA, 19 bp, Homo sapiens
aagaaggcagcaggtggca

SEQ ID NO: 1328147 - DNA, 15 bp, Homo sapiens
aagacagagctggga

SEQ ID NO: 1328148 - DNA, 11 bp, Homo sapiens
aagagctgagg

SEQ ID NO: 1328149 - DNA, 17 bp, Homo sapiens
aagccacaggcctgaga

SEQ ID NO: 1328150 - DNA, 22 bp, Homo sapiens
aagccacaggcctgagatttca

SEQ ID NO: 1328151 - DNA, 20 bp, Homo sapiens
aaggcagggagcgagggaga

SEQ ID NO: 1328152 - DNA, 17 bp, Homo sapiens
aaggttgtattgcatat

SEQ ID NO: 1328153 - DNA, 13 bp, Homo sapiens
aataatgtctctg

SEQ ID NO: 1328154 - DNA, 21 bp, Homo sapiens
aatgccatggacagaagaagg

SEQ ID NO: 1328155 - DNA, 17 bp, Homo sapiens
aatggtttgcaaggaag

SEQ ID NO: 1328156 - DNA, 18 bp, Homo sapiens
aatggtttgcaaggaagc

SEQ ID NO: 1328157 - DNA, 17 bp, Homo sapiens
aattaaattttgtgtct

SEQ ID NO: 1328158 - DNA, 17 bp, Homo sapiens
aattcttacaaacatgt

SEQ ID NO: 1328159 - DNA, 13 bp, Homo sapiens
aatttctattaaa

SEQ ID NO: 1328160 - DNA, 14 bp, Homo sapiens
acaaaatttctatt

SEQ ID NO: 1328161 - DNA, 13 bp, Homo sapiens
acaaatgtatgat

SEQ ID NO: 1328162 - DNA, 14 bp, Homo sapiens
acaacatgtataat

SEQ ID NO: 1328163 - DNA, 19 bp, Homo sapiens
acactgcttgtgtttttaa

SEQ ID NO: 1328164 - DNA, 12 bp, Homo sapiens
acagaacactgt

SEQ ID NO: 1328165 - DNA, 14 bp, Homo sapiens
acagaacactgtct

SEQ ID NO: 1328166 - DNA, 10 bp, Homo sapiens
acagagctgg

SEQ ID NO: 1328167 - DNA, 14 bp, Homo sapiens
acagagctgggatg

SEQ ID NO: 1328168 - DNA, 21 bp, Homo sapiens
acagagctgggatgtttctgt

SEQ ID NO: 1328169 - DNA, 16 bp, Homo sapiens
acagcaagtcagggtt

SEQ ID NO: 1328170 - DNA, 18 bp, Homo sapiens
acagcccaaagaaggaaa

SEQ ID NO: 1328171 - DNA, 19 bp, Homo sapiens
acagcccaaagaaggaaaa

SEQ ID NO: 1328172 - DNA, 14 bp, Homo sapiens
acatgtataatatt

SEQ ID NO: 1328173 - DNA, 19 bp, Homo sapiens
acatgtataatatttttaa

SEQ ID NO: 1328174 - DNA, 16 bp, Homo sapiens
acccctccctttctcc

SEQ ID NO: 1328175 - DNA, 14 bp, Homo sapiens
acccctggttctca

SEQ ID NO: 1328176 - DNA, 15 bp, Homo sapiens
acccctggttctcat

SEQ ID NO: 1328177 - DNA, 18 bp, Homo sapiens
actacaaacaaaatttct

SEQ ID NO: 1328178 - DNA, 18 bp, Homo sapiens
ttatactttgtaaagaca

SEQ ID NO: 1328179 - DNA, 15 bp, Homo sapiens
ttatgccttttattt

SEQ ID NO: 1328180 - DNA, 19 bp, Homo sapiens
ttcaatttccaagagctga

SEQ ID NO: 1328181 - DNA, 12 bp, Homo sapiens
ttcacccctccc

SEQ ID NO: 1328182 - DNA, 16 bp, Homo sapiens
ttcacccctccctttc

SEQ ID NO: 1328183 - DNA, 18 bp, Homo sapiens
ttcacccctccctttctc

SEQ ID NO: 1328184 - DNA, 15 bp, Homo sapiens
ttcatctgctctcct

SEQ ID NO: 1328185 - DNA, 16 bp, Homo sapiens
ttcatctgctctcctt

SEQ ID NO: 1328186 - DNA, 18 bp, Homo sapiens
ttcatttttttccaggct

SEQ ID NO: 1328187 - DNA, 13 bp, Homo sapiens
ttccaagagctga

SEQ ID NO: 1328188 - DNA, 16 bp, Homo sapiens
ttcctggagcccagag

SEQ ID NO: 1328189 - DNA, 20 bp, Homo sapiens
ttcgatgggcccaattctta

SEQ ID NO: 1328190 - DNA, 17 bp, Homo sapiens
ttcggatttggggtgga

SEQ ID NO: 1328191 - DNA, 17 bp, Homo sapiens
ttctcccctgcccccag

SEQ ID NO: 1328192 - DNA, 15 bp, Homo sapiens
ttctccttcagccct

SEQ ID NO: 1328193 - DNA, 12 bp, Homo sapiens
ttctctcatctc

SEQ ID NO: 1328194 - DNA, 13 bp, Homo sapiens
ttctctcatctct

SEQ ID NO: 1328195 - DNA, 17 bp, Homo sapiens
ttctctcatctcttagc

SEQ ID NO: 1328196 - DNA, 19 bp, Homo sapiens
ttctgggtggggcagtggg

SEQ ID NO: 1328197 - DNA, 21 bp, Homo sapiens
ttcttgatcaacatcttttct

SEQ ID NO: 1328198 - DNA, 20 bp, Homo sapiens
ttcttgcctctgtccccttc

SEQ ID NO: 1328199 - DNA, 14 bp, Homo sapiens
ttgacagaacactg

SEQ ID NO: 1328200 - DNA, 19 bp, Homo sapiens
ttgacttgacagaacactg

SEQ ID NO: 1328201 - DNA, 18 bp, Homo sapiens
ttgatcaacatcttttct

SEQ ID NO: 1328202 - DNA, 21 bp, Homo sapiens
ttgcgtggaattgtgctgagt

SEQ ID NO: 1328203 - DNA, 17 bp, Homo sapiens
ttggttttgttcccctc

SEQ ID NO: 1328204 - DNA, 18 bp, Homo sapiens
ttgttcccctcctccact

SEQ ID NO: 1328205 - DNA, 20 bp, Homo sapiens
ttgttcccctcctccactct

SEQ ID NO: 1328206 - DNA, 23 bp, Homo sapiens
ttgttcccctcctccactctccc

SEQ ID NO: 1328207 - DNA, 21 bp, Homo sapiens
tttacaccagttcctttcaat

SEQ ID NO: 1328208 - DNA, 19 bp, Homo sapiens
tttatctttgattctcctt

SEQ ID NO: 1328209 - DNA, 13 bp, Homo sapiens
tttatttcttaaa

SEQ ID NO: 1328210 - DNA, 21 bp, Homo sapiens
tttcaatggtttgcaaggaag

SEQ ID NO: 1328211 - DNA, 14 bp, Homo sapiens
tttcaatttccaag

SEQ ID NO: 1328212 - DNA, 20 bp, Homo sapiens
tttcacccctccctttctcc

SEQ ID NO: 1328213 - DNA, 15 bp, Homo sapiens
tttcatctgctctcc

SEQ ID NO: 1328214 - DNA, 20 bp, Homo sapiens
tttcatctgctctccttcct

SEQ ID NO: 1328215 - DNA, 16 bp, Homo sapiens
tttccaagagctgagg

SEQ ID NO: 1328216 - DNA, 13 bp, Homo sapiens
tttctcccctgcc

SEQ ID NO: 1328217 - DNA, 17 bp, Homo sapiens
tttctcccctgccccca

SEQ ID NO: 1328218 - DNA, 22 bp, Homo sapiens
tttctcccctgcccccaggact

SEQ ID NO: 1328219 - DNA, 24 bp, Homo sapiens
tttctcccctgcccccaggactgg

SEQ ID NO: 1328220 - DNA, 16 bp, Homo sapiens
tttcttaaacaaatgt

SEQ ID NO: 1328221 - DNA, 12 bp, Homo sapiens
tttcttgcctct

SEQ ID NO: 1328222 - DNA, 18 bp, Homo sapiens
tttgaatataaacactat

SEQ ID NO: 1328223 - DNA, 19 bp, Homo sapiens
tttgaatataaacactata

SEQ ID NO: 1328224 - DNA, 21 bp, Homo sapiens
tttgattctccttcagccctc

SEQ ID NO: 1328225 - DNA, 12 bp, Homo sapiens
tttgcaaggaag

SEQ ID NO: 1328226 - DNA, 21 bp, Homo sapiens
tttgcaaggaagccacagctg

SEQ ID NO: 1328227 - DNA, 13 bp, Homo sapiens
tttggcagagttc

SEQ ID NO: 1328228 - DNA, 14 bp, Homo sapiens
tttggttttgttcc

SEQ ID NO: 1328229 - DNA, 15 bp, Homo sapiens
tttggttttgttccc

SEQ ID NO: 1328230 - DNA, 16 bp, Homo sapiens
tttggttttgttcccc

SEQ ID NO: 1328231 - DNA, 19 bp, Homo sapiens
tttggttttgttcccctcc

SEQ ID NO: 1328232 - DNA, 21 bp, Homo sapiens
tttggttttgttcccctcctc

SEQ ID NO: 1328233 - DNA, 12 bp, Homo sapiens
tttgttcccctc

SEQ ID NO: 1328234 - DNA, 15 bp, Homo sapiens
tttgttcccctcctc

SEQ ID NO: 1328235 - DNA, 13 bp, Homo sapiens
ttttaactcaata

SEQ ID NO: 1328236 - DNA, 13 bp, Homo sapiens
ttttaatttgata

SEQ ID NO: 1328237 - DNA, 21 bp, Homo sapiens
ttttcttgcctctgtcccctt

SEQ ID NO: 1328238 - DNA, 14 bp, Homo sapiens
ttttgttcccctcc

SEQ ID NO: 1328239 - DNA, 15 bp, Homo sapiens
ttttgttcccctcct

SEQ ID NO: 1328240 - DNA, 19 bp, Homo sapiens
ttttgttcccctcctccac

SEQ ID NO: 1328241 - DNA, 19 bp, Homo sapiens
tttttatttgtttgtgcat

SEQ ID NO: 1328242 - DNA, 18 bp, Homo sapiens
aaaatgcaacaacatgta

SEQ ID NO: 1328243 - DNA, 20 bp, Homo sapiens
aaaccattatgaagaagaga

SEQ ID NO: 1328244 - DNA, 18 bp, Homo sapiens
aaactaaggccctcttga

SEQ ID NO: 1328245 - DNA, 22 bp, Homo sapiens
aaactggtattttatctttgat

SEQ ID NO: 1328246 - DNA, 16 bp, Homo sapiens
aaatgcaacaacatgt

SEQ ID NO: 1328247 - DNA, 13 bp, Homo sapiens
aaattaacactgc

SEQ ID NO: 1328248 - DNA, 15 bp, Homo sapiens
aacaaaatttctatt

SEQ ID NO: 1328249 - DNA, 21 bp, Homo sapiens
aacactatatggcagtgtctt

SEQ ID NO: 1328250 - DNA, 17 bp, Homo sapiens
aacactgcttgtgtttt

SEQ ID NO: 1328251 - DNA, 22 bp, Homo sapiens
aacccaaattacgtgtactaca

SEQ ID NO: 1328252 - DNA, 11 bp, Homo sapiens
aaccccccagc

SEQ ID NO: 1328253 - DNA, 19 bp, Homo sapiens
aaccccccagcactgagga

SEQ ID NO: 1328254 - DNA, 13 bp, Homo sapiens
aactcaatatttt

SEQ ID NO: 1328255 - DNA, 18 bp, Homo sapiens
aactgagatccttccttt

SEQ ID NO: 1328256 - DNA, 18 bp, Homo sapiens
aagaacggggctcttctc

SEQ ID NO: 1328257 - DNA, 20 bp, Homo sapiens
aagaactacaaacaaaattt

SEQ ID NO: 1328258 - DNA, 21 bp, Homo sapiens
aagaactacaaacaaaatttc

SEQ ID NO: 1328259 - DNA, 16 bp, Homo sapiens
aagacagagctgggat

SEQ ID NO: 1328260 - DNA, 17 bp, Homo sapiens
aagattactttttcttt

SEQ ID NO: 1328261 - DNA, 14 bp, Homo sapiens
aagccacagctggt

SEQ ID NO: 1328262 - DNA, 17 bp, Homo sapiens
aagggggtggtgtctcc

SEQ ID NO: 1328263 - DNA, 16 bp, Homo sapiens
aaggtttctgaaaatt

SEQ ID NO: 1328264 - DNA, 11 bp, Homo sapiens
aataatgtctc

SEQ ID NO: 1328265 - DNA, 21 bp, Homo sapiens
aatacaccaggtagaacacaa

SEQ ID NO: 1328266 - DNA, 13 bp, Homo sapiens
aatataaacacta

SEQ ID NO: 1328267 - DNA, 18 bp, Homo sapiens
aatatggtgtacattctt

SEQ ID NO: 1328268 - DNA, 21 bp, Homo sapiens
aatattttccatgaaaatgca

SEQ ID NO: 1328269 - DNA, 17 bp, Homo sapiens
aatgatcttttcaagtt

SEQ ID NO: 1328270 - DNA, 15 bp, Homo sapiens
aatgcaacaacatgt

SEQ ID NO: 1328271 - DNA, 17 bp, Homo sapiens
aatggtttgaatataaa

SEQ ID NO: 1328272 - DNA, 23 bp, Homo sapiens
aatggtttgaatataaacactat

SEQ ID NO: 1328273 - DNA, 18 bp, Homo sapiens
aattaaattttgtgtctc

SEQ ID NO: 1328274 - DNA, 12 bp, Homo sapiens
aattaacactgc

SEQ ID NO: 1328275 - DNA, 19 bp, Homo sapiens
acaaacaaaatttctatta

SEQ ID NO: 1328276 - DNA, 14 bp, Homo sapiens
acaatttaaagcaa

SEQ ID NO: 1328277 - DNA, 15 bp, Homo sapiens
acaccttatatttac

SEQ ID NO: 1328278 - DNA, 23 bp, Homo sapiens
acactgcttgtgtttttaactca

SEQ ID NO: 1328279 - DNA, 18 bp, Homo sapiens
acagagctgggatgtttc

SEQ ID NO: 1328280 - DNA, 21 bp, Homo sapiens
acaggcctgagatttcatctg

SEQ ID NO: 1328281 - DNA, 18 bp, Homo sapiens
accattatgaagaagaga

SEQ ID NO: 1328282 - DNA, 15 bp, Homo sapiens
accccctccccgccc

SEQ ID NO: 1328283 - DNA, 13 bp, Homo sapiens
acccctccctttc

SEQ ID NO: 1328284 - DNA, 20 bp, Homo sapiens
acccctggttctcatctttc

SEQ ID NO: 1328285 - DNA, 17 bp, Homo sapiens
accctggaaaatgaatc

SEQ ID NO: 1328286 - DNA, 23 bp, Homo sapiens
accttaggaataatctcctgtta

SEQ ID NO: 1328287 - DNA, 20 bp, Homo sapiens
acgtatgtttttgtgtattt

SEQ ID NO: 1328288 - DNA, 20 bp, Homo sapiens
actacaaacaaaatttctat

SEQ ID NO: 1328289 - DNA, 22 bp, Homo sapiens
actacaatttaaagcaaaggag

SEQ ID NO: 1328290 - DNA, 15 bp, Homo sapiens
actatattgtacaca

SEQ ID NO: 1328291 - DNA, 21 bp, Homo sapiens
actcaatattttccatgaaaa

SEQ ID NO: 1328292 - DNA, 22 bp, Homo sapiens
actcaatattttccatgaaaat

SEQ ID NO: 1328293 - DNA, 23 bp, Homo sapiens
actcaatattttccatgaaaatg

SEQ ID NO: 1328294 - DNA, 16 bp, Homo sapiens
actcacatggctatgt

SEQ ID NO: 1328295 - DNA, 10 bp, Homo sapiens
actctccccc

SEQ ID NO: 1328296 - DNA, 20 bp, Homo sapiens
actctcccccaccccctccc

SEQ ID NO: 1328297 - DNA, 13 bp, Homo sapiens
actgaggcctgag

SEQ ID NO: 1328298 - DNA, 19 bp, Homo sapiens
actgcctttggcagagttc

SEQ ID NO: 1328299 - DNA, 16 bp, Homo sapiens
actgcttgtgttttta

SEQ ID NO: 1328300 - DNA, 18 bp, Homo sapiens
actgcttgtgtttttaac

SEQ ID NO: 1328301 - DNA, 16 bp, Homo sapiens
acttcaaactgagatc

SEQ ID NO: 1328302 - DNA, 16 bp, Homo sapiens
acttctgggtggggca

SEQ ID NO: 1328303 - DNA, 17 bp, Homo sapiens
acttctgggtggggcag

SEQ ID NO: 1328304 - DNA, 18 bp, Homo sapiens
acttgacagaacactgtc

SEQ ID NO: 1328305 - DNA, 20 bp, Homo sapiens
actttcatttttttccaggc

SEQ ID NO: 1328306 - DNA, 16 bp, Homo sapiens
agaacacaaggtcatt

SEQ ID NO: 1328307 - DNA, 17 bp, Homo sapiens
agaacggggctcttctc

SEQ ID NO: 1328308 - DNA, 14 bp, Homo sapiens
agaactttcatttt

SEQ ID NO: 1328309 - DNA, 18 bp, Homo sapiens
agaactttcatttttttc

SEQ ID NO: 1328310 - DNA, 20 bp, Homo sapiens
agaagggggtggtgtctcca

SEQ ID NO: 1328311 - DNA, 15 bp, Homo sapiens
agaatggggtgcatg

SEQ ID NO: 1328312 - DNA, 14 bp, Homo sapiens
gacagaacactgtc

SEQ ID NO: 1328313 - DNA, 15 bp, Homo sapiens
gaccttctaggaagc

SEQ ID NO: 1328314 - DNA, 18 bp, Homo sapiens
gactatattgtacacacc

SEQ ID NO: 1328315 - DNA, 23 bp, Homo sapiens
gactgaggcctgagcgctcctgc

SEQ ID NO: 1328316 - DNA, 18 bp, Homo sapiens
gacttgacagaacactgt

SEQ ID NO: 1328317 - DNA, 17 bp, Homo sapiens
gagaactttcatttttt

SEQ ID NO: 1328318 - DNA, 15 bp, Homo sapiens
gagaatgtaagaact

SEQ ID NO: 1328319 - DNA, 15 bp, Homo sapiens
gagactcgagaactt

SEQ ID NO: 1328320 - DNA, 17 bp, Homo sapiens
gagactcgagaactttc

SEQ ID NO: 1328321 - DNA, 18 bp, Homo sapiens
gagagcccctcacacagc

SEQ ID NO: 1328322 - DNA, 17 bp, Homo sapiens
gagatttcatctgctct

SEQ ID NO: 1328323 - DNA, 19 bp, Homo sapiens
gagatttcatctgctctcc

SEQ ID NO: 1328324 - DNA, 22 bp, Homo sapiens
gagatttcatctgctctccttc

SEQ ID NO: 1328325 - DNA, 18 bp, Homo sapiens
gaggagctcaggacacta

SEQ ID NO: 1328326 - DNA, 20 bp, Homo sapiens
gaggcccctgtctcagggtg

SEQ ID NO: 1328327 - DNA, 22 bp, Homo sapiens
gagggagcaagtccttcccttt

SEQ ID NO: 1328328 - DNA, 21 bp, Homo sapiens
gagggcagcagaagggggtgg

SEQ ID NO: 1328329 - DNA, 23 bp, Homo sapiens
gagttgacttgacagaacactgt

SEQ ID NO: 1328330 - DNA, 16 bp, Homo sapiens
gatcaacatcttttct

SEQ ID NO: 1328331 - DNA, 16 bp, Homo sapiens
gatcttttcaagttaa

SEQ ID NO: 1328332 - DNA, 16 bp, Homo sapiens
gatgcagcattatgat

SEQ ID NO: 1328333 - DNA, 16 bp, Homo sapiens
gatgggcccaattctt

SEQ ID NO: 1328334 - DNA, 22 bp, Homo sapiens
gattgcgtggaattgtgctgag

SEQ ID NO: 1328335 - DNA, 17 bp, Homo sapiens
gattggctcacactgag

SEQ ID NO: 1328336 - DNA, 20 bp, Homo sapiens
gattggctcacactgagaat

SEQ ID NO: 1328337 - DNA, 12 bp, Homo sapiens
gatttcatctgc

SEQ ID NO: 1328338 - DNA, 15 bp, Homo sapiens
gatttcatctgctct

SEQ ID NO: 1328339 - DNA, 13 bp, Homo sapiens
gcactgaggaaga

SEQ ID NO: 1328340 - DNA, 12 bp, Homo sapiens
gcagcagaaggg

SEQ ID NO: 1328341 - DNA, 20 bp, Homo sapiens
gcagcaggtggcagaatggg

SEQ ID NO: 1328342 - DNA, 16 bp, Homo sapiens
gccaaataatgtctct

SEQ ID NO: 1328343 - DNA, 18 bp, Homo sapiens
gccaaataatgtctctgt

SEQ ID NO: 1328344 - DNA, 15 bp, Homo sapiens
gccacaggcctgaga

SEQ ID NO: 1328345 - DNA, 22 bp, Homo sapiens
gccacaggcctgagatttcatc

SEQ ID NO: 1328346 - DNA, 16 bp, Homo sapiens
gcccagaggagggcag

SEQ ID NO: 1328347 - DNA, 13 bp, Homo sapiens
gcccccaggactg

SEQ ID NO: 1328348 - DNA, 18 bp, Homo sapiens
gcccccaggactgggcca

SEQ ID NO: 1328349 - DNA, 21 bp, Homo sapiens
gccctcacccctggttctcat

SEQ ID NO: 1328350 - DNA, 12 bp, Homo sapiens
gccgcagagctg

SEQ ID NO: 1328351 - DNA, 13 bp, Homo sapiens
gcctccagggctg

SEQ ID NO: 1328352 - DNA, 17 bp, Homo sapiens
gcctccagggctggact

SEQ ID NO: 1328353 - DNA, 22 bp, Homo sapiens
gcctccagggctggactgaggc

SEQ ID NO: 1328354 - DNA, 19 bp, Homo sapiens
gcctctgtccccttctctc

SEQ ID NO: 1328355 - DNA, 20 bp, Homo sapiens
gcctctgtccccttctctca

SEQ ID NO: 1328356 - DNA, 18 bp, Homo sapiens
gcctgagatttcatctgc

SEQ ID NO: 1328357 - DNA, 23 bp, Homo sapiens
gcctgagatttcatctgctctcc

SEQ ID NO: 1328358 - DNA, 18 bp, Homo sapiens
gcctgcctccagggctgg

SEQ ID NO: 1328359 - DNA, 19 bp, Homo sapiens
gctatccagctatttttat

SEQ ID NO: 1328360 - DNA, 18 bp, Homo sapiens
gctcctgccgcagagctg

SEQ ID NO: 1328361 - DNA, 22 bp, Homo sapiens
gctcctgccgcagagctggccg

SEQ ID NO: 1328362 - DNA, 20 bp, Homo sapiens
gctcttctcatttcacccct

SEQ ID NO: 1328363 - DNA, 14 bp, Homo sapiens
gctgaggcaattct

SEQ ID NO: 1328364 - DNA, 13 bp, Homo sapiens
gctggactgaggc

SEQ ID NO: 1328365 - DNA, 14 bp, Homo sapiens
gctggactgaggcc

SEQ ID NO: 1328366 - DNA, 16 bp, Homo sapiens
gctggactgaggcctg

SEQ ID NO: 1328367 - DNA, 17 bp, Homo sapiens
ggaaactggatgaggtc

SEQ ID NO: 1328368 - DNA, 15 bp, Homo sapiens
ggaatggcacagccc

SEQ ID NO: 1328369 - DNA, 23 bp, Homo sapiens
ggactgggccacttctgggtggg

SEQ ID NO: 1328370 - DNA, 23 bp, Homo sapiens
ggatgtttctgtcacatcagctc

SEQ ID NO: 1328371 - DNA, 15 bp, Homo sapiens
ggccacttctgggtg

SEQ ID NO: 1328372 - DNA, 14 bp, Homo sapiens
ggctcacactgaga

SEQ ID NO: 1328373 - DNA, 15 bp, Homo sapiens
ggctcacactgagaa

SEQ ID NO: 1328374 - DNA, 17 bp, Homo sapiens
ggctcacactgagaatg

SEQ ID NO: 1328375 - DNA, 18 bp, Homo sapiens
ggctcacactgagaatgt

SEQ ID NO: 1328376 - DNA, 12 bp, Homo sapiens
ggctcttctcat

SEQ ID NO: 1328377 - DNA, 20 bp, Homo sapiens
ggctcttctcatttcacccc

SEQ ID NO: 1328378 - DNA, 17 bp, Homo sapiens
ggctggactgaggcctg

SEQ ID NO: 1328379 - DNA, 16 bp, Homo sapiens
gggaatggcacagccc

SEQ ID NO: 1328380 - DNA, 19 bp, Homo sapiens
gggctggactgaggcctga

SEQ ID NO: 1328381 - DNA, 12 bp, Homo sapiens
gggtcaaggaat

SEQ ID NO: 1328382 - DNA, 21 bp, Homo sapiens
gggttggagcagtagctggag

SEQ ID NO: 1328383 - DNA, 21 bp, Homo sapiens
ggtatgaccttctaggaagct

SEQ ID NO: 1328384 - DNA, 17 bp, Homo sapiens
ggtgttgacatgtgctt

SEQ ID NO: 1328385 - DNA, 22 bp, Homo sapiens
ggttttgttcccctcctccact

SEQ ID NO: 1328386 - DNA, 15 bp, Homo sapiens
gtactacaatttaaa

SEQ ID NO: 1328387 - DNA, 18 bp, Homo sapiens
gtagaaagacagagctgg

SEQ ID NO: 1328388 - DNA, 21 bp, Homo sapiens
gtagaaagacagagctgggat

SEQ ID NO: 1328389 - DNA, 19 bp, Homo sapiens
gtatgtttttgtgtatttg

SEQ ID NO: 1328390 - DNA, 23 bp, Homo sapiens
gtatgtttttgtgtatttgttaa

SEQ ID NO: 1328391 - DNA, 22 bp, Homo sapiens
gtcccagattggctcacactga

SEQ ID NO: 1328392 - DNA, 20 bp, Homo sapiens
gtgaaagcatcacttgggat

SEQ ID NO: 1328393 - DNA, 17 bp, Homo sapiens
gtgagactcgagaactt

SEQ ID NO: 1328394 - DNA, 22 bp, Homo sapiens
gtgcatgaaggtttctgaaaat

SEQ ID NO: 1328395 - DNA, 22 bp, Homo sapiens
gtggagaagccacaggcctgag

SEQ ID NO: 1328396 - DNA, 16 bp, Homo sapiens
gtggaggagctcagga

SEQ ID NO: 1328397 - DNA, 23 bp, Homo sapiens
gtggaggagctcaggacactaat

SEQ ID NO: 1328398 - DNA, 23 bp, Homo sapiens
gtgggaaagattactttttcttt

SEQ ID NO: 1328399 - DNA, 14 bp, Homo sapiens
gtgggtcaaggaat

SEQ ID NO: 1328400 - DNA, 17 bp, Homo sapiens
gtgtctccaacccccca

SEQ ID NO: 1328401 - DNA, 19 bp, Homo sapiens
gtgtctccaaccccccagc

SEQ ID NO: 1328402 - DNA, 23 bp, Homo sapiens
gtgtggagaagccacaggcctga

SEQ ID NO: 1328403 - DNA, 22 bp, Homo sapiens
gttcccctcctccactctcccc

SEQ ID NO: 1328404 - DNA, 19 bp, Homo sapiens
gttgacttgacagaacact

SEQ ID NO: 1328405 - DNA, 17 bp, Homo sapiens
gtttgaatataaacact

SEQ ID NO: 1328406 - DNA, 15 bp, Homo sapiens
gtttgcaaggaagcc

SEQ ID NO: 1328407 - DNA, 17 bp, Homo sapiens
gtttgcaaggaagccac

SEQ ID NO: 1328408 - DNA, 19 bp, Homo sapiens
gttttgtggaggagctcag

SEQ ID NO: 1328409 - DNA, 16 bp, Homo sapiens
gttttgttcccctcct

SEQ ID NO: 1328410 - DNA, 21 bp, Homo sapiens
gttttgttcccctcctccact

SEQ ID NO: 1328411 - DNA, 22 bp, Homo sapiens
gttttgttcccctcctccactc

SEQ ID NO: 1328412 - DNA, 12 bp, Homo sapiens
taaacaaatgta

SEQ ID NO: 1328413 - DNA, 19 bp, Homo sapiens
taaacaaatgtatgattac

SEQ ID NO: 1328414 - DNA, 15 bp, Homo sapiens
taaattttgtgtctc

SEQ ID NO: 1328415 - DNA, 14 bp, Homo sapiens
taactcaatatttt

SEQ ID NO: 1328416 - DNA, 19 bp, Homo sapiens
taatgtctctgtgagactc

SEQ ID NO: 1328417 - DNA, 21 bp, Homo sapiens
tagggaatggcacagcccaaa

SEQ ID NO: 1328418 - DNA, 14 bp, Homo sapiens
tatattttaatttg

SEQ ID NO: 1328419 - DNA, 16 bp, Homo sapiens
tatctttgattctcct

SEQ ID NO: 1328420 - DNA, 19 bp, Homo sapiens
tatctttgattctccttca

SEQ ID NO: 1328421 - DNA, 22 bp, Homo sapiens
tatctttgattctccttcagcc

SEQ ID NO: 1328422 - DNA, 15 bp, Homo sapiens
tatgaagaagagagt

SEQ ID NO: 1328423 - DNA, 14 bp, Homo sapiens
tatgtttttgtgta

SEQ ID NO: 1328424 - DNA, 20 bp, Homo sapiens
tatttcttaaacaaatgtat

SEQ ID NO: 1328425 - DNA, 16 bp, Homo sapiens
tattttccatgaaaat

SEQ ID NO: 1328426 - DNA, 17 bp, Homo sapiens
tatttttaattaaataa

SEQ ID NO: 1328427 - DNA, 17 bp, Homo sapiens
tatttttatttgtttgt

SEQ ID NO: 1328428 - DNA, 15 bp, Homo sapiens
tcaatattttccatg

SEQ ID NO: 1328429 - DNA, 16 bp, Homo sapiens
tcaatattttccatga

SEQ ID NO: 1328430 - DNA, 18 bp, Homo sapiens
tcaatggtttgcaaggaa

SEQ ID NO: 1328431 - DNA, 19 bp, Homo sapiens
gctcctgccgcagagctgg

SEQ ID NO: 1328432 - DNA, 22 bp, Homo sapiens
gctctccttcctggagcccaga

SEQ ID NO: 1328433 - DNA, 15 bp, Homo sapiens
gctcttctcatttca

SEQ ID NO: 1328434 - DNA, 16 bp, Homo sapiens
gctcttctcatttcac

SEQ ID NO: 1328435 - DNA, 23 bp, Homo sapiens
gctcttctcatttcacccctccc

SEQ ID NO: 1328436 - DNA, 20 bp, Homo sapiens
gctggttcggatttggggtg

SEQ ID NO: 1328437 - DNA, 18 bp, Homo sapiens
gcttggaaactggatgag

SEQ ID NO: 1328438 - DNA, 20 bp, Homo sapiens
ggaaaaggcagggagcgagg

SEQ ID NO: 1328439 - DNA, 21 bp, Homo sapiens
ggaagaacggggctcttctca

SEQ ID NO: 1328440 - DNA, 14 bp, Homo sapiens
ggactgaggcctga

SEQ ID NO: 1328441 - DNA, 18 bp, Homo sapiens
ggagaagccacaggcctg

SEQ ID NO: 1328442 - DNA, 19 bp, Homo sapiens
ggagaagccacaggcctga

SEQ ID NO: 1328443 - DNA, 20 bp, Homo sapiens
ggaggctaaagcccagagac

SEQ ID NO: 1328444 - DNA, 16 bp, Homo sapiens
ggagggcagcagaagg

SEQ ID NO: 1328445 - DNA, 21 bp, Homo sapiens
ggcagagttctataatgtaaa

SEQ ID NO: 1328446 - DNA, 22 bp, Homo sapiens
ggccgcgccaaataatgtctct

SEQ ID NO: 1328447 - DNA, 18 bp, Homo sapiens
ggcctgcctccagggctg

SEQ ID NO: 1328448 - DNA, 19 bp, Homo sapiens
ggcctgcctccagggctgg

SEQ ID NO: 1328449 - DNA, 20 bp, Homo sapiens
ggcctgcctccagggctgga

SEQ ID NO: 1328450 - DNA, 12 bp, Homo sapiens
ggctcacactga

SEQ ID NO: 1328451 - DNA, 22 bp, Homo sapiens
ggctggttcggatttggggtgg

SEQ ID NO: 1328452 - DNA, 12 bp, Homo sapiens
gggctcttctca

SEQ ID NO: 1328453 - DNA, 15 bp, Homo sapiens
ggggaattcatctct

SEQ ID NO: 1328454 - DNA, 14 bp, Homo sapiens
ggggctcttctcat

SEQ ID NO: 1328455 - DNA, 23 bp, Homo sapiens
ggtgtctccaaccccccagcact

SEQ ID NO: 1328456 - DNA, 15 bp, Homo sapiens
ggtttgaatataaac

SEQ ID NO: 1328457 - DNA, 19 bp, Homo sapiens
ggttttgttcccctcctcc

SEQ ID NO: 1328458 - DNA, 12 bp, Homo sapiens
gtactacaattt

SEQ ID NO: 1328459 - DNA, 14 bp, Homo sapiens
gtatttgttaatgg

SEQ ID NO: 1328460 - DNA, 23 bp, Homo sapiens
gtattttatctttgattctcctt

SEQ ID NO: 1328461 - DNA, 17 bp, Homo sapiens
gtcccagattggctcac

SEQ ID NO: 1328462 - DNA, 21 bp, Homo sapiens
gtcccagattggctcacactg

SEQ ID NO: 1328463 - DNA, 12 bp, Homo sapiens
gtccccttctct

SEQ ID NO: 1328464 - DNA, 13 bp, Homo sapiens
gtccccttctctc

SEQ ID NO: 1328465 - DNA, 17 bp, Homo sapiens
gtccccttctctcatct

SEQ ID NO: 1328466 - DNA, 21 bp, Homo sapiens
gtctccaaccccccagcactg

SEQ ID NO: 1328467 - DNA, 22 bp, Homo sapiens
gtctccaaccccccagcactga

SEQ ID NO: 1328468 - DNA, 22 bp, Homo sapiens
gtgagactcgagaactttcatt

SEQ ID NO: 1328469 - DNA, 22 bp, Homo sapiens
gtgtggagaagccacaggcctg

SEQ ID NO: 1328470 - DNA, 20 bp, Homo sapiens
gttgacttgacagaacactg

SEQ ID NO: 1328471 - DNA, 20 bp, Homo sapiens
gtttctgaaaattaacactg

SEQ ID NO: 1328472 - DNA, 19 bp, Homo sapiens
gtttgaatataaacactat

SEQ ID NO: 1328473 - DNA, 19 bp, Homo sapiens
gtttttaactcaatatttt

SEQ ID NO: 1328474 - DNA, 21 bp, Homo sapiens
caggcctgagatttcatctgc

SEQ ID NO: 1328475 - DNA, 15 bp, Homo sapiens
cagggctggactgag

SEQ ID NO: 1328476 - DNA, 18 bp, Homo sapiens
cagggctggactgaggcc

SEQ ID NO: 1328477 - DNA, 20 bp, Homo sapiens
cagggctggactgaggcctg

SEQ ID NO: 1328478 - DNA, 22 bp, Homo sapiens
cagggctggactgaggcctgag

SEQ ID NO: 1328479 - DNA, 19 bp, Homo sapiens
caggtagaacacaaggtca

SEQ ID NO: 1328480 - DNA, 13 bp, Homo sapiens
cagtgaaagcatc

SEQ ID NO: 1328481 - DNA, 19 bp, Homo sapiens
cagtgcttgattgcgtgga

SEQ ID NO: 1328482 - DNA, 12 bp, Homo sapiens
catatttcaatt

SEQ ID NO: 1328483 - DNA, 23 bp, Homo sapiens
catctcttagctcccctccaacc

SEQ ID NO: 1328484 - DNA, 21 bp, Homo sapiens
catcttttcttgcctctgtcc

SEQ ID NO: 1328485 - DNA, 15 bp, Homo sapiens
catgaaaatgcaaca

SEQ ID NO: 1328486 - DNA, 23 bp, Homo sapiens
cattatgatgtgggtcaaggaat

SEQ ID NO: 1328487 - DNA, 19 bp, Homo sapiens
catttcacccctccctttc

SEQ ID NO: 1328488 - DNA, 20 bp, Homo sapiens
ccaaccccccagcactgagg

SEQ ID NO: 1328489 - DNA, 11 bp, Homo sapiens
ccacaggcctg

SEQ ID NO: 1328490 - DNA, 12 bp, Homo sapiens
ccacaggcctga

SEQ ID NO: 1328491 - DNA, 14 bp, Homo sapiens
ccacaggcctgaga

SEQ ID NO: 1328492 - DNA, 15 bp, Homo sapiens
ccacttctgggtggg

SEQ ID NO: 1328493 - DNA, 16 bp, Homo sapiens
ccagattggctcacac

SEQ ID NO: 1328494 - DNA, 13 bp, Homo sapiens
ccagcactgagga

SEQ ID NO: 1328495 - DNA, 13 bp, Homo sapiens
ccaggactgggcc

SEQ ID NO: 1328496 - DNA, 14 bp, Homo sapiens
ccaggactgggcca

SEQ ID NO: 1328497 - DNA, 22 bp, Homo sapiens
ccagggctggactgaggcctga

SEQ ID NO: 1328498 - DNA, 21 bp, Homo sapiens
ccagtgatgctaaaggttgta

SEQ ID NO: 1328499 - DNA, 22 bp, Homo sapiens
ccatgaaaatgcaacaacatgt

SEQ ID NO: 1328500 - DNA, 17 bp, Homo sapiens
ccattatgaagaagaga

SEQ ID NO: 1328501 - DNA, 12 bp, Homo sapiens
cccaaagaagga

SEQ ID NO: 1328502 - DNA, 13 bp, Homo sapiens
cccagcactgagg

SEQ ID NO: 1328503 - DNA, 15 bp, Homo sapiens
cccagcactgaggaa

SEQ ID NO: 1328504 - DNA, 12 bp, Homo sapiens
cccaggactggg

SEQ ID NO: 1328505 - DNA, 16 bp, Homo sapiens
ccccaggactgggcca

SEQ ID NO: 1328506 - DNA, 12 bp, Homo sapiens
cccccaggactg

SEQ ID NO: 1328507 - DNA, 13 bp, Homo sapiens
cccccaggactgg

SEQ ID NO: 1328508 - DNA, 14 bp, Homo sapiens
cccctccaacctgg

SEQ ID NO: 1328509 - DNA, 20 bp, Homo sapiens
ccctcacccctggttctcat

SEQ ID NO: 1328510 - DNA, 22 bp, Homo sapiens
ccctcacccctggttctcatct

SEQ ID NO: 1328511 - DNA, 16 bp, Homo sapiens
ccctccctttctcccc

SEQ ID NO: 1328512 - DNA, 20 bp, Homo sapiens
ccctgcccccaggactgggc

SEQ ID NO: 1328513 - DNA, 23 bp, Homo sapiens
ccctgcccccaggactgggccac

SEQ ID NO: 1328514 - DNA, 20 bp, Homo sapiens
cctcacccctggttctcatc

SEQ ID NO: 1328515 - DNA, 16 bp, Homo sapiens
cctccagggctggact

SEQ ID NO: 1328516 - DNA, 17 bp, Homo sapiens
cctccagggctggactg

SEQ ID NO: 1328517 - DNA, 16 bp, Homo sapiens
cctccccgcccttttt

SEQ ID NO: 1328518 - DNA, 14 bp, Homo sapiens
cctccctttctccc

SEQ ID NO: 1328519 - DNA, 22 bp, Homo sapiens
cctctgtccccttctctcatct

SEQ ID NO: 1328520 - DNA, 17 bp, Homo sapiens
cctgagatttcatctgc

SEQ ID NO: 1328521 - DNA, 18 bp, Homo sapiens
cctgagatttcatctgct

SEQ ID NO: 1328522 - DNA, 21 bp, Homo sapiens
cctgagcgctcctgccgcaga

SEQ ID NO: 1328523 - DNA, 23 bp, Homo sapiens
cctgagcgctcctgccgcagagc

SEQ ID NO: 1328524 - DNA, 14 bp, Homo sapiens
cctgcccccaggac

SEQ ID NO: 1328525 - DNA, 16 bp, Homo sapiens
cctgcccccaggactg

SEQ ID NO: 1328526 - DNA, 14 bp, Homo sapiens
cctgccgcagagct

SEQ ID NO: 1328527 - DNA, 15 bp, Homo sapiens
cctgccgcagagctg

SEQ ID NO: 1328528 - DNA, 16 bp, Homo sapiens
cctgccgcagagctgg

SEQ ID NO: 1328529 - DNA, 16 bp, Homo sapiens
cctgcctccagggctg

SEQ ID NO: 1328530 - DNA, 20 bp, Homo sapiens
cctgcctccagggctggact

SEQ ID NO: 1328531 - DNA, 15 bp, Homo sapiens
ccttcagccctcacc

SEQ ID NO: 1328532 - DNA, 14 bp, Homo sapiens
ccttctctcatctc

SEQ ID NO: 1328533 - DNA, 21 bp, Homo sapiens
ccttctctcatctcttagctc

SEQ ID NO: 1328534 - DNA, 15 bp, Homo sapiens
cctttctcccctgcc

SEQ ID NO: 1328535 - DNA, 19 bp, Homo sapiens
cgccaaataatgtctctgt

SEQ ID NO: 1328536 - DNA, 19 bp, Homo sapiens
cgcgccaaataatgtctct

SEQ ID NO: 1328537 - DNA, 15 bp, Homo sapiens
cggatttggggtgga

SEQ ID NO: 1328538 - DNA, 12 bp, Homo sapiens
ctaatacaccag

SEQ ID NO: 1328539 - DNA, 13 bp, Homo sapiens
ctacaaacaaaat

SEQ ID NO: 1328540 - DNA, 15 bp, Homo sapiens
ctacaaacaaaattt

SEQ ID NO: 1328541 - DNA, 20 bp, Homo sapiens
ctacaaacaaaatttctatt

SEQ ID NO: 1328542 - DNA, 13 bp, Homo sapiens
tgattctccttca

SEQ ID NO: 1328543 - DNA, 18 bp, Homo sapiens
tgattctccttcagccct

SEQ ID NO: 1328544 - DNA, 19 bp, Homo sapiens
tgattctccttcagccctc

SEQ ID NO: 1328545 - DNA, 23 bp, Homo sapiens
tgattctccttcagccctcaccc

SEQ ID NO: 1328546 - DNA, 15 bp, Homo sapiens
tgcaacaacatgtat

SEQ ID NO: 1328547 - DNA, 20 bp, Homo sapiens
tgcaaggaagccacagctgg

SEQ ID NO: 1328548 - DNA, 20 bp, Homo sapiens
tgccatggacagaagaaggc

SEQ ID NO: 1328549 - DNA, 23 bp, Homo sapiens
tgccatggacagaagaaggcagc

SEQ ID NO: 1328550 - DNA, 14 bp, Homo sapiens
tgcccccaggactg

SEQ ID NO: 1328551 - DNA, 16 bp, Homo sapiens
tgcccccaggactggg

SEQ ID NO: 1328552 - DNA, 14 bp, Homo sapiens
tgccgcagagctgg

SEQ ID NO: 1328553 - DNA, 16 bp, Homo sapiens
tgcctccagggctgga

SEQ ID NO: 1328554 - DNA, 17 bp, Homo sapiens
tgcctccagggctggac

SEQ ID NO: 1328555 - DNA, 18 bp, Homo sapiens
tgcctccagggctggact

SEQ ID NO: 1328556 - DNA, 15 bp, Homo sapiens
tgcctctgtcccctt

SEQ ID NO: 1328557 - DNA, 15 bp, Homo sapiens
tgctgagttggtgtt

SEQ ID NO: 1328558 - DNA, 20 bp, Homo sapiens
tggaggagctcaggacacta

SEQ ID NO: 1328559 - DNA, 18 bp, Homo sapiens
tggcacagcccaaagaag

SEQ ID NO: 1328560 - DNA, 21 bp, Homo sapiens
tggccgcgccaaataatgtct

SEQ ID NO: 1328561 - DNA, 22 bp, Homo sapiens
tggccgcgccaaataatgtctc

SEQ ID NO: 1328562 - DNA, 15 bp, Homo sapiens
tggtggtatctgagt

SEQ ID NO: 1328563 - DNA, 11 bp, Homo sapiens
tggtgtctcca

SEQ ID NO: 1328564 - DNA, 17 bp, Homo sapiens
tggttctcatctttctt

SEQ ID NO: 1328565 - DNA, 20 bp, Homo sapiens
tggttttgttcccctcctcc

SEQ ID NO: 1328566 - DNA, 19 bp, Homo sapiens
tgtaagaactacaaacaaa

SEQ ID NO: 1328567 - DNA, 19 bp, Homo sapiens
tgtattgcatatatacata

SEQ ID NO: 1328568 - DNA, 22 bp, Homo sapiens
tgtccccttctctcatctctta

SEQ ID NO: 1328569 - DNA, 11 bp, Homo sapiens
tgtctccaacc

SEQ ID NO: 1328570 - DNA, 19 bp, Homo sapiens
tgtctccaaccccccagca

SEQ ID NO: 1328571 - DNA, 20 bp, Homo sapiens
tgtctccaaccccccagcac

SEQ ID NO: 1328572 - DNA, 19 bp, Homo sapiens
tgtggagaagccacaggcc

SEQ ID NO: 1328573 - DNA, 12 bp, Homo sapiens
tgttcccctcct

SEQ ID NO: 1328574 - DNA, 17 bp, Homo sapiens
tgttcccctcctccact

SEQ ID NO: 1328575 - DNA, 19 bp, Homo sapiens
ttaaactggtattttatct

SEQ ID NO: 1328576 - DNA, 14 bp, Homo sapiens
ttaaattttgtgtc

SEQ ID NO: 1328577 - DNA, 12 bp, Homo sapiens
ttaactcaatat

SEQ ID NO: 1328578 - DNA, 18 bp, Homo sapiens
ttaagttagggaatggca

SEQ ID NO: 1328579 - DNA, 18 bp, Homo sapiens
ttacatcaaggcttcaaa

SEQ ID NO: 1328580 - DNA, 16 bp, Homo sapiens
aaaatctgtggtggtc

SEQ ID NO: 1328581 - DNA, 16 bp, Homo sapiens
aaactggtattttatc

SEQ ID NO: 1328582 - DNA, 14 bp, Homo sapiens
aaagacagagctgg

SEQ ID NO: 1328583 - DNA, 22 bp, Homo sapiens
aaagattactttttctttatgt

SEQ ID NO: 1328584 - DNA, 15 bp, Homo sapiens
aaagcccagagacag

SEQ ID NO: 1328585 - DNA, 13 bp, Homo sapiens
aaataatgtctct

SEQ ID NO: 1328586 - DNA, 18 bp, Homo sapiens
aaatgtatgattacatca

SEQ ID NO: 1328587 - DNA, 13 bp, Homo sapiens
aacaaaatttcta

SEQ ID NO: 1328588 - DNA, 16 bp, Homo sapiens
aacactgtcttgaaga

SEQ ID NO: 1328589 - DNA, 12 bp, Homo sapiens
aacctggggggc

SEQ ID NO: 1328590 - DNA, 18 bp, Homo sapiens
aacggggctcttctcatt

SEQ ID NO: 1328591 - DNA, 19 bp, Homo sapiens
aactacaaacaaaatttct

SEQ ID NO: 1328592 - DNA, 18 bp, Homo sapiens
aactagcttggaaactgg

SEQ ID NO: 1328593 - DNA, 14 bp, Homo sapiens
aactcaatattttc

SEQ ID NO: 1328594 - DNA, 14 bp, Homo sapiens
aactttcatttttt

SEQ ID NO: 1328595 - DNA, 21 bp, Homo sapiens
aagaacggggctcttctcatt

SEQ ID NO: 1328596 - DNA, 23 bp, Homo sapiens
aagacaatggcttactccaggag

SEQ ID NO: 1328597 - DNA, 18 bp, Homo sapiens
aagagctgaggcaattct

SEQ ID NO: 1328598 - DNA, 15 bp, Homo sapiens
aagccacaggcctga

SEQ ID NO: 1328599 - DNA, 19 bp, Homo sapiens
aagccacaggcctgagatt

SEQ ID NO: 1328600 - DNA, 23 bp, Homo sapiens
aagccacaggcctgagatttcat

SEQ ID NO: 1328601 - DNA, 13 bp, Homo sapiens
aaggttgtattgc

SEQ ID NO: 1328602 - DNA, 14 bp, Homo sapiens
aatataaacactat

SEQ ID NO: 1328603 - DNA, 13 bp, Homo sapiens
aatatcagacttt

SEQ ID NO: 1328604 - DNA, 18 bp, Homo sapiens
aatgcaacaacatgtata

SEQ ID NO: 1328605 - DNA, 19 bp, Homo sapiens
aatggcacagcccaaagaa

SEQ ID NO: 1328606 - DNA, 20 bp, Homo sapiens
aatggcacagcccaaagaag

SEQ ID NO: 1328607 - DNA, 14 bp, Homo sapiens
aatggtttgaatat

SEQ ID NO: 1328608 - DNA, 19 bp, Homo sapiens
aatggtttgcaaggaagcc

SEQ ID NO: 1328609 - DNA, 18 bp, Homo sapiens
aatgtctctgtgagactc

SEQ ID NO: 1328610 - DNA, 17 bp, Homo sapiens
aatttgagatacaaaca

SEQ ID NO: 1328611 - DNA, 18 bp, Homo sapiens
acaaacaaaatttctatt

SEQ ID NO: 1328612 - DNA, 22 bp, Homo sapiens
acaacatgtataatatttttaa

SEQ ID NO: 1328613 - DNA, 20 bp, Homo sapiens
acaatttaaagcaaaggagt

SEQ ID NO: 1328614 - DNA, 19 bp, Homo sapiens
acactgagaatgtaagaac

SEQ ID NO: 1328615 - DNA, 22 bp, Homo sapiens
acactgagaatgtaagaactac

SEQ ID NO: 1328616 - DNA, 16 bp, Homo sapiens
acagaagaaggcagca

SEQ ID NO: 1328617 - DNA, 20 bp, Homo sapiens
acagaagaaggcagcaggtg

SEQ ID NO: 1328618 - DNA, 12 bp, Homo sapiens
acagcaagtcag

SEQ ID NO: 1328619 - DNA, 16 bp, Homo sapiens
acagcccaaagaagga

SEQ ID NO: 1328620 - DNA, 15 bp, Homo sapiens
acaggcctgagattt

SEQ ID NO: 1328621 - DNA, 17 bp, Homo sapiens
acaggcctgagatttca

SEQ ID NO: 1328622 - DNA, 24 bp, Homo sapiens
acatcttttcttgcctctgtcccc

SEQ ID NO: 1328623 - DNA, 13 bp, Homo sapiens
accccccagcact

SEQ ID NO: 1328624 - DNA, 15 bp, Homo sapiens
accccccagcactga

SEQ ID NO: 1328625 - DNA, 14 bp, Homo sapiens
acccctccctttct

SEQ ID NO: 1328626 - DNA, 18 bp, Homo sapiens
acccctccctttctcccc

SEQ ID NO: 1328627 - DNA, 23 bp, Homo sapiens
acccctccctttctcccctgccc

SEQ ID NO: 1328628 - DNA, 16 bp, Homo sapiens
acccctggttctcatc

SEQ ID NO: 1328629 - DNA, 22 bp, Homo sapiens
acctggggggcagtggtgtgga

SEQ ID NO: 1328630 - DNA, 22 bp, Homo sapiens
actacaaacaaaatttctatta

SEQ ID NO: 1328631 - DNA, 17 bp, Homo sapiens
actacaatttaaagcaa

SEQ ID NO: 1328632 - DNA, 18 bp, Homo sapiens
actcaatattttccatga

SEQ ID NO: 1328633 - DNA, 19 bp, Homo sapiens
actcacatggctatgtttt

SEQ ID NO: 1328634 - DNA, 20 bp, Homo sapiens
actcacatggctatgtttta

SEQ ID NO: 1328635 - DNA, 13 bp, Homo sapiens
actcgagaacttt

SEQ ID NO: 1328636 - DNA, 20 bp, Homo sapiens
actgagaatgtaagaactac

SEQ ID NO: 1328637 - DNA, 14 bp, Homo sapiens
actgaggcctgagc

SEQ ID NO: 1328638 - DNA, 20 bp, Homo sapiens
acttgacagaacactgtctt

SEQ ID NO: 1328639 - DNA, 23 bp, Homo sapiens
actttcatttttttccaggctgg

SEQ ID NO: 1328640 - DNA, 15 bp, Homo sapiens
agaaagacagagctg

SEQ ID NO: 1328641 - DNA, 20 bp, Homo sapiens
agaacggggctcttctcatt

SEQ ID NO: 1328642 - DNA, 23 bp, Homo sapiens
agaactacaaacaaaatttctat

SEQ ID NO: 1328643 - DNA, 22 bp, Homo sapiens
agaactgcctttggcagagttc

SEQ ID NO: 1328644 - DNA, 21 bp, Homo sapiens
agaagccacaggcctgagatt

SEQ ID NO: 1328645 - DNA, 16 bp, Homo sapiens
agaaggaaaaggcagg

SEQ ID NO: 1328646 - DNA, 18 bp, Homo sapiens
agactcgagaactttcat

SEQ ID NO: 1328647 - DNA, 22 bp, Homo sapiens
agaggcctgcctccagggctgg

SEQ ID NO: 1328648 - DNA, 15 bp, Homo sapiens
agatttcatctgctc

SEQ ID NO: 1328649 - DNA, 19 bp, Homo sapiens
agatttcatctgctctcct

SEQ ID NO: 1328650 - DNA, 21 bp, Homo sapiens
agatttcatctgctctccttc

SEQ ID NO: 1328651 - DNA, 14 bp, Homo sapiens
agcaagtcagggtt

SEQ ID NO: 1328652 - DNA, 16 bp, Homo sapiens
agcagaagggggtggt

SEQ ID NO: 1328653 - DNA, 13 bp, Homo sapiens
agccacaggcctg

SEQ ID NO: 1328654 - DNA, 21 bp, Homo sapiens
agccacaggcctgagatttca

SEQ ID NO: 1328655 - DNA, 23 bp, Homo sapiens
agccacaggcctgagatttcatc

SEQ ID NO: 1328656 - DNA, 14 bp, Homo sapiens
agcccaaagaagga

SEQ ID NO: 1328657 - DNA, 16 bp, Homo sapiens
agcccaaagaaggaaa

SEQ ID NO: 1328658 - DNA, 22 bp, Homo sapiens
agctatttttatttgtttgtgc

SEQ ID NO: 1328659 - DNA, 17 bp, Homo sapiens
agctgggatgtttctgt

SEQ ID NO: 1328660 - DNA, 23 bp, Homo sapiens
agcttggaaactggatgaggtca

SEQ ID NO: 1328661 - DNA, 12 bp, Homo sapiens
aggaagaacggg

SEQ ID NO: 1328662 - DNA, 12 bp, Homo sapiens
aggactgggcca

SEQ ID NO: 1328663 - DNA, 14 bp, Homo sapiens
aggagacccacagg

SEQ ID NO: 1328664 - DNA, 21 bp, Homo sapiens
aggcccctgtctcagggtgag

SEQ ID NO: 1328665 - DNA, 19 bp, Homo sapiens
aggcctgagatttcatctg

SEQ ID NO: 1328666 - DNA, 14 bp, Homo sapiens
aggcctgagcgctc

SEQ ID NO: 1328667 - DNA, 21 bp, Homo sapiens
aggcctgagcgctcctgccgc

SEQ ID NO: 1328668 - DNA, 19 bp, Homo sapiens
aggcctgcctccagggctg

SEQ ID NO: 1328669 - DNA, 19 bp, Homo sapiens
agggagcaagtccttccct

SEQ ID NO: 1328670 - DNA, 21 bp, Homo sapiens
agggcagcagaagggggtggt

SEQ ID NO: 1328671 - DNA, 19 bp, Homo sapiens
agggcgtggaaaggggcag

SEQ ID NO: 1328672 - DNA, 14 bp, Homo sapiens
agggttggagcagt

SEQ ID NO: 1328673 - DNA, 15 bp, Homo sapiens
aggtttctgaaaatt

SEQ ID NO: 1328674 - DNA, 20 bp, Homo sapiens
agtagaaagacagagctggg

SEQ ID NO: 1328675 - DNA, 21 bp, Homo sapiens
agtccatatttcaatttccaa

SEQ ID NO: 1328676 - DNA, 23 bp, Homo sapiens
agtccatatttcaatttccaaga

SEQ ID NO: 1328677 - DNA, 14 bp, Homo sapiens
agtgggtcccagat

SEQ ID NO: 1328678 - DNA, 17 bp, Homo sapiens
agttagggaatggcaca

SEQ ID NO: 1328679 - DNA, 21 bp, Homo sapiens
agttcgatgggcccaattctt

SEQ ID NO: 1328680 - DNA, 22 bp, Homo sapiens
agttgacttgacagaacactgt

SEQ ID NO: 1328681 - DNA, 20 bp, Homo sapiens
atacctgggatactgtgccc

SEQ ID NO: 1328682 - DNA, 15 bp, Homo sapiens
atataaacactatat

SEQ ID NO: 1328683 - DNA, 13 bp, Homo sapiens
atcaacatctttt

SEQ ID NO: 1328684 - DNA, 15 bp, Homo sapiens
atctgctctccttcc

SEQ ID NO: 1328685 - DNA, 20 bp, Homo sapiens
atctgctctccttcctggag

SEQ ID NO: 1328686 - DNA, 15 bp, Homo sapiens
atctttgattctcct

SEQ ID NO: 1328687 - DNA, 23 bp, Homo sapiens
atcttttcttgcctctgtcccct

SEQ ID NO: 1328688 - DNA, 20 bp, Homo sapiens
atgaaaatgcaacaacatgt

SEQ ID NO: 1328689 - DNA, 17 bp, Homo sapiens
atgaccttctaggaagc

SEQ ID NO: 1328690 - DNA, 14 bp, Homo sapiens
atgcaacaacatgt

SEQ ID NO: 1328691 - DNA, 19 bp, Homo sapiens
atgccatggacagaagaag

SEQ ID NO: 1328692 - DNA, 14 bp, Homo sapiens
atgccttttatttc

SEQ ID NO: 1328693 - DNA, 23 bp, Homo sapiens
atgctaaaggttgtattgcatat

SEQ ID NO: 1328694 - DNA, 23 bp, Homo sapiens
atggcacagcccaaagaaggaaa

SEQ ID NO: 1328695 - DNA, 22 bp, Homo sapiens
atggtttgaatataaacactat

SEQ ID NO: 1328696 - DNA, 16 bp, Homo sapiens
atggtttgcaaggaag

SEQ ID NO: 1328697 - DNA, 17 bp, Homo sapiens
atggtttgcaaggaagc

SEQ ID NO: 1328698 - DNA, 18 bp, Homo sapiens
atggtttgcaaggaagcc

SEQ ID NO: 1328699 - DNA, 11 bp, Homo sapiens
attaacactgc

SEQ ID NO: 1328700 - DNA, 15 bp, Homo sapiens
attctccttcagccc

SEQ ID NO: 1328701 - DNA, 18 bp, Homo sapiens
attctccttcagccctca

SEQ ID NO: 1328702 - DNA, 16 bp, Homo sapiens
attcttacaaacatgt

SEQ ID NO: 1328703 - DNA, 17 bp, Homo sapiens
attcttacaaacatgtg

SEQ ID NO: 1328704 - DNA, 17 bp, Homo sapiens
attggctcacactgaga

SEQ ID NO: 1328705 - DNA, 21 bp, Homo sapiens
attggctcacactgagaatgt

SEQ ID NO: 1328706 - DNA, 21 bp, Homo sapiens
atttcaatttccaagagctga

SEQ ID NO: 1328707 - DNA, 11 bp, Homo sapiens
atttcatctgc

SEQ ID NO: 1328708 - DNA, 14 bp, Homo sapiens
atttcatctgctct

SEQ ID NO: 1328709 - DNA, 23 bp, Homo sapiens
attttatctttgattctccttca

SEQ ID NO: 1328710 - DNA, 21 bp, Homo sapiens
attttatgccttttatttctt

SEQ ID NO: 1328711 - DNA, 17 bp, Homo sapiens
attttggttttgttccc

SEQ ID NO: 1328712 - DNA, 21 bp, Homo sapiens
attttggttttgttcccctcc

SEQ ID NO: 1328713 - DNA, 14 bp, Homo sapiens
caaacaaaatttct

SEQ ID NO: 1328714 - DNA, 16 bp, Homo sapiens
caaaggagtagaaaga

SEQ ID NO: 1328715 - DNA, 13 bp, Homo sapiens
caaataatgtctc

SEQ ID NO: 1328716 - DNA, 20 bp, Homo sapiens
caaataatgtctctgtgaga

SEQ ID NO: 1328717 - DNA, 13 bp, Homo sapiens
caacatcttttct

SEQ ID NO: 1328718 - DNA, 19 bp, Homo sapiens
caacatgtataatattttt

SEQ ID NO: 1328719 - DNA, 15 bp, Homo sapiens
caaccccccagcact

SEQ ID NO: 1328720 - DNA, 16 bp, Homo sapiens
caaccccccagcactg

SEQ ID NO: 1328721 - DNA, 19 bp, Homo sapiens
caaccccccagcactgagg

SEQ ID NO: 1328722 - DNA, 15 bp, Homo sapiens
caatattttccatga

SEQ ID NO: 1328723 - DNA, 16 bp, Homo sapiens
caatggtttgcaagga

SEQ ID NO: 1328724 - DNA, 17 bp, Homo sapiens
caatggtttgcaaggaa

SEQ ID NO: 1328725 - DNA, 19 bp, Homo sapiens
caatggtttgcaaggaagc

SEQ ID NO: 1328726 - DNA, 17 bp, Homo sapiens
caattcttacaaacatg

SEQ ID NO: 1328727 - DNA, 12 bp, Homo sapiens
caatttaaagca

SEQ ID NO: 1328728 - DNA, 19 bp, Homo sapiens
cacacagcaagtcagggtt

SEQ ID NO: 1328729 - DNA, 19 bp, Homo sapiens
cacagcccaaagaaggaaa

SEQ ID NO: 1328730 - DNA, 15 bp, Homo sapiens
cacaggcctgagatt

SEQ ID NO: 1328731 - DNA, 16 bp, Homo sapiens
caccccctccccgccc

SEQ ID NO: 1328732 - DNA, 15 bp, Homo sapiens
cacccctccctttct

SEQ ID NO: 1328733 - DNA, 18 bp, Homo sapiens
cacccctccctttctccc

SEQ ID NO: 1328734 - DNA, 15 bp, Homo sapiens
caccttatatttacg

SEQ ID NO: 1328735 - DNA, 18 bp, Homo sapiens
cactctcccccaccccct

SEQ ID NO: 1328736 - DNA, 20 bp, Homo sapiens
cactctcccccaccccctcc

SEQ ID NO: 1328737 - DNA, 20 bp, Homo sapiens
cactgagaatgtaagaacta

SEQ ID NO: 1328738 - DNA, 21 bp, Homo sapiens
cactgagaatgtaagaactac

SEQ ID NO: 1328739 - DNA, 14 bp, Homo sapiens
cactgaggaagaac

SEQ ID NO: 1328740 - DNA, 14 bp, Homo sapiens
cactgtcttgaaga

SEQ ID NO: 1328741 - DNA, 18 bp, Homo sapiens
cacttctgggtggggcag

SEQ ID NO: 1328742 - DNA, 19 bp, Homo sapiens
cactttcagtgaaagcatc

SEQ ID NO: 1328743 - DNA, 21 bp, Homo sapiens
cagaagggggtggtgtctcca

SEQ ID NO: 1328744 - DNA, 17 bp, Homo sapiens
cagattggctcacactg

SEQ ID NO: 1328745 - DNA, 20 bp, Homo sapiens
cagattggctcacactgaga

SEQ ID NO: 1328746 - DNA, 17 bp, Homo sapiens
cagcactgaggaagaac

SEQ ID NO: 1328747 - DNA, 13 bp, Homo sapiens
cagccctcacccc

SEQ ID NO: 1328748 - DNA, 14 bp, Homo sapiens
cagccctcacccct

SEQ ID NO: 1328749 - DNA, 15 bp, Homo sapiens
cagccctcacccctg

SEQ ID NO: 1328750 - DNA, 19 bp, Homo sapiens
cagcttgatcaaaggcaca

SEQ ID NO: 1328751 - DNA, 23 bp, Homo sapiens
cagcttgatcaaaggcacacagc

SEQ ID NO: 1328752 - DNA, 13 bp, Homo sapiens
caggactgggcca

SEQ ID NO: 1328753 - DNA, 15 bp, Homo sapiens
caggactgggccact

SEQ ID NO: 1328754 - DNA, 20 bp, Homo sapiens
caggactgggccacttctgg

SEQ ID NO: 1328755 - DNA, 16 bp, Homo sapiens
caggcctgagatttca

SEQ ID NO: 1328756 - DNA, 23 bp, Homo sapiens
caggcctgagatttcatctgctc

SEQ ID NO: 1328757 - DNA, 16 bp, Homo sapiens
cagggctggactgagg

SEQ ID NO: 1328758 - DNA, 17 bp, Homo sapiens
cagggctggactgaggc

SEQ ID NO: 1328759 - DNA, 16 bp, Homo sapiens
catctcttagctcccc

SEQ ID NO: 1328760 - DNA, 18 bp, Homo sapiens
catctcttagctcccctc

SEQ ID NO: 1328761 - DNA, 19 bp, Homo sapiens
catctcttagctcccctcc

SEQ ID NO: 1328762 - DNA, 21 bp, Homo sapiens
catctcttagctcccctccaa

SEQ ID NO: 1328763 - DNA, 16 bp, Homo sapiens
catcttttcttgcctc

SEQ ID NO: 1328764 - DNA, 22 bp, Homo sapiens
catgaaaatgcaacaacatgta

SEQ ID NO: 1328765 - DNA, 18 bp, Homo sapiens
catgaaggtttctgaaaa

SEQ ID NO: 1328766 - DNA, 21 bp, Homo sapiens
catggacagaagaaggcagca

SEQ ID NO: 1328767 - DNA, 15 bp, Homo sapiens
catgtataatatttt

SEQ ID NO: 1328768 - DNA, 20 bp, Homo sapiens
catgtataatatttttaatt

SEQ ID NO: 1328769 - DNA, 17 bp, Homo sapiens
catgtggttaatgccat

SEQ ID NO: 1328770 - DNA, 13 bp, Homo sapiens
catttcacccctc

SEQ ID NO: 1328771 - DNA, 15 bp, Homo sapiens
catttttttccaggc

SEQ ID NO: 1328772 - DNA, 16 bp, Homo sapiens
ccaaataatgtctctg

SEQ ID NO: 1328773 - DNA, 15 bp, Homo sapiens
ccaaccccccagcac

SEQ ID NO: 1328774 - DNA, 19 bp, Homo sapiens
ccaaccccccagcactgag

SEQ ID NO: 1328775 - DNA, 14 bp, Homo sapiens
ccaacctggggggc

SEQ ID NO: 1328776 - DNA, 11 bp, Homo sapiens
ccaattcttac

SEQ ID NO: 1328777 - DNA, 19 bp, Homo sapiens
ccacaggcctgagatttca

SEQ ID NO: 1328778 - DNA, 21 bp, Homo sapiens
ccagagctacccgcagagttc

SEQ ID NO: 1328779 - DNA, 22 bp, Homo sapiens
ccagattggctcacactgagaa

SEQ ID NO: 1328780 - DNA, 14 bp, Homo sapiens
ccagcactgaggaa

SEQ ID NO: 1328781 - DNA, 17 bp, Homo sapiens
ccaggactgggccactt

SEQ ID NO: 1328782 - DNA, 16 bp, Homo sapiens
ccagggctggactgag

SEQ ID NO: 1328783 - DNA, 14 bp, Homo sapiens
ccaggtagaacaca

SEQ ID NO: 1328784 - DNA, 15 bp, Homo sapiens
cccagaggagggcag

SEQ ID NO: 1328785 - DNA, 13 bp, Homo sapiens
cccaggactgggc

SEQ ID NO: 1328786 - DNA, 15 bp, Homo sapiens
cccaggactgggcca

SEQ ID NO: 1328787 - DNA, 15 bp, Homo sapiens
cccagggaagttttg

SEQ ID NO: 1328788 - DNA, 12 bp, Homo sapiens
ccccagcactga

SEQ ID NO: 1328789 - DNA, 16 bp, Homo sapiens
ccccagcactgaggaa

SEQ ID NO: 1328790 - DNA, 18 bp, Homo sapiens
cccccagcactgaggaag

SEQ ID NO: 1328791 - DNA, 12 bp, Homo sapiens
ccccccagcact

SEQ ID NO: 1328792 - DNA, 12 bp, Homo sapiens
cccctccctttc

SEQ ID NO: 1328793 - DNA, 12 bp, Homo sapiens
cccctcctccac

SEQ ID NO: 1328794 - DNA, 18 bp, Homo sapiens
cccctgcccccaggactg

SEQ ID NO: 1328795 - DNA, 19 bp, Homo sapiens
cccctgcccccaggactgg

SEQ ID NO: 1328796 - DNA, 17 bp, Homo sapiens
gagctcaggacactaat

SEQ ID NO: 1328797 - DNA, 19 bp, Homo sapiens
gaggaagaacggggctctt

SEQ ID NO: 1328798 - DNA, 20 bp, Homo sapiens
gaggcctgcctccagggctg

SEQ ID NO: 1328799 - DNA, 21 bp, Homo sapiens
gaggcctgcctccagggctgg

SEQ ID NO: 1328800 - DNA, 22 bp, Homo sapiens
gaggcctgcctccagggctgga

SEQ ID NO: 1328801 - DNA, 17 bp, Homo sapiens
gatcaaaggcacacagc

SEQ ID NO: 1328802 - DNA, 20 bp, Homo sapiens
gatcaacatcttttcttgcc

SEQ ID NO: 1328803 - DNA, 17 bp, Homo sapiens
gcaaaggagtagaaaga

SEQ ID NO: 1328804 - DNA, 15 bp, Homo sapiens
gcagcagaagggggt

SEQ ID NO: 1328805 - DNA, 22 bp, Homo sapiens
gcagcagaagggggtggtgtct

SEQ ID NO: 1328806 - DNA, 13 bp, Homo sapiens
gccacaggcctga

SEQ ID NO: 1328807 - DNA, 20 bp, Homo sapiens
gccacaggcctgagatttca

SEQ ID NO: 1328808 - DNA, 14 bp, Homo sapiens
gccacttctgggtg

SEQ ID NO: 1328809 - DNA, 12 bp, Homo sapiens
gcccccaggact

SEQ ID NO: 1328810 - DNA, 14 bp, Homo sapiens
gcccccaggactgg

SEQ ID NO: 1328811 - DNA, 15 bp, Homo sapiens
gcccccaggactggg

SEQ ID NO: 1328812 - DNA, 17 bp, Homo sapiens
gcccccaggactgggcc

SEQ ID NO: 1328813 - DNA, 16 bp, Homo sapiens
gcctccagggctggac

SEQ ID NO: 1328814 - DNA, 21 bp, Homo sapiens
gcctccagggctggactgagg

SEQ ID NO: 1328815 - DNA, 23 bp, Homo sapiens
gcctccagggctggactgaggcc

SEQ ID NO: 1328816 - DNA, 15 bp, Homo sapiens
gcctctgtccccttc

SEQ ID NO: 1328817 - DNA, 18 bp, Homo sapiens
gcctctgtccccttctct

SEQ ID NO: 1328818 - DNA, 22 bp, Homo sapiens
gcctgagatttcatctgctctc

SEQ ID NO: 1328819 - DNA, 22 bp, Homo sapiens
gcctgcctccagggctggactg

SEQ ID NO: 1328820 - DNA, 20 bp, Homo sapiens
gcgctcctgccgcagagctg

SEQ ID NO: 1328821 - DNA, 22 bp, Homo sapiens
gctacccgcagagttctcagaa

SEQ ID NO: 1328822 - DNA, 15 bp, Homo sapiens
gctcctgccgcagag

SEQ ID NO: 1328823 - DNA, 17 bp, Homo sapiens
gctcctgccgcagagct

SEQ ID NO: 1328824 - DNA, 11 bp, Homo sapiens
gctctccttcc

SEQ ID NO: 1328825 - DNA, 12 bp, Homo sapiens
gctcttctcatt

SEQ ID NO: 1328826 - DNA, 14 bp, Homo sapiens
ggacagaagaaggc

SEQ ID NO: 1328827 - DNA, 13 bp, Homo sapiens
ggactgaggcctg

SEQ ID NO: 1328828 - DNA, 20 bp, Homo sapiens
ggagaagccacaggcctgag

SEQ ID NO: 1328829 - DNA, 22 bp, Homo sapiens
ggccagagctacccgcagagtt

SEQ ID NO: 1328830 - DNA, 20 bp, Homo sapiens
ggcctgagatttcatctgct

SEQ ID NO: 1328831 - DNA, 22 bp, Homo sapiens
ggctcttctcatttcacccctc

SEQ ID NO: 1328832 - DNA, 14 bp, Homo sapiens
ggctggactgaggc

SEQ ID NO: 1328833 - DNA, 18 bp, Homo sapiens
ggctggactgaggcctga

SEQ ID NO: 1328834 - DNA, 23 bp, Homo sapiens
ggctggttcggatttggggtgga

SEQ ID NO: 1328835 - DNA, 22 bp, Homo sapiens
gggaatggcacagcccaaagaa

SEQ ID NO: 1328836 - DNA, 20 bp, Homo sapiens
gggcagcagaagggggtggt

SEQ ID NO: 1328837 - DNA, 15 bp, Homo sapiens
gggcaggccagagct

SEQ ID NO: 1328838 - DNA, 18 bp, Homo sapiens
gggcagtgggtcccagat

SEQ ID NO: 1328839 - DNA, 20 bp, Homo sapiens
gggcagtggtgtggagaagc

SEQ ID NO: 1328840 - DNA, 22 bp, Homo sapiens
gggccacttctgggtggggcag

SEQ ID NO: 1328841 - DNA, 17 bp, Homo sapiens
ggggcccatgaaagagg

SEQ ID NO: 1328842 - DNA, 11 bp, Homo sapiens
ggtagaacaca

SEQ ID NO: 1328843 - DNA, 16 bp, Homo sapiens
ggtcatagcagtgctt

SEQ ID NO: 1328844 - DNA, 21 bp, Homo sapiens
ggtggtgtctccaacccccca

SEQ ID NO: 1328845 - DNA, 19 bp, Homo sapiens
ggtgtctccaaccccccag

SEQ ID NO: 1328846 - DNA, 12 bp, Homo sapiens
ggttctcatctt

SEQ ID NO: 1328847 - DNA, 13 bp, Homo sapiens
ggtttctgaaaat

SEQ ID NO: 1328848 - DNA, 18 bp, Homo sapiens
ggtttgaatataaacact

SEQ ID NO: 1328849 - DNA, 14 bp, Homo sapiens
ggtttgcaaggaag

SEQ ID NO: 1328850 - DNA, 22 bp, Homo sapiens
gtagaacacaaggtcatttgct

SEQ ID NO: 1328851 - DNA, 11 bp, Homo sapiens
gtccccttctc

SEQ ID NO: 1328852 - DNA, 14 bp, Homo sapiens
gtccccttctctca

SEQ ID NO: 1328853 - DNA, 19 bp, Homo sapiens
gtccccttctctcatctct

SEQ ID NO: 1328854 - DNA, 20 bp, Homo sapiens
gtccccttctctcatctctt

SEQ ID NO: 1328855 - DNA, 20 bp, Homo sapiens
gtctccaaccccccagcact

SEQ ID NO: 1328856 - DNA, 22 bp, Homo sapiens
gtgatgctaaaggttgtattgc

SEQ ID NO: 1328857 - DNA, 20 bp, Homo sapiens
gtggagaagccacaggcctg

SEQ ID NO: 1328858 - DNA, 21 bp, Homo sapiens
gtggattttggttttgttccc

SEQ ID NO: 1328859 - DNA, 14 bp, Homo sapiens
gtggtgtggagaag

SEQ ID NO: 1328860 - DNA, 23 bp, Homo sapiens
gtggttaatgccatggacagaag

SEQ ID NO: 1328861 - DNA, 15 bp, Homo sapiens
gtgtttttaactcaa

SEQ ID NO: 1328862 - DNA, 13 bp, Homo sapiens
gttagggaatggc

SEQ ID NO: 1328863 - DNA, 18 bp, Homo sapiens
gttcggatttggggtgga

SEQ ID NO: 1328864 - DNA, 16 bp, Homo sapiens
gttctcatctttcttg

SEQ ID NO: 1328865 - DNA, 21 bp, Homo sapiens
gtttctgaaaattaacactgc

SEQ ID NO: 1328866 - DNA, 13 bp, Homo sapiens
gtttgaatataaa

SEQ ID NO: 1328867 - DNA, 14 bp, Homo sapiens
gtttgcaaggaagc

SEQ ID NO: 1328868 - DNA, 22 bp, Homo sapiens
gtttgcaaggaagccacagctg

SEQ ID NO: 1328869 - DNA, 14 bp, Homo sapiens
gttttgttcccctc

SEQ ID NO: 1328870 - DNA, 15 bp, Homo sapiens
gtttttaactcaata

SEQ ID NO: 1328871 - DNA, 22 bp, Homo sapiens
taactcaatattttccatgaaa

SEQ ID NO: 1328872 - DNA, 20 bp, Homo sapiens
taattcttcaccttaggaat

SEQ ID NO: 1328873 - DNA, 16 bp, Homo sapiens
tacaaacaaaatttct

SEQ ID NO: 1328874 - DNA, 17 bp, Homo sapiens
tagaaagacagagctgg

SEQ ID NO: 1328875 - DNA, 22 bp, Homo sapiens
tataatatttttaattaaataa

SEQ ID NO: 1328876 - DNA, 15 bp, Homo sapiens
tatatacatatatat

SEQ ID NO: 1328877 - DNA, 16 bp, Homo sapiens
tatgaccttctaggaa

SEQ ID NO: 1328878 - DNA, 18 bp, Homo sapiens
tatgaccttctaggaagc

SEQ ID NO: 1328879 - DNA, 18 bp, Homo sapiens
tatgatgtgggtcaagga

SEQ ID NO: 1328880 - DNA, 13 bp, Homo sapiens
tatggcagtgtct

SEQ ID NO: 1328881 - DNA, 16 bp, Homo sapiens
tatggcagtgtctttc

SEQ ID NO: 1328882 - DNA, 22 bp, Homo sapiens
tatttcaatttccaagagctga

SEQ ID NO: 1328883 - DNA, 17 bp, Homo sapiens
tcaatattttccatgaa

SEQ ID NO: 1328884 - DNA, 11 bp, Homo sapiens
tcacactgaga

SEQ ID NO: 1328885 - DNA, 12 bp, Homo sapiens
tcacactgagaa

SEQ ID NO: 1328886 - DNA, 23 bp, Homo sapiens
tcacactgagaatgtaagaacta

SEQ ID NO: 1328887 - DNA, 22 bp, Homo sapiens
tcacccctggttctcatctttc

SEQ ID NO: 1328888 - DNA, 13 bp, Homo sapiens
tcatctcttagct

SEQ ID NO: 1328889 - DNA, 19 bp, Homo sapiens
tcatctcttagctcccctc

SEQ ID NO: 1328890 - DNA, 17 bp, Homo sapiens
tcatctgctctccttcc

SEQ ID NO: 1328891 - DNA, 18 bp, Homo sapiens
tcatctgctctccttcct

SEQ ID NO: 1328892 - DNA, 21 bp, Homo sapiens
tcatttcacccctccctttct

SEQ ID NO: 1328893 - DNA, 13 bp, Homo sapiens
tcatttttttcca

SEQ ID NO: 1328894 - DNA, 20 bp, Homo sapiens
tccaaccccccagcactgag

SEQ ID NO: 1328895 - DNA, 18 bp, Homo sapiens
tccactttcagtgaaagc

SEQ ID NO: 1328896 - DNA, 19 bp, Homo sapiens
tccagggctggactgaggc

SEQ ID NO: 1328897 - DNA, 21 bp, Homo sapiens
tccagggctggactgaggcct

SEQ ID NO: 1328898 - DNA, 23 bp, Homo sapiens
tccagggctggactgaggcctga

SEQ ID NO: 1328899 - DNA, 12 bp, Homo sapiens
tccatgaaaatg

SEQ ID NO: 1328900 - DNA, 23 bp, Homo sapiens
tcccagattggctcacactgaga

SEQ ID NO: 1328901 - DNA, 12 bp, Homo sapiens
tcccctccaacc

SEQ ID NO: 1328902 - DNA, 13 bp, Homo sapiens
tcccctccaacct

SEQ ID NO: 1328903 - DNA, 22 bp, Homo sapiens
tcccctccaacctggggggcag

SEQ ID NO: 1328904 - DNA, 12 bp, Homo sapiens
tcccctcctcca

SEQ ID NO: 1328905 - DNA, 18 bp, Homo sapiens
tcccctgcccccaggact

SEQ ID NO: 1328906 - DNA, 16 bp, Homo sapiens
tccccttctctcatct

SEQ ID NO: 1328907 - DNA, 14 bp, Homo sapiens
tccctttctcccct

SEQ ID NO: 1328908 - DNA, 15 bp, Homo sapiens
tccctttctcccctg

SEQ ID NO: 1328909 - DNA, 23 bp, Homo sapiens
tccctttctcccctgcccccagg

SEQ ID NO: 1328910 - DNA, 16 bp, Homo sapiens
tcctccactctccccc

SEQ ID NO: 1328911 - DNA, 16 bp, Homo sapiens
tcctgccgcagagctg

SEQ ID NO: 1328912 - DNA, 14 bp, Homo sapiens
tcgagaactttcat

SEQ ID NO: 1328913 - DNA, 15 bp, Homo sapiens
tcgagaactttcatt

SEQ ID NO: 1328914 - DNA, 16 bp, Homo sapiens
tcgagaactttcattt

SEQ ID NO: 1328915 - DNA, 16 bp, Homo sapiens
tcggatttggggtgga

SEQ ID NO: 1328916 - DNA, 12 bp, Homo sapiens
tctcccccaccc

SEQ ID NO: 1328917 - DNA, 19 bp, Homo sapiens
tctcccccaccccctcccc

SEQ ID NO: 1328918 - DNA, 18 bp, Homo sapiens
cccctggttctcatcttt

SEQ ID NO: 1328919 - DNA, 16 bp, Homo sapiens
ccctccccgccctttt

SEQ ID NO: 1328920 - DNA, 13 bp, Homo sapiens
ccctccctttctc

SEQ ID NO: 1328921 - DNA, 14 bp, Homo sapiens
ccctccctttctcc

SEQ ID NO: 1328922 - DNA, 13 bp, Homo sapiens
ccctcctccactc

SEQ ID NO: 1328923 - DNA, 14 bp, Homo sapiens
ccctcctccactct

SEQ ID NO: 1328924 - DNA, 14 bp, Homo sapiens
ccctgcccccagga

SEQ ID NO: 1328925 - DNA, 17 bp, Homo sapiens
ccctgcccccaggactg

SEQ ID NO: 1328926 - DNA, 15 bp, Homo sapiens
cccttctctcatctc

SEQ ID NO: 1328927 - DNA, 14 bp, Homo sapiens
ccctttctcccctg

SEQ ID NO: 1328928 - DNA, 13 bp, Homo sapiens
ccgcagagctggc

SEQ ID NO: 1328929 - DNA, 15 bp, Homo sapiens
cctcacccctggttc

SEQ ID NO: 1328930 - DNA, 21 bp, Homo sapiens
cctcacccctggttctcatct

SEQ ID NO: 1328931 - DNA, 22 bp, Homo sapiens
cctcacccctggttctcatctt

SEQ ID NO: 1328932 - DNA, 17 bp, Homo sapiens
cctccactctcccccac

SEQ ID NO: 1328933 - DNA, 22 bp, Homo sapiens
cctccactctcccccaccccct

SEQ ID NO: 1328934 - DNA, 21 bp, Homo sapiens
cctccagggctggactgaggc

SEQ ID NO: 1328935 - DNA, 22 bp, Homo sapiens
cctccagggctggactgaggcc

SEQ ID NO: 1328936 - DNA, 23 bp, Homo sapiens
cctccagggctggactgaggcct

SEQ ID NO: 1328937 - DNA, 12 bp, Homo sapiens
cctccctttctc

SEQ ID NO: 1328938 - DNA, 15 bp, Homo sapiens
cctccctttctcccc

SEQ ID NO: 1328939 - DNA, 17 bp, Homo sapiens
cctctgtccccttctct

SEQ ID NO: 1328940 - DNA, 21 bp, Homo sapiens
cctctgtccccttctctcatc

SEQ ID NO: 1328941 - DNA, 22 bp, Homo sapiens
cctgagatttcatctgctctcc

SEQ ID NO: 1328942 - DNA, 16 bp, Homo sapiens
cctgcccattggagag

SEQ ID NO: 1328943 - DNA, 22 bp, Homo sapiens
cctgcccccaggactgggccac

SEQ ID NO: 1328944 - DNA, 13 bp, Homo sapiens
cctgccgcagagc

SEQ ID NO: 1328945 - DNA, 15 bp, Homo sapiens
cctgcctccagggct

SEQ ID NO: 1328946 - DNA, 17 bp, Homo sapiens
cctggagcccagaggag

SEQ ID NO: 1328947 - DNA, 12 bp, Homo sapiens
cctggggggcag

SEQ ID NO: 1328948 - DNA, 13 bp, Homo sapiens
cctggttctcatc

SEQ ID NO: 1328949 - DNA, 14 bp, Homo sapiens
cctggttctcatct

SEQ ID NO: 1328950 - DNA, 14 bp, Homo sapiens
ccttcagccctcac

SEQ ID NO: 1328951 - DNA, 18 bp, Homo sapiens
ccttcagccctcacccct

SEQ ID NO: 1328952 - DNA, 16 bp, Homo sapiens
ccttctctcatctctt

SEQ ID NO: 1328953 - DNA, 14 bp, Homo sapiens
cgcagagctggccg

SEQ ID NO: 1328954 - DNA, 19 bp, Homo sapiens
cgctcctgccgcagagctg

SEQ ID NO: 1328955 - DNA, 20 bp, Homo sapiens
cgctcctgccgcagagctgg

SEQ ID NO: 1328956 - DNA, 16 bp, Homo sapiens
ctacaatttaaagcaa

SEQ ID NO: 1328957 - DNA, 13 bp, Homo sapiens
ctatattgtacac

SEQ ID NO: 1328958 - DNA, 15 bp, Homo sapiens
ctatattgtacacac

SEQ ID NO: 1328959 - DNA, 20 bp, Homo sapiens
ctcacactgagaatgtaaga

SEQ ID NO: 1328960 - DNA, 17 bp, Homo sapiens
ctcatctcttagctccc

SEQ ID NO: 1328961 - DNA, 19 bp, Homo sapiens
ctcatctcttagctcccct

SEQ ID NO: 1328962 - DNA, 17 bp, Homo sapiens
ctcatttcacccctccc

SEQ ID NO: 1328963 - DNA, 19 bp, Homo sapiens
ctcatttcacccctccctt

SEQ ID NO: 1328964 - DNA, 23 bp, Homo sapiens
ctcatttcacccctccctttctc

SEQ ID NO: 1328965 - DNA, 19 bp, Homo sapiens
ctccaaccccccagcactg

SEQ ID NO: 1328966 - DNA, 18 bp, Homo sapiens
ctccacaccattcaggtc

SEQ ID NO: 1328967 - DNA, 20 bp, Homo sapiens
ctccacaccattcaggtctt

SEQ ID NO: 1328968 - DNA, 15 bp, Homo sapiens
ctccactctccccca

SEQ ID NO: 1328969 - DNA, 15 bp, Homo sapiens
ctccagggctggact

SEQ ID NO: 1328970 - DNA, 16 bp, Homo sapiens
ctccagggctggactg

SEQ ID NO: 1328971 - DNA, 18 bp, Homo sapiens
ctccagggctggactgag

SEQ ID NO: 1328972 - DNA, 15 bp, Homo sapiens
ctcccctgcccccag

SEQ ID NO: 1328973 - DNA, 17 bp, Homo sapiens
ctcccctgcccccagga

SEQ ID NO: 1328974 - DNA, 18 bp, Homo sapiens
ctcccctgcccccaggac

SEQ ID NO: 1328975 - DNA, 19 bp, Homo sapiens
ctcccctgcccccaggact

SEQ ID NO: 1328976 - DNA, 20 bp, Homo sapiens
ctcccctgcccccaggactg

SEQ ID NO: 1328977 - DNA, 21 bp, Homo sapiens
ctcccctgcccccaggactgg

SEQ ID NO: 1328978 - DNA, 23 bp, Homo sapiens
ctcccctgcccccaggactgggc

SEQ ID NO: 1328979 - DNA, 18 bp, Homo sapiens
ctcctgccgcagagctgg

SEQ ID NO: 1328980 - DNA, 17 bp, Homo sapiens
ctccttcagccctcacc

SEQ ID NO: 1328981 - DNA, 20 bp, Homo sapiens
ctccttcagccctcacccct

SEQ ID NO: 1328982 - DNA, 20 bp, Homo sapiens
ctccttcctggagcccagag

SEQ ID NO: 1328983 - DNA, 23 bp, Homo sapiens
ctccttcctggagcccagaggag

SEQ ID NO: 1328984 - DNA, 13 bp, Homo sapiens
ctctcccccaccc

SEQ ID NO: 1328985 - DNA, 14 bp, Homo sapiens
ctctgtccccttct

SEQ ID NO: 1328986 - DNA, 17 bp, Homo sapiens
ctctgtccccttctctc

SEQ ID NO: 1328987 - DNA, 23 bp, Homo sapiens
ctctgtccccttctctcatctct

SEQ ID NO: 1328988 - DNA, 19 bp, Homo sapiens
ctcttagctcccctccaac

SEQ ID NO: 1328989 - DNA, 12 bp, Homo sapiens
ctcttctcattt

SEQ ID NO: 1328990 - DNA, 15 bp, Homo sapiens
ctgagatttcatctg

SEQ ID NO: 1328991 - DNA, 18 bp, Homo sapiens
ctgagatttcatctgctc

SEQ ID NO: 1328992 - DNA, 19 bp, Homo sapiens
ctgagatttcatctgctct

SEQ ID NO: 1328993 - DNA, 20 bp, Homo sapiens
ctgagatttcatctgctctc

SEQ ID NO: 1328994 - DNA, 22 bp, Homo sapiens
ctgagatttcatctgctctcct

SEQ ID NO: 1328995 - DNA, 17 bp, Homo sapiens
ctgaggcctgagcgctc

SEQ ID NO: 1328996 - DNA, 22 bp, Homo sapiens
ctgaggcctgagcgctcctgcc

SEQ ID NO: 1328997 - DNA, 15 bp, Homo sapiens
ctgcccccaggactg

SEQ ID NO: 1328998 - DNA, 17 bp, Homo sapiens
ctgcccccaggactggg

SEQ ID NO: 1328999 - DNA, 14 bp, Homo sapiens
ctgccgcagagctg

SEQ ID NO: 1329000 - DNA, 15 bp, Homo sapiens
ctgccgcagagctgg

SEQ ID NO: 1329001 - DNA, 15 bp, Homo sapiens
ctgcctccagggctg

SEQ ID NO: 1329002 - DNA, 16 bp, Homo sapiens
ctgcctccagggctgg

SEQ ID NO: 1329003 - DNA, 19 bp, Homo sapiens
ctgcctccagggctggact

SEQ ID NO: 1329004 - DNA, 18 bp, Homo sapiens
ctgcctttggcagagttc

SEQ ID NO: 1329005 - DNA, 13 bp, Homo sapiens
ctggactgaggcc

SEQ ID NO: 1329006 - DNA, 17 bp, Homo sapiens
ctggagcccagaggagg

SEQ ID NO: 1329007 - DNA, 21 bp, Homo sapiens
ctggagcccagaggagggcag

SEQ ID NO: 1329008 - DNA, 19 bp, Homo sapiens
ctgggatgtttctgtcaca

SEQ ID NO: 1329009 - DNA, 18 bp, Homo sapiens
ctgggccacttctgggtg

SEQ ID NO: 1329010 - DNA, 13 bp, Homo sapiens
ctggggggcagtg

SEQ ID NO: 1329011 - DNA, 14 bp, Homo sapiens
ctggttctcatctt

SEQ ID NO: 1329012 - DNA, 14 bp, Homo sapiens
ctgtccccttctct

SEQ ID NO: 1329013 - DNA, 23 bp, Homo sapiens
ctgtccccttctctcatctctta

SEQ ID NO: 1329014 - DNA, 14 bp, Homo sapiens
cttaaacaaatgta

SEQ ID NO: 1329015 - DNA, 14 bp, Homo sapiens
cttagctcccctcc

SEQ ID NO: 1329016 - DNA, 13 bp, Homo sapiens
cttctaggaagct

SEQ ID NO: 1329017 - DNA, 17 bp, Homo sapiens
cttctcatttcacccct

SEQ ID NO: 1329018 - DNA, 17 bp, Homo sapiens
cttgacagaacactgtc

SEQ ID NO: 1329019 - DNA, 21 bp, Homo sapiens
cttggaaactggatgaggtca

SEQ ID NO: 1329020 - DNA, 17 bp, Homo sapiens
ctttcagtgaaagcatc

SEQ ID NO: 1329021 - DNA, 21 bp, Homo sapiens
ctttcttgatcaacatctttt

SEQ ID NO: 1329022 - DNA, 13 bp, Homo sapiens
ctttgattctcct

SEQ ID NO: 1329023 - DNA, 19 bp, Homo sapiens
ctttgattctccttcagcc

SEQ ID NO: 1329024 - DNA, 18 bp, Homo sapiens
gaaaatgcaacaacatgt

SEQ ID NO: 1329025 - DNA, 16 bp, Homo sapiens
gaaagacagagctggg

SEQ ID NO: 1329026 - DNA, 19 bp, Homo sapiens
gaacggggctcttctcatt

SEQ ID NO: 1329027 - DNA, 14 bp, Homo sapiens
gaactttcattttt

SEQ ID NO: 1329028 - DNA, 20 bp, Homo sapiens
gaagaacggggctcttctca

SEQ ID NO: 1329029 - DNA, 21 bp, Homo sapiens
gaagagagtccatatttcaat

SEQ ID NO: 1329030 - DNA, 18 bp, Homo sapiens
gaagccacaggcctgaga

SEQ ID NO: 1329031 - DNA, 15 bp, Homo sapiens
gacagaacactgtct

SEQ ID NO: 1329032 - DNA, 19 bp, Homo sapiens
gactcgagaactttcattt

SEQ ID NO: 1329033 - DNA, 13 bp, Homo sapiens
gactgaggcctga

SEQ ID NO: 1329034 - DNA, 16 bp, Homo sapiens
gacttgacagaacact

SEQ ID NO: 1329035 - DNA, 13 bp, Homo sapiens
gagaagccacagg

SEQ ID NO: 1329036 - DNA, 18 bp, Homo sapiens
gagaagccacaggcctga

SEQ ID NO: 1329037 - DNA, 19 bp, Homo sapiens
gagacagcttgatcaaagg

SEQ ID NO: 1329038 - DNA, 20 bp, Homo sapiens
gagactcgagaactttcatt

SEQ ID NO: 1329039 - DNA, 21 bp, Homo sapiens
gagatttcatctgctctcctt

SEQ ID NO: 1329040 - DNA, 21 bp, Homo sapiens
gagcgctcctgccgcagagct

SEQ ID NO: 1329041 - DNA, 22 bp, Homo sapiens
tctcccctgcccccaggactgg

SEQ ID NO: 1329042 - DNA, 15 bp, Homo sapiens
tctccttcagccctc

SEQ ID NO: 1329043 - DNA, 19 bp, Homo sapiens
tctccttcagccctcaccc

SEQ ID NO: 1329044 - DNA, 19 bp, Homo sapiens
tctctgtgagactcgagaa

SEQ ID NO: 1329045 - DNA, 22 bp, Homo sapiens
tctctgtgagactcgagaactt

SEQ ID NO: 1329046 - DNA, 19 bp, Homo sapiens
tctgtccccttctctcatc

SEQ ID NO: 1329047 - DNA, 17 bp, Homo sapiens
tcttaaacaaatgtatg

SEQ ID NO: 1329048 - DNA, 14 bp, Homo sapiens
tcttacaaacatgt

SEQ ID NO: 1329049 - DNA, 16 bp, Homo sapiens
tcttagctcccctcca

SEQ ID NO: 1329050 - DNA, 18 bp, Homo sapiens
tcttctcatttcacccct

SEQ ID NO: 1329051 - DNA, 19 bp, Homo sapiens
tcttctcatttcacccctc

SEQ ID NO: 1329052 - DNA, 20 bp, Homo sapiens
tcttgatcaacatcttttct

SEQ ID NO: 1329053 - DNA, 16 bp, Homo sapiens
tcttgcctctgtcccc

SEQ ID NO: 1329054 - DNA, 21 bp, Homo sapiens
tcttgcctctgtccccttctc

SEQ ID NO: 1329055 - DNA, 20 bp, Homo sapiens
tctttgattctccttcagcc

SEQ ID NO: 1329056 - DNA, 23 bp, Homo sapiens
tctttgattctccttcagccctc

SEQ ID NO: 1329057 - DNA, 18 bp, Homo sapiens
tgaaaatgcaacaacatg

SEQ ID NO: 1329058 - DNA, 14 bp, Homo sapiens
tgaaaattaacact

SEQ ID NO: 1329059 - DNA, 18 bp, Homo sapiens
tgaaaattaacactgctt

SEQ ID NO: 1329060 - DNA, 16 bp, Homo sapiens
tgacagaacactgtct

SEQ ID NO: 1329061 - DNA, 21 bp, Homo sapiens
tgacagaacactgtcttgaag

SEQ ID NO: 1329062 - DNA, 17 bp, Homo sapiens
tgaccttctaggaagct

SEQ ID NO: 1329063 - DNA, 15 bp, Homo sapiens
tgagaatgtaagaac

SEQ ID NO: 1329064 - DNA, 17 bp, Homo sapiens
tgagactcgagaacttt

SEQ ID NO: 1329065 - DNA, 18 bp, Homo sapiens
tgagatccttccttttga

SEQ ID NO: 1329066 - DNA, 22 bp, Homo sapiens
tgagcgctcctgccgcagagct

SEQ ID NO: 1329067 - DNA, 24 bp, Homo sapiens
tgaggaagaacggggctcttctca

SEQ ID NO: 1329068 - DNA, 23 bp, Homo sapiens
tgagttgacttgacagaacactg

SEQ ID NO: 1329069 - DNA, 14 bp, Homo sapiens
tgattctccttcag

SEQ ID NO: 1329070 - DNA, 16 bp, Homo sapiens
tgattctccttcagcc

SEQ ID NO: 1329071 - DNA, 13 bp, Homo sapiens
tgcaacaacatgt

SEQ ID NO: 1329072 - DNA, 17 bp, Homo sapiens
tgcatagagccacgtat

SEQ ID NO: 1329073 - DNA, 18 bp, Homo sapiens
tgcatgaaggtttctgaa

SEQ ID NO: 1329074 - DNA, 21 bp, Homo sapiens
tgcatgaaggtttctgaaaat

SEQ ID NO: 1329075 - DNA, 12 bp, Homo sapiens
tgcccccaggac

SEQ ID NO: 1329076 - DNA, 19 bp, Homo sapiens
tgcccccaggactgggcca

SEQ ID NO: 1329077 - DNA, 15 bp, Homo sapiens
tgccgcagagctggc

SEQ ID NO: 1329078 - DNA, 17 bp, Homo sapiens
tgccgcagagctggccg

SEQ ID NO: 1329079 - DNA, 12 bp, Homo sapiens
tgcctccagggc

SEQ ID NO: 1329080 - DNA, 19 bp, Homo sapiens
tgcctccagggctggactg

SEQ ID NO: 1329081 - DNA, 13 bp, Homo sapiens
tgcctctgtcccc

SEQ ID NO: 1329082 - DNA, 20 bp, Homo sapiens
tgcctctgtccccttctctc

SEQ ID NO: 1329083 - DNA, 17 bp, Homo sapiens
tgcctttggcagagttc

SEQ ID NO: 1329084 - DNA, 20 bp, Homo sapiens
tgctaactagcttggaaact

SEQ ID NO: 1329085 - DNA, 17 bp, Homo sapiens
tgctctccttcctggag

SEQ ID NO: 1329086 - DNA, 18 bp, Homo sapiens
tgctctccttcctggagc

SEQ ID NO: 1329087 - DNA, 19 bp, Homo sapiens
tggagaagccacaggcctg

SEQ ID NO: 1329088 - DNA, 20 bp, Homo sapiens
tggagaagccacaggcctga

SEQ ID NO: 1329089 - DNA, 21 bp, Homo sapiens
tggagaagccacaggcctgag

SEQ ID NO: 1329090 - DNA, 22 bp, Homo sapiens
tggagaagccacaggcctgaga

SEQ ID NO: 1329091 - DNA, 15 bp, Homo sapiens
tggagcccagaggag

SEQ ID NO: 1329092 - DNA, 19 bp, Homo sapiens
tggagcccagaggagggca

SEQ ID NO: 1329093 - DNA, 20 bp, Homo sapiens
tggagcccagaggagggcag

SEQ ID NO: 1329094 - DNA, 19 bp, Homo sapiens
tggaggagctcaggacact

SEQ ID NO: 1329095 - DNA, 22 bp, Homo sapiens
tggaggagctcaggacactaat

SEQ ID NO: 1329096 - DNA, 22 bp, Homo sapiens
tggattttggttttgttcccct

SEQ ID NO: 1329097 - DNA, 20 bp, Homo sapiens
tggcacagcccaaagaagga

SEQ ID NO: 1329098 - DNA, 14 bp, Homo sapiens
tggctttaatgaat

SEQ ID NO: 1329099 - DNA, 22 bp, Homo sapiens
tgggccacttctgggtggggca

SEQ ID NO: 1329100 - DNA, 21 bp, Homo sapiens
tgggggcggggtgggaaagat

SEQ ID NO: 1329101 - DNA, 13 bp, Homo sapiens
tgggtcaaggaat

SEQ ID NO: 1329102 - DNA, 19 bp, Homo sapiens
tggtgtctccaacccccca

SEQ ID NO: 1329103 - DNA, 20 bp, Homo sapiens
tggtgtctccaaccccccag

SEQ ID NO: 1329104 - DNA, 11 bp, Homo sapiens
tggttctcatc

SEQ ID NO: 1329105 - DNA, 17 bp, Homo sapiens
tggtttgcaaggaagcc

SEQ ID NO: 1329106 - DNA, 16 bp, Homo sapiens
tggttttgttcccctc

SEQ ID NO: 1329107 - DNA, 12 bp, Homo sapiens
tgtactacaatt

SEQ ID NO: 1329108 - DNA, 15 bp, Homo sapiens
tgtataatattttta

SEQ ID NO: 1329109 - DNA, 11 bp, Homo sapiens
tgtccccttct

SEQ ID NO: 1329110 - DNA, 21 bp, Homo sapiens
tgtctccaaccccccagcact

SEQ ID NO: 1329111 - DNA, 23 bp, Homo sapiens
tgtctccaaccccccagcactga

SEQ ID NO: 1329112 - DNA, 13 bp, Homo sapiens
tgtctctgtgaga

SEQ ID NO: 1329113 - DNA, 19 bp, Homo sapiens
tgtgcatagagccacgtat

SEQ ID NO: 1329114 - DNA, 15 bp, Homo sapiens
tgtgggtcaaggaat

SEQ ID NO: 1329115 - DNA, 14 bp, Homo sapiens
tgtggttaatgcca

SEQ ID NO: 1329116 - DNA, 15 bp, Homo sapiens
tgtggttaatgccat

SEQ ID NO: 1329117 - DNA, 13 bp, Homo sapiens
tgttcccctcctc

SEQ ID NO: 1329118 - DNA, 23 bp, Homo sapiens
tgttcccctcctccactctcccc

SEQ ID NO: 1329119 - DNA, 14 bp, Homo sapiens
tgttgacatgtgct

SEQ ID NO: 1329120 - DNA, 22 bp, Homo sapiens
ttaaacaaatgtatgattacat

SEQ ID NO: 1329121 - DNA, 14 bp, Homo sapiens
ttaaagcaaaggag

SEQ ID NO: 1329122 - DNA, 19 bp, Homo sapiens
ttatttcttaaacaaatgt

SEQ ID NO: 1329123 - DNA, 17 bp, Homo sapiens
ttcaatttccaagagct

SEQ ID NO: 1329124 - DNA, 12 bp, Homo sapiens
ttcagccctcac

SEQ ID NO: 1329125 - DNA, 13 bp, Homo sapiens
ttcatctgctctc

SEQ ID NO: 1329126 - DNA, 12 bp, Homo sapiens
ttccaagagctg

SEQ ID NO: 1329127 - DNA, 15 bp, Homo sapiens
ttccatgaaaatgca

SEQ ID NO: 1329128 - DNA, 15 bp, Homo sapiens
ttcctggagcccaga

SEQ ID NO: 1329129 - DNA, 21 bp, Homo sapiens
ttcgatgggcccaattcttac

SEQ ID NO: 1329130 - DNA, 18 bp, Homo sapiens
ttctcatctttcttgatc

SEQ ID NO: 1329131 - DNA, 15 bp, Homo sapiens
ttctcatttcacccc

SEQ ID NO: 1329132 - DNA, 19 bp, Homo sapiens
ttctcatttcacccctccc

SEQ ID NO: 1329133 - DNA, 16 bp, Homo sapiens
ttctcccctgccccca

SEQ ID NO: 1329134 - DNA, 19 bp, Homo sapiens
ttctcccctgcccccagga

SEQ ID NO: 1329135 - DNA, 22 bp, Homo sapiens
ttctcccctgcccccaggactg

SEQ ID NO: 1329136 - DNA, 20 bp, Homo sapiens
ttctccttcagccctcaccc

SEQ ID NO: 1329137 - DNA, 20 bp, Homo sapiens
ttctctcatctcttagctcc

SEQ ID NO: 1329138 - DNA, 23 bp, Homo sapiens
ttctctcatctcttagctcccct

SEQ ID NO: 1329139 - DNA, 15 bp, Homo sapiens
ttgacagaacactgt

SEQ ID NO: 1329140 - DNA, 22 bp, Homo sapiens
ttgatcaacatcttttcttgcc

SEQ ID NO: 1329141 - DNA, 13 bp, Homo sapiens
ttgattctccttc

SEQ ID NO: 1329142 - DNA, 20 bp, Homo sapiens
ttgattctccttcagccctc

SEQ ID NO: 1329143 - DNA, 13 bp, Homo sapiens
ttgcaaggaagcc

SEQ ID NO: 1329144 - DNA, 18 bp, Homo sapiens
ttgcctctgtccccttct

SEQ ID NO: 1329145 - DNA, 13 bp, Homo sapiens
ttgggattaatat

SEQ ID NO: 1329146 - DNA, 14 bp, Homo sapiens
ttggttttgttccc

SEQ ID NO: 1329147 - DNA, 18 bp, Homo sapiens
ttggttttgttcccctcc

SEQ ID NO: 1329148 - DNA, 19 bp, Homo sapiens
ttgtacacaccttatattt

SEQ ID NO: 1329149 - DNA, 22 bp, Homo sapiens
ttgtggaggagctcaggacact

SEQ ID NO: 1329150 - DNA, 13 bp, Homo sapiens
ttgttcccctcct

SEQ ID NO: 1329151 - DNA, 16 bp, Homo sapiens
ttgttcccctcctcca

SEQ ID NO: 1329152 - DNA, 18 bp, Homo sapiens
tttatctttgattctcct

SEQ ID NO: 1329153 - DNA, 20 bp, Homo sapiens
tttatttgtttgtgcatttg

SEQ ID NO: 1329154 - DNA, 19 bp, Homo sapiens
tttcaatttccaagagctg

SEQ ID NO: 1329155 - DNA, 13 bp, Homo sapiens
tttcacccctccc

SEQ ID NO: 1329156 - DNA, 14 bp, Homo sapiens
tttcacccctccct

SEQ ID NO: 1329157 - DNA, 17 bp, Homo sapiens
tttcacccctccctttc

SEQ ID NO: 1329158 - DNA, 18 bp, Homo sapiens
tttcacccctccctttct

SEQ ID NO: 1329159 - DNA, 16 bp, Homo sapiens
tttcatctgctctcct

SEQ ID NO: 1329160 - DNA, 17 bp, Homo sapiens
tttcatctgctctcctt

SEQ ID NO: 1329161 - DNA, 18 bp, Homo sapiens
tttcatctgctctccttc

SEQ ID NO: 1329162 - DNA, 19 bp, Homo sapiens
tttcatctgctctccttcc

SEQ ID NO: 1329163 - DNA, 14 bp, Homo sapiens
tttccaagagctga

SEQ ID NO: 1329164 - DNA, 15 bp, Homo sapiens
tttccaggctggttc

SEQ ID NO: 1329165 - DNA, 22 bp, Homo sapiens
tttccaggctggttcggatttg

SEQ ID NO: 1329166 - DNA, 19 bp, Homo sapiens
tttctgaaaattaacactg

SEQ ID NO: 1329167 - DNA, 17 bp, Homo sapiens
tttgaatataaacacta

SEQ ID NO: 1329168 - DNA, 19 bp, Homo sapiens
tttgacgggaaacaaaact

SEQ ID NO: 1329169 - DNA, 14 bp, Homo sapiens
tttgattctccttc

SEQ ID NO: 1329170 - DNA, 16 bp, Homo sapiens
tttgattctccttcag

SEQ ID NO: 1329171 - DNA, 14 bp, Homo sapiens
tttgcaaggaagcc

SEQ ID NO: 1329172 - DNA, 13 bp, Homo sapiens
tttgttcccctcc

SEQ ID NO: 1329173 - DNA, 19 bp, Homo sapiens
tttgttcccctcctccact

SEQ ID NO: 1329174 - DNA, 13 bp, Homo sapiens
tttgtttgtgcat

SEQ ID NO: 1329175 - DNA, 18 bp, Homo sapiens
ttttccatgaaaatgcaa

SEQ ID NO: 1329176 - DNA, 22 bp, Homo sapiens
tttttaactcaatattttccat

SEQ ID NO: 1329177 - DNA, 15 bp, Homo sapiens
tttttgtgtatttgt

SEQ ID NO: 1329178 - DNA, 15 bp, Homo sapiens
actcaatattttcca

SEQ ID NO: 1329179 - DNA, 17 bp, Homo sapiens
actcgagaactttcatt

SEQ ID NO: 1329180 - DNA, 20 bp, Homo sapiens
actgagatccttccttttga

SEQ ID NO: 1329181 - DNA, 22 bp, Homo sapiens
actgaggaagaacggggctctt

SEQ ID NO: 1329182 - DNA, 14 bp, Homo sapiens
actggtattttatc

SEQ ID NO: 1329183 - DNA, 15 bp, Homo sapiens
actttttctttatgt

SEQ ID NO: 1329184 - DNA, 23 bp, Homo sapiens
acttttttgctatccagctattt

SEQ ID NO: 1329185 - DNA, 19 bp, Homo sapiens
agaacggggctcttctcat

SEQ ID NO: 1329186 - DNA, 18 bp, Homo sapiens
agaactacaaacaaaatt

SEQ ID NO: 1329187 - DNA, 15 bp, Homo sapiens
agaactttcattttt

SEQ ID NO: 1329188 - DNA, 16 bp, Homo sapiens
agaactttcatttttt

SEQ ID NO: 1329189 - DNA, 13 bp, Homo sapiens
agaagaaggcagc

SEQ ID NO: 1329190 - DNA, 22 bp, Homo sapiens
agaagagagtccatatttcaat

SEQ ID NO: 1329191 - DNA, 17 bp, Homo sapiens
agaagccacaggcctga

SEQ ID NO: 1329192 - DNA, 15 bp, Homo sapiens
agaatgtaagaacta

SEQ ID NO: 1329193 - DNA, 16 bp, Homo sapiens
agaatgtaagaactac

SEQ ID NO: 1329194 - DNA, 14 bp, Homo sapiens
agactcgagaactt

SEQ ID NO: 1329195 - DNA, 15 bp, Homo sapiens
agactcgagaacttt

SEQ ID NO: 1329196 - DNA, 21 bp, Homo sapiens
agaggcctgcctccagggctg

SEQ ID NO: 1329197 - DNA, 19 bp, Homo sapiens
agattggctcacactgaga

SEQ ID NO: 1329198 - DNA, 23 bp, Homo sapiens
agattggctcacactgagaatgt

SEQ ID NO: 1329199 - DNA, 23 bp, Homo sapiens
agatttcatctgctctccttcct

SEQ ID NO: 1329200 - DNA, 23 bp, Homo sapiens
agcaaaggagtagaaagacagag

SEQ ID NO: 1329201 - DNA, 14 bp, Homo sapiens
agcactgaggaaga

SEQ ID NO: 1329202 - DNA, 23 bp, Homo sapiens
agcagaagggggtggtgtctcca

SEQ ID NO: 1329203 - DNA, 17 bp, Homo sapiens
agcatcacttgggatta

SEQ ID NO: 1329204 - DNA, 13 bp, Homo sapiens
agccacagctggt

SEQ ID NO: 1329205 - DNA, 16 bp, Homo sapiens
agccacaggcctgaga

SEQ ID NO: 1329206 - DNA, 23 bp, Homo sapiens
agccctcacccctggttctcatc

SEQ ID NO: 1329207 - DNA, 17 bp, Homo sapiens
agcccttgcattgcaga

SEQ ID NO: 1329208 - DNA, 17 bp, Homo sapiens
agcgctcctgccgcaga

SEQ ID NO: 1329209 - DNA, 13 bp, Homo sapiens
agctccagttcga

SEQ ID NO: 1329210 - DNA, 15 bp, Homo sapiens
aggaagccacagctg

SEQ ID NO: 1329211 - DNA, 16 bp, Homo sapiens
aggaagccacagctgg

SEQ ID NO: 1329212 - DNA, 18 bp, Homo sapiens
aggaagccacagctggtg

SEQ ID NO: 1329213 - DNA, 20 bp, Homo sapiens
aggcctgagatttcatctgc

SEQ ID NO: 1329214 - DNA, 21 bp, Homo sapiens
aggcctgagatttcatctgct

SEQ ID NO: 1329215 - DNA, 23 bp, Homo sapiens
aggcctgagatttcatctgctct

SEQ ID NO: 1329216 - DNA, 19 bp, Homo sapiens
aggcctgagcgctcctgcc

SEQ ID NO: 1329217 - DNA, 17 bp, Homo sapiens
aggcctgcctccagggc

SEQ ID NO: 1329218 - DNA, 21 bp, Homo sapiens
aggcctgcctccagggctgga

SEQ ID NO: 1329219 - DNA, 21 bp, Homo sapiens
aggctaaagcccagagacagc

SEQ ID NO: 1329220 - DNA, 13 bp, Homo sapiens
agggaagttttgt

SEQ ID NO: 1329221 - DNA, 21 bp, Homo sapiens
agggagcaagtccttcccttt

SEQ ID NO: 1329222 - DNA, 15 bp, Homo sapiens
agggcagcagaaggg

SEQ ID NO: 1329223 - DNA, 16 bp, Homo sapiens
agggctggactgaggc

SEQ ID NO: 1329224 - DNA, 17 bp, Homo sapiens
agggctggactgaggcc

SEQ ID NO: 1329225 - DNA, 20 bp, Homo sapiens
aggtatgaccttctaggaag

SEQ ID NO: 1329226 - DNA, 23 bp, Homo sapiens
aggtatgaccttctaggaagctc

SEQ ID NO: 1329227 - DNA, 19 bp, Homo sapiens
agtacaccacaagggtcac

SEQ ID NO: 1329228 - DNA, 19 bp, Homo sapiens
ataatgtaaacaatatcag

SEQ ID NO: 1329229 - DNA, 15 bp, Homo sapiens
ataatgtctctgtga

SEQ ID NO: 1329230 - DNA, 15 bp, Homo sapiens
atactgttgtgcgca

SEQ ID NO: 1329231 - DNA, 13 bp, Homo sapiens
atatattttaatt

SEQ ID NO: 1329232 - DNA, 16 bp, Homo sapiens
atattttccatgaaaa

SEQ ID NO: 1329233 - DNA, 15 bp, Homo sapiens
atatttttaattaaa

SEQ ID NO: 1329234 - DNA, 18 bp, Homo sapiens
atcagctccactttcagt

SEQ ID NO: 1329235 - DNA, 18 bp, Homo sapiens
atctcttagctcccctcc

SEQ ID NO: 1329236 - DNA, 19 bp, Homo sapiens
atctcttagctcccctcca

SEQ ID NO: 1329237 - DNA, 18 bp, Homo sapiens
atctttcttgatcaacat

SEQ ID NO: 1329238 - DNA, 17 bp, Homo sapiens
atctttgattctccttc

SEQ ID NO: 1329239 - DNA, 20 bp, Homo sapiens
atctttgattctccttcagc

SEQ ID NO: 1329240 - DNA, 17 bp, Homo sapiens
atgaaggtttctgaaaa

SEQ ID NO: 1329241 - DNA, 17 bp, Homo sapiens
atgagtggctttaatga

SEQ ID NO: 1329242 - DNA, 19 bp, Homo sapiens
atgatgtgggtcaaggaat

SEQ ID NO: 1329243 - DNA, 17 bp, Homo sapiens
atgccatggacagaaga

SEQ ID NO: 1329244 - DNA, 18 bp, Homo sapiens
atgccatggacagaagaa

SEQ ID NO: 1329245 - DNA, 19 bp, Homo sapiens
atggacagaagaaggcagc

SEQ ID NO: 1329246 - DNA, 21 bp, Homo sapiens
atggtttgaatataaacacta

SEQ ID NO: 1329247 - DNA, 23 bp, Homo sapiens
atgtataatatttttaattaaat

SEQ ID NO: 1329248 - DNA, 23 bp, Homo sapiens
atgtctctgtgagactcgagaac

SEQ ID NO: 1329249 - DNA, 17 bp, Homo sapiens
atgtttttgtgtatttg

SEQ ID NO: 1329250 - DNA, 17 bp, Homo sapiens
attctccttcagccctc

SEQ ID NO: 1329251 - DNA, 23 bp, Homo sapiens
attctccttcagccctcacccct

SEQ ID NO: 1329252 - DNA, 21 bp, Homo sapiens
attcttacaaacatgtggtta

SEQ ID NO: 1329253 - DNA, 16 bp, Homo sapiens
attggctcacactgag

SEQ ID NO: 1329254 - DNA, 20 bp, Homo sapiens
atttcacccctccctttctc

SEQ ID NO: 1329255 - DNA, 15 bp, Homo sapiens
atttcatctgctctc

SEQ ID NO: 1329256 - DNA, 18 bp, Homo sapiens
atttcatctgctctcctt

SEQ ID NO: 1329257 - DNA, 20 bp, Homo sapiens
atttcatctgctctccttcc

SEQ ID NO: 1329258 - DNA, 16 bp, Homo sapiens
atttccaagagctgag

SEQ ID NO: 1329259 - DNA, 13 bp, Homo sapiens
atttcttaaacaa

SEQ ID NO: 1329260 - DNA, 21 bp, Homo sapiens
atttcttaaacaaatgtatga

SEQ ID NO: 1329261 - DNA, 12 bp, Homo sapiens
atttgttaatgg

SEQ ID NO: 1329262 - DNA, 20 bp, Homo sapiens
attttatctttgattctcct

SEQ ID NO: 1329263 - DNA, 14 bp, Homo sapiens
caaaatttctatta

SEQ ID NO: 1329264 - DNA, 15 bp, Homo sapiens
caaacaaaatttcta

SEQ ID NO: 1329265 - DNA, 20 bp, Homo sapiens
caaacatgtggttaatgcca

SEQ ID NO: 1329266 - DNA, 23 bp, Homo sapiens
caaataatgtctctgtgagactc

SEQ ID NO: 1329267 - DNA, 22 bp, Homo sapiens
caacaacatgtataatattttt

SEQ ID NO: 1329268 - DNA, 13 bp, Homo sapiens
caacatgtataat

SEQ ID NO: 1329269 - DNA, 17 bp, Homo sapiens
caacatgtataatattt

SEQ ID NO: 1329270 - DNA, 23 bp, Homo sapiens
caacatgtataatatttttaatt

SEQ ID NO: 1329271 - DNA, 20 bp, Homo sapiens
caaccccccagcactgagga

SEQ ID NO: 1329272 - DNA, 12 bp, Homo sapiens
caagagctgagg

SEQ ID NO: 1329273 - DNA, 11 bp, Homo sapiens
caatattttcc

SEQ ID NO: 1329274 - DNA, 19 bp, Homo sapiens
caatattttccatgaaaat

SEQ ID NO: 1329275 - DNA, 20 bp, Homo sapiens
caatattttccatgaaaatg

SEQ ID NO: 1329276 - DNA, 18 bp, Homo sapiens
caatggcttactccagga

SEQ ID NO: 1329277 - DNA, 13 bp, Homo sapiens
caatggtttgcaa

SEQ ID NO: 1329278 - DNA, 19 bp, Homo sapiens
caattcttacaaacatgtg

SEQ ID NO: 1329279 - DNA, 13 bp, Homo sapiens
caatttaaagcaa

SEQ ID NO: 1329280 - DNA, 20 bp, Homo sapiens
cacaggcctgagatttcatc

SEQ ID NO: 1329281 - DNA, 23 bp, Homo sapiens
cacaggcctgagatttcatctgc

SEQ ID NO: 1329282 - DNA, 21 bp, Homo sapiens
tgaaaatgcaacaacatgtat

SEQ ID NO: 1329283 - DNA, 16 bp, Homo sapiens
tgaaaattaacactgc

SEQ ID NO: 1329284 - DNA, 15 bp, Homo sapiens
tgacagaacactgtc

SEQ ID NO: 1329285 - DNA, 12 bp, Homo sapiens
tgagactcgaga

SEQ ID NO: 1329286 - DNA, 16 bp, Homo sapiens
tgagactcgagaactt

SEQ ID NO: 1329287 - DNA, 19 bp, Homo sapiens
tgagatttcatctgctctc

SEQ ID NO: 1329288 - DNA, 21 bp, Homo sapiens
tgagatttcatctgctctcct

SEQ ID NO: 1329289 - DNA, 22 bp, Homo sapiens
tgagatttcatctgctctcctt

SEQ ID NO: 1329290 - DNA, 18 bp, Homo sapiens
tgagcgctcctgccgcag

SEQ ID NO: 1329291 - DNA, 14 bp, Homo sapiens
tgatcaacatcttt

SEQ ID NO: 1329292 - DNA, 21 bp, Homo sapiens
tgatcaacatcttttcttgcc

SEQ ID NO: 1329293 - DNA, 23 bp, Homo sapiens
tgatcaacatcttttcttgcctc

SEQ ID NO: 1329294 - DNA, 12 bp, Homo sapiens
tgattctccttc

SEQ ID NO: 1329295 - DNA, 21 bp, Homo sapiens
tgattctccttcagccctcac

SEQ ID NO: 1329296 - DNA, 17 bp, Homo sapiens
tgcatatatacatatat

SEQ ID NO: 1329297 - DNA, 15 bp, Homo sapiens
tgcccccaggactgg

SEQ ID NO: 1329298 - DNA, 17 bp, Homo sapiens
tgcccccaggactgggc

SEQ ID NO: 1329299 - DNA, 13 bp, Homo sapiens
tgccgcagagctg

SEQ ID NO: 1329300 - DNA, 14 bp, Homo sapiens
tgcctccagggctg

SEQ ID NO: 1329301 - DNA, 17 bp, Homo sapiens
tgcctctgtccccttct

SEQ ID NO: 1329302 - DNA, 22 bp, Homo sapiens
tgctaactagcttggaaactgg

SEQ ID NO: 1329303 - DNA, 12 bp, Homo sapiens
tgctctccttcc

SEQ ID NO: 1329304 - DNA, 21 bp, Homo sapiens
tggaaactggatgaggtcata

SEQ ID NO: 1329305 - DNA, 12 bp, Homo sapiens
tggacagaagaa

SEQ ID NO: 1329306 - DNA, 11 bp, Homo sapiens
tggactgaggc

SEQ ID NO: 1329307 - DNA, 14 bp, Homo sapiens
tggactgaggcctg

SEQ ID NO: 1329308 - DNA, 23 bp, Homo sapiens
tggagaagccacaggcctgagat

SEQ ID NO: 1329309 - DNA, 22 bp, Homo sapiens
tggcagaatggggtgcatgaag

SEQ ID NO: 1329310 - DNA, 14 bp, Homo sapiens
tggctcacactgag

SEQ ID NO: 1329311 - DNA, 15 bp, Homo sapiens
tggctcacactgaga

SEQ ID NO: 1329312 - DNA, 16 bp, Homo sapiens
tggctcacactgagaa

SEQ ID NO: 1329313 - DNA, 15 bp, Homo sapiens
tggtttgcaaggaag

SEQ ID NO: 1329314 - DNA, 17 bp, Homo sapiens
tggttttgttcccctcc

SEQ ID NO: 1329315 - DNA, 18 bp, Homo sapiens
tgtaagaactacaaacaa

SEQ ID NO: 1329316 - DNA, 18 bp, Homo sapiens
tgtatttgttaatggttt

SEQ ID NO: 1329317 - DNA, 16 bp, Homo sapiens
tgtccccttctctcat

SEQ ID NO: 1329318 - DNA, 20 bp, Homo sapiens
tgtccccttctctcatctct

SEQ ID NO: 1329319 - DNA, 16 bp, Homo sapiens
tgtctccaacccccca

SEQ ID NO: 1329320 - DNA, 17 bp, Homo sapiens
tgtctccaaccccccag

SEQ ID NO: 1329321 - DNA, 22 bp, Homo sapiens
tgtctccaaccccccagcactg

SEQ ID NO: 1329322 - DNA, 15 bp, Homo sapiens
tgttcccctcctcca

SEQ ID NO: 1329323 - DNA, 19 bp, Homo sapiens
tgttcccctcctccactct

SEQ ID NO: 1329324 - DNA, 12 bp, Homo sapiens
tgtttttaactc

SEQ ID NO: 1329325 - DNA, 20 bp, Homo sapiens
ttaaactaaggccctcttga

SEQ ID NO: 1329326 - DNA, 16 bp, Homo sapiens
ttaaattttgtgtctc

SEQ ID NO: 1329327 - DNA, 22 bp, Homo sapiens
ttaatatggggatgcagcatta

SEQ ID NO: 1329328 - DNA, 12 bp, Homo sapiens
ttacaaacatgt

SEQ ID NO: 1329329 - DNA, 20 bp, Homo sapiens
taaactggtattttatcttt

SEQ ID NO: 1329330 - DNA, 15 bp, Homo sapiens
taactagcttggaaa

SEQ ID NO: 1329331 - DNA, 21 bp, Homo sapiens
taagaactacaaacaaaattt

SEQ ID NO: 1329332 - DNA, 19 bp, Homo sapiens
taatataaagttggatgcg

SEQ ID NO: 1329333 - DNA, 16 bp, Homo sapiens
taatatggggatgcag

SEQ ID NO: 1329334 - DNA, 15 bp, Homo sapiens
taatggtttgaatat

SEQ ID NO: 1329335 - DNA, 11 bp, Homo sapiens
taatgtctctg

SEQ ID NO: 1329336 - DNA, 22 bp, Homo sapiens
taatttgatagtattgtgcata

SEQ ID NO: 1329337 - DNA, 18 bp, Homo sapiens
tacaaacaaaatttctat

SEQ ID NO: 1329338 - DNA, 17 bp, Homo sapiens
tacaaacatgtggttaa

SEQ ID NO: 1329339 - DNA, 14 bp, Homo sapiens
tacccgcagagttc

SEQ ID NO: 1329340 - DNA, 13 bp, Homo sapiens
tacgtatgagacg

SEQ ID NO: 1329341 - DNA, 14 bp, Homo sapiens
tatatattttaatt

SEQ ID NO: 1329342 - DNA, 18 bp, Homo sapiens
tatgtttttgtgtatttg

SEQ ID NO: 1329343 - DNA, 19 bp, Homo sapiens
tattaaattaaattttgtg

SEQ ID NO: 1329344 - DNA, 21 bp, Homo sapiens
tattaaattaaattttgtgtc

SEQ ID NO: 1329345 - DNA, 20 bp, Homo sapiens
tatttgttaatggtttgaat

SEQ ID NO: 1329346 - DNA, 23 bp, Homo sapiens
tattttatctttgattctccttc

SEQ ID NO: 1329347 - DNA, 20 bp, Homo sapiens
tattttccatgaaaatgcaa

SEQ ID NO: 1329348 - DNA, 13 bp, Homo sapiens
tatttttatttgt

SEQ ID NO: 1329349 - DNA, 12 bp, Homo sapiens
tcaacatctttt

SEQ ID NO: 1329350 - DNA, 18 bp, Homo sapiens
tcaatattttccatgaaa

SEQ ID NO: 1329351 - DNA, 19 bp, Homo sapiens
tcaatggtttgcaaggaag

SEQ ID NO: 1329352 - DNA, 13 bp, Homo sapiens
tcaatttccaaga

SEQ ID NO: 1329353 - DNA, 18 bp, Homo sapiens
tcaatttccaagagctga

SEQ ID NO: 1329354 - DNA, 21 bp, Homo sapiens
tcacactgagaatgtaagaac

SEQ ID NO: 1329355 - DNA, 17 bp, Homo sapiens
tcacccctccctttctc

SEQ ID NO: 1329356 - DNA, 18 bp, Homo sapiens
tcacccctccctttctcc

SEQ ID NO: 1329357 - DNA, 13 bp, Homo sapiens
tcaggacactaat

SEQ ID NO: 1329358 - DNA, 12 bp, Homo sapiens
tcatctgctctc

SEQ ID NO: 1329359 - DNA, 16 bp, Homo sapiens
tcatctgctctccttc

SEQ ID NO: 1329360 - DNA, 20 bp, Homo sapiens
tcatttgctaactagcttgg

SEQ ID NO: 1329361 - DNA, 16 bp, Homo sapiens
tcatttttttccaggc

SEQ ID NO: 1329362 - DNA, 18 bp, Homo sapiens
tcatttttttccaggctg

SEQ ID NO: 1329363 - DNA, 19 bp, Homo sapiens
tccaaccccccagcactga

SEQ ID NO: 1329364 - DNA, 13 bp, Homo sapiens
tccaggctggttc

SEQ ID NO: 1329365 - DNA, 21 bp, Homo sapiens
tcccagattggctcacactga

SEQ ID NO: 1329366 - DNA, 22 bp, Homo sapiens
tcccagattggctcacactgag

SEQ ID NO: 1329367 - DNA, 14 bp, Homo sapiens
tcccctcctccact

SEQ ID NO: 1329368 - DNA, 22 bp, Homo sapiens
tcccctgcccccaggactgggc

SEQ ID NO: 1329369 - DNA, 16 bp, Homo sapiens
tccctttctcccctgc

SEQ ID NO: 1329370 - DNA, 18 bp, Homo sapiens
tcctgccgcagagctggc

SEQ ID NO: 1329371 - DNA, 20 bp, Homo sapiens
tcctgccgcagagctggccg

SEQ ID NO: 1329372 - DNA, 15 bp, Homo sapiens
tcctggagcccagag

SEQ ID NO: 1329373 - DNA, 14 bp, Homo sapiens
tccttcagccctca

SEQ ID NO: 1329374 - DNA, 15 bp, Homo sapiens
tccttcagccctcac

SEQ ID NO: 1329375 - DNA, 22 bp, Homo sapiens
tcgagaactttcatttttttcc

SEQ ID NO: 1329376 - DNA, 22 bp, Homo sapiens
tctcatctttcttgatcaacat

SEQ ID NO: 1329377 - DNA, 15 bp, Homo sapiens
tctcccccaccccct

SEQ ID NO: 1329378 - DNA, 20 bp, Homo sapiens
tctcccccaccccctccccg

SEQ ID NO: 1329379 - DNA, 20 bp, Homo sapiens
tctcccctgcccccaggact

SEQ ID NO: 1329380 - DNA, 18 bp, Homo sapiens
tctgaaaattaacactgc

SEQ ID NO: 1329381 - DNA, 19 bp, Homo sapiens
tctgaaaattaacactgct

SEQ ID NO: 1329382 - DNA, 19 bp, Homo sapiens
tctgctctccttcctggag

SEQ ID NO: 1329383 - DNA, 20 bp, Homo sapiens
tctgctctccttcctggagc

SEQ ID NO: 1329384 - DNA, 20 bp, Homo sapiens
tctgtccccttctctcatct

SEQ ID NO: 1329385 - DNA, 22 bp, Homo sapiens
tctgtccccttctctcatctct

SEQ ID NO: 1329386 - DNA, 17 bp, Homo sapiens
tctgtgagactcgagaa

SEQ ID NO: 1329387 - DNA, 13 bp, Homo sapiens
tcttagctcccct

SEQ ID NO: 1329388 - DNA, 17 bp, Homo sapiens
tcttagctcccctccaa

SEQ ID NO: 1329389 - DNA, 10 bp, Homo sapiens
tcttctcatt

SEQ ID NO: 1329390 - DNA, 15 bp, Homo sapiens
tctttgattctcctt

SEQ ID NO: 1329391 - DNA, 19 bp, Homo sapiens
tctttgattctccttcagc

SEQ ID NO: 1329392 - DNA, 23 bp, Homo sapiens
tgaaaatgcaacaacatgtataa

SEQ ID NO: 1329393 - DNA, 15 bp, Homo sapiens
tgaaaattaacactg

SEQ ID NO: 1329394 - DNA, 11 bp, Homo sapiens
tgaagaagaga

SEQ ID NO: 1329395 - DNA, 16 bp, Homo sapiens
tgaaggtttctgaaaa

SEQ ID NO: 1329396 - DNA, 14 bp, Homo sapiens
tgaatataaacact

SEQ ID NO: 1329397 - DNA, 13 bp, Homo sapiens
tgacagaacactg

SEQ ID NO: 1329398 - DNA, 14 bp, Homo sapiens
tgacagaacactgt

SEQ ID NO: 1329399 - DNA, 17 bp, Homo sapiens
tgacagaacactgtctt

SEQ ID NO: 1329400 - DNA, 19 bp, Homo sapiens
tgacttgacagaacactgt

SEQ ID NO: 1329401 - DNA, 17 bp, Homo sapiens
tgaggaagaacggggct

SEQ ID NO: 1329402 - DNA, 19 bp, Homo sapiens
tgaggaagaacggggctct

SEQ ID NO: 1329403 - DNA, 23 bp, Homo sapiens
tgaggaagaacggggctcttctc

SEQ ID NO: 1329404 - DNA, 18 bp, Homo sapiens
tgaggtcatagcagtgct

SEQ ID NO: 1329405 - DNA, 20 bp, Homo sapiens
tgagttggtgttgacatgtg

SEQ ID NO: 1329406 - DNA, 17 bp, Homo sapiens
tgatcaacatcttttct

SEQ ID NO: 1329407 - DNA, 18 bp, Homo sapiens
tgatcaacatcttttctt

SEQ ID NO: 1329408 - DNA, 21 bp, Homo sapiens
actacaaacaaaatttctatt

SEQ ID NO: 1329409 - DNA, 14 bp, Homo sapiens
actctcccccaccc

SEQ ID NO: 1329410 - DNA, 19 bp, Homo sapiens
actgagaatgtaagaacta

SEQ ID NO: 1329411 - DNA, 13 bp, Homo sapiens
actgaggaagaac

SEQ ID NO: 1329412 - DNA, 16 bp, Homo sapiens
actgcctttggcagag

SEQ ID NO: 1329413 - DNA, 17 bp, Homo sapiens
acttgacagaacactgt

SEQ ID NO: 1329414 - DNA, 18 bp, Homo sapiens
actttcagtgaaagcatc

SEQ ID NO: 1329415 - DNA, 17 bp, Homo sapiens
actttcatttttttcca

SEQ ID NO: 1329416 - DNA, 21 bp, Homo sapiens
actttcatttttttccaggct

SEQ ID NO: 1329417 - DNA, 18 bp, Homo sapiens
agaaagacagagctggga

SEQ ID NO: 1329418 - DNA, 21 bp, Homo sapiens
agaacggggctcttctcattt

SEQ ID NO: 1329419 - DNA, 22 bp, Homo sapiens
agaactacaaacaaaatttcta

SEQ ID NO: 1329420 - DNA, 14 bp, Homo sapiens
agaagaaggcagca

SEQ ID NO: 1329421 - DNA, 21 bp, Homo sapiens
agaagaaggcagcaggtggca

SEQ ID NO: 1329422 - DNA, 16 bp, Homo sapiens
agaagccacaggcctg

SEQ ID NO: 1329423 - DNA, 18 bp, Homo sapiens
agaagccacaggcctgag

SEQ ID NO: 1329424 - DNA, 19 bp, Homo sapiens
agaagccacaggcctgaga

SEQ ID NO: 1329425 - DNA, 13 bp, Homo sapiens
agaagggggtggt

SEQ ID NO: 1329426 - DNA, 11 bp, Homo sapiens
agagctgaggc

SEQ ID NO: 1329427 - DNA, 20 bp, Homo sapiens
agaggcctgcctccagggct

SEQ ID NO: 1329428 - DNA, 15 bp, Homo sapiens
agatccttccttttg

SEQ ID NO: 1329429 - DNA, 22 bp, Homo sapiens
agattggctcacactgagaatg

SEQ ID NO: 1329430 - DNA, 20 bp, Homo sapiens
agatttcatctgctctcctt

SEQ ID NO: 1329431 - DNA, 15 bp, Homo sapiens
agcaatgcctgccca

SEQ ID NO: 1329432 - DNA, 11 bp, Homo sapiens
agcactgagga

SEQ ID NO: 1329433 - DNA, 12 bp, Homo sapiens
agcagaaggggg

SEQ ID NO: 1329434 - DNA, 19 bp, Homo sapiens
agcattatgatgtgggtca

SEQ ID NO: 1329435 - DNA, 14 bp, Homo sapiens
agccacaggcctga

SEQ ID NO: 1329436 - DNA, 17 bp, Homo sapiens
agccacaggcctgagat

SEQ ID NO: 1329437 - DNA, 14 bp, Homo sapiens
agcccagaggaggg

SEQ ID NO: 1329438 - DNA, 15 bp, Homo sapiens
agcccagaggagggc

SEQ ID NO: 1329439 - DNA, 22 bp, Homo sapiens
agccctcacccctggttctcat

SEQ ID NO: 1329440 - DNA, 21 bp, Homo sapiens
agcgctcctgccgcagagctg

SEQ ID NO: 1329441 - DNA, 17 bp, Homo sapiens
agctacccgcagagttc

SEQ ID NO: 1329442 - DNA, 17 bp, Homo sapiens
agctgaggcaattctaa

SEQ ID NO: 1329443 - DNA, 22 bp, Homo sapiens
agctggccgcgccaaataatgt

SEQ ID NO: 1329444 - DNA, 18 bp, Homo sapiens
aggaagaacggggctctt

SEQ ID NO: 1329445 - DNA, 14 bp, Homo sapiens
aggagggcagcaga

SEQ ID NO: 1329446 - DNA, 16 bp, Homo sapiens
aggcctgagatttcat

SEQ ID NO: 1329447 - DNA, 17 bp, Homo sapiens
aggcctgagatttcatc

SEQ ID NO: 1329448 - DNA, 22 bp, Homo sapiens
aggcctgagatttcatctgctc

SEQ ID NO: 1329449 - DNA, 18 bp, Homo sapiens
aggcctgagcgctcctgc

SEQ ID NO: 1329450 - DNA, 20 bp, Homo sapiens
aggcctgcctccagggctgg

SEQ ID NO: 1329451 - DNA, 18 bp, Homo sapiens
aggctaaagcccagagac

SEQ ID NO: 1329452 - DNA, 15 bp, Homo sapiens
agggaatggcacagc

SEQ ID NO: 1329453 - DNA, 16 bp, Homo sapiens
agggagcgagggagaa

SEQ ID NO: 1329454 - DNA, 15 bp, Homo sapiens
agggctggactgagg

SEQ ID NO: 1329455 - DNA, 22 bp, Homo sapiens
aggtatgaccttctaggaagct

SEQ ID NO: 1329456 - DNA, 14 bp, Homo sapiens
agtgaaagcatcac

SEQ ID NO: 1329457 - DNA, 17 bp, Homo sapiens
agtggctttaatgaata

SEQ ID NO: 1329458 - DNA, 22 bp, Homo sapiens
ataaacatttgtagcatcctct

SEQ ID NO: 1329459 - DNA, 14 bp, Homo sapiens
ataatatttttaat

SEQ ID NO: 1329460 - DNA, 11 bp, Homo sapiens
ataatgtctct

SEQ ID NO: 1329461 - DNA, 19 bp, Homo sapiens
ataatgtctctgtgagact

SEQ ID NO: 1329462 - DNA, 14 bp, Homo sapiens
atatatacatatat

SEQ ID NO: 1329463 - DNA, 13 bp, Homo sapiens
atatatattttaa

SEQ ID NO: 1329464 - DNA, 16 bp, Homo sapiens
atatggggatgcagca

SEQ ID NO: 1329465 - DNA, 14 bp, Homo sapiens
atatttacgtatga

SEQ ID NO: 1329466 - DNA, 18 bp, Homo sapiens
atattttccatgaaaatg

SEQ ID NO: 1329467 - DNA, 15 bp, Homo sapiens
atcaacatcttttct

SEQ ID NO: 1329468 - DNA, 17 bp, Homo sapiens
atctctctttaatataa

SEQ ID NO: 1329469 - DNA, 13 bp, Homo sapiens
atctcttagctcc

SEQ ID NO: 1329470 - DNA, 23 bp, Homo sapiens
atctcttagctcccctccaacct

SEQ ID NO: 1329471 - DNA, 13 bp, Homo sapiens
atctgctctcctt

SEQ ID NO: 1329472 - DNA, 14 bp, Homo sapiens
atctgctctccttc

SEQ ID NO: 1329473 - DNA, 16 bp, Homo sapiens
atctgctctccttcct

SEQ ID NO: 1329474 - DNA, 17 bp, Homo sapiens
atctgctctccttcctg

SEQ ID NO: 1329475 - DNA, 13 bp, Homo sapiens
atctttcttgatc

SEQ ID NO: 1329476 - DNA, 14 bp, Homo sapiens
atctttgattctcc

SEQ ID NO: 1329477 - DNA, 16 bp, Homo sapiens
atctttgattctcctt

SEQ ID NO: 1329478 - DNA, 18 bp, Homo sapiens
atctttgattctccttca

SEQ ID NO: 1329479 - DNA, 19 bp, Homo sapiens
atctttgattctccttcag

SEQ ID NO: 1329480 - DNA, 21 bp, Homo sapiens
atgcaacaacatgtataatat

SEQ ID NO: 1329481 - DNA, 15 bp, Homo sapiens
atggcagtgtctttc

SEQ ID NO: 1329482 - DNA, 12 bp, Homo sapiens
atggggatgcag

SEQ ID NO: 1329483 - DNA, 21 bp, Homo sapiens
attatgatgtgggtcaaggaa

SEQ ID NO: 1329484 - DNA, 13 bp, Homo sapiens
attctccttcagc

SEQ ID NO: 1329485 - DNA, 13 bp, Homo sapiens
attggctcacact

SEQ ID NO: 1329486 - DNA, 19 bp, Homo sapiens
atttcatctgctctccttc

SEQ ID NO: 1329487 - DNA, 21 bp, Homo sapiens
atttcatctgctctccttcct

SEQ ID NO: 1329488 - DNA, 12 bp, Homo sapiens
atttggggtgga

SEQ ID NO: 1329489 - DNA, 13 bp, Homo sapiens
attttatctttga

SEQ ID NO: 1329490 - DNA, 15 bp, Homo sapiens
attttatctttgatt

SEQ ID NO: 1329491 - DNA, 22 bp, Homo sapiens
attttatctttgattctccttc

SEQ ID NO: 1329492 - DNA, 16 bp, Homo sapiens
attttggttttgttcc

SEQ ID NO: 1329493 - DNA, 22 bp, Homo sapiens
attttggttttgttcccctcct

SEQ ID NO: 1329494 - DNA, 23 bp, Homo sapiens
attttggttttgttcccctcctc

SEQ ID NO: 1329495 - DNA, 18 bp, Homo sapiens
caaacatgtggttaatgc

SEQ ID NO: 1329496 - DNA, 19 bp, Homo sapiens
caaagaaggaaaaggcagg

SEQ ID NO: 1329497 - DNA, 22 bp, Homo sapiens
caaagggggaggctaaagccca

SEQ ID NO: 1329498 - DNA, 16 bp, Homo sapiens
caaataatgtctctgt

SEQ ID NO: 1329499 - DNA, 18 bp, Homo sapiens
caacatgtataatatttt

SEQ ID NO: 1329500 - DNA, 14 bp, Homo sapiens
caatatcagacttt

SEQ ID NO: 1329501 - DNA, 13 bp, Homo sapiens
caatattttccat

SEQ ID NO: 1329502 - DNA, 20 bp, Homo sapiens
caatggtttgcaaggaagcc

SEQ ID NO: 1329503 - DNA, 17 bp, Homo sapiens
caatttccaagagctga

SEQ ID NO: 1329504 - DNA, 13 bp, Homo sapiens
cacaggcctgaga

SEQ ID NO: 1329505 - DNA, 14 bp, Homo sapiens
cacaggcctgagat

SEQ ID NO: 1329506 - DNA, 19 bp, Homo sapiens
cacaggcctgagatttcat

SEQ ID NO: 1329507 - DNA, 23 bp, Homo sapiens
cacaggtatgaccttctaggaag

SEQ ID NO: 1329508 - DNA, 24 bp, Homo sapiens
cacatcagctccactttcagtgaa

SEQ ID NO: 1329509 - DNA, 18 bp, Homo sapiens
cacatggctatgttttag

SEQ ID NO: 1329510 - DNA, 18 bp, Homo sapiens
caccagttcctttcaatg

SEQ ID NO: 1329511 - DNA, 17 bp, Homo sapiens
cacccctggttctcatc

SEQ ID NO: 1329512 - DNA, 15 bp, Homo sapiens
cactaatacaccagg

SEQ ID NO: 1329513 - DNA, 18 bp, Homo sapiens
cactgagaatgtaagaac

SEQ ID NO: 1329514 - DNA, 19 bp, Homo sapiens
cacttctgggtggggcagt

SEQ ID NO: 1329515 - DNA, 11 bp, Homo sapiens
cagaacactgt

SEQ ID NO: 1329516 - DNA, 14 bp, Homo sapiens
cagaagaaggcagc

SEQ ID NO: 1329517 - DNA, 14 bp, Homo sapiens
cagaagggggtggt

SEQ ID NO: 1329518 - DNA, 20 bp, Homo sapiens
cagaagggggtggtgtctcc

SEQ ID NO: 1329519 - DNA, 18 bp, Homo sapiens
cagaatggggtgcatgaa

SEQ ID NO: 1329520 - DNA, 20 bp, Homo sapiens
cagagctgggatgtttctgt

SEQ ID NO: 1329521 - DNA, 18 bp, Homo sapiens
cagaggagggcagcagaa

SEQ ID NO: 1329522 - DNA, 22 bp, Homo sapiens
cagaggagggcagcagaagggg

SEQ ID NO: 1329523 - DNA, 18 bp, Homo sapiens
cagattggctcacactga

SEQ ID NO: 1329524 - DNA, 22 bp, Homo sapiens
cagattggctcacactgagaat

SEQ ID NO: 1329525 - DNA, 15 bp, Homo sapiens
cagcaagtcagggtt

SEQ ID NO: 1329526 - DNA, 11 bp, Homo sapiens
cagcactgagg

SEQ ID NO: 1329527 - DNA, 18 bp, Homo sapiens
cagccctcacccctggtt

SEQ ID NO: 1329528 - DNA, 19 bp, Homo sapiens
cagctggtggtatctgagt

SEQ ID NO: 1329529 - DNA, 22 bp, Homo sapiens
ctttcatttttttccaggctgg

SEQ ID NO: 1329530 - DNA, 14 bp, Homo sapiens
ctttctcccctgcc

SEQ ID NO: 1329531 - DNA, 14 bp, Homo sapiens
ctttgattctcctt

SEQ ID NO: 1329532 - DNA, 15 bp, Homo sapiens
ctttgattctccttc

SEQ ID NO: 1329533 - DNA, 18 bp, Homo sapiens
ctttgattctccttcagc

SEQ ID NO: 1329534 - DNA, 20 bp, Homo sapiens
ctttgattctccttcagccc

SEQ ID NO: 1329535 - DNA, 20 bp, Homo sapiens
ctttggggcttttacaccag

SEQ ID NO: 1329536 - DNA, 17 bp, Homo sapiens
cttttatttcttaaaca

SEQ ID NO: 1329537 - DNA, 11 bp, Homo sapiens
gaaaaggcagg

SEQ ID NO: 1329538 - DNA, 20 bp, Homo sapiens
gaaaatgcaacaacatgtat

SEQ ID NO: 1329539 - DNA, 13 bp, Homo sapiens
gaaaattaacact

SEQ ID NO: 1329540 - DNA, 23 bp, Homo sapiens
gaactacaaacaaaatttctatt

SEQ ID NO: 1329541 - DNA, 21 bp, Homo sapiens
gaactgcctttggcagagttc

SEQ ID NO: 1329542 - DNA, 18 bp, Homo sapiens
gaaggaaaaggcagggag

SEQ ID NO: 1329543 - DNA, 20 bp, Homo sapiens
gaaggaaaaggcagggagcg

SEQ ID NO: 1329544 - DNA, 12 bp, Homo sapiens
gaagggggtggt

SEQ ID NO: 1329545 - DNA, 13 bp, Homo sapiens
gaatataaacact

SEQ ID NO: 1329546 - DNA, 21 bp, Homo sapiens
gaatataaacactatatggca

SEQ ID NO: 1329547 - DNA, 22 bp, Homo sapiens
gaatggcacagcccaaagaagg

SEQ ID NO: 1329548 - DNA, 21 bp, Homo sapiens
gaattaagttagggaatggca

SEQ ID NO: 1329549 - DNA, 21 bp, Homo sapiens
gactgaggcctgagcgctcct

SEQ ID NO: 1329550 - DNA, 19 bp, Homo sapiens
gactttttttttttataat

SEQ ID NO: 1329551 - DNA, 16 bp, Homo sapiens
gagaactttcattttt

SEQ ID NO: 1329552 - DNA, 22 bp, Homo sapiens
gagaagccacaggcctgagatt

SEQ ID NO: 1329553 - DNA, 16 bp, Homo sapiens
gagaatgtaagaacta

SEQ ID NO: 1329554 - DNA, 14 bp, Homo sapiens
gagactcgagaact

SEQ ID NO: 1329555 - DNA, 16 bp, Homo sapiens
gagactcgagaacttt

SEQ ID NO: 1329556 - DNA, 13 bp, Homo sapiens
gagagagctggag

SEQ ID NO: 1329557 - DNA, 13 bp, Homo sapiens
gagatttcatctg

SEQ ID NO: 1329558 - DNA, 23 bp, Homo sapiens
gagatttcatctgctctccttcc

SEQ ID NO: 1329559 - DNA, 14 bp, Homo sapiens
gagcccagaggagg

SEQ ID NO: 1329560 - DNA, 22 bp, Homo sapiens
gagcccagaggagggcagcaga

SEQ ID NO: 1329561 - DNA, 15 bp, Homo sapiens
gagcgctcctgccgc

SEQ ID NO: 1329562 - DNA, 18 bp, Homo sapiens
gagctacccgcagagttc

SEQ ID NO: 1329563 - DNA, 17 bp, Homo sapiens
gagctgaggcaattcta

SEQ ID NO: 1329564 - DNA, 23 bp, Homo sapiens
gagctggccgcgccaaataatgt

SEQ ID NO: 1329565 - DNA, 23 bp, Homo sapiens
gaggaagaacggggctcttctca

SEQ ID NO: 1329566 - DNA, 19 bp, Homo sapiens
gaggaggtaatgaattaaa

SEQ ID NO: 1329567 - DNA, 19 bp, Homo sapiens
gaggcctgcctccagggct

SEQ ID NO: 1329568 - DNA, 17 bp, Homo sapiens
gagtagaaagacagagc

SEQ ID NO: 1329569 - DNA, 17 bp, Homo sapiens
gatgtgggtcaaggaat

SEQ ID NO: 1329570 - DNA, 18 bp, Homo sapiens
gattaatatggggatgca

SEQ ID NO: 1329571 - DNA, 20 bp, Homo sapiens
gatttcatctgctctccttc

SEQ ID NO: 1329572 - DNA, 22 bp, Homo sapiens
gatttcatctgctctccttcct

SEQ ID NO: 1329573 - DNA, 19 bp, Homo sapiens
gattttggttttgttcccc

SEQ ID NO: 1329574 - DNA, 17 bp, Homo sapiens
gcacagcccaaagaagg

SEQ ID NO: 1329575 - DNA, 14 bp, Homo sapiens
gcagaagggggtgg

SEQ ID NO: 1329576 - DNA, 15 bp, Homo sapiens
gcagaagggggtggt

SEQ ID NO: 1329577 - DNA, 22 bp, Homo sapiens
gcagaagggggtggtgtctcca

SEQ ID NO: 1329578 - DNA, 13 bp, Homo sapiens
gcagcagaagggg

SEQ ID NO: 1329579 - DNA, 18 bp, Homo sapiens
gcagtggtgtggagaagc

SEQ ID NO: 1329580 - DNA, 13 bp, Homo sapiens
gcatgaaggtttc

SEQ ID NO: 1329581 - DNA, 22 bp, Homo sapiens
gccaaataatgtctctgtgaga

SEQ ID NO: 1329582 - DNA, 20 bp, Homo sapiens
gccacttctgggtggggcag

SEQ ID NO: 1329583 - DNA, 22 bp, Homo sapiens
gccagagctacccgcagagttc

SEQ ID NO: 1329584 - DNA, 22 bp, Homo sapiens
gcccaattcttacaaacatgtg

SEQ ID NO: 1329585 - DNA, 23 bp, Homo sapiens
gcccagaggagggcagcagaagg

SEQ ID NO: 1329586 - DNA, 16 bp, Homo sapiens
gcccccaggactgggc

SEQ ID NO: 1329587 - DNA, 18 bp, Homo sapiens
gcctccagggctggactg

SEQ ID NO: 1329588 - DNA, 20 bp, Homo sapiens
gcctccagggctggactgag

SEQ ID NO: 1329589 - DNA, 24 bp, Homo sapiens
gcctccagggctggactgaggcct

SEQ ID NO: 1329590 - DNA, 22 bp, Homo sapiens
gcctctgtccccttctctcatc

SEQ ID NO: 1329591 - DNA, 16 bp, Homo sapiens
gcctgagatttcatct

SEQ ID NO: 1329592 - DNA, 16 bp, Homo sapiens
gcctgcctccagggct

SEQ ID NO: 1329593 - DNA, 17 bp, Homo sapiens
gcctgcctccagggctg

SEQ ID NO: 1329594 - DNA, 16 bp, Homo sapiens
gcctttggcagagttc

SEQ ID NO: 1329595 - DNA, 19 bp, Homo sapiens
gcgctcctgccgcagagct

SEQ ID NO: 1329596 - DNA, 21 bp, Homo sapiens
gcgctcctgccgcagagctgg

SEQ ID NO: 1329597 - DNA, 13 bp, Homo sapiens
gctcacactgaga

SEQ ID NO: 1329598 - DNA, 14 bp, Homo sapiens
gctcacactgagaa

SEQ ID NO: 1329599 - DNA, 22 bp, Homo sapiens
gctcacactgagaatgtaagaa

SEQ ID NO: 1329600 - DNA, 12 bp, Homo sapiens
gctcccctccaa

SEQ ID NO: 1329601 - DNA, 13 bp, Homo sapiens
ccccccagcactg

SEQ ID NO: 1329602 - DNA, 15 bp, Homo sapiens
cccctccctttctcc

SEQ ID NO: 1329603 - DNA, 15 bp, Homo sapiens
cccctcctccactct

SEQ ID NO: 1329604 - DNA, 18 bp, Homo sapiens
cccctcctccactctccc

SEQ ID NO: 1329605 - DNA, 16 bp, Homo sapiens
cccctgcccccaggac

SEQ ID NO: 1329606 - DNA, 17 bp, Homo sapiens
cccctgcccccaggact

SEQ ID NO: 1329607 - DNA, 15 bp, Homo sapiens
cccctggttctcatc

SEQ ID NO: 1329608 - DNA, 16 bp, Homo sapiens
ccccttctctcatctc

SEQ ID NO: 1329609 - DNA, 13 bp, Homo sapiens
ccctcacccctgg

SEQ ID NO: 1329610 - DNA, 17 bp, Homo sapiens
ccctccccgcccttttt

SEQ ID NO: 1329611 - DNA, 12 bp, Homo sapiens
ccctcctccact

SEQ ID NO: 1329612 - DNA, 13 bp, Homo sapiens
ccctgcccccagg

SEQ ID NO: 1329613 - DNA, 18 bp, Homo sapiens
ccctgcccccaggactgg

SEQ ID NO: 1329614 - DNA, 22 bp, Homo sapiens
ccctgcccccaggactgggcca

SEQ ID NO: 1329615 - DNA, 14 bp, Homo sapiens
ccctggttctcatc

SEQ ID NO: 1329616 - DNA, 16 bp, Homo sapiens
ccctggttctcatctt

SEQ ID NO: 1329617 - DNA, 17 bp, Homo sapiens
ccctggttctcatcttt

SEQ ID NO: 1329618 - DNA, 22 bp, Homo sapiens
ccgcgccaaataatgtctctgt

SEQ ID NO: 1329619 - DNA, 11 bp, Homo sapiens
cctcacacagc

SEQ ID NO: 1329620 - DNA, 23 bp, Homo sapiens
cctcacccctggttctcatcttt

SEQ ID NO: 1329621 - DNA, 19 bp, Homo sapiens
cctccaacctggggggcag

SEQ ID NO: 1329622 - DNA, 14 bp, Homo sapiens
cctccactctcccc

SEQ ID NO: 1329623 - DNA, 13 bp, Homo sapiens
cctccagggctgg

SEQ ID NO: 1329624 - DNA, 20 bp, Homo sapiens
cctccagggctggactgagg

SEQ ID NO: 1329625 - DNA, 14 bp, Homo sapiens
cctctgtccccttc

SEQ ID NO: 1329626 - DNA, 19 bp, Homo sapiens
cctctgtccccttctctca

SEQ ID NO: 1329627 - DNA, 11 bp, Homo sapiens
cctgagatttc

SEQ ID NO: 1329628 - DNA, 15 bp, Homo sapiens
cctgagatttcatct

SEQ ID NO: 1329629 - DNA, 16 bp, Homo sapiens
cctgagatttcatctg

SEQ ID NO: 1329630 - DNA, 23 bp, Homo sapiens
cctgagatttcatctgctctcct

SEQ ID NO: 1329631 - DNA, 12 bp, Homo sapiens
cctgcccccagg

SEQ ID NO: 1329632 - DNA, 17 bp, Homo sapiens
cctgcccccaggactgg

SEQ ID NO: 1329633 - DNA, 18 bp, Homo sapiens
cctgcccccaggactggg

SEQ ID NO: 1329634 - DNA, 19 bp, Homo sapiens
cctgcccccaggactgggc

SEQ ID NO: 1329635 - DNA, 20 bp, Homo sapiens
cctgcccccaggactgggcc

SEQ ID NO: 1329636 - DNA, 12 bp, Homo sapiens
cctgcctccagg

SEQ ID NO: 1329637 - DNA, 21 bp, Homo sapiens
cctgcctccagggctggactg

SEQ ID NO: 1329638 - DNA, 23 bp, Homo sapiens
cctgcctccagggctggactgag

SEQ ID NO: 1329639 - DNA, 14 bp, Homo sapiens
cctggagcccagag

SEQ ID NO: 1329640 - DNA, 15 bp, Homo sapiens
cctggttctcatctt

SEQ ID NO: 1329641 - DNA, 13 bp, Homo sapiens
ccttcagccctca

SEQ ID NO: 1329642 - DNA, 21 bp, Homo sapiens
ccttcctggagcccagaggag

SEQ ID NO: 1329643 - DNA, 18 bp, Homo sapiens
cctttctcccctgccccc

SEQ ID NO: 1329644 - DNA, 19 bp, Homo sapiens
cctttctcccctgccccca

SEQ ID NO: 1329645 - DNA, 15 bp, Homo sapiens
cctttggcagagttc

SEQ ID NO: 1329646 - DNA, 17 bp, Homo sapiens
cgagaactttcattttt

SEQ ID NO: 1329647 - DNA, 21 bp, Homo sapiens
cgatgggcccaattcttacaa

SEQ ID NO: 1329648 - DNA, 18 bp, Homo sapiens
cgctcctgccgcagagct

SEQ ID NO: 1329649 - DNA, 17 bp, Homo sapiens
cggggctcttctcattt

SEQ ID NO: 1329650 - DNA, 23 bp, Homo sapiens
cggggctcttctcatttcacccc

SEQ ID NO: 1329651 - DNA, 14 bp, Homo sapiens
ctatattgtacaca

SEQ ID NO: 1329652 - DNA, 14 bp, Homo sapiens
ctcacccctggttc

SEQ ID NO: 1329653 - DNA, 21 bp, Homo sapiens
ctcacccctggttctcatctt

SEQ ID NO: 1329654 - DNA, 12 bp, Homo sapiens
ctcatctttctt

SEQ ID NO: 1329655 - DNA, 13 bp, Homo sapiens
ctcatctttcttg

SEQ ID NO: 1329656 - DNA, 15 bp, Homo sapiens
ctcatctttcttgat

SEQ ID NO: 1329657 - DNA, 22 bp, Homo sapiens
ctccaaccccccagcactgagg

SEQ ID NO: 1329658 - DNA, 23 bp, Homo sapiens
ctccaaccccccagcactgagga

SEQ ID NO: 1329659 - DNA, 12 bp, Homo sapiens
ctccagggctgg

SEQ ID NO: 1329660 - DNA, 13 bp, Homo sapiens
ctccagggctgga

SEQ ID NO: 1329661 - DNA, 14 bp, Homo sapiens
ctccagggctggac

SEQ ID NO: 1329662 - DNA, 21 bp, Homo sapiens
ctccagggctggactgaggcc

SEQ ID NO: 1329663 - DNA, 14 bp, Homo sapiens
ctccctttctcccc

SEQ ID NO: 1329664 - DNA, 16 bp, Homo sapiens
ctcctccactctcccc

SEQ ID NO: 1329665 - DNA, 14 bp, Homo sapiens
ctcctgccgcagag

SEQ ID NO: 1329666 - DNA, 14 bp, Homo sapiens
ctccttcagccctc

SEQ ID NO: 1329667 - DNA, 15 bp, Homo sapiens
ctctgtccccttctc

SEQ ID NO: 1329668 - DNA, 18 bp, Homo sapiens
ctctgtccccttctctca

SEQ ID NO: 1329669 - DNA, 21 bp, Homo sapiens
ctctgtccccttctctcatct

SEQ ID NO: 1329670 - DNA, 13 bp, Homo sapiens
ctctgtgagactc

SEQ ID NO: 1329671 - DNA, 18 bp, Homo sapiens
ctctgtgagactcgagaa

SEQ ID NO: 1329672 - DNA, 15 bp, Homo sapiens
ctcttagctcccctc

SEQ ID NO: 1329673 - DNA, 19 bp, Homo sapiens
ctcttctcatttcacccct

SEQ ID NO: 1329674 - DNA, 16 bp, Homo sapiens
ctgagatttcatctgc

SEQ ID NO: 1329675 - DNA, 15 bp, Homo sapiens
ctgaggaagaacggg

SEQ ID NO: 1329676 - DNA, 20 bp, Homo sapiens
ctgagttgacttgacagaac

SEQ ID NO: 1329677 - DNA, 13 bp, Homo sapiens
ctgcccccaggac

SEQ ID NO: 1329678 - DNA, 13 bp, Homo sapiens
ctgccgcagagct

SEQ ID NO: 1329679 - DNA, 18 bp, Homo sapiens
ctgccgcagagctggccg

SEQ ID NO: 1329680 - DNA, 14 bp, Homo sapiens
ctgcctccagggct

SEQ ID NO: 1329681 - DNA, 17 bp, Homo sapiens
ctgcctccagggctgga

SEQ ID NO: 1329682 - DNA, 20 bp, Homo sapiens
ctgcctccagggctggactg

SEQ ID NO: 1329683 - DNA, 12 bp, Homo sapiens
ctgctctccttc

SEQ ID NO: 1329684 - DNA, 15 bp, Homo sapiens
ctgctctccttcctg

SEQ ID NO: 1329685 - DNA, 12 bp, Homo sapiens
ctggactgaggc

SEQ ID NO: 1329686 - DNA, 15 bp, Homo sapiens
ctggactgaggcctg

SEQ ID NO: 1329687 - DNA, 16 bp, Homo sapiens
ctggactgaggcctga

SEQ ID NO: 1329688 - DNA, 16 bp, Homo sapiens
ctggagcccagaggag

SEQ ID NO: 1329689 - DNA, 14 bp, Homo sapiens
ctgggatgtttctg

SEQ ID NO: 1329690 - DNA, 14 bp, Homo sapiens
ctggtattttatct

SEQ ID NO: 1329691 - DNA, 12 bp, Homo sapiens
ctggttctcatc

SEQ ID NO: 1329692 - DNA, 16 bp, Homo sapiens
ctggttctcatctttc

SEQ ID NO: 1329693 - DNA, 16 bp, Homo sapiens
ctgtccccttctctca

SEQ ID NO: 1329694 - DNA, 20 bp, Homo sapiens
ctgtccccttctctcatctc

SEQ ID NO: 1329695 - DNA, 21 bp, Homo sapiens
ctgtccccttctctcatctct

SEQ ID NO: 1329696 - DNA, 13 bp, Homo sapiens
ctgtctcagggtg

SEQ ID NO: 1329697 - DNA, 16 bp, Homo sapiens
cttcagccctcacccc

SEQ ID NO: 1329698 - DNA, 15 bp, Homo sapiens
cttccttttgaggga

SEQ ID NO: 1329699 - DNA, 21 bp, Homo sapiens
cttctcatttcacccctccct

SEQ ID NO: 1329700 - DNA, 14 bp, Homo sapiens
cttctctcatctct

SEQ ID NO: 1329701 - DNA, 17 bp, Homo sapiens
cttgcctctgtcccctt

SEQ ID NO: 1329702 - DNA, 12 bp, Homo sapiens
ctttaatataaa

SEQ ID NO: 1329703 - DNA, 22 bp, Homo sapiens
ctttcaatggtttgcaaggaag

SEQ ID NO: 1329704 - DNA, 15 bp, Homo sapiens
ctttcagtgaaagca

SEQ ID NO: 1329705 - DNA, 19 bp, Homo sapiens
ctttctcccctgcccccag

SEQ ID NO: 1329706 - DNA, 22 bp, Homo sapiens
ctttctcccctgcccccaggac

SEQ ID NO: 1329707 - DNA, 22 bp, Homo sapiens
ctttcttgatcaacatcttttc

SEQ ID NO: 1329708 - DNA, 16 bp, Homo sapiens
ctttgattctccttca

SEQ ID NO: 1329709 - DNA, 22 bp, Homo sapiens
ctttgattctccttcagccctc

SEQ ID NO: 1329710 - DNA, 21 bp, Homo sapiens
ctttggggcttttacaccagt

SEQ ID NO: 1329711 - DNA, 16 bp, Homo sapiens
gaaaatgaatccctct

SEQ ID NO: 1329712 - DNA, 15 bp, Homo sapiens
gaaaattaacactgc

SEQ ID NO: 1329713 - DNA, 14 bp, Homo sapiens
gaaagacagagctg

SEQ ID NO: 1329714 - DNA, 13 bp, Homo sapiens
gaagaacggggct

SEQ ID NO: 1329715 - DNA, 22 bp, Homo sapiens
gaagaacggggctcttctcatt

SEQ ID NO: 1329716 - DNA, 23 bp, Homo sapiens
gaagaacggggctcttctcattt

SEQ ID NO: 1329717 - DNA, 15 bp, Homo sapiens
gaagccacaggcctg

SEQ ID NO: 1329718 - DNA, 17 bp, Homo sapiens
gaagccacaggcctgag

SEQ ID NO: 1329719 - DNA, 18 bp, Homo sapiens
gaatctctgaatttgaga

SEQ ID NO: 1329720 - DNA, 17 bp, Homo sapiens
gaatggcacagcccaaa

SEQ ID NO: 1329721 - DNA, 13 bp, Homo sapiens
gacagaacactgt

SEQ ID NO: 1329722 - DNA, 23 bp, Homo sapiens
ttcaatggtttgcaaggaagcca

SEQ ID NO: 1329723 - DNA, 15 bp, Homo sapiens
ttcacccctcccttt

SEQ ID NO: 1329724 - DNA, 17 bp, Homo sapiens
ttcacccctccctttct

SEQ ID NO: 1329725 - DNA, 22 bp, Homo sapiens
ttcacccctccctttctcccct

SEQ ID NO: 1329726 - DNA, 16 bp, Homo sapiens
ttcagccctcacccct

SEQ ID NO: 1329727 - DNA, 19 bp, Homo sapiens
ttcatctgctctccttcct

SEQ ID NO: 1329728 - DNA, 24 bp, Homo sapiens
ttccatgaaaatgcaacaacatgt

SEQ ID NO: 1329729 - DNA, 15 bp, Homo sapiens
ttctcatctttcttg

SEQ ID NO: 1329730 - DNA, 15 bp, Homo sapiens
ttctcccctgccccc

SEQ ID NO: 1329731 - DNA, 17 bp, Homo sapiens
ttcttaaacaaatgtat

SEQ ID NO: 1329732 - DNA, 15 bp, Homo sapiens
ttcttacaaacatgt

SEQ ID NO: 1329733 - DNA, 18 bp, Homo sapiens
ttgaatataaacactata

SEQ ID NO: 1329734 - DNA, 17 bp, Homo sapiens
ttgacagaacactgtct

SEQ ID NO: 1329735 - DNA, 20 bp, Homo sapiens
ttgacttgacagaacactgt

SEQ ID NO: 1329736 - DNA, 21 bp, Homo sapiens
ttgacttgacagaacactgtc

SEQ ID NO: 1329737 - DNA, 17 bp, Homo sapiens
ttgatcaacatcttttc

SEQ ID NO: 1329738 - DNA, 17 bp, Homo sapiens
ttgattctccttcagcc

SEQ ID NO: 1329739 - DNA, 12 bp, Homo sapiens
ttgcaaggaagc

SEQ ID NO: 1329740 - DNA, 14 bp, Homo sapiens
ttgcatatatacat

SEQ ID NO: 1329741 - DNA, 17 bp, Homo sapiens
ttgcctctgtccccttc

SEQ ID NO: 1329742 - DNA, 19 bp, Homo sapiens
ttgcctctgtccccttctc

SEQ ID NO: 1329743 - DNA, 13 bp, Homo sapiens
ttggtgttgacat

SEQ ID NO: 1329744 - DNA, 19 bp, Homo sapiens
ttgttaatggtttgaatat

SEQ ID NO: 1329745 - DNA, 19 bp, Homo sapiens
ttgttcccctcctccactc

SEQ ID NO: 1329746 - DNA, 13 bp, Homo sapiens
tttaattaaataa

SEQ ID NO: 1329747 - DNA, 20 bp, Homo sapiens
tttatgccttttatttctta

SEQ ID NO: 1329748 - DNA, 22 bp, Homo sapiens
tttcacccctccctttctcccc

SEQ ID NO: 1329749 - DNA, 22 bp, Homo sapiens
tttctattaaattaaattttgt

SEQ ID NO: 1329750 - DNA, 16 bp, Homo sapiens
tttctcccctgccccc

SEQ ID NO: 1329751 - DNA, 20 bp, Homo sapiens
tttctgaaaattaacactgc

SEQ ID NO: 1329752 - DNA, 21 bp, Homo sapiens
tttcttgatcaacatcttttc

SEQ ID NO: 1329753 - DNA, 21 bp, Homo sapiens
tttcttgcctctgtccccttc

SEQ ID NO: 1329754 - DNA, 16 bp, Homo sapiens
tttgttcccctcctcc

SEQ ID NO: 1329755 - DNA, 18 bp, Homo sapiens
tttgttcccctcctccac

SEQ ID NO: 1329756 - DNA, 19 bp, Homo sapiens
ttttatgccttttatttct

SEQ ID NO: 1329757 - DNA, 12 bp, Homo sapiens
ttttccaggctg

SEQ ID NO: 1329758 - DNA, 19 bp, Homo sapiens
ttttccatgaaaatgcaac

SEQ ID NO: 1329759 - DNA, 19 bp, Homo sapiens
ttttcttgcctctgtcccc

SEQ ID NO: 1329760 - DNA, 16 bp, Homo sapiens
ttttggttttgttccc

SEQ ID NO: 1329761 - DNA, 12 bp, Homo sapiens
tttttccaggct

SEQ ID NO: 1329762 - DNA, 21 bp, Homo sapiens
ctacaaacaaaatttctatta

SEQ ID NO: 1329763 - DNA, 13 bp, Homo sapiens
ctcaatattttcc

SEQ ID NO: 1329764 - DNA, 22 bp, Homo sapiens
ctcaatattttccatgaaaatg

SEQ ID NO: 1329765 - DNA, 14 bp, Homo sapiens
ctcacactgagaat

SEQ ID NO: 1329766 - DNA, 17 bp, Homo sapiens
ctcacccctggttctca

SEQ ID NO: 1329767 - DNA, 20 bp, Homo sapiens
ctcacccctggttctcatct

SEQ ID NO: 1329768 - DNA, 20 bp, Homo sapiens
ctcatctcttagctcccctc

SEQ ID NO: 1329769 - DNA, 22 bp, Homo sapiens
ctcatctcttagctcccctcca

SEQ ID NO: 1329770 - DNA, 14 bp, Homo sapiens
ctccaaccccccag

SEQ ID NO: 1329771 - DNA, 15 bp, Homo sapiens
ctccaaccccccagc

SEQ ID NO: 1329772 - DNA, 17 bp, Homo sapiens
ctccaaccccccagcac

SEQ ID NO: 1329773 - DNA, 18 bp, Homo sapiens
ctccaaccccccagcact

SEQ ID NO: 1329774 - DNA, 21 bp, Homo sapiens
ctccaaccccccagcactgag

SEQ ID NO: 1329775 - DNA, 18 bp, Homo sapiens
ctccaacctggggggcag

SEQ ID NO: 1329776 - DNA, 13 bp, Homo sapiens
ctccactctcccc

SEQ ID NO: 1329777 - DNA, 19 bp, Homo sapiens
ctccagggctggactgagg

SEQ ID NO: 1329778 - DNA, 14 bp, Homo sapiens
ctcccctgccccca

SEQ ID NO: 1329779 - DNA, 15 bp, Homo sapiens
ctccctttctcccct

SEQ ID NO: 1329780 - DNA, 23 bp, Homo sapiens
ctccctttctcccctgcccccag

SEQ ID NO: 1329781 - DNA, 17 bp, Homo sapiens
ctcctccactctccccc

SEQ ID NO: 1329782 - DNA, 16 bp, Homo sapiens
ctctccttcctggagc

SEQ ID NO: 1329783 - DNA, 17 bp, Homo sapiens
ctcttagctcccctcca

SEQ ID NO: 1329784 - DNA, 17 bp, Homo sapiens
ctgaaaattaacactgc

SEQ ID NO: 1329785 - DNA, 17 bp, Homo sapiens
ctgagaatgtaagaact

SEQ ID NO: 1329786 - DNA, 14 bp, Homo sapiens
ctgagatttcatct

SEQ ID NO: 1329787 - DNA, 23 bp, Homo sapiens
ctgaggaagaacggggctcttct

SEQ ID NO: 1329788 - DNA, 18 bp, Homo sapiens
ctgaggcctgagcgctcc

SEQ ID NO: 1329789 - DNA, 14 bp, Homo sapiens
ctgcccccaggact

SEQ ID NO: 1329790 - DNA, 16 bp, Homo sapiens
ctgccgcagagctggc

SEQ ID NO: 1329791 - DNA, 22 bp, Homo sapiens
ctgcctccagggctggactgag

SEQ ID NO: 1329792 - DNA, 23 bp, Homo sapiens
ctgcctccagggctggactgagg

SEQ ID NO: 1329793 - DNA, 18 bp, Homo sapiens
ctggactgaggcctgagc

SEQ ID NO: 1329794 - DNA, 23 bp, Homo sapiens
ctggagcccagaggagggcagca

SEQ ID NO: 1329795 - DNA, 16 bp, Homo sapiens
ctggggggcagtggtg

SEQ ID NO: 1329796 - DNA, 15 bp, Homo sapiens
ctgggtggggcagtg

SEQ ID NO: 1329797 - DNA, 23 bp, Homo sapiens
ctggttcggatttggggtggatt

SEQ ID NO: 1329798 - DNA, 18 bp, Homo sapiens
ctgtgagactcgagaact

SEQ ID NO: 1329799 - DNA, 17 bp, Homo sapiens
cttagctcccctccaac

SEQ ID NO: 1329800 - DNA, 15 bp, Homo sapiens
cttcagccctcaccc

SEQ ID NO: 1329801 - DNA, 16 bp, Homo sapiens
cttcctggagcccaga

SEQ ID NO: 1329802 - DNA, 22 bp, Homo sapiens
cttcctggagcccagaggaggg

SEQ ID NO: 1329803 - DNA, 17 bp, Homo sapiens
cttccttgcttaaggta

SEQ ID NO: 1329804 - DNA, 22 bp, Homo sapiens
cttctcatttcacccctccctt

SEQ ID NO: 1329805 - DNA, 15 bp, Homo sapiens
cttctgggtggggca

SEQ ID NO: 1329806 - DNA, 16 bp, Homo sapiens
cttgacagaacactgt

SEQ ID NO: 1329807 - DNA, 23 bp, Homo sapiens
cttgcctctgtccccttctctca

SEQ ID NO: 1329808 - DNA, 22 bp, Homo sapiens
cttgtgtttttaactcaatatt

SEQ ID NO: 1329809 - DNA, 21 bp, Homo sapiens
ctttcaatggtttgcaaggaa

SEQ ID NO: 1329810 - DNA, 19 bp, Homo sapiens
ctttcatttttttccaggc

SEQ ID NO: 1329811 - DNA, 14 bp, Homo sapiens
aaaattaacactgc

SEQ ID NO: 1329812 - DNA, 14 bp, Homo sapiens
aaacaaaatttcta

SEQ ID NO: 1329813 - DNA, 12 bp, Homo sapiens
aaataatgtctc

SEQ ID NO: 1329814 - DNA, 16 bp, Homo sapiens
aaatgatcttttcaag

SEQ ID NO: 1329815 - DNA, 21 bp, Homo sapiens
aaattaacactgcttgtgttt

SEQ ID NO: 1329816 - DNA, 13 bp, Homo sapiens
aacaacatgtata

SEQ ID NO: 1329817 - DNA, 14 bp, Homo sapiens
aacactatatggca

SEQ ID NO: 1329818 - DNA, 18 bp, Homo sapiens
aacactatatggcagtgt

SEQ ID NO: 1329819 - DNA, 11 bp, Homo sapiens
aacatcttttc

SEQ ID NO: 1329820 - DNA, 17 bp, Homo sapiens
aacatgtataatatttt

SEQ ID NO: 1329821 - DNA, 14 bp, Homo sapiens
aaccccccagcact

SEQ ID NO: 1329822 - DNA, 18 bp, Homo sapiens
aaccccccagcactgagg

SEQ ID NO: 1329823 - DNA, 16 bp, Homo sapiens
aacggggctcttctca

SEQ ID NO: 1329824 - DNA, 15 bp, Homo sapiens
aactacaaacaaaat

SEQ ID NO: 1329825 - DNA, 12 bp, Homo sapiens
aactcaatattt

SEQ ID NO: 1329826 - DNA, 21 bp, Homo sapiens
aactcaatattttccatgaaa

SEQ ID NO: 1329827 - DNA, 13 bp, Homo sapiens
aactggtatttta

SEQ ID NO: 1329828 - DNA, 11 bp, Homo sapiens
aactttcattt

SEQ ID NO: 1329829 - DNA, 17 bp, Homo sapiens
aactttcatttttttcc

SEQ ID NO: 1329830 - DNA, 23 bp, Homo sapiens
aagaacggggctcttctcatttc

SEQ ID NO: 1329831 - DNA, 14 bp, Homo sapiens
aagccacaggcctg

SEQ ID NO: 1329832 - DNA, 22 bp, Homo sapiens
aaggaagccacagctggtggta

SEQ ID NO: 1329833 - DNA, 14 bp, Homo sapiens
aagttaaattttat

SEQ ID NO: 1329834 - DNA, 12 bp, Homo sapiens
aataatgtctct

SEQ ID NO: 1329835 - DNA, 17 bp, Homo sapiens
aatggcacagcccaaag

SEQ ID NO: 1329836 - DNA, 22 bp, Homo sapiens
aattaagttagggaatggcaca

SEQ ID NO: 1329837 - DNA, 14 bp, Homo sapiens
aattctaacttttt

SEQ ID NO: 1329838 - DNA, 12 bp, Homo sapiens
aatttaaagcaa

SEQ ID NO: 1329839 - DNA, 21 bp, Homo sapiens
aatttgatagtattgtgcata

SEQ ID NO: 1329840 - DNA, 16 bp, Homo sapiens
acaaacaaaatttcta

SEQ ID NO: 1329841 - DNA, 19 bp, Homo sapiens
acaaacatgtggttaatgc

SEQ ID NO: 1329842 - DNA, 13 bp, Homo sapiens
acaatttaaagca

SEQ ID NO: 1329843 - DNA, 20 bp, Homo sapiens
acactgagaatgtaagaact

SEQ ID NO: 1329844 - DNA, 13 bp, Homo sapiens
acactgtcttgaa

SEQ ID NO: 1329845 - DNA, 17 bp, Homo sapiens
acagcccaaagaaggaa

SEQ ID NO: 1329846 - DNA, 20 bp, Homo sapiens
acatgtataatatttttaat

SEQ ID NO: 1329847 - DNA, 21 bp, Homo sapiens
acatttgtagcatcctcttta

SEQ ID NO: 1329848 - DNA, 14 bp, Homo sapiens
accccccagcactg

SEQ ID NO: 1329849 - DNA, 17 bp, Homo sapiens
accccccagcactgagg

SEQ ID NO: 1329850 - DNA, 19 bp, Homo sapiens
accccccagcactgaggaa

SEQ ID NO: 1329851 - DNA, 19 bp, Homo sapiens
acccctccctttctcccct

SEQ ID NO: 1329852 - DNA, 22 bp, Homo sapiens
acccctggttctcatctttctt

SEQ ID NO: 1329853 - DNA, 15 bp, Homo sapiens
acggggctcttctca

SEQ ID NO: 1329854 - DNA, 18 bp, Homo sapiens
acggggctcttctcattt

SEQ ID NO: 1329855 - DNA, 18 bp, Homo sapiens
acgtgtactacaatttaa

SEQ ID NO: 1329856 - DNA, 12 bp, Homo sapiens
actcaatatttt

SEQ ID NO: 1329857 - DNA, 16 bp, Homo sapiens
caccaggtagaacaca

SEQ ID NO: 1329858 - DNA, 18 bp, Homo sapiens
cacccctggttctcatct

SEQ ID NO: 1329859 - DNA, 19 bp, Homo sapiens
cactgagaatgtaagaact

SEQ ID NO: 1329860 - DNA, 13 bp, Homo sapiens
cactgaggaagaa

SEQ ID NO: 1329861 - DNA, 15 bp, Homo sapiens
cactgaggaagaacg

SEQ ID NO: 1329862 - DNA, 17 bp, Homo sapiens
cactgaggaagaacggg

SEQ ID NO: 1329863 - DNA, 17 bp, Homo sapiens
cactttcagtgaaagca

SEQ ID NO: 1329864 - DNA, 18 bp, Homo sapiens
cactttcagtgaaagcat

SEQ ID NO: 1329865 - DNA, 15 bp, Homo sapiens
cagaagaaggcagca

SEQ ID NO: 1329866 - DNA, 19 bp, Homo sapiens
cagaagggggtggtgtctc

SEQ ID NO: 1329867 - DNA, 20 bp, Homo sapiens
cagagctacccgcagagttc

SEQ ID NO: 1329868 - DNA, 9 bp, Homo sapiens
cagagctgg

SEQ ID NO: 1329869 - DNA, 14 bp, Homo sapiens
cagaggagggcagc

SEQ ID NO: 1329870 - DNA, 12 bp, Homo sapiens
cagcactgagga

SEQ ID NO: 1329871 - DNA, 17 bp, Homo sapiens
cagcagaagggggtggt

SEQ ID NO: 1329872 - DNA, 17 bp, Homo sapiens
cagcccaaagaaggaaa

SEQ ID NO: 1329873 - DNA, 13 bp, Homo sapiens
cagctatttttat

SEQ ID NO: 1329874 - DNA, 12 bp, Homo sapiens
caggactgggcc

SEQ ID NO: 1329875 - DNA, 18 bp, Homo sapiens
caggcctgagatttcatc

SEQ ID NO: 1329876 - DNA, 19 bp, Homo sapiens
cagggctggactgaggcct

SEQ ID NO: 1329877 - DNA, 23 bp, Homo sapiens
cagggctggactgaggcctgagc

SEQ ID NO: 1329878 - DNA, 20 bp, Homo sapiens
caggtatgaccttctaggaa

SEQ ID NO: 1329879 - DNA, 15 bp, Homo sapiens
cagttcctttcaatg

SEQ ID NO: 1329880 - DNA, 14 bp, Homo sapiens
catctctctttaat

SEQ ID NO: 1329881 - DNA, 14 bp, Homo sapiens
catctgctctcctt

SEQ ID NO: 1329882 - DNA, 14 bp, Homo sapiens
catcttttcttgcc

SEQ ID NO: 1329883 - DNA, 15 bp, Homo sapiens
catggacagaagaag

SEQ ID NO: 1329884 - DNA, 18 bp, Homo sapiens
catgtataatatttttaa

SEQ ID NO: 1329885 - DNA, 22 bp, Homo sapiens
cattatgatgtgggtcaaggaa

SEQ ID NO: 1329886 - DNA, 15 bp, Homo sapiens
catttcacccctccc

SEQ ID NO: 1329887 - DNA, 17 bp, Homo sapiens
catttcacccctccctt

SEQ ID NO: 1329888 - DNA, 18 bp, Homo sapiens
catttcacccctcccttt

SEQ ID NO: 1329889 - DNA, 21 bp, Homo sapiens
catttcacccctccctttctc

SEQ ID NO: 1329890 - DNA, 23 bp, Homo sapiens
catttcacccctccctttctccc

SEQ ID NO: 1329891 - DNA, 20 bp, Homo sapiens
catttgctaactagcttgga

SEQ ID NO: 1329892 - DNA, 17 bp, Homo sapiens
catttttttccaggctg

SEQ ID NO: 1329893 - DNA, 15 bp, Homo sapiens
ccaaataatgtctct

SEQ ID NO: 1329894 - DNA, 13 bp, Homo sapiens
ccaaccccccagc

SEQ ID NO: 1329895 - DNA, 14 bp, Homo sapiens
ccaaccccccagca

SEQ ID NO: 1329896 - DNA, 18 bp, Homo sapiens
ccaaccccccagcactga

SEQ ID NO: 1329897 - DNA, 24 bp, Homo sapiens
ccaacggcaagggaacaagtactt

SEQ ID NO: 1329898 - DNA, 22 bp, Homo sapiens
ccaagagctgaggcaattctaa

SEQ ID NO: 1329899 - DNA, 18 bp, Homo sapiens
ccaattcttacaaacatg

SEQ ID NO: 1329900 - DNA, 19 bp, Homo sapiens
ccaattcttacaaacatgt

SEQ ID NO: 1329901 - DNA, 22 bp, Homo sapiens
ccacaggcctgagatttcatct

SEQ ID NO: 1329902 - DNA, 12 bp, Homo sapiens
ccagaggagggc

SEQ ID NO: 1329903 - DNA, 20 bp, Homo sapiens
ccagattggctcacactgag

SEQ ID NO: 1329904 - DNA, 21 bp, Homo sapiens
ccagattggctcacactgaga

SEQ ID NO: 1329905 - DNA, 22 bp, Homo sapiens
ccagcactgaggaagaacgggg

SEQ ID NO: 1329906 - DNA, 12 bp, Homo sapiens
ccaggactgggc

SEQ ID NO: 1329907 - DNA, 13 bp, Homo sapiens
ccagggctggact

SEQ ID NO: 1329908 - DNA, 19 bp, Homo sapiens
ccagggctggactgaggcc

SEQ ID NO: 1329909 - DNA, 23 bp, Homo sapiens
ccagttcctttcaatggtttgca

SEQ ID NO: 1329910 - DNA, 19 bp, Homo sapiens
cccagattggctcacactg

SEQ ID NO: 1329911 - DNA, 20 bp, Homo sapiens
cccagattggctcacactga

SEQ ID NO: 1329912 - DNA, 21 bp, Homo sapiens
cccagattggctcacactgag

SEQ ID NO: 1329913 - DNA, 22 bp, Homo sapiens
cccagattggctcacactgaga

SEQ ID NO: 1329914 - DNA, 14 bp, Homo sapiens
cccagcactgagga

SEQ ID NO: 1329915 - DNA, 24 bp, Homo sapiens
cccagcactgaggaagaacggggc

SEQ ID NO: 1329916 - DNA, 14 bp, Homo sapiens
cccaggactgggcc

SEQ ID NO: 1329917 - DNA, 13 bp, Homo sapiens
ccccagcactgag

SEQ ID NO: 1329918 - DNA, 22 bp, Homo sapiens
ccccaggactgggccacttctg

SEQ ID NO: 1329919 - DNA, 12 bp, Homo sapiens
cccccaccccct

SEQ ID NO: 1329920 - DNA, 13 bp, Homo sapiens
cccccagcactga

SEQ ID NO: 1329921 - DNA, 17 bp, Homo sapiens
cccccagcactgaggaa

SEQ ID NO: 1329922 - DNA, 11 bp, Homo sapiens
cccccaggact

SEQ ID NO: 1329923 - DNA, 15 bp, Homo sapiens
cccccaggactgggc

SEQ ID NO: 1329924 - DNA, 17 bp, Homo sapiens
cccccaggactgggcca

SEQ ID NO: 1329925 - DNA, 14 bp, Homo sapiens
ccccccagcactga

SEQ ID NO: 1329926 - DNA, 23 bp, Homo sapiens
cccctgcccccaggactgggcca

SEQ ID NO: 1329927 - DNA, 13 bp, Homo sapiens
ccccttctctcat

SEQ ID NO: 1329928 - DNA, 16 bp, Homo sapiens
ccctgcccccaggact

SEQ ID NO: 1329929 - DNA, 15 bp, Homo sapiens
ccctggttctcatct

SEQ ID NO: 1329930 - DNA, 22 bp, Homo sapiens
ccctttctcccctgcccccagg

SEQ ID NO: 1329931 - DNA, 15 bp, Homo sapiens
ccgcagagctggccg

SEQ ID NO: 1329932 - DNA, 19 bp, Homo sapiens
cctccactctcccccaccc

SEQ ID NO: 1329933 - DNA, 12 bp, Homo sapiens
cctccagggctg

SEQ ID NO: 1329934 - DNA, 18 bp, Homo sapiens
cctccagggctggactga

SEQ ID NO: 1329935 - DNA, 13 bp, Homo sapiens
cctccctttctcc

SEQ ID NO: 1329936 - DNA, 16 bp, Homo sapiens
cctcctccactctccc

SEQ ID NO: 1329937 - DNA, 18 bp, Homo sapiens
cctctgtccccttctctc

SEQ ID NO: 1329938 - DNA, 12 bp, Homo sapiens
cctgagcgctcc

SEQ ID NO: 1329939 - DNA, 16 bp, Homo sapiens
cctgagcgctcctgcc

SEQ ID NO: 1329940 - DNA, 15 bp, Homo sapiens
cctgcccccaggact

SEQ ID NO: 1329941 - DNA, 17 bp, Homo sapiens
cctgccgcagagctggc

SEQ ID NO: 1329942 - DNA, 17 bp, Homo sapiens
cctgcctccagggctgg

SEQ ID NO: 1329943 - DNA, 13 bp, Homo sapiens
cctggagcccaga

SEQ ID NO: 1329944 - DNA, 16 bp, Homo sapiens
cctggttctcatcttt

SEQ ID NO: 1329945 - DNA, 14 bp, Homo sapiens
ccttctaggaagct

SEQ ID NO: 1329946 - DNA, 15 bp, Homo sapiens
ccttctctcatctct

SEQ ID NO: 1329947 - DNA, 20 bp, Homo sapiens
cctttctcccctgcccccag

SEQ ID NO: 1329948 - DNA, 16 bp, Homo sapiens
cgagaactttcatttt

SEQ ID NO: 1329949 - DNA, 17 bp, Homo sapiens
cgaggaggtaatgaatt

SEQ ID NO: 1329950 - DNA, 17 bp, Homo sapiens
cgccaaataatgtctct

SEQ ID NO: 1329951 - DNA, 21 bp, Homo sapiens
cgcgccaaataatgtctctgt

SEQ ID NO: 1329952 - DNA, 23 bp, Homo sapiens
cgcgccaaataatgtctctgtga

SEQ ID NO: 1329953 - DNA, 16 bp, Homo sapiens
cggggctcttctcatt

SEQ ID NO: 1329954 - DNA, 17 bp, Homo sapiens
ctacaaacaaaatttct

SEQ ID NO: 1329955 - DNA, 15 bp, Homo sapiens
ctacccgcagagttc

SEQ ID NO: 1329956 - DNA, 18 bp, Homo sapiens
ctcaactagcagatacag

SEQ ID NO: 1329957 - DNA, 11 bp, Homo sapiens
ctcaatatttt

SEQ ID NO: 1329958 - DNA, 18 bp, Homo sapiens
ctcaatattttccatgaa

SEQ ID NO: 1329959 - DNA, 19 bp, Homo sapiens
ctcaatattttccatgaaa

SEQ ID NO: 1329960 - DNA, 12 bp, Homo sapiens
ctcacactgaga

SEQ ID NO: 1329961 - DNA, 13 bp, Homo sapiens
ctcacactgagaa

SEQ ID NO: 1329962 - DNA, 19 bp, Homo sapiens
ctcacccctggttctcatc

SEQ ID NO: 1329963 - DNA, 14 bp, Homo sapiens
ctcatttcacccct

SEQ ID NO: 1329964 - DNA, 22 bp, Homo sapiens
ctcatttcacccctccctttct

SEQ ID NO: 1329965 - DNA, 20 bp, Homo sapiens
ctccaaccccccagcactga

SEQ ID NO: 1329966 - DNA, 16 bp, Homo sapiens
ctccactctcccccac

SEQ ID NO: 1329967 - DNA, 17 bp, Homo sapiens
ctccagggctggactga

SEQ ID NO: 1329968 - DNA, 20 bp, Homo sapiens
ctccagggctggactgaggc

SEQ ID NO: 1329969 - DNA, 15 bp, Homo sapiens
ctcccctccaacctg

SEQ ID NO: 1329970 - DNA, 13 bp, Homo sapiens
ctcccctgccccc

SEQ ID NO: 1329971 - DNA, 16 bp, Homo sapiens
ctcccctgcccccagg

SEQ ID NO: 1329972 - DNA, 22 bp, Homo sapiens
ctcccctgcccccaggactggg

SEQ ID NO: 1329973 - DNA, 12 bp, Homo sapiens
ctccctttctcc

SEQ ID NO: 1329974 - DNA, 16 bp, Homo sapiens
ctcctgccgcagagct

SEQ ID NO: 1329975 - DNA, 17 bp, Homo sapiens
ctcctgccgcagagctg

SEQ ID NO: 1329976 - DNA, 13 bp, Homo sapiens
ctccttcagccct

SEQ ID NO: 1329977 - DNA, 15 bp, Homo sapiens
ctccttcagccctca

SEQ ID NO: 1329978 - DNA, 12 bp, Homo sapiens
agacagagctgg

SEQ ID NO: 1329979 - DNA, 17 bp, Homo sapiens
agactatattgtacaca

SEQ ID NO: 1329980 - DNA, 19 bp, Homo sapiens
agactcgagaactttcatt

SEQ ID NO: 1329981 - DNA, 23 bp, Homo sapiens
agaggagggcagcagaagggggt

SEQ ID NO: 1329982 - DNA, 14 bp, Homo sapiens
agattggctcacac

SEQ ID NO: 1329983 - DNA, 13 bp, Homo sapiens
agatttcatctgc

SEQ ID NO: 1329984 - DNA, 18 bp, Homo sapiens
agatttcatctgctctcc

SEQ ID NO: 1329985 - DNA, 10 bp, Homo sapiens
agcactgagg

SEQ ID NO: 1329986 - DNA, 21 bp, Homo sapiens
agcactgaggaagaacggggc

SEQ ID NO: 1329987 - DNA, 22 bp, Homo sapiens
agcagaagggggtggtgtctcc

SEQ ID NO: 1329988 - DNA, 22 bp, Homo sapiens
agccacaggcctgagatttcat

SEQ ID NO: 1329989 - DNA, 13 bp, Homo sapiens
agcccaaagaagg

SEQ ID NO: 1329990 - DNA, 12 bp, Homo sapiens
agcccagaggag

SEQ ID NO: 1329991 - DNA, 16 bp, Homo sapiens
agcccagaggagggca

SEQ ID NO: 1329992 - DNA, 20 bp, Homo sapiens
agcgctcctgccgcagagct

SEQ ID NO: 1329993 - DNA, 22 bp, Homo sapiens
agcgctcctgccgcagagctgg

SEQ ID NO: 1329994 - DNA, 21 bp, Homo sapiens
agctggtggtatctgagttga

SEQ ID NO: 1329995 - DNA, 22 bp, Homo sapiens
aggaagaacggggctcttctca

SEQ ID NO: 1329996 - DNA, 23 bp, Homo sapiens
aggaattaagttagggaatggca

SEQ ID NO: 1329997 - DNA, 11 bp, Homo sapiens
aggactgggcc

SEQ ID NO: 1329998 - DNA, 15 bp, Homo sapiens
aggactgggccactt

SEQ ID NO: 1329999 - DNA, 22 bp, Homo sapiens
aggcctgagcgctcctgccgca

SEQ ID NO: 1330000 - DNA, 22 bp, Homo sapiens
aggctggttcggatttggggtg

SEQ ID NO: 1330001 - DNA, 21 bp, Homo sapiens
agggagaagactatattgtac

SEQ ID NO: 1330002 - DNA, 14 bp, Homo sapiens
agggctggactgag

SEQ ID NO: 1330003 - DNA, 18 bp, Homo sapiens
agggctggactgaggcct

SEQ ID NO: 1330004 - DNA, 20 bp, Homo sapiens
agggctggactgaggcctga

SEQ ID NO: 1330005 - DNA, 14 bp, Homo sapiens
aggtttctgaaaat

SEQ ID NO: 1330006 - DNA, 23 bp, Homo sapiens
aggtttctgaaaattaacactgc

SEQ ID NO: 1330007 - DNA, 21 bp, Homo sapiens
agtagaaagacagagctggga

SEQ ID NO: 1330008 - DNA, 20 bp, Homo sapiens
ataatatttttaattaaata

SEQ ID NO: 1330009 - DNA, 13 bp, Homo sapiens
atataaacactat

SEQ ID NO: 1330010 - DNA, 20 bp, Homo sapiens
atatggggatgcagcattat

SEQ ID NO: 1330011 - DNA, 11 bp, Homo sapiens
atattttaatt

SEQ ID NO: 1330012 - DNA, 16 bp, Homo sapiens
atctcttagctcccct

SEQ ID NO: 1330013 - DNA, 22 bp, Homo sapiens
atctcttagctcccctccaacc

SEQ ID NO: 1330014 - DNA, 21 bp, Homo sapiens
atctgctctccttcctggagc

SEQ ID NO: 1330015 - DNA, 14 bp, Homo sapiens
atcttttcttgcct

SEQ ID NO: 1330016 - DNA, 19 bp, Homo sapiens
atgaaggtttctgaaaatt

SEQ ID NO: 1330017 - DNA, 18 bp, Homo sapiens
atgaccttctaggaagct

SEQ ID NO: 1330018 - DNA, 15 bp, Homo sapiens
atgatcttttcaagt

SEQ ID NO: 1330019 - DNA, 16 bp, Homo sapiens
atgcaacaacatgtat

SEQ ID NO: 1330020 - DNA, 20 bp, Homo sapiens
atggacagaagaaggcagca

SEQ ID NO: 1330021 - DNA, 14 bp, Homo sapiens
atgtataatatttt

SEQ ID NO: 1330022 - DNA, 14 bp, Homo sapiens
atgtatgattacat

SEQ ID NO: 1330023 - DNA, 21 bp, Homo sapiens
atgtctctgtgagactcgaga

SEQ ID NO: 1330024 - DNA, 16 bp, Homo sapiens
atgtgggtcaaggaat

SEQ ID NO: 1330025 - DNA, 20 bp, Homo sapiens
attaatatggggatgcagca

SEQ ID NO: 1330026 - DNA, 17 bp, Homo sapiens
attcatctctctttaat

SEQ ID NO: 1330027 - DNA, 22 bp, Homo sapiens
attcatctctctttaatataaa

SEQ ID NO: 1330028 - DNA, 19 bp, Homo sapiens
attctaacttttttgctat

SEQ ID NO: 1330029 - DNA, 14 bp, Homo sapiens
attctccttcagcc

SEQ ID NO: 1330030 - DNA, 16 bp, Homo sapiens
attctccttcagccct

SEQ ID NO: 1330031 - DNA, 22 bp, Homo sapiens
attctccttcagccctcacccc

SEQ ID NO: 1330032 - DNA, 16 bp, Homo sapiens
attgcatatatacata

SEQ ID NO: 1330033 - DNA, 15 bp, Homo sapiens
attggctcacactga

SEQ ID NO: 1330034 - DNA, 19 bp, Homo sapiens
attgtacacaccttatatt

SEQ ID NO: 1330035 - DNA, 15 bp, Homo sapiens
atttcacccctccct

SEQ ID NO: 1330036 - DNA, 21 bp, Homo sapiens
atttcacccctccctttctcc

SEQ ID NO: 1330037 - DNA, 16 bp, Homo sapiens
atttcatctgctctcc

SEQ ID NO: 1330038 - DNA, 17 bp, Homo sapiens
atttcatctgctctcct

SEQ ID NO: 1330039 - DNA, 15 bp, Homo sapiens
atttccaagagctga

SEQ ID NO: 1330040 - DNA, 20 bp, Homo sapiens
atttgatagtattgtgcata

SEQ ID NO: 1330041 - DNA, 21 bp, Homo sapiens
attttatctttgattctcctt

SEQ ID NO: 1330042 - DNA, 20 bp, Homo sapiens
attttatgccttttatttct

SEQ ID NO: 1330043 - DNA, 15 bp, Homo sapiens
attttccatgaaaat

SEQ ID NO: 1330044 - DNA, 18 bp, Homo sapiens
caaacaaaatttctatta

SEQ ID NO: 1330045 - DNA, 21 bp, Homo sapiens
caacaacatgtataatatttt

SEQ ID NO: 1330046 - DNA, 14 bp, Homo sapiens
caaccccccagcac

SEQ ID NO: 1330047 - DNA, 18 bp, Homo sapiens
caaccccccagcactgag

SEQ ID NO: 1330048 - DNA, 20 bp, Homo sapiens
caacctggggggcagtggtg

SEQ ID NO: 1330049 - DNA, 16 bp, Homo sapiens
caatattttccatgaa

SEQ ID NO: 1330050 - DNA, 22 bp, Homo sapiens
caatattttccatgaaaatgca

SEQ ID NO: 1330051 - DNA, 18 bp, Homo sapiens
caatggtttgcaaggaag

SEQ ID NO: 1330052 - DNA, 18 bp, Homo sapiens
caattcttacaaacatgt

SEQ ID NO: 1330053 - DNA, 22 bp, Homo sapiens
cacaggcctgagatttcatctg

SEQ ID NO: 1330054 - DNA, 13 bp, Homo sapiens
caccattcaggtc

SEQ ID NO: 1330055 - DNA, 16 bp, Homo sapiens
cactctcccccacccc

SEQ ID NO: 1330056 - DNA, 16 bp, Homo sapiens
cactgagaatgtaaga

SEQ ID NO: 1330057 - DNA, 13 bp, Homo sapiens
cagcactgaggaa

SEQ ID NO: 1330058 - DNA, 15 bp, Homo sapiens
cagcactgaggaaga

SEQ ID NO: 1330059 - DNA, 13 bp, Homo sapiens
cagcagaaggggg

SEQ ID NO: 1330060 - DNA, 16 bp, Homo sapiens
caggactgggccactt

SEQ ID NO: 1330061 - DNA, 14 bp, Homo sapiens
caggcctgagattt

SEQ ID NO: 1330062 - DNA, 19 bp, Homo sapiens
caggcctgagatttcatct

SEQ ID NO: 1330063 - DNA, 14 bp, Homo sapiens
cagggctggactga

SEQ ID NO: 1330064 - DNA, 21 bp, Homo sapiens
cagggctggactgaggcctga

SEQ ID NO: 1330065 - DNA, 14 bp, Homo sapiens
cagtgaaagcatca

SEQ ID NO: 1330066 - DNA, 13 bp, Homo sapiens
catctgctctcct

SEQ ID NO: 1330067 - DNA, 15 bp, Homo sapiens
catctgctctccttc

SEQ ID NO: 1330068 - DNA, 16 bp, Homo sapiens
catctgctctccttcc

SEQ ID NO: 1330069 - DNA, 18 bp, Homo sapiens
catctgctctccttcctg

SEQ ID NO: 1330070 - DNA, 20 bp, Homo sapiens
catctgctctccttcctgga

SEQ ID NO: 1330071 - DNA, 13 bp, Homo sapiens
catgaaaatgcaa

SEQ ID NO: 1330072 - DNA, 15 bp, Homo sapiens
catgaaggtttctga

SEQ ID NO: 1330073 - DNA, 22 bp, Homo sapiens
catgtggttaatgccatggaca

SEQ ID NO: 1330074 - DNA, 21 bp, Homo sapiens
cattatgatgtgggtcaagga

SEQ ID NO: 1330075 - DNA, 20 bp, Homo sapiens
catttcacccctccctttct

SEQ ID NO: 1330076 - DNA, 22 bp, Homo sapiens
catttcacccctccctttctcc

SEQ ID NO: 1330077 - DNA, 18 bp, Homo sapiens
catttttttccaggctgg

SEQ ID NO: 1330078 - DNA, 17 bp, Homo sapiens
ccaaataatgtctctgt

SEQ ID NO: 1330079 - DNA, 17 bp, Homo sapiens
ccaaccccccagcactg

SEQ ID NO: 1330080 - DNA, 21 bp, Homo sapiens
ccaaccccccagcactgagga

SEQ ID NO: 1330081 - DNA, 20 bp, Homo sapiens
ccactctcccccaccccctc

SEQ ID NO: 1330082 - DNA, 20 bp, Homo sapiens
ccagagctacccgcagagtt

SEQ ID NO: 1330083 - DNA, 22 bp, Homo sapiens
ccagaggagggcagcagaaggg

SEQ ID NO: 1330084 - DNA, 19 bp, Homo sapiens
ccagattggctcacactga

SEQ ID NO: 1330085 - DNA, 12 bp, Homo sapiens
ccagcactgagg

SEQ ID NO: 1330086 - DNA, 15 bp, Homo sapiens
ccagcactgaggaag

SEQ ID NO: 1330087 - DNA, 17 bp, Homo sapiens
ccagcactgaggaagaa

SEQ ID NO: 1330088 - DNA, 17 bp, Homo sapiens
ccagggctggactgagg

SEQ ID NO: 1330089 - DNA, 18 bp, Homo sapiens
ccagggctggactgaggc

SEQ ID NO: 1330090 - DNA, 21 bp, Homo sapiens
ccagttcctttcaatggtttg

SEQ ID NO: 1330091 - DNA, 22 bp, Homo sapiens
ccagttcctttcaatggtttgc

SEQ ID NO: 1330092 - DNA, 21 bp, Homo sapiens
cccaattcttacaaacatgtg

SEQ ID NO: 1330093 - DNA, 17 bp, Homo sapiens
cccagattggctcacac

SEQ ID NO: 1330094 - DNA, 15 bp, Homo sapiens
ccccagcactgagga

SEQ ID NO: 1330095 - DNA, 13 bp, Homo sapiens
ccccaggactggg

SEQ ID NO: 1330096 - DNA, 14 bp, Homo sapiens
ccccaggactgggc

SEQ ID NO: 1330097 - DNA, 15 bp, Homo sapiens
cccccagcactgagg

SEQ ID NO: 1330098 - DNA, 20 bp, Homo sapiens
tcaatttccaagagctgagg

SEQ ID NO: 1330099 - DNA, 15 bp, Homo sapiens
tcacccctggttctc

SEQ ID NO: 1330100 - DNA, 18 bp, Homo sapiens
tcacccctggttctcatc

SEQ ID NO: 1330101 - DNA, 12 bp, Homo sapiens
tcaggacactaa

SEQ ID NO: 1330102 - DNA, 16 bp, Homo sapiens
tcatctctctttaata

SEQ ID NO: 1330103 - DNA, 14 bp, Homo sapiens
tcatctcttagctc

SEQ ID NO: 1330104 - DNA, 14 bp, Homo sapiens
tcatctgctctcct

SEQ ID NO: 1330105 - DNA, 22 bp, Homo sapiens
tcatctttcttgatcaacatct

SEQ ID NO: 1330106 - DNA, 16 bp, Homo sapiens
tcatttcacccctccc

SEQ ID NO: 1330107 - DNA, 18 bp, Homo sapiens
tccaaccccccagcactg

SEQ ID NO: 1330108 - DNA, 23 bp, Homo sapiens
tccaaccccccagcactgaggaa

SEQ ID NO: 1330109 - DNA, 21 bp, Homo sapiens
tccaacctggggggcagtggt

SEQ ID NO: 1330110 - DNA, 12 bp, Homo sapiens
tccaagagctga

SEQ ID NO: 1330111 - DNA, 12 bp, Homo sapiens
tccactctcccc

SEQ ID NO: 1330112 - DNA, 14 bp, Homo sapiens
tccactctccccca

SEQ ID NO: 1330113 - DNA, 16 bp, Homo sapiens
tccactctcccccacc

SEQ ID NO: 1330114 - DNA, 18 bp, Homo sapiens
tccactctcccccacccc

SEQ ID NO: 1330115 - DNA, 21 bp, Homo sapiens
tccagctatttttatttgttt

SEQ ID NO: 1330116 - DNA, 22 bp, Homo sapiens
tccagggctggactgaggcctg

SEQ ID NO: 1330117 - DNA, 18 bp, Homo sapiens
tcccagattggctcacac

SEQ ID NO: 1330118 - DNA, 19 bp, Homo sapiens
tcccagattggctcacact

SEQ ID NO: 1330119 - DNA, 19 bp, Homo sapiens
tcccccaccccctccccgc

SEQ ID NO: 1330120 - DNA, 13 bp, Homo sapiens
tccccgccctttt

SEQ ID NO: 1330121 - DNA, 16 bp, Homo sapiens
tcccctcctccactct

SEQ ID NO: 1330122 - DNA, 16 bp, Homo sapiens
tcccctgcccccagga

SEQ ID NO: 1330123 - DNA, 17 bp, Homo sapiens
tcccctgcccccaggac

SEQ ID NO: 1330124 - DNA, 19 bp, Homo sapiens
tcccctgcccccaggactg

SEQ ID NO: 1330125 - DNA, 20 bp, Homo sapiens
tcccctgcccccaggactgg

SEQ ID NO: 1330126 - DNA, 13 bp, Homo sapiens
tccccttctctca

SEQ ID NO: 1330127 - DNA, 15 bp, Homo sapiens
tccccttctctcatc

SEQ ID NO: 1330128 - DNA, 18 bp, Homo sapiens
tccccttctctcatctct

SEQ ID NO: 1330129 - DNA, 17 bp, Homo sapiens
tccctttctcccctgcc

SEQ ID NO: 1330130 - DNA, 18 bp, Homo sapiens
tccctttctcccctgccc

SEQ ID NO: 1330131 - DNA, 23 bp, Homo sapiens
tcctccactctcccccaccccct

SEQ ID NO: 1330132 - DNA, 13 bp, Homo sapiens
tcctgccgcagag

SEQ ID NO: 1330133 - DNA, 19 bp, Homo sapiens
tccttcagccctcacccct

SEQ ID NO: 1330134 - DNA, 21 bp, Homo sapiens
tccttcagccctcacccctgg

SEQ ID NO: 1330135 - DNA, 20 bp, Homo sapiens
tccttcctggagcccagagg

SEQ ID NO: 1330136 - DNA, 19 bp, Homo sapiens
tcctttcaatggtttgcaa

SEQ ID NO: 1330137 - DNA, 20 bp, Homo sapiens
tctcatctcttagctcccct

SEQ ID NO: 1330138 - DNA, 13 bp, Homo sapiens
tctcatctttctt

SEQ ID NO: 1330139 - DNA, 19 bp, Homo sapiens
tctcatttcacccctccct

SEQ ID NO: 1330140 - DNA, 22 bp, Homo sapiens
tctcatttcacccctccctttc

SEQ ID NO: 1330141 - DNA, 17 bp, Homo sapiens
tctccaaccccccagca

SEQ ID NO: 1330142 - DNA, 19 bp, Homo sapiens
tctccaaccccccagcact

SEQ ID NO: 1330143 - DNA, 20 bp, Homo sapiens
tctccaaccccccagcactg

SEQ ID NO: 1330144 - DNA, 22 bp, Homo sapiens
tctccaaccccccagcactgag

SEQ ID NO: 1330145 - DNA, 15 bp, Homo sapiens
tctcccctgccccca

SEQ ID NO: 1330146 - DNA, 22 bp, Homo sapiens
tctctcatctcttagctcccct

SEQ ID NO: 1330147 - DNA, 23 bp, Homo sapiens
tctctcatctcttagctcccctc

SEQ ID NO: 1330148 - DNA, 14 bp, Homo sapiens
tctctgtgagactc

SEQ ID NO: 1330149 - DNA, 18 bp, Homo sapiens
tctcttagctcccctcca

SEQ ID NO: 1330150 - DNA, 17 bp, Homo sapiens
tctgaaaattaacactg

SEQ ID NO: 1330151 - DNA, 12 bp, Homo sapiens
tctgctctcctt

SEQ ID NO: 1330152 - DNA, 15 bp, Homo sapiens
tctgctctccttcct

SEQ ID NO: 1330153 - DNA, 15 bp, Homo sapiens
tctgtccccttctct

SEQ ID NO: 1330154 - DNA, 21 bp, Homo sapiens
tctgtccccttctctcatctc

SEQ ID NO: 1330155 - DNA, 20 bp, Homo sapiens
tcttctcatttcacccctcc

SEQ ID NO: 1330156 - DNA, 22 bp, Homo sapiens
tcttctcatttcacccctccct

SEQ ID NO: 1330157 - DNA, 23 bp, Homo sapiens
tcttctcatttcacccctccctt

SEQ ID NO: 1330158 - DNA, 17 bp, Homo sapiens
tcttgatcaacatcttt

SEQ ID NO: 1330159 - DNA, 18 bp, Homo sapiens
tcttgatcaacatctttt

SEQ ID NO: 1330160 - DNA, 19 bp, Homo sapiens
tcttgatcaacatcttttc

SEQ ID NO: 1330161 - DNA, 23 bp, Homo sapiens
tcttgatcaacatcttttcttgc

SEQ ID NO: 1330162 - DNA, 16 bp, Homo sapiens
tctttgattctccttc

SEQ ID NO: 1330163 - DNA, 16 bp, Homo sapiens
tcttttcttgcctctg

SEQ ID NO: 1330164 - DNA, 20 bp, Homo sapiens
tcttttcttgcctctgtccc

SEQ ID NO: 1330165 - DNA, 13 bp, Homo sapiens
tgaaggtttctga

SEQ ID NO: 1330166 - DNA, 18 bp, Homo sapiens
tgaaggtttctgaaaatt

SEQ ID NO: 1330167 - DNA, 15 bp, Homo sapiens
tgaatataaacacta

SEQ ID NO: 1330168 - DNA, 16 bp, Homo sapiens
tgaatataaacactat

SEQ ID NO: 1330169 - DNA, 17 bp, Homo sapiens
tgacttgacagaacact

SEQ ID NO: 1330170 - DNA, 15 bp, Homo sapiens
tgagactcgagaact

SEQ ID NO: 1330171 - DNA, 13 bp, Homo sapiens
tgagatttcatct

SEQ ID NO: 1330172 - DNA, 14 bp, Homo sapiens
tgagatttcatctg

SEQ ID NO: 1330173 - DNA, 18 bp, Homo sapiens
tgagatttcatctgctct

SEQ ID NO: 1330174 - DNA, 14 bp, Homo sapiens
tgagcgctcctgcc

SEQ ID NO: 1330175 - DNA, 18 bp, Homo sapiens
tgatgtgggtcaaggaat

SEQ ID NO: 1330176 - DNA, 19 bp, Homo sapiens
tgcaaggaagccacagctg

SEQ ID NO: 1330177 - DNA, 19 bp, Homo sapiens
tgcatagagccacgtatgt

SEQ ID NO: 1330178 - DNA, 13 bp, Homo sapiens
tgcatgaaggttt

SEQ ID NO: 1330179 - DNA, 19 bp, Homo sapiens
tgcatgaaggtttctgaaa

SEQ ID NO: 1330180 - DNA, 18 bp, Homo sapiens
tgccatggacagaagaag

SEQ ID NO: 1330181 - DNA, 11 bp, Homo sapiens
tgcccccagga

SEQ ID NO: 1330182 - DNA, 13 bp, Homo sapiens
tgcccccaggact

SEQ ID NO: 1330183 - DNA, 15 bp, Homo sapiens
tgcctccagggctgg

SEQ ID NO: 1330184 - DNA, 20 bp, Homo sapiens
tgcctccagggctggactga

SEQ ID NO: 1330185 - DNA, 21 bp, Homo sapiens
tgcctccagggctggactgag

SEQ ID NO: 1330186 - DNA, 23 bp, Homo sapiens
tgcctccagggctggactgaggc

SEQ ID NO: 1330187 - DNA, 14 bp, Homo sapiens
tgcctctgtcccct

SEQ ID NO: 1330188 - DNA, 16 bp, Homo sapiens
tgcctctgtccccttc

SEQ ID NO: 1330189 - DNA, 21 bp, Homo sapiens
tgcctctgtccccttctctca

SEQ ID NO: 1330190 - DNA, 19 bp, Homo sapiens
tgctatccagctattttta

SEQ ID NO: 1330191 - DNA, 23 bp, Homo sapiens
tgctctccttcctggagcccaga

SEQ ID NO: 1330192 - DNA, 15 bp, Homo sapiens
tggactgaggcctga

SEQ ID NO: 1330193 - DNA, 16 bp, Homo sapiens
tggactgaggcctgag

SEQ ID NO: 1330194 - DNA, 18 bp, Homo sapiens
tggagaagccacaggcct

SEQ ID NO: 1330195 - DNA, 23 bp, Homo sapiens
tggagcccagaggagggcagcag

SEQ ID NO: 1330196 - DNA, 23 bp, Homo sapiens
tggatgcggaacccaaattacgt

SEQ ID NO: 1330197 - DNA, 23 bp, Homo sapiens
tggccgcgccaaataatgtctct

SEQ ID NO: 1330198 - DNA, 12 bp, Homo sapiens
tggctcacactg

SEQ ID NO: 1330199 - DNA, 13 bp, Homo sapiens
tggctcacactga

SEQ ID NO: 1330200 - DNA, 14 bp, Homo sapiens
tgggatgtttctgt

SEQ ID NO: 1330201 - DNA, 13 bp, Homo sapiens
tggttaatgccat

SEQ ID NO: 1330202 - DNA, 13 bp, Homo sapiens
tggttctcatctt

SEQ ID NO: 1330203 - DNA, 14 bp, Homo sapiens
tggttctcatcttt

SEQ ID NO: 1330204 - DNA, 15 bp, Homo sapiens
tggttctcatctttc

SEQ ID NO: 1330205 - DNA, 20 bp, Homo sapiens
tgtatttgttaatggtttga

SEQ ID NO: 1330206 - DNA, 14 bp, Homo sapiens
tgtccccttctctc

SEQ ID NO: 1330207 - DNA, 19 bp, Homo sapiens
tgtgagactcgagaacttt

SEQ ID NO: 1330208 - DNA, 20 bp, Homo sapiens
tgtggttaatgccatggaca

SEQ ID NO: 1330209 - DNA, 17 bp, Homo sapiens
tgttaatggtttgaata

SEQ ID NO: 1330210 - DNA, 21 bp, Homo sapiens
tgtttgacgggaaacaaaact

SEQ ID NO: 1330211 - DNA, 13 bp, Homo sapiens
ttaaactggtatt

SEQ ID NO: 1330212 - DNA, 22 bp, Homo sapiens
ttaaactggtattttatctttg

SEQ ID NO: 1330213 - DNA, 19 bp, Homo sapiens
ttaacactgcttgtgtttt

SEQ ID NO: 1330214 - DNA, 16 bp, Homo sapiens
ttaatatggggatgca

SEQ ID NO: 1330215 - DNA, 13 bp, Homo sapiens
ttagctcccctcc

SEQ ID NO: 1330216 - DNA, 14 bp, Homo sapiens
ttagctcccctcca

SEQ ID NO: 1330217 - DNA, 20 bp, Homo sapiens
ttatgatgtgggtcaaggaa

SEQ ID NO: 1330218 - DNA, 23 bp, Homo sapiens
atgcctcctctgtcctcattctt

SEQ ID NO: 1330219 - DNA, 15 bp, Homo sapiens
atggatgtttcttct

SEQ ID NO: 1330220 - DNA, 16 bp, Homo sapiens
atggatgtttcttctt

SEQ ID NO: 1330221 - DNA, 19 bp, Homo sapiens
attaactgaattctgaact

SEQ ID NO: 1330222 - DNA, 15 bp, Homo sapiens
attgccatttcttcc

SEQ ID NO: 1330223 - DNA, 19 bp, Homo sapiens
attgccatttcttcccaag

SEQ ID NO: 1330224 - DNA, 12 bp, Homo sapiens
atttcttcccaa

SEQ ID NO: 1330225 - DNA, 21 bp, Homo sapiens
caaatgagatgtatgcccaaa

SEQ ID NO: 1330226 - DNA, 22 bp, Homo sapiens
caaatgagatgtatgcccaaag

SEQ ID NO: 1330227 - DNA, 20 bp, Homo sapiens
caagattcccggctggactt

SEQ ID NO: 1330228 - DNA, 13 bp, Homo sapiens
caagtcttcctga

SEQ ID NO: 1330229 - DNA, 14 bp, Homo sapiens
caccagcagcagaa

SEQ ID NO: 1330230 - DNA, 14 bp, Homo sapiens
cactattggacttt

SEQ ID NO: 1330231 - DNA, 18 bp, Homo sapiens
cagatgcctcctctgtcc

SEQ ID NO: 1330232 - DNA, 17 bp, Homo sapiens
caggggttccagcttcc

SEQ ID NO: 1330233 - DNA, 15 bp, Homo sapiens
cagtggactgtgtcc

SEQ ID NO: 1330234 - DNA, 16 bp, Homo sapiens
catcaattctctatca

SEQ ID NO: 1330235 - DNA, 13 bp, Homo sapiens
catcagcagcttg

SEQ ID NO: 1330236 - DNA, 17 bp, Homo sapiens
cattcttctctcccaca

SEQ ID NO: 1330237 - DNA, 14 bp, Homo sapiens
catttcttcccaag

SEQ ID NO: 1330238 - DNA, 13 bp, Homo sapiens
ccaataattctgt

SEQ ID NO: 1330239 - DNA, 21 bp, Homo sapiens
ccatggatgtttcttctttga

SEQ ID NO: 1330240 - DNA, 18 bp, Homo sapiens
cccatggatgtttcttct

SEQ ID NO: 1330241 - DNA, 13 bp, Homo sapiens
cccggctggactt

SEQ ID NO: 1330242 - DNA, 19 bp, Homo sapiens
cctaaaagttttaacctca

SEQ ID NO: 1330243 - DNA, 15 bp, Homo sapiens
cctcaggttccaaat

SEQ ID NO: 1330244 - DNA, 14 bp, Homo sapiens
cctcattcttctct

SEQ ID NO: 1330245 - DNA, 15 bp, Homo sapiens
cctcctctgtcctca

SEQ ID NO: 1330246 - DNA, 23 bp, Homo sapiens
cctgtgtccacatctaacaaagt

SEQ ID NO: 1330247 - DNA, 16 bp, Homo sapiens
agtggactgtgtccct

SEQ ID NO: 1330248 - DNA, 20 bp, Homo sapiens
atcccatggatgtttcttct

SEQ ID NO: 1330249 - DNA, 21 bp, Homo sapiens
atcggtgctgtcagccctgct

SEQ ID NO: 1330250 - DNA, 16 bp, Homo sapiens
atgttgaagtcaaatt

SEQ ID NO: 1330251 - DNA, 23 bp, Homo sapiens
attctgaatttgtagacatactt

SEQ ID NO: 1330252 - DNA, 18 bp, Homo sapiens
caaaggtgattttcctgt

SEQ ID NO: 1330253 - DNA, 21 bp, Homo sapiens
caaggccagtctgaacctgag

SEQ ID NO: 1330254 - DNA, 15 bp, Homo sapiens
caattcttcttctca

SEQ ID NO: 1330255 - DNA, 12 bp, Homo sapiens
cacacaagcagt

SEQ ID NO: 1330256 - DNA, 23 bp, Homo sapiens
cacaggacgatttcactgacact

SEQ ID NO: 1330257 - DNA, 20 bp, Homo sapiens
cagatgcctcctctgtcctc

SEQ ID NO: 1330258 - DNA, 21 bp, Homo sapiens
cagatgcctcctctgtcctca

SEQ ID NO: 1330259 - DNA, 16 bp, Homo sapiens
cagccagtaaggcagc

SEQ ID NO: 1330260 - DNA, 23 bp, Homo sapiens
cagctatttctcatcaattctct

SEQ ID NO: 1330261 - DNA, 16 bp, Homo sapiens
cagtaaggcagctctg

SEQ ID NO: 1330262 - DNA, 18 bp, Homo sapiens
cagtacagctatttctca

SEQ ID NO: 1330263 - DNA, 13 bp, Homo sapiens
ccaagtcttcctg

SEQ ID NO: 1330264 - DNA, 14 bp, Homo sapiens
ccaagtcttcctga

SEQ ID NO: 1330265 - DNA, 12 bp, Homo sapiens
ccagcagcagaa

SEQ ID NO: 1330266 - DNA, 10 bp, Homo sapiens
ccagcttccc

SEQ ID NO: 1330267 - DNA, 20 bp, Homo sapiens
ccagtaaggcagctctgtcg

SEQ ID NO: 1330268 - DNA, 22 bp, Homo sapiens
ccattattctagggtcttactc

SEQ ID NO: 1330269 - DNA, 20 bp, Homo sapiens
ccctcggtgcagaaactacc

SEQ ID NO: 1330270 - DNA, 14 bp, Homo sapiens
ccctctctttgagt

SEQ ID NO: 1330271 - DNA, 15 bp, Homo sapiens
ccggctggacttttg

SEQ ID NO: 1330272 - DNA, 21 bp, Homo sapiens
cctgctgtcagaccttcttcc

SEQ ID NO: 1330273 - DNA, 16 bp, Homo sapiens
cgcagtggactgtgtc

SEQ ID NO: 1330274 - DNA, 23 bp, Homo sapiens
cgtctgtgattgccatttcttcc

SEQ ID NO: 1330275 - DNA, 18 bp, Homo sapiens
ctacagccagtaaggcag

SEQ ID NO: 1330276 - DNA, 13 bp, Homo sapiens
ctcaggttccaaa

SEQ ID NO: 1330277 - DNA, 18 bp, Homo sapiens
ctcattaccgtctgtgat

SEQ ID NO: 1330278 - DNA, 20 bp, Homo sapiens
ctctcccacacaagcagtct

SEQ ID NO: 1330279 - DNA, 15 bp, Homo sapiens
ctgaattctgaactt

SEQ ID NO: 1330280 - DNA, 19 bp, Homo sapiens
ctgacactgcgaactctca

SEQ ID NO: 1330281 - DNA, 20 bp, Homo sapiens
ctgctgtcagaccttcttcc

SEQ ID NO: 1330282 - DNA, 17 bp, Homo sapiens
ctggacttttgcagctt

SEQ ID NO: 1330283 - DNA, 20 bp, Homo sapiens
ctggacttttgcagcttcct

SEQ ID NO: 1330284 - DNA, 20 bp, Homo sapiens
ctgtattaactgaattctga

SEQ ID NO: 1330285 - DNA, 20 bp, Homo sapiens
ctgtgattgccatttcttcc

SEQ ID NO: 1330286 - DNA, 18 bp, Homo sapiens
ctgtgccccatcagcagc

SEQ ID NO: 1330287 - DNA, 22 bp, Homo sapiens
ctgtgtccacatctaacaaagt

SEQ ID NO: 1330288 - DNA, 16 bp, Homo sapiens
cttcatcgcagtggac

SEQ ID NO: 1330289 - DNA, 19 bp, Homo sapiens
cttcatcgcagtggactgt

SEQ ID NO: 1330290 - DNA, 20 bp, Homo sapiens
ctttgactataacaaaatct

SEQ ID NO: 1330291 - DNA, 23 bp, Homo sapiens
ctttgtatgatgaaaagaatgtg

SEQ ID NO: 1330292 - DNA, 12 bp, Homo sapiens
cttttgcagctt

SEQ ID NO: 1330293 - DNA, 12 bp, Homo sapiens
gaactctcagga

SEQ ID NO: 1330294 - DNA, 14 bp, Homo sapiens
gacaaaggtgattt

SEQ ID NO: 1330295 - DNA, 14 bp, Homo sapiens
gaccttcttccaca

SEQ ID NO: 1330296 - DNA, 15 bp, Homo sapiens
gatgcctcctctgtc

SEQ ID NO: 1330297 - DNA, 17 bp, Homo sapiens
gattcccggctggactt

SEQ ID NO: 1330298 - DNA, 18 bp, Homo sapiens
gattttcctgtgtccaca

SEQ ID NO: 1330299 - DNA, 14 bp, Homo sapiens
gcactattggactt

SEQ ID NO: 1330300 - DNA, 16 bp, Homo sapiens
gcagtggactgtgtcc

SEQ ID NO: 1330301 - DNA, 20 bp, Homo sapiens
gccagtaaggcagctctgtc

SEQ ID NO: 1330302 - DNA, 19 bp, Homo sapiens
gcccggaagttgctgtgcc

SEQ ID NO: 1330303 - DNA, 17 bp, Homo sapiens
gcgaactctcaggacta

SEQ ID NO: 1330304 - DNA, 16 bp, Homo sapiens
gctgtcagaccttctt

SEQ ID NO: 1330305 - DNA, 14 bp, Homo sapiens
ggaaggaggtgcct

SEQ ID NO: 1330306 - DNA, 19 bp, Homo sapiens
ggacttttgcagcttcctt

SEQ ID NO: 1330307 - DNA, 13 bp, Homo sapiens
ggatgtttcttct

SEQ ID NO: 1330308 - DNA, 16 bp, Homo sapiens
ggcaattcttcttctc

SEQ ID NO: 1330309 - DNA, 22 bp, Homo sapiens
ggctggacttttgcagcttcct

SEQ ID NO: 1330310 - DNA, 14 bp, Homo sapiens
ggttccagcttccc

SEQ ID NO: 1330311 - DNA, 16 bp, Homo sapiens
gtaaggcagctctgtc

SEQ ID NO: 1330312 - DNA, 18 bp, Homo sapiens
gtgattgccatttcttcc

SEQ ID NO: 1330313 - DNA, 17 bp, Homo sapiens
gtgccccatcagcagct

SEQ ID NO: 1330314 - DNA, 21 bp, Homo sapiens
gtgggcaggggttccagcttc

SEQ ID NO: 1330315 - DNA, 19 bp, Homo sapiens
gttttcccctctctttgag

SEQ ID NO: 1330316 - DNA, 17 bp, Homo sapiens
taaaagttttaacctca

SEQ ID NO: 1330317 - DNA, 15 bp, Homo sapiens
tacagctatttctca

SEQ ID NO: 1330318 - DNA, 19 bp, Homo sapiens
tacttcatcgcagtggact

SEQ ID NO: 1330319 - DNA, 22 bp, Homo sapiens
tcacaggacgatttcactgaca

SEQ ID NO: 1330320 - DNA, 15 bp, Homo sapiens
tcagaccttcttcca

SEQ ID NO: 1330321 - DNA, 15 bp, Homo sapiens
tcagccctgctgtca

SEQ ID NO: 1330322 - DNA, 17 bp, Homo sapiens
tccacatctaacaaagt

SEQ ID NO: 1330323 - DNA, 19 bp, Homo sapiens
tcccatggatgtttcttct

SEQ ID NO: 1330324 - DNA, 21 bp, Homo sapiens
tcctgtgtccacatctaacaa

SEQ ID NO: 1330325 - DNA, 14 bp, Homo sapiens
tctcaagcactgac

SEQ ID NO: 1330326 - DNA, 18 bp, Homo sapiens
tctctcccacacaagcag

SEQ ID NO: 1330327 - DNA, 13 bp, Homo sapiens
tcttccacagcaa

SEQ ID NO: 1330328 - DNA, 22 bp, Homo sapiens
tcttcctgaccaccttgcacta

SEQ ID NO: 1330329 - DNA, 12 bp, Homo sapiens
tcttcttctcaa

SEQ ID NO: 1330330 - DNA, 13 bp, Homo sapiens
tcttcttctcaag

SEQ ID NO: 1330331 - DNA, 17 bp, Homo sapiens
tctttgagtcaagtcaa

SEQ ID NO: 1330332 - DNA, 13 bp, Homo sapiens
tgattttcctgtg

SEQ ID NO: 1330333 - DNA, 14 bp, Homo sapiens
tgccatttcttccc

SEQ ID NO: 1330334 - DNA, 16 bp, Homo sapiens
tgccatttcttcccaa

SEQ ID NO: 1330335 - DNA, 19 bp, Homo sapiens
tgccccatcagcagcttga

SEQ ID NO: 1330336 - DNA, 18 bp, Homo sapiens
tgcgaactctcaggacta

SEQ ID NO: 1330337 - DNA, 22 bp, Homo sapiens
tgctgtcagaccttcttccaca

SEQ ID NO: 1330338 - DNA, 23 bp, Homo sapiens
tgctgtcagaccttcttccacag

SEQ ID NO: 1330339 - DNA, 20 bp, Homo sapiens
tgctgtcagccctgctgtca

SEQ ID NO: 1330340 - DNA, 22 bp, Homo sapiens
tgtcagccctgctgtcagacct

SEQ ID NO: 1330341 - DNA, 19 bp, Homo sapiens
tgtgccccatcagcagctt

SEQ ID NO: 1330342 - DNA, 18 bp, Homo sapiens
ttaacctcaggttccaaa

SEQ ID NO: 1330343 - DNA, 17 bp, Homo sapiens
ttagaatcccatggatg

SEQ ID NO: 1330344 - DNA, 13 bp, Homo sapiens
ttctctcccacac

SEQ ID NO: 1330345 - DNA, 14 bp, Homo sapiens
ttgccatttcttcc

SEQ ID NO: 1330346 - DNA, 24 bp, Homo sapiens
ttgccatttcttcccaaggccagt

SEQ ID NO: 1330347 - DNA, 20 bp, Homo sapiens
tttgattttttgctgcagac

SEQ ID NO: 1330348 - DNA, 19 bp, Homo sapiens
tttgcagcttccttccaag

SEQ ID NO: 1330349 - DNA, 11 bp, Homo sapiens
aagtcttcctg

SEQ ID NO: 1330350 - DNA, 19 bp, Homo sapiens
acaaaggtgattttcctgt

SEQ ID NO: 1330351 - DNA, 17 bp, Homo sapiens
acagccagtaaggcagc

SEQ ID NO: 1330352 - DNA, 22 bp, Homo sapiens
accaccttgcactattggactt

SEQ ID NO: 1330353 - DNA, 15 bp, Homo sapiens
acctcaggttccaaa

SEQ ID NO: 1330354 - DNA, 16 bp, Homo sapiens
acctcaggttccaaat

SEQ ID NO: 1330355 - DNA, 13 bp, Homo sapiens
accttcttccaca

SEQ ID NO: 1330356 - DNA, 13 bp, Homo sapiens
actataacaaaat

SEQ ID NO: 1330357 - DNA, 23 bp, Homo sapiens
agaatcccatggatgtttcttct

SEQ ID NO: 1330358 - DNA, 15 bp, Homo sapiens
agatgtatgcccaaa

SEQ ID NO: 1330359 - DNA, 19 bp, Homo sapiens
agcaaatgagatgtatgcc

SEQ ID NO: 1330360 - DNA, 14 bp, Homo sapiens
agcagatggtccca

SEQ ID NO: 1330361 - DNA, 21 bp, Homo sapiens
agctctgtcgtggtagcagat

SEQ ID NO: 1330362 - DNA, 14 bp, Homo sapiens
agcttccttccaag

SEQ ID NO: 1330363 - DNA, 17 bp, Homo sapiens
aggggttccagcttccc

SEQ ID NO: 1330364 - DNA, 22 bp, Homo sapiens
agtcaagattcccggctggact

SEQ ID NO: 1330365 - DNA, 14 bp, Homo sapiens
agtcaagtcaaata

SEQ ID NO: 1330366 - DNA, 16 bp, Homo sapiens
attcccggctggactt

SEQ ID NO: 1330367 - DNA, 15 bp, Homo sapiens
attcttcttctcaag

SEQ ID NO: 1330368 - DNA, 21 bp, Homo sapiens
atttcactgacactgcgaact

SEQ ID NO: 1330369 - DNA, 14 bp, Homo sapiens
attttcctgtgtcc

SEQ ID NO: 1330370 - DNA, 17 bp, Homo sapiens
attttcctgtgtccaca

SEQ ID NO: 1330371 - DNA, 16 bp, Homo sapiens
caaaggtgattttcct

SEQ ID NO: 1330372 - DNA, 19 bp, Homo sapiens
cacaggacgatttcactga

SEQ ID NO: 1330373 - DNA, 14 bp, Homo sapiens
cactgcgaactctc

SEQ ID NO: 1330374 - DNA, 16 bp, Homo sapiens
cactgcgaactctcag

SEQ ID NO: 1330375 - DNA, 18 bp, Homo sapiens
caggcaccagcagcagaa

SEQ ID NO: 1330376 - DNA, 19 bp, Homo sapiens
cagtaaggcagctctgtcg

SEQ ID NO: 1330377 - DNA, 23 bp, Homo sapiens
catacttcatcgcagtggactgt

SEQ ID NO: 1330378 - DNA, 12 bp, Homo sapiens
catttcttccca

SEQ ID NO: 1330379 - DNA, 23 bp, Homo sapiens
ccagatgcctcctctgtcctcat

SEQ ID NO: 1330380 - DNA, 17 bp, Homo sapiens
ccagtaaggcagctctg

SEQ ID NO: 1330381 - DNA, 15 bp, Homo sapiens
ccagtctgaacctga

SEQ ID NO: 1330382 - DNA, 13 bp, Homo sapiens
ccatttcttccca

SEQ ID NO: 1330383 - DNA, 15 bp, Homo sapiens
ccatttcttcccaag

SEQ ID NO: 1330384 - DNA, 15 bp, Homo sapiens
cccaaggccagtctg

SEQ ID NO: 1330385 - DNA, 21 bp, Homo sapiens
cccagatgcctcctctgtcct

SEQ ID NO: 1330386 - DNA, 12 bp, Homo sapiens
cctgtgtccaca

SEQ ID NO: 1330387 - DNA, 18 bp, Homo sapiens
ccttcttccacagcaaat

SEQ ID NO: 1330388 - DNA, 20 bp, Homo sapiens
ccttgcactattggactttg

SEQ ID NO: 1330389 - DNA, 14 bp, Homo sapiens
cgaggtcaaggaga

SEQ ID NO: 1330390 - DNA, 20 bp, Homo sapiens
cggctggacttttgcagctt

SEQ ID NO: 1330391 - DNA, 16 bp, Homo sapiens
ctcaagcactgacact

SEQ ID NO: 1330392 - DNA, 18 bp, Homo sapiens
ctggacttttgcagcttc

SEQ ID NO: 1330393 - DNA, 16 bp, Homo sapiens
ctggggaggacaaagg

SEQ ID NO: 1330394 - DNA, 20 bp, Homo sapiens
ctgtcagaccttcttccaca

SEQ ID NO: 1330395 - DNA, 17 bp, Homo sapiens
ctgtcgtggtagcagat

SEQ ID NO: 1330396 - DNA, 19 bp, Homo sapiens
ctgtgattgccatttcttc

SEQ ID NO: 1330397 - DNA, 20 bp, Homo sapiens
ctgtgccccatcagcagctt

SEQ ID NO: 1330398 - DNA, 23 bp, Homo sapiens
ctgtgccccatcagcagcttgac

SEQ ID NO: 1330399 - DNA, 14 bp, Homo sapiens
cttccacagcaaat

SEQ ID NO: 1330400 - DNA, 22 bp, Homo sapiens
cttccctttgattttttgctgc

SEQ ID NO: 1330401 - DNA, 22 bp, Homo sapiens
cttccttccaagtcttcctgac

SEQ ID NO: 1330402 - DNA, 21 bp, Homo sapiens
cttctctcccacacaagcagt

SEQ ID NO: 1330403 - DNA, 22 bp, Homo sapiens
cttctttgactataacaaaatc

SEQ ID NO: 1330404 - DNA, 17 bp, Homo sapiens
cttgcactattggactt

SEQ ID NO: 1330405 - DNA, 22 bp, Homo sapiens
cttgccccagatgcctcctctg

SEQ ID NO: 1330406 - DNA, 23 bp, Homo sapiens
ctttggcaattcttcttctcaag

SEQ ID NO: 1330407 - DNA, 18 bp, Homo sapiens
gacactcattaccgtctg

SEQ ID NO: 1330408 - DNA, 14 bp, Homo sapiens
gagcaggcaccagc

SEQ ID NO: 1330409 - DNA, 13 bp, Homo sapiens
gatgtatgcccaa

SEQ ID NO: 1330410 - DNA, 18 bp, Homo sapiens
gattcccggctggacttt

SEQ ID NO: 1330411 - DNA, 16 bp, Homo sapiens
gattgccatttcttcc

SEQ ID NO: 1330412 - DNA, 15 bp, Homo sapiens
gatttcactgacact

SEQ ID NO: 1330413 - DNA, 16 bp, Homo sapiens
gcactattggactttg

SEQ ID NO: 1330414 - DNA, 16 bp, Homo sapiens
gccatttcttcccaag

SEQ ID NO: 1330415 - DNA, 21 bp, Homo sapiens
gccccagatgcctcctctgtc

SEQ ID NO: 1330416 - DNA, 19 bp, Homo sapiens
gccccatcagcagcttgac

SEQ ID NO: 1330417 - DNA, 13 bp, Homo sapiens
gcctcctctgtcc

SEQ ID NO: 1330418 - DNA, 18 bp, Homo sapiens
gcctttggcaattcttct

SEQ ID NO: 1330419 - DNA, 18 bp, Homo sapiens
gctgtcagccctgctgtc

SEQ ID NO: 1330420 - DNA, 20 bp, Homo sapiens
gctgtgccccatcagcagct

SEQ ID NO: 1330421 - DNA, 14 bp, Homo sapiens
ggaagttgctgtgc

SEQ ID NO: 1330422 - DNA, 17 bp, Homo sapiens
ggaagttgctgtgcccc

SEQ ID NO: 1330423 - DNA, 20 bp, Homo sapiens
aaagaagagtaaaatggctg

SEQ ID NO: 1330424 - DNA, 16 bp, Homo sapiens
aaagttttaacctcag

SEQ ID NO: 1330425 - DNA, 18 bp, Homo sapiens
aacaaagtcaagattccc

SEQ ID NO: 1330426 - DNA, 13 bp, Homo sapiens
aactctcaggact

SEQ ID NO: 1330427 - DNA, 13 bp, Homo sapiens
aactcttcatctt

SEQ ID NO: 1330428 - DNA, 21 bp, Homo sapiens
aactcttcatcttaaactaca

SEQ ID NO: 1330429 - DNA, 15 bp, Homo sapiens
aaggcagctctgtcg

SEQ ID NO: 1330430 - DNA, 15 bp, Homo sapiens
aagttttaacctcag

SEQ ID NO: 1330431 - DNA, 16 bp, Homo sapiens
acactgcgaactctca

SEQ ID NO: 1330432 - DNA, 20 bp, Homo sapiens
acagccagtaaggcagctct

SEQ ID NO: 1330433 - DNA, 22 bp, Homo sapiens
acatacttcatcgcagtggact

SEQ ID NO: 1330434 - DNA, 23 bp, Homo sapiens
acatacttcatcgcagtggactg

SEQ ID NO: 1330435 - DNA, 15 bp, Homo sapiens
acccaataattctgt

SEQ ID NO: 1330436 - DNA, 20 bp, Homo sapiens
actgacactgcgaactctca

SEQ ID NO: 1330437 - DNA, 14 bp, Homo sapiens
actgcgaactctca

SEQ ID NO: 1330438 - DNA, 22 bp, Homo sapiens
acttgtacgctcacttgcccca

SEQ ID NO: 1330439 - DNA, 19 bp, Homo sapiens
acttttgcagcttccttcc

SEQ ID NO: 1330440 - DNA, 15 bp, Homo sapiens
agaccttcttccaca

SEQ ID NO: 1330441 - DNA, 21 bp, Homo sapiens
agacggtagaattaaagaaga

SEQ ID NO: 1330442 - DNA, 17 bp, Homo sapiens
agacttgttttcccctc

SEQ ID NO: 1330443 - DNA, 19 bp, Homo sapiens
agattcccggctggacttt

SEQ ID NO: 1330444 - DNA, 21 bp, Homo sapiens
agcaaatgagatgtatgccca

SEQ ID NO: 1330445 - DNA, 12 bp, Homo sapiens
agcactgacact

SEQ ID NO: 1330446 - DNA, 22 bp, Homo sapiens
agctatttctcatcaattctct

SEQ ID NO: 1330447 - DNA, 20 bp, Homo sapiens
aggacgatttcactgacact

SEQ ID NO: 1330448 - DNA, 16 bp, Homo sapiens
aggcagctctgtcgtg

SEQ ID NO: 1330449 - DNA, 20 bp, Homo sapiens
aggtgattttcctgtgtcca

SEQ ID NO: 1330450 - DNA, 18 bp, Homo sapiens
agtaaggcagctctgtcg

SEQ ID NO: 1330451 - DNA, 12 bp, Homo sapiens
agtacagctatt

SEQ ID NO: 1330452 - DNA, 14 bp, Homo sapiens
agtggactgtgtcc

SEQ ID NO: 1330453 - DNA, 15 bp, Homo sapiens
agttgctgtgcccca

SEQ ID NO: 1330454 - DNA, 15 bp, Homo sapiens
atcaattctctatca

SEQ ID NO: 1330455 - DNA, 21 bp, Homo sapiens
atgagatgtatgcccaaagac

SEQ ID NO: 1330456 - DNA, 15 bp, Homo sapiens
atgcctcctctgtcc

SEQ ID NO: 1330457 - DNA, 22 bp, Homo sapiens
attgcctttggcaattcttctt

SEQ ID NO: 1330458 - DNA, 22 bp, Homo sapiens
atttctcatcaattctctatca

SEQ ID NO: 1330459 - DNA, 20 bp, Homo sapiens
caccttgcactattggactt

SEQ ID NO: 1330460 - DNA, 13 bp, Homo sapiens
cactattggactt

SEQ ID NO: 1330461 - DNA, 21 bp, Homo sapiens
cactgcgaactctcaggacta

SEQ ID NO: 1330462 - DNA, 20 bp, Homo sapiens
cagccagtaaggcagctctg

SEQ ID NO: 1330463 - DNA, 23 bp, Homo sapiens
cagccagtaaggcagctctgtcg

SEQ ID NO: 1330464 - DNA, 14 bp, Homo sapiens
cagctatttctcat

SEQ ID NO: 1330465 - DNA, 19 bp, Homo sapiens
caggacgatttcactgaca

SEQ ID NO: 1330466 - DNA, 21 bp, Homo sapiens
caggaggtactgtgaggaaga

SEQ ID NO: 1330467 - DNA, 18 bp, Homo sapiens
caggggttccagcttccc

SEQ ID NO: 1330468 - DNA, 12 bp, Homo sapiens
cagtaaggcagc

SEQ ID NO: 1330469 - DNA, 16 bp, Homo sapiens
catggatgtttcttct

SEQ ID NO: 1330470 - DNA, 15 bp, Homo sapiens
cattcttctctccca

SEQ ID NO: 1330471 - DNA, 19 bp, Homo sapiens
ccaaacggaactcttcatc

SEQ ID NO: 1330472 - DNA, 21 bp, Homo sapiens
ccaccttgcactattggactt

SEQ ID NO: 1330473 - DNA, 19 bp, Homo sapiens
ccagatgcctcctctgtcc

SEQ ID NO: 1330474 - DNA, 15 bp, Homo sapiens
cccatcagcagcttg

SEQ ID NO: 1330475 - DNA, 13 bp, Homo sapiens
ccggctggacttt

SEQ ID NO: 1330476 - DNA, 13 bp, Homo sapiens
cctctctttgagt

SEQ ID NO: 1330477 - DNA, 15 bp, Homo sapiens
ccttcttccacagca

SEQ ID NO: 1330478 - DNA, 21 bp, Homo sapiens
cctttttaaatgagacttgtt

SEQ ID NO: 1330479 - DNA, 22 bp, Homo sapiens
ctacagccagtaaggcagctct

SEQ ID NO: 1330480 - DNA, 14 bp, Homo sapiens
ctgctgtcagacct

SEQ ID NO: 1330481 - DNA, 23 bp, Homo sapiens
ctgctgtcagaccttcttccaca

SEQ ID NO: 1330482 - DNA, 22 bp, Homo sapiens
ctgtcctcattcttctctccca

SEQ ID NO: 1330483 - DNA, 18 bp, Homo sapiens
cttcatcgcagtggactg

SEQ ID NO: 1330484 - DNA, 13 bp, Homo sapiens
cttctctcccaca

SEQ ID NO: 1330485 - DNA, 20 bp, Homo sapiens
cttgacgcgtggtcacagga

SEQ ID NO: 1330486 - DNA, 18 bp, Homo sapiens
cttgcactattggacttt

SEQ ID NO: 1330487 - DNA, 13 bp, Homo sapiens
cttttgcagcttc

SEQ ID NO: 1330488 - DNA, 18 bp, Homo sapiens
cttttgcagcttccttcc

SEQ ID NO: 1330489 - DNA, 21 bp, Homo sapiens
gaatcggtgctgtcagccctg

SEQ ID NO: 1330490 - DNA, 13 bp, Homo sapiens
gaattctgaactt

SEQ ID NO: 1330491 - DNA, 16 bp, Homo sapiens
gatgtatgcccaaaga

SEQ ID NO: 1330492 - DNA, 15 bp, Homo sapiens
gcactattggacttt

SEQ ID NO: 1330493 - DNA, 13 bp, Homo sapiens
gcagcttgacgcg

SEQ ID NO: 1330494 - DNA, 17 bp, Homo sapiens
gcagtggactgtgtccc

SEQ ID NO: 1330495 - DNA, 18 bp, Homo sapiens
gcagtggactgtgtccct

SEQ ID NO: 1330496 - DNA, 14 bp, Homo sapiens
gccatttcttccca

SEQ ID NO: 1330497 - DNA, 16 bp, Homo sapiens
gccccatcagcagctt

SEQ ID NO: 1330498 - DNA, 23 bp, Homo sapiens
gccctgctgtcagaccttcttcc

SEQ ID NO: 1330499 - DNA, 16 bp, Homo sapiens
gcgaactctcaggact

SEQ ID NO: 1330500 - DNA, 20 bp, Homo sapiens
gctctgtcgtggtagcagat

SEQ ID NO: 1330501 - DNA, 19 bp, Homo sapiens
gctggacttttgcagcttc

SEQ ID NO: 1330502 - DNA, 19 bp, Homo sapiens
gctgtcagaccttcttcca

SEQ ID NO: 1330503 - DNA, 22 bp, Homo sapiens
gctgtcagaccttcttccacag

SEQ ID NO: 1330504 - DNA, 22 bp, Homo sapiens
gctgtgccccatcagcagcttg

SEQ ID NO: 1330505 - DNA, 20 bp, Homo sapiens
ggacttttgcagcttccttc

SEQ ID NO: 1330506 - DNA, 18 bp, Homo sapiens
ggcccggaagttgctgtg

SEQ ID NO: 1330507 - DNA, 15 bp, Homo sapiens
ggtgattttcctgtg

SEQ ID NO: 1330508 - DNA, 18 bp, Homo sapiens
ggtgattttcctgtgtcc

SEQ ID NO: 1330509 - DNA, 17 bp, Homo sapiens
gtaaggcagctctgtcg

SEQ ID NO: 1330510 - DNA, 19 bp, Homo sapiens
gtcagaccttcttccacag

SEQ ID NO: 1330511 - DNA, 15 bp, Homo sapiens
gtcagccctgctgtc

SEQ ID NO: 1330512 - DNA, 14 bp, Homo sapiens
gtgcctatagaaaa

SEQ ID NO: 1330513 - DNA, 13 bp, Homo sapiens
gtggactgtgtcc

SEQ ID NO: 1330514 - DNA, 21 bp, Homo sapiens
gttttaacctcaggttccaaa

SEQ ID NO: 1330515 - DNA, 17 bp, Homo sapiens
taacctcaggttccaaa

SEQ ID NO: 1330516 - DNA, 18 bp, Homo sapiens
taaggcagctctgtcgtg

SEQ ID NO: 1330517 - DNA, 14 bp, Homo sapiens
tatgtagattgcct

SEQ ID NO: 1330518 - DNA, 22 bp, Homo sapiens
tcactgacactgcgaactctca

SEQ ID NO: 1330519 - DNA, 18 bp, Homo sapiens
tcaggaggtactgtgagg

SEQ ID NO: 1330520 - DNA, 13 bp, Homo sapiens
tcaggttccaaat

SEQ ID NO: 1330521 - DNA, 14 bp, Homo sapiens
tcccacacaagcag

SEQ ID NO: 1330522 - DNA, 19 bp, Homo sapiens
tccttccaagtcttcctga

SEQ ID NO: 1330523 - DNA, 15 bp, Homo sapiens
tctcaagcactgaca

SEQ ID NO: 1330524 - DNA, 22 bp, Homo sapiens
tctgtgattgccatttcttccc

SEQ ID NO: 1330525 - DNA, 19 bp, Homo sapiens
tcttccacagcaaatgaga

SEQ ID NO: 1330526 - DNA, 14 bp, Homo sapiens
tcttcccaaggcca

SEQ ID NO: 1330527 - DNA, 15 bp, Homo sapiens
tcttcttctcaagca

SEQ ID NO: 1330528 - DNA, 20 bp, Homo sapiens
tctttgagtcaagtcaaata

SEQ ID NO: 1330529 - DNA, 15 bp, Homo sapiens
tgaatcggtgctgtc

SEQ ID NO: 1330530 - DNA, 18 bp, Homo sapiens
tgacactgcgaactctca

SEQ ID NO: 1330531 - DNA, 23 bp, Homo sapiens
tgagggacgaggtcaaggagata

SEQ ID NO: 1330532 - DNA, 17 bp, Homo sapiens
tgcagcttccttccaag

SEQ ID NO: 1330533 - DNA, 13 bp, Homo sapiens
tgccatttcttcc

SEQ ID NO: 1330534 - DNA, 17 bp, Homo sapiens
tgccatttcttcccaag

SEQ ID NO: 1330535 - DNA, 15 bp, Homo sapiens
tgccccatcagcagc

SEQ ID NO: 1330536 - DNA, 16 bp, Homo sapiens
tgcctcctctgtcctc

SEQ ID NO: 1330537 - DNA, 12 bp, Homo sapiens
tggactgtgtcc

SEQ ID NO: 1330538 - DNA, 22 bp, Homo sapiens
tggactttggaaggaggtgcct

SEQ ID NO: 1330539 - DNA, 19 bp, Homo sapiens
tggacttttgcagcttcct

SEQ ID NO: 1330540 - DNA, 14 bp, Homo sapiens
tggatgtttcttct

SEQ ID NO: 1330541 - DNA, 16 bp, Homo sapiens
tggatgtttcttcttt

SEQ ID NO: 1330542 - DNA, 19 bp, Homo sapiens
tgtcagaccttcttccaca

SEQ ID NO: 1330543 - DNA, 21 bp, Homo sapiens
tgtccacatctaacaaagtca

SEQ ID NO: 1330544 - DNA, 15 bp, Homo sapiens
tgtcctcattcttct

SEQ ID NO: 1330545 - DNA, 16 bp, Homo sapiens
tgtcctcattcttctc

SEQ ID NO: 1330546 - DNA, 20 bp, Homo sapiens
ttaaaccaaacggaactctt

SEQ ID NO: 1330547 - DNA, 15 bp, Homo sapiens
ttccaagtcttcctg

SEQ ID NO: 1330548 - DNA, 14 bp, Homo sapiens
ttcccggctggact

SEQ ID NO: 1330549 - DNA, 14 bp, Homo sapiens
ttctcaagcactga

SEQ ID NO: 1330550 - DNA, 17 bp, Homo sapiens
ttgcagcttccttccaa

SEQ ID NO: 1330551 - DNA, 16 bp, Homo sapiens
ttgccatttcttccca

SEQ ID NO: 1330552 - DNA, 17 bp, Homo sapiens
ttgccatttcttcccaa

SEQ ID NO: 1330553 - DNA, 22 bp, Homo sapiens
tttaacctcaggttccaaattc

SEQ ID NO: 1330554 - DNA, 22 bp, Homo sapiens
tttcactgacactgcgaactct

SEQ ID NO: 1330555 - DNA, 23 bp, Homo sapiens
ttttctacagccagtaaggcagc

SEQ ID NO: 1330556 - DNA, 19 bp, Homo sapiens
ttttgcagcttccttccaa

SEQ ID NO: 1330557 - DNA, 21 bp, Homo sapiens
aaaatctggggaggacaaagg

SEQ ID NO: 1330558 - DNA, 14 bp, Homo sapiens
aacctcaggttcca

SEQ ID NO: 1330559 - DNA, 16 bp, Homo sapiens
aacctcaggttccaaa

SEQ ID NO: 1330560 - DNA, 14 bp, Homo sapiens
aacggaactcttca

SEQ ID NO: 1330561 - DNA, 20 bp, Homo sapiens
aagattcccggctggacttt

SEQ ID NO: 1330562 - DNA, 15 bp, Homo sapiens
acagcaaatgagatg

SEQ ID NO: 1330563 - DNA, 14 bp, Homo sapiens
acatctaacaaagt

SEQ ID NO: 1330564 - DNA, 16 bp, Homo sapiens
accaaacggaactctt

SEQ ID NO: 1330565 - DNA, 18 bp, Homo sapiens
accaaacggaactcttca

SEQ ID NO: 1330566 - DNA, 12 bp, Homo sapiens
accaaattctga

SEQ ID NO: 1330567 - DNA, 20 bp, Homo sapiens
accttgcactattggacttt

SEQ ID NO: 1330568 - DNA, 17 bp, Homo sapiens
acgatttcactgacact

SEQ ID NO: 1330569 - DNA, 11 bp, Homo sapiens
acggaactctt

SEQ ID NO: 1330570 - DNA, 13 bp, Homo sapiens
acttgttttcccc

SEQ ID NO: 1330571 - DNA, 16 bp, Homo sapiens
acttttgcagcttcct

SEQ ID NO: 1330572 - DNA, 21 bp, Homo sapiens
agaccttcttccacagcaaat

SEQ ID NO: 1330573 - DNA, 20 bp, Homo sapiens
agattcccggctggactttt

SEQ ID NO: 1330574 - DNA, 18 bp, Homo sapiens
agcaggcaccagcagcag

SEQ ID NO: 1330575 - DNA, 19 bp, Homo sapiens
agccagtaaggcagctctg

SEQ ID NO: 1330576 - DNA, 22 bp, Homo sapiens
agttttaacctcaggttccaaa

SEQ ID NO: 1330577 - DNA, 17 bp, Homo sapiens
cgcgtggtcacaggacg

SEQ ID NO: 1330578 - DNA, 23 bp, Homo sapiens
cggctggacttttgcagcttcct

SEQ ID NO: 1330579 - DNA, 24 bp, Homo sapiens
ctcatcctttttaaatgagacttg

SEQ ID NO: 1330580 - DNA, 11 bp, Homo sapiens
ctcctctgtcc

SEQ ID NO: 1330581 - DNA, 15 bp, Homo sapiens
ctgaacttttcagga

SEQ ID NO: 1330582 - DNA, 22 bp, Homo sapiens
ctgacactgcgaactctcagga

SEQ ID NO: 1330583 - DNA, 16 bp, Homo sapiens
ctgcgaactctcagga

SEQ ID NO: 1330584 - DNA, 19 bp, Homo sapiens
ctggacttttgcagcttcc

SEQ ID NO: 1330585 - DNA, 22 bp, Homo sapiens
ctggacttttgcagcttccttc

SEQ ID NO: 1330586 - DNA, 21 bp, Homo sapiens
ctgtcagaccttcttccacag

SEQ ID NO: 1330587 - DNA, 22 bp, Homo sapiens
cttccacagcaaatgagatgta

SEQ ID NO: 1330588 - DNA, 17 bp, Homo sapiens
cttctcaagcactgaca

SEQ ID NO: 1330589 - DNA, 22 bp, Homo sapiens
cttgacgcgtggtcacaggacg

SEQ ID NO: 1330590 - DNA, 18 bp, Homo sapiens
ctttgactataacaaaat

SEQ ID NO: 1330591 - DNA, 22 bp, Homo sapiens
cttttcaggaggtactgtgagg

SEQ ID NO: 1330592 - DNA, 21 bp, Homo sapiens
cttttgcagcttccttccaag

SEQ ID NO: 1330593 - DNA, 22 bp, Homo sapiens
gaatcccatggatgtttcttct

SEQ ID NO: 1330594 - DNA, 15 bp, Homo sapiens
gaatcggtgctgtca

SEQ ID NO: 1330595 - DNA, 16 bp, Homo sapiens
gagatgtatgcccaaa

SEQ ID NO: 1330596 - DNA, 12 bp, Homo sapiens
gatgtttcttct

SEQ ID NO: 1330597 - DNA, 20 bp, Homo sapiens
gattgccatttcttcccaag

SEQ ID NO: 1330598 - DNA, 22 bp, Homo sapiens
gattgccatttcttcccaaggc

SEQ ID NO: 1330599 - DNA, 14 bp, Homo sapiens
gcagctctgtcgtg

SEQ ID NO: 1330600 - DNA, 16 bp, Homo sapiens
gcagcttccttccaag

SEQ ID NO: 1330601 - DNA, 23 bp, Homo sapiens
gcagcttccttccaagtcttcct

SEQ ID NO: 1330602 - DNA, 17 bp, Homo sapiens
gcaggcaccagcagcag

SEQ ID NO: 1330603 - DNA, 18 bp, Homo sapiens
gcagtctttttctacagc

SEQ ID NO: 1330604 - DNA, 19 bp, Homo sapiens
gccagtaaggcagctctgt

SEQ ID NO: 1330605 - DNA, 18 bp, Homo sapiens
gcccggaagttgctgtgc

SEQ ID NO: 1330606 - DNA, 21 bp, Homo sapiens
gctggacttttgcagcttcct

SEQ ID NO: 1330607 - DNA, 23 bp, Homo sapiens
gcttgacgcgtggtcacaggacg

SEQ ID NO: 1330608 - DNA, 23 bp, Homo sapiens
ggaggacaaaggtgattttcctg

SEQ ID NO: 1330609 - DNA, 13 bp, Homo sapiens
ggcagctctgtcg

SEQ ID NO: 1330610 - DNA, 21 bp, Homo sapiens
ggctggacttttgcagcttcc

SEQ ID NO: 1330611 - DNA, 16 bp, Homo sapiens
gggttccagcttccct

SEQ ID NO: 1330612 - DNA, 16 bp, Homo sapiens
gtccacatctaacaaa

SEQ ID NO: 1330613 - DNA, 14 bp, Homo sapiens
gtctgtgattgcca

SEQ ID NO: 1330614 - DNA, 19 bp, Homo sapiens
taaaccaaacggaactctt

SEQ ID NO: 1330615 - DNA, 22 bp, Homo sapiens
tcaagattcccggctggacttt

SEQ ID NO: 1330616 - DNA, 13 bp, Homo sapiens
tcaagcactgaca

SEQ ID NO: 1330617 - DNA, 22 bp, Homo sapiens
tcaggactaccgttaccaagag

SEQ ID NO: 1330618 - DNA, 15 bp, Homo sapiens
tcatgttgaagtcaa

SEQ ID NO: 1330619 - DNA, 11 bp, Homo sapiens
tccagcttccc

SEQ ID NO: 1330620 - DNA, 21 bp, Homo sapiens
tcccatggatgtttcttcttt

SEQ ID NO: 1330621 - DNA, 14 bp, Homo sapiens
tcccggctggactt

SEQ ID NO: 1330622 - DNA, 21 bp, Homo sapiens
tcctaaaagttttaacctcag

SEQ ID NO: 1330623 - DNA, 21 bp, Homo sapiens
tcctcattcttctctcccaca

SEQ ID NO: 1330624 - DNA, 16 bp, Homo sapiens
tcctttttaaatgaga

SEQ ID NO: 1330625 - DNA, 23 bp, Homo sapiens
tctacagccagtaaggcagctct

SEQ ID NO: 1330626 - DNA, 21 bp, Homo sapiens
tctctcccacacaagcagtct

SEQ ID NO: 1330627 - DNA, 21 bp, Homo sapiens
tctgtgattgccatttcttcc

SEQ ID NO: 1330628 - DNA, 23 bp, Homo sapiens
tctgtgattgccatttcttccca

SEQ ID NO: 1330629 - DNA, 19 bp, Homo sapiens
tcttcccaaggccagtctg

SEQ ID NO: 1330630 - DNA, 18 bp, Homo sapiens
tctttgactataacaaaa

SEQ ID NO: 1330631 - DNA, 20 bp, Homo sapiens
tgacgcgtggtcacaggacg

SEQ ID NO: 1330632 - DNA, 19 bp, Homo sapiens
tgactataacaaaatctgg

SEQ ID NO: 1330633 - DNA, 18 bp, Homo sapiens
tgattgccatttcttccc

SEQ ID NO: 1330634 - DNA, 20 bp, Homo sapiens
tgccccatcagcagcttgac

SEQ ID NO: 1330635 - DNA, 14 bp, Homo sapiens
tgcctcctctgtcc

SEQ ID NO: 1330636 - DNA, 15 bp, Homo sapiens
tgcctcctctgtcct

SEQ ID NO: 1330637 - DNA, 17 bp, Homo sapiens
tgcctcctctgtcctca

SEQ ID NO: 1330638 - DNA, 20 bp, Homo sapiens
tgcggttagaatcccatgga

SEQ ID NO: 1330639 - DNA, 13 bp, Homo sapiens
tgctgcagactca

SEQ ID NO: 1330640 - DNA, 20 bp, Homo sapiens
tgggcaggggttccagcttc

SEQ ID NO: 1330641 - DNA, 20 bp, Homo sapiens
tgtagacatacttgtacgct

SEQ ID NO: 1330642 - DNA, 14 bp, Homo sapiens
tgtatgcccaaaga

SEQ ID NO: 1330643 - DNA, 19 bp, Homo sapiens
tgtgattgccatttcttcc

SEQ ID NO: 1330644 - DNA, 12 bp, Homo sapiens
ttcactgacact

SEQ ID NO: 1330645 - DNA, 12 bp, Homo sapiens
ttccagcttccc

SEQ ID NO: 1330646 - DNA, 18 bp, Homo sapiens
ttctcaagcactgacact

SEQ ID NO: 1330647 - DNA, 15 bp, Homo sapiens
ttgactataacaaaa

SEQ ID NO: 1330648 - DNA, 20 bp, Homo sapiens
ttggcaattcttcttctcaa

SEQ ID NO: 1330649 - DNA, 22 bp, Homo sapiens
tttcctgtgtccacatctaaca

SEQ ID NO: 1330650 - DNA, 14 bp, Homo sapiens
aaaggtgattttcc

SEQ ID NO: 1330651 - DNA, 20 bp, Homo sapiens
aaatgagatgtatgcccaaa

SEQ ID NO: 1330652 - DNA, 13 bp, Homo sapiens
aagcactgacact

SEQ ID NO: 1330653 - DNA, 21 bp, Homo sapiens
aaggtgattttcctgtgtcca

SEQ ID NO: 1330654 - DNA, 16 bp, Homo sapiens
aagttgctgtgcccca

SEQ ID NO: 1330655 - DNA, 18 bp, Homo sapiens
aatgagacttgttttccc

SEQ ID NO: 1330656 - DNA, 15 bp, Homo sapiens
acactgcgaactctc

SEQ ID NO: 1330657 - DNA, 18 bp, Homo sapiens
actgtgaggaagagcagg

SEQ ID NO: 1330658 - DNA, 14 bp, Homo sapiens
actttggaaggagg

SEQ ID NO: 1330659 - DNA, 22 bp, Homo sapiens
agagcaggcaccagcagcagaa

SEQ ID NO: 1330660 - DNA, 17 bp, Homo sapiens
agattcccggctggact

SEQ ID NO: 1330661 - DNA, 20 bp, Homo sapiens
agcaggcaccagcagcagaa

SEQ ID NO: 1330662 - DNA, 20 bp, Homo sapiens
agccagtaaggcagctctgt

SEQ ID NO: 1330663 - DNA, 15 bp, Homo sapiens
agtaaggcagctctg

SEQ ID NO: 1330664 - DNA, 18 bp, Homo sapiens
ggatgtttcttctttgac

SEQ ID NO: 1330665 - DNA, 13 bp, Homo sapiens
ggcaccagcagca

SEQ ID NO: 1330666 - DNA, 19 bp, Homo sapiens
ggcaggggttccagcttcc

SEQ ID NO: 1330667 - DNA, 18 bp, Homo sapiens
ggccagtctgaacctgag

SEQ ID NO: 1330668 - DNA, 22 bp, Homo sapiens
gtcacaggacgatttcactgac

SEQ ID NO: 1330669 - DNA, 14 bp, Homo sapiens
gtcctcattcttct

SEQ ID NO: 1330670 - DNA, 22 bp, Homo sapiens
gtgattgccatttcttcccaag

SEQ ID NO: 1330671 - DNA, 17 bp, Homo sapiens
gtgattttcctgtgtcc

SEQ ID NO: 1330672 - DNA, 17 bp, Homo sapiens
gtgcagaaactaccaga

SEQ ID NO: 1330673 - DNA, 21 bp, Homo sapiens
gttgctgtgccccatcagcag

SEQ ID NO: 1330674 - DNA, 21 bp, Homo sapiens
taaaccaaacggaactcttca

SEQ ID NO: 1330675 - DNA, 18 bp, Homo sapiens
tacagccagtaaggcagc

SEQ ID NO: 1330676 - DNA, 21 bp, Homo sapiens
tcaagattcccggctggactt

SEQ ID NO: 1330677 - DNA, 17 bp, Homo sapiens
tcatcaattctctatca

SEQ ID NO: 1330678 - DNA, 15 bp, Homo sapiens
tccaccaaattctga

SEQ ID NO: 1330679 - DNA, 19 bp, Homo sapiens
tctacagccagtaaggcag

SEQ ID NO: 1330680 - DNA, 22 bp, Homo sapiens
tctatcatgttgaagtcaaatt

SEQ ID NO: 1330681 - DNA, 15 bp, Homo sapiens
tctcccacacaagca

SEQ ID NO: 1330682 - DNA, 20 bp, Homo sapiens
tcttcccaaggccagtctga

SEQ ID NO: 1330683 - DNA, 15 bp, Homo sapiens
tcttctctcccacac

SEQ ID NO: 1330684 - DNA, 19 bp, Homo sapiens
tcttctttgactataacaa

SEQ ID NO: 1330685 - DNA, 14 bp, Homo sapiens
tgaacttttcagga

SEQ ID NO: 1330686 - DNA, 18 bp, Homo sapiens
tgacgcgtggtcacagga

SEQ ID NO: 1330687 - DNA, 15 bp, Homo sapiens
tgactataacaaaat

SEQ ID NO: 1330688 - DNA, 16 bp, Homo sapiens
tgagggacgaggtcaa

SEQ ID NO: 1330689 - DNA, 17 bp, Homo sapiens
tgattgccatttcttcc

SEQ ID NO: 1330690 - DNA, 20 bp, Homo sapiens
tgattgccatttcttcccaa

SEQ ID NO: 1330691 - DNA, 16 bp, Homo sapiens
tgattttcctgtgtcc

SEQ ID NO: 1330692 - DNA, 15 bp, Homo sapiens
tgccatttcttccca

SEQ ID NO: 1330693 - DNA, 19 bp, Homo sapiens
tgccatttcttcccaaggc

SEQ ID NO: 1330694 - DNA, 19 bp, Homo sapiens
tgcctttggcaattcttct

SEQ ID NO: 1330695 - DNA, 23 bp, Homo sapiens
tgggcaggggttccagcttccct

SEQ ID NO: 1330696 - DNA, 20 bp, Homo sapiens
tgtcagaccttcttccacag

SEQ ID NO: 1330697 - DNA, 17 bp, Homo sapiens
tgtcgtggtagcagatg

SEQ ID NO: 1330698 - DNA, 18 bp, Homo sapiens
tgttgaagtcaaatttgg

SEQ ID NO: 1330699 - DNA, 13 bp, Homo sapiens
ttccaccaaattc

SEQ ID NO: 1330700 - DNA, 21 bp, Homo sapiens
ttcccaaggccagtctgaacc

SEQ ID NO: 1330701 - DNA, 14 bp, Homo sapiens
ttcctgtgtccaca

SEQ ID NO: 1330702 - DNA, 22 bp, Homo sapiens
ttctctcccacacaagcagtct

SEQ ID NO: 1330703 - DNA, 12 bp, Homo sapiens
ttgcagcttcct

SEQ ID NO: 1330704 - DNA, 18 bp, Homo sapiens
ttgccatttcttcccaag

SEQ ID NO: 1330705 - DNA, 16 bp, Homo sapiens
ttggcaattcttcttc

SEQ ID NO: 1330706 - DNA, 15 bp, Homo sapiens
tttccaccaaattct

SEQ ID NO: 1330707 - DNA, 21 bp, Homo sapiens
ttttaacctcaggttccaaat

SEQ ID NO: 1330708 - DNA, 15 bp, Homo sapiens
aaatttatgtgatgg

SEQ ID NO: 1330709 - DNA, 13 bp, Homo sapiens
aacaaattaaata

SEQ ID NO: 1330710 - DNA, 16 bp, Homo sapiens
aacaaattaaataaat

SEQ ID NO: 1330711 - DNA, 12 bp, Homo sapiens
aacactgccagc

SEQ ID NO: 1330712 - DNA, 19 bp, Homo sapiens
aagaagtgtgtcaccctta

SEQ ID NO: 1330713 - DNA, 21 bp, Homo sapiens
aagacaaaattgtaagccaga

SEQ ID NO: 1330714 - DNA, 18 bp, Homo sapiens
aagagaagggcagggctg

SEQ ID NO: 1330715 - DNA, 12 bp, Homo sapiens
aagccagagtca

SEQ ID NO: 1330716 - DNA, 13 bp, Homo sapiens
aagggagggggag

SEQ ID NO: 1330717 - DNA, 10 bp, Homo sapiens
aagtgtgggt

SEQ ID NO: 1330718 - DNA, 18 bp, Homo sapiens
aagtgtgggtctgtgtgt

SEQ ID NO: 1330719 - DNA, 17 bp, Homo sapiens
aataagtgccaggatgg

SEQ ID NO: 1330720 - DNA, 15 bp, Homo sapiens
aatgtcagtatgtgg

SEQ ID NO: 1330721 - DNA, 16 bp, Homo sapiens
aatgtcagtatgtgga

SEQ ID NO: 1330722 - DNA, 18 bp, Homo sapiens
aattctttgacctgttgg

SEQ ID NO: 1330723 - DNA, 15 bp, Homo sapiens
acaaaattgtaagcc

SEQ ID NO: 1330724 - DNA, 22 bp, Homo sapiens
acaaaattgtaagccagagtca

SEQ ID NO: 1330725 - DNA, 17 bp, Homo sapiens
acaccccgacttttgtt

SEQ ID NO: 1330726 - DNA, 14 bp, Homo sapiens
acagaagacaaaat

SEQ ID NO: 1330727 - DNA, 16 bp, Homo sapiens
acccagatatggaaac

SEQ ID NO: 1330728 - DNA, 18 bp, Homo sapiens
acccagatatggaaacag

SEQ ID NO: 1330729 - DNA, 13 bp, Homo sapiens
accccctgtgcct

SEQ ID NO: 1330730 - DNA, 16 bp, Homo sapiens
accctcatctttcttc

SEQ ID NO: 1330731 - DNA, 18 bp, Homo sapiens
acctgaataaagaatgaa

SEQ ID NO: 1330732 - DNA, 22 bp, Homo sapiens
actcgtgtctggcacagcctgg

SEQ ID NO: 1330733 - DNA, 23 bp, Homo sapiens
actggccagtggctggatctgtg

SEQ ID NO: 1330734 - DNA, 15 bp, Homo sapiens
agaatgtcagtatgt

SEQ ID NO: 1330735 - DNA, 17 bp, Homo sapiens
agaatgtcagtatgtgg

SEQ ID NO: 1330736 - DNA, 20 bp, Homo sapiens
agacaaaattgtaagccaga

SEQ ID NO: 1330737 - DNA, 22 bp, Homo sapiens
agacaaaattgtaagccagagt

SEQ ID NO: 1330738 - DNA, 22 bp, Homo sapiens
agagggactgttcttttgtccc

SEQ ID NO: 1330739 - DNA, 10 bp, Homo sapiens
agagggctgc

SEQ ID NO: 1330740 - DNA, 22 bp, Homo sapiens
agagtcaacaaattaaataaat

SEQ ID NO: 1330741 - DNA, 15 bp, Homo sapiens
agatatggaaacaga

SEQ ID NO: 1330742 - DNA, 20 bp, Homo sapiens
agatcccaacactgccagca

SEQ ID NO: 1330743 - DNA, 13 bp, Homo sapiens
agccagaggtctg

SEQ ID NO: 1330744 - DNA, 11 bp, Homo sapiens
agccagagtca

SEQ ID NO: 1330745 - DNA, 13 bp, Homo sapiens
agccagagtcaac

SEQ ID NO: 1330746 - DNA, 16 bp, Homo sapiens
agccagagtcaacaaa

SEQ ID NO: 1330747 - DNA, 16 bp, Homo sapiens
agcctctccactcatg

SEQ ID NO: 1330748 - DNA, 12 bp, Homo sapiens
aggacagtattt

SEQ ID NO: 1330749 - DNA, 15 bp, Homo sapiens
aggagggcaggcatc

SEQ ID NO: 1330750 - DNA, 19 bp, Homo sapiens
aggatcccatgagctcctt

SEQ ID NO: 1330751 - DNA, 17 bp, Homo sapiens
aggccattctttcccaa

SEQ ID NO: 1330752 - DNA, 19 bp, Homo sapiens
aggccattctttcccaaca

SEQ ID NO: 1330753 - DNA, 15 bp, Homo sapiens
aggctagggtgggga

SEQ ID NO: 1330754 - DNA, 19 bp, Homo sapiens
aggctagggtggggagaga

SEQ ID NO: 1330755 - DNA, 18 bp, Homo sapiens
aggctcagagggtgtcct

SEQ ID NO: 1330756 - DNA, 19 bp, Homo sapiens
aggctcagagggtgtcctg

SEQ ID NO: 1330757 - DNA, 23 bp, Homo sapiens
agggaaggatcccatgagctcct

SEQ ID NO: 1330758 - DNA, 15 bp, Homo sapiens
aggggcttctaatga

SEQ ID NO: 1330759 - DNA, 21 bp, Homo sapiens
aggtgcttctagttctgccag

SEQ ID NO: 1330760 - DNA, 14 bp, Homo sapiens
agtatttgtgggga

SEQ ID NO: 1330761 - DNA, 13 bp, Homo sapiens
agtccctgcctgg

SEQ ID NO: 1330762 - DNA, 15 bp, Homo sapiens
agtccctgcctggac

SEQ ID NO: 1330763 - DNA, 16 bp, Homo sapiens
agtctgagagaggcca

SEQ ID NO: 1330764 - DNA, 20 bp, Homo sapiens
agtgatttttatgccacctg

SEQ ID NO: 1330765 - DNA, 18 bp, Homo sapiens
agtgccaggatggaatga

SEQ ID NO: 1330766 - DNA, 16 bp, Homo sapiens
agtggggtaggttggg

SEQ ID NO: 1330767 - DNA, 20 bp, Homo sapiens
agttctgccaggagacaggt

SEQ ID NO: 1330768 - DNA, 13 bp, Homo sapiens
agtttagggtggg

SEQ ID NO: 1330769 - DNA, 19 bp, Homo sapiens
atagaaggctatggggata

SEQ ID NO: 1330770 - DNA, 14 bp, Homo sapiens
atagatgtgtggac

SEQ ID NO: 1330771 - DNA, 16 bp, Homo sapiens
atcaggccattgtccc

SEQ ID NO: 1330772 - DNA, 18 bp, Homo sapiens
atcatgtttacagaggac

SEQ ID NO: 1330773 - DNA, 21 bp, Homo sapiens
atccagagtccctgcctggac

SEQ ID NO: 1330774 - DNA, 17 bp, Homo sapiens
atcccaacactgccagc

SEQ ID NO: 1330775 - DNA, 22 bp, Homo sapiens
atctgtgaggggctctctcatg

SEQ ID NO: 1330776 - DNA, 16 bp, Homo sapiens
atgatgggtcagttgt

SEQ ID NO: 1330777 - DNA, 18 bp, Homo sapiens
atggaaacagaagacaaa

SEQ ID NO: 1330778 - DNA, 21 bp, Homo sapiens
atggaatgatgggtcagttgt

SEQ ID NO: 1330779 - DNA, 23 bp, Homo sapiens
atgggattgaaggggcttctaat

SEQ ID NO: 1330780 - DNA, 12 bp, Homo sapiens
atgtgactcttt

SEQ ID NO: 1330781 - DNA, 21 bp, Homo sapiens
atgtgactctttccaaccggc

SEQ ID NO: 1330782 - DNA, 13 bp, Homo sapiens
atgtggaagtgtg

SEQ ID NO: 1330783 - DNA, 18 bp, Homo sapiens
atgtgtgtgtgttgtgtg

SEQ ID NO: 1330784 - DNA, 22 bp, Homo sapiens
atgtgtgtgtgttgtgtgtggg

SEQ ID NO: 1330785 - DNA, 15 bp, Homo sapiens
atgtttacagaggac

SEQ ID NO: 1330786 - DNA, 19 bp, Homo sapiens
atgtttacagaggacagta

SEQ ID NO: 1330787 - DNA, 12 bp, Homo sapiens
attccagaggaa

SEQ ID NO: 1330788 - DNA, 23 bp, Homo sapiens
attgcaggagtccctgccatcat

SEQ ID NO: 1330789 - DNA, 13 bp, Homo sapiens
attgtaagccaga

SEQ ID NO: 1330790 - DNA, 17 bp, Homo sapiens
attgtagagccagaggt

SEQ ID NO: 1330791 - DNA, 16 bp, Homo sapiens
atttgctatgagctgg

SEQ ID NO: 1330792 - DNA, 20 bp, Homo sapiens
atttgctatgagctggggat

SEQ ID NO: 1330793 - DNA, 18 bp, Homo sapiens
atttgtaaatttatgtga

SEQ ID NO: 1330794 - DNA, 22 bp, Homo sapiens
atttgtggggagggatttgggg

SEQ ID NO: 1330795 - DNA, 22 bp, Homo sapiens
caaaattgtaagccagagtcaa

SEQ ID NO: 1330796 - DNA, 15 bp, Homo sapiens
caaattaaataaatt

SEQ ID NO: 1330797 - DNA, 14 bp, Homo sapiens
caacaaattaaata

SEQ ID NO: 1330798 - DNA, 13 bp, Homo sapiens
caacactgccagc

SEQ ID NO: 1330799 - DNA, 13 bp, Homo sapiens
caaccggctttgt

SEQ ID NO: 1330800 - DNA, 20 bp, Homo sapiens
cacggctcctcgagatccca

SEQ ID NO: 1330801 - DNA, 14 bp, Homo sapiens
cagaagacaaaatt

SEQ ID NO: 1330802 - DNA, 12 bp, Homo sapiens
cagacttcccac

SEQ ID NO: 1330803 - DNA, 12 bp, Homo sapiens
cagagaaaaagg

SEQ ID NO: 1330804 - DNA, 22 bp, Homo sapiens
cagaggacagtatttgtgggga

SEQ ID NO: 1330805 - DNA, 12 bp, Homo sapiens
cagagtcaacaa

SEQ ID NO: 1330806 - DNA, 18 bp, Homo sapiens
cagagtcaacaaattaaa

SEQ ID NO: 1330807 - DNA, 18 bp, Homo sapiens
cagagtccctgcctggac

SEQ ID NO: 1330808 - DNA, 17 bp, Homo sapiens
cagatatggaaacagaa

SEQ ID NO: 1330809 - DNA, 21 bp, Homo sapiens
cagcctccatcctaccccctg

SEQ ID NO: 1330810 - DNA, 14 bp, Homo sapiens
caggagtccctgcc

SEQ ID NO: 1330811 - DNA, 11 bp, Homo sapiens
caggctcagag

SEQ ID NO: 1330812 - DNA, 18 bp, Homo sapiens
cagggctgaggcctctca

SEQ ID NO: 1330813 - DNA, 12 bp, Homo sapiens
cagtatgtggaa

SEQ ID NO: 1330814 - DNA, 16 bp, Homo sapiens
cagtggctggatctgt

SEQ ID NO: 1330815 - DNA, 15 bp, Homo sapiens
catacctggccctgt

SEQ ID NO: 1330816 - DNA, 22 bp, Homo sapiens
ggcctaacctgccgagagtcca

SEQ ID NO: 1330817 - DNA, 20 bp, Homo sapiens
ggcctctcattccagaggaa

SEQ ID NO: 1330818 - DNA, 16 bp, Homo sapiens
ggcctgactctcagca

SEQ ID NO: 1330819 - DNA, 13 bp, Homo sapiens
ggcctgggcagga

SEQ ID NO: 1330820 - DNA, 14 bp, Homo sapiens
ggcctgggcaggag

SEQ ID NO: 1330821 - DNA, 16 bp, Homo sapiens
ggcgcggctgggagga

SEQ ID NO: 1330822 - DNA, 14 bp, Homo sapiens
ggctcagagtgggg

SEQ ID NO: 1330823 - DNA, 12 bp, Homo sapiens
ggcttctaatga

SEQ ID NO: 1330824 - DNA, 18 bp, Homo sapiens
ggcttctaatgacccaga

SEQ ID NO: 1330825 - DNA, 19 bp, Homo sapiens
ggcttctaatgacccagat

SEQ ID NO: 1330826 - DNA, 22 bp, Homo sapiens
gggacacctaggctagggtggg

SEQ ID NO: 1330827 - DNA, 23 bp, Homo sapiens
gggaggtgcttctagttctgcca

SEQ ID NO: 1330828 - DNA, 13 bp, Homo sapiens
gggatagatgtgt

SEQ ID NO: 1330829 - DNA, 20 bp, Homo sapiens
gggattgaaggggcttctaa

SEQ ID NO: 1330830 - DNA, 19 bp, Homo sapiens
gggcttctaatgacccaga

SEQ ID NO: 1330831 - DNA, 15 bp, Homo sapiens
ggggcagtctgagag

SEQ ID NO: 1330832 - DNA, 19 bp, Homo sapiens
ggggcagtctgagagaggc

SEQ ID NO: 1330833 - DNA, 15 bp, Homo sapiens
ggggcgcggctggga

SEQ ID NO: 1330834 - DNA, 15 bp, Homo sapiens
gggggagagggctgc

SEQ ID NO: 1330835 - DNA, 21 bp, Homo sapiens
gggtgtcctgcaccggggcct

SEQ ID NO: 1330836 - DNA, 11 bp, Homo sapiens
ggtctgtgtgt

SEQ ID NO: 1330837 - DNA, 17 bp, Homo sapiens
ggtctgtgtgtgtgtat

SEQ ID NO: 1330838 - DNA, 22 bp, Homo sapiens
ggtgcttctagttctgccagga

SEQ ID NO: 1330839 - DNA, 22 bp, Homo sapiens
ggtttgtttagaagaagtgtgt

SEQ ID NO: 1330840 - DNA, 17 bp, Homo sapiens
gtaaatttatgtgatgg

SEQ ID NO: 1330841 - DNA, 12 bp, Homo sapiens
gtaagccagagt

SEQ ID NO: 1330842 - DNA, 13 bp, Homo sapiens
gtaagccagagtc

SEQ ID NO: 1330843 - DNA, 16 bp, Homo sapiens
gtaagccagagtcaac

SEQ ID NO: 1330844 - DNA, 20 bp, Homo sapiens
gtaatttaaaattgtgatgt

SEQ ID NO: 1330845 - DNA, 15 bp, Homo sapiens
gtagagccagaggtc

SEQ ID NO: 1330846 - DNA, 19 bp, Homo sapiens
gtagtgatttttatgccac

SEQ ID NO: 1330847 - DNA, 21 bp, Homo sapiens
gtatgtggaagtgtgggtctg

SEQ ID NO: 1330848 - DNA, 20 bp, Homo sapiens
gtatgtgggggtctgtgtgt

SEQ ID NO: 1330849 - DNA, 17 bp, Homo sapiens
gtcagtatgtggaagtg

SEQ ID NO: 1330850 - DNA, 12 bp, Homo sapiens
gtctccctcctc

SEQ ID NO: 1330851 - DNA, 16 bp, Homo sapiens
gtctccctcctctgcc

SEQ ID NO: 1330852 - DNA, 13 bp, Homo sapiens
gtctgagagaggc

SEQ ID NO: 1330853 - DNA, 18 bp, Homo sapiens
gtctgagagaggccattc

SEQ ID NO: 1330854 - DNA, 17 bp, Homo sapiens
gtctggcacagcctggc

SEQ ID NO: 1330855 - DNA, 12 bp, Homo sapiens
gtctgtgtgtgt

SEQ ID NO: 1330856 - DNA, 16 bp, Homo sapiens
gtctgtgtgtgtgtat

SEQ ID NO: 1330857 - DNA, 21 bp, Homo sapiens
gtgactatggagctgagcagg

SEQ ID NO: 1330858 - DNA, 12 bp, Homo sapiens
gtgactctttcc

SEQ ID NO: 1330859 - DNA, 16 bp, Homo sapiens
gtgatttttatgccac

SEQ ID NO: 1330860 - DNA, 19 bp, Homo sapiens
gtgccttgtcacgccagac

SEQ ID NO: 1330861 - DNA, 23 bp, Homo sapiens
gtgctattgtagagccagaggtc

SEQ ID NO: 1330862 - DNA, 22 bp, Homo sapiens
gtgcttctagttctgccaggag

SEQ ID NO: 1330863 - DNA, 14 bp, Homo sapiens
gtggaagtgtgggt

SEQ ID NO: 1330864 - DNA, 14 bp, Homo sapiens
gtggcactggggca

SEQ ID NO: 1330865 - DNA, 14 bp, Homo sapiens
gtggcatccagagt

SEQ ID NO: 1330866 - DNA, 18 bp, Homo sapiens
gtggctcgggaggcgaag

SEQ ID NO: 1330867 - DNA, 13 bp, Homo sapiens
gtgggagtgtgta

SEQ ID NO: 1330868 - DNA, 14 bp, Homo sapiens
gtgggggtctgtgt

SEQ ID NO: 1330869 - DNA, 21 bp, Homo sapiens
gtgtcctgcaccggggcctgg

SEQ ID NO: 1330870 - DNA, 13 bp, Homo sapiens
gtgtgtatgtggg

SEQ ID NO: 1330871 - DNA, 15 bp, Homo sapiens
gtgtgtatgtggggg

SEQ ID NO: 1330872 - DNA, 14 bp, Homo sapiens
gtgtgtgtatgtgg

SEQ ID NO: 1330873 - DNA, 14 bp, Homo sapiens
gtgtgtttatgtgt

SEQ ID NO: 1330874 - DNA, 15 bp, Homo sapiens
gtgttgtgtgtggga

SEQ ID NO: 1330875 - DNA, 12 bp, Homo sapiens
gtgtttatgtgt

SEQ ID NO: 1330876 - DNA, 13 bp, Homo sapiens
gttctgccaggag

SEQ ID NO: 1330877 - DNA, 14 bp, Homo sapiens
gttctgccaggaga

SEQ ID NO: 1330878 - DNA, 14 bp, Homo sapiens
gttgggagaatgtc

SEQ ID NO: 1330879 - DNA, 18 bp, Homo sapiens
gttgtatcagcacgtgtg

SEQ ID NO: 1330880 - DNA, 17 bp, Homo sapiens
gttgtcctcagccccgc

SEQ ID NO: 1330881 - DNA, 13 bp, Homo sapiens
gtttatgtgtgtg

SEQ ID NO: 1330882 - DNA, 16 bp, Homo sapiens
gttttcttaacttaaa

SEQ ID NO: 1330883 - DNA, 14 bp, Homo sapiens
taagccagagtcaa

SEQ ID NO: 1330884 - DNA, 16 bp, Homo sapiens
taatttaaaattgtga

SEQ ID NO: 1330885 - DNA, 19 bp, Homo sapiens
taatttaaaattgtgatgt

SEQ ID NO: 1330886 - DNA, 14 bp, Homo sapiens
tacagaggacagta

SEQ ID NO: 1330887 - DNA, 18 bp, Homo sapiens
tacagaggacagtatttg

SEQ ID NO: 1330888 - DNA, 13 bp, Homo sapiens
tacctcttggctg

SEQ ID NO: 1330889 - DNA, 15 bp, Homo sapiens
taggaactgctgggc

SEQ ID NO: 1330890 - DNA, 13 bp, Homo sapiens
tagttctgccagg

SEQ ID NO: 1330891 - DNA, 22 bp, Homo sapiens
tataaacatgcttgcattatat

SEQ ID NO: 1330892 - DNA, 20 bp, Homo sapiens
tatatttgtaaatttatgtg

SEQ ID NO: 1330893 - DNA, 14 bp, Homo sapiens
tatcagcacgtgtg

SEQ ID NO: 1330894 - DNA, 15 bp, Homo sapiens
tatcagcacgtgtgg

SEQ ID NO: 1330895 - DNA, 23 bp, Homo sapiens
tatgagctggggatgtctctcat

SEQ ID NO: 1330896 - DNA, 20 bp, Homo sapiens
tatgccacctgaataaagaa

SEQ ID NO: 1330897 - DNA, 18 bp, Homo sapiens
tatggaaacagaagacaa

SEQ ID NO: 1330898 - DNA, 19 bp, Homo sapiens
tatggggatagatgtgtgg

SEQ ID NO: 1330899 - DNA, 20 bp, Homo sapiens
tatggggatagatgtgtgga

SEQ ID NO: 1330900 - DNA, 21 bp, Homo sapiens
tatggtaggaactgctgggct

SEQ ID NO: 1330901 - DNA, 18 bp, Homo sapiens
tatgtgggggtctgtgtg

SEQ ID NO: 1330902 - DNA, 16 bp, Homo sapiens
tatttgtaaatttatg

SEQ ID NO: 1330903 - DNA, 18 bp, Homo sapiens
tcacgccagacttcccac

SEQ ID NO: 1330904 - DNA, 20 bp, Homo sapiens
tcagatcattatcagcctgt

SEQ ID NO: 1330905 - DNA, 17 bp, Homo sapiens
tcagatttgccttattg

SEQ ID NO: 1330906 - DNA, 17 bp, Homo sapiens
tcaggaaccgaggcagg

SEQ ID NO: 1330907 - DNA, 15 bp, Homo sapiens
tcaggccgaaggagg

SEQ ID NO: 1330908 - DNA, 14 bp, Homo sapiens
tcatctttcttcca

SEQ ID NO: 1330909 - DNA, 17 bp, Homo sapiens
tcatgtgactctttcca

SEQ ID NO: 1330910 - DNA, 19 bp, Homo sapiens
tcatgtgactctttccaac

SEQ ID NO: 1330911 - DNA, 17 bp, Homo sapiens
tcatgtttacagaggac

SEQ ID NO: 1330912 - DNA, 21 bp, Homo sapiens
tccaaccggctttgtggcact

SEQ ID NO: 1330913 - DNA, 14 bp, Homo sapiens
tccactcatgtgac

SEQ ID NO: 1330914 - DNA, 15 bp, Homo sapiens
tccagagtccctgcc

SEQ ID NO: 1330915 - DNA, 18 bp, Homo sapiens
tccagagtccctgcctgg

SEQ ID NO: 1330916 - DNA, 20 bp, Homo sapiens
tccagagtccctgcctggac

SEQ ID NO: 1330917 - DNA, 14 bp, Homo sapiens
tcccaacactgcca

SEQ ID NO: 1330918 - DNA, 23 bp, Homo sapiens
tcccatgagctccttaaggctct

SEQ ID NO: 1330919 - DNA, 21 bp, Homo sapiens
tcccgggacacctaggctagg

SEQ ID NO: 1330920 - DNA, 16 bp, Homo sapiens
tcccttccttcctctc

SEQ ID NO: 1330921 - DNA, 17 bp, Homo sapiens
tcctaccccctgtgcct

SEQ ID NO: 1330922 - DNA, 13 bp, Homo sapiens
tcctctcctgtct

SEQ ID NO: 1330923 - DNA, 19 bp, Homo sapiens
tcctgtccctcatccatag

SEQ ID NO: 1330924 - DNA, 15 bp, Homo sapiens
tcctgtctccctcct

SEQ ID NO: 1330925 - DNA, 23 bp, Homo sapiens
tcgagatcccaacactgccagca

SEQ ID NO: 1330926 - DNA, 20 bp, Homo sapiens
tcggggagccgggagcctga

SEQ ID NO: 1330927 - DNA, 15 bp, Homo sapiens
tctaatgacccagat

SEQ ID NO: 1330928 - DNA, 17 bp, Homo sapiens
tctagttctgccaggag

SEQ ID NO: 1330929 - DNA, 16 bp, Homo sapiens
tctcattccagaggaa

SEQ ID NO: 1330930 - DNA, 15 bp, Homo sapiens
tctgccaggagacag

SEQ ID NO: 1330931 - DNA, 15 bp, Homo sapiens
tctgtgtgtgtgtat

SEQ ID NO: 1330932 - DNA, 22 bp, Homo sapiens
tctgtgtgtgtgtatgtggggg

SEQ ID NO: 1330933 - DNA, 20 bp, Homo sapiens
tctgtgtgtttatgtgtgtg

SEQ ID NO: 1330934 - DNA, 15 bp, Homo sapiens
tgaaggggcttctaa

SEQ ID NO: 1330935 - DNA, 21 bp, Homo sapiens
tgaccctcatctttcttccaa

SEQ ID NO: 1330936 - DNA, 16 bp, Homo sapiens
tgactctttccaaccg

SEQ ID NO: 1330937 - DNA, 13 bp, Homo sapiens
tgagagaggccat

SEQ ID NO: 1330938 - DNA, 21 bp, Homo sapiens
tgatagaaggctatggggata

SEQ ID NO: 1330939 - DNA, 21 bp, Homo sapiens
tgcattatatttgtaaattta

SEQ ID NO: 1330940 - DNA, 16 bp, Homo sapiens
tgccatcatgtttaca

SEQ ID NO: 1330941 - DNA, 17 bp, Homo sapiens
tgcccgggagctcagga

SEQ ID NO: 1330942 - DNA, 22 bp, Homo sapiens
tgccgagagtccatcagcctcc

SEQ ID NO: 1330943 - DNA, 19 bp, Homo sapiens
tgctatgagctggggatgt

SEQ ID NO: 1330944 - DNA, 15 bp, Homo sapiens
tgctgtagacatttg

SEQ ID NO: 1330945 - DNA, 16 bp, Homo sapiens
tggaaacagaagacaa

SEQ ID NO: 1330946 - DNA, 22 bp, Homo sapiens
tggaaacagaagacaaaattgt

SEQ ID NO: 1330947 - DNA, 23 bp, Homo sapiens
tggaagtgtgggtctgtgtgtgt

SEQ ID NO: 1330948 - DNA, 20 bp, Homo sapiens
tggaatgatgggtcagttgt

SEQ ID NO: 1330949 - DNA, 22 bp, Homo sapiens
tggcacagcctggctgtggcct

SEQ ID NO: 1330950 - DNA, 21 bp, Homo sapiens
tggcctgttcttctatgggtt

SEQ ID NO: 1330951 - DNA, 20 bp, Homo sapiens
tggctccattggtgttgaca

SEQ ID NO: 1330952 - DNA, 22 bp, Homo sapiens
tggctgccttgtgaaggaatta

SEQ ID NO: 1330953 - DNA, 20 bp, Homo sapiens
tgggagaatgtcagtatgtg

SEQ ID NO: 1330954 - DNA, 14 bp, Homo sapiens
tgggaggagggcag

SEQ ID NO: 1330955 - DNA, 17 bp, Homo sapiens
tgggaggagggcaggca

SEQ ID NO: 1330956 - DNA, 21 bp, Homo sapiens
tgggagtgaggatgtctgggc

SEQ ID NO: 1330957 - DNA, 13 bp, Homo sapiens
tggggagagacgg

SEQ ID NO: 1330958 - DNA, 14 bp, Homo sapiens
tggggagggatttg

SEQ ID NO: 1330959 - DNA, 19 bp, Homo sapiens
tggggagtttagggtgggg

SEQ ID NO: 1330960 - DNA, 17 bp, Homo sapiens
tggggatagatgtgtgg

SEQ ID NO: 1330961 - DNA, 18 bp, Homo sapiens
tggggatagatgtgtgga

SEQ ID NO: 1330962 - DNA, 18 bp, Homo sapiens
tgggggtctgtgtgttta

SEQ ID NO: 1330963 - DNA, 14 bp, Homo sapiens
tgtaagccagagtc

SEQ ID NO: 1330964 - DNA, 17 bp, Homo sapiens
tgtaagccagagtcaac

SEQ ID NO: 1330965 - DNA, 20 bp, Homo sapiens
tgtaatttaaaattgtgatg

SEQ ID NO: 1330966 - DNA, 21 bp, Homo sapiens
tgtaatttaaaattgtgatgt

SEQ ID NO: 1330967 - DNA, 22 bp, Homo sapiens
tgtatccatccatggggctgat

SEQ ID NO: 1330968 - DNA, 12 bp, Homo sapiens
tgtatgtggggg

SEQ ID NO: 1330969 - DNA, 20 bp, Homo sapiens
tgtatgtgggggtctgtgtg

SEQ ID NO: 1330970 - DNA, 22 bp, Homo sapiens
tgtatgtgggggtctgtgtgtt

SEQ ID NO: 1330971 - DNA, 18 bp, Homo sapiens
tgtcagtatgtggaagtg

SEQ ID NO: 1330972 - DNA, 17 bp, Homo sapiens
tgtctggcacagcctgg

SEQ ID NO: 1330973 - DNA, 17 bp, Homo sapiens
tgtgccttgtcacgcca

SEQ ID NO: 1330974 - DNA, 19 bp, Homo sapiens
tgtgccttgtcacgccaga

SEQ ID NO: 1330975 - DNA, 19 bp, Homo sapiens
tgtggcatccagagtccct

SEQ ID NO: 1330976 - DNA, 21 bp, Homo sapiens
tgtggcatccagagtccctgc

SEQ ID NO: 1330977 - DNA, 14 bp, Homo sapiens
tgtgggagtgtgta

SEQ ID NO: 1330978 - DNA, 16 bp, Homo sapiens
tgtgggggtctgtgtg

SEQ ID NO: 1330979 - DNA, 20 bp, Homo sapiens
tgtgggtctgtgtgtgtgta

SEQ ID NO: 1330980 - DNA, 15 bp, Homo sapiens
tgtgtgggagtgtgt

SEQ ID NO: 1330981 - DNA, 20 bp, Homo sapiens
tgtgtgtgggagtgtgtaat

SEQ ID NO: 1330982 - DNA, 18 bp, Homo sapiens
tgttgggagtgaggatgt

SEQ ID NO: 1330983 - DNA, 14 bp, Homo sapiens
tgttgtgtgtggga

SEQ ID NO: 1330984 - DNA, 16 bp, Homo sapiens
tgttgtgtgtgggagt

SEQ ID NO: 1330985 - DNA, 19 bp, Homo sapiens
tgtttagaagaagtgtgtc

SEQ ID NO: 1330986 - DNA, 15 bp, Homo sapiens
ttacagaggacagta

SEQ ID NO: 1330987 - DNA, 19 bp, Homo sapiens
ttaccccctcctccagatc

SEQ ID NO: 1330988 - DNA, 12 bp, Homo sapiens
ttatgtgtgtgt

SEQ ID NO: 1330989 - DNA, 14 bp, Homo sapiens
ttatgtgtgtgtgt

SEQ ID NO: 1330990 - DNA, 10 bp, Homo sapiens
ttctaatgac

SEQ ID NO: 1330991 - DNA, 16 bp, Homo sapiens
ttctagttctgccagg

SEQ ID NO: 1330992 - DNA, 20 bp, Homo sapiens
ttgaagggaaaagggatgat

SEQ ID NO: 1330993 - DNA, 17 bp, Homo sapiens
ttgaaggggcttctaat

SEQ ID NO: 1330994 - DNA, 20 bp, Homo sapiens
ttgaaggggcttctaatgac

SEQ ID NO: 1330995 - DNA, 22 bp, Homo sapiens
ttgaaggggcttctaatgaccc

SEQ ID NO: 1330996 - DNA, 16 bp, Homo sapiens
ttggcagctctactct

SEQ ID NO: 1330997 - DNA, 13 bp, Homo sapiens
ttgtaagccagag

SEQ ID NO: 1330998 - DNA, 15 bp, Homo sapiens
ttgtaagccagagtc

SEQ ID NO: 1330999 - DNA, 18 bp, Homo sapiens
ttgtaagccagagtcaac

SEQ ID NO: 1331000 - DNA, 18 bp, Homo sapiens
ttgtccctgaagagaagg

SEQ ID NO: 1331001 - DNA, 22 bp, Homo sapiens
ttgtcctcagccccgcgtggaa

SEQ ID NO: 1331002 - DNA, 20 bp, Homo sapiens
tttacagaggacagtatttg

SEQ ID NO: 1331003 - DNA, 14 bp, Homo sapiens
tttatgccacctga

SEQ ID NO: 1331004 - DNA, 11 bp, Homo sapiens
tttgtggggag

SEQ ID NO: 1331005 - DNA, 18 bp, Homo sapiens
aaattgtaagccagagtc

SEQ ID NO: 1331006 - DNA, 19 bp, Homo sapiens
aaattgtaagccagagtca

SEQ ID NO: 1331007 - DNA, 20 bp, Homo sapiens
aaattgtaagccagagtcaa

SEQ ID NO: 1331008 - DNA, 12 bp, Homo sapiens
aaatttatgtga

SEQ ID NO: 1331009 - DNA, 21 bp, Homo sapiens
aacagaagacaaaattgtaag

SEQ ID NO: 1331010 - DNA, 22 bp, Homo sapiens
aagacaaaattgtaagccagag

SEQ ID NO: 1331011 - DNA, 14 bp, Homo sapiens
aagccagagtcaac

SEQ ID NO: 1331012 - DNA, 14 bp, Homo sapiens
aaggggcttctaat

SEQ ID NO: 1331013 - DNA, 16 bp, Homo sapiens
aaggggcttctaatga

SEQ ID NO: 1331014 - DNA, 22 bp, Homo sapiens
aaggggcttctaatgacccaga

SEQ ID NO: 1331015 - DNA, 22 bp, Homo sapiens
cagatatggaaacagaagacaa

SEQ ID NO: 1331016 - DNA, 15 bp, Homo sapiens
cagcatttcccttcc

SEQ ID NO: 1331017 - DNA, 24 bp, Homo sapiens
cagccccgcgtggaactcgtgtct

SEQ ID NO: 1331018 - DNA, 23 bp, Homo sapiens
cagcctctccactcatgtgactc

SEQ ID NO: 1331019 - DNA, 23 bp, Homo sapiens
cagcctggctgtggcctaacctg

SEQ ID NO: 1331020 - DNA, 15 bp, Homo sapiens
caggaaccgaggcag

SEQ ID NO: 1331021 - DNA, 17 bp, Homo sapiens
caggaaccgaggcaggg

SEQ ID NO: 1331022 - DNA, 18 bp, Homo sapiens
cagggaaggatcccatga

SEQ ID NO: 1331023 - DNA, 16 bp, Homo sapiens
cagggctgaggcctct

SEQ ID NO: 1331024 - DNA, 15 bp, Homo sapiens
cagtatttgtgggga

SEQ ID NO: 1331025 - DNA, 22 bp, Homo sapiens
cagtctttaatctgagaggcca

SEQ ID NO: 1331026 - DNA, 20 bp, Homo sapiens
cagtggctggatctgtgagg

SEQ ID NO: 1331027 - DNA, 21 bp, Homo sapiens
catcatgtttacagaggacag

SEQ ID NO: 1331028 - DNA, 19 bp, Homo sapiens
catggggctgattgtattt

SEQ ID NO: 1331029 - DNA, 14 bp, Homo sapiens
catgtgactctttc

SEQ ID NO: 1331030 - DNA, 13 bp, Homo sapiens
cattccagaggaa

SEQ ID NO: 1331031 - DNA, 12 bp, Homo sapiens
cattctttccca

SEQ ID NO: 1331032 - DNA, 14 bp, Homo sapiens
cattctttcccaac

SEQ ID NO: 1331033 - DNA, 13 bp, Homo sapiens
ccaacactgccag

SEQ ID NO: 1331034 - DNA, 15 bp, Homo sapiens
ccaacactgccagca

SEQ ID NO: 1331035 - DNA, 16 bp, Homo sapiens
ccacaccctcactgct

SEQ ID NO: 1331036 - DNA, 14 bp, Homo sapiens
ctttgacctgttgg

SEQ ID NO: 1331037 - DNA, 18 bp, Homo sapiens
gaaaagggatgatgggat

SEQ ID NO: 1331038 - DNA, 12 bp, Homo sapiens
gaaacagaagac

SEQ ID NO: 1331039 - DNA, 15 bp, Homo sapiens
gaaacagaagacaaa

SEQ ID NO: 1331040 - DNA, 12 bp, Homo sapiens
gaaccgaggcag

SEQ ID NO: 1331041 - DNA, 17 bp, Homo sapiens
gaactgctgggcttggc

SEQ ID NO: 1331042 - DNA, 20 bp, Homo sapiens
gaactgctgggcttggcagc

SEQ ID NO: 1331043 - DNA, 12 bp, Homo sapiens
gaagacaaaatt

SEQ ID NO: 1331044 - DNA, 20 bp, Homo sapiens
gaagacaaaattgtaagcca

SEQ ID NO: 1331045 - DNA, 18 bp, Homo sapiens
gtatgtggaagtgtgggt

SEQ ID NO: 1331046 - DNA, 14 bp, Homo sapiens
gtcaacaaattaaa

SEQ ID NO: 1331047 - DNA, 20 bp, Homo sapiens
gtcaacaaattaaataaatt

SEQ ID NO: 1331048 - DNA, 21 bp, Homo sapiens
gtcagtatgtggaagtgtggg

SEQ ID NO: 1331049 - DNA, 13 bp, Homo sapiens
gtcagttgtatca

SEQ ID NO: 1331050 - DNA, 15 bp, Homo sapiens
gtccatcagcctcca

SEQ ID NO: 1331051 - DNA, 22 bp, Homo sapiens
gtcccgggacacctaggctagg

SEQ ID NO: 1331052 - DNA, 16 bp, Homo sapiens
gtccctgaagagaagg

SEQ ID NO: 1331053 - DNA, 14 bp, Homo sapiens
gtccctgcctggac

SEQ ID NO: 1331054 - DNA, 21 bp, Homo sapiens
gtccctgcctggaccagcctc

SEQ ID NO: 1331055 - DNA, 23 bp, Homo sapiens
gtccctgcctggaccagcctctc

SEQ ID NO: 1331056 - DNA, 15 bp, Homo sapiens
gtcctgcaccggggc

SEQ ID NO: 1331057 - DNA, 19 bp, Homo sapiens
gtctccctcctctgcccgg

SEQ ID NO: 1331058 - DNA, 11 bp, Homo sapiens
gtctgtgtgtg

SEQ ID NO: 1331059 - DNA, 20 bp, Homo sapiens
gtctgtgtgtgtgtatgtgg

SEQ ID NO: 1331060 - DNA, 11 bp, Homo sapiens
gtctgtgtgtt

SEQ ID NO: 1331061 - DNA, 15 bp, Homo sapiens
gtgaggatgtctggg

SEQ ID NO: 1331062 - DNA, 21 bp, Homo sapiens
gtgatttttatgccacctgaa

SEQ ID NO: 1331063 - DNA, 21 bp, Homo sapiens
gtgccaggatggaatgatggg

SEQ ID NO: 1331064 - DNA, 21 bp, Homo sapiens
gtgcttctagttctgccagga

SEQ ID NO: 1331065 - DNA, 17 bp, Homo sapiens
gtggcactggggcaggg

SEQ ID NO: 1331066 - DNA, 21 bp, Homo sapiens
gtggcctaacctgccgagagt

SEQ ID NO: 1331067 - DNA, 22 bp, Homo sapiens
gtggcctaacctgccgagagtc

SEQ ID NO: 1331068 - DNA, 17 bp, Homo sapiens
gtggctggatctgtgag

SEQ ID NO: 1331069 - DNA, 21 bp, Homo sapiens
gtggggagagacgggccctgg

SEQ ID NO: 1331070 - DNA, 16 bp, Homo sapiens
gtgggtctgtgtgtgt

SEQ ID NO: 1331071 - DNA, 14 bp, Homo sapiens
gtggtggctcggga

SEQ ID NO: 1331072 - DNA, 22 bp, Homo sapiens
gtgtaatttaaaattgtgatgt

SEQ ID NO: 1331073 - DNA, 13 bp, Homo sapiens
gtgtatgtggggg

SEQ ID NO: 1331074 - DNA, 17 bp, Homo sapiens
gtgtctggcacagcctg

SEQ ID NO: 1331075 - DNA, 17 bp, Homo sapiens
gtgtgggagtgtgtaat

SEQ ID NO: 1331076 - DNA, 16 bp, Homo sapiens
gtgtgtgggagtgtgt

SEQ ID NO: 1331077 - DNA, 17 bp, Homo sapiens
gtgtgtgttgtgtgtgg

SEQ ID NO: 1331078 - DNA, 12 bp, Homo sapiens
gtgtgttgtgtg

SEQ ID NO: 1331079 - DNA, 14 bp, Homo sapiens
gtgtgttgtgtgtg

SEQ ID NO: 1331080 - DNA, 15 bp, Homo sapiens
gtgtgtttatgtgtg

SEQ ID NO: 1331081 - DNA, 16 bp, Homo sapiens
gtgtttatgtgtgtgt

SEQ ID NO: 1331082 - DNA, 21 bp, Homo sapiens
gttgggagaatgtcagtatgt

SEQ ID NO: 1331083 - DNA, 12 bp, Homo sapiens
gttgtgtgtggg

SEQ ID NO: 1331084 - DNA, 16 bp, Homo sapiens
gttgtgtgtgggagtg

SEQ ID NO: 1331085 - DNA, 16 bp, Homo sapiens
gtttagaagaagtgtg

SEQ ID NO: 1331086 - DNA, 16 bp, Homo sapiens
taaaattgtgatgtgt

SEQ ID NO: 1331087 - DNA, 12 bp, Homo sapiens
taaataaattac

SEQ ID NO: 1331088 - DNA, 13 bp, Homo sapiens
taaatttatgtga

SEQ ID NO: 1331089 - DNA, 22 bp, Homo sapiens
taacttaaaagaacatgtatat

SEQ ID NO: 1331090 - DNA, 17 bp, Homo sapiens
taagccagagtcaacaa

SEQ ID NO: 1331091 - DNA, 13 bp, Homo sapiens
taatgacccagat

SEQ ID NO: 1331092 - DNA, 19 bp, Homo sapiens
taattctttgacctgttgg

SEQ ID NO: 1331093 - DNA, 20 bp, Homo sapiens
taatttaaaattgtgatgtg

SEQ ID NO: 1331094 - DNA, 19 bp, Homo sapiens
taccagagaaaaagggagg

SEQ ID NO: 1331095 - DNA, 18 bp, Homo sapiens
taggaactgctgggcttg

SEQ ID NO: 1331096 - DNA, 13 bp, Homo sapiens
taggctagggtgg

SEQ ID NO: 1331097 - DNA, 14 bp, Homo sapiens
tatgtgtgtgtgtt

SEQ ID NO: 1331098 - DNA, 22 bp, Homo sapiens
tatgtgtgtgtgttgtgtgtgg

SEQ ID NO: 1331099 - DNA, 23 bp, Homo sapiens
tatgtgtgtgtgttgtgtgtggg

SEQ ID NO: 1331100 - DNA, 19 bp, Homo sapiens
tcaacaaattaaataaatt

SEQ ID NO: 1331101 - DNA, 20 bp, Homo sapiens
tcaacaaattaaataaatta

SEQ ID NO: 1331102 - DNA, 19 bp, Homo sapiens
tcagagggtgtcctgcacc

SEQ ID NO: 1331103 - DNA, 22 bp, Homo sapiens
tcagatttgccttattggcagc

SEQ ID NO: 1331104 - DNA, 18 bp, Homo sapiens
tcaggaaccgaggcaggg

SEQ ID NO: 1331105 - DNA, 16 bp, Homo sapiens
tcataaatttatggtt

SEQ ID NO: 1331106 - DNA, 14 bp, Homo sapiens
tcattccagaggaa

SEQ ID NO: 1331107 - DNA, 16 bp, Homo sapiens
tcccaacactgccagc

SEQ ID NO: 1331108 - DNA, 19 bp, Homo sapiens
tcccttccttcctctcctg

SEQ ID NO: 1331109 - DNA, 13 bp, Homo sapiens
tcctaccccctgt

SEQ ID NO: 1331110 - DNA, 15 bp, Homo sapiens
tcctaccccctgtgc

SEQ ID NO: 1331111 - DNA, 16 bp, Homo sapiens
tcctctgcccgggagc

SEQ ID NO: 1331112 - DNA, 18 bp, Homo sapiens
tcctgcaccggggcctgg

SEQ ID NO: 1331113 - DNA, 19 bp, Homo sapiens
tcctgcaccggggcctggg

SEQ ID NO: 1331114 - DNA, 21 bp, Homo sapiens
tcctgcaccggggcctgggca

SEQ ID NO: 1331115 - DNA, 17 bp, Homo sapiens
tcgagatcccaacactg

SEQ ID NO: 1331116 - DNA, 22 bp, Homo sapiens
tcgagatcccaacactgccagc

SEQ ID NO: 1331117 - DNA, 14 bp, Homo sapiens
tcgtgtctggcaca

SEQ ID NO: 1331118 - DNA, 14 bp, Homo sapiens
tctaatgacccaga

SEQ ID NO: 1331119 - DNA, 14 bp, Homo sapiens
tctagttctgccag

SEQ ID NO: 1331120 - DNA, 18 bp, Homo sapiens
tctccctcctctgcccgg

SEQ ID NO: 1331121 - DNA, 22 bp, Homo sapiens
tctggcacagcctggctgtggc

SEQ ID NO: 1331122 - DNA, 11 bp, Homo sapiens
tctggccctat

SEQ ID NO: 1331123 - DNA, 11 bp, Homo sapiens
tctgtgtgtgt

SEQ ID NO: 1331124 - DNA, 18 bp, Homo sapiens
tctgtgtgtgtgtatgtg

SEQ ID NO: 1331125 - DNA, 19 bp, Homo sapiens
tctgtgtgtgtgtatgtgg

SEQ ID NO: 1331126 - DNA, 16 bp, Homo sapiens
tctgtgtgtttatgtg

SEQ ID NO: 1331127 - DNA, 19 bp, Homo sapiens
tctgtgtgtttatgtgtgt

SEQ ID NO: 1331128 - DNA, 22 bp, Homo sapiens
tcttggggagtttagggtgggg

SEQ ID NO: 1331129 - DNA, 20 bp, Homo sapiens
tgaagagaagggcagggctg

SEQ ID NO: 1331130 - DNA, 22 bp, Homo sapiens
tgaagagaagggcagggctgag

SEQ ID NO: 1331131 - DNA, 20 bp, Homo sapiens
tgaaggggcttctaatgacc

SEQ ID NO: 1331132 - DNA, 19 bp, Homo sapiens
tgagctccttaaggctctt

SEQ ID NO: 1331133 - DNA, 17 bp, Homo sapiens
tgaggaagagggactgt

SEQ ID NO: 1331134 - DNA, 12 bp, Homo sapiens
tgcaccggggcc

SEQ ID NO: 1331135 - DNA, 18 bp, Homo sapiens
tgccaggatggaatgatg

SEQ ID NO: 1331136 - DNA, 17 bp, Homo sapiens
tgccttgtcacgccaga

SEQ ID NO: 1331137 - DNA, 16 bp, Homo sapiens
tgctatgagctgggga

SEQ ID NO: 1331138 - DNA, 20 bp, Homo sapiens
tgctatgagctggggatgtc

SEQ ID NO: 1331139 - DNA, 18 bp, Homo sapiens
tgctattgtagagccaga

SEQ ID NO: 1331140 - DNA, 22 bp, Homo sapiens
tgctattgtagagccagaggtc

SEQ ID NO: 1331141 - DNA, 13 bp, Homo sapiens
tgctccccacgtc

SEQ ID NO: 1331142 - DNA, 23 bp, Homo sapiens
tgctgtatccatccatggggctg

SEQ ID NO: 1331143 - DNA, 13 bp, Homo sapiens
tggaaacagaaga

SEQ ID NO: 1331144 - DNA, 14 bp, Homo sapiens
tggaaacagaagac

SEQ ID NO: 1331145 - DNA, 13 bp, Homo sapiens
tggaagtgtgggt

SEQ ID NO: 1331146 - DNA, 20 bp, Homo sapiens
tggaagtgtgggtctgtgtg

SEQ ID NO: 1331147 - DNA, 21 bp, Homo sapiens
tggaagtgtgggtctgtgtgt

SEQ ID NO: 1331148 - DNA, 22 bp, Homo sapiens
tggacctttcctgaggaagagg

SEQ ID NO: 1331149 - DNA, 15 bp, Homo sapiens
tggatctgtgagggg

SEQ ID NO: 1331150 - DNA, 19 bp, Homo sapiens
tggatctgtgaggggctct

SEQ ID NO: 1331151 - DNA, 22 bp, Homo sapiens
tggcatccagagtccctgcctg

SEQ ID NO: 1331152 - DNA, 16 bp, Homo sapiens
tggccagtggctggat

SEQ ID NO: 1331153 - DNA, 20 bp, Homo sapiens
tggctgtggcctaacctgcc

SEQ ID NO: 1331154 - DNA, 12 bp, Homo sapiens
ctggaccagcct

SEQ ID NO: 1331155 - DNA, 14 bp, Homo sapiens
ctggaccagcctct

SEQ ID NO: 1331156 - DNA, 18 bp, Homo sapiens
ctggaccagcctctccac

SEQ ID NO: 1331157 - DNA, 12 bp, Homo sapiens
ctggaggtttgt

SEQ ID NO: 1331158 - DNA, 14 bp, Homo sapiens
ctggatctgtgagg

SEQ ID NO: 1331159 - DNA, 14 bp, Homo sapiens
ctggtggtggctcg

SEQ ID NO: 1331160 - DNA, 16 bp, Homo sapiens
ctgtgtgtgtgtatgt

SEQ ID NO: 1331161 - DNA, 21 bp, Homo sapiens
ctgtgtgtgtgtatgtggggg

SEQ ID NO: 1331162 - DNA, 17 bp, Homo sapiens
ctgtgtgtttatgtgtg

SEQ ID NO: 1331163 - DNA, 15 bp, Homo sapiens
cttaaggctcttttg

SEQ ID NO: 1331164 - DNA, 19 bp, Homo sapiens
cttccaaacaggctcagag

SEQ ID NO: 1331165 - DNA, 19 bp, Homo sapiens
cttcctctcctgtctccct

SEQ ID NO: 1331166 - DNA, 18 bp, Homo sapiens
cttctaatgacccagata

SEQ ID NO: 1331167 - DNA, 20 bp, Homo sapiens
cttctaatgacccagatatg

SEQ ID NO: 1331168 - DNA, 18 bp, Homo sapiens
cttctagttctgccagga

SEQ ID NO: 1331169 - DNA, 19 bp, Homo sapiens
cttctagttctgccaggag

SEQ ID NO: 1331170 - DNA, 18 bp, Homo sapiens
cttgtcacgccagacttc

SEQ ID NO: 1331171 - DNA, 13 bp, Homo sapiens
ctttcccaacacc

SEQ ID NO: 1331172 - DNA, 13 bp, Homo sapiens
ctttcttccaaac

SEQ ID NO: 1331173 - DNA, 14 bp, Homo sapiens
ctttgtggcactgg

SEQ ID NO: 1331174 - DNA, 16 bp, Homo sapiens
gaaaagggatgatggg

SEQ ID NO: 1331175 - DNA, 15 bp, Homo sapiens
gaaccgaggcaggga

SEQ ID NO: 1331176 - DNA, 13 bp, Homo sapiens
gaagaagtgtgtc

SEQ ID NO: 1331177 - DNA, 13 bp, Homo sapiens
gaagcgttgtcct

SEQ ID NO: 1331178 - DNA, 20 bp, Homo sapiens
gaagcgttgtcctcagcccc

SEQ ID NO: 1331179 - DNA, 19 bp, Homo sapiens
gaagggcagggctgaggcc

SEQ ID NO: 1331180 - DNA, 20 bp, Homo sapiens
gaaggggcttctaatgaccc

SEQ ID NO: 1331181 - DNA, 21 bp, Homo sapiens
gaagtgtgggtctgtgtgtgt

SEQ ID NO: 1331182 - DNA, 17 bp, Homo sapiens
gacaaaattgtaagcca

SEQ ID NO: 1331183 - DNA, 20 bp, Homo sapiens
gacaaaattgtaagccagag

SEQ ID NO: 1331184 - DNA, 23 bp, Homo sapiens
gacaaaattgtaagccagagtca

SEQ ID NO: 1331185 - DNA, 16 bp, Homo sapiens
gacaggttagctgctc

SEQ ID NO: 1331186 - DNA, 14 bp, Homo sapiens
gaccagcctctcca

SEQ ID NO: 1331187 - DNA, 23 bp, Homo sapiens
gacccagatatggaaacagaaga

SEQ ID NO: 1331188 - DNA, 22 bp, Homo sapiens
gagctcaggaaccgaggcaggg

SEQ ID NO: 1331189 - DNA, 20 bp, Homo sapiens
gagctccttaaggctctttt

SEQ ID NO: 1331190 - DNA, 14 bp, Homo sapiens
gaggagggcaggca

SEQ ID NO: 1331191 - DNA, 22 bp, Homo sapiens
gaggcctctcattccagaggaa

SEQ ID NO: 1331192 - DNA, 13 bp, Homo sapiens
gagggtgtcctgc

SEQ ID NO: 1331193 - DNA, 23 bp, Homo sapiens
gaggtgcttctagttctgccagg

SEQ ID NO: 1331194 - DNA, 22 bp, Homo sapiens
gaggtttgtttagaagaagtgt

SEQ ID NO: 1331195 - DNA, 13 bp, Homo sapiens
gagtccatcagcc

SEQ ID NO: 1331196 - DNA, 14 bp, Homo sapiens
gagtccatcagcct

SEQ ID NO: 1331197 - DNA, 16 bp, Homo sapiens
gagtccatcagcctcc

SEQ ID NO: 1331198 - DNA, 19 bp, Homo sapiens
gagtccctgcctggaccag

SEQ ID NO: 1331199 - DNA, 21 bp, Homo sapiens
gagtgtgtaatttaaaattgt

SEQ ID NO: 1331200 - DNA, 22 bp, Homo sapiens
gatagatgtgtggacacattgg

SEQ ID NO: 1331201 - DNA, 11 bp, Homo sapiens
gatatggaaac

SEQ ID NO: 1331202 - DNA, 14 bp, Homo sapiens
aaaagggaggggga

SEQ ID NO: 1331203 - DNA, 17 bp, Homo sapiens
aaaattgtaagccagag

SEQ ID NO: 1331204 - DNA, 13 bp, Homo sapiens
aaattaaataaat

SEQ ID NO: 1331205 - DNA, 15 bp, Homo sapiens
aaattgtaagccaga

SEQ ID NO: 1331206 - DNA, 22 bp, Homo sapiens
aacactgccagcatttcccttc

SEQ ID NO: 1331207 - DNA, 14 bp, Homo sapiens
aacaggctcagagg

SEQ ID NO: 1331208 - DNA, 23 bp, Homo sapiens
aagacaaaattgtaagccagagt

SEQ ID NO: 1331209 - DNA, 11 bp, Homo sapiens
aagccagagtc

SEQ ID NO: 1331210 - DNA, 13 bp, Homo sapiens
aagccagagtcaa

SEQ ID NO: 1331211 - DNA, 14 bp, Homo sapiens
aaggctcttttgta

SEQ ID NO: 1331212 - DNA, 15 bp, Homo sapiens
aaggggcttctaatg

SEQ ID NO: 1331213 - DNA, 17 bp, Homo sapiens
aaggggcttctaatgac

SEQ ID NO: 1331214 - DNA, 21 bp, Homo sapiens
aaggggcttctaatgacccag

SEQ ID NO: 1331215 - DNA, 17 bp, Homo sapiens
aagtgtgggtctgtgtg

SEQ ID NO: 1331216 - DNA, 13 bp, Homo sapiens
aatgtcagtatgt

SEQ ID NO: 1331217 - DNA, 22 bp, Homo sapiens
aatgtcagtatgtggaagtgtg

SEQ ID NO: 1331218 - DNA, 22 bp, Homo sapiens
aattctttgacctgttgggagt

SEQ ID NO: 1331219 - DNA, 18 bp, Homo sapiens
aattgtaagccagagtca

SEQ ID NO: 1331220 - DNA, 11 bp, Homo sapiens
aattgtgatgt

SEQ ID NO: 1331221 - DNA, 20 bp, Homo sapiens
acaaaattgtaagccagagt

SEQ ID NO: 1331222 - DNA, 11 bp, Homo sapiens
acactgccagc

SEQ ID NO: 1331223 - DNA, 20 bp, Homo sapiens
accagagaaaaagggagggg

SEQ ID NO: 1331224 - DNA, 20 bp, Homo sapiens
acccagatatggaaacagaa

SEQ ID NO: 1331225 - DNA, 16 bp, Homo sapiens
acgccagacttcccac

SEQ ID NO: 1331226 - DNA, 13 bp, Homo sapiens
actcagtctttaa

SEQ ID NO: 1331227 - DNA, 17 bp, Homo sapiens
actcatgtgactctttc

SEQ ID NO: 1331228 - DNA, 18 bp, Homo sapiens
actcatgtgactctttcc

SEQ ID NO: 1331229 - DNA, 21 bp, Homo sapiens
actctggaggtttgtttagaa

SEQ ID NO: 1331230 - DNA, 23 bp, Homo sapiens
acttgtcccgggacacctaggct

SEQ ID NO: 1331231 - DNA, 14 bp, Homo sapiens
agaagaagtgtgtc

SEQ ID NO: 1331232 - DNA, 19 bp, Homo sapiens
agacttcccacggctcctc

SEQ ID NO: 1331233 - DNA, 17 bp, Homo sapiens
agagacgggccctggtg

SEQ ID NO: 1331234 - DNA, 22 bp, Homo sapiens
agagaggccattctttcccaac

SEQ ID NO: 1331235 - DNA, 21 bp, Homo sapiens
agaggccattctttcccaaca

SEQ ID NO: 1331236 - DNA, 21 bp, Homo sapiens
agagtcaacaaattaaataaa

SEQ ID NO: 1331237 - DNA, 19 bp, Homo sapiens
agagtggggtaggttggga

SEQ ID NO: 1331238 - DNA, 12 bp, Homo sapiens
agatatggaaac

SEQ ID NO: 1331239 - DNA, 14 bp, Homo sapiens
agatatggaaacag

SEQ ID NO: 1331240 - DNA, 20 bp, Homo sapiens
agatatggaaacagaagaca

SEQ ID NO: 1331241 - DNA, 19 bp, Homo sapiens
agatcccaacactgccagc

SEQ ID NO: 1331242 - DNA, 14 bp, Homo sapiens
agccgggagcctga

SEQ ID NO: 1331243 - DNA, 19 bp, Homo sapiens
agctaattctttgacctgt

SEQ ID NO: 1331244 - DNA, 21 bp, Homo sapiens
agctcaggaaccgaggcaggg

SEQ ID NO: 1331245 - DNA, 16 bp, Homo sapiens
agctccttaaggctct

SEQ ID NO: 1331246 - DNA, 17 bp, Homo sapiens
agctccttaaggctctt

SEQ ID NO: 1331247 - DNA, 14 bp, Homo sapiens
agctgcctgtgcct

SEQ ID NO: 1331248 - DNA, 22 bp, Homo sapiens
aggaactgctgggcttggcagc

SEQ ID NO: 1331249 - DNA, 20 bp, Homo sapiens
aggagacaggttagctgctc

SEQ ID NO: 1331250 - DNA, 15 bp, Homo sapiens
aggagggaggtgctt

SEQ ID NO: 1331251 - DNA, 13 bp, Homo sapiens
aggagggcaggca

SEQ ID NO: 1331252 - DNA, 13 bp, Homo sapiens
aggatgtctgggc

SEQ ID NO: 1331253 - DNA, 19 bp, Homo sapiens
aggcatcggggagccggga

SEQ ID NO: 1331254 - DNA, 22 bp, Homo sapiens
aggctatggggatagatgtgtg

SEQ ID NO: 1331255 - DNA, 12 bp, Homo sapiens
aggggcttctaa

SEQ ID NO: 1331256 - DNA, 13 bp, Homo sapiens
aggggcttctaat

SEQ ID NO: 1331257 - DNA, 21 bp, Homo sapiens
aggggcttctaatgacccaga

SEQ ID NO: 1331258 - DNA, 16 bp, Homo sapiens
agggggagagggctgc

SEQ ID NO: 1331259 - DNA, 21 bp, Homo sapiens
agggtggggggggggcgcggc

SEQ ID NO: 1331260 - DNA, 23 bp, Homo sapiens
aggttgggagaatgtcagtatgt

SEQ ID NO: 1331261 - DNA, 23 bp, Homo sapiens
aggtttgtttagaagaagtgtgt

SEQ ID NO: 1331262 - DNA, 15 bp, Homo sapiens
agtatgtggaagtgt

SEQ ID NO: 1331263 - DNA, 12 bp, Homo sapiens
agtcaacaaatt

SEQ ID NO: 1331264 - DNA, 23 bp, Homo sapiens
agtcaacaaattaaataaattac

SEQ ID NO: 1331265 - DNA, 21 bp, Homo sapiens
agtccctgcctggaccagcct

SEQ ID NO: 1331266 - DNA, 14 bp, Homo sapiens
agtgaggatgtctg

SEQ ID NO: 1331267 - DNA, 15 bp, Homo sapiens
agtgtgggtctgtgt

SEQ ID NO: 1331268 - DNA, 16 bp, Homo sapiens
agtgtgggtctgtgtg

SEQ ID NO: 1331269 - DNA, 20 bp, Homo sapiens
tgacccagatatggaaacag

SEQ ID NO: 1331270 - DNA, 13 bp, Homo sapiens
tgactctttccaa

SEQ ID NO: 1331271 - DNA, 19 bp, Homo sapiens
tgactctttccaaccggct

SEQ ID NO: 1331272 - DNA, 21 bp, Homo sapiens
tgagctccttaaggctctttt

SEQ ID NO: 1331273 - DNA, 18 bp, Homo sapiens
tgagttcataaatttatg

SEQ ID NO: 1331274 - DNA, 17 bp, Homo sapiens
tgagttggctgggaata

SEQ ID NO: 1331275 - DNA, 24 bp, Homo sapiens
tgataagcagtcatcctcagatca

SEQ ID NO: 1331276 - DNA, 15 bp, Homo sapiens
tgatgggtcagttgt

SEQ ID NO: 1331277 - DNA, 18 bp, Homo sapiens
tgatttttatgccacctg

SEQ ID NO: 1331278 - DNA, 16 bp, Homo sapiens
tgcaccggggcctggg

SEQ ID NO: 1331279 - DNA, 22 bp, Homo sapiens
tgcaccggggcctgggcaggag

SEQ ID NO: 1331280 - DNA, 19 bp, Homo sapiens
tgccttgtgaaggaattat

SEQ ID NO: 1331281 - DNA, 18 bp, Homo sapiens
tgcttctagttctgccag

SEQ ID NO: 1331282 - DNA, 19 bp, Homo sapiens
tgcttctagttctgccagg

SEQ ID NO: 1331283 - DNA, 18 bp, Homo sapiens
tggaactcgtgtctggca

SEQ ID NO: 1331284 - DNA, 16 bp, Homo sapiens
tggaccagcctctcca

SEQ ID NO: 1331285 - DNA, 14 bp, Homo sapiens
tggccagtggctgg

SEQ ID NO: 1331286 - DNA, 15 bp, Homo sapiens
tggccagtggctgga

SEQ ID NO: 1331287 - DNA, 16 bp, Homo sapiens
tggcctaacctgccga

SEQ ID NO: 1331288 - DNA, 23 bp, Homo sapiens
tggcctaacctgccgagagtcca

SEQ ID NO: 1331289 - DNA, 23 bp, Homo sapiens
tgggaataagtgccaggatggaa

SEQ ID NO: 1331290 - DNA, 13 bp, Homo sapiens
tgggagtgtgtaa

SEQ ID NO: 1331291 - DNA, 23 bp, Homo sapiens
tgggattgaaggggcttctaatg

SEQ ID NO: 1331292 - DNA, 16 bp, Homo sapiens
tgggcaggagggaggt

SEQ ID NO: 1331293 - DNA, 16 bp, Homo sapiens
tggggcaggggccggg

SEQ ID NO: 1331294 - DNA, 15 bp, Homo sapiens
tggggctcagagtgg

SEQ ID NO: 1331295 - DNA, 11 bp, Homo sapiens
tgggggatgta

SEQ ID NO: 1331296 - DNA, 14 bp, Homo sapiens
tgggggtctgtgtg

SEQ ID NO: 1331297 - DNA, 15 bp, Homo sapiens
tgggggtctgtgtgt

SEQ ID NO: 1331298 - DNA, 12 bp, Homo sapiens
tgggtctgtgtg

SEQ ID NO: 1331299 - DNA, 16 bp, Homo sapiens
tgtaaatttatgtgat

SEQ ID NO: 1331300 - DNA, 17 bp, Homo sapiens
tgtaaatttatgtgatg

SEQ ID NO: 1331301 - DNA, 15 bp, Homo sapiens
tgtaagccagagtca

SEQ ID NO: 1331302 - DNA, 20 bp, Homo sapiens
tgtaagccagagtcaacaaa

SEQ ID NO: 1331303 - DNA, 21 bp, Homo sapiens
tgtatgtgggggtctgtgtgt

SEQ ID NO: 1331304 - DNA, 15 bp, Homo sapiens
tgtgactctttccaa

SEQ ID NO: 1331305 - DNA, 17 bp, Homo sapiens
tgtgactctttccaacc

SEQ ID NO: 1331306 - DNA, 18 bp, Homo sapiens
tgtgaggggctctctcat

SEQ ID NO: 1331307 - DNA, 16 bp, Homo sapiens
tgtgccttttgccatc

SEQ ID NO: 1331308 - DNA, 19 bp, Homo sapiens
tgtggcactggggcagggg

SEQ ID NO: 1331309 - DNA, 15 bp, Homo sapiens
tgtggcctaacctgc

SEQ ID NO: 1331310 - DNA, 15 bp, Homo sapiens
tgtgggagtgtgtaa

SEQ ID NO: 1331311 - DNA, 19 bp, Homo sapiens
tgtgtaatttaaaattgtg

SEQ ID NO: 1331312 - DNA, 11 bp, Homo sapiens
tgtgtatgtgg

SEQ ID NO: 1331313 - DNA, 23 bp, Homo sapiens
tgtgtatgtgggggtctgtgtgt

SEQ ID NO: 1331314 - DNA, 14 bp, Homo sapiens
tgtgtgggagtgtg

SEQ ID NO: 1331315 - DNA, 14 bp, Homo sapiens
tgtgtgtgtatgtg

SEQ ID NO: 1331316 - DNA, 13 bp, Homo sapiens
tgtgtgtgtgtat

SEQ ID NO: 1331317 - DNA, 23 bp, Homo sapiens
tgtgttgtgtgtgggagtgtgta

SEQ ID NO: 1331318 - DNA, 16 bp, Homo sapiens
tgttcttttgtcccag

SEQ ID NO: 1331319 - DNA, 18 bp, Homo sapiens
ttaaaattgtgatgtgtc

SEQ ID NO: 1331320 - DNA, 14 bp, Homo sapiens
ttagaagaagtgtg

SEQ ID NO: 1331321 - DNA, 15 bp, Homo sapiens
ttagaagaagtgtgt

SEQ ID NO: 1331322 - DNA, 16 bp, Homo sapiens
ttagaagaagtgtgtc

SEQ ID NO: 1331323 - DNA, 17 bp, Homo sapiens
ttgtaagccagagtcaa

SEQ ID NO: 1331324 - DNA, 20 bp, Homo sapiens
ttgtcacgccagacttccca

SEQ ID NO: 1331325 - DNA, 10 bp, Homo sapiens
ttgtgtgtgg

SEQ ID NO: 1331326 - DNA, 17 bp, Homo sapiens
tttagaagaagtgtgtc

SEQ ID NO: 1331327 - DNA, 12 bp, Homo sapiens
tttatgtgatgg

SEQ ID NO: 1331328 - DNA, 11 bp, Homo sapiens
tttatgtgtgt

SEQ ID NO: 1331329 - DNA, 23 bp, Homo sapiens
tttgacctgttgggagtgaggat

SEQ ID NO: 1331330 - DNA, 16 bp, Homo sapiens
actcatgtgactcttt

SEQ ID NO: 1331331 - DNA, 19 bp, Homo sapiens
actcatgtgactctttcca

SEQ ID NO: 1331332 - DNA, 12 bp, Homo sapiens
actgccagcatt

SEQ ID NO: 1331333 - DNA, 14 bp, Homo sapiens
actggggcaggggc

SEQ ID NO: 1331334 - DNA, 16 bp, Homo sapiens
actggggcaggggccg

SEQ ID NO: 1331335 - DNA, 13 bp, Homo sapiens
agaatgtcagtat

SEQ ID NO: 1331336 - DNA, 16 bp, Homo sapiens
agaatgtcagtatgtg

SEQ ID NO: 1331337 - DNA, 21 bp, Homo sapiens
agacatttgctatgagctggg

SEQ ID NO: 1331338 - DNA, 14 bp, Homo sapiens
agacgggccctggt

SEQ ID NO: 1331339 - DNA, 14 bp, Homo sapiens
agacttatcaacat

SEQ ID NO: 1331340 - DNA, 12 bp, Homo sapiens
agagaggccatt

SEQ ID NO: 1331341 - DNA, 23 bp, Homo sapiens
agagaggccattctttcccaaca

SEQ ID NO: 1331342 - DNA, 16 bp, Homo sapiens
agagggtgtcctgcac

SEQ ID NO: 1331343 - DNA, 15 bp, Homo sapiens
agagtcaacaaatta

SEQ ID NO: 1331344 - DNA, 23 bp, Homo sapiens
agagtcaacaaattaaataaatt

SEQ ID NO: 1331345 - DNA, 23 bp, Homo sapiens
agagtccatcagcctccatccta

SEQ ID NO: 1331346 - DNA, 14 bp, Homo sapiens
agagtccctgcctg

SEQ ID NO: 1331347 - DNA, 13 bp, Homo sapiens
agcatctcccagt

SEQ ID NO: 1331348 - DNA, 10 bp, Homo sapiens
agccagagtc

SEQ ID NO: 1331349 - DNA, 22 bp, Homo sapiens
agccagagtcaacaaattaaat

SEQ ID NO: 1331350 - DNA, 18 bp, Homo sapiens
agcctgaccctcatcttt

SEQ ID NO: 1331351 - DNA, 20 bp, Homo sapiens
agctcaggaaccgaggcagg

SEQ ID NO: 1331352 - DNA, 22 bp, Homo sapiens
agctccttaaggctcttttgta

SEQ ID NO: 1331353 - DNA, 17 bp, Homo sapiens
agctgctccccacgtca

SEQ ID NO: 1331354 - DNA, 21 bp, Homo sapiens
agctgggacaccccgactttt

SEQ ID NO: 1331355 - DNA, 15 bp, Homo sapiens
agctggggatgtctc

SEQ ID NO: 1331356 - DNA, 21 bp, Homo sapiens
aggagtccctgccatcatgtt

SEQ ID NO: 1331357 - DNA, 15 bp, Homo sapiens
aggccattctttccc

SEQ ID NO: 1331358 - DNA, 21 bp, Homo sapiens
aggcctctcattccagaggaa

SEQ ID NO: 1331359 - DNA, 16 bp, Homo sapiens
aggcctgactctcagc

SEQ ID NO: 1331360 - DNA, 18 bp, Homo sapiens
aggcgaagcgttgtcctc

SEQ ID NO: 1331361 - DNA, 14 bp, Homo sapiens
aggctagggtgggg

SEQ ID NO: 1331362 - DNA, 21 bp, Homo sapiens
aggctatggggatagatgtgt

SEQ ID NO: 1331363 - DNA, 22 bp, Homo sapiens
agggaaggatcccatgagctcc

SEQ ID NO: 1331364 - DNA, 22 bp, Homo sapiens
agggatttggggctcagagtgg

SEQ ID NO: 1331365 - DNA, 17 bp, Homo sapiens
aggggccgggggcagtc

SEQ ID NO: 1331366 - DNA, 17 bp, Homo sapiens
aggggcttctaatgacc

SEQ ID NO: 1331367 - DNA, 19 bp, Homo sapiens
agtatgtggaagtgtgggt

SEQ ID NO: 1331368 - DNA, 19 bp, Homo sapiens
agtcaacaaattaaataaa

SEQ ID NO: 1331369 - DNA, 14 bp, Homo sapiens
agtccctgcctgga

SEQ ID NO: 1331370 - DNA, 23 bp, Homo sapiens
agtctgagagaggccattctttc

SEQ ID NO: 1331371 - DNA, 16 bp, Homo sapiens
agtgatttttatgcca

SEQ ID NO: 1331372 - DNA, 21 bp, Homo sapiens
agtgatttttatgccacctga

SEQ ID NO: 1331373 - DNA, 16 bp, Homo sapiens
agtggctggatctgtg

SEQ ID NO: 1331374 - DNA, 18 bp, Homo sapiens
agttcataaatttatggt

SEQ ID NO: 1331375 - DNA, 20 bp, Homo sapiens
agttgtatcagcacgtgtgg

SEQ ID NO: 1331376 - DNA, 12 bp, Homo sapiens
agtttagggtgg

SEQ ID NO: 1331377 - DNA, 19 bp, Homo sapiens
atccagagtccctgcctgg

SEQ ID NO: 1331378 - DNA, 19 bp, Homo sapiens
atccatagcacctccacat

SEQ ID NO: 1331379 - DNA, 11 bp, Homo sapiens
atcccaacact

SEQ ID NO: 1331380 - DNA, 16 bp, Homo sapiens
atcccaacactgccag

SEQ ID NO: 1331381 - DNA, 14 bp, Homo sapiens
atcctaccccctgt

SEQ ID NO: 1331382 - DNA, 18 bp, Homo sapiens
atcggggagccgggagcc

SEQ ID NO: 1331383 - DNA, 19 bp, Homo sapiens
atgggattgaaggggcttc

SEQ ID NO: 1331384 - DNA, 16 bp, Homo sapiens
atgtgactctttccaa

SEQ ID NO: 1331385 - DNA, 22 bp, Homo sapiens
atgtggaagtgtgggtctgtgt

SEQ ID NO: 1331386 - DNA, 23 bp, Homo sapiens
atgtggaagtgtgggtctgtgtg

SEQ ID NO: 1331387 - DNA, 17 bp, Homo sapiens
atgtttacagaggacag

SEQ ID NO: 1331388 - DNA, 17 bp, Homo sapiens
attcatggcctggggga

SEQ ID NO: 1331389 - DNA, 16 bp, Homo sapiens
attctttcccaacacc

SEQ ID NO: 1331390 - DNA, 19 bp, Homo sapiens
attctttgacctgttggga

SEQ ID NO: 1331391 - DNA, 13 bp, Homo sapiens
attgaaggggctt

SEQ ID NO: 1331392 - DNA, 17 bp, Homo sapiens
attgaaggggcttctaa

SEQ ID NO: 1331393 - DNA, 19 bp, Homo sapiens
attgaaggggcttctaatg

SEQ ID NO: 1331394 - DNA, 12 bp, Homo sapiens
attggtgttgac

SEQ ID NO: 1331395 - DNA, 14 bp, Homo sapiens
attgtaagccagag

SEQ ID NO: 1331396 - DNA, 17 bp, Homo sapiens
attgtaagccagagtca

SEQ ID NO: 1331397 - DNA, 18 bp, Homo sapiens
attgtagagccagaggtc

SEQ ID NO: 1331398 - DNA, 15 bp, Homo sapiens
atttaaaattgtgat

SEQ ID NO: 1331399 - DNA, 19 bp, Homo sapiens
atttgtaaatttatgtgat

SEQ ID NO: 1331400 - DNA, 19 bp, Homo sapiens
caaaattgtaagccagagt

SEQ ID NO: 1331401 - DNA, 14 bp, Homo sapiens
caaacaggctcaga

SEQ ID NO: 1331402 - DNA, 15 bp, Homo sapiens
caaacaggctcagag

SEQ ID NO: 1331403 - DNA, 15 bp, Homo sapiens
caacaaattaaataa

SEQ ID NO: 1331404 - DNA, 18 bp, Homo sapiens
caacaaattaaataaatt

SEQ ID NO: 1331405 - DNA, 18 bp, Homo sapiens
caacacctcttggggagt

SEQ ID NO: 1331406 - DNA, 14 bp, Homo sapiens
caacactgccagca

SEQ ID NO: 1331407 - DNA, 14 bp, Homo sapiens
caccggggcctggg

SEQ ID NO: 1331408 - DNA, 21 bp, Homo sapiens
caccggggcctgggcaggagg

SEQ ID NO: 1331409 - DNA, 18 bp, Homo sapiens
cacctaggctagggtggg

SEQ ID NO: 1331410 - DNA, 19 bp, Homo sapiens
cacctaggctagggtgggg

SEQ ID NO: 1331411 - DNA, 16 bp, Homo sapiens
cactcatgtgactctt

SEQ ID NO: 1331412 - DNA, 22 bp, Homo sapiens
cagacttcccacggctcctcga

SEQ ID NO: 1331413 - DNA, 17 bp, Homo sapiens
cagagaaaaagggaggg

SEQ ID NO: 1331414 - DNA, 18 bp, Homo sapiens
cagagaaaaagggagggg

SEQ ID NO: 1331415 - DNA, 15 bp, Homo sapiens
cagagtcaacaaatt

SEQ ID NO: 1331416 - DNA, 16 bp, Homo sapiens
cagatatggaaacaga

SEQ ID NO: 1331417 - DNA, 19 bp, Homo sapiens
cagatatggaaacagaaga

SEQ ID NO: 1331418 - DNA, 16 bp, Homo sapiens
gtaaatttatgtgatg

SEQ ID NO: 1331419 - DNA, 19 bp, Homo sapiens
gtaatttaaaattgtgatg

SEQ ID NO: 1331420 - DNA, 23 bp, Homo sapiens
gtaatttaaaattgtgatgtgtc

SEQ ID NO: 1331421 - DNA, 17 bp, Homo sapiens
gtatgtggaagtgtggg

SEQ ID NO: 1331422 - DNA, 17 bp, Homo sapiens
gaagagaagggcagggc

SEQ ID NO: 1331423 - DNA, 19 bp, Homo sapiens
gaagcgttgtcctcagccc

SEQ ID NO: 1331424 - DNA, 19 bp, Homo sapiens
gaaggatcccatgagctcc

SEQ ID NO: 1331425 - DNA, 15 bp, Homo sapiens
gaaggggcttctaat

SEQ ID NO: 1331426 - DNA, 16 bp, Homo sapiens
gaaggggcttctaatg

SEQ ID NO: 1331427 - DNA, 24 bp, Homo sapiens
gaagtgtgggtctgtgtgtgtgta

SEQ ID NO: 1331428 - DNA, 20 bp, Homo sapiens
gaataagtgccaggatggaa

SEQ ID NO: 1331429 - DNA, 19 bp, Homo sapiens
gaatgtcagtatgtggaag

SEQ ID NO: 1331430 - DNA, 19 bp, Homo sapiens
gacaaaattgtaagccaga

SEQ ID NO: 1331431 - DNA, 21 bp, Homo sapiens
gacaaaattgtaagccagagt

SEQ ID NO: 1331432 - DNA, 15 bp, Homo sapiens
gacacctaggctagg

SEQ ID NO: 1331433 - DNA, 16 bp, Homo sapiens
gacacctaggctaggg

SEQ ID NO: 1331434 - DNA, 20 bp, Homo sapiens
gacacctaggctagggtggg

SEQ ID NO: 1331435 - DNA, 17 bp, Homo sapiens
gagaatgtcagtatgtg

SEQ ID NO: 1331436 - DNA, 18 bp, Homo sapiens
gagatcccaacactgcca

SEQ ID NO: 1331437 - DNA, 19 bp, Homo sapiens
gagatcccaacactgccag

SEQ ID NO: 1331438 - DNA, 20 bp, Homo sapiens
gaggcgaagcgttgtcctca

SEQ ID NO: 1331439 - DNA, 21 bp, Homo sapiens
gaggcgaagcgttgtcctcag

SEQ ID NO: 1331440 - DNA, 16 bp, Homo sapiens
gagggctgcctttgga

SEQ ID NO: 1331441 - DNA, 19 bp, Homo sapiens
gagtcaacaaattaaataa

SEQ ID NO: 1331442 - DNA, 14 bp, Homo sapiens
gagtccctgcctgg

SEQ ID NO: 1331443 - DNA, 16 bp, Homo sapiens
gagtccctgcctggac

SEQ ID NO: 1331444 - DNA, 18 bp, Homo sapiens
gagtgaggatgtctgggc

SEQ ID NO: 1331445 - DNA, 15 bp, Homo sapiens
gagtttagggtgggg

SEQ ID NO: 1331446 - DNA, 14 bp, Homo sapiens
gatatggaaacaga

SEQ ID NO: 1331447 - DNA, 19 bp, Homo sapiens
gatatggaaacagaagaca

SEQ ID NO: 1331448 - DNA, 17 bp, Homo sapiens
gatcccaacactgccag

SEQ ID NO: 1331449 - DNA, 19 bp, Homo sapiens
gcacagcctggctgtggcc

SEQ ID NO: 1331450 - DNA, 20 bp, Homo sapiens
gcaccggggcctgggcagga

SEQ ID NO: 1331451 - DNA, 18 bp, Homo sapiens
gcactggggcaggggccg

SEQ ID NO: 1331452 - DNA, 19 bp, Homo sapiens
gcaggggccgggggcagtc

SEQ ID NO: 1331453 - DNA, 20 bp, Homo sapiens
gcaggggccgggggcagtct

SEQ ID NO: 1331454 - DNA, 17 bp, Homo sapiens
gcatcggggagccggga

SEQ ID NO: 1331455 - DNA, 18 bp, Homo sapiens
gcatttcccttccttcct

SEQ ID NO: 1331456 - DNA, 15 bp, Homo sapiens
gccacgattgcagga

SEQ ID NO: 1331457 - DNA, 11 bp, Homo sapiens
gccagagtcaa

SEQ ID NO: 1331458 - DNA, 17 bp, Homo sapiens
gccagagtcaacaaatt

SEQ ID NO: 1331459 - DNA, 22 bp, Homo sapiens
gccagagtcaacaaattaaata

SEQ ID NO: 1331460 - DNA, 14 bp, Homo sapiens
gccagtggctggat

SEQ ID NO: 1331461 - DNA, 17 bp, Homo sapiens
gccatcatgtttacaga

SEQ ID NO: 1331462 - DNA, 19 bp, Homo sapiens
gccgggagcctgaccctca

SEQ ID NO: 1331463 - DNA, 17 bp, Homo sapiens
gccttgtcacgccagac

SEQ ID NO: 1331464 - DNA, 13 bp, Homo sapiens
gcggctgggagga

SEQ ID NO: 1331465 - DNA, 17 bp, Homo sapiens
gcggctgggaggagggc

SEQ ID NO: 1331466 - DNA, 18 bp, Homo sapiens
gcggctgggaggagggca

SEQ ID NO: 1331467 - DNA, 17 bp, Homo sapiens
gctagggtggggagaga

SEQ ID NO: 1331468 - DNA, 17 bp, Homo sapiens
gctatgagctggggatg

SEQ ID NO: 1331469 - DNA, 19 bp, Homo sapiens
gctcaggaaccgaggcagg

SEQ ID NO: 1331470 - DNA, 14 bp, Homo sapiens
gctgaggcctctca

SEQ ID NO: 1331471 - DNA, 20 bp, Homo sapiens
gctgcctttggacttgtccc

SEQ ID NO: 1331472 - DNA, 13 bp, Homo sapiens
gctggatctgtga

SEQ ID NO: 1331473 - DNA, 19 bp, Homo sapiens
gcttctaatgacccagata

SEQ ID NO: 1331474 - DNA, 17 bp, Homo sapiens
gcttctagttctgccag

SEQ ID NO: 1331475 - DNA, 20 bp, Homo sapiens
gcttctagttctgccaggag

SEQ ID NO: 1331476 - DNA, 14 bp, Homo sapiens
gctttgtggcactg

SEQ ID NO: 1331477 - DNA, 15 bp, Homo sapiens
ggaaccgaggcaggg

SEQ ID NO: 1331478 - DNA, 17 bp, Homo sapiens
ggaactcgtgtctggca

SEQ ID NO: 1331479 - DNA, 15 bp, Homo sapiens
ggaactgctgggctt

SEQ ID NO: 1331480 - DNA, 17 bp, Homo sapiens
ggaaggatcccatgagc

SEQ ID NO: 1331481 - DNA, 22 bp, Homo sapiens
ggaaggatcccatgagctcctt

SEQ ID NO: 1331482 - DNA, 12 bp, Homo sapiens
ggaagtgtgggt

SEQ ID NO: 1331483 - DNA, 22 bp, Homo sapiens
ggaagtgtgggtctgtgtgtgt

SEQ ID NO: 1331484 - DNA, 14 bp, Homo sapiens
ggaggagggcaggc

SEQ ID NO: 1331485 - DNA, 13 bp, Homo sapiens
ggatagatgtgtg

SEQ ID NO: 1331486 - DNA, 15 bp, Homo sapiens
ggatagatgtgtgga

SEQ ID NO: 1331487 - DNA, 20 bp, Homo sapiens
ggatcccatgagctccttaa

SEQ ID NO: 1331488 - DNA, 17 bp, Homo sapiens
ggatggaatgatgggtc

SEQ ID NO: 1331489 - DNA, 13 bp, Homo sapiens
ggcacagcctggc

SEQ ID NO: 1331490 - DNA, 20 bp, Homo sapiens
ggcagtctgagagaggccat

SEQ ID NO: 1331491 - DNA, 18 bp, Homo sapiens
ggcatccagagtccctgc

SEQ ID NO: 1331492 - DNA, 22 bp, Homo sapiens
ggcatccagagtccctgcctgg

SEQ ID NO: 1331493 - DNA, 19 bp, Homo sapiens
ggccagtggctggatctgt

SEQ ID NO: 1331494 - DNA, 12 bp, Homo sapiens
ggccctgtgcct

SEQ ID NO: 1331495 - DNA, 19 bp, Homo sapiens
ggcctgggcaggagggagg

SEQ ID NO: 1331496 - DNA, 16 bp, Homo sapiens
ggctagggtggggaga

SEQ ID NO: 1331497 - DNA, 20 bp, Homo sapiens
ggctgggaggagggcaggca

SEQ ID NO: 1331498 - DNA, 21 bp, Homo sapiens
ggctgggaggagggcaggcat

SEQ ID NO: 1331499 - DNA, 15 bp, Homo sapiens
gggaaggatcccatg

SEQ ID NO: 1331500 - DNA, 19 bp, Homo sapiens
gggagaatgtcagtatgtg

SEQ ID NO: 1331501 - DNA, 22 bp, Homo sapiens
gggagaatgtcagtatgtggaa

SEQ ID NO: 1331502 - DNA, 12 bp, Homo sapiens
gggagctcagga

SEQ ID NO: 1331503 - DNA, 22 bp, Homo sapiens
gggagctcaggaaccgaggcag

SEQ ID NO: 1331504 - DNA, 16 bp, Homo sapiens
gggaggagggcaggca

SEQ ID NO: 1331505 - DNA, 16 bp, Homo sapiens
gggagtttagggtggg

SEQ ID NO: 1331506 - DNA, 14 bp, Homo sapiens
gggatgtctctcat

SEQ ID NO: 1331507 - DNA, 22 bp, Homo sapiens
gggattgaaggggcttctaatg

SEQ ID NO: 1331508 - DNA, 17 bp, Homo sapiens
gggcagtctgagagagg

SEQ ID NO: 1331509 - DNA, 19 bp, Homo sapiens
gggcagtctgagagaggcc

SEQ ID NO: 1331510 - DNA, 21 bp, Homo sapiens
gggcagtctgagagaggccat

SEQ ID NO: 1331511 - DNA, 16 bp, Homo sapiens
gggcctgggcaggagg

SEQ ID NO: 1331512 - DNA, 17 bp, Homo sapiens
gggcctgggcaggaggg

SEQ ID NO: 1331513 - DNA, 14 bp, Homo sapiens
gggcgcggctggga

SEQ ID NO: 1331514 - DNA, 18 bp, Homo sapiens
gggctcagagtggggtag

SEQ ID NO: 1331515 - DNA, 18 bp, Homo sapiens
ggggagtttagggtgggg

SEQ ID NO: 1331516 - DNA, 18 bp, Homo sapiens
ggggcagtctgagagagg

SEQ ID NO: 1331517 - DNA, 23 bp, Homo sapiens
ggggtctgtgtgtttatgtgtgt

SEQ ID NO: 1331518 - DNA, 21 bp, Homo sapiens
gggtcatctgtacctctgcct

SEQ ID NO: 1331519 - DNA, 18 bp, Homo sapiens
gggtcattcatggcctgg

SEQ ID NO: 1331520 - DNA, 13 bp, Homo sapiens
gggtggggagaga

SEQ ID NO: 1331521 - DNA, 23 bp, Homo sapiens
gggtgtcctgcaccggggcctgg

SEQ ID NO: 1331522 - DNA, 20 bp, Homo sapiens
ggtctgtgtgtgtgtatgtg

SEQ ID NO: 1331523 - DNA, 21 bp, Homo sapiens
ggtctgtgtgtgtgtatgtgg

SEQ ID NO: 1331524 - DNA, 21 bp, Homo sapiens
ggtgcttctagttctgccagg

SEQ ID NO: 1331525 - DNA, 21 bp, Homo sapiens
ggtggggagagacgggccctg

SEQ ID NO: 1331526 - DNA, 21 bp, Homo sapiens
tgggacaccccgacttttgtt

SEQ ID NO: 1331527 - DNA, 19 bp, Homo sapiens
tgggagaatgtcagtatgt

SEQ ID NO: 1331528 - DNA, 22 bp, Homo sapiens
tgggagaatgtcagtatgtgga

SEQ ID NO: 1331529 - DNA, 22 bp, Homo sapiens
tgggagtgaggatgtctgggcc

SEQ ID NO: 1331530 - DNA, 24 bp, Homo sapiens
tgggattgaaggggcttctaatga

SEQ ID NO: 1331531 - DNA, 15 bp, Homo sapiens
tgggcaggagggagg

SEQ ID NO: 1331532 - DNA, 18 bp, Homo sapiens
tggggagtttagggtggg

SEQ ID NO: 1331533 - DNA, 18 bp, Homo sapiens
tggggcaggggccggggg

SEQ ID NO: 1331534 - DNA, 14 bp, Homo sapiens
tggggctgattgta

SEQ ID NO: 1331535 - DNA, 15 bp, Homo sapiens
tggggtaggttggga

SEQ ID NO: 1331536 - DNA, 20 bp, Homo sapiens
tggtaggaactgctgggctt

SEQ ID NO: 1331537 - DNA, 15 bp, Homo sapiens
tgtaaatttatgtga

SEQ ID NO: 1331538 - DNA, 12 bp, Homo sapiens
tgtaagccagag

SEQ ID NO: 1331539 - DNA, 14 bp, Homo sapiens
tgtacctctgcctc

SEQ ID NO: 1331540 - DNA, 21 bp, Homo sapiens
tgtagtgatttttatgccacc

SEQ ID NO: 1331541 - DNA, 22 bp, Homo sapiens
tgtcacccttaggccagcacca

SEQ ID NO: 1331542 - DNA, 14 bp, Homo sapiens
tgtcacgccagact

SEQ ID NO: 1331543 - DNA, 19 bp, Homo sapiens
tgtcagtatgtggaagtgt

SEQ ID NO: 1331544 - DNA, 20 bp, Homo sapiens
tgtcagtatgtggaagtgtg

SEQ ID NO: 1331545 - DNA, 22 bp, Homo sapiens
tgtcagtatgtggaagtgtggg

SEQ ID NO: 1331546 - DNA, 21 bp, Homo sapiens
tgtcctcagccccgcgtggaa

SEQ ID NO: 1331547 - DNA, 18 bp, Homo sapiens
tgtcctgcaccggggcct

SEQ ID NO: 1331548 - DNA, 14 bp, Homo sapiens
tgtgactctttcca

SEQ ID NO: 1331549 - DNA, 11 bp, Homo sapiens
tgtgatgtgtc

SEQ ID NO: 1331550 - DNA, 17 bp, Homo sapiens
tgtgccttggtgtgctg

SEQ ID NO: 1331551 - DNA, 15 bp, Homo sapiens
tgtggaagtgtgggt

SEQ ID NO: 1331552 - DNA, 16 bp, Homo sapiens
tgtggcatccagagtc

SEQ ID NO: 1331553 - DNA, 11 bp, Homo sapiens
tgtgtaattta

SEQ ID NO: 1331554 - DNA, 18 bp, Homo sapiens
tgtgtaatttaaaattgt

SEQ ID NO: 1331555 - DNA, 22 bp, Homo sapiens
tgtgtaatttaaaattgtgatg

SEQ ID NO: 1331556 - DNA, 14 bp, Homo sapiens
tgtgtatgtggggg

SEQ ID NO: 1331557 - DNA, 11 bp, Homo sapiens
tgtgtgtatgt

SEQ ID NO: 1331558 - DNA, 12 bp, Homo sapiens
tgtgtgtgggag

SEQ ID NO: 1331559 - DNA, 18 bp, Homo sapiens
tgtgtgttgtgtgtggga

SEQ ID NO: 1331560 - DNA, 14 bp, Homo sapiens
tgtgttgtgtgtgg

SEQ ID NO: 1331561 - DNA, 15 bp, Homo sapiens
tgttgtgtgtgggag

SEQ ID NO: 1331562 - DNA, 16 bp, Homo sapiens
tgtttatgtgtgtgtg

SEQ ID NO: 1331563 - DNA, 16 bp, Homo sapiens
ttagcctttgtcccag

SEQ ID NO: 1331564 - DNA, 14 bp, Homo sapiens
ttatcaacatttgt

SEQ ID NO: 1331565 - DNA, 13 bp, Homo sapiens
ttatgccacctga

SEQ ID NO: 1331566 - DNA, 16 bp, Homo sapiens
ttatgccacctgaata

SEQ ID NO: 1331567 - DNA, 16 bp, Homo sapiens
ttcagatttgccttat

SEQ ID NO: 1331568 - DNA, 14 bp, Homo sapiens
ttctaatgacccag

SEQ ID NO: 1331569 - DNA, 15 bp, Homo sapiens
ttctagttctgccag

SEQ ID NO: 1331570 - DNA, 17 bp, Homo sapiens
ttctagttctgccagga

SEQ ID NO: 1331571 - DNA, 20 bp, Homo sapiens
ttgctatgagctggggatgt

SEQ ID NO: 1331572 - DNA, 19 bp, Homo sapiens
ttgtaaatttatgtgatgg

SEQ ID NO: 1331573 - DNA, 13 bp, Homo sapiens
ttgtcacgccaga

SEQ ID NO: 1331574 - DNA, 15 bp, Homo sapiens
ttgtttagaagaagt

SEQ ID NO: 1331575 - DNA, 16 bp, Homo sapiens
tttaaaattgtgatgt

SEQ ID NO: 1331576 - DNA, 19 bp, Homo sapiens
tttgctatgagctggggat

SEQ ID NO: 1331577 - DNA, 21 bp, Homo sapiens
ttttatttttctcatgatgag

SEQ ID NO: 1331578 - DNA, 16 bp, Homo sapiens
ttttgtttaccagaga

SEQ ID NO: 1331579 - DNA, 18 bp, Homo sapiens
aaaattgtaagccagagt

SEQ ID NO: 1331580 - DNA, 20 bp, Homo sapiens
aaaattgtaagccagagtca

SEQ ID NO: 1331581 - DNA, 22 bp, Homo sapiens
aaattaccccctcctccagatc

SEQ ID NO: 1331582 - DNA, 16 bp, Homo sapiens
aaattgtaagccagag

SEQ ID NO: 1331583 - DNA, 17 bp, Homo sapiens
aaattgtaagccagagt

SEQ ID NO: 1331584 - DNA, 21 bp, Homo sapiens
aaattgtaagccagagtcaac

SEQ ID NO: 1331585 - DNA, 12 bp, Homo sapiens
aaattgtgatgt

SEQ ID NO: 1331586 - DNA, 15 bp, Homo sapiens
aaattgtgatgtgtc

SEQ ID NO: 1331587 - DNA, 15 bp, Homo sapiens
aacaaattaaataaa

SEQ ID NO: 1331588 - DNA, 19 bp, Homo sapiens
aactcgtgtctggcacagc

SEQ ID NO: 1331589 - DNA, 23 bp, Homo sapiens
aaggctatggggatagatgtgtg

SEQ ID NO: 1331590 - DNA, 11 bp, Homo sapiens
aagggaaaagg

SEQ ID NO: 1331591 - DNA, 20 bp, Homo sapiens
aagtgtgggtctgtgtgtgt

SEQ ID NO: 1331592 - DNA, 19 bp, Homo sapiens
aatgacccagatatggaaa

SEQ ID NO: 1331593 - DNA, 20 bp, Homo sapiens
aatgacccagatatggaaac

SEQ ID NO: 1331594 - DNA, 16 bp, Homo sapiens
aattccacaccctcac

SEQ ID NO: 1331595 - DNA, 14 bp, Homo sapiens
aattgtaagccaga

SEQ ID NO: 1331596 - DNA, 16 bp, Homo sapiens
aattgtaagccagagt

SEQ ID NO: 1331597 - DNA, 14 bp, Homo sapiens
aatttatgtgatgg

SEQ ID NO: 1331598 - DNA, 23 bp, Homo sapiens
acacctaggctagggtggggaga

SEQ ID NO: 1331599 - DNA, 23 bp, Homo sapiens
acagaggacagtatttgtgggga

SEQ ID NO: 1331600 - DNA, 15 bp, Homo sapiens
acaggttagctgctc

SEQ ID NO: 1331601 - DNA, 18 bp, Homo sapiens
accagagaaaaagggagg

SEQ ID NO: 1331602 - DNA, 17 bp, Homo sapiens
acccagatatggaaaca

SEQ ID NO: 1331603 - DNA, 19 bp, Homo sapiens
acccagatatggaaacaga

SEQ ID NO: 1331604 - DNA, 22 bp, Homo sapiens
acccagatatggaaacagaaga

SEQ ID NO: 1331605 - DNA, 15 bp, Homo sapiens
accccgacttttgtt

SEQ ID NO: 1331606 - DNA, 19 bp, Homo sapiens
accctcatctttcttccaa

SEQ ID NO: 1331607 - DNA, 13 bp, Homo sapiens
accgaggcaggga

SEQ ID NO: 1331608 - DNA, 12 bp, Homo sapiens
acctaggctagg

SEQ ID NO: 1331609 - DNA, 16 bp, Homo sapiens
acctgccgagagtcca

SEQ ID NO: 1331610 - DNA, 23 bp, Homo sapiens
acctgccgagagtccatcagcct

SEQ ID NO: 1331611 - DNA, 22 bp, Homo sapiens
acgccagacttcccacggctcc

SEQ ID NO: 1331612 - DNA, 15 bp, Homo sapiens
actcatgtgactctt

SEQ ID NO: 1331613 - DNA, 23 bp, Homo sapiens
actcgtgtctggcacagcctggc

SEQ ID NO: 1331614 - DNA, 23 bp, Homo sapiens
agaagacaaaattgtaagccaga

SEQ ID NO: 1331615 - DNA, 19 bp, Homo sapiens
agaatgtcagtatgtggaa

SEQ ID NO: 1331616 - DNA, 21 bp, Homo sapiens
agacaaaattgtaagccagag

SEQ ID NO: 1331617 - DNA, 23 bp, Homo sapiens
agacaaaattgtaagccagagtc

SEQ ID NO: 1331618 - DNA, 20 bp, Homo sapiens
agaggacagtatttgtgggg

SEQ ID NO: 1331619 - DNA, 17 bp, Homo sapiens
agagtccctgcctggac

SEQ ID NO: 1331620 - DNA, 18 bp, Homo sapiens
agatatggaaacagaaga

SEQ ID NO: 1331621 - DNA, 18 bp, Homo sapiens
agatcccaacactgccag

SEQ ID NO: 1331622 - DNA, 17 bp, Homo sapiens
agcatttcccttccttc

SEQ ID NO: 1331623 - DNA, 12 bp, Homo sapiens
agccagagtcaa

SEQ ID NO: 1331624 - DNA, 23 bp, Homo sapiens
agccccgcgtggaactcgtgtct

SEQ ID NO: 1331625 - DNA, 19 bp, Homo sapiens
agcctgaccctcatctttc

SEQ ID NO: 1331626 - DNA, 22 bp, Homo sapiens
agctcaggaaccgaggcaggga

SEQ ID NO: 1331627 - DNA, 18 bp, Homo sapiens
agctccttaaggctcttt

SEQ ID NO: 1331628 - DNA, 14 bp, Homo sapiens
agctgagcaggtgt

SEQ ID NO: 1331629 - DNA, 14 bp, Homo sapiens
agctgctccccacg

SEQ ID NO: 1331630 - DNA, 16 bp, Homo sapiens
aggaaccgaggcaggg

SEQ ID NO: 1331631 - DNA, 16 bp, Homo sapiens
aggaactgctgggctt

SEQ ID NO: 1331632 - DNA, 19 bp, Homo sapiens
aggacagtatttgtgggga

SEQ ID NO: 1331633 - DNA, 14 bp, Homo sapiens
aggccattctttcc

SEQ ID NO: 1331634 - DNA, 18 bp, Homo sapiens
aggccattctttcccaac

SEQ ID NO: 1331635 - DNA, 16 bp, Homo sapiens
aggctagggtggggag

SEQ ID NO: 1331636 - DNA, 19 bp, Homo sapiens
aggctatggggatagatgt

SEQ ID NO: 1331637 - DNA, 20 bp, Homo sapiens
aggctcagagggtgtcctgc

SEQ ID NO: 1331638 - DNA, 15 bp, Homo sapiens
agggaaggatcccat

SEQ ID NO: 1331639 - DNA, 20 bp, Homo sapiens
aggggcttctaatgacccag

SEQ ID NO: 1331640 - DNA, 15 bp, Homo sapiens
agggggagagggctg

SEQ ID NO: 1331641 - DNA, 22 bp, Homo sapiens
aggtgcttctagttctgccagg

SEQ ID NO: 1331642 - DNA, 23 bp, Homo sapiens
aggtgcttctagttctgccagga

SEQ ID NO: 1331643 - DNA, 19 bp, Homo sapiens
aggtttttgtagtgatttt

SEQ ID NO: 1331644 - DNA, 17 bp, Homo sapiens
agtatgtggaagtgtgg

SEQ ID NO: 1331645 - DNA, 13 bp, Homo sapiens
agtccatcagcct

SEQ ID NO: 1331646 - DNA, 14 bp, Homo sapiens
agtccatcagcctc

SEQ ID NO: 1331647 - DNA, 16 bp, Homo sapiens
agtccatcagcctcca

SEQ ID NO: 1331648 - DNA, 22 bp, Homo sapiens
agtccctgcctggaccagcctc

SEQ ID NO: 1331649 - DNA, 23 bp, Homo sapiens
agtccctgcctggaccagcctct

SEQ ID NO: 1331650 - DNA, 14 bp, Homo sapiens
agttctgccaggag

SEQ ID NO: 1331651 - DNA, 18 bp, Homo sapiens
ataatcacaacccttcag

SEQ ID NO: 1331652 - DNA, 11 bp, Homo sapiens
atagatgtgtg

SEQ ID NO: 1331653 - DNA, 13 bp, Homo sapiens
atagatgtgtgga

SEQ ID NO: 1331654 - DNA, 13 bp, Homo sapiens
atatggaaacaga

SEQ ID NO: 1331655 - DNA, 18 bp, Homo sapiens
atatggaaacagaagaca

SEQ ID NO: 1331656 - DNA, 20 bp, Homo sapiens
atatttgtaaatttatgtga

SEQ ID NO: 1331657 - DNA, 13 bp, Homo sapiens
atcaggccattgt

SEQ ID NO: 1331658 - DNA, 23 bp, Homo sapiens
atcatgtttacagaggacagtat

SEQ ID NO: 1331659 - DNA, 20 bp, Homo sapiens
atccagagtccctgcctgga

SEQ ID NO: 1331660 - DNA, 16 bp, Homo sapiens
atcctaccccctgtgc

SEQ ID NO: 1331661 - DNA, 16 bp, Homo sapiens
atctgtacctctgcct

SEQ ID NO: 1331662 - DNA, 21 bp, Homo sapiens
atctgtgaggggctctctcat

SEQ ID NO: 1331663 - DNA, 19 bp, Homo sapiens
atgagctccttaaggctct

SEQ ID NO: 1331664 - DNA, 18 bp, Homo sapiens
atgagttggctgggaata

SEQ ID NO: 1331665 - DNA, 11 bp, Homo sapiens
atgatgggatt

SEQ ID NO: 1331666 - DNA, 16 bp, Homo sapiens
atggcctgggggatgt

SEQ ID NO: 1331667 - DNA, 16 bp, Homo sapiens
atggttctcaggcctg

SEQ ID NO: 1331668 - DNA, 17 bp, Homo sapiens
atgtatataaacatgct

SEQ ID NO: 1331669 - DNA, 14 bp, Homo sapiens
atgtcagtatgtgg

SEQ ID NO: 1331670 - DNA, 16 bp, Homo sapiens
atgtcagtatgtggaa

SEQ ID NO: 1331671 - DNA, 16 bp, Homo sapiens
atgtgggggtctgtgt

SEQ ID NO: 1331672 - DNA, 17 bp, Homo sapiens
atgtgggggtctgtgtg

SEQ ID NO: 1331673 - DNA, 23 bp, Homo sapiens
atgtgtgtgtgttgtgtgtggga

SEQ ID NO: 1331674 - DNA, 15 bp, Homo sapiens
attaaataaattacc

SEQ ID NO: 1331675 - DNA, 16 bp, Homo sapiens
attaccccctcctcca

SEQ ID NO: 1331676 - DNA, 13 bp, Homo sapiens
attctttcccaac

SEQ ID NO: 1331677 - DNA, 15 bp, Homo sapiens
attgaaggggcttct

SEQ ID NO: 1331678 - DNA, 18 bp, Homo sapiens
attgaaggggcttctaat

SEQ ID NO: 1331679 - DNA, 20 bp, Homo sapiens
attgaaggggcttctaatga

SEQ ID NO: 1331680 - DNA, 22 bp, Homo sapiens
attgaaggggcttctaatgacc

SEQ ID NO: 1331681 - DNA, 23 bp, Homo sapiens
attgaaggggcttctaatgaccc

SEQ ID NO: 1331682 - DNA, 13 bp, Homo sapiens
attgtgatgtgtc

SEQ ID NO: 1331683 - DNA, 14 bp, Homo sapiens
attgtgatgtgtcc

SEQ ID NO: 1331684 - DNA, 15 bp, Homo sapiens
attgtgatgtgtcct

SEQ ID NO: 1331685 - DNA, 19 bp, Homo sapiens
atttaaaattgtgatgtgt

SEQ ID NO: 1331686 - DNA, 17 bp, Homo sapiens
atttttatgccacctga

SEQ ID NO: 1331687 - DNA, 21 bp, Homo sapiens
caaaattgtaagccagagtca

SEQ ID NO: 1331688 - DNA, 22 bp, Homo sapiens
caacaaattaaataaattaccc

SEQ ID NO: 1331689 - DNA, 17 bp, Homo sapiens
caagccttggctctacc

SEQ ID NO: 1331690 - DNA, 22 bp, Homo sapiens
caccggggcctgggcaggaggg

SEQ ID NO: 1331691 - DNA, 17 bp, Homo sapiens
cacctaggctagggtgg

SEQ ID NO: 1331692 - DNA, 22 bp, Homo sapiens
cacggctcctcgagatcccaac

SEQ ID NO: 1331693 - DNA, 19 bp, Homo sapiens
cacgtgtggcctgttcttc

SEQ ID NO: 1331694 - DNA, 13 bp, Homo sapiens
cactggggcaggg

SEQ ID NO: 1331695 - DNA, 15 bp, Homo sapiens
cactggggcaggggc

SEQ ID NO: 1331696 - DNA, 14 bp, Homo sapiens
cagagtcaacaaat

SEQ ID NO: 1331697 - DNA, 23 bp, Homo sapiens
cagagtcaacaaattaaataaat
